United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 11

SEQ ID NO: 409907 - RNA, 20 nt, Bordetella pertussis
cgcguccagcgcgcggccuc

SEQ ID NO: 409908 - RNA, 17 nt, Bordetella pertussis
cgcguccaggcccagcg

SEQ ID NO: 409909 - RNA, 19 nt, Bordetella pertussis
cgcguccaggugcggcggc

SEQ ID NO: 409910 - RNA, 18 nt, Bordetella pertussis
cgcguccaucuggaccgc

SEQ ID NO: 409911 - RNA, 20 nt, Bordetella pertussis
cgcguccaucuggaccgcgc

SEQ ID NO: 409912 - RNA, 15 nt, Bordetella pertussis
cgcgucgagcaggcc

SEQ ID NO: 409913 - RNA, 20 nt, Bordetella pertussis
cgcgucgaucagcgcgggcc

SEQ ID NO: 409914 - RNA, 14 nt, Bordetella pertussis
cgcgucgccgcgcc

SEQ ID NO: 409915 - RNA, 22 nt, Bordetella pertussis
cgcgucgccgcuggccagccgc

SEQ ID NO: 409916 - RNA, 16 nt, Bordetella pertussis
cgcgucgcgcgccagg

SEQ ID NO: 409917 - RNA, 18 nt, Bordetella pertussis
cgcgucgcgcgccaggcg

SEQ ID NO: 409918 - RNA, 16 nt, Bordetella pertussis
cgcgucggacgcgcgc

SEQ ID NO: 409919 - RNA, 21 nt, Bordetella pertussis
cgcgucggccaaggccggcgc

SEQ ID NO: 409920 - RNA, 17 nt, Bordetella pertussis
cgcgucggccagcgccg

SEQ ID NO: 409921 - RNA, 14 nt, Bordetella pertussis
cgcgucggccaggc

SEQ ID NO: 409922 - RNA, 17 nt, Bordetella pertussis
cgcgucggccugccagc

SEQ ID NO: 409923 - RNA, 14 nt, Bordetella pertussis
cgcgugcagccagc

SEQ ID NO: 409924 - RNA, 21 nt, Bordetella pertussis
cgcgugcagccagcggccgau

SEQ ID NO: 409925 - RNA, 16 nt, Bordetella pertussis
cgcgugcagcgccgcg

SEQ ID NO: 409926 - RNA, 18 nt, Bordetella pertussis
cgcgugcagcgccgcgcg

SEQ ID NO: 409927 - RNA, 13 nt, Bordetella pertussis
cgcgugcagguag

SEQ ID NO: 409928 - RNA, 15 nt, Bordetella pertussis
cgcgugcccgcgucc

SEQ ID NO: 409929 - RNA, 15 nt, Bordetella pertussis
cgcgugcgugccgac

SEQ ID NO: 409930 - RNA, 15 nt, Bordetella pertussis
cgcgugcguuucgga

SEQ ID NO: 409931 - RNA, 20 nt, Bordetella pertussis
cgcgugcuggcgcagcagcg

SEQ ID NO: 409932 - RNA, 17 nt, Bordetella pertussis
cgcguggccgcgcugcu

SEQ ID NO: 409933 - RNA, 20 nt, Bordetella pertussis
cgcguggccagcacggcgca

SEQ ID NO: 409934 - RNA, 13 nt, Bordetella pertussis
cgcguggccgcca

SEQ ID NO: 409935 - RNA, 21 nt, Bordetella pertussis
cgcguuucccucggugcugcu

SEQ ID NO: 409936 - RNA, 17 nt, Bordetella pertussis
cgcuaccgcuucccugg

SEQ ID NO: 409937 - RNA, 22 nt, Bordetella pertussis
cgcuacgacgagaucgcgccua

SEQ ID NO: 409938 - RNA, 13 nt, Bordetella pertussis
cgcucacggggcu

SEQ ID NO: 409939 - RNA, 14 nt, Bordetella pertussis
cgcucagagcccca

SEQ ID NO: 409940 - RNA, 12 nt, Bordetella pertussis
cgcucagcacca

SEQ ID NO: 409941 - RNA, 16 nt, Bordetella pertussis
cgcucagcaccaggcc

SEQ ID NO: 409942 - RNA, 22 nt, Bordetella pertussis
cgcucagcaccaggccgccggc

SEQ ID NO: 409943 - RNA, 22 nt, Bordetella pertussis
cgcucagcgacgcgcgccggcg

SEQ ID NO: 409944 - RNA, 15 nt, Bordetella pertussis
cgcucagcgccauca

SEQ ID NO: 409945 - RNA, 19 nt, Bordetella pertussis
cgcucagcgccaucaucgc

SEQ ID NO: 409946 - RNA, 13 nt, Bordetella pertussis
cgcucagcgcggc

SEQ ID NO: 409947 - RNA, 22 nt, Bordetella pertussis
cgcucagcgcggcgcggccagc

SEQ ID NO: 409948 - RNA, 19 nt, Bordetella pertussis
cgcucagcuuguagcccuc

SEQ ID NO: 409949 - RNA, 22 nt, Bordetella pertussis
cgcucaggaaccagcggcuggc

SEQ ID NO: 409950 - RNA, 14 nt, Bordetella pertussis
cgcucaggccgccg

SEQ ID NO: 409951 - RNA, 16 nt, Bordetella pertussis
cgcucaggccgccggc

SEQ ID NO: 409952 - RNA, 18 nt, Bordetella pertussis
cgcucaggccgccggcgc

SEQ ID NO: 409953 - RNA, 22 nt, Bordetella pertussis
cgcucaggcggugacgcccugc

SEQ ID NO: 409954 - RNA, 20 nt, Bordetella pertussis
cgcucagggggcgccccaac

SEQ ID NO: 409955 - RNA, 18 nt, Bordetella pertussis
cgcucauccaggcgcguu

SEQ ID NO: 409956 - RNA, 20 nt, Bordetella pertussis
cgcucauggaggggcgcagg

SEQ ID NO: 409957 - RNA, 18 nt, Bordetella pertussis
cgcucauguucgggcgcg

SEQ ID NO: 409958 - RNA, 13 nt, Bordetella pertussis
cgcuccaccagca

SEQ ID NO: 409959 - RNA, 22 nt, Bordetella pertussis
cgcuccaccagcaccggcagcg

SEQ ID NO: 409960 - RNA, 15 nt, Bordetella pertussis
cgcuccagagcgcgc

SEQ ID NO: 409961 - RNA, 17 nt, Bordetella pertussis
cgcuccagagcgcgcac

SEQ ID NO: 409962 - RNA, 22 nt, Bordetella pertussis
cgcuccagcgucauggccuggc

SEQ ID NO: 409963 - RNA, 14 nt, Bordetella pertussis
cgcuccaggcggcc

SEQ ID NO: 409964 - RNA, 12 nt, Bordetella pertussis
cgcuccagggcg

SEQ ID NO: 409965 - RNA, 17 nt, Bordetella pertussis
cgcuccauggcgccggc

SEQ ID NO: 409966 - RNA, 19 nt, Bordetella pertussis
cgcuccauggcgccggcgg

SEQ ID NO: 409967 - RNA, 22 nt, Bordetella pertussis
cgcuccauggcgccggcggccu

SEQ ID NO: 409968 - RNA, 23 nt, Bordetella pertussis
cgcuccauguaaaaacccggccu

SEQ ID NO: 409969 - RNA, 22 nt, Bordetella pertussis
cgcucccccaugcggggacagg

SEQ ID NO: 409970 - RNA, 13 nt, Bordetella pertussis
cgcucccgccaac

SEQ ID NO: 409971 - RNA, 19 nt, Bordetella pertussis
cgcuccgccauggaggcgc

SEQ ID NO: 409972 - RNA, 22 nt, Bordetella pertussis
cgcucgaauggcugcgcgccgu

SEQ ID NO: 409973 - RNA, 17 nt, Bordetella pertussis
cgcucgaccgaaaugaa

SEQ ID NO: 409974 - RNA, 20 nt, Bordetella pertussis
cgcucgaccuugucgcccga

SEQ ID NO: 409975 - RNA, 16 nt, Bordetella pertussis
cgcucgaggccaggcu

SEQ ID NO: 409976 - RNA, 18 nt, Bordetella pertussis
cgcucgaggcgcuggcgu

SEQ ID NO: 409977 - RNA, 19 nt, Bordetella pertussis
cgcucgcccagcaccucga

SEQ ID NO: 409978 - RNA, 17 nt, Bordetella pertussis
cgcucgcccagccgccu

SEQ ID NO: 409979 - RNA, 15 nt, Bordetella pertussis
cgcucgccggcgcgc

SEQ ID NO: 409980 - RNA, 13 nt, Bordetella pertussis
cgcucgcgccagg

SEQ ID NO: 409981 - RNA, 18 nt, Bordetella pertussis
cgcucgcugccggcgucc

SEQ ID NO: 409982 - RNA, 19 nt, Bordetella pertussis
cgcucggccacgcgcugcu

SEQ ID NO: 409983 - RNA, 13 nt, Bordetella pertussis
cgcucggccagcg

SEQ ID NO: 409984 - RNA, 21 nt, Bordetella pertussis
cgcucggccagcgaggccgcu

SEQ ID NO: 409985 - RNA, 21 nt, Bordetella pertussis
cgcucggccagcgcgcggccg

SEQ ID NO: 409986 - RNA, 16 nt, Bordetella pertussis
cgcucgggcgcggcau

SEQ ID NO: 409987 - RNA, 21 nt, Bordetella pertussis
cgcucggucauguccagcgcc

SEQ ID NO: 409988 - RNA, 15 nt, Bordetella pertussis
cgcucuugagcgcgg

SEQ ID NO: 409989 - RNA, 18 nt, Bordetella pertussis
cgcucuugagcgcggccu

SEQ ID NO: 409990 - RNA, 15 nt, Bordetella pertussis
cgcucuuggcgugcu

SEQ ID NO: 409991 - RNA, 14 nt, Bordetella pertussis
cgcugaagcgccgc

SEQ ID NO: 409992 - RNA, 22 nt, Bordetella pertussis
cgcugaauccggggugccuguc

SEQ ID NO: 409993 - RNA, 13 nt, Bordetella pertussis
cgcugacagcgcu

SEQ ID NO: 409994 - RNA, 15 nt, Bordetella pertussis
cgcugacccuggccg

SEQ ID NO: 409995 - RNA, 23 nt, Bordetella pertussis
cgcugacccuggccgaacgccgc

SEQ ID NO: 409996 - RNA, 14 nt, Bordetella pertussis
cgcugaccggccug

SEQ ID NO: 409997 - RNA, 13 nt, Bordetella pertussis
cgcugaccggcgu

SEQ ID NO: 409998 - RNA, 20 nt, Bordetella pertussis
cgcugaccugcacgauggcg

SEQ ID NO: 409999 - RNA, 20 nt, Bordetella pertussis
cgcugaccuggugugccugu

SEQ ID NO: 410000 - RNA, 21 nt, Bordetella pertussis
cgcugaccuggugugccuguc

SEQ ID NO: 410001 - RNA, 14 nt, Bordetella pertussis
cgcugauccuggcu

SEQ ID NO: 410002 - RNA, 16 nt, Bordetella pertussis
cgcugaucuuccuggg

SEQ ID NO: 410003 - RNA, 20 nt, Bordetella pertussis
cgcugaugagaucgcccgcg

SEQ ID NO: 410004 - RNA, 18 nt, Bordetella pertussis
cgcugaugcccagcccgg

SEQ ID NO: 410005 - RNA, 16 nt, Bordetella pertussis
cgcugaugcgcggcgg

SEQ ID NO: 410006 - RNA, 15 nt, Bordetella pertussis
cgcugauggccgcca

SEQ ID NO: 410007 - RNA, 16 nt, Bordetella pertussis
cgcugauucgcgucgu

SEQ ID NO: 410008 - RNA, 13 nt, Bordetella pertussis
cgcugcacaggga

SEQ ID NO: 410009 - RNA, 21 nt, Bordetella pertussis
cgcugcagcacgcaccaggcg

SEQ ID NO: 410010 - RNA, 12 nt, Bordetella pertussis
cgcugcagcgcu

SEQ ID NO: 410011 - RNA, 14 nt, Bordetella pertussis
cgcugcagcgcugg

SEQ ID NO: 410012 - RNA, 15 nt, Bordetella pertussis
cgcugcagcgcagga

SEQ ID NO: 410013 - RNA, 15 nt, Bordetella pertussis
cgcugcccaccuucc

SEQ ID NO: 410014 - RNA, 16 nt, Bordetella pertussis
cgcugccgcgcgccgg

SEQ ID NO: 410015 - RNA, 18 nt, Bordetella pertussis
cgcugccgcugcaggccc

SEQ ID NO: 410016 - RNA, 13 nt, Bordetella pertussis
cgcugccggcgcc

SEQ ID NO: 410017 - RNA, 14 nt, Bordetella pertussis
cgcugccggcgccc

SEQ ID NO: 410018 - RNA, 18 nt, Bordetella pertussis
cgcugcgaaacagcagcg

SEQ ID NO: 410019 - RNA, 16 nt, Bordetella pertussis
cgcugcgacagcagca

SEQ ID NO: 410020 - RNA, 16 nt, Bordetella pertussis
cgcugcgagccgccgc

SEQ ID NO: 410021 - RNA, 15 nt, Bordetella pertussis
cgcugcgcagcagcg

SEQ ID NO: 410022 - RNA, 16 nt, Bordetella pertussis
cgcugcgcagcagcgc

SEQ ID NO: 410023 - RNA, 12 nt, Bordetella pertussis
cgcugcgcaggc

SEQ ID NO: 410024 - RNA, 14 nt, Bordetella pertussis
cgcugcgcccgcua

SEQ ID NO: 410025 - RNA, 12 nt, Bordetella pertussis
cgcugcgccgcg

SEQ ID NO: 410026 - RNA, 19 nt, Bordetella pertussis
cgcugcgccuuggcgcgca

SEQ ID NO: 410027 - RNA, 14 nt, Bordetella pertussis
cgcugcgccggcgg

SEQ ID NO: 410028 - RNA, 13 nt, Bordetella pertussis
cgcugcgcgccgc

SEQ ID NO: 410029 - RNA, 15 nt, Bordetella pertussis
cgcugcgcgcggccu

SEQ ID NO: 410030 - RNA, 20 nt, Bordetella pertussis
cgcugcgcgcggccuggcgg

SEQ ID NO: 410031 - RNA, 15 nt, Bordetella pertussis
cgcugcgcggcggcu

SEQ ID NO: 410032 - RNA, 17 nt, Bordetella pertussis
cgcugcgcuugaccgcc

SEQ ID NO: 410033 - RNA, 14 nt, Bordetella pertussis
cgcugcguccacca

SEQ ID NO: 410034 - RNA, 16 nt, Bordetella pertussis
cgcugcguccggucga

SEQ ID NO: 410035 - RNA, 21 nt, Bordetella pertussis
cgcugcucguccacggccuuc

SEQ ID NO: 410036 - RNA, 14 nt, Bordetella pertussis
cgcugcucuuggcg

SEQ ID NO: 410037 - RNA, 15 nt, Bordetella pertussis
cgcugcugaccgacg

SEQ ID NO: 410038 - RNA, 22 nt, Bordetella pertussis
cgcugcugauccucgccagcgg

SEQ ID NO: 410039 - RNA, 23 nt, Bordetella pertussis
cgcugcugcaggccggcgcgcau

SEQ ID NO: 410040 - RNA, 11 nt, Bordetella pertussis
cgcugcugcug

SEQ ID NO: 410041 - RNA, 21 nt, Bordetella pertussis
cgcugcuggccaagcgcgccg

SEQ ID NO: 410042 - RNA, 17 nt, Bordetella pertussis
cgcugcuggccggccag

SEQ ID NO: 410043 - RNA, 13 nt, Bordetella pertussis
cgcugcuggcggc

SEQ ID NO: 410044 - RNA, 16 nt, Bordetella pertussis
cgcugcuggcggcgcu

SEQ ID NO: 410045 - RNA, 19 nt, Bordetella pertussis
cgcugcugucgcgcugccc

SEQ ID NO: 410046 - RNA, 16 nt, Bordetella pertussis
cgcuggaagacguggc

SEQ ID NO: 410047 - RNA, 21 nt, Bordetella pertussis
cgcuggacagauccagcgcgg

SEQ ID NO: 410048 - RNA, 17 nt, Bordetella pertussis
cgcuggagaacaggcgg

SEQ ID NO: 410049 - RNA, 18 nt, Bordetella pertussis
cgcuggagcgcggcggcg

SEQ ID NO: 410050 - RNA, 21 nt, Bordetella pertussis
cgcuggaggccuuccaccagc

SEQ ID NO: 410051 - RNA, 14 nt, Bordetella pertussis
cgcuggccagccgc

SEQ ID NO: 410052 - RNA, 22 nt, Bordetella pertussis
cgcuggccaugccgucgcgcac

SEQ ID NO: 410053 - RNA, 19 nt, Bordetella pertussis
cgcuggccgccauggcgcu

SEQ ID NO: 410054 - RNA, 19 nt, Bordetella pertussis
cgcuggccgcgcuggcggc

SEQ ID NO: 410055 - RNA, 19 nt, Bordetella pertussis
cgcuggccggacgcaaccg

SEQ ID NO: 410056 - RNA, 12 nt, Bordetella pertussis
cgcuggccggcc

SEQ ID NO: 410057 - RNA, 13 nt, Bordetella pertussis
cgcuggccggccg

SEQ ID NO: 410058 - RNA, 14 nt, Bordetella pertussis
cgcuggccggccgc

SEQ ID NO: 410059 - RNA, 21 nt, Bordetella pertussis
cgcuggccgucgccgcccugc

SEQ ID NO: 410060 - RNA, 19 nt, Bordetella pertussis
cgcuggccugccgcgccga

SEQ ID NO: 410061 - RNA, 20 nt, Bordetella pertussis
cgcuggccugccgcgccgac

SEQ ID NO: 410062 - RNA, 15 nt, Bordetella pertussis
cgcuggccuggccgc

SEQ ID NO: 410063 - RNA, 14 nt, Bordetella pertussis
cgcuggcgcagcag

SEQ ID NO: 410064 - RNA, 20 nt, Bordetella pertussis
cgcuggcgaugcccaccagc

SEQ ID NO: 410065 - RNA, 19 nt, Bordetella pertussis
cgcuggcgaugcgggccac

SEQ ID NO: 410066 - RNA, 22 nt, Bordetella pertussis
cgcuggcgcccggccugcgggc

SEQ ID NO: 410067 - RNA, 13 nt, Bordetella pertussis
cgcuggcgccgcg

SEQ ID NO: 410068 - RNA, 15 nt, Bordetella pertussis
cgcuggcgcgucugg

SEQ ID NO: 410069 - RNA, 15 nt, Bordetella pertussis
cgcuggcggcccugc

SEQ ID NO: 410070 - RNA, 19 nt, Bordetella pertussis
cgcuggcggcgcaggccgc

SEQ ID NO: 410071 - RNA, 20 nt, Bordetella pertussis
cgcuggcgguggccgcgcau

SEQ ID NO: 410072 - RNA, 20 nt, Bordetella pertussis
cgcuggcguccagccugccc

SEQ ID NO: 410073 - RNA, 23 nt, Bordetella pertussis
cgcuggcuggacgcgcgcggcga

SEQ ID NO: 410074 - RNA, 13 nt, Bordetella pertussis
cgcugggacaggc

SEQ ID NO: 410075 - RNA, 17 nt, Bordetella pertussis
cgcugggacaggcacac

SEQ ID NO: 410076 - RNA, 21 nt, Bordetella pertussis
cgcugggauggguacgccggc

SEQ ID NO: 410077 - RNA, 23 nt, Bordetella pertussis
cgcugggauggguacgccggccu

SEQ ID NO: 410078 - RNA, 18 nt, Bordetella pertussis
cgcugggcacauccagcg

SEQ ID NO: 410079 - RNA, 15 nt, Bordetella pertussis
cgcugggcaggcugg

SEQ ID NO: 410080 - RNA, 17 nt, Bordetella pertussis
cgcugggccagaccgcg

SEQ ID NO: 410081 - RNA, 22 nt, Bordetella pertussis
cgcugggcgcauuggcccugcu

SEQ ID NO: 410082 - RNA, 20 nt, Bordetella pertussis
cgcugggcgguugcgcugcu

SEQ ID NO: 410083 - RNA, 17 nt, Bordetella pertussis
cgcugggcguggcgcgc

SEQ ID NO: 410084 - RNA, 23 nt, Bordetella pertussis
cgcuggggcaggacgccggcgcc

SEQ ID NO: 410085 - RNA, 14 nt, Bordetella pertussis
cgcugggcuacgac

SEQ ID NO: 410086 - RNA, 21 nt, Bordetella pertussis
cgcuggguguagucgcggccg

SEQ ID NO: 410087 - RNA, 15 nt, Bordetella pertussis
cgcuggucaaccugg

SEQ ID NO: 410088 - RNA, 14 nt, Bordetella pertussis
cgcuggucgcgcag

SEQ ID NO: 410089 - RNA, 16 nt, Bordetella pertussis
cgcuggucgcgcagca

SEQ ID NO: 410090 - RNA, 12 nt, Bordetella pertussis
cgcuggugcuga

SEQ ID NO: 410091 - RNA, 17 nt, Bordetella pertussis
cgcuguauauauagggg

SEQ ID NO: 410092 - RNA, 15 nt, Bordetella pertussis
cgcugucggucagca

SEQ ID NO: 410093 - RNA, 16 nt, Bordetella pertussis
cgcugucggucagcac

SEQ ID NO: 410094 - RNA, 14 nt, Bordetella pertussis
cgcugugcgcggcg

SEQ ID NO: 410095 - RNA, 15 nt, Bordetella pertussis
cgcugugcgcggcga

SEQ ID NO: 410096 - RNA, 18 nt, Bordetella pertussis
cgcuguggacgccgccgg

SEQ ID NO: 410097 - RNA, 14 nt, Bordetella pertussis
cgcuguucgggcgc

SEQ ID NO: 410098 - RNA, 16 nt, Bordetella pertussis
cgcuguugcccaccag

SEQ ID NO: 410099 - RNA, 20 nt, Bordetella pertussis
cgcuguuggccggcgcgccc

SEQ ID NO: 410100 - RNA, 21 nt, Bordetella pertussis
cgcuguuggccggcgcgcccu

SEQ ID NO: 410101 - RNA, 18 nt, Bordetella pertussis
cgcuguuggucaggucga

SEQ ID NO: 410102 - RNA, 17 nt, Bordetella pertussis
cgcuguugcuggccacc

SEQ ID NO: 410103 - RNA, 23 nt, Bordetella pertussis
cgcuguuucccuuccuggccaau

SEQ ID NO: 410104 - RNA, 20 nt, Bordetella pertussis
cgcuuacuggaucuuggccu

SEQ ID NO: 410105 - RNA, 15 nt, Bordetella pertussis
cgcuucccgcacggg

SEQ ID NO: 410106 - RNA, 13 nt, Bordetella pertussis
cgcuuccggcaug

SEQ ID NO: 410107 - RNA, 14 nt, Bordetella pertussis
cgcuuccugcugcg

SEQ ID NO: 410108 - RNA, 19 nt, Bordetella pertussis
cgcuuccugcugcgccugg

SEQ ID NO: 410109 - RNA, 23 nt, Bordetella pertussis
cgcuucugccagacggccagcgc

SEQ ID NO: 410110 - RNA, 21 nt, Bordetella pertussis
cgcuugaaguaaucgcccggc

SEQ ID NO: 410111 - RNA, 16 nt, Bordetella pertussis
cgcuugaccgccucga

SEQ ID NO: 410112 - RNA, 22 nt, Bordetella pertussis
cgcuugacccguuugcgcagcu

SEQ ID NO: 410113 - RNA, 15 nt, Bordetella pertussis
cgcuugacggccagg

SEQ ID NO: 410114 - RNA, 23 nt, Bordetella pertussis
cgcuugccgcccacugccaggcg

SEQ ID NO: 410115 - RNA, 22 nt, Bordetella pertussis
cgcuugcgcuuggcaggcgucu

SEQ ID NO: 410116 - RNA, 16 nt, Bordetella pertussis
cgcuugcggccgucga

SEQ ID NO: 410117 - RNA, 18 nt, Bordetella pertussis
cgcuugcucggugcgggc

SEQ ID NO: 410118 - RNA, 14 nt, Bordetella pertussis
cgcuuggcaggcgu

SEQ ID NO: 410119 - RNA, 16 nt, Bordetella pertussis
cgcuuggcaggcgucu

SEQ ID NO: 410120 - RNA, 15 nt, Bordetella pertussis
cgcuuggccagcugg

SEQ ID NO: 410121 - RNA, 20 nt, Bordetella pertussis
cgcuuggccugcgccaccgc

SEQ ID NO: 410122 - RNA, 16 nt, Bordetella pertussis
cgcuugggccgcgccu

SEQ ID NO: 410123 - RNA, 22 nt, Bordetella pertussis
cgcuuggucagcaucagcagac

SEQ ID NO: 410124 - RNA, 15 nt, Bordetella pertussis
cggcacgaucggcgc

SEQ ID NO: 410125 - RNA, 22 nt, Bordetella pertussis
cggcacgaucggcgccuggccg

SEQ ID NO: 410126 - RNA, 16 nt, Bordetella pertussis
cggcacgcacagcaug

SEQ ID NO: 410127 - RNA, 22 nt, Bordetella pertussis
cggcacgccgaugaacgacagg

SEQ ID NO: 410128 - RNA, 16 nt, Bordetella pertussis
cggcacgccggcggcc

SEQ ID NO: 410129 - RNA, 17 nt, Bordetella pertussis
cggcacgccggcggccc

SEQ ID NO: 410130 - RNA, 23 nt, Bordetella pertussis
cggcacgccucgccggcccugcc

SEQ ID NO: 410131 - RNA, 22 nt, Bordetella pertussis
cggcacgccugccgcgcccggc

SEQ ID NO: 410132 - RNA, 16 nt, Bordetella pertussis
cggcacgcgcgccggc

SEQ ID NO: 410133 - RNA, 15 nt, Bordetella pertussis
cggcacgcugaucgc

SEQ ID NO: 410134 - RNA, 17 nt, Bordetella pertussis
cggcacgcugcugaucc

SEQ ID NO: 410135 - RNA, 17 nt, Bordetella pertussis
cggcacgggucaggcug

SEQ ID NO: 410136 - RNA, 19 nt, Bordetella pertussis
cggcacgggucaggcugcg

SEQ ID NO: 410137 - RNA, 18 nt, Bordetella pertussis
cggcagccccagcgccca

SEQ ID NO: 410138 - RNA, 19 nt, Bordetella pertussis
cggcagcccggcacgucgg

SEQ ID NO: 410139 - RNA, 12 nt, Bordetella pertussis
cggcagccgaaa

SEQ ID NO: 410140 - RNA, 13 nt, Bordetella pertussis
cggcagccugggg

SEQ ID NO: 410141 - RNA, 17 nt, Bordetella pertussis
cggcagcgaggcgcagc

SEQ ID NO: 410142 - RNA, 20 nt, Bordetella pertussis
cggcagcgcaccgucgccag

SEQ ID NO: 410143 - RNA, 13 nt, Bordetella pertussis
cggcagcgccggg

SEQ ID NO: 410144 - RNA, 18 nt, Bordetella pertussis
cggcagcgcgcaggacaa

SEQ ID NO: 410145 - RNA, 13 nt, Bordetella pertussis
cggcagcgcgacc

SEQ ID NO: 410146 - RNA, 23 nt, Bordetella pertussis
cggcagcguaucgcccgcgcggu

SEQ ID NO: 410147 - RNA, 23 nt, Bordetella pertussis
cggcagcgucaauccgccgccag

SEQ ID NO: 410148 - RNA, 16 nt, Bordetella pertussis
cggcagcucgcgcugc

SEQ ID NO: 410149 - RNA, 12 nt, Bordetella pertussis
cggcagcuugac

SEQ ID NO: 410150 - RNA, 17 nt, Bordetella pertussis
cggcagcuugaccgccu

SEQ ID NO: 410151 - RNA, 23 nt, Bordetella pertussis
cggcagcuuguagcgcucuucgc

SEQ ID NO: 410152 - RNA, 19 nt, Bordetella pertussis
cggcaggagccuguccccg

SEQ ID NO: 410153 - RNA, 17 nt, Bordetella pertussis
cggcaggcacacgaccg

SEQ ID NO: 410154 - RNA, 22 nt, Bordetella pertussis
cggcaggccccggcccggcggg

SEQ ID NO: 410155 - RNA, 18 nt, Bordetella pertussis
cggcaggccgcgcugcca

SEQ ID NO: 410156 - RNA, 18 nt, Bordetella pertussis
cggcaggccggcgcgcgc

SEQ ID NO: 410157 - RNA, 17 nt, Bordetella pertussis
cggcaggccggccagca

SEQ ID NO: 410158 - RNA, 21 nt, Bordetella pertussis
cggcaggccggccagcaaggg

SEQ ID NO: 410159 - RNA, 18 nt, Bordetella pertussis
cggcaggcgccgccgccc

SEQ ID NO: 410160 - RNA, 17 nt, Bordetella pertussis
cggcaggcgccggcugg

SEQ ID NO: 410161 - RNA, 19 nt, Bordetella pertussis
cggcaggcgccggcuggca

SEQ ID NO: 410162 - RNA, 20 nt, Bordetella pertussis
cggcaggcgccggcuggcau

SEQ ID NO: 410163 - RNA, 20 nt, Bordetella pertussis
cggcaggcgcgagguggcgc

SEQ ID NO: 410164 - RNA, 17 nt, Bordetella pertussis
cggcaggcgcgccagcc

SEQ ID NO: 410165 - RNA, 12 nt, Bordetella pertussis
cggcaggcuggc

SEQ ID NO: 410166 - RNA, 16 nt, Bordetella pertussis
cggcaggcuggccggc

SEQ ID NO: 410167 - RNA, 14 nt, Bordetella pertussis
cggcagggcgucgg

SEQ ID NO: 410168 - RNA, 16 nt, Bordetella pertussis
cggcagggcgucggcc

SEQ ID NO: 410169 - RNA, 18 nt, Bordetella pertussis
cggcaggggcucgcgccc

SEQ ID NO: 410170 - RNA, 16 nt, Bordetella pertussis
cggcagggugacgggc

SEQ ID NO: 410171 - RNA, 20 nt, Bordetella pertussis
cggcagggugacgggcuggg

SEQ ID NO: 410172 - RNA, 17 nt, Bordetella pertussis
cggcaggucgaugcccu

SEQ ID NO: 410173 - RNA, 13 nt, Bordetella pertussis
cggcaggugcgcc

SEQ ID NO: 410174 - RNA, 16 nt, Bordetella pertussis
cggcagugucaggaug

SEQ ID NO: 410175 - RNA, 15 nt, Bordetella pertussis
cggcauagcccaggc

SEQ ID NO: 410176 - RNA, 21 nt, Bordetella pertussis
cggcauaggcggcgcaggcca

SEQ ID NO: 410177 - RNA, 22 nt, Bordetella pertussis
cggcauaggcggcgcaggccag

SEQ ID NO: 410178 - RNA, 22 nt, Bordetella pertussis
cggcaucccgacaugccgcccc

SEQ ID NO: 410179 - RNA, 19 nt, Bordetella pertussis
cggcaucgccgcgggcgaa

SEQ ID NO: 410180 - RNA, 15 nt, Bordetella pertussis
cggcaucgcgcugac

SEQ ID NO: 410181 - RNA, 22 nt, Bordetella pertussis
cggcaucggccacgcugcccug

SEQ ID NO: 410182 - RNA, 15 nt, Bordetella pertussis
cggcaucggccagca

SEQ ID NO: 410183 - RNA, 12 nt, Bordetella pertussis
cggcaucggcca

SEQ ID NO: 410184 - RNA, 19 nt, Bordetella pertussis
cggcaucguuacacuggcc

SEQ ID NO: 410185 - RNA, 13 nt, Bordetella pertussis
cggcaucuguccg

SEQ ID NO: 410186 - RNA, 18 nt, Bordetella pertussis
cggcaucuugccuuggcg

SEQ ID NO: 410187 - RNA, 17 nt, Bordetella pertussis
cggcaugaagcgcagca

SEQ ID NO: 410188 - RNA, 13 nt, Bordetella pertussis
cggcaugcgcaug

SEQ ID NO: 410189 - RNA, 14 nt, Bordetella pertussis
cggcauggccagcu

SEQ ID NO: 410190 - RNA, 14 nt, Bordetella pertussis
cggcauggccagga

SEQ ID NO: 410191 - RNA, 20 nt, Bordetella pertussis
cggcauggcgccgcgccgcc

SEQ ID NO: 410192 - RNA, 15 nt, Bordetella pertussis
cggcauggcgcgcgc

SEQ ID NO: 410193 - RNA, 17 nt, Bordetella pertussis
cggcaugggcgugccgc

SEQ ID NO: 410194 - RNA, 21 nt, Bordetella pertussis
cggcaugggcgugccgcgcug

SEQ ID NO: 410195 - RNA, 23 nt, Bordetella pertussis
cggcaugguagcgguccagcugc

SEQ ID NO: 410196 - RNA, 19 nt, Bordetella pertussis
cggcauggucggcauggcc

SEQ ID NO: 410197 - RNA, 21 nt, Bordetella pertussis
cggcaugguguaccgggccga

SEQ ID NO: 410198 - RNA, 17 nt, Bordetella pertussis
cggcauguaggccucgg

SEQ ID NO: 410199 - RNA, 21 nt, Bordetella pertussis
cggccaacggcuggcugggcg

SEQ ID NO: 410200 - RNA, 17 nt, Bordetella pertussis
cggccaaggccggcgcg

SEQ ID NO: 410201 - RNA, 15 nt, Bordetella pertussis
cggccaaucggccug

SEQ ID NO: 410202 - RNA, 22 nt, Bordetella pertussis
cggccaauggccggugagaucc

SEQ ID NO: 410203 - RNA, 20 nt, Bordetella pertussis
cggccaccagcggcgccgga

SEQ ID NO: 410204 - RNA, 14 nt, Bordetella pertussis
cggccaccaggccg

SEQ ID NO: 410205 - RNA, 20 nt, Bordetella pertussis
cggccacccggaucgacagg

SEQ ID NO: 410206 - RNA, 15 nt, Bordetella pertussis
cggccagcagcgccu

SEQ ID NO: 410207 - RNA, 14 nt, Bordetella pertussis
cggccagcagcacg

SEQ ID NO: 410208 - RNA, 17 nt, Bordetella pertussis
cggccagcagcggcagg

SEQ ID NO: 410209 - RNA, 14 nt, Bordetella pertussis
cggccagcagcuug

SEQ ID NO: 410210 - RNA, 18 nt, Bordetella pertussis
cggccagcaggagcccgc

SEQ ID NO: 410211 - RNA, 18 nt, Bordetella pertussis
cggccagcauacccugcg

SEQ ID NO: 410212 - RNA, 20 nt, Bordetella pertussis
cggccagcauacccugcgcg

SEQ ID NO: 410213 - RNA, 13 nt, Bordetella pertussis
cggccagccacgc

SEQ ID NO: 410214 - RNA, 19 nt, Bordetella pertussis
cggccagccacgccggcgc

SEQ ID NO: 410215 - RNA, 15 nt, Bordetella pertussis
cggccagccccaccu

SEQ ID NO: 410216 - RNA, 11 nt, Bordetella pertussis
cggccagccgg

SEQ ID NO: 410217 - RNA, 13 nt, Bordetella pertussis
cggccagccugcc

SEQ ID NO: 410218 - RNA, 15 nt, Bordetella pertussis
cggccagccugcccg

SEQ ID NO: 410219 - RNA, 14 nt, Bordetella pertussis
cggccagccgggcg

SEQ ID NO: 410220 - RNA, 14 nt, Bordetella pertussis
cggccagcgcgucg

SEQ ID NO: 410221 - RNA, 14 nt, Bordetella pertussis
cggccagcggcagg

SEQ ID NO: 410222 - RNA, 20 nt, Bordetella pertussis
cggccagcgugccggugacg

SEQ ID NO: 410223 - RNA, 14 nt, Bordetella pertussis
cggccagcgucagc

SEQ ID NO: 410224 - RNA, 22 nt, Bordetella pertussis
cggccagcucggcggccgccug

SEQ ID NO: 410225 - RNA, 14 nt, Bordetella pertussis
cggccagcugggcc

SEQ ID NO: 410226 - RNA, 22 nt, Bordetella pertussis
cggccagcuugagcaggcgcga

SEQ ID NO: 410227 - RNA, 17 nt, Bordetella pertussis
cggccagcuugccgcuc

SEQ ID NO: 410228 - RNA, 19 nt, Bordetella pertussis
cggccaggaaagccggcgu

SEQ ID NO: 410229 - RNA, 20 nt, Bordetella pertussis
cggccaggcccaugccgccc

SEQ ID NO: 410230 - RNA, 18 nt, Bordetella pertussis
cggccaggccggcgcgcc

SEQ ID NO: 410231 - RNA, 19 nt, Bordetella pertussis
cggccaggccggcgcgccg

SEQ ID NO: 410232 - RNA, 22 nt, Bordetella pertussis
cggccaggccggcgcgccggcc

SEQ ID NO: 410233 - RNA, 15 nt, Bordetella pertussis
cggccaggccggccu

SEQ ID NO: 410234 - RNA, 16 nt, Bordetella pertussis
cggccaggccggccug

SEQ ID NO: 410235 - RNA, 16 nt, Bordetella pertussis
cggccaggccgguggg

SEQ ID NO: 410236 - RNA, 18 nt, Bordetella pertussis
cggccaggcgccgcucag

SEQ ID NO: 410237 - RNA, 14 nt, Bordetella pertussis
cggccaggcgcgcc

SEQ ID NO: 410238 - RNA, 15 nt, Bordetella pertussis
cggccaggcgcgccg

SEQ ID NO: 410239 - RNA, 17 nt, Bordetella pertussis
cggccaggcucugggcg

SEQ ID NO: 410240 - RNA, 12 nt, Bordetella pertussis
cggccagggcca

SEQ ID NO: 410241 - RNA, 17 nt, Bordetella pertussis
cggccagggccugcggg

SEQ ID NO: 410242 - RNA, 21 nt, Bordetella pertussis
cggccaguucgacgcccaugc

SEQ ID NO: 410243 - RNA, 17 nt, Bordetella pertussis
cggccaucgccgccacg

SEQ ID NO: 410244 - RNA, 19 nt, Bordetella pertussis
cggccaucuuggugcgcgc

SEQ ID NO: 410245 - RNA, 18 nt, Bordetella pertussis
cggccaugcccaggccca

SEQ ID NO: 410246 - RNA, 20 nt, Bordetella pertussis
cggccaugcgcgccagcaug

SEQ ID NO: 410247 - RNA, 17 nt, Bordetella pertussis
cggccaugcggugcgcc

SEQ ID NO: 410248 - RNA, 14 nt, Bordetella pertussis
cggccaugcucagc

SEQ ID NO: 410249 - RNA, 15 nt, Bordetella pertussis
cggccauggccgcca

SEQ ID NO: 410250 - RNA, 22 nt, Bordetella pertussis
cggcccaggauggcgccagccc

SEQ ID NO: 410251 - RNA, 16 nt, Bordetella pertussis
cggcccaggccgggcg

SEQ ID NO: 410252 - RNA, 14 nt, Bordetella pertussis
cggcccaggcgcgc

SEQ ID NO: 410253 - RNA, 23 nt, Bordetella pertussis
cggcccaggcguccaggcugccg

SEQ ID NO: 410254 - RNA, 18 nt, Bordetella pertussis
cggcccaggucaucgcca

SEQ ID NO: 410255 - RNA, 14 nt, Bordetella pertussis
cggcccaguccagg

SEQ ID NO: 410256 - RNA, 16 nt, Bordetella pertussis
cggcccaguccagggu

SEQ ID NO: 410257 - RNA, 12 nt, Bordetella pertussis
cggcccauccau

SEQ ID NO: 410258 - RNA, 15 nt, Bordetella pertussis
cggccccaccuggcg

SEQ ID NO: 410259 - RNA, 13 nt, Bordetella pertussis
cggccccagcgcc

SEQ ID NO: 410260 - RNA, 17 nt, Bordetella pertussis
cggccccagcgccgcga

SEQ ID NO: 410261 - RNA, 13 nt, Bordetella pertussis
cggccccaggaug

SEQ ID NO: 410262 - RNA, 20 nt, Bordetella pertussis
cggccccaggaugcgcaccg

SEQ ID NO: 410263 - RNA, 22 nt, Bordetella pertussis
cggccccaggaugcgcaccggc

SEQ ID NO: 410264 - RNA, 15 nt, Bordetella pertussis
cggccccaggccggg

SEQ ID NO: 410265 - RNA, 16 nt, Bordetella pertussis
cggccgccaccugggc

SEQ ID NO: 410266 - RNA, 17 nt, Bordetella pertussis
cggccgccaccugggcc

SEQ ID NO: 410267 - RNA, 22 nt, Bordetella pertussis
cggccgccaccugggccgccug

SEQ ID NO: 410268 - RNA, 18 nt, Bordetella pertussis
cggccgccacgcccuggc

SEQ ID NO: 410269 - RNA, 15 nt, Bordetella pertussis
cggccgccagcaagg

SEQ ID NO: 410270 - RNA, 14 nt, Bordetella pertussis
cggccgccagccac

SEQ ID NO: 410271 - RNA, 18 nt, Bordetella pertussis
cggccgccagccaccccg

SEQ ID NO: 410272 - RNA, 18 nt, Bordetella pertussis
cggccgccagccggccca

SEQ ID NO: 410273 - RNA, 14 nt, Bordetella pertussis
cggccgccagcgcc

SEQ ID NO: 410274 - RNA, 20 nt, Bordetella pertussis
cggccgccaggucggccacc

SEQ ID NO: 410275 - RNA, 18 nt, Bordetella pertussis
cggccgcccaggcgcagc

SEQ ID NO: 410276 - RNA, 20 nt, Bordetella pertussis
cggccgcccccagcgcgccu

SEQ ID NO: 410277 - RNA, 16 nt, Bordetella pertussis
cggccgccgacgccgc

SEQ ID NO: 410278 - RNA, 19 nt, Bordetella pertussis
cggccgccgacgccgccac

SEQ ID NO: 410279 - RNA, 14 nt, Bordetella pertussis
cggccgccgccagc

SEQ ID NO: 410280 - RNA, 13 nt, Bordetella pertussis
cggccgccgcccg

SEQ ID NO: 410281 - RNA, 13 nt, Bordetella pertussis
cggccgccgccgg

SEQ ID NO: 410282 - RNA, 21 nt, Bordetella pertussis
cggccgccucaccgcgccggg

SEQ ID NO: 410283 - RNA, 15 nt, Bordetella pertussis
cggccgccuccaggc

SEQ ID NO: 410284 - RNA, 20 nt, Bordetella pertussis
cggccgccuccaggcggcgg

SEQ ID NO: 410285 - RNA, 17 nt, Bordetella pertussis
cggccgcgcaaggcggc

SEQ ID NO: 410286 - RNA, 22 nt, Bordetella pertussis
cggccgcgcaaggcggcccggc

SEQ ID NO: 410287 - RNA, 15 nt, Bordetella pertussis
cggccgcgccagccc

SEQ ID NO: 410288 - RNA, 14 nt, Bordetella pertussis
cggccgcgcccagc

SEQ ID NO: 410289 - RNA, 15 nt, Bordetella pertussis
cggccgcgcccaggu

SEQ ID NO: 410290 - RNA, 15 nt, Bordetella pertussis
cggccgcgcccaugc

SEQ ID NO: 410291 - RNA, 23 nt, Bordetella pertussis
cggccgcgccgccgcccuggccg

SEQ ID NO: 410292 - RNA, 18 nt, Bordetella pertussis
cggccgcgccgcgccggu

SEQ ID NO: 410293 - RNA, 15 nt, Bordetella pertussis
cggccgcugccgcgc

SEQ ID NO: 410294 - RNA, 21 nt, Bordetella pertussis
cggccgcugccgcgcgccggc

SEQ ID NO: 410295 - RNA, 13 nt, Bordetella pertussis
cggccggacaggg

SEQ ID NO: 410296 - RNA, 17 nt, Bordetella pertussis
cggccggacagggccgc

SEQ ID NO: 410297 - RNA, 21 nt, Bordetella pertussis
cggccggacagggccgcgagc

SEQ ID NO: 410298 - RNA, 16 nt, Bordetella pertussis
cggccggaccgcugug

SEQ ID NO: 410299 - RNA, 16 nt, Bordetella pertussis
cggccggaggccgccc

SEQ ID NO: 410300 - RNA, 14 nt, Bordetella pertussis
cggccggcacgccc

SEQ ID NO: 410301 - RNA, 17 nt, Bordetella pertussis
cggccggcacgcccagc

SEQ ID NO: 410302 - RNA, 20 nt, Bordetella pertussis
cggccggcacgcccagccgc

SEQ ID NO: 410303 - RNA, 23 nt, Bordetella pertussis
cggccggcagcgcgaccggcgcg

SEQ ID NO: 410304 - RNA, 18 nt, Bordetella pertussis
cggccguaaugcaucuuu

SEQ ID NO: 410305 - RNA, 18 nt, Bordetella pertussis
cggccguaguucggcggg

SEQ ID NO: 410306 - RNA, 15 nt, Bordetella pertussis
cggccgucaccgccg

SEQ ID NO: 410307 - RNA, 18 nt, Bordetella pertussis
cggccgucaccgccgccg

SEQ ID NO: 410308 - RNA, 15 nt, Bordetella pertussis
cggccgucgccgccc

SEQ ID NO: 410309 - RNA, 19 nt, Bordetella pertussis
cggccgucgccgcccaugc

SEQ ID NO: 410310 - RNA, 15 nt, Bordetella pertussis
cggccgucggggccg

SEQ ID NO: 410311 - RNA, 23 nt, Bordetella pertussis
cggccgucggggccgauggucag

SEQ ID NO: 410312 - RNA, 15 nt, Bordetella pertussis
cggccgucgugcagc

SEQ ID NO: 410313 - RNA, 14 nt, Bordetella pertussis
cggccgugccgccc

SEQ ID NO: 410314 - RNA, 15 nt, Bordetella pertussis
cggccgugccgcccg

SEQ ID NO: 410315 - RNA, 16 nt, Bordetella pertussis
cggccgugccgcccgg

SEQ ID NO: 410316 - RNA, 18 nt, Bordetella pertussis
cggccgugcgccagcgcc

SEQ ID NO: 410317 - RNA, 19 nt, Bordetella pertussis
cggccgugcgccagcgcca

SEQ ID NO: 410318 - RNA, 21 nt, Bordetella pertussis
cggccgucggcgcuggcgcgc

SEQ ID NO: 410319 - RNA, 19 nt, Bordetella pertussis
cggccguggaggcggcggc

SEQ ID NO: 410320 - RNA, 17 nt, Bordetella pertussis
cggccucgcggcgcagc

SEQ ID NO: 410321 - RNA, 19 nt, Bordetella pertussis
cggccucgcgcagggcggc

SEQ ID NO: 410322 - RNA, 22 nt, Bordetella pertussis
cggccucgcgcagggcggccuc

SEQ ID NO: 410323 - RNA, 15 nt, Bordetella pertussis
cggccucgcugcggg

SEQ ID NO: 410324 - RNA, 22 nt, Bordetella pertussis
cggccucgcugcgggcggccug

SEQ ID NO: 410325 - RNA, 21 nt, Bordetella pertussis
cggccucggucaggguggaga

SEQ ID NO: 410326 - RNA, 13 nt, Bordetella pertussis
cggccugacgcgc

SEQ ID NO: 410327 - RNA, 22 nt, Bordetella pertussis
cggccugacgcgcaagcggccc

SEQ ID NO: 410328 - RNA, 21 nt, Bordetella pertussis
cggccugcaaugcggccaggc

SEQ ID NO: 410329 - RNA, 15 nt, Bordetella pertussis
cggccugcaccggcg

SEQ ID NO: 410330 - RNA, 13 nt, Bordetella pertussis
cggccugcagacc

SEQ ID NO: 410331 - RNA, 17 nt, Bordetella pertussis
cggccugcaggcccagc

SEQ ID NO: 410332 - RNA, 21 nt, Bordetella pertussis
cggccugccaccagcgcgcca

SEQ ID NO: 410333 - RNA, 23 nt, Bordetella pertussis
cggccugccaccagcgcgccagc

SEQ ID NO: 410334 - RNA, 14 nt, Bordetella pertussis
cggccugccaccga

SEQ ID NO: 410335 - RNA, 16 nt, Bordetella pertussis
cggccugccagccugc

SEQ ID NO: 410336 - RNA, 15 nt, Bordetella pertussis
cggccugcccgggcg

SEQ ID NO: 410337 - RNA, 17 nt, Bordetella pertussis
cggccugccggcgcgcc

SEQ ID NO: 410338 - RNA, 14 nt, Bordetella pertussis
cggccugcgccagc

SEQ ID NO: 410339 - RNA, 16 nt, Bordetella pertussis
cggccugcgccagcuc

SEQ ID NO: 410340 - RNA, 14 nt, Bordetella pertussis
cggccugcgccggc

SEQ ID NO: 410341 - RNA, 16 nt, Bordetella pertussis
cggccugcgccgggcg

SEQ ID NO: 410342 - RNA, 14 nt, Bordetella pertussis
cggccugcgcgccg

SEQ ID NO: 410343 - RNA, 22 nt, Bordetella pertussis
cggccugcgggcgccgcggggc

SEQ ID NO: 410344 - RNA, 17 nt, Bordetella pertussis
cggccugcuccggcgug

SEQ ID NO: 410345 - RNA, 22 nt, Bordetella pertussis
cggccugcucgcaggccugcug

SEQ ID NO: 410346 - RNA, 12 nt, Bordetella pertussis
cggccugcugca

SEQ ID NO: 410347 - RNA, 19 nt, Bordetella pertussis
cggcgaaagcgucggcuuc

SEQ ID NO: 410348 - RNA, 19 nt, Bordetella pertussis
cggcgaacacgucgcgggc

SEQ ID NO: 410349 - RNA, 22 nt, Bordetella pertussis
cggcgaacacgucgcgggcgau

SEQ ID NO: 410350 - RNA, 19 nt, Bordetella pertussis
cggcgaccaggcccauggc

SEQ ID NO: 410351 - RNA, 20 nt, Bordetella pertussis
cggcgaccaggcccauggcg

SEQ ID NO: 410352 - RNA, 19 nt, Bordetella pertussis
cggcgaccggcgccggcuc

SEQ ID NO: 410353 - RNA, 21 nt, Bordetella pertussis
cggcgacggucaggggcaggc

SEQ ID NO: 410354 - RNA, 18 nt, Bordetella pertussis
cggcgacguggcgcucca

SEQ ID NO: 410355 - RNA, 15 nt, Bordetella pertussis
cggcgacucggcauc

SEQ ID NO: 410356 - RNA, 21 nt, Bordetella pertussis
cggcgacugccccagcggcug

SEQ ID NO: 410357 - RNA, 23 nt, Bordetella pertussis
cggcgacuuccgcuuccggccgg

SEQ ID NO: 410358 - RNA, 17 nt, Bordetella pertussis
cggcgacuucggcggcc

SEQ ID NO: 410359 - RNA, 18 nt, Bordetella pertussis
cggcgacuucggcggcca

SEQ ID NO: 410360 - RNA, 21 nt, Bordetella pertussis
cggcgacuucggcggccaugc

SEQ ID NO: 410361 - RNA, 23 nt, Bordetella pertussis
cggcgagcaauccgucaggcagc

SEQ ID NO: 410362 - RNA, 15 nt, Bordetella pertussis
cggcgagccgcgcgc

SEQ ID NO: 410363 - RNA, 16 nt, Bordetella pertussis
cggcgagcgcggcgcg

SEQ ID NO: 410364 - RNA, 19 nt, Bordetella pertussis
cggcgagcgcggcgcgcgc

SEQ ID NO: 410365 - RNA, 21 nt, Bordetella pertussis
cggcgagcgcggcgcgcgcca

SEQ ID NO: 410366 - RNA, 15 nt, Bordetella pertussis
cggcgagcgcggcga

SEQ ID NO: 410367 - RNA, 14 nt, Bordetella pertussis
cggcgaggccgccc

SEQ ID NO: 410368 - RNA, 16 nt, Bordetella pertussis
cggcgaggccgcccgc

SEQ ID NO: 410369 - RNA, 16 nt, Bordetella pertussis
cggcgauacgcgccgc

SEQ ID NO: 410370 - RNA, 14 nt, Bordetella pertussis
cggcgauccgccgc

SEQ ID NO: 410371 - RNA, 16 nt, Bordetella pertussis
cggcgauccgccgcgg

SEQ ID NO: 410372 - RNA, 16 nt, Bordetella pertussis
cggcgaucucgcgcgc

SEQ ID NO: 410373 - RNA, 18 nt, Bordetella pertussis
cggcgaucugggccucgg

SEQ ID NO: 410374 - RNA, 23 nt, Bordetella pertussis
cggcgaugauggggucgccgggc

SEQ ID NO: 410375 - RNA, 15 nt, Bordetella pertussis
cggcgaugcacccag

SEQ ID NO: 410376 - RNA, 18 nt, Bordetella pertussis
cggcgaugccggccagca

SEQ ID NO: 410377 - RNA, 13 nt, Bordetella pertussis
cggcgaugcgcga

SEQ ID NO: 410378 - RNA, 15 nt, Bordetella pertussis
cggcgaugcgcgagc

SEQ ID NO: 410379 - RNA, 20 nt, Bordetella pertussis
cggcgaugcgcggggccggu

SEQ ID NO: 410380 - RNA, 15 nt, Bordetella pertussis
cggcgaugcgggcca

SEQ ID NO: 410381 - RNA, 17 nt, Bordetella pertussis
cggcgaugcgggcggcg

SEQ ID NO: 410382 - RNA, 18 nt, Bordetella pertussis
cggcgaugccgcugucgg

SEQ ID NO: 410383 - RNA, 17 nt, Bordetella pertussis
cggcgcacccgcggcgc

SEQ ID NO: 410384 - RNA, 23 nt, Bordetella pertussis
cggcgcacccgcggcgcaugcag

SEQ ID NO: 410385 - RNA, 19 nt, Bordetella pertussis
cggcgcaccgacagcaagg

SEQ ID NO: 410386 - RNA, 15 nt, Bordetella pertussis
cggcgcagccggccg

SEQ ID NO: 410387 - RNA, 22 nt, Bordetella pertussis
cggcgcagcauuucggcgccgc

SEQ ID NO: 410388 - RNA, 17 nt, Bordetella pertussis
cggcgcagcgcccaggc

SEQ ID NO: 410389 - RNA, 15 nt, Bordetella pertussis
cggcgcagcgcgucc

SEQ ID NO: 410390 - RNA, 19 nt, Bordetella pertussis
cggcgcaggccagcgccgc

SEQ ID NO: 410391 - RNA, 13 nt, Bordetella pertussis
cggcgcaggcggg

SEQ ID NO: 410392 - RNA, 14 nt, Bordetella pertussis
cggcgcagucgcgc

SEQ ID NO: 410393 - RNA, 16 nt, Bordetella pertussis
cggcgcagucgcgcac

SEQ ID NO: 410394 - RNA, 15 nt, Bordetella pertussis
cggcgcaguuccggc

SEQ ID NO: 410395 - RNA, 21 nt, Bordetella pertussis
cggcgcaucagcgcgcccgcu

SEQ ID NO: 410396 - RNA, 19 nt, Bordetella pertussis
cggcgcaugagccggcaga

SEQ ID NO: 410397 - RNA, 20 nt, Bordetella pertussis
cggcgcaugauggccggccu

SEQ ID NO: 410398 - RNA, 19 nt, Bordetella pertussis
cggcgcauugccgucggcc

SEQ ID NO: 410399 - RNA, 22 nt, Bordetella pertussis
cggcgccaaagcacaggauggc

SEQ ID NO: 410400 - RNA, 22 nt, Bordetella pertussis
cggcgccacaggugcgcggcgc

SEQ ID NO: 410401 - RNA, 15 nt, Bordetella pertussis
cggcgcccacgccga

SEQ ID NO: 410402 - RNA, 23 nt, Bordetella pertussis
cggcgcccauuccgagcgggccc

SEQ ID NO: 410403 - RNA, 17 nt, Bordetella pertussis
cggcgcccccagcagcg

SEQ ID NO: 410404 - RNA, 16 nt, Bordetella pertussis
cggcgcccgcauggac

SEQ ID NO: 410405 - RNA, 16 nt, Bordetella pertussis
cggcgcccgccgccgg

SEQ ID NO: 410406 - RNA, 16 nt, Bordetella pertussis
cggcgcccgcgcaugc

SEQ ID NO: 410407 - RNA, 14 nt, Bordetella pertussis
cggcgcccggcagc

SEQ ID NO: 410408 - RNA, 17 nt, Bordetella pertussis
cggcgccgcgcgcggcc

SEQ ID NO: 410409 - RNA, 22 nt, Bordetella pertussis
cggcgccgcgcgcggccccggc

SEQ ID NO: 410410 - RNA, 15 nt, Bordetella pertussis
cggcgccgcgcgcug

SEQ ID NO: 410411 - RNA, 16 nt, Bordetella pertussis
cggcgccgcgcgcugg

SEQ ID NO: 410412 - RNA, 15 nt, Bordetella pertussis
cggcgccgcgcagca

SEQ ID NO: 410413 - RNA, 13 nt, Bordetella pertussis
cggcgccgcgcgu

SEQ ID NO: 410414 - RNA, 15 nt, Bordetella pertussis
cggcgccgcggcgcu

SEQ ID NO: 410415 - RNA, 22 nt, Bordetella pertussis
cggcgccggaucggccggcagc

SEQ ID NO: 410416 - RNA, 14 nt, Bordetella pertussis
cggcgccggccgcc

SEQ ID NO: 410417 - RNA, 15 nt, Bordetella pertussis
cggcgccggccgccc

SEQ ID NO: 410418 - RNA, 17 nt, Bordetella pertussis
cggcgccggccgcccgc

SEQ ID NO: 410419 - RNA, 14 nt, Bordetella pertussis
cggcgccggcgacg

SEQ ID NO: 410420 - RNA, 15 nt, Bordetella pertussis
cggcgccggcggcgc

SEQ ID NO: 410421 - RNA, 19 nt, Bordetella pertussis
cggcgccggugcgcggcgc

SEQ ID NO: 410422 - RNA, 23 nt, Bordetella pertussis
cggcgccggugcgcggcgccccc

SEQ ID NO: 410423 - RNA, 12 nt, Bordetella pertussis
cggcgccgucga

SEQ ID NO: 410424 - RNA, 23 nt, Bordetella pertussis
cggcgccguccagcgcggcaugc

SEQ ID NO: 410425 - RNA, 20 nt, Bordetella pertussis
cggcgccugccugccgagcg

SEQ ID NO: 410426 - RNA, 16 nt, Bordetella pertussis
cggcgccugcgcgcgc

SEQ ID NO: 410427 - RNA, 17 nt, Bordetella pertussis
cggcgccugcgcgcgcu

SEQ ID NO: 410428 - RNA, 19 nt, Bordetella pertussis
cggcgccugcgcgcgcugg

SEQ ID NO: 410429 - RNA, 16 nt, Bordetella pertussis
cggcgccugcggcaug

SEQ ID NO: 410430 - RNA, 18 nt, Bordetella pertussis
cggcgccuggccgcccag

SEQ ID NO: 410431 - RNA, 19 nt, Bordetella pertussis
cggcgccuggucgcgcgcc

SEQ ID NO: 410432 - RNA, 16 nt, Bordetella pertussis
cggcgcgaacggcagc

SEQ ID NO: 410433 - RNA, 17 nt, Bordetella pertussis
cggcgcgaacggcagcu

SEQ ID NO: 410434 - RNA, 19 nt, Bordetella pertussis
cggcgcgaccgccuccagc

SEQ ID NO: 410435 - RNA, 16 nt, Bordetella pertussis
cggcgcgaccugcgcg

SEQ ID NO: 410436 - RNA, 15 nt, Bordetella pertussis
cggcgcgacgcgcuu

SEQ ID NO: 410437 - RNA, 23 nt, Bordetella pertussis
cggcgcgagcgcacaggcggcgc

SEQ ID NO: 410438 - RNA, 14 nt, Bordetella pertussis
cggcgcgcaggcag

SEQ ID NO: 410439 - RNA, 18 nt, Bordetella pertussis
cggcgcgccagcgcggcc

SEQ ID NO: 410440 - RNA, 23 nt, Bordetella pertussis
cggcgcgccauggucucccccuc

SEQ ID NO: 410441 - RNA, 15 nt, Bordetella pertussis
cggcgcgcccgcccc

SEQ ID NO: 410442 - RNA, 23 nt, Bordetella pertussis
cggcgcgcccgccuucggcggcg

SEQ ID NO: 410443 - RNA, 13 nt, Bordetella pertussis
cggcgcgccgccc

SEQ ID NO: 410444 - RNA, 15 nt, Bordetella pertussis
cggcgcgccgcccgc

SEQ ID NO: 410445 - RNA, 17 nt, Bordetella pertussis
cggcgcgccgcgccgcc

SEQ ID NO: 410446 - RNA, 15 nt, Bordetella pertussis
cggcgcgccggccca

SEQ ID NO: 410447 - RNA, 15 nt, Bordetella pertussis
cggcgcgccggccgc

SEQ ID NO: 410448 - RNA, 18 nt, Bordetella pertussis
cggcgcgccggccugcgc

SEQ ID NO: 410449 - RNA, 12 nt, Bordetella pertussis
cggcgcgccggg

SEQ ID NO: 410450 - RNA, 23 nt, Bordetella pertussis
cggcgcgccucggcgcgcgcggc

SEQ ID NO: 410451 - RNA, 20 nt, Bordetella pertussis
cggcgcgccuuacgcggcgc

SEQ ID NO: 410452 - RNA, 19 nt, Bordetella pertussis
cggcgcgccuucggcaggc

SEQ ID NO: 410453 - RNA, 12 nt, Bordetella pertussis
cggcgcgcgcag

SEQ ID NO: 410454 - RNA, 11 nt, Bordetella pertussis
cggcgcgcgcc

SEQ ID NO: 410455 - RNA, 12 nt, Bordetella pertussis
cggcgcgcgcca

SEQ ID NO: 410456 - RNA, 12 nt, Bordetella pertussis
cggcgcgcgccg

SEQ ID NO: 410457 - RNA, 22 nt, Bordetella pertussis
cggcgcgcgccgcgccggggcg

SEQ ID NO: 410458 - RNA, 11 nt, Bordetella pertussis
cggcgcgcgcg

SEQ ID NO: 410459 - RNA, 20 nt, Bordetella pertussis
cggcgcgcgcgacuccaccg

SEQ ID NO: 410460 - RNA, 15 nt, Bordetella pertussis
cggcgcgcgcggcgc

SEQ ID NO: 410461 - RNA, 21 nt, Bordetella pertussis
cggcgcgcgcggcgccugggg

SEQ ID NO: 410462 - RNA, 11 nt, Bordetella pertussis
cggcgcgcgcu

SEQ ID NO: 410463 - RNA, 23 nt, Bordetella pertussis
cggcgcgcggaugaucgcgcagc

SEQ ID NO: 410464 - RNA, 14 nt, Bordetella pertussis
cggcgcgcgguggc

SEQ ID NO: 410465 - RNA, 15 nt, Bordetella pertussis
cggcgcgcgguggca

SEQ ID NO: 410466 - RNA, 21 nt, Bordetella pertussis
cggcgcggaucgugcgccacu

SEQ ID NO: 410467 - RNA, 16 nt, Bordetella pertussis
cggcgcggcagguucu

SEQ ID NO: 410468 - RNA, 14 nt, Bordetella pertussis
cggcgcggccagca

SEQ ID NO: 410469 - RNA, 15 nt, Bordetella pertussis
cggcgcggcccgcca

SEQ ID NO: 410470 - RNA, 20 nt, Bordetella pertussis
cggcgcggcccgccacgcag

SEQ ID NO: 410471 - RNA, 18 nt, Bordetella pertussis
cggcgcggcgcaggccug

SEQ ID NO: 410472 - RNA, 15 nt, Bordetella pertussis
cggcgcggcgccagc

SEQ ID NO: 410473 - RNA, 19 nt, Bordetella pertussis
cggcgcggcgccagcgccc

SEQ ID NO: 410474 - RNA, 20 nt, Bordetella pertussis
cggcgcggcgccagcgcccc

SEQ ID NO: 410475 - RNA, 15 nt, Bordetella pertussis
cggcgcggcgcgcgc

SEQ ID NO: 410476 - RNA, 14 nt, Bordetella pertussis
cggcgcggcgcgcu

SEQ ID NO: 410477 - RNA, 23 nt, Bordetella pertussis
cggcgcggcgaucggcccgggcg

SEQ ID NO: 410478 - RNA, 19 nt, Bordetella pertussis
cggcgcggcggugccuguc

SEQ ID NO: 410479 - RNA, 13 nt, Bordetella pertussis
cggcgcgggcacu

SEQ ID NO: 410480 - RNA, 14 nt, Bordetella pertussis
cggcgcgggcggcu

SEQ ID NO: 410481 - RNA, 23 nt, Bordetella pertussis
cggcgcgggcggcuaggcgcagc

SEQ ID NO: 410482 - RNA, 16 nt, Bordetella pertussis
cggcgcgucgcgcgcc

SEQ ID NO: 410483 - RNA, 20 nt, Bordetella pertussis
cggcgcgucgcgcggcggca

SEQ ID NO: 410484 - RNA, 22 nt, Bordetella pertussis
cggcgcgugcggaugcagcagc

SEQ ID NO: 410485 - RNA, 17 nt, Bordetella pertussis
cggcgcguucgccgcag

SEQ ID NO: 410486 - RNA, 21 nt, Bordetella pertussis
cggcgcguucgccgcagccgu

SEQ ID NO: 410487 - RNA, 20 nt, Bordetella pertussis
cggcgcguucucagccgccc

SEQ ID NO: 410488 - RNA, 20 nt, Bordetella pertussis
cggcgcucagcgacgcgcgc

SEQ ID NO: 410489 - RNA, 16 nt, Bordetella pertussis
cggcgcugcgcagcag

SEQ ID NO: 410490 - RNA, 17 nt, Bordetella pertussis
cggcgcuggccuggccg

SEQ ID NO: 410491 - RNA, 19 nt, Bordetella pertussis
cggcgcuggcgccgcgcgc

SEQ ID NO: 410492 - RNA, 15 nt, Bordetella pertussis
cggcgcuggcgcgcu

SEQ ID NO: 410493 - RNA, 16 nt, Bordetella pertussis
cggcgcuggcuggacg

SEQ ID NO: 410494 - RNA, 18 nt, Bordetella pertussis
cggcgcugggcaggcugg

SEQ ID NO: 410495 - RNA, 17 nt, Bordetella pertussis
cggcgcuggucaaccug

SEQ ID NO: 410496 - RNA, 21 nt, Bordetella pertussis
cggcgcuggucaaccuggugu

SEQ ID NO: 410497 - RNA, 19 nt, Bordetella pertussis
cggcgcuuaccgcgccggc

SEQ ID NO: 410498 - RNA, 15 nt, Bordetella pertussis
cggcggacacgcaug

SEQ ID NO: 410499 - RNA, 16 nt, Bordetella pertussis
cggcggacugcgccgc

SEQ ID NO: 410500 - RNA, 15 nt, Bordetella pertussis
cggcggacuggccgc

SEQ ID NO: 410501 - RNA, 20 nt, Bordetella pertussis
cggcggacuggccgcgccgc

SEQ ID NO: 410502 - RNA, 17 nt, Bordetella pertussis
cggcggaucggcguggu

SEQ ID NO: 410503 - RNA, 19 nt, Bordetella pertussis
cggcggcaccagcaggccg

SEQ ID NO: 410504 - RNA, 16 nt, Bordetella pertussis
cggcggcaccgcgcag

SEQ ID NO: 410505 - RNA, 19 nt, Bordetella pertussis
cggcggcaccgcgcagccc

SEQ ID NO: 410506 - RNA, 15 nt, Bordetella pertussis
cggcggcacgcgcgc

SEQ ID NO: 410507 - RNA, 14 nt, Bordetella pertussis
cggcggcaggccgc

SEQ ID NO: 410508 - RNA, 13 nt, Bordetella pertussis
cggcggccagcag

SEQ ID NO: 410509 - RNA, 21 nt, Bordetella pertussis
cggcggccagccggcgcgcca

SEQ ID NO: 410510 - RNA, 16 nt, Bordetella pertussis
cggcggccagcgcgcc

SEQ ID NO: 410511 - RNA, 17 nt, Bordetella pertussis
cggcggccagcgcgccc

SEQ ID NO: 410512 - RNA, 18 nt, Bordetella pertussis
cggcggccagcgcgccgc

SEQ ID NO: 410513 - RNA, 20 nt, Bordetella pertussis
cggcggccaggccggcgcgc

SEQ ID NO: 410514 - RNA, 12 nt, Bordetella pertussis
cggcggccaggc

SEQ ID NO: 410515 - RNA, 18 nt, Bordetella pertussis
cggcggcccacagcgccc

SEQ ID NO: 410516 - RNA, 17 nt, Bordetella pertussis
cggcggccggggccgcc

SEQ ID NO: 410517 - RNA, 16 nt, Bordetella pertussis
cggcggccuccagcag

SEQ ID NO: 410518 - RNA, 14 nt, Bordetella pertussis
cggcggccuccgcg

SEQ ID NO: 410519 - RNA, 17 nt, Bordetella pertussis
cggcggccuccgcgcac

SEQ ID NO: 410520 - RNA, 13 nt, Bordetella pertussis
cggcggccugcag

SEQ ID NO: 410521 - RNA, 13 nt, Bordetella pertussis
cggcggccugcuu

SEQ ID NO: 410522 - RNA, 13 nt, Bordetella pertussis
cggcggccuggac

SEQ ID NO: 410523 - RNA, 14 nt, Bordetella pertussis
cggcggccugggcc

SEQ ID NO: 410524 - RNA, 18 nt, Bordetella pertussis
cggcggccugggccaugg

SEQ ID NO: 410525 - RNA, 17 nt, Bordetella pertussis
cggcggccugggcgggc

SEQ ID NO: 410526 - RNA, 23 nt, Bordetella pertussis
cggcggcgagcgcggcgcgcgcc

SEQ ID NO: 410527 - RNA, 15 nt, Bordetella pertussis
cggcggcgaugccgc

SEQ ID NO: 410528 - RNA, 18 nt, Bordetella pertussis
cggcggcgaugcgggcca

SEQ ID NO: 410529 - RNA, 13 nt, Bordetella pertussis
cggcggcgcgccg

SEQ ID NO: 410530 - RNA, 13 nt, Bordetella pertussis
cggcggcgcgcgc

SEQ ID NO: 410531 - RNA, 17 nt, Bordetella pertussis
cggcggcgcgcgcgccg

SEQ ID NO: 410532 - RNA, 18 nt, Bordetella pertussis
cggcggcgcgcgcgccgc

SEQ ID NO: 410533 - RNA, 17 nt, Bordetella pertussis
cggcggcgcggcgagca

SEQ ID NO: 410534 - RNA, 14 nt, Bordetella pertussis
cggcggcgcggcgc

SEQ ID NO: 410535 - RNA, 16 nt, Bordetella pertussis
cggcggcgcggcgcca

SEQ ID NO: 410536 - RNA, 16 nt, Bordetella pertussis
cggcggcgcggucagc

SEQ ID NO: 410537 - RNA, 17 nt, Bordetella pertussis
cggcggcgcggucagca

SEQ ID NO: 410538 - RNA, 20 nt, Bordetella pertussis
cggcggcgcguucgccgcag

SEQ ID NO: 410539 - RNA, 15 nt, Bordetella pertussis
cggcggcgcuggccu

SEQ ID NO: 410540 - RNA, 14 nt, Bordetella pertussis
cggcggcgggcugc

SEQ ID NO: 410541 - RNA, 15 nt, Bordetella pertussis
cggcggcgggcugca

SEQ ID NO: 410542 - RNA, 18 nt, Bordetella pertussis
cggcggcguggcggcggg

SEQ ID NO: 410543 - RNA, 13 nt, Bordetella pertussis
cggcggcgugccc

SEQ ID NO: 410544 - RNA, 22 nt, Bordetella pertussis
cggcggcugugggccucgcugg

SEQ ID NO: 410545 - RNA, 16 nt, Bordetella pertussis
cggcggcuucgcgcag

SEQ ID NO: 410546 - RNA, 17 nt, Bordetella pertussis
cggcggcuucgcgcagc

SEQ ID NO: 410547 - RNA, 18 nt, Bordetella pertussis
cggcggcuucgcgcagca

SEQ ID NO: 410548 - RNA, 19 nt, Bordetella pertussis
cggcggcuucgcgcagcaa

SEQ ID NO: 410549 - RNA, 21 nt, Bordetella pertussis
cggcggcuucggccgucagca

SEQ ID NO: 410550 - RNA, 22 nt, Bordetella pertussis
cggcggcuucggccgucagcag

SEQ ID NO: 410551 - RNA, 14 nt, Bordetella pertussis
cggcgggaacaggc

SEQ ID NO: 410552 - RNA, 17 nt, Bordetella pertussis
cggcgggacggccauuc

SEQ ID NO: 410553 - RNA, 19 nt, Bordetella pertussis
cggcgggccccgcagggcc

SEQ ID NO: 410554 - RNA, 13 nt, Bordetella pertussis
cggcgggcgcgca

SEQ ID NO: 410555 - RNA, 16 nt, Bordetella pertussis
cggcgggcggccggcg

SEQ ID NO: 410556 - RNA, 15 nt, Bordetella pertussis
cggcgggcggcgcca

SEQ ID NO: 410557 - RNA, 18 nt, Bordetella pertussis
cggcgggcggcgcggcca

SEQ ID NO: 410558 - RNA, 20 nt, Bordetella pertussis
cggcgggcgugaugccgacc

SEQ ID NO: 410559 - RNA, 20 nt, Bordetella pertussis
cggcgggcucgagcuggcug

SEQ ID NO: 410560 - RNA, 21 nt, Bordetella pertussis
cggcgggcucggcgccggcgg

SEQ ID NO: 410561 - RNA, 23 nt, Bordetella pertussis
cggcgggcucggcgccggcggcg

SEQ ID NO: 410562 - RNA, 14 nt, Bordetella pertussis
cggcgggcgcugcc

SEQ ID NO: 410563 - RNA, 18 nt, Bordetella pertussis
cggcgggcgcuggcgcgc

SEQ ID NO: 410564 - RNA, 14 nt, Bordetella pertussis
cggcggggacaggc

SEQ ID NO: 410565 - RNA, 20 nt, Bordetella pertussis
cggcgggucaaguccggcgc

SEQ ID NO: 410566 - RNA, 17 nt, Bordetella pertussis
cggcggguggcggcggg

SEQ ID NO: 410567 - RNA, 21 nt, Bordetella pertussis
cggcgguaagcguccgcgcgc

SEQ ID NO: 410568 - RNA, 22 nt, Bordetella pertussis
cggcgguaagcguccgcgcgcc

SEQ ID NO: 410569 - RNA, 19 nt, Bordetella pertussis
cggcgguaccaggccgaga

SEQ ID NO: 410570 - RNA, 23 nt, Bordetella pertussis
cggcgguaguaccaauacaggaa

SEQ ID NO: 410571 - RNA, 15 nt, Bordetella pertussis
cggcggucagcgcgg

SEQ ID NO: 410572 - RNA, 22 nt, Bordetella pertussis
cggcgguccacagcccggcccc

SEQ ID NO: 410573 - RNA, 16 nt, Bordetella pertussis
cggcgguccugcugau

SEQ ID NO: 410574 - RNA, 18 nt, Bordetella pertussis
cggcgguccugcugaucc

SEQ ID NO: 410575 - RNA, 21 nt, Bordetella pertussis
cggcggugaccaccaggccgc

SEQ ID NO: 410576 - RNA, 18 nt, Bordetella pertussis
cggcggugccgcgcaccc

SEQ ID NO: 410577 - RNA, 19 nt, Bordetella pertussis
cggcgguuucuuccagcag

SEQ ID NO: 410578 - RNA, 17 nt, Bordetella pertussis
cggcguaaggccgccgg

SEQ ID NO: 410579 - RNA, 22 nt, Bordetella pertussis
cggcguaaggccgccggccacc

SEQ ID NO: 410580 - RNA, 23 nt, Bordetella pertussis
cggcguaaggccgccggccacca

SEQ ID NO: 410581 - RNA, 13 nt, Bordetella pertussis
cggcgccgcgcag

SEQ ID NO: 410582 - RNA, 14 nt, Bordetella pertussis
cggcgccgcgcagc

SEQ ID NO: 410583 - RNA, 17 nt, Bordetella pertussis
cggcguagcugcgccgc

SEQ ID NO: 410584 - RNA, 17 nt, Bordetella pertussis
cggcguauaggccaccc

SEQ ID NO: 410585 - RNA, 16 nt, Bordetella pertussis
cggcguauugccgggu

SEQ ID NO: 410586 - RNA, 24 nt, Bordetella pertussis
cggcgucaaaccaagcagggacag

SEQ ID NO: 410587 - RNA, 21 nt, Bordetella pertussis
cggcguccgaauacgccacgu

SEQ ID NO: 410588 - RNA, 18 nt, Bordetella pertussis
cggcguccucgcgguccu

SEQ ID NO: 410589 - RNA, 13 nt, Bordetella pertussis
cggcguccugccg

SEQ ID NO: 410590 - RNA, 20 nt, Bordetella pertussis
cggcguccugcggcggcagc

SEQ ID NO: 410591 - RNA, 13 nt, Bordetella pertussis
cggcgucgaauuc

SEQ ID NO: 410592 - RNA, 17 nt, Bordetella pertussis
cggcgucgaccgcgggc

SEQ ID NO: 410593 - RNA, 16 nt, Bordetella pertussis
cggcgucgaucggcgc

SEQ ID NO: 410594 - RNA, 19 nt, Bordetella pertussis
cggcgucgaucggcgcgcc

SEQ ID NO: 410595 - RNA, 22 nt, Bordetella pertussis
cggcgucgaucggcgcgcccgc

SEQ ID NO: 410596 - RNA, 16 nt, Bordetella pertussis
cggcgucgccgcgcac

SEQ ID NO: 410597 - RNA, 19 nt, Bordetella pertussis
cggcgucgccgcgcacgau

SEQ ID NO: 410598 - RNA, 14 nt, Bordetella pertussis
cggcgucgggcagc

SEQ ID NO: 410599 - RNA, 22 nt, Bordetella pertussis
cggcgucggugccguccagcgc

SEQ ID NO: 410600 - RNA, 17 nt, Bordetella pertussis
cggcgugaugcccaggc

SEQ ID NO: 410601 - RNA, 21 nt, Bordetella pertussis
cggcgugcagcaagcccaccg

SEQ ID NO: 410602 - RNA, 13 nt, Bordetella pertussis
cggcgugcccagg

SEQ ID NO: 410603 - RNA, 18 nt, Bordetella pertussis
cggcgugcgcuggcuggg

SEQ ID NO: 410604 - RNA, 20 nt, Bordetella pertussis
cggcgugcgcuggcugggcc

SEQ ID NO: 410605 - RNA, 16 nt, Bordetella pertussis
cggcgugcggcccagc

SEQ ID NO: 410606 - RNA, 15 nt, Bordetella pertussis
cggcgugcugcccgc

SEQ ID NO: 410607 - RNA, 16 nt, Bordetella pertussis
cggcguggccugcccg

SEQ ID NO: 410608 - RNA, 22 nt, Bordetella pertussis
cggcguggccugcccgucgggc

SEQ ID NO: 410609 - RNA, 14 nt, Bordetella pertussis
cggcguggcgcgca

SEQ ID NO: 410610 - RNA, 16 nt, Bordetella pertussis
cggcguggcgcgcaac

SEQ ID NO: 410611 - RNA, 15 nt, Bordetella pertussis
cggcguggcgcgccc

SEQ ID NO: 410612 - RNA, 19 nt, Bordetella pertussis
cggcguggcggccaggccg

SEQ ID NO: 410613 - RNA, 13 nt, Bordetella pertussis
cggcguggcgggg

SEQ ID NO: 410614 - RNA, 23 nt, Bordetella pertussis
cggcguggcgccgaaggcggcgc

SEQ ID NO: 410615 - RNA, 15 nt, Bordetella pertussis
cggcguggggccggc

SEQ ID NO: 410616 - RNA, 18 nt, Bordetella pertussis
cggcguggggccggccgc

SEQ ID NO: 410617 - RNA, 19 nt, Bordetella pertussis
cggcguggggccggccgcg

SEQ ID NO: 410618 - RNA, 20 nt, Bordetella pertussis
cggcgugguaucgcgccagc

SEQ ID NO: 410619 - RNA, 23 nt, Bordetella pertussis
cggcgugguaucgcgccagcgcc

SEQ ID NO: 410620 - RNA, 22 nt, Bordetella pertussis
cggcguguccagcggcgccagc

SEQ ID NO: 410621 - RNA, 19 nt, Bordetella pertussis
cggcgugugcccagcacca

SEQ ID NO: 410622 - RNA, 19 nt, Bordetella pertussis
cggcguguucagcgcgcgc

SEQ ID NO: 410623 - RNA, 14 nt, Bordetella pertussis
cggcguuccuggcg

SEQ ID NO: 410624 - RNA, 15 nt, Bordetella pertussis
cggcguuccuggcgc

SEQ ID NO: 410625 - RNA, 15 nt, Bordetella pertussis
cggcguuccugggca

SEQ ID NO: 410626 - RNA, 20 nt, Bordetella pertussis
cggcguucuucagcgcgcuc

SEQ ID NO: 410627 - RNA, 15 nt, Bordetella pertussis
cggcguugaccuggu

SEQ ID NO: 410628 - RNA, 16 nt, Bordetella pertussis
cggcguugcggcagcg

SEQ ID NO: 410629 - RNA, 23 nt, Bordetella pertussis
cggcguuggccgggucgcgcagc

SEQ ID NO: 410630 - RNA, 24 nt, Bordetella pertussis
cggcguuggccgggucgcgcagca

SEQ ID NO: 410631 - RNA, 15 nt, Bordetella pertussis
cggcuacacccugcu

SEQ ID NO: 410632 - RNA, 15 nt, Bordetella pertussis
cggcuaggcgcagca

SEQ ID NO: 410633 - RNA, 15 nt, Bordetella pertussis
cggcuauccgcgggu

SEQ ID NO: 410634 - RNA, 13 nt, Bordetella pertussis
cggcucagccccc

SEQ ID NO: 410635 - RNA, 12 nt, Bordetella pertussis
cggcucaggcca

SEQ ID NO: 410636 - RNA, 14 nt, Bordetella pertussis
cggcuccaggccgc

SEQ ID NO: 410637 - RNA, 18 nt, Bordetella pertussis
cggcuccaggccgcccag

SEQ ID NO: 410638 - RNA, 19 nt, Bordetella pertussis
cggcuccaggccgcccagc

SEQ ID NO: 410639 - RNA, 16 nt, Bordetella pertussis
cggcucccgcgcugcc

SEQ ID NO: 410640 - RNA, 19 nt, Bordetella pertussis
cggcucccgcgcugccgcu

SEQ ID NO: 410641 - RNA, 18 nt, Bordetella pertussis
cggcuccgauagcggcgc

SEQ ID NO: 410642 - RNA, 18 nt, Bordetella pertussis
cggcucgagcaagggcca

SEQ ID NO: 410643 - RNA, 21 nt, Bordetella pertussis
cggcucgagcaagggccagac

SEQ ID NO: 410644 - RNA, 16 nt, Bordetella pertussis
cggcuccggccgcuuc

SEQ ID NO: 410645 - RNA, 16 nt, Bordetella pertussis
cggcucgaacaggcug

SEQ ID NO: 410646 - RNA, 13 nt, Bordetella pertussis
cggcucgccgcuc

SEQ ID NO: 410647 - RNA, 14 nt, Bordetella pertussis
cggcucgccgcgca

SEQ ID NO: 410648 - RNA, 14 nt, Bordetella pertussis
cggcucgccucccc

SEQ ID NO: 410649 - RNA, 19 nt, Bordetella pertussis
cggcucgcgcucgcccggc

SEQ ID NO: 410650 - RNA, 21 nt, Bordetella pertussis
cggcucggugaugauggccag

SEQ ID NO: 410651 - RNA, 23 nt, Bordetella pertussis
cggcucguaggcgagguccaggc

SEQ ID NO: 410652 - RNA, 19 nt, Bordetella pertussis
cggcucuggaucgugccca

SEQ ID NO: 410653 - RNA, 21 nt, Bordetella pertussis
cggcucuggaucgugcccagc

SEQ ID NO: 410654 - RNA, 21 nt, Bordetella pertussis
cggcugaagaagcccggcugc

SEQ ID NO: 410655 - RNA, 22 nt, Bordetella pertussis
cggcugaagaagcccggcugcu

SEQ ID NO: 410656 - RNA, 17 nt, Bordetella pertussis
cggcugaucaccgccgg

SEQ ID NO: 410657 - RNA, 18 nt, Bordetella pertussis
cggcugauucucggguuu

SEQ ID NO: 410658 - RNA, 20 nt, Bordetella pertussis
cggcugcaagacgcccaggc

SEQ ID NO: 410659 - RNA, 23 nt, Bordetella pertussis
cggcugcaagacgcccaggccca

SEQ ID NO: 410660 - RNA, 16 nt, Bordetella pertussis
cggcugcccgggcugc

SEQ ID NO: 410661 - RNA, 15 nt, Bordetella pertussis
cggcugcgcggccga

SEQ ID NO: 410662 - RNA, 16 nt, Bordetella pertussis
cggcugcgggccggcg

SEQ ID NO: 410663 - RNA, 17 nt, Bordetella pertussis
cggcugcgggccggcgc

SEQ ID NO: 410664 - RNA, 18 nt, Bordetella pertussis
cggcugcgggccggcgcc

SEQ ID NO: 410665 - RNA, 22 nt, Bordetella pertussis
cggcugcgggcgcaagccagca

SEQ ID NO: 410666 - RNA, 21 nt, Bordetella pertussis
cggcugcucguucugcgcgcc

SEQ ID NO: 410667 - RNA, 18 nt, Bordetella pertussis
cggcuggccacuggccgc

SEQ ID NO: 410668 - RNA, 22 nt, Bordetella pertussis
cggcuggccgucgaacuccucg

SEQ ID NO: 410669 - RNA, 23 nt, Bordetella pertussis
cggcuggccgucgaacuccucga

SEQ ID NO: 410670 - RNA, 13 nt, Bordetella pertussis
cggcuggccgucg

SEQ ID NO: 410671 - RNA, 13 nt, Bordetella pertussis
cggcuggcgccgu

SEQ ID NO: 410672 - RNA, 21 nt, Bordetella pertussis
cggcuggcugggcgcgccgcu

SEQ ID NO: 410673 - RNA, 13 nt, Bordetella pertussis
cggcuggucgggg

SEQ ID NO: 410674 - RNA, 16 nt, Bordetella pertussis
cggcuggugccgacgg

SEQ ID NO: 410675 - RNA, 19 nt, Bordetella pertussis
cggcuggugccgacggcgc

SEQ ID NO: 410676 - RNA, 16 nt, Bordetella pertussis
cggcuguagucgccgc

SEQ ID NO: 410677 - RNA, 17 nt, Bordetella pertussis
cggcuguagucgccgcu

SEQ ID NO: 410678 - RNA, 13 nt, Bordetella pertussis
cggcuguccaccu

SEQ ID NO: 410679 - RNA, 15 nt, Bordetella pertussis
cggcugucgggcggc

SEQ ID NO: 410680 - RNA, 17 nt, Bordetella pertussis
cggcugucgggcggcgc

SEQ ID NO: 410681 - RNA, 13 nt, Bordetella pertussis
cggcugugggccu

SEQ ID NO: 410682 - RNA, 15 nt, Bordetella pertussis
cggcuuccagcagca

SEQ ID NO: 410683 - RNA, 22 nt, Bordetella pertussis
cggcuucgaucaugcccgccac

SEQ ID NO: 410684 - RNA, 16 nt, Bordetella pertussis
cggcuucguucaagcg

SEQ ID NO: 410685 - RNA, 17 nt, Bordetella pertussis
cggcuugaccacggcca

SEQ ID NO: 410686 - RNA, 20 nt, Bordetella pertussis
cggcuugaccacggccagca

SEQ ID NO: 410687 - RNA, 22 nt, Bordetella pertussis
cggcuugaccacggccagcagc

SEQ ID NO: 410688 - RNA, 23 nt, Bordetella pertussis
cggcuugaccacggccagcagca

SEQ ID NO: 410689 - RNA, 18 nt, Bordetella pertussis
cggcuugccgcgcggcgu

SEQ ID NO: 410690 - RNA, 20 nt, Bordetella pertussis
cggcuugccgcggcgcggcc

SEQ ID NO: 410691 - RNA, 18 nt, Bordetella pertussis
cggcuugcgcgccugcug

SEQ ID NO: 410692 - RNA, 21 nt, Bordetella pertussis
cggcuugcgcgccugcugguc

SEQ ID NO: 410693 - RNA, 15 nt, Bordetella pertussis
cggcuugcgcggcgc

SEQ ID NO: 410694 - RNA, 19 nt, Bordetella pertussis
cggcuugcgcggcgcgucg

SEQ ID NO: 410695 - RNA, 14 nt, Bordetella pertussis
cggcuugccgucga

SEQ ID NO: 410696 - RNA, 20 nt, Bordetella pertussis
cggcuugcgcaagccggccg

SEQ ID NO: 410697 - RNA, 21 nt, Bordetella pertussis
cggcuugcgcaagccggccgc

SEQ ID NO: 410698 - RNA, 22 nt, Bordetella pertussis
cggcuuggccucggccggcagg

SEQ ID NO: 410699 - RNA, 21 nt, Bordetella pertussis
cggcuuguucgagcgcgcgca

SEQ ID NO: 410700 - RNA, 22 nt, Bordetella pertussis
cggcuuucgauuugcagcagca

SEQ ID NO: 410701 - RNA, 19 nt, Bordetella pertussis
cggcuuuggacaggcgugc

SEQ ID NO: 410702 - RNA, 14 nt, Bordetella pertussis
cgggaacaggcacc

SEQ ID NO: 410703 - RNA, 22 nt, Bordetella pertussis
cgggaauccgcugcgccgaggc

SEQ ID NO: 410704 - RNA, 18 nt, Bordetella pertussis
cgggaauugggcgagccc

SEQ ID NO: 410705 - RNA, 22 nt, Bordetella pertussis
cgggacaggcaccccgucgucc

SEQ ID NO: 410706 - RNA, 15 nt, Bordetella pertussis
cgggacaggcaccuu

SEQ ID NO: 410707 - RNA, 16 nt, Bordetella pertussis
cgggacaggcaucagg

SEQ ID NO: 410708 - RNA, 18 nt, Bordetella pertussis
cgggacaggcgccacagg

SEQ ID NO: 410709 - RNA, 19 nt, Bordetella pertussis
cgggaccgaacaccaccga

SEQ ID NO: 410710 - RNA, 15 nt, Bordetella pertussis
cgggacugagucguc

SEQ ID NO: 410711 - RNA, 22 nt, Bordetella pertussis
cgggacuugguuggccugggcc

SEQ ID NO: 410712 - RNA, 18 nt, Bordetella pertussis
cgggagccuguccccgcc

SEQ ID NO: 410713 - RNA, 16 nt, Bordetella pertussis
cgggagcggccagcaa

SEQ ID NO: 410714 - RNA, 13 nt, Bordetella pertussis
cgggaggaagggu

SEQ ID NO: 410715 - RNA, 20 nt, Bordetella pertussis
cgggaggaagggugcggcgc

SEQ ID NO: 410716 - RNA, 22 nt, Bordetella pertussis
cgggaggaagggugcggcgcca

SEQ ID NO: 410717 - RNA, 18 nt, Bordetella pertussis
cgggauaguccagcaccg

SEQ ID NO: 410718 - RNA, 15 nt, Bordetella pertussis
cgggauaggccucgg

SEQ ID NO: 410719 - RNA, 15 nt, Bordetella pertussis
cgggauccacgccgc

SEQ ID NO: 410720 - RNA, 21 nt, Bordetella pertussis
cgggauccgugcggcgcgcac

SEQ ID NO: 410721 - RNA, 15 nt, Bordetella pertussis
cgggaucgggcagcu

SEQ ID NO: 410722 - RNA, 23 nt, Bordetella pertussis
cgggaugccguaggugcgcgcca

SEQ ID NO: 410723 - RNA, 21 nt, Bordetella pertussis
cgggaugcugcucggccaugu

SEQ ID NO: 410724 - RNA, 16 nt, Bordetella pertussis
cgggauuucgcuggcc

SEQ ID NO: 410725 - RNA, 15 nt, Bordetella pertussis
cgggcaaagcccagc

SEQ ID NO: 410726 - RNA, 17 nt, Bordetella pertussis
cgggcaaagcccagcaa

SEQ ID NO: 410727 - RNA, 19 nt, Bordetella pertussis
cgggcaaagcccagcaagg

SEQ ID NO: 410728 - RNA, 18 nt, Bordetella pertussis
cgggcaaacggcggcagg

SEQ ID NO: 410729 - RNA, 19 nt, Bordetella pertussis
cgggcaaucggcgugcagc

SEQ ID NO: 410730 - RNA, 20 nt, Bordetella pertussis
cgggcaaucggcgugcagca

SEQ ID NO: 410731 - RNA, 23 nt, Bordetella pertussis
cgggcaaucggcgugcagcaagc

SEQ ID NO: 410732 - RNA, 16 nt, Bordetella pertussis
cgggcacaacccgccc

SEQ ID NO: 410733 - RNA, 18 nt, Bordetella pertussis
cgggcacaacccgcccgg

SEQ ID NO: 410734 - RNA, 14 nt, Bordetella pertussis
cgggcaccagcacu

SEQ ID NO: 410735 - RNA, 15 nt, Bordetella pertussis
cgggcaccagcacuu

SEQ ID NO: 410736 - RNA, 17 nt, Bordetella pertussis
cgggcaccaucucccgc

SEQ ID NO: 410737 - RNA, 19 nt, Bordetella pertussis
cgggcaccaucucccgcag

SEQ ID NO: 410738 - RNA, 13 nt, Bordetella pertussis
cgggcaccgagcc

SEQ ID NO: 410739 - RNA, 18 nt, Bordetella pertussis
cgggcacguaguacagca

SEQ ID NO: 410740 - RNA, 18 nt, Bordetella pertussis
cgggcacggccagcacca

SEQ ID NO: 410741 - RNA, 17 nt, Bordetella pertussis
cgggcacucggccaugg

SEQ ID NO: 410742 - RNA, 22 nt, Bordetella pertussis
cgggcagcaccggggcagggcg

SEQ ID NO: 410743 - RNA, 21 nt, Bordetella pertussis
cgggcagcagcagggccaggc

SEQ ID NO: 410744 - RNA, 12 nt, Bordetella pertussis
cgggcagcaugg

SEQ ID NO: 410745 - RNA, 14 nt, Bordetella pertussis
cgggcagcauggcg

SEQ ID NO: 410746 - RNA, 16 nt, Bordetella pertussis
cgggcagcccgcgcac

SEQ ID NO: 410747 - RNA, 19 nt, Bordetella pertussis
cgggcagcggcgacggcgc

SEQ ID NO: 410748 - RNA, 22 nt, Bordetella pertussis
cgggcagcggcgacggcgccug

SEQ ID NO: 410749 - RNA, 18 nt, Bordetella pertussis
cgggcagcuuggcgcgcc

SEQ ID NO: 410750 - RNA, 12 nt, Bordetella pertussis
cgggcaggagcg

SEQ ID NO: 410751 - RNA, 15 nt, Bordetella pertussis
cgggcaggauggcca

SEQ ID NO: 410752 - RNA, 14 nt, Bordetella pertussis
cgggcaggcccagc

SEQ ID NO: 410753 - RNA, 18 nt, Bordetella pertussis
cgggcaggcccagccagc

SEQ ID NO: 410754 - RNA, 18 nt, Bordetella pertussis
cgggcaggcgggccaggc

SEQ ID NO: 410755 - RNA, 20 nt, Bordetella pertussis
cgggcaggcgggccaggccg

SEQ ID NO: 410756 - RNA, 17 nt, Bordetella pertussis
cgggcaggcuccacagc

SEQ ID NO: 410757 - RNA, 13 nt, Bordetella pertussis
cgggcaggucggc

SEQ ID NO: 410758 - RNA, 14 nt, Bordetella pertussis
cgggcaggucggcc

SEQ ID NO: 410759 - RNA, 15 nt, Bordetella pertussis
cgggcaggucggcca

SEQ ID NO: 410760 - RNA, 20 nt, Bordetella pertussis
cgggcaggucggcgcggggc

SEQ ID NO: 410761 - RNA, 16 nt, Bordetella pertussis
cgggcagugcgccgga

SEQ ID NO: 410762 - RNA, 20 nt, Bordetella pertussis
cgggcaguucgggcacgccg

SEQ ID NO: 410763 - RNA, 13 nt, Bordetella pertussis
cgggcaugacgac

SEQ ID NO: 410764 - RNA, 14 nt, Bordetella pertussis
cgggcaugacgacc

SEQ ID NO: 410765 - RNA, 22 nt, Bordetella pertussis
cgggcaugcgaaagccggccuc

SEQ ID NO: 410766 - RNA, 15 nt, Bordetella pertussis
cgggcaugcgccugc

SEQ ID NO: 410767 - RNA, 22 nt, Bordetella pertussis
cgggcaugucgcggcccacggc

SEQ ID NO: 410768 - RNA, 14 nt, Bordetella pertussis
cgggccacgcgcac

SEQ ID NO: 410769 - RNA, 14 nt, Bordetella pertussis
cgggccacugcgcc

SEQ ID NO: 410770 - RNA, 15 nt, Bordetella pertussis
cgggccagccccggc

SEQ ID NO: 410771 - RNA, 19 nt, Bordetella pertussis
cgggccagccccggcgcgc

SEQ ID NO: 410772 - RNA, 20 nt, Bordetella pertussis
cgggccagcuccccgggcgu

SEQ ID NO: 410773 - RNA, 13 nt, Bordetella pertussis
cgggccagcucuu

SEQ ID NO: 410774 - RNA, 17 nt, Bordetella pertussis
cgggccaggccgaugcc

SEQ ID NO: 410775 - RNA, 18 nt, Bordetella pertussis
cgggccaugucggcuucg

SEQ ID NO: 410776 - RNA, 15 nt, Bordetella pertussis
cgggccccgcagggc

SEQ ID NO: 410777 - RNA, 18 nt, Bordetella pertussis
cgggcccgcaucgcgcgc

SEQ ID NO: 410778 - RNA, 13 nt, Bordetella pertussis
cgggcccgcgcag

SEQ ID NO: 410779 - RNA, 15 nt, Bordetella pertussis
cgggcccgcgcagac

SEQ ID NO: 410780 - RNA, 22 nt, Bordetella pertussis
cgggcccggaucauccgggccc

SEQ ID NO: 410781 - RNA, 21 nt, Bordetella pertussis
cgggcccuggcguucgcgcgc

SEQ ID NO: 410782 - RNA, 16 nt, Bordetella pertussis
cgggccgaccaggccg

SEQ ID NO: 410783 - RNA, 13 nt, Bordetella pertussis
cgggccgcagcau

SEQ ID NO: 410784 - RNA, 17 nt, Bordetella pertussis
cgggccgcagcauggcg

SEQ ID NO: 410785 - RNA, 22 nt, Bordetella pertussis
cgggccgcagcauggcgccagc

SEQ ID NO: 410786 - RNA, 17 nt, Bordetella pertussis
cgggccgccgcacagcg

SEQ ID NO: 410787 - RNA, 13 nt, Bordetella pertussis
cgggccgcgccgc

SEQ ID NO: 410788 - RNA, 22 nt, Bordetella pertussis
cgggccgcgcgcgggcgcccgc

SEQ ID NO: 410789 - RNA, 23 nt, Bordetella pertussis
cgggccgcggacgaagccuaggc

SEQ ID NO: 410790 - RNA, 18 nt, Bordetella pertussis
cgggccgcuaggccuugc

SEQ ID NO: 410791 - RNA, 20 nt, Bordetella pertussis
cgggccgcuaggccuugccg

SEQ ID NO: 410792 - RNA, 21 nt, Bordetella pertussis
cgggccgcuggucaccgcccc

SEQ ID NO: 410793 - RNA, 22 nt, Bordetella pertussis
cgggccgcuggucaccgccccg

SEQ ID NO: 410794 - RNA, 13 nt, Bordetella pertussis
cgggccggauggc

SEQ ID NO: 410795 - RNA, 19 nt, Bordetella pertussis
cgggccggcaccacgaccg

SEQ ID NO: 410796 - RNA, 15 nt, Bordetella pertussis
cgggccggcgccggu

SEQ ID NO: 410797 - RNA, 15 nt, Bordetella pertussis
cgggccggcggcagc

SEQ ID NO: 410798 - RNA, 15 nt, Bordetella pertussis
cgggccggcuacagc

SEQ ID NO: 410799 - RNA, 16 nt, Bordetella pertussis
cgggccgggcaggccg

SEQ ID NO: 410800 - RNA, 19 nt, Bordetella pertussis
cgggccgucgccgcgcggc

SEQ ID NO: 410801 - RNA, 22 nt, Bordetella pertussis
cgggccgucgugcgccuggcgg

SEQ ID NO: 410802 - RNA, 23 nt, Bordetella pertussis
cgggccguggcgauccagggccg

SEQ ID NO: 410803 - RNA, 18 nt, Bordetella pertussis
cgggccguugcgccugcc

SEQ ID NO: 410804 - RNA, 19 nt, Bordetella pertussis
cgggccuacugggccagau

SEQ ID NO: 410805 - RNA, 14 nt, Bordetella pertussis
cgggccuagcccgg

SEQ ID NO: 410806 - RNA, 15 nt, Bordetella pertussis
cgggccuagcccggc

SEQ ID NO: 410807 - RNA, 16 nt, Bordetella pertussis
cgggccuagcccggcg

SEQ ID NO: 410808 - RNA, 20 nt, Bordetella pertussis
cgggccucaaucgaugaugu

SEQ ID NO: 410809 - RNA, 22 nt, Bordetella pertussis
cgggccucgaagcccggcaggg

SEQ ID NO: 410810 - RNA, 15 nt, Bordetella pertussis
cgggccugcagcaug

SEQ ID NO: 410811 - RNA, 12 nt, Bordetella pertussis
cgggccugcagu

SEQ ID NO: 410812 - RNA, 13 nt, Bordetella pertussis
cgggccugccgcg

SEQ ID NO: 410813 - RNA, 16 nt, Bordetella pertussis
cgggccuggccugcgc

SEQ ID NO: 410814 - RNA, 20 nt, Bordetella pertussis
cgggccuggccugcgccgcc

SEQ ID NO: 410815 - RNA, 15 nt, Bordetella pertussis
cgggccuggcguucg

SEQ ID NO: 410816 - RNA, 17 nt, Bordetella pertussis
cgggcgaccccggaggg

SEQ ID NO: 410817 - RNA, 13 nt, Bordetella pertussis
cgggcgagggcug

SEQ ID NO: 410818 - RNA, 19 nt, Bordetella pertussis
cgggcgaggucagcccggc

SEQ ID NO: 410819 - RNA, 21 nt, Bordetella pertussis
cgggcgaggucagcccggcgg

SEQ ID NO: 410820 - RNA, 23 nt, Bordetella pertussis
cgggcgauauccaucggcgcgcg

SEQ ID NO: 410821 - RNA, 18 nt, Bordetella pertussis
cgggcgauuugccgcagc

SEQ ID NO: 410822 - RNA, 20 nt, Bordetella pertussis
cgggcgauuugccgcagccc

SEQ ID NO: 410823 - RNA, 18 nt, Bordetella pertussis
cgggcgcaaguguggcgc

SEQ ID NO: 410824 - RNA, 16 nt, Bordetella pertussis
cgggcgcagcgccgcu

SEQ ID NO: 410825 - RNA, 18 nt, Bordetella pertussis
cgggcgcagcgccgcuuc

SEQ ID NO: 410826 - RNA, 14 nt, Bordetella pertussis
cgggcgccaggcug

SEQ ID NO: 410827 - RNA, 23 nt, Bordetella pertussis
cgggcgccgauccagcccaccgc

SEQ ID NO: 410828 - RNA, 14 nt, Bordetella pertussis
cgggcgccgcgccc

SEQ ID NO: 410829 - RNA, 17 nt, Bordetella pertussis
cgggcgccggcacgacg

SEQ ID NO: 410830 - RNA, 20 nt, Bordetella pertussis
cgggcgccucguccugcagg

SEQ ID NO: 410831 - RNA, 22 nt, Bordetella pertussis
cgggcgccucguccugcaggcg

SEQ ID NO: 410832 - RNA, 15 nt, Bordetella pertussis
cgggcgccugcgcca

SEQ ID NO: 410833 - RNA, 23 nt, Bordetella pertussis
cgggcgccugcgccaccuggcgc

SEQ ID NO: 410834 - RNA, 14 nt, Bordetella pertussis
cgggcgccugcggc

SEQ ID NO: 410835 - RNA, 15 nt, Bordetella pertussis
cgggcgcgcccggcg

SEQ ID NO: 410836 - RNA, 17 nt, Bordetella pertussis
cgggcgcgcccggcgcg

SEQ ID NO: 410837 - RNA, 21 nt, Bordetella pertussis
cgggcgcgccgucgcuggggc

SEQ ID NO: 410838 - RNA, 13 nt, Bordetella pertussis
cgggcgcgcgccg

SEQ ID NO: 410839 - RNA, 15 nt, Bordetella pertussis
cgggcgcgcgccggc

SEQ ID NO: 410840 - RNA, 16 nt, Bordetella pertussis
cgggcgcgcgccggcg

SEQ ID NO: 410841 - RNA, 23 nt, Bordetella pertussis
cgggcgcgcgccggcggccugca

SEQ ID NO: 410842 - RNA, 13 nt, Bordetella pertussis
cgggcgcgcugcc

SEQ ID NO: 410843 - RNA, 19 nt, Bordetella pertussis
cgggcgcgcugcccagcca

SEQ ID NO: 410844 - RNA, 15 nt, Bordetella pertussis
cgggcgcggcaggcg

SEQ ID NO: 410845 - RNA, 15 nt, Bordetella pertussis
cgggcgcggcccggc

SEQ ID NO: 410846 - RNA, 16 nt, Bordetella pertussis
cgggcgcggcccggcg

SEQ ID NO: 410847 - RNA, 17 nt, Bordetella pertussis
cgggcgcggccgccgcc

SEQ ID NO: 410848 - RNA, 16 nt, Bordetella pertussis
cgggcgcgggcugucg

SEQ ID NO: 410849 - RNA, 20 nt, Bordetella pertussis
cgggcgcguggcccgcgccg

SEQ ID NO: 410850 - RNA, 19 nt, Bordetella pertussis
cgggcgcugacgccgaugu

SEQ ID NO: 410851 - RNA, 18 nt, Bordetella pertussis
cgggcgcugccugccggc

SEQ ID NO: 410852 - RNA, 13 nt, Bordetella pertussis
cgggcggcccggc

SEQ ID NO: 410853 - RNA, 14 nt, Bordetella pertussis
cgggcggcccggcg

SEQ ID NO: 410854 - RNA, 15 nt, Bordetella pertussis
cgggcggcccggcgg

SEQ ID NO: 410855 - RNA, 14 nt, Bordetella pertussis
cgggcggccggcgc

SEQ ID NO: 410856 - RNA, 19 nt, Bordetella pertussis
cgggcggccugggaggcgc

SEQ ID NO: 410857 - RNA, 21 nt, Bordetella pertussis
cgggcggccugggaggcgcug

SEQ ID NO: 410858 - RNA, 14 nt, Bordetella pertussis
cgggcggcgccagc

SEQ ID NO: 410859 - RNA, 14 nt, Bordetella pertussis
cgggcggcgccggc

SEQ ID NO: 410860 - RNA, 14 nt, Bordetella pertussis
cgggcggcgcgccc

SEQ ID NO: 410861 - RNA, 17 nt, Bordetella pertussis
cgggcggcgcgcccagc

SEQ ID NO: 410862 - RNA, 15 nt, Bordetella pertussis
cgggcggcugccagu

SEQ ID NO: 410863 - RNA, 16 nt, Bordetella pertussis
cgggcggcugcccggg

SEQ ID NO: 410864 - RNA, 17 nt, Bordetella pertussis
cgggcggcugcccgggc

SEQ ID NO: 410865 - RNA, 13 nt, Bordetella pertussis
cgggcgggccgcg

SEQ ID NO: 410866 - RNA, 14 nt, Bordetella pertussis
cgggcggucggcgc

SEQ ID NO: 410867 - RNA, 17 nt, Bordetella pertussis
cgggcggugcggccucg

SEQ ID NO: 410868 - RNA, 22 nt, Bordetella pertussis
cgggcggugcggccucggcggg

SEQ ID NO: 410869 - RNA, 13 nt, Bordetella pertussis
cgggcgucaugcg

SEQ ID NO: 410870 - RNA, 21 nt, Bordetella pertussis
cgggcgugaugccgaccaggc

SEQ ID NO: 410871 - RNA, 23 nt, Bordetella pertussis
cgggcguuugcccuucgcggcug

SEQ ID NO: 410872 - RNA, 22 nt, Bordetella pertussis
cgggcguuuuugcguccggcgc

SEQ ID NO: 410873 - RNA, 23 nt, Bordetella pertussis
cgggcguuuuugcguccggcgcg

SEQ ID NO: 410874 - RNA, 19 nt, Bordetella pertussis
cgggcuccucgcccgaccu

SEQ ID NO: 410875 - RNA, 18 nt, Bordetella pertussis
cgggcucgagccucacuc

SEQ ID NO: 410876 - RNA, 20 nt, Bordetella pertussis
cgggcucgagcuggcuggcc

SEQ ID NO: 410877 - RNA, 18 nt, Bordetella pertussis
cgggcucggcgccggcgg

SEQ ID NO: 410878 - RNA, 18 nt, Bordetella pertussis
cgggcugaugcaggccug

SEQ ID NO: 410879 - RNA, 15 nt, Bordetella pertussis
cgggcugcgcggguc

SEQ ID NO: 410880 - RNA, 23 nt, Bordetella pertussis
cgggcugcugcacgcgcgcgggc

SEQ ID NO: 410881 - RNA, 15 nt, Bordetella pertussis
cgggcuggccgccug

SEQ ID NO: 410882 - RNA, 20 nt, Bordetella pertussis
cgggcuggccgccugcugcg

SEQ ID NO: 410883 - RNA, 16 nt, Bordetella pertussis
cgggcugggccgaggc

SEQ ID NO: 410884 - RNA, 16 nt, Bordetella pertussis
cgggcuguucgcgcag

SEQ ID NO: 410885 - RNA, 20 nt, Bordetella pertussis
cgggcuguucgcgcagcagg

SEQ ID NO: 410886 - RNA, 20 nt, Bordetella pertussis
cgggcuugcugccccccgag

SEQ ID NO: 410887 - RNA, 22 nt, Bordetella pertussis
cgggcuuucggucucgcgcggc

SEQ ID NO: 410888 - RNA, 18 nt, Bordetella pertussis
cggggaaauugacggcgc

SEQ ID NO: 410889 - RNA, 19 nt, Bordetella pertussis
cggggaaauugacggcgcu

SEQ ID NO: 410890 - RNA, 18 nt, Bordetella pertussis
cggggaacaggcgcgcca

SEQ ID NO: 410891 - RNA, 22 nt, Bordetella pertussis
cggggaagccgccggcgugccc

SEQ ID NO: 410892 - RNA, 15 nt, Bordetella pertussis
cggggacaggcacac

SEQ ID NO: 410893 - RNA, 14 nt, Bordetella pertussis
cggggacaggcacc

SEQ ID NO: 410894 - RNA, 19 nt, Bordetella pertussis
cggggacaggcacccgcac

SEQ ID NO: 410895 - RNA, 15 nt, Bordetella pertussis
cggggacaggcaccg

SEQ ID NO: 410896 - RNA, 16 nt, Bordetella pertussis
cggggacaggcaccuc

SEQ ID NO: 410897 - RNA, 15 nt, Bordetella pertussis
cggggacaggcacgc

SEQ ID NO: 410898 - RNA, 17 nt, Bordetella pertussis
cggggacaggcucccgc

SEQ ID NO: 410899 - RNA, 18 nt, Bordetella pertussis
cggggacgccggcgggca

SEQ ID NO: 410900 - RNA, 15 nt, Bordetella pertussis
cggggacgggcgccc

SEQ ID NO: 410901 - RNA, 15 nt, Bordetella pertussis
cggggacuggcacca

SEQ ID NO: 410902 - RNA, 16 nt, Bordetella pertussis
cggggacuggcucccg

SEQ ID NO: 410903 - RNA, 18 nt, Bordetella pertussis
cggggauguuccggcugg

SEQ ID NO: 410904 - RNA, 14 nt, Bordetella pertussis
cggggcacccaggc

SEQ ID NO: 410905 - RNA, 23 nt, Bordetella pertussis
cggggcacccaggcgggcuggcg

SEQ ID NO: 410906 - RNA, 23 nt, Bordetella pertussis
cggggcagcgaauacggcaagca

SEQ ID NO: 410907 - RNA, 21 nt, Bordetella pertussis
cggggccacauggucgcccag

SEQ ID NO: 410908 - RNA, 22 nt, Bordetella pertussis
cggggccacauggucgcccagc

SEQ ID NO: 410909 - RNA, 21 nt, Bordetella pertussis
cggggcccgcgggcgcccggc

SEQ ID NO: 410910 - RNA, 14 nt, Bordetella pertussis
cggggccgcccagc

SEQ ID NO: 410911 - RNA, 20 nt, Bordetella pertussis
cggggccgcuucggccugcg

SEQ ID NO: 410912 - RNA, 22 nt, Bordetella pertussis
cggggccgcuucggccugcgcc

SEQ ID NO: 410913 - RNA, 15 nt, Bordetella pertussis
cggggcgagcgcagc

SEQ ID NO: 410914 - RNA, 13 nt, Bordetella pertussis
cggggcgcccagc

SEQ ID NO: 410915 - RNA, 14 nt, Bordetella pertussis
cggggcgcgagagg

SEQ ID NO: 410916 - RNA, 15 nt, Bordetella pertussis
cggggcggcgcagca

SEQ ID NO: 410917 - RNA, 20 nt, Bordetella pertussis
cggggcggcucggcccuaga

SEQ ID NO: 410918 - RNA, 13 nt, Bordetella pertussis
cggggcgggcgcg

SEQ ID NO: 410919 - RNA, 19 nt, Bordetella pertussis
cggggcguagcucagccug

SEQ ID NO: 410920 - RNA, 23 nt, Bordetella pertussis
cggggcgucgucgcgguccagca

SEQ ID NO: 410921 - RNA, 13 nt, Bordetella pertussis
cggggcgugagca

SEQ ID NO: 410922 - RNA, 17 nt, Bordetella pertussis
cggggcgugagcaggcg

SEQ ID NO: 410923 - RNA, 20 nt, Bordetella pertussis
cggggcguucgacgggcagg

SEQ ID NO: 410924 - RNA, 22 nt, Bordetella pertussis
cggggcuggcgcggcuggcgau

SEQ ID NO: 410925 - RNA, 16 nt, Bordetella pertussis
cggggcugucgcgcgc

SEQ ID NO: 410926 - RNA, 16 nt, Bordetella pertussis
cgggggacgcccgccc

SEQ ID NO: 410927 - RNA, 15 nt, Bordetella pertussis
cgggggcaggcacgc

SEQ ID NO: 410928 - RNA, 13 nt, Bordetella pertussis
cgggggcgggccc

SEQ ID NO: 410929 - RNA, 20 nt, Bordetella pertussis
cgggggcggccggggccgcc

SEQ ID NO: 410930 - RNA, 15 nt, Bordetella pertussis
cggggggcaggcugg

SEQ ID NO: 410931 - RNA, 21 nt, Bordetella pertussis
cggggguggacgccaagaccg

SEQ ID NO: 410932 - RNA, 23 nt, Bordetella pertussis
cggggguggacgccaagaccgcg

SEQ ID NO: 410933 - RNA, 22 nt, Bordetella pertussis
cggggucgaucgcaucgcggca

SEQ ID NO: 410934 - RNA, 24 nt, Bordetella pertussis
cggggucgaucgcaucgcggcagc

SEQ ID NO: 410935 - RNA, 13 nt, Bordetella pertussis
cggggucggggca

SEQ ID NO: 410936 - RNA, 15 nt, Bordetella pertussis
cggggucgucggcgc

SEQ ID NO: 410937 - RNA, 19 nt, Bordetella pertussis
cggggucuugccgcgcagc

SEQ ID NO: 410938 - RNA, 17 nt, Bordetella pertussis
cggggugccuguccccg

SEQ ID NO: 410939 - RNA, 21 nt, Bordetella pertussis
cggggugccuguccccgcgga

SEQ ID NO: 410940 - RNA, 23 nt, Bordetella pertussis
cggggugccuguccccgcgggga

SEQ ID NO: 410941 - RNA, 14 nt, Bordetella pertussis
cgggguggcacagc

SEQ ID NO: 410942 - RNA, 20 nt, Bordetella pertussis
cgggguggccggcgcgcggc

SEQ ID NO: 410943 - RNA, 13 nt, Bordetella pertussis
cgggguucuggca

SEQ ID NO: 410944 - RNA, 15 nt, Bordetella pertussis
cgggguucuggcagg

SEQ ID NO: 410945 - RNA, 20 nt, Bordetella pertussis
cggguaggcaaagcgcagca

SEQ ID NO: 410946 - RNA, 19 nt, Bordetella pertussis
cggguauucgaaggcagca

SEQ ID NO: 410947 - RNA, 16 nt, Bordetella pertussis
cgggucaaggcggggc

SEQ ID NO: 410948 - RNA, 18 nt, Bordetella pertussis
cgggucacccgccgcacc

SEQ ID NO: 410949 - RNA, 18 nt, Bordetella pertussis
cggguccacguggcgacg

SEQ ID NO: 410950 - RNA, 14 nt, Bordetella pertussis
cggguccagcacgc

SEQ ID NO: 410951 - RNA, 24 nt, Bordetella pertussis
cggguccagccccacgccgaccuc

SEQ ID NO: 410952 - RNA, 21 nt, Bordetella pertussis
cgggucccaaccagggccgcc

SEQ ID NO: 410953 - RNA, 12 nt, Bordetella pertussis
cgggucgcgcag

SEQ ID NO: 410954 - RNA, 22 nt, Bordetella pertussis
cgggucgucccagcgcacgcag

SEQ ID NO: 410955 - RNA, 14 nt, Bordetella pertussis
cgggucgucgggcg

SEQ ID NO: 410956 - RNA, 17 nt, Bordetella pertussis
cgggucgucgggcggcg

SEQ ID NO: 410957 - RNA, 17 nt, Bordetella pertussis
cgggucguuggucgggu

SEQ ID NO: 410958 - RNA, 21 nt, Bordetella pertussis
cgggucuugagcggcccgggc

SEQ ID NO: 410959 - RNA, 17 nt, Bordetella pertussis
cgggugaggggccagcc

SEQ ID NO: 410960 - RNA, 22 nt, Bordetella pertussis
cgggugccuguccccacagggg

SEQ ID NO: 410961 - RNA, 18 nt, Bordetella pertussis
cgggugccuguccccgcc

SEQ ID NO: 410962 - RNA, 14 nt, Bordetella pertussis
cgggugcgcagcac

SEQ ID NO: 410963 - RNA, 22 nt, Bordetella pertussis
cgggugcgggcaaacggcggca

SEQ ID NO: 410964 - RNA, 18 nt, Bordetella pertussis
cgggugcggcgccugcgu

SEQ ID NO: 410965 - RNA, 16 nt, Bordetella pertussis
cggguggccucgcccu

SEQ ID NO: 410966 - RNA, 21 nt, Bordetella pertussis
cggguggugcugcucaacggc

SEQ ID NO: 410967 - RNA, 22 nt, Bordetella pertussis
cggguucggcgguuccagccug

SEQ ID NO: 410968 - RNA, 20 nt, Bordetella pertussis
cggguugcgcgccagcucgc

SEQ ID NO: 410969 - RNA, 21 nt, Bordetella pertussis
cggguugcgcgccagcucgcg

SEQ ID NO: 410970 - RNA, 15 nt, Bordetella pertussis
cggguugcggcagcg

SEQ ID NO: 410971 - RNA, 20 nt, Bordetella pertussis
cggguugcggcagcgccgca

SEQ ID NO: 410972 - RNA, 23 nt, Bordetella pertussis
cggguugccgggauccacgccgc

SEQ ID NO: 410973 - RNA, 17 nt, Bordetella pertussis
cggguuggcguccaggc

SEQ ID NO: 410974 - RNA, 22 nt, Bordetella pertussis
cggguuuccagcccguggacga

SEQ ID NO: 410975 - RNA, 17 nt, Bordetella pertussis
cggguuucggcaucucg

SEQ ID NO: 410976 - RNA, 18 nt, Bordetella pertussis
cgguaaccggcgauaacu

SEQ ID NO: 410977 - RNA, 12 nt, Bordetella pertussis
cgguacaggucg

SEQ ID NO: 410978 - RNA, 13 nt, Bordetella pertussis
cgguacgcccagc

SEQ ID NO: 410979 - RNA, 15 nt, Bordetella pertussis
cgguagcgcaagcag

SEQ ID NO: 410980 - RNA, 20 nt, Bordetella pertussis
cgguagcgcugggcgccagc

SEQ ID NO: 410981 - RNA, 20 nt, Bordetella pertussis
cgguaggcgcccgacggcgc

SEQ ID NO: 410982 - RNA, 15 nt, Bordetella pertussis
cgguaguucagcagc

SEQ ID NO: 410983 - RNA, 18 nt, Bordetella pertussis
cgguaguucagcagcgcc

SEQ ID NO: 410984 - RNA, 14 nt, Bordetella pertussis
cgguauccaggucg

SEQ ID NO: 410985 - RNA, 14 nt, Bordetella pertussis
cgguaucgcggcgc

SEQ ID NO: 410986 - RNA, 21 nt, Bordetella pertussis
cgguaucuguccccgcgggga

SEQ ID NO: 410987 - RNA, 14 nt, Bordetella pertussis
cgguaugccugcca

SEQ ID NO: 410988 - RNA, 22 nt, Bordetella pertussis
cgguauugcgccaccccgccgc

SEQ ID NO: 410989 - RNA, 18 nt, Bordetella pertussis
cggucaccgcgcccaggg

SEQ ID NO: 410990 - RNA, 20 nt, Bordetella pertussis
cggucacgccgaugaccagg

SEQ ID NO: 410991 - RNA, 20 nt, Bordetella pertussis
cggucacgcugguggccacc

SEQ ID NO: 410992 - RNA, 20 nt, Bordetella pertussis
cggucacguucagcgccggc

SEQ ID NO: 410993 - RNA, 20 nt, Bordetella pertussis
cggucagcaaccccagcagc

SEQ ID NO: 410994 - RNA, 23 nt, Bordetella pertussis
cggucagcaaccccagcagcgcc

SEQ ID NO: 410995 - RNA, 20 nt, Bordetella pertussis
cggucagcacuugccggccg

SEQ ID NO: 410996 - RNA, 12 nt, Bordetella pertussis
cggucagcaggg

SEQ ID NO: 410997 - RNA, 12 nt, Bordetella pertussis
cggucagcauga

SEQ ID NO: 410998 - RNA, 14 nt, Bordetella pertussis
cggucagcccaggc

SEQ ID NO: 410999 - RNA, 15 nt, Bordetella pertussis
cggucagcccaggcg

SEQ ID NO: 411000 - RNA, 21 nt, Bordetella pertussis
cggucagccugauucccaggc

SEQ ID NO: 411001 - RNA, 14 nt, Bordetella pertussis
cggucagcgccagg

SEQ ID NO: 411002 - RNA, 18 nt, Bordetella pertussis
cggucagcucgucgccgc

SEQ ID NO: 411003 - RNA, 18 nt, Bordetella pertussis
cggucagcuggaacgcgc

SEQ ID NO: 411004 - RNA, 15 nt, Bordetella pertussis
cggucagcuugccgc

SEQ ID NO: 411005 - RNA, 17 nt, Bordetella pertussis
cggucagcuugccgccc

SEQ ID NO: 411006 - RNA, 20 nt, Bordetella pertussis
cggucagcuugccgcccagg

SEQ ID NO: 411007 - RNA, 20 nt, Bordetella pertussis
cggucaggaugcgcgccagg

SEQ ID NO: 411008 - RNA, 19 nt, Bordetella pertussis
cggucagucgggacggcgc

SEQ ID NO: 411009 - RNA, 19 nt, Bordetella pertussis
cggucauagacggcgucgg

SEQ ID NO: 411010 - RNA, 20 nt, Bordetella pertussis
cggucaugagcgucaugucc

SEQ ID NO: 411011 - RNA, 18 nt, Bordetella pertussis
cgguccacagcccggccc

SEQ ID NO: 411012 - RNA, 16 nt, Bordetella pertussis
cgguccacgcccuggc

SEQ ID NO: 411013 - RNA, 18 nt, Bordetella pertussis
cgguccagcaccagggcg

SEQ ID NO: 411014 - RNA, 17 nt, Bordetella pertussis
cgguccagccccugccc

SEQ ID NO: 411015 - RNA, 20 nt, Bordetella pertussis
cgguccagcugcgcgcgagc

SEQ ID NO: 411016 - RNA, 16 nt, Bordetella pertussis
cgguccgcucgaggcc

SEQ ID NO: 411017 - RNA, 20 nt, Bordetella pertussis
cgguccgcucgaggccaggc

SEQ ID NO: 411018 - RNA, 15 nt, Bordetella pertussis
cgguccugcugaucc

SEQ ID NO: 411019 - RNA, 13 nt, Bordetella pertussis
cggucgaugaagc

SEQ ID NO: 411020 - RNA, 23 nt, Bordetella pertussis
cggucgaugcgcacgcccagacu

SEQ ID NO: 411021 - RNA, 20 nt, Bordetella pertussis
cggucgauguccagcgccag

SEQ ID NO: 411022 - RNA, 22 nt, Bordetella pertussis
cggucgauguccagcgccagca

SEQ ID NO: 411023 - RNA, 23 nt, Bordetella pertussis
cggucgauguccagcgccagcag

SEQ ID NO: 411024 - RNA, 19 nt, Bordetella pertussis
cggucgcauuggccgccgc

SEQ ID NO: 411025 - RNA, 20 nt, Bordetella pertussis
cggucgccgcggucgcagac

SEQ ID NO: 411026 - RNA, 22 nt, Bordetella pertussis
cggucgccuguaucagcgccug

SEQ ID NO: 411027 - RNA, 17 nt, Bordetella pertussis
cggucgccucgaagacc

SEQ ID NO: 411028 - RNA, 21 nt, Bordetella pertussis
cggucgcggccggccugcuug

SEQ ID NO: 411029 - RNA, 17 nt, Bordetella pertussis
cggucggccgcgccgcc

SEQ ID NO: 411030 - RNA, 18 nt, Bordetella pertussis
cggucggccgcgccgccg

SEQ ID NO: 411031 - RNA, 15 nt, Bordetella pertussis
cggucggccggcagc

SEQ ID NO: 411032 - RNA, 22 nt, Bordetella pertussis
cggucguagcguucgccgucga

SEQ ID NO: 411033 - RNA, 21 nt, Bordetella pertussis
cggucguccccaauacccgcc

SEQ ID NO: 411034 - RNA, 15 nt, Bordetella pertussis
cggucguggcugacc

SEQ ID NO: 411035 - RNA, 12 nt, Bordetella pertussis
cggucugcaccu

SEQ ID NO: 411036 - RNA, 17 nt, Bordetella pertussis
cggucugcacgccgggc

SEQ ID NO: 411037 - RNA, 19 nt, Bordetella pertussis
cggucugcgugcgcggcgu

SEQ ID NO: 411038 - RNA, 15 nt, Bordetella pertussis
cggucuggcccacgc

SEQ ID NO: 411039 - RNA, 15 nt, Bordetella pertussis
cggucugggccaugc

SEQ ID NO: 411040 - RNA, 15 nt, Bordetella pertussis
cggugaaggccacgc

SEQ ID NO: 411041 - RNA, 23 nt, Bordetella pertussis
cggugaaggcgcccgggcugccg

SEQ ID NO: 411042 - RNA, 13 nt, Bordetella pertussis
cggugaccaccag

SEQ ID NO: 411043 - RNA, 19 nt, Bordetella pertussis
cggugaccggguggcugcg

SEQ ID NO: 411044 - RNA, 21 nt, Bordetella pertussis
cggugacggcguagccgaucu

SEQ ID NO: 411045 - RNA, 21 nt, Bordetella pertussis
cggugagcaagcgcuggaugg

SEQ ID NO: 411046 - RNA, 13 nt, Bordetella pertussis
cggugagcggcac

SEQ ID NO: 411047 - RNA, 19 nt, Bordetella pertussis
cggugaucagcaggcccac

SEQ ID NO: 411048 - RNA, 14 nt, Bordetella pertussis
cggugaucuugccg

SEQ ID NO: 411049 - RNA, 18 nt, Bordetella pertussis
cggugaugcggcgcgccg

SEQ ID NO: 411050 - RNA, 15 nt, Bordetella pertussis
cggugaugcucugcc

SEQ ID NO: 411051 - RNA, 19 nt, Bordetella pertussis
cggugcaccaggccacccg

SEQ ID NO: 411052 - RNA, 18 nt, Bordetella pertussis
cggugcagcccagcacca

SEQ ID NO: 411053 - RNA, 19 nt, Bordetella pertussis
cggugcagccgccgcaggc

SEQ ID NO: 411054 - RNA, 16 nt, Bordetella pertussis
cggugcagcguggcgc

SEQ ID NO: 411055 - RNA, 18 nt, Bordetella pertussis
cggugcaucggccggcgg

SEQ ID NO: 411056 - RNA, 22 nt, Bordetella pertussis
cggugcaucucggcaucggcca

SEQ ID NO: 411057 - RNA, 17 nt, Bordetella pertussis
cggugccagucccccgc

SEQ ID NO: 411058 - RNA, 19 nt, Bordetella pertussis
cggugccgccuggccagau

SEQ ID NO: 411059 - RNA, 12 nt, Bordetella pertussis
cggugccgcgca

SEQ ID NO: 411060 - RNA, 12 nt, Bordetella pertussis
cggugccgcgcg

SEQ ID NO: 411061 - RNA, 13 nt, Bordetella pertussis
cggugccgcgcgc

SEQ ID NO: 411062 - RNA, 14 nt, Bordetella pertussis
cggugccgcgcgcu

SEQ ID NO: 411063 - RNA, 15 nt, Bordetella pertussis
cggugccgcgcgcuu

SEQ ID NO: 411064 - RNA, 16 nt, Bordetella pertussis
cggugccuguccccac

SEQ ID NO: 411065 - RNA, 13 nt, Bordetella pertussis
cggugccugugcc

SEQ ID NO: 411066 - RNA, 16 nt, Bordetella pertussis
cggugccugugcccgc

SEQ ID NO: 411067 - RNA, 16 nt, Bordetella pertussis
cggugccuugcggcgc

SEQ ID NO: 411068 - RNA, 15 nt, Bordetella pertussis
cggugcgcaccaggc

SEQ ID NO: 411069 - RNA, 14 nt, Bordetella pertussis
cggugcgcagcacc

SEQ ID NO: 411070 - RNA, 15 nt, Bordetella pertussis
cggugcgcagcacca

SEQ ID NO: 411071 - RNA, 21 nt, Bordetella pertussis
cggugcgcagcaccagcaugu

SEQ ID NO: 411072 - RNA, 15 nt, Bordetella pertussis
cggugcgccgccgcc

SEQ ID NO: 411073 - RNA, 17 nt, Bordetella pertussis
cggugcgccgccgccgc

SEQ ID NO: 411074 - RNA, 15 nt, Bordetella pertussis
cggugcgcggcgccc

SEQ ID NO: 411075 - RNA, 14 nt, Bordetella pertussis
cggugcgcgcggcc

SEQ ID NO: 411076 - RNA, 12 nt, Bordetella pertussis
cggugcgggccg

SEQ ID NO: 411077 - RNA, 19 nt, Bordetella pertussis
cggugcgugcgcccauggc

SEQ ID NO: 411078 - RNA, 19 nt, Bordetella pertussis
cggugcucuggcccgccuc

SEQ ID NO: 411079 - RNA, 16 nt, Bordetella pertussis
cgguggaccagggcac

SEQ ID NO: 411080 - RNA, 16 nt, Bordetella pertussis
cgguggacggccagca

SEQ ID NO: 411081 - RNA, 16 nt, Bordetella pertussis
cgguggccgccgcgcg

SEQ ID NO: 411082 - RNA, 17 nt, Bordetella pertussis
cgguggccgccgcgcgc

SEQ ID NO: 411083 - RNA, 18 nt, Bordetella pertussis
cgguggccgccgcgcgcc

SEQ ID NO: 411084 - RNA, 20 nt, Bordetella pertussis
cgguggccgccgcgcgccgc

SEQ ID NO: 411085 - RNA, 13 nt, Bordetella pertussis
cgguggccgcgca

SEQ ID NO: 411086 - RNA, 22 nt, Bordetella pertussis
cgguggccuuguacaggcacuc

SEQ ID NO: 411087 - RNA, 12 nt, Bordetella pertussis
cgguggcgcgca

SEQ ID NO: 411088 - RNA, 14 nt, Bordetella pertussis
cggugggcagcagc

SEQ ID NO: 411089 - RNA, 19 nt, Bordetella pertussis
cggugggauaaggcgugcc

SEQ ID NO: 411090 - RNA, 22 nt, Bordetella pertussis
cgguggggcaggucgccagcag

SEQ ID NO: 411091 - RNA, 22 nt, Bordetella pertussis
cgguggguguggccaugcacca

SEQ ID NO: 411092 - RNA, 12 nt, Bordetella pertussis
cgguggucgggc

SEQ ID NO: 411093 - RNA, 22 nt, Bordetella pertussis
cgguggugucgaacagcgagac

SEQ ID NO: 411094 - RNA, 18 nt, Bordetella pertussis
cgguggugucggcggcca

SEQ ID NO: 411095 - RNA, 16 nt, Bordetella pertussis
cgguguagaccaccag

SEQ ID NO: 411096 - RNA, 13 nt, Bordetella pertussis
cgguucagaacgc

SEQ ID NO: 411097 - RNA, 20 nt, Bordetella pertussis
cgguucagcgcgccagcgcg

SEQ ID NO: 411098 - RNA, 21 nt, Bordetella pertussis
cgguucagcgcgccagcgcgc

SEQ ID NO: 411099 - RNA, 23 nt, Bordetella pertussis
cgguucgaugaccugggccuggu

SEQ ID NO: 411100 - RNA, 16 nt, Bordetella pertussis
cgguucggcgcggcgc

SEQ ID NO: 411101 - RNA, 16 nt, Bordetella pertussis
cgguucgucagggccg

SEQ ID NO: 411102 - RNA, 21 nt, Bordetella pertussis
cgguucgugccgggcagcauc

SEQ ID NO: 411103 - RNA, 16 nt, Bordetella pertussis
cgguugcagcgcgcca

SEQ ID NO: 411104 - RNA, 19 nt, Bordetella pertussis
cgguugcagcgcgccaggc

SEQ ID NO: 411105 - RNA, 20 nt, Bordetella pertussis
cgguugcgaggcggccuuga

SEQ ID NO: 411106 - RNA, 16 nt, Bordetella pertussis
cgguugcgcugcuguc

SEQ ID NO: 411107 - RNA, 20 nt, Bordetella pertussis
cgguugguuugcggcgcgac

SEQ ID NO: 411108 - RNA, 20 nt, Bordetella pertussis
cgguuucccgaugcuccggg

SEQ ID NO: 411109 - RNA, 23 nt, Bordetella pertussis
cgguuucggccugcaggcccagc

SEQ ID NO: 411110 - RNA, 17 nt, Bordetella pertussis
cguaaagaugcgcgccg

SEQ ID NO: 411111 - RNA, 16 nt, Bordetella pertussis
cguaagcaggucugca

SEQ ID NO: 411112 - RNA, 14 nt, Bordetella pertussis
cguaagcccacuca

SEQ ID NO: 411113 - RNA, 17 nt, Bordetella pertussis
cguaagcccacucacgc

SEQ ID NO: 411114 - RNA, 13 nt, Bordetella pertussis
cguaagcgcugga

SEQ ID NO: 411115 - RNA, 14 nt, Bordetella pertussis
cguaagugcccagg

SEQ ID NO: 411116 - RNA, 15 nt, Bordetella pertussis
cguaagugcccaggc

SEQ ID NO: 411117 - RNA, 16 nt, Bordetella pertussis
cguaauccaggcaaca

SEQ ID NO: 411118 - RNA, 20 nt, Bordetella pertussis
cguagcgcguggccagcacg

SEQ ID NO: 411119 - RNA, 13 nt, Bordetella pertussis
cguagcgcugcag

SEQ ID NO: 411120 - RNA, 12 nt, Bordetella pertussis
cguagcucagcc

SEQ ID NO: 411121 - RNA, 13 nt, Bordetella pertussis
cguaguccagcag

SEQ ID NO: 411122 - RNA, 14 nt, Bordetella pertussis
cguaguccagcagc

SEQ ID NO: 411123 - RNA, 17 nt, Bordetella pertussis
cguaguccgagcccggg

SEQ ID NO: 411124 - RNA, 15 nt, Bordetella pertussis
cguagucgagccagg

SEQ ID NO: 411125 - RNA, 17 nt, Bordetella pertussis
cguaguucagccacacg

SEQ ID NO: 411126 - RNA, 14 nt, Bordetella pertussis
cguaugcggcagca

SEQ ID NO: 411127 - RNA, 21 nt, Bordetella pertussis
cguauggcccgccaccacggc

SEQ ID NO: 411128 - RNA, 16 nt, Bordetella pertussis
cgucaacagcauggac

SEQ ID NO: 411129 - RNA, 19 nt, Bordetella pertussis
cgucaacccgucgacgcag

SEQ ID NO: 411130 - RNA, 15 nt, Bordetella pertussis
cgucaacgcccaggu

SEQ ID NO: 411131 - RNA, 15 nt, Bordetella pertussis
cgucaagccagcggc

SEQ ID NO: 411132 - RNA, 12 nt, Bordetella pertussis
cgucaccagcag

SEQ ID NO: 411133 - RNA, 14 nt, Bordetella pertussis
cgucaccaucgccg

SEQ ID NO: 411134 - RNA, 14 nt, Bordetella pertussis
cgucaccccgcccu

SEQ ID NO: 411135 - RNA, 15 nt, Bordetella pertussis
cgucacgcgcuggua

SEQ ID NO: 411136 - RNA, 18 nt, Bordetella pertussis
cgucacggcaagacggcg

SEQ ID NO: 411137 - RNA, 16 nt, Bordetella pertussis
cgucagcagcgcggcg

SEQ ID NO: 411138 - RNA, 20 nt, Bordetella pertussis
cgucagcgcaaacgggggca

SEQ ID NO: 411139 - RNA, 16 nt, Bordetella pertussis
cgucagcggcgcgccc

SEQ ID NO: 411140 - RNA, 20 nt, Bordetella pertussis
cgucaguccguggcgcggcc

SEQ ID NO: 411141 - RNA, 18 nt, Bordetella pertussis
cgucaguugggcgcgccc

SEQ ID NO: 411142 - RNA, 15 nt, Bordetella pertussis
cgucaguugaagacg

SEQ ID NO: 411143 - RNA, 19 nt, Bordetella pertussis
cgucaguugaagacgccgg

SEQ ID NO: 411144 - RNA, 15 nt, Bordetella pertussis
cguccagccgcccgu

SEQ ID NO: 411145 - RNA, 18 nt, Bordetella pertussis
cguccagccugcccgggc

SEQ ID NO: 411146 - RNA, 17 nt, Bordetella pertussis
cguccagcgccaccagc

SEQ ID NO: 411147 - RNA, 13 nt, Bordetella pertussis
cguccagcgcggc

SEQ ID NO: 411148 - RNA, 14 nt, Bordetella pertussis
cguccagcgcggca

SEQ ID NO: 411149 - RNA, 13 nt, Bordetella pertussis
cguccagcggcgc

SEQ ID NO: 411150 - RNA, 15 nt, Bordetella pertussis
cguccagcgcggcgc

SEQ ID NO: 411151 - RNA, 17 nt, Bordetella pertussis
cguccagcgcggcgcca

SEQ ID NO: 411152 - RNA, 15 nt, Bordetella pertussis
cguccaggaagcagc

SEQ ID NO: 411153 - RNA, 19 nt, Bordetella pertussis
cguccaggaagcagcccag

SEQ ID NO: 411154 - RNA, 16 nt, Bordetella pertussis
cguccaggcccagcgc

SEQ ID NO: 411155 - RNA, 17 nt, Bordetella pertussis
cguccaggcccagcgcg

SEQ ID NO: 411156 - RNA, 20 nt, Bordetella pertussis
cguccaggcccagcgcgucc

SEQ ID NO: 411157 - RNA, 13 nt, Bordetella pertussis
cguccaggcgcgc

SEQ ID NO: 411158 - RNA, 17 nt, Bordetella pertussis
cguccaggcgcgccagc

SEQ ID NO: 411159 - RNA, 20 nt, Bordetella pertussis
cguccaggcgcgccagccgc

SEQ ID NO: 411160 - RNA, 19 nt, Bordetella pertussis
cguccagguugagucugga

SEQ ID NO: 411161 - RNA, 19 nt, Bordetella pertussis
cguccagguugcccgagcg

SEQ ID NO: 411162 - RNA, 22 nt, Bordetella pertussis
cguccagguugcccgagcgcga

SEQ ID NO: 411163 - RNA, 22 nt, Bordetella pertussis
cguccagucccguggcgcucau

SEQ ID NO: 411164 - RNA, 19 nt, Bordetella pertussis
cguccaucgacgcggcgac

SEQ ID NO: 411165 - RNA, 18 nt, Bordetella pertussis
cguccaucuggaccgcgc

SEQ ID NO: 411166 - RNA, 15 nt, Bordetella pertussis
cguccaugcggaggc

SEQ ID NO: 411167 - RNA, 19 nt, Bordetella pertussis
cguccaugcggaggcuuug

SEQ ID NO: 411168 - RNA, 22 nt, Bordetella pertussis
cgucccagccaaugccgcgguu

SEQ ID NO: 411169 - RNA, 22 nt, Bordetella pertussis
cgucccagggggucagggccgc

SEQ ID NO: 411170 - RNA, 15 nt, Bordetella pertussis
cgucccagucgccgc

SEQ ID NO: 411171 - RNA, 19 nt, Bordetella pertussis
cgucccagucgccgcgccc

SEQ ID NO: 411172 - RNA, 17 nt, Bordetella pertussis
cgucccccuacugcccu

SEQ ID NO: 411173 - RNA, 14 nt, Bordetella pertussis
cguccgcgcgccgc

SEQ ID NO: 411174 - RNA, 17 nt, Bordetella pertussis
cguccggcacggcggca

SEQ ID NO: 411175 - RNA, 15 nt, Bordetella pertussis
cguccggccccagga

SEQ ID NO: 411176 - RNA, 16 nt, Bordetella pertussis
cguccggggucagguu

SEQ ID NO: 411177 - RNA, 21 nt, Bordetella pertussis
cguccggugcgauagcgccgc

SEQ ID NO: 411178 - RNA, 15 nt, Bordetella pertussis
cguccguggccggcg

SEQ ID NO: 411179 - RNA, 17 nt, Bordetella pertussis
cguccguggccggcgcg

SEQ ID NO: 411180 - RNA, 18 nt, Bordetella pertussis
cguccguuucgucggcgc

SEQ ID NO: 411181 - RNA, 16 nt, Bordetella pertussis
cguccgucucgcccag

SEQ ID NO: 411182 - RNA, 17 nt, Bordetella pertussis
cguccucggcacggcca

SEQ ID NO: 411183 - RNA, 19 nt, Bordetella pertussis
cguccucggcacggccagc

SEQ ID NO: 411184 - RNA, 15 nt, Bordetella pertussis
cguccucggccagcc

SEQ ID NO: 411185 - RNA, 18 nt, Bordetella pertussis
cguccucggccagccggg

SEQ ID NO: 411186 - RNA, 22 nt, Bordetella pertussis
cguccugcaggaaggccgccgc

SEQ ID NO: 411187 - RNA, 18 nt, Bordetella pertussis
cguccugcaggcggcgca

SEQ ID NO: 411188 - RNA, 21 nt, Bordetella pertussis
cguccugccauugcgcggccu

SEQ ID NO: 411189 - RNA, 13 nt, Bordetella pertussis
cguccugccgcga

SEQ ID NO: 411190 - RNA, 20 nt, Bordetella pertussis
cguccugcggcggcagcuug

SEQ ID NO: 411191 - RNA, 21 nt, Bordetella pertussis
cguccugcggcggcagcuuga

SEQ ID NO: 411192 - RNA, 14 nt, Bordetella pertussis
cguccuggccacug

SEQ ID NO: 411193 - RNA, 19 nt, Bordetella pertussis
cguccuggcgaccggcggc

SEQ ID NO: 411194 - RNA, 16 nt, Bordetella pertussis
cguccugguggaccug

SEQ ID NO: 411195 - RNA, 23 nt, Bordetella pertussis
cguccugggccgagcgcgccagc

SEQ ID NO: 411196 - RNA, 15 nt, Bordetella pertussis
cguccuuggcggccu

SEQ ID NO: 411197 - RNA, 18 nt, Bordetella pertussis
cguccuuggcggccuugc

SEQ ID NO: 411198 - RNA, 17 nt, Bordetella pertussis
cguccuugagcgccagc

SEQ ID NO: 411199 - RNA, 15 nt, Bordetella pertussis
cgucgaacagcuucu

SEQ ID NO: 411200 - RNA, 20 nt, Bordetella pertussis
cgucgaacuccugcagcacg

SEQ ID NO: 411201 - RNA, 22 nt, Bordetella pertussis
cgucgaaggccgccggacgcag

SEQ ID NO: 411202 - RNA, 15 nt, Bordetella pertussis
cgucgaaggcgcgcu

SEQ ID NO: 411203 - RNA, 18 nt, Bordetella pertussis
cgucgaaggcggccggca

SEQ ID NO: 411204 - RNA, 22 nt, Bordetella pertussis
cgucgaauuccaguugcgcgcc

SEQ ID NO: 411205 - RNA, 23 nt, Bordetella pertussis
cgucgacagcaugaacggcagcg

SEQ ID NO: 411206 - RNA, 14 nt, Bordetella pertussis
cgucgaccaccagc

SEQ ID NO: 411207 - RNA, 14 nt, Bordetella pertussis
cgucgaccgccucg

SEQ ID NO: 411208 - RNA, 20 nt, Bordetella pertussis
cgucgaccgccucgacgccc

SEQ ID NO: 411209 - RNA, 18 nt, Bordetella pertussis
cgucgaccgcgggcgcgc

SEQ ID NO: 411210 - RNA, 18 nt, Bordetella pertussis
cgucgaccucgagcaccu

SEQ ID NO: 411211 - RNA, 18 nt, Bordetella pertussis
cgucgacguaccaagccu

SEQ ID NO: 411212 - RNA, 23 nt, Bordetella pertussis
cgucgacguaccaagccugcuua

SEQ ID NO: 411213 - RNA, 14 nt, Bordetella pertussis
cgucgagccgggcg

SEQ ID NO: 411214 - RNA, 16 nt, Bordetella pertussis
cgucgagccgggcgcc

SEQ ID NO: 411215 - RNA, 14 nt, Bordetella pertussis
cgucgagcgcggcc

SEQ ID NO: 411216 - RNA, 17 nt, Bordetella pertussis
cgucgauccggcagcag

SEQ ID NO: 411217 - RNA, 15 nt, Bordetella pertussis
cgucgaucuucgccu

SEQ ID NO: 411218 - RNA, 18 nt, Bordetella pertussis
cgucgaugaccagcgccg

SEQ ID NO: 411219 - RNA, 15 nt, Bordetella pertussis
cgucgaugcgcgcgc

SEQ ID NO: 411220 - RNA, 23 nt, Bordetella pertussis
cgucgcaaagccggaauccuggc

SEQ ID NO: 411221 - RNA, 20 nt, Bordetella pertussis
cgucgcgaaacccucccacg

SEQ ID NO: 411222 - RNA, 15 nt, Bordetella pertussis
cgucgcgaccgccgc

SEQ ID NO: 411223 - RNA, 21 nt, Bordetella pertussis
cgucgcgccaggccggcggcg

SEQ ID NO: 411224 - RNA, 21 nt, Bordetella pertussis
cgucugcccgcgguccagcac

SEQ ID NO: 411225 - RNA, 17 nt, Bordetella pertussis
cgugaaaggccagcggc

SEQ ID NO: 411226 - RNA, 16 nt, Bordetella pertussis
cgugaacuccugcaac

SEQ ID NO: 411227 - RNA, 14 nt, Bordetella pertussis
cgugaccagcugca

SEQ ID NO: 411228 - RNA, 20 nt, Bordetella pertussis
cgugaccagcugcaccaggc

SEQ ID NO: 411229 - RNA, 14 nt, Bordetella pertussis
cgugaccugcucgu

SEQ ID NO: 411230 - RNA, 17 nt, Bordetella pertussis
cgugacgauauccaggc

SEQ ID NO: 411231 - RNA, 19 nt, Bordetella pertussis
cgugacgauauccaggcgc

SEQ ID NO: 411232 - RNA, 15 nt, Bordetella pertussis
cgugacgcugacccu

SEQ ID NO: 411233 - RNA, 16 nt, Bordetella pertussis
cgugagugcagcgcuc

SEQ ID NO: 411234 - RNA, 16 nt, Bordetella pertussis
cgugauaguccacccc

SEQ ID NO: 411235 - RNA, 19 nt, Bordetella pertussis
cgugaucgaccgccagcag

SEQ ID NO: 411236 - RNA, 19 nt, Bordetella pertussis
cgugcacgcguaugcccug

SEQ ID NO: 411237 - RNA, 16 nt, Bordetella pertussis
cgugcagaagcugacc

SEQ ID NO: 411238 - RNA, 15 nt, Bordetella pertussis
cgugccacggcuucg

SEQ ID NO: 411239 - RNA, 12 nt, Bordetella pertussis
cgugccagccga

SEQ ID NO: 411240 - RNA, 14 nt, Bordetella pertussis
cgugcgcaucagcg

SEQ ID NO: 411241 - RNA, 15 nt, Bordetella pertussis
cgugcgccagcgcca

SEQ ID NO: 411242 - RNA, 14 nt, Bordetella pertussis
cgugcgccgggcgu

SEQ ID NO: 411243 - RNA, 17 nt, Bordetella pertussis
cgugcgccuguccccgc

SEQ ID NO: 411244 - RNA, 19 nt, Bordetella pertussis
cgugcgcgaccgcgcggcg

SEQ ID NO: 411245 - RNA, 21 nt, Bordetella pertussis
cgugcgcgaccgcgcggcgcu

SEQ ID NO: 411246 - RNA, 17 nt, Bordetella pertussis
cgugcgcgaccuccggc

SEQ ID NO: 411247 - RNA, 17 nt, Bordetella pertussis
cgugcgcgacgcguagc

SEQ ID NO: 411248 - RNA, 14 nt, Bordetella pertussis
cgugcgcgagcugg

SEQ ID NO: 411249 - RNA, 16 nt, Bordetella pertussis
cgugcgcgagcugguc

SEQ ID NO: 411250 - RNA, 14 nt, Bordetella pertussis
cgugcgcgggcgcg

SEQ ID NO: 411251 - RNA, 17 nt, Bordetella pertussis
cgugcgcgggcgcggca

SEQ ID NO: 411252 - RNA, 17 nt, Bordetella pertussis
cgugcgcggcgagccgc

SEQ ID NO: 411253 - RNA, 18 nt, Bordetella pertussis
cgugcgcuggcugggccu

SEQ ID NO: 411254 - RNA, 13 nt, Bordetella pertussis
cgugcggcccagc

SEQ ID NO: 411255 - RNA, 15 nt, Bordetella pertussis
cgugcggcccagccg

SEQ ID NO: 411256 - RNA, 16 nt, Bordetella pertussis
cgugcggcccagccgc

SEQ ID NO: 411257 - RNA, 15 nt, Bordetella pertussis
cgugcggccgcagca

SEQ ID NO: 411258 - RNA, 16 nt, Bordetella pertussis
cgugcggccgcagcag

SEQ ID NO: 411259 - RNA, 16 nt, Bordetella pertussis
cgugcggaugcagcag

SEQ ID NO: 411260 - RNA, 18 nt, Bordetella pertussis
cgugcggaugcagcagcg

SEQ ID NO: 411261 - RNA, 20 nt, Bordetella pertussis
cgugcggauggucgagcgcc

SEQ ID NO: 411262 - RNA, 16 nt, Bordetella pertussis
cgugcggcacgcacag

SEQ ID NO: 411263 - RNA, 18 nt, Bordetella pertussis
cgugcggcacgcacagca

SEQ ID NO: 411264 - RNA, 19 nt, Bordetella pertussis
cgugcggggaccggcaccc

SEQ ID NO: 411265 - RNA, 20 nt, Bordetella pertussis
cgugcgguucgucagggccg

SEQ ID NO: 411266 - RNA, 17 nt, Bordetella pertussis
cgugcguuucggacccg

SEQ ID NO: 411267 - RNA, 21 nt, Bordetella pertussis
cguggacgugcgcgaccgcgc

SEQ ID NO: 411268 - RNA, 11 nt, Bordetella pertussis
cguggcccagc

SEQ ID NO: 411269 - RNA, 14 nt, Bordetella pertussis
cguggcccagccgc

SEQ ID NO: 411270 - RNA, 15 nt, Bordetella pertussis
cguggcccgcgccgc

SEQ ID NO: 411271 - RNA, 16 nt, Bordetella pertussis
cguggcccgcgccgcg

SEQ ID NO: 411272 - RNA, 18 nt, Bordetella pertussis
cguggcccgcgccgcguc

SEQ ID NO: 411273 - RNA, 21 nt, Bordetella pertussis
cguggcccgcgugacggccgc

SEQ ID NO: 411274 - RNA, 14 nt, Bordetella pertussis
cguggccggcgacg

SEQ ID NO: 411275 - RNA, 17 nt, Bordetella pertussis
cguggccggcgacggca

SEQ ID NO: 411276 - RNA, 16 nt, Bordetella pertussis
cguggccggcgcggca

SEQ ID NO: 411277 - RNA, 18 nt, Bordetella pertussis
cguggccggcgcggcagc

SEQ ID NO: 411278 - RNA, 22 nt, Bordetella pertussis
cguggccggcgcggcagccugg

SEQ ID NO: 411279 - RNA, 22 nt, Bordetella pertussis
cguggccgccgggucgcugugc

SEQ ID NO: 411280 - RNA, 19 nt, Bordetella pertussis
cguggccgcuucggcggcc

SEQ ID NO: 411281 - RNA, 20 nt, Bordetella pertussis
cguggccguucggugcgcag

SEQ ID NO: 411282 - RNA, 22 nt, Bordetella pertussis
cguggccguucggugcgcagcg

SEQ ID NO: 411283 - RNA, 22 nt, Bordetella pertussis
cguggccugcuugaagacgccc

SEQ ID NO: 411284 - RNA, 13 nt, Bordetella pertussis
cguggcgacgcgc

SEQ ID NO: 411285 - RNA, 16 nt, Bordetella pertussis
cguggcgauagcgcuc

SEQ ID NO: 411286 - RNA, 22 nt, Bordetella pertussis
cguggcgauccagggccgccag

SEQ ID NO: 411287 - RNA, 18 nt, Bordetella pertussis
cguggcgccgacccugcc

SEQ ID NO: 411288 - RNA, 17 nt, Bordetella pertussis
cguggcgcgccuccagc

SEQ ID NO: 411289 - RNA, 14 nt, Bordetella pertussis
cguggcgcgcgccg

SEQ ID NO: 411290 - RNA, 15 nt, Bordetella pertussis
cguggcgcgcaccug

SEQ ID NO: 411291 - RNA, 14 nt, Bordetella pertussis
cguggcggccaggc

SEQ ID NO: 411292 - RNA, 20 nt, Bordetella pertussis
cguggcggccugcgccggca

SEQ ID NO: 411293 - RNA, 21 nt, Bordetella pertussis
cguggcggcgauguggcgcgc

SEQ ID NO: 411294 - RNA, 12 nt, Bordetella pertussis
cguggcggcgca

SEQ ID NO: 411295 - RNA, 15 nt, Bordetella pertussis
cguggcggcgcagcg

SEQ ID NO: 411296 - RNA, 12 nt, Bordetella pertussis
cguggcgggccg

SEQ ID NO: 411297 - RNA, 19 nt, Bordetella pertussis
cguggcgggccgcgccgcg

SEQ ID NO: 411298 - RNA, 21 nt, Bordetella pertussis
cguggcguaauagcuggcggc

SEQ ID NO: 411299 - RNA, 13 nt, Bordetella pertussis
cguggcgugccgc

SEQ ID NO: 411300 - RNA, 18 nt, Bordetella pertussis
cguggcguugacggccca

SEQ ID NO: 411301 - RNA, 20 nt, Bordetella pertussis
cguggcguugacggcccagc

SEQ ID NO: 411302 - RNA, 16 nt, Bordetella pertussis
cgugggacaggcaccc

SEQ ID NO: 411303 - RNA, 19 nt, Bordetella pertussis
cgugggccaguccgcagcg

SEQ ID NO: 411304 - RNA, 16 nt, Bordetella pertussis
cgugggcgaacugguc

SEQ ID NO: 411305 - RNA, 12 nt, Bordetella pertussis
cgugggcucgau

SEQ ID NO: 411306 - RNA, 17 nt, Bordetella pertussis
cguggggacaggcaccu

SEQ ID NO: 411307 - RNA, 18 nt, Bordetella pertussis
cguggggacaggcaccug

SEQ ID NO: 411308 - RNA, 14 nt, Bordetella pertussis
cguggggagcgcgg

SEQ ID NO: 411309 - RNA, 16 nt, Bordetella pertussis
cguggggagcgcggcc

SEQ ID NO: 411310 - RNA, 17 nt, Bordetella pertussis
cguggggcgcggcggcg

SEQ ID NO: 411311 - RNA, 22 nt, Bordetella pertussis
cgugguacgacgagcgcaccau

SEQ ID NO: 411312 - RNA, 21 nt, Bordetella pertussis
cgugguacguggacucgaugg

SEQ ID NO: 411313 - RNA, 22 nt, Bordetella pertussis
cgugguaucgcgccagcgccgc

SEQ ID NO: 411314 - RNA, 15 nt, Bordetella pertussis
cguggucaucgaugg

SEQ ID NO: 411315 - RNA, 20 nt, Bordetella pertussis
cguggucgacauagacgcgc

SEQ ID NO: 411316 - RNA, 15 nt, Bordetella pertussis
cguggucgcaguccc

SEQ ID NO: 411317 - RNA, 14 nt, Bordetella pertussis
cguggucgccagca

SEQ ID NO: 411318 - RNA, 16 nt, Bordetella pertussis
cguggugacccguccg

SEQ ID NO: 411319 - RNA, 23 nt, Bordetella pertussis
cguguagacggcaaucuugccgc

SEQ ID NO: 411320 - RNA, 18 nt, Bordetella pertussis
cguguagagcaggccgcc

SEQ ID NO: 411321 - RNA, 16 nt, Bordetella pertussis
cguguagcugugaacu

SEQ ID NO: 411322 - RNA, 14 nt, Bordetella pertussis
cguguccagcggcg

SEQ ID NO: 411323 - RNA, 19 nt, Bordetella pertussis
cguguccgccguagcgcgc

SEQ ID NO: 411324 - RNA, 14 nt, Bordetella pertussis
cgugucccagccgg

SEQ ID NO: 411325 - RNA, 20 nt, Bordetella pertussis
cgugucgcccuucaggccag

SEQ ID NO: 411326 - RNA, 15 nt, Bordetella pertussis
cgugucggcaaccug

SEQ ID NO: 411327 - RNA, 16 nt, Bordetella pertussis
cgugugauagcacugc

SEQ ID NO: 411328 - RNA, 18 nt, Bordetella pertussis
cgugugauagcacugcac

SEQ ID NO: 411329 - RNA, 19 nt, Bordetella pertussis
cgugugcccagcaccaggc

SEQ ID NO: 411330 - RNA, 18 nt, Bordetella pertussis
cguguggcaggccagcgc

SEQ ID NO: 411331 - RNA, 16 nt, Bordetella pertussis
cguguuccagcgccug

SEQ ID NO: 411332 - RNA, 17 nt, Bordetella pertussis
cguguucgacgcggccg

SEQ ID NO: 411333 - RNA, 16 nt, Bordetella pertussis
cguguuguccuggaca

SEQ ID NO: 411334 - RNA, 22 nt, Bordetella pertussis
cguguuguucagguuggcaacg

SEQ ID NO: 411335 - RNA, 16 nt, Bordetella pertussis
cguucaugucgcgggu

SEQ ID NO: 411336 - RNA, 21 nt, Bordetella pertussis
cguuccauuauuucggagacc

SEQ ID NO: 411337 - RNA, 15 nt, Bordetella pertussis
cguucgccgcagccg

SEQ ID NO: 411338 - RNA, 22 nt, Bordetella pertussis
cguucgccgucguugacgggga

SEQ ID NO: 411339 - RNA, 17 nt, Bordetella pertussis
cguucgcgccgcgucuu

SEQ ID NO: 411340 - RNA, 14 nt, Bordetella pertussis
cguucggccagcgc

SEQ ID NO: 411341 - RNA, 16 nt, Bordetella pertussis
cguucggccagcgcgc

SEQ ID NO: 411342 - RNA, 22 nt, Bordetella pertussis
cguucggccagcgcgcggcgca

SEQ ID NO: 411343 - RNA, 14 nt, Bordetella pertussis
cguucucgcgcuuc

SEQ ID NO: 411344 - RNA, 14 nt, Bordetella pertussis
cguucugcagcgcg

SEQ ID NO: 411345 - RNA, 18 nt, Bordetella pertussis
cguucugcgcgcccgugu

SEQ ID NO: 411346 - RNA, 15 nt, Bordetella pertussis
cguucugcguggcgg

SEQ ID NO: 411347 - RNA, 21 nt, Bordetella pertussis
cguucuggcagugcgccuggc

SEQ ID NO: 411348 - RNA, 21 nt, Bordetella pertussis
cguucuggcugcgcgccuggc

SEQ ID NO: 411349 - RNA, 15 nt, Bordetella pertussis
cguugaccggcuggc

SEQ ID NO: 411350 - RNA, 15 nt, Bordetella pertussis
cguugacggcccagc

SEQ ID NO: 411351 - RNA, 18 nt, Bordetella pertussis
cguugacggggacgccgg

SEQ ID NO: 411352 - RNA, 17 nt, Bordetella pertussis
cguugcgcgacaggccc

SEQ ID NO: 411353 - RNA, 15 nt, Bordetella pertussis
cguugcgggcugcgc

SEQ ID NO: 411354 - RNA, 16 nt, Bordetella pertussis
cguugcuccagccagg

SEQ ID NO: 411355 - RNA, 14 nt, Bordetella pertussis
cguugcugcagcgu

SEQ ID NO: 411356 - RNA, 19 nt, Bordetella pertussis
cguugcuggcaaagcgcgc

SEQ ID NO: 411357 - RNA, 18 nt, Bordetella pertussis
cguuggccaaugcgccgc

SEQ ID NO: 411358 - RNA, 22 nt, Bordetella pertussis
cguuggccugccauccggccgc

SEQ ID NO: 411359 - RNA, 23 nt, Bordetella pertussis
cguuggccugccauccggccgca

SEQ ID NO: 411360 - RNA, 17 nt, Bordetella pertussis
cguuggucagcaccucg

SEQ ID NO: 411361 - RNA, 18 nt, Bordetella pertussis
cguuggugcgcaccuugc

SEQ ID NO: 411362 - RNA, 18 nt, Bordetella pertussis
cguuuacuccccagacgc

SEQ ID NO: 411363 - RNA, 22 nt, Bordetella pertussis
cguuuacuccccagacgcagac

SEQ ID NO: 411364 - RNA, 13 nt, Bordetella pertussis
cguuuauguaguu

SEQ ID NO: 411365 - RNA, 15 nt, Bordetella pertussis
cguuugcgcgcgcgc

SEQ ID NO: 411366 - RNA, 17 nt, Bordetella pertussis
cuacgacacgcucaagg

SEQ ID NO: 411367 - RNA, 16 nt, Bordetella pertussis
cuacugggugcuggcc

SEQ ID NO: 411368 - RNA, 13 nt, Bordetella pertussis
cuaggcgcagcag

SEQ ID NO: 411369 - RNA, 20 nt, Bordetella pertussis
cuaggcgcagcaggccagga

SEQ ID NO: 411370 - RNA, 14 nt, Bordetella pertussis
cuaggugugaacug

SEQ ID NO: 411371 - RNA, 16 nt, Bordetella pertussis
cuauaccgggcugguc

SEQ ID NO: 411372 - RNA, 14 nt, Bordetella pertussis
cuaucauccgcgca

SEQ ID NO: 411373 - RNA, 22 nt, Bordetella pertussis
cuaucccaacccguuccccauc

SEQ ID NO: 411374 - RNA, 23 nt, Bordetella pertussis
cucaaccuucucgaugcgcgcca

SEQ ID NO: 411375 - RNA, 15 nt, Bordetella pertussis
cucaacuggccggcc

SEQ ID NO: 411376 - RNA, 19 nt, Bordetella pertussis
cucaagggccugucacacc

SEQ ID NO: 411377 - RNA, 20 nt, Bordetella pertussis
cucaggcggugacgcccugc

SEQ ID NO: 411378 - RNA, 13 nt, Bordetella pertussis
cucagggggcgcc

SEQ ID NO: 411379 - RNA, 22 nt, Bordetella pertussis
cucaggucgaacaggcuggugg

SEQ ID NO: 411380 - RNA, 18 nt, Bordetella pertussis
cucagucgggcagcgccc

SEQ ID NO: 411381 - RNA, 21 nt, Bordetella pertussis
cucagucgggcagcgcccgcg

SEQ ID NO: 411382 - RNA, 22 nt, Bordetella pertussis
cucauaauccguuggugccgag

SEQ ID NO: 411383 - RNA, 14 nt, Bordetella pertussis
cucauccaggcgcg

SEQ ID NO: 411384 - RNA, 18 nt, Bordetella pertussis
cucaucggcaggccggcg

SEQ ID NO: 411385 - RNA, 15 nt, Bordetella pertussis
cuccagcgccagcac

SEQ ID NO: 411386 - RNA, 18 nt, Bordetella pertussis
cuccagcgcuucgugcag

SEQ ID NO: 411387 - RNA, 22 nt, Bordetella pertussis
cuccagcgcuucgugcagcgcg

SEQ ID NO: 411388 - RNA, 22 nt, Bordetella pertussis
cuccagcgugucgaacaccagg

SEQ ID NO: 411389 - RNA, 23 nt, Bordetella pertussis
cuccagcgugucgaacaccaggu

SEQ ID NO: 411390 - RNA, 19 nt, Bordetella pertussis
cuccagcucagcagcgcca

SEQ ID NO: 411391 - RNA, 17 nt, Bordetella pertussis
cuccagcuggcgcacca

SEQ ID NO: 411392 - RNA, 19 nt, Bordetella pertussis
cuccaggaaaaccuccucc

SEQ ID NO: 411393 - RNA, 19 nt, Bordetella pertussis
cuccaggaugagcgccugc

SEQ ID NO: 411394 - RNA, 14 nt, Bordetella pertussis
cuccaggcccaggc

SEQ ID NO: 411395 - RNA, 15 nt, Bordetella pertussis
cuccaggcccaggcg

SEQ ID NO: 411396 - RNA, 22 nt, Bordetella pertussis
cuccaggcccaggcgacccagc

SEQ ID NO: 411397 - RNA, 14 nt, Bordetella pertussis
cuccaggccggcau

SEQ ID NO: 411398 - RNA, 20 nt, Bordetella pertussis
cuccaggcgcaagccuggag

SEQ ID NO: 411399 - RNA, 15 nt, Bordetella pertussis
cuccaggugccagau

SEQ ID NO: 411400 - RNA, 21 nt, Bordetella pertussis
cuccagucccgcaccgggcaa

SEQ ID NO: 411401 - RNA, 18 nt, Bordetella pertussis
cucccacgaacgccacgc

SEQ ID NO: 411402 - RNA, 14 nt, Bordetella pertussis
cucccacgaccugc

SEQ ID NO: 411403 - RNA, 13 nt, Bordetella pertussis
cucccagaccugc

SEQ ID NO: 411404 - RNA, 14 nt, Bordetella pertussis
cucccgauauauga

SEQ ID NO: 411405 - RNA, 13 nt, Bordetella pertussis
cucccgcaggccc

SEQ ID NO: 411406 - RNA, 16 nt, Bordetella pertussis
cucccgcgcugccgcu

SEQ ID NO: 411407 - RNA, 18 nt, Bordetella pertussis
cucccugugggggacagg

SEQ ID NO: 411408 - RNA, 19 nt, Bordetella pertussis
cuccgcgcacagcgcggcg

SEQ ID NO: 411409 - RNA, 16 nt, Bordetella pertussis
cuccggccgggccagc

SEQ ID NO: 411410 - RNA, 13 nt, Bordetella pertussis
cuccggcgccgcc

SEQ ID NO: 411411 - RNA, 20 nt, Bordetella pertussis
cuccucgaccugggucggaa

SEQ ID NO: 411412 - RNA, 14 nt, Bordetella pertussis
cuccucgcccgacc

SEQ ID NO: 411413 - RNA, 17 nt, Bordetella pertussis
cuccucgcgcgcggacu

SEQ ID NO: 411414 - RNA, 21 nt, Bordetella pertussis
cuccucggccugccggcgcgc

SEQ ID NO: 411415 - RNA, 13 nt, Bordetella pertussis
cuccugcagcacg

SEQ ID NO: 411416 - RNA, 20 nt, Bordetella pertussis
cuccugcagcacgcuggccu

SEQ ID NO: 411417 - RNA, 11 nt, Bordetella pertussis
cuccugccagg

SEQ ID NO: 411418 - RNA, 18 nt, Bordetella pertussis
cuccugguugaccgagcc

SEQ ID NO: 411419 - RNA, 23 nt, Bordetella pertussis
cuccugguugaccgagcccggca

SEQ ID NO: 411420 - RNA, 22 nt, Bordetella pertussis
cuccuugagcacguccagcggc

SEQ ID NO: 411421 - RNA, 19 nt, Bordetella pertussis
cucgaauggcugcgcgccg

SEQ ID NO: 411422 - RNA, 21 nt, Bordetella pertussis
cucgaauggcugcgcgccgug

SEQ ID NO: 411423 - RNA, 23 nt, Bordetella pertussis
cucgacauagagauuguccagcg

SEQ ID NO: 411424 - RNA, 19 nt, Bordetella pertussis
cucgacgccguacugggca

SEQ ID NO: 411425 - RNA, 17 nt, Bordetella pertussis
cucgagcaugcgggcca

SEQ ID NO: 411426 - RNA, 17 nt, Bordetella pertussis
cucgagcggcagcagcg

SEQ ID NO: 411427 - RNA, 22 nt, Bordetella pertussis
cucgaggaaccagccgucggca

SEQ ID NO: 411428 - RNA, 14 nt, Bordetella pertussis
cucgauccgggccu

SEQ ID NO: 411429 - RNA, 14 nt, Bordetella pertussis
cucgaucgccgccg

SEQ ID NO: 411430 - RNA, 18 nt, Bordetella pertussis
cucgaucugguuggccac

SEQ ID NO: 411431 - RNA, 20 nt, Bordetella pertussis
cucgaucuucucgacggcgc

SEQ ID NO: 411432 - RNA, 16 nt, Bordetella pertussis
cucgcguugcaccgcg

SEQ ID NO: 411433 - RNA, 13 nt, Bordetella pertussis
cucgcuaacaagg

SEQ ID NO: 411434 - RNA, 13 nt, Bordetella pertussis
cucgcucuuggcg

SEQ ID NO: 411435 - RNA, 17 nt, Bordetella pertussis
cucgcuuuaccagcugu

SEQ ID NO: 411436 - RNA, 20 nt, Bordetella pertussis
cucggaagacauggcgcgcg

SEQ ID NO: 411437 - RNA, 22 nt, Bordetella pertussis
cucggaagacauggcgcgcgcc

SEQ ID NO: 411438 - RNA, 19 nt, Bordetella pertussis
cucggacgagacaggcgcg

SEQ ID NO: 411439 - RNA, 14 nt, Bordetella pertussis
cucggaccuggcca

SEQ ID NO: 411440 - RNA, 17 nt, Bordetella pertussis
cucggagccugucccug

SEQ ID NO: 411441 - RNA, 18 nt, Bordetella pertussis
cucggcaucggccacgcu

SEQ ID NO: 411442 - RNA, 22 nt, Bordetella pertussis
cucggcaucggccacgcugccc

SEQ ID NO: 411443 - RNA, 16 nt, Bordetella pertussis
cucggcauggcgcgcg

SEQ ID NO: 411444 - RNA, 21 nt, Bordetella pertussis
cucggccacgcgcaacgccgc

SEQ ID NO: 411445 - RNA, 11 nt, Bordetella pertussis
cucggccacuu

SEQ ID NO: 411446 - RNA, 14 nt, Bordetella pertussis
cucggccagcagcg

SEQ ID NO: 411447 - RNA, 14 nt, Bordetella pertussis
cucggccagcgccg

SEQ ID NO: 411448 - RNA, 13 nt, Bordetella pertussis
cucggccagcugg

SEQ ID NO: 411449 - RNA, 23 nt, Bordetella pertussis
cucggccaggaaagccggcguca

SEQ ID NO: 411450 - RNA, 14 nt, Bordetella pertussis
cucggccauggugc

SEQ ID NO: 411451 - RNA, 22 nt, Bordetella pertussis
cucggcccauugcggcaccugc

SEQ ID NO: 411452 - RNA, 13 nt, Bordetella pertussis
cucggccuggccc

SEQ ID NO: 411453 - RNA, 16 nt, Bordetella pertussis
cucggccugggcgcga

SEQ ID NO: 411454 - RNA, 16 nt, Bordetella pertussis
cucggcgaagccgcag

SEQ ID NO: 411455 - RNA, 21 nt, Bordetella pertussis
cucggcgaagccgcagcggca

SEQ ID NO: 411456 - RNA, 17 nt, Bordetella pertussis
cucggcuuccugccgca

SEQ ID NO: 411457 - RNA, 15 nt, Bordetella pertussis
cucgggaaacaggcc

SEQ ID NO: 411458 - RNA, 21 nt, Bordetella pertussis
cucgggaaugaugcagcugua

SEQ ID NO: 411459 - RNA, 23 nt, Bordetella pertussis
cucgggauaggccucggccaccu

SEQ ID NO: 411460 - RNA, 23 nt, Bordetella pertussis
cucgggcagcagcagggccaggc

SEQ ID NO: 411461 - RNA, 16 nt, Bordetella pertussis
cucgggcaugcgccug

SEQ ID NO: 411462 - RNA, 17 nt, Bordetella pertussis
cucgggcgacaggcgcg

SEQ ID NO: 411463 - RNA, 17 nt, Bordetella pertussis
cucgggcgccucguccu

SEQ ID NO: 411464 - RNA, 13 nt, Bordetella pertussis
cucgggcgcggca

SEQ ID NO: 411465 - RNA, 19 nt, Bordetella pertussis
cucggucagcgccagggug

SEQ ID NO: 411466 - RNA, 21 nt, Bordetella pertussis
cucggucauguccagcgccag

SEQ ID NO: 411467 - RNA, 18 nt, Bordetella pertussis
cucggucucgugcgugcg

SEQ ID NO: 411468 - RNA, 19 nt, Bordetella pertussis
cucggucgucagcacgccc

SEQ ID NO: 411469 - RNA, 19 nt, Bordetella pertussis
cucguagaucuugccggcc

SEQ ID NO: 411470 - RNA, 22 nt, Bordetella pertussis
cucguauugugcaugcgcgcca

SEQ ID NO: 411471 - RNA, 15 nt, Bordetella pertussis
cucguccaucgccug

SEQ ID NO: 411472 - RNA, 14 nt, Bordetella pertussis
cucguccauggugg

SEQ ID NO: 411473 - RNA, 14 nt, Bordetella pertussis
cucgucgccaugcg

SEQ ID NO: 411474 - RNA, 12 nt, Bordetella pertussis
cucgucgcgcau

SEQ ID NO: 411475 - RNA, 18 nt, Bordetella pertussis
cucuaugcgguguugcuc

SEQ ID NO: 411476 - RNA, 23 nt, Bordetella pertussis
cucuaugcgguguugcucgugcu

SEQ ID NO: 411477 - RNA, 16 nt, Bordetella pertussis
cucuauucggccaacg

SEQ ID NO: 411478 - RNA, 23 nt, Bordetella pertussis
cucuauucggccaacggcuggcu

SEQ ID NO: 411479 - RNA, 20 nt, Bordetella pertussis
cucuccacuggccuucuuca

SEQ ID NO: 411480 - RNA, 19 nt, Bordetella pertussis
cucuccgugcaucggcacg

SEQ ID NO: 411481 - RNA, 21 nt, Bordetella pertussis
cucugcaccuugggcgccugc

SEQ ID NO: 411482 - RNA, 20 nt, Bordetella pertussis
cucugccgugggacaggcac

SEQ ID NO: 411483 - RNA, 12 nt, Bordetella pertussis
cucugcgcggca

SEQ ID NO: 411484 - RNA, 20 nt, Bordetella pertussis
cucuggcacaccagcgccag

SEQ ID NO: 411485 - RNA, 19 nt, Bordetella pertussis
cucugguaacucaugccua

SEQ ID NO: 411486 - RNA, 18 nt, Bordetella pertussis
cucuuccaucuacgugcu

SEQ ID NO: 411487 - RNA, 13 nt, Bordetella pertussis
cucuuccccgucg

SEQ ID NO: 411488 - RNA, 15 nt, Bordetella pertussis
cucuuccguuggcca

SEQ ID NO: 411489 - RNA, 21 nt, Bordetella pertussis
cucuucgaaguauuucaggau

SEQ ID NO: 411490 - RNA, 19 nt, Bordetella pertussis
cucuucgagcgcggcgcgc

SEQ ID NO: 411491 - RNA, 13 nt, Bordetella pertussis
cucuucggcggcc

SEQ ID NO: 411492 - RNA, 21 nt, Bordetella pertussis
cucuucgucgccggcgcugcu

SEQ ID NO: 411493 - RNA, 20 nt, Bordetella pertussis
cucuucucguccgauggcga

SEQ ID NO: 411494 - RNA, 18 nt, Bordetella pertussis
cucuugaccugggccagc

SEQ ID NO: 411495 - RNA, 15 nt, Bordetella pertussis
cucuugcgcgcgccg

SEQ ID NO: 411496 - RNA, 18 nt, Bordetella pertussis
cugaaaccucgaugaacg

SEQ ID NO: 411497 - RNA, 21 nt, Bordetella pertussis
cugaacaccggcgcgccuggc

SEQ ID NO: 411498 - RNA, 18 nt, Bordetella pertussis
cugaacgacgguacaccu

SEQ ID NO: 411499 - RNA, 19 nt, Bordetella pertussis
cugaacgccgcgcugccug

SEQ ID NO: 411500 - RNA, 16 nt, Bordetella pertussis
cugaacgccgggccgu

SEQ ID NO: 411501 - RNA, 22 nt, Bordetella pertussis
cugaacguguaggucagcgccu

SEQ ID NO: 411502 - RNA, 22 nt, Bordetella pertussis
cugaagcgccgccacaggcuga

SEQ ID NO: 411503 - RNA, 15 nt, Bordetella pertussis
cugacaauccuggcu

SEQ ID NO: 411504 - RNA, 17 nt, Bordetella pertussis
cugaccaccgggaugcc

SEQ ID NO: 411505 - RNA, 12 nt, Bordetella pertussis
cugaccagcacg

SEQ ID NO: 411506 - RNA, 18 nt, Bordetella pertussis
cugacccccgaacugggc

SEQ ID NO: 411507 - RNA, 19 nt, Bordetella pertussis
cugacccccgaacugggcg

SEQ ID NO: 411508 - RNA, 15 nt, Bordetella pertussis
cugacccgcuggcug

SEQ ID NO: 411509 - RNA, 17 nt, Bordetella pertussis
cugacccgcuggcuggc

SEQ ID NO: 411510 - RNA, 19 nt, Bordetella pertussis
cugacccgcuggcuggcag

SEQ ID NO: 411511 - RNA, 16 nt, Bordetella pertussis
cugaccucgcccaggc

SEQ ID NO: 411512 - RNA, 21 nt, Bordetella pertussis
cugaccuggugugccuguccc

SEQ ID NO: 411513 - RNA, 17 nt, Bordetella pertussis
cugacgccugcgccggg

SEQ ID NO: 411514 - RNA, 16 nt, Bordetella pertussis
cugagaaaggccgcca

SEQ ID NO: 411515 - RNA, 20 nt, Bordetella pertussis
cugagaaaggccgccacgaa

SEQ ID NO: 411516 - RNA, 22 nt, Bordetella pertussis
cugagcacaugcccggccacca

SEQ ID NO: 411517 - RNA, 24 nt, Bordetella pertussis
cugagcacaugcccggccaccagc

SEQ ID NO: 411518 - RNA, 14 nt, Bordetella pertussis
cugagcaccagcag

SEQ ID NO: 411519 - RNA, 20 nt, Bordetella pertussis
cugagccaggcgcccggcgu

SEQ ID NO: 411520 - RNA, 21 nt, Bordetella pertussis
cugaucaaucugaucaucuuc

SEQ ID NO: 411521 - RNA, 19 nt, Bordetella pertussis
cugaucacccacagcagcg

SEQ ID NO: 411522 - RNA, 17 nt, Bordetella pertussis
cugauccucgccagcgg

SEQ ID NO: 411523 - RNA, 14 nt, Bordetella pertussis
cugauccuggcucu

SEQ ID NO: 411524 - RNA, 22 nt, Bordetella pertussis
cugauccuggcucugaucgcgc

SEQ ID NO: 411525 - RNA, 21 nt, Bordetella pertussis
cugaucgacaugcuggcccag

SEQ ID NO: 411526 - RNA, 21 nt, Bordetella pertussis
cugaucgcgcagcgccuggcc

SEQ ID NO: 411527 - RNA, 23 nt, Bordetella pertussis
cugaucgcgcagcgccuggccga

SEQ ID NO: 411528 - RNA, 21 nt, Bordetella pertussis
cugaucgccggcgcccccagc

SEQ ID NO: 411529 - RNA, 16 nt, Bordetella pertussis
cugaucggccgacugc

SEQ ID NO: 411530 - RNA, 15 nt, Bordetella pertussis
cugaucuuccugggc

SEQ ID NO: 411531 - RNA, 18 nt, Bordetella pertussis
cugaugcccagcccggcu

SEQ ID NO: 411532 - RNA, 19 nt, Bordetella pertussis
cugaugccgaccgaagagg

SEQ ID NO: 411533 - RNA, 18 nt, Bordetella pertussis
cugaugccguaccaggug

SEQ ID NO: 411534 - RNA, 14 nt, Bordetella pertussis
cugcaaggcccgcc

SEQ ID NO: 411535 - RNA, 15 nt, Bordetella pertussis
cugcaaggcccgccc

SEQ ID NO: 411536 - RNA, 15 nt, Bordetella pertussis
cugcaaggccugcug

SEQ ID NO: 411537 - RNA, 16 nt, Bordetella pertussis
cugcaguucggccgcc

SEQ ID NO: 411538 - RNA, 21 nt, Bordetella pertussis
cugcaguucggccgccagguc

SEQ ID NO: 411539 - RNA, 14 nt, Bordetella pertussis
cugcaguugcgcca

SEQ ID NO: 411540 - RNA, 17 nt, Bordetella pertussis
cugcauccggcccagcg

SEQ ID NO: 411541 - RNA, 18 nt, Bordetella pertussis
cugcaucggcaugagcga

SEQ ID NO: 411542 - RNA, 21 nt, Bordetella pertussis
cugcaugcgcacggacagccc

SEQ ID NO: 411543 - RNA, 17 nt, Bordetella pertussis
cugcaugggcggcccgc

SEQ ID NO: 411544 - RNA, 22 nt, Bordetella pertussis
cugccaaagacaaugccccgca

SEQ ID NO: 411545 - RNA, 23 nt, Bordetella pertussis
cugccaaccgcgacgcauaucca

SEQ ID NO: 411546 - RNA, 18 nt, Bordetella pertussis
cugccacacgcgguaggu

SEQ ID NO: 411547 - RNA, 14 nt, Bordetella pertussis
cugccagacggcca

SEQ ID NO: 411548 - RNA, 17 nt, Bordetella pertussis
cugccagacggccagcg

SEQ ID NO: 411549 - RNA, 20 nt, Bordetella pertussis
cugccagacggccagcgcgc

SEQ ID NO: 411550 - RNA, 17 nt, Bordetella pertussis
cugccaugccgcgcgcc

SEQ ID NO: 411551 - RNA, 18 nt, Bordetella pertussis
cugccaugccgcgcgccu

SEQ ID NO: 411552 - RNA, 24 nt, Bordetella pertussis
cugcccaccuugcgcgcgaacucc

SEQ ID NO: 411553 - RNA, 16 nt, Bordetella pertussis
cugcccagccacacca

SEQ ID NO: 411554 - RNA, 19 nt, Bordetella pertussis
cugcccagccacaccaggu

SEQ ID NO: 411555 - RNA, 18 nt, Bordetella pertussis
cugcccaggauggagagg

SEQ ID NO: 411556 - RNA, 14 nt, Bordetella pertussis
cugcccauggccug

SEQ ID NO: 411557 - RNA, 13 nt, Bordetella pertussis
cugccccaggaaa

SEQ ID NO: 411558 - RNA, 18 nt, Bordetella pertussis
cugcccgcauccgacucc

SEQ ID NO: 411559 - RNA, 15 nt, Bordetella pertussis
cugcccgcaacgccg

SEQ ID NO: 411560 - RNA, 17 nt, Bordetella pertussis
cugcccgcacgggccga

SEQ ID NO: 411561 - RNA, 16 nt, Bordetella pertussis
cugcccgccgccgccc

SEQ ID NO: 411562 - RNA, 19 nt, Bordetella pertussis
cugccgcacuucgggccac

SEQ ID NO: 411563 - RNA, 18 nt, Bordetella pertussis
cugccgcaucccgccccc

SEQ ID NO: 411564 - RNA, 18 nt, Bordetella pertussis
cugccgccaagggcgcgc

SEQ ID NO: 411565 - RNA, 14 nt, Bordetella pertussis
cugccgggacaggc

SEQ ID NO: 411566 - RNA, 17 nt, Bordetella pertussis
cugccgggacaggcacc

SEQ ID NO: 411567 - RNA, 19 nt, Bordetella pertussis
cugccggggcacccaggcg

SEQ ID NO: 411568 - RNA, 16 nt, Bordetella pertussis
cugccgugggacaggc

SEQ ID NO: 411569 - RNA, 20 nt, Bordetella pertussis
cugccgugggacaggcacuc

SEQ ID NO: 411570 - RNA, 21 nt, Bordetella pertussis
cugccguuuucgaucagggcg

SEQ ID NO: 411571 - RNA, 22 nt, Bordetella pertussis
cugccguuuucgaucagggcga

SEQ ID NO: 411572 - RNA, 22 nt, Bordetella pertussis
cugccugagcaccgccgcgucc

SEQ ID NO: 411573 - RNA, 14 nt, Bordetella pertussis
cugccugccgccug

SEQ ID NO: 411574 - RNA, 15 nt, Bordetella pertussis
cugccugccgccugc

SEQ ID NO: 411575 - RNA, 19 nt, Bordetella pertussis
cugcgaucaguucggcaug

SEQ ID NO: 411576 - RNA, 16 nt, Bordetella pertussis
cugcgcacccgccugg

SEQ ID NO: 411577 - RNA, 17 nt, Bordetella pertussis
cugcgcacccgccugga

SEQ ID NO: 411578 - RNA, 15 nt, Bordetella pertussis
cugcgcagcagggcg

SEQ ID NO: 411579 - RNA, 19 nt, Bordetella pertussis
cugcgcaggcgcgcggggg

SEQ ID NO: 411580 - RNA, 16 nt, Bordetella pertussis
cugcgcaggucggcca

SEQ ID NO: 411581 - RNA, 21 nt, Bordetella pertussis
cugcgcaggucggccaggacg

SEQ ID NO: 411582 - RNA, 20 nt, Bordetella pertussis
cugcgcaucgaugcggccuu

SEQ ID NO: 411583 - RNA, 16 nt, Bordetella pertussis
cugcgcaugcgccugu

SEQ ID NO: 411584 - RNA, 20 nt, Bordetella pertussis
cugcgcaugggcgcaggccg

SEQ ID NO: 411585 - RNA, 13 nt, Bordetella pertussis
cugcgccaccugg

SEQ ID NO: 411586 - RNA, 22 nt, Bordetella pertussis
cugcgccacguccagcacggcc

SEQ ID NO: 411587 - RNA, 14 nt, Bordetella pertussis
cugcgccagguggg

SEQ ID NO: 411588 - RNA, 15 nt, Bordetella pertussis
cugcgccaggugggc

SEQ ID NO: 411589 - RNA, 22 nt, Bordetella pertussis
cugcgccagcuuggccaggcug

SEQ ID NO: 411590 - RNA, 18 nt, Bordetella pertussis
cugcgccaguugcggggc

SEQ ID NO: 411591 - RNA, 20 nt, Bordetella pertussis
cugcgccaguugcggggcgc

SEQ ID NO: 411592 - RNA, 14 nt, Bordetella pertussis
cugcgccauggcgc

SEQ ID NO: 411593 - RNA, 19 nt, Bordetella pertussis
cugcgccauggcgcgcaga

SEQ ID NO: 411594 - RNA, 21 nt, Bordetella pertussis
cugcgcccgcuaugcgggcuu

SEQ ID NO: 411595 - RNA, 14 nt, Bordetella pertussis
cugcgccgaggccu

SEQ ID NO: 411596 - RNA, 19 nt, Bordetella pertussis
cugcgccgaggccugcugu

SEQ ID NO: 411597 - RNA, 23 nt, Bordetella pertussis
cugcgccgaggccugcugugcga

SEQ ID NO: 411598 - RNA, 16 nt, Bordetella pertussis
cugcgccgaggcgggc

SEQ ID NO: 411599 - RNA, 19 nt, Bordetella pertussis
cugcgccgaggcgggcagc

SEQ ID NO: 411600 - RNA, 22 nt, Bordetella pertussis
cugcgccgaggcgggcagcaug

SEQ ID NO: 411601 - RNA, 16 nt, Bordetella pertussis
cugcgccgccgcgcgc

SEQ ID NO: 411602 - RNA, 22 nt, Bordetella pertussis
cugcgccgccgcgcgcuggcug

SEQ ID NO: 411603 - RNA, 14 nt, Bordetella pertussis
cugcgccgcggcgc

SEQ ID NO: 411604 - RNA, 13 nt, Bordetella pertussis
cugcgccggcaug

SEQ ID NO: 411605 - RNA, 21 nt, Bordetella pertussis
cugcgccggcauggccaaugc

SEQ ID NO: 411606 - RNA, 16 nt, Bordetella pertussis
cugcgccgggcgcggc

SEQ ID NO: 411607 - RNA, 16 nt, Bordetella pertussis
cugcgccggguccggc

SEQ ID NO: 411608 - RNA, 12 nt, Bordetella pertussis
cugcgccugcug

SEQ ID NO: 411609 - RNA, 23 nt, Bordetella pertussis
cugcgccugcuggucggccucgu

SEQ ID NO: 411610 - RNA, 17 nt, Bordetella pertussis
cugcgccuggccgcgcu

SEQ ID NO: 411611 - RNA, 17 nt, Bordetella pertussis
cugcgccugggcggcgc

SEQ ID NO: 411612 - RNA, 16 nt, Bordetella pertussis
cugcgccuuccgggcg

SEQ ID NO: 411613 - RNA, 18 nt, Bordetella pertussis
cugcgccuuggcgcgcag

SEQ ID NO: 411614 - RNA, 19 nt, Bordetella pertussis
cugcgccuuggcgcgcaga

SEQ ID NO: 411615 - RNA, 22 nt, Bordetella pertussis
cugcgcgaaacccccuggguga

SEQ ID NO: 411616 - RNA, 14 nt, Bordetella pertussis
cugcgcgaccucca

SEQ ID NO: 411617 - RNA, 22 nt, Bordetella pertussis
cugcgcgaggaccaauaccuga

SEQ ID NO: 411618 - RNA, 21 nt, Bordetella pertussis
cugcgcgaggugggcggcagc

SEQ ID NO: 411619 - RNA, 18 nt, Bordetella pertussis
cugcgcgcccgugucggu

SEQ ID NO: 411620 - RNA, 22 nt, Bordetella pertussis
cugcgcgccgaccaccugcacc

SEQ ID NO: 411621 - RNA, 13 nt, Bordetella pertussis
cugcgcgccgccu

SEQ ID NO: 411622 - RNA, 13 nt, Bordetella pertussis
cugcgcgccggcg

SEQ ID NO: 411623 - RNA, 22 nt, Bordetella pertussis
cugcgcgccggcgccuuggccu

SEQ ID NO: 411624 - RNA, 12 nt, Bordetella pertussis
cugcgcgccggg

SEQ ID NO: 411625 - RNA, 12 nt, Bordetella pertussis
cugcgcgcgcag

SEQ ID NO: 411626 - RNA, 17 nt, Bordetella pertussis
cugcgcgcgcagccagg

SEQ ID NO: 411627 - RNA, 14 nt, Bordetella pertussis
cugcgcgcgccagc

SEQ ID NO: 411628 - RNA, 18 nt, Bordetella pertussis
cugcgcgcgccagcgccu

SEQ ID NO: 411629 - RNA, 14 nt, Bordetella pertussis
cugcgcgcggccug

SEQ ID NO: 411630 - RNA, 20 nt, Bordetella pertussis
cugcgcgcgguguucgagcc

SEQ ID NO: 411631 - RNA, 19 nt, Bordetella pertussis
cugcgcggccgagcgggcc

SEQ ID NO: 411632 - RNA, 17 nt, Bordetella pertussis
cugcgcggcgggccccg

SEQ ID NO: 411633 - RNA, 21 nt, Bordetella pertussis
cugcgcggcgggccccgcagg

SEQ ID NO: 411634 - RNA, 21 nt, Bordetella pertussis
cugcgcguacguggcgcggcu

SEQ ID NO: 411635 - RNA, 14 nt, Bordetella pertussis
cugcgcguccuggc

SEQ ID NO: 411636 - RNA, 17 nt, Bordetella pertussis
cugcgcguugagcagca

SEQ ID NO: 411637 - RNA, 22 nt, Bordetella pertussis
cugcgcugcucguccacggccu

SEQ ID NO: 411638 - RNA, 13 nt, Bordetella pertussis
cugcgcuggccgc

SEQ ID NO: 411639 - RNA, 20 nt, Bordetella pertussis
cugcggcgccugggccuucu

SEQ ID NO: 411640 - RNA, 18 nt, Bordetella pertussis
cugcggcgcggugucgga

SEQ ID NO: 411641 - RNA, 19 nt, Bordetella pertussis
cugcggcuugggcccggcg

SEQ ID NO: 411642 - RNA, 24 nt, Bordetella pertussis
cugcggcuugggcccggcguagcu

SEQ ID NO: 411643 - RNA, 16 nt, Bordetella pertussis
cugcgggccgggcagg

SEQ ID NO: 411644 - RNA, 18 nt, Bordetella pertussis
cugcggugccugucccca

SEQ ID NO: 411645 - RNA, 22 nt, Bordetella pertussis
cugcgucacgaaagcgcccagg

SEQ ID NO: 411646 - RNA, 23 nt, Bordetella pertussis
cugcguccagccgagccuggcgu

SEQ ID NO: 411647 - RNA, 20 nt, Bordetella pertussis
cugcguccaccaccaggccg

SEQ ID NO: 411648 - RNA, 15 nt, Bordetella pertussis
cugcguucgggacgc

SEQ ID NO: 411649 - RNA, 17 nt, Bordetella pertussis
cugcguuuucuggccuu

SEQ ID NO: 411650 - RNA, 14 nt, Bordetella pertussis
cugcucaacggcca

SEQ ID NO: 411651 - RNA, 16 nt, Bordetella pertussis
cugcucaacggccacc

SEQ ID NO: 411652 - RNA, 22 nt, Bordetella pertussis
cugcucaacggccaccagggcc

SEQ ID NO: 411653 - RNA, 17 nt, Bordetella pertussis
cugcucacgccccgccc

SEQ ID NO: 411654 - RNA, 19 nt, Bordetella pertussis
cugcucacgccccgcccuc

SEQ ID NO: 411655 - RNA, 23 nt, Bordetella pertussis
cugcucacgccccgcccucuucc

SEQ ID NO: 411656 - RNA, 19 nt, Bordetella pertussis
cugcucgacagcagcccgc

SEQ ID NO: 411657 - RNA, 18 nt, Bordetella pertussis
cugcucgagcaugcgggc

SEQ ID NO: 411658 - RNA, 20 nt, Bordetella pertussis
cugcucgagcaugcgggcca

SEQ ID NO: 411659 - RNA, 21 nt, Bordetella pertussis
cugcucgaucugguuggccac

SEQ ID NO: 411660 - RNA, 17 nt, Bordetella pertussis
cugcucggugcucuggc

SEQ ID NO: 411661 - RNA, 18 nt, Bordetella pertussis
cugcucggugcucuggcc

SEQ ID NO: 411662 - RNA, 21 nt, Bordetella pertussis
cugcucggugcucuggcccgc

SEQ ID NO: 411663 - RNA, 17 nt, Bordetella pertussis
cugcucgucgccaugcg

SEQ ID NO: 411664 - RNA, 21 nt, Bordetella pertussis
aaacucaccgccgcccgcagg

SEQ ID NO: 411665 - RNA, 21 nt, Bordetella pertussis
cugcugcaauucgccgaugcg

SEQ ID NO: 411666 - RNA, 16 nt, Bordetella pertussis
cugcugcacgcgcgcg

SEQ ID NO: 411667 - RNA, 13 nt, Bordetella pertussis
cugcugcaggccg

SEQ ID NO: 411668 - RNA, 16 nt, Bordetella pertussis
cugcugcaggccggcg

SEQ ID NO: 411669 - RNA, 14 nt, Bordetella pertussis
cugcugcaggcgcg

SEQ ID NO: 411670 - RNA, 15 nt, Bordetella pertussis
cugcugcccgccgcc

SEQ ID NO: 411671 - RNA, 16 nt, Bordetella pertussis
cugcugcgccgucugu

SEQ ID NO: 411672 - RNA, 12 nt, Bordetella pertussis
cugcugcgccug

SEQ ID NO: 411673 - RNA, 13 nt, Bordetella pertussis
cugcugcggcacg

SEQ ID NO: 411674 - RNA, 18 nt, Bordetella pertussis
cugcugcuggaccuggcc

SEQ ID NO: 411675 - RNA, 12 nt, Bordetella pertussis
cugcugcuggcu

SEQ ID NO: 411676 - RNA, 14 nt, Bordetella pertussis
cugcugcuggcuuc

SEQ ID NO: 411677 - RNA, 14 nt, Bordetella pertussis
cugcuggaccuggc

SEQ ID NO: 411678 - RNA, 11 nt, Bordetella pertussis
cugcuggagau

SEQ ID NO: 411679 - RNA, 22 nt, Bordetella pertussis
cugcuggccaagcgcgccggcu

SEQ ID NO: 411680 - RNA, 15 nt, Bordetella pertussis
cugcuggccggccag

SEQ ID NO: 411681 - RNA, 15 nt, Bordetella pertussis
cuggaccgcgccugg

SEQ ID NO: 411682 - RNA, 17 nt, Bordetella pertussis
cuggaccgcgccugggg

SEQ ID NO: 411683 - RNA, 17 nt, Bordetella pertussis
cuggaccugagccaggc

SEQ ID NO: 411684 - RNA, 19 nt, Bordetella pertussis
cuggaccugagccaggcgc

SEQ ID NO: 411685 - RNA, 21 nt, Bordetella pertussis
cuggaccugagccaggcgccc

SEQ ID NO: 411686 - RNA, 13 nt, Bordetella pertussis
cuggaccuggacg

SEQ ID NO: 411687 - RNA, 14 nt, Bordetella pertussis
cuggaccuggacga

SEQ ID NO: 411688 - RNA, 16 nt, Bordetella pertussis
cuggacgagggccgcg

SEQ ID NO: 411689 - RNA, 17 nt, Bordetella pertussis
cuggacgagggccgcgg

SEQ ID NO: 411690 - RNA, 20 nt, Bordetella pertussis
cuggacgcgccgaacaccag

SEQ ID NO: 411691 - RNA, 17 nt, Bordetella pertussis
cuggacgcgcuggccga

SEQ ID NO: 411692 - RNA, 20 nt, Bordetella pertussis
cuggacgcuuucggggcgca

SEQ ID NO: 411693 - RNA, 15 nt, Bordetella pertussis
cuggacggcgcuggg

SEQ ID NO: 411694 - RNA, 17 nt, Bordetella pertussis
cuggacggcgcugggga

SEQ ID NO: 411695 - RNA, 20 nt, Bordetella pertussis
cuggacgucugagcgccggg

SEQ ID NO: 411696 - RNA, 20 nt, Bordetella pertussis
cuggacuguccggcaacacc

SEQ ID NO: 411697 - RNA, 13 nt, Bordetella pertussis
cuggaucaccgcc

SEQ ID NO: 411698 - RNA, 16 nt, Bordetella pertussis
cuggaucaggaugggc

SEQ ID NO: 411699 - RNA, 17 nt, Bordetella pertussis
cuggauccggcgcuggc

SEQ ID NO: 411700 - RNA, 16 nt, Bordetella pertussis
cuggaucgccgaucgg

SEQ ID NO: 411701 - RNA, 23 nt, Bordetella pertussis
cuggaucgugcccagcuggcacc

SEQ ID NO: 411702 - RNA, 20 nt, Bordetella pertussis
cuggaucuggugaaacagca

SEQ ID NO: 411703 - RNA, 18 nt, Bordetella pertussis
cuggaucuuggccuguuc

SEQ ID NO: 411704 - RNA, 23 nt, Bordetella pertussis
cuggaugaaaucgaggaaggccc

SEQ ID NO: 411705 - RNA, 19 nt, Bordetella pertussis
cuggcaacguugcugcagc

SEQ ID NO: 411706 - RNA, 22 nt, Bordetella pertussis
cuggcaugugccaccgcccagg

SEQ ID NO: 411707 - RNA, 20 nt, Bordetella pertussis
cuggccacaagcggccccag

SEQ ID NO: 411708 - RNA, 19 nt, Bordetella pertussis
cuggccacccgacagcucg

SEQ ID NO: 411709 - RNA, 15 nt, Bordetella pertussis
cuggccacgcugcug

SEQ ID NO: 411710 - RNA, 22 nt, Bordetella pertussis
cuggccacuggccgcgcucagg

SEQ ID NO: 411711 - RNA, 14 nt, Bordetella pertussis
cuggccagauagcc

SEQ ID NO: 411712 - RNA, 22 nt, Bordetella pertussis
cuggccagauagcccaggcggg

SEQ ID NO: 411713 - RNA, 14 nt, Bordetella pertussis
cuggccagccgcuc

SEQ ID NO: 411714 - RNA, 18 nt, Bordetella pertussis
cuggccagccggcccagc

SEQ ID NO: 411715 - RNA, 21 nt, Bordetella pertussis
cuggccaucaccgccuccggg

SEQ ID NO: 411716 - RNA, 23 nt, Bordetella pertussis
cuggccaucaccgccuccgggua

SEQ ID NO: 411717 - RNA, 20 nt, Bordetella pertussis
cuggccaugccgucgcgcac

SEQ ID NO: 411718 - RNA, 21 nt, Bordetella pertussis
cuggccauuccuuccgggccc

SEQ ID NO: 411719 - RNA, 20 nt, Bordetella pertussis
cuggcccacucggugcgcgc

SEQ ID NO: 411720 - RNA, 15 nt, Bordetella pertussis
cuggcccagcugggc

SEQ ID NO: 411721 - RNA, 16 nt, Bordetella pertussis
cuggcccagcugggcg

SEQ ID NO: 411722 - RNA, 19 nt, Bordetella pertussis
cuggcccaguucgcgcagc

SEQ ID NO: 411723 - RNA, 19 nt, Bordetella pertussis
cuggcccgccagcaaggcg

SEQ ID NO: 411724 - RNA, 15 nt, Bordetella pertussis
cuggcccgcgcgagc

SEQ ID NO: 411725 - RNA, 14 nt, Bordetella pertussis
cuggcccgucaugu

SEQ ID NO: 411726 - RNA, 14 nt, Bordetella pertussis
cuggcccuggcaga

SEQ ID NO: 411727 - RNA, 19 nt, Bordetella pertussis
cuggcccuggcgggccgga

SEQ ID NO: 411728 - RNA, 18 nt, Bordetella pertussis
cuggccgaacgccgccgc

SEQ ID NO: 411729 - RNA, 13 nt, Bordetella pertussis
cuggccgacgcgc

SEQ ID NO: 411730 - RNA, 16 nt, Bordetella pertussis
cuggccgagcgcggca

SEQ ID NO: 411731 - RNA, 18 nt, Bordetella pertussis
cuggccgagcgcggcaug

SEQ ID NO: 411732 - RNA, 19 nt, Bordetella pertussis
cuguuccugcagggcgucu

SEQ ID NO: 411733 - RNA, 17 nt, Bordetella pertussis
cuguucgauacggccac

SEQ ID NO: 411734 - RNA, 17 nt, Bordetella pertussis
cuguucgcgcagcaggc

SEQ ID NO: 411735 - RNA, 20 nt, Bordetella pertussis
cuguucggcgagccgggcac

SEQ ID NO: 411736 - RNA, 21 nt, Bordetella pertussis
cuguucggcgaugcgggcggc

SEQ ID NO: 411737 - RNA, 14 nt, Bordetella pertussis
cuguucggggcagg

SEQ ID NO: 411738 - RNA, 20 nt, Bordetella pertussis
cuguucguagucgagccagg

SEQ ID NO: 411739 - RNA, 16 nt, Bordetella pertussis
cuguuuccgggccugg

SEQ ID NO: 411740 - RNA, 18 nt, Bordetella pertussis
cuuacuggaucuuggccu

SEQ ID NO: 411741 - RNA, 20 nt, Bordetella pertussis
cuuacuggaucuuggccugu

SEQ ID NO: 411742 - RNA, 18 nt, Bordetella pertussis
cuuagcgcagcagcgaca

SEQ ID NO: 411743 - RNA, 17 nt, Bordetella pertussis
cuuaucgcggcgcggcg

SEQ ID NO: 411744 - RNA, 12 nt, Bordetella pertussis
cuucaccccgcc

SEQ ID NO: 411745 - RNA, 17 nt, Bordetella pertussis
cuucaccgaggcgcugc

SEQ ID NO: 411746 - RNA, 17 nt, Bordetella pertussis
cuucagcauggagcugg

SEQ ID NO: 411747 - RNA, 17 nt, Bordetella pertussis
cuucagcuacggcuggc

SEQ ID NO: 411748 - RNA, 21 nt, Bordetella pertussis
cuucagcuuggucacggccuc

SEQ ID NO: 411749 - RNA, 23 nt, Bordetella pertussis
cuucaggccagugauggccugcu

SEQ ID NO: 411750 - RNA, 22 nt, Bordetella pertussis
cuucaggccguuuacuccccag

SEQ ID NO: 411751 - RNA, 21 nt, Bordetella pertussis
cuucaggcuggccugcagguc

SEQ ID NO: 411752 - RNA, 16 nt, Bordetella pertussis
cuucagggcgccggcg

SEQ ID NO: 411753 - RNA, 21 nt, Bordetella pertussis
cuucagugcucgggcugcggc

SEQ ID NO: 411754 - RNA, 14 nt, Bordetella pertussis
cuucaguuccaggc

SEQ ID NO: 411755 - RNA, 20 nt, Bordetella pertussis
cuucaguugacgccggcggc

SEQ ID NO: 411756 - RNA, 14 nt, Bordetella pertussis
cuucauccaggcgc

SEQ ID NO: 411757 - RNA, 15 nt, Bordetella pertussis
cuucauuuccugguu

SEQ ID NO: 411758 - RNA, 15 nt, Bordetella pertussis
cuuccaccgucuggc

SEQ ID NO: 411759 - RNA, 16 nt, Bordetella pertussis
cuuccaggaguuccca

SEQ ID NO: 411760 - RNA, 23 nt, Bordetella pertussis
cuuccaggcgcccgccaccagga

SEQ ID NO: 411761 - RNA, 20 nt, Bordetella pertussis
cuuccaguucgcuuuccagg

SEQ ID NO: 411762 - RNA, 16 nt, Bordetella pertussis
cuuccccgucggcggc

SEQ ID NO: 411763 - RNA, 15 nt, Bordetella pertussis
cuucccgguccaggc

SEQ ID NO: 411764 - RNA, 17 nt, Bordetella pertussis
cuucccgguccaggccg

SEQ ID NO: 411765 - RNA, 22 nt, Bordetella pertussis
cuuccggaugagcuacccccug

SEQ ID NO: 411766 - RNA, 21 nt, Bordetella pertussis
cuuccggcagcggccagcgcg

SEQ ID NO: 411767 - RNA, 18 nt, Bordetella pertussis
cuuccgggcgaccccgga

SEQ ID NO: 411768 - RNA, 22 nt, Bordetella pertussis
cuuccgugccauacagcaagga

SEQ ID NO: 411769 - RNA, 15 nt, Bordetella pertussis
cuuccugcugacagg

SEQ ID NO: 411770 - RNA, 18 nt, Bordetella pertussis
cuuccugcugcgccuggc

SEQ ID NO: 411771 - RNA, 17 nt, Bordetella pertussis
cuucgacagcgcgcagg

SEQ ID NO: 411772 - RNA, 17 nt, Bordetella pertussis
cuucgacguccagcccg

SEQ ID NO: 411773 - RNA, 15 nt, Bordetella pertussis
cuucgagcgacggca

SEQ ID NO: 411774 - RNA, 21 nt, Bordetella pertussis
cuucgagcgacggcaaugccu

SEQ ID NO: 411775 - RNA, 14 nt, Bordetella pertussis
cuucgagcgcggcg

SEQ ID NO: 411776 - RNA, 21 nt, Bordetella pertussis
cuucgcgaaagcgcugcgccg

SEQ ID NO: 411777 - RNA, 20 nt, Bordetella pertussis
cuucgcgauccagcagcgug

SEQ ID NO: 411778 - RNA, 17 nt, Bordetella pertussis
cuucggcguaaggcugc

SEQ ID NO: 411779 - RNA, 18 nt, Bordetella pertussis
cuucggcguacugcugca

SEQ ID NO: 411780 - RNA, 22 nt, Bordetella pertussis
cuucggcguacugcugcaagga

SEQ ID NO: 411781 - RNA, 13 nt, Bordetella pertussis
cuucgcggcuggu

SEQ ID NO: 411782 - RNA, 19 nt, Bordetella pertussis
cuucgggauuucgcuggcc

SEQ ID NO: 411783 - RNA, 23 nt, Bordetella pertussis
cuucgggcgguuuuuucuugccg

SEQ ID NO: 411784 - RNA, 21 nt, Bordetella pertussis
cuucggucacacugggcggcg

SEQ ID NO: 411785 - RNA, 17 nt, Bordetella pertussis
cuucggucacguucagc

SEQ ID NO: 411786 - RNA, 20 nt, Bordetella pertussis
cuucggucagcugcuguugg

SEQ ID NO: 411787 - RNA, 12 nt, Bordetella pertussis
cuucgucggccg

SEQ ID NO: 411788 - RNA, 20 nt, Bordetella pertussis
cuucgucgggcagcgcggcg

SEQ ID NO: 411789 - RNA, 15 nt, Bordetella pertussis
cuucgugcggccgca

SEQ ID NO: 411790 - RNA, 14 nt, Bordetella pertussis
cuucgugcuggcca

SEQ ID NO: 411791 - RNA, 15 nt, Bordetella pertussis
cuucguggcgcagcu

SEQ ID NO: 411792 - RNA, 18 nt, Bordetella pertussis
cuucguggcgcagcuccg

SEQ ID NO: 411793 - RNA, 15 nt, Bordetella pertussis
cuucguggcgccggg

SEQ ID NO: 411794 - RNA, 22 nt, Bordetella pertussis
cuucguguucgcggccggacag

SEQ ID NO: 411795 - RNA, 17 nt, Bordetella pertussis
cuucguugucgcgcgcg

SEQ ID NO: 411796 - RNA, 20 nt, Bordetella pertussis
cuucuaggagacggucaccg

SEQ ID NO: 411797 - RNA, 19 nt, Bordetella pertussis
cuucucacugcccgcgccg

SEQ ID NO: 411798 - RNA, 16 nt, Bordetella pertussis
cuucucgacggcgcgc

SEQ ID NO: 411799 - RNA, 22 nt, Bordetella pertussis
cuucucgcaagugcuggcccgc

SEQ ID NO: 411800 - RNA, 17 nt, Bordetella pertussis
cuucucggugcgccgcc

SEQ ID NO: 411801 - RNA, 18 nt, Bordetella pertussis
cuucucggugcgccgccg

SEQ ID NO: 411802 - RNA, 16 nt, Bordetella pertussis
cuucugcaaggccugc

SEQ ID NO: 411803 - RNA, 19 nt, Bordetella pertussis
cuucugcaaggccugcugc

SEQ ID NO: 411804 - RNA, 13 nt, Bordetella pertussis
cuucugccgccag

SEQ ID NO: 411805 - RNA, 15 nt, Bordetella pertussis
cuucugccgccaggc

SEQ ID NO: 411806 - RNA, 20 nt, Bordetella pertussis
cuucuggaucaccgccggcg

SEQ ID NO: 411807 - RNA, 23 nt, Bordetella pertussis
cuucuggaucaccgccggcggcg

SEQ ID NO: 411808 - RNA, 14 nt, Bordetella pertussis
cuucugggucagcu

SEQ ID NO: 411809 - RNA, 14 nt, Bordetella pertussis
cuucuucagcaugg

SEQ ID NO: 411810 - RNA, 17 nt, Bordetella pertussis
cuucuucagcuugguca

SEQ ID NO: 411811 - RNA, 18 nt, Bordetella pertussis
cuucuucgagcaauugcc

SEQ ID NO: 411812 - RNA, 17 nt, Bordetella pertussis
cuucuucgucgcgccag

SEQ ID NO: 411813 - RNA, 22 nt, Bordetella pertussis
cuucuuggcgaccaggcccacg

SEQ ID NO: 411814 - RNA, 13 nt, Bordetella pertussis
cuugaacagcucg

SEQ ID NO: 411815 - RNA, 22 nt, Bordetella pertussis
cuugaaccccggcugcgcggcc

SEQ ID NO: 411816 - RNA, 21 nt, Bordetella pertussis
cuugaagcggucgauguccag

SEQ ID NO: 411817 - RNA, 20 nt, Bordetella pertussis
cuugaccacggccagcagca

SEQ ID NO: 411818 - RNA, 18 nt, Bordetella pertussis
cuugaccaguucgcgcag

SEQ ID NO: 411819 - RNA, 23 nt, Bordetella pertussis
cuugaccaguucgcgcagcgccg

SEQ ID NO: 411820 - RNA, 19 nt, Bordetella pertussis
cuugaccgacgugcugcug

SEQ ID NO: 411821 - RNA, 14 nt, Bordetella pertussis
cuugaccgccucca

SEQ ID NO: 411822 - RNA, 17 nt, Bordetella pertussis
cuugaccgccuccagga

SEQ ID NO: 411823 - RNA, 18 nt, Bordetella pertussis
cuugaccgccagcaucca

SEQ ID NO: 411824 - RNA, 12 nt, Bordetella pertussis
cuugaccugggc

SEQ ID NO: 411825 - RNA, 14 nt, Bordetella pertussis
cuugaccuggucgg

SEQ ID NO: 411826 - RNA, 18 nt, Bordetella pertussis
cuugaccuuggcuugcag

SEQ ID NO: 411827 - RNA, 18 nt, Bordetella pertussis
cuugacgcugcucuuggc

SEQ ID NO: 411828 - RNA, 14 nt, Bordetella pertussis
cuugacggccagga

SEQ ID NO: 411829 - RNA, 12 nt, Bordetella pertussis
cuugacguccag

SEQ ID NO: 411830 - RNA, 15 nt, Bordetella pertussis
cuugacguccagcca

SEQ ID NO: 411831 - RNA, 18 nt, Bordetella pertussis
cuugagcacggcgcggcu

SEQ ID NO: 411832 - RNA, 16 nt, Bordetella pertussis
cuugagcacguccagc

SEQ ID NO: 411833 - RNA, 17 nt, Bordetella pertussis
cuugagcaucugcggca

SEQ ID NO: 411834 - RNA, 21 nt, Bordetella pertussis
cuugagcgccagcucggccaa

SEQ ID NO: 411835 - RNA, 21 nt, Bordetella pertussis
cuugagcgcggccucgccggc

SEQ ID NO: 411836 - RNA, 14 nt, Bordetella pertussis
cuugaggcugguga

SEQ ID NO: 411837 - RNA, 20 nt, Bordetella pertussis
cuugaggucggggugguugu

SEQ ID NO: 411838 - RNA, 18 nt, Bordetella pertussis
cuugaucagcggcggcac

SEQ ID NO: 411839 - RNA, 14 nt, Bordetella pertussis
cuugaucagggcca

SEQ ID NO: 411840 - RNA, 18 nt, Bordetella pertussis
cuugaugccgcccagcau

SEQ ID NO: 411841 - RNA, 17 nt, Bordetella pertussis
cuugcagcggacggcgc

SEQ ID NO: 411842 - RNA, 18 nt, Bordetella pertussis
cuugcaggcgccaguccc

SEQ ID NO: 411843 - RNA, 17 nt, Bordetella pertussis
cuugccauccagccagg

SEQ ID NO: 411844 - RNA, 23 nt, Bordetella pertussis
cuugccauccagccaggccgcau

SEQ ID NO: 411845 - RNA, 16 nt, Bordetella pertussis
cuugcccagcagcucc

SEQ ID NO: 411846 - RNA, 17 nt, Bordetella pertussis
cuugcccagcagcuccu

SEQ ID NO: 411847 - RNA, 21 nt, Bordetella pertussis
cuugcccagcagcuccucggc

SEQ ID NO: 411848 - RNA, 22 nt, Bordetella pertussis
cuugcccagcagcuccucggcc

SEQ ID NO: 411849 - RNA, 16 nt, Bordetella pertussis
cuugcccaggccggcg

SEQ ID NO: 411850 - RNA, 14 nt, Bordetella pertussis
cuugcccaggcugg

SEQ ID NO: 411851 - RNA, 16 nt, Bordetella pertussis
cuugcccaggcugggc

SEQ ID NO: 411852 - RNA, 16 nt, Bordetella pertussis
cuugcccgucagggua

SEQ ID NO: 411853 - RNA, 19 nt, Bordetella pertussis
cuugccgaccuccaggccc

SEQ ID NO: 411854 - RNA, 20 nt, Bordetella pertussis
cuugccgaccuccaggccca

SEQ ID NO: 411855 - RNA, 21 nt, Bordetella pertussis
cuugccgaccuccaggcccag

SEQ ID NO: 411856 - RNA, 22 nt, Bordetella pertussis
cuugccgaccuccaggcccagg

SEQ ID NO: 411857 - RNA, 18 nt, Bordetella pertussis
cuugccgauccagcgccu

SEQ ID NO: 411858 - RNA, 22 nt, Bordetella pertussis
cuugccgaugcggcgcaugcug

SEQ ID NO: 411859 - RNA, 16 nt, Bordetella pertussis
cuugccgcagcggcca

SEQ ID NO: 411860 - RNA, 20 nt, Bordetella pertussis
cuugccgcagcggccaugga

SEQ ID NO: 411861 - RNA, 20 nt, Bordetella pertussis
cuugccgcagcggggacagg

SEQ ID NO: 411862 - RNA, 15 nt, Bordetella pertussis
cuugccgccgcgcag

SEQ ID NO: 411863 - RNA, 14 nt, Bordetella pertussis
cuugccgccgugcu

SEQ ID NO: 411864 - RNA, 15 nt, Bordetella pertussis
cuugccgccuuccca

SEQ ID NO: 411865 - RNA, 14 nt, Bordetella pertussis
cuugccgcgcggcg

SEQ ID NO: 411866 - RNA, 14 nt, Bordetella pertussis
cuugccgcugguga

SEQ ID NO: 411867 - RNA, 15 nt, Bordetella pertussis
cuugccggccuguuc

SEQ ID NO: 411868 - RNA, 19 nt, Bordetella pertussis
cuugccggcgaucacgccg

SEQ ID NO: 411869 - RNA, 16 nt, Bordetella pertussis
cuugccggccgcccag

SEQ ID NO: 411870 - RNA, 23 nt, Bordetella pertussis
cuugccggccgcccaggcgcagc

SEQ ID NO: 411871 - RNA, 23 nt, Bordetella pertussis
cuugccguagcgcguggccagca

SEQ ID NO: 411872 - RNA, 23 nt, Bordetella pertussis
cuugccguaggguucgccgcugu

SEQ ID NO: 411873 - RNA, 15 nt, Bordetella pertussis
cuugccuguccccac

SEQ ID NO: 411874 - RNA, 14 nt, Bordetella pertussis
cuugccuuccagga

SEQ ID NO: 411875 - RNA, 23 nt, Bordetella pertussis
cuugccuuccaggaacuccagga

SEQ ID NO: 411876 - RNA, 14 nt, Bordetella pertussis
cuugcgaggcccgg

SEQ ID NO: 411877 - RNA, 13 nt, Bordetella pertussis
cuugcgaugccag

SEQ ID NO: 411878 - RNA, 16 nt, Bordetella pertussis
cuugcgcaagccggcc

SEQ ID NO: 411879 - RNA, 13 nt, Bordetella pertussis
cuugcgcagcgcg

SEQ ID NO: 411880 - RNA, 17 nt, Bordetella pertussis
cuugcgcaucggcggca

SEQ ID NO: 411881 - RNA, 14 nt, Bordetella pertussis
cuugcgccagccac

SEQ ID NO: 411882 - RNA, 18 nt, Bordetella pertussis
cuugcgcgacagcaggcc

SEQ ID NO: 411883 - RNA, 16 nt, Bordetella pertussis
cuugcgcgccuuggcg

SEQ ID NO: 411884 - RNA, 21 nt, Bordetella pertussis
cuugcgcggccacccugccgu

SEQ ID NO: 411885 - RNA, 18 nt, Bordetella pertussis
cuugcgcggcgagcgccg

SEQ ID NO: 411886 - RNA, 24 nt, Bordetella pertussis
cuugcgcggcgcgucgcgcgccag

SEQ ID NO: 411887 - RNA, 21 nt, Bordetella pertussis
cuugcgcuuuuuucuccagcg

SEQ ID NO: 411888 - RNA, 22 nt, Bordetella pertussis
cuugcggcgaugcacccaggcg

SEQ ID NO: 411889 - RNA, 14 nt, Bordetella pertussis
cuugcggccgcgca

SEQ ID NO: 411890 - RNA, 19 nt, Bordetella pertussis
cuugcggcgcuggcuggac

SEQ ID NO: 411891 - RNA, 16 nt, Bordetella pertussis
cuugcggguccagcag

SEQ ID NO: 411892 - RNA, 20 nt, Bordetella pertussis
cuugcggguccagcaggaug

SEQ ID NO: 411893 - RNA, 18 nt, Bordetella pertussis
cuugcuguccagucugga

SEQ ID NO: 411894 - RNA, 20 nt, Bordetella pertussis
cuuggaguucuucuuggcca

SEQ ID NO: 411895 - RNA, 20 nt, Bordetella pertussis
cuuggcaaccucgccgcgcc

SEQ ID NO: 411896 - RNA, 13 nt, Bordetella pertussis
cuuggccaccacg

SEQ ID NO: 411897 - RNA, 21 nt, Bordetella pertussis
cuuggccagaucgucgaacuu

SEQ ID NO: 411898 - RNA, 15 nt, Bordetella pertussis
cuuggccagcuggcg

SEQ ID NO: 411899 - RNA, 18 nt, Bordetella pertussis
cuuggcccacucaugcgc

SEQ ID NO: 411900 - RNA, 11 nt, Bordetella pertussis
cuuggccgcag

SEQ ID NO: 411901 - RNA, 12 nt, Bordetella pertussis
cuuggccgccac

SEQ ID NO: 411902 - RNA, 15 nt, Bordetella pertussis
cuuggccgccacgcu

SEQ ID NO: 411903 - RNA, 17 nt, Bordetella pertussis
cuuggcgaaucaguucg

SEQ ID NO: 411904 - RNA, 17 nt, Bordetella pertussis
cuuggcgcgcagcagcg

SEQ ID NO: 411905 - RNA, 18 nt, Bordetella pertussis
cuuggcgcgguccacgcc

SEQ ID NO: 411906 - RNA, 20 nt, Bordetella pertussis
cuuggcgcgguccacgcccu

SEQ ID NO: 411907 - RNA, 20 nt, Bordetella pertussis
cuuggcgcuuacuggaucuu

SEQ ID NO: 411908 - RNA, 14 nt, Bordetella pertussis
cuuggcggccagga

SEQ ID NO: 411909 - RNA, 13 nt, Bordetella pertussis
cuuggcggcuggc

SEQ ID NO: 411910 - RNA, 19 nt, Bordetella pertussis
cuuggcggcuggcgcggcc

SEQ ID NO: 411911 - RNA, 13 nt, Bordetella pertussis
cuugggaucggcc

SEQ ID NO: 411912 - RNA, 22 nt, Bordetella pertussis
cuugggaucggccaggccggcc

SEQ ID NO: 411913 - RNA, 17 nt, Bordetella pertussis
cuugggaucgucccagg

SEQ ID NO: 411914 - RNA, 22 nt, Bordetella pertussis
cuugggcaaaaaaagaggccac

SEQ ID NO: 411915 - RNA, 21 nt, Bordetella pertussis
cuugggcgccugcggggccgc

SEQ ID NO: 411916 - RNA, 18 nt, Bordetella pertussis
cuugggcuugauggccag

SEQ ID NO: 411917 - RNA, 15 nt, Bordetella pertussis
cuuggggcgcgccgc

SEQ ID NO: 411918 - RNA, 12 nt, Bordetella pertussis
cuuggggcggcc

SEQ ID NO: 411919 - RNA, 20 nt, Bordetella pertussis
cuuggggcggcccggcggca

SEQ ID NO: 411920 - RNA, 18 nt, Bordetella pertussis
cuuggucggguccagcac

SEQ ID NO: 411921 - RNA, 20 nt, Bordetella pertussis
cuugguggggucgaugccag

SEQ ID NO: 411922 - RNA, 16 nt, Bordetella pertussis
cuugguggugccugcu

SEQ ID NO: 411923 - RNA, 14 nt, Bordetella pertussis
cuuguacaggcacu

SEQ ID NO: 411924 - RNA, 22 nt, Bordetella pertussis
cuugucgaugacgcgccgcgcc

SEQ ID NO: 411925 - RNA, 19 nt, Bordetella pertussis
cuugucgcgcccgauggug

SEQ ID NO: 411926 - RNA, 16 nt, Bordetella pertussis
cuugugcugccaugcc

SEQ ID NO: 411927 - RNA, 14 nt, Bordetella pertussis
cuuucaaagaucug

SEQ ID NO: 411928 - RNA, 19 nt, Bordetella pertussis
cuuucaaagaucugcuggc

SEQ ID NO: 411929 - RNA, 18 nt, Bordetella pertussis
cuuuccuggccggcgccg

SEQ ID NO: 411930 - RNA, 13 nt, Bordetella pertussis
cuuucugcugcuc

SEQ ID NO: 411931 - RNA, 13 nt, Bordetella pertussis
cuuucugcuugcc

SEQ ID NO: 411932 - RNA, 18 nt, Bordetella pertussis
cuuucugcuugccggccc

SEQ ID NO: 411933 - RNA, 16 nt, Bordetella pertussis
cuuuggccgcgcgccg

SEQ ID NO: 411934 - RNA, 24 nt, Bordetella pertussis
cuuugggggggcaccgccaggcag

SEQ ID NO: 411935 - RNA, 13 nt, Bordetella pertussis
gaaaagccgcggc

SEQ ID NO: 411936 - RNA, 17 nt, Bordetella pertussis
gaaacacguccagcgcc

SEQ ID NO: 411937 - RNA, 20 nt, Bordetella pertussis
gaaacagauugaacugcugg

SEQ ID NO: 411938 - RNA, 13 nt, Bordetella pertussis
gaaacagcagcgg

SEQ ID NO: 411939 - RNA, 23 nt, Bordetella pertussis
gaaacagcaucagcggcagcacg

SEQ ID NO: 411940 - RNA, 16 nt, Bordetella pertussis
gaaacccgcugggcca

SEQ ID NO: 411941 - RNA, 20 nt, Bordetella pertussis
gaaaccggugaucagcaggc

SEQ ID NO: 411942 - RNA, 16 nt, Bordetella pertussis
gaaaccuggcccggca

SEQ ID NO: 411943 - RNA, 12 nt, Bordetella pertussis
gaaacgcccagc

SEQ ID NO: 411944 - RNA, 22 nt, Bordetella pertussis
gaaacgcucgaugcgccagucc

SEQ ID NO: 411945 - RNA, 23 nt, Bordetella pertussis
gaaacgcuggacaugggcaagcc

SEQ ID NO: 411946 - RNA, 23 nt, Bordetella pertussis
gaaacgcggucaccgagcugagc

SEQ ID NO: 411947 - RNA, 16 nt, Bordetella pertussis
gaaagaggccaggccc

SEQ ID NO: 411948 - RNA, 19 nt, Bordetella pertussis
gaaagcccggccccaggcc

SEQ ID NO: 411949 - RNA, 17 nt, Bordetella pertussis
gaaagccgauaccgcaa

SEQ ID NO: 411950 - RNA, 20 nt, Bordetella pertussis
gaaaggccagcggcgguucg

SEQ ID NO: 411951 - RNA, 14 nt, Bordetella pertussis
gaaaggggcugccg

SEQ ID NO: 411952 - RNA, 20 nt, Bordetella pertussis
gaaaggggcugccgugaggc

SEQ ID NO: 411953 - RNA, 13 nt, Bordetella pertussis
gaaagguccugga

SEQ ID NO: 411954 - RNA, 20 nt, Bordetella pertussis
gaaaucuucugcgccacggc

SEQ ID NO: 411955 - RNA, 17 nt, Bordetella pertussis
gaaaugccgcgcgcagg

SEQ ID NO: 411956 - RNA, 13 nt, Bordetella pertussis
gaaauggcggcgg

SEQ ID NO: 411957 - RNA, 14 nt, Bordetella pertussis
gaaauggcggcggu

SEQ ID NO: 411958 - RNA, 13 nt, Bordetella pertussis
gaaauggugcggc

SEQ ID NO: 411959 - RNA, 23 nt, Bordetella pertussis
gaaauugggcguggcgguacggu

SEQ ID NO: 411960 - RNA, 16 nt, Bordetella pertussis
gaacaacacgaugauc

SEQ ID NO: 411961 - RNA, 16 nt, Bordetella pertussis
gaacaacgggaucggc

SEQ ID NO: 411962 - RNA, 15 nt, Bordetella pertussis
gaacaaggcgguggc

SEQ ID NO: 411963 - RNA, 16 nt, Bordetella pertussis
gaacaaggcgguggcc

SEQ ID NO: 411964 - RNA, 15 nt, Bordetella pertussis
gaacaccagcaagcc

SEQ ID NO: 411965 - RNA, 19 nt, Bordetella pertussis
gaacaccccggucagcagg

SEQ ID NO: 411966 - RNA, 20 nt, Bordetella pertussis
gaacaccccggucagcaggg

SEQ ID NO: 411967 - RNA, 23 nt, Bordetella pertussis
gaacaccgccgcgccgcccgcgg

SEQ ID NO: 411968 - RNA, 11 nt, Bordetella pertussis
gaacagccgcc

SEQ ID NO: 411969 - RNA, 16 nt, Bordetella pertussis
gaacagccgccccagc

SEQ ID NO: 411970 - RNA, 19 nt, Bordetella pertussis
gaacagccgccccagcagc

SEQ ID NO: 411971 - RNA, 20 nt, Bordetella pertussis
gaacagccgccccagcagca

SEQ ID NO: 411972 - RNA, 21 nt, Bordetella pertussis
gaacagccgccccagcagcag

SEQ ID NO: 411973 - RNA, 13 nt, Bordetella pertussis
gaacagccugccc

SEQ ID NO: 411974 - RNA, 15 nt, Bordetella pertussis
gaacagcgccaggcu

SEQ ID NO: 411975 - RNA, 13 nt, Bordetella pertussis
gaacagggugccg

SEQ ID NO: 411976 - RNA, 17 nt, Bordetella pertussis
gaacaucggcagcgagg

SEQ ID NO: 411977 - RNA, 19 nt, Bordetella pertussis
gaacauguccaccagccgg

SEQ ID NO: 411978 - RNA, 19 nt, Bordetella pertussis
gaagaccucggcgcucagg

SEQ ID NO: 411979 - RNA, 22 nt, Bordetella pertussis
gaagacgaagucccagccggcc

SEQ ID NO: 411980 - RNA, 23 nt, Bordetella pertussis
gaagacgaucucacagacgauca

SEQ ID NO: 411981 - RNA, 16 nt, Bordetella pertussis
gaagagcagaagcauu

SEQ ID NO: 411982 - RNA, 17 nt, Bordetella pertussis
gaagauguggucggcgc

SEQ ID NO: 411983 - RNA, 13 nt, Bordetella pertussis
gaagauuucccag

SEQ ID NO: 411984 - RNA, 22 nt, Bordetella pertussis
gaagcaggugaugcgcgcggcc

SEQ ID NO: 411985 - RNA, 12 nt, Bordetella pertussis
gaagccacggcc

SEQ ID NO: 411986 - RNA, 21 nt, Bordetella pertussis
gaagccgaugcgccgcgcuuc

SEQ ID NO: 411987 - RNA, 20 nt, Bordetella pertussis
gaagccgaugucgaacagcu

SEQ ID NO: 411988 - RNA, 22 nt, Bordetella pertussis
gaagccgccgccgucaacgccc

SEQ ID NO: 411989 - RNA, 18 nt, Bordetella pertussis
gaagccggcacgccugcc

SEQ ID NO: 411990 - RNA, 21 nt, Bordetella pertussis
gaagccggcacgccugccgcg

SEQ ID NO: 411991 - RNA, 22 nt, Bordetella pertussis
gaagccggcccguuggcaggcc

SEQ ID NO: 411992 - RNA, 15 nt, Bordetella pertussis
gaagccgggcggcga

SEQ ID NO: 411993 - RNA, 22 nt, Bordetella pertussis
gaagccuucuucugcaucggca

SEQ ID NO: 411994 - RNA, 21 nt, Bordetella pertussis
gaagccuugcgcggccagcac

SEQ ID NO: 411995 - RNA, 18 nt, Bordetella pertussis
gaagcguucggccuugcc

SEQ ID NO: 411996 - RNA, 19 nt, Bordetella pertussis
gaagcugacgaaacgcgcg

SEQ ID NO: 411997 - RNA, 13 nt, Bordetella pertussis
gaaggcgugaggc

SEQ ID NO: 411998 - RNA, 16 nt, Bordetella pertussis
gaaggcgugaggccca

SEQ ID NO: 411999 - RNA, 20 nt, Bordetella pertussis
gaaggcgugcugaacgcgcg

SEQ ID NO: 412000 - RNA, 13 nt, Bordetella pertussis
gaagggcagcagc

SEQ ID NO: 412001 - RNA, 14 nt, Bordetella pertussis
gaagggcagcagca

SEQ ID NO: 412002 - RNA, 15 nt, Bordetella pertussis
gaagggcagcagcag

SEQ ID NO: 412003 - RNA, 18 nt, Bordetella pertussis
gaaggucugggccagcag

SEQ ID NO: 412004 - RNA, 16 nt, Bordetella pertussis
gaaguaggcggccagg

SEQ ID NO: 412005 - RNA, 21 nt, Bordetella pertussis
gaaguccggaucccaggccgg

SEQ ID NO: 412006 - RNA, 16 nt, Bordetella pertussis
gaaguccgacaggcag

SEQ ID NO: 412007 - RNA, 17 nt, Bordetella pertussis
gaauccgcaacccagca

SEQ ID NO: 412008 - RNA, 14 nt, Bordetella pertussis
gaauccggccagca

SEQ ID NO: 412009 - RNA, 15 nt, Bordetella pertussis
gaaucgucgaccagc

SEQ ID NO: 412010 - RNA, 16 nt, Bordetella pertussis
gaauggcgcgauccag

SEQ ID NO: 412011 - RNA, 14 nt, Bordetella pertussis
gaauuccucgccgc

SEQ ID NO: 412012 - RNA, 19 nt, Bordetella pertussis
gaauuccucgcggcugucc

SEQ ID NO: 412013 - RNA, 21 nt, Bordetella pertussis
gacaccguuuuggcaggcugg

SEQ ID NO: 412014 - RNA, 23 nt, Bordetella pertussis
gacaccguuuuggcaggcuggca

SEQ ID NO: 412015 - RNA, 19 nt, Bordetella pertussis
gacacgaugaacgcgcgca

SEQ ID NO: 412016 - RNA, 13 nt, Bordetella pertussis
gacacgcccagca

SEQ ID NO: 412017 - RNA, 17 nt, Bordetella pertussis
gacacgcccagcaggcu

SEQ ID NO: 412018 - RNA, 14 nt, Bordetella pertussis
gacacgcuggcgga

SEQ ID NO: 412019 - RNA, 20 nt, Bordetella pertussis
gacacguacaaccgcgccga

SEQ ID NO: 412020 - RNA, 19 nt, Bordetella pertussis
gacagcacgcccgccagca

SEQ ID NO: 412021 - RNA, 22 nt, Bordetella pertussis
gacagcacgcccgccagcagcu

SEQ ID NO: 412022 - RNA, 10 nt, Bordetella pertussis
gacagcagca

SEQ ID NO: 412023 - RNA, 15 nt, Bordetella pertussis
gacagcagcccgcug

SEQ ID NO: 412024 - RNA, 23 nt, Bordetella pertussis
gacagcagcccgcuggccgaucu

SEQ ID NO: 412025 - RNA, 17 nt, Bordetella pertussis
gacagcgacagccaggc

SEQ ID NO: 412026 - RNA, 14 nt, Bordetella pertussis
gacagcgccagccc

SEQ ID NO: 412027 - RNA, 13 nt, Bordetella pertussis
gacagcgcgcagg

SEQ ID NO: 412028 - RNA, 14 nt, Bordetella pertussis
gacagcgcgcccgc

SEQ ID NO: 412029 - RNA, 18 nt, Bordetella pertussis
gacaggaacuccggcggc

SEQ ID NO: 412030 - RNA, 21 nt, Bordetella pertussis
gacaggaaggcgagcgcggca

SEQ ID NO: 412031 - RNA, 11 nt, Bordetella pertussis
gacaggcacac

SEQ ID NO: 412032 - RNA, 17 nt, Bordetella pertussis
gacaggcacacccuccu

SEQ ID NO: 412033 - RNA, 20 nt, Bordetella pertussis
gacaggcacauugccguacg

SEQ ID NO: 412034 - RNA, 15 nt, Bordetella pertussis
gacaggcacccugcc

SEQ ID NO: 412035 - RNA, 23 nt, Bordetella pertussis
gacaggcacccuuuugccgcagg

SEQ ID NO: 412036 - RNA, 13 nt, Bordetella pertussis
gacaggcaccgcc

SEQ ID NO: 412037 - RNA, 17 nt, Bordetella pertussis
gacaggcaccgccgcac

SEQ ID NO: 412038 - RNA, 18 nt, Bordetella pertussis
gacaggcaccgccgcaca

SEQ ID NO: 412039 - RNA, 17 nt, Bordetella pertussis
gacaggaugggcgcuug

SEQ ID NO: 412040 - RNA, 18 nt, Bordetella pertussis
gacauagacgcgcagcgg

SEQ ID NO: 412041 - RNA, 23 nt, Bordetella pertussis
gacaucgccgcugcgcagcagcg

SEQ ID NO: 412042 - RNA, 17 nt, Bordetella pertussis
gaccaacucgaggcggc

SEQ ID NO: 412043 - RNA, 13 nt, Bordetella pertussis
gaccaagcgccac

SEQ ID NO: 412044 - RNA, 15 nt, Bordetella pertussis
gaccaagcgccacag

SEQ ID NO: 412045 - RNA, 16 nt, Bordetella pertussis
gaccacggccagcagc

SEQ ID NO: 412046 - RNA, 17 nt, Bordetella pertussis
gaccacggccagcagca

SEQ ID NO: 412047 - RNA, 14 nt, Bordetella pertussis
gaccacggcggcuu

SEQ ID NO: 412048 - RNA, 14 nt, Bordetella pertussis
gaccacguggauga

SEQ ID NO: 412049 - RNA, 19 nt, Bordetella pertussis
gaccacguggaugaugguc

SEQ ID NO: 412050 - RNA, 16 nt, Bordetella pertussis
gaccacuggcagaccg

SEQ ID NO: 412051 - RNA, 20 nt, Bordetella pertussis
gaccagcaccagcgccugcc

SEQ ID NO: 412052 - RNA, 10 nt, Bordetella pertussis
gaccagcagc

SEQ ID NO: 412053 - RNA, 11 nt, Bordetella pertussis
gaccagcagcc

SEQ ID NO: 412054 - RNA, 16 nt, Bordetella pertussis
gaccagcagcgccggg

SEQ ID NO: 412055 - RNA, 19 nt, Bordetella pertussis
gaccagcaguugcgccagu

SEQ ID NO: 412056 - RNA, 14 nt, Bordetella pertussis
gaccagccagccgc

SEQ ID NO: 412057 - RNA, 16 nt, Bordetella pertussis
gaccagccagccgccg

SEQ ID NO: 412058 - RNA, 16 nt, Bordetella pertussis
gaccagcccggccgcc

SEQ ID NO: 412059 - RNA, 20 nt, Bordetella pertussis
gaccagcccggccgccagca

SEQ ID NO: 412060 - RNA, 14 nt, Bordetella pertussis
gaccagcgacagca

SEQ ID NO: 412061 - RNA, 20 nt, Bordetella pertussis
gaccagcgaguugaaggcuu

SEQ ID NO: 412062 - RNA, 14 nt, Bordetella pertussis
gaccagcgcacggu

SEQ ID NO: 412063 - RNA, 20 nt, Bordetella pertussis
gaccaggaugaugcagcaca

SEQ ID NO: 412064 - RNA, 22 nt, Bordetella pertussis
gaccaggaugaugcagcacacg

SEQ ID NO: 412065 - RNA, 20 nt, Bordetella pertussis
gaccaggcccauggcguagc

SEQ ID NO: 412066 - RNA, 13 nt, Bordetella pertussis
gaccaggccggcg

SEQ ID NO: 412067 - RNA, 11 nt, Bordetella pertussis
gaccaggcugc

SEQ ID NO: 412068 - RNA, 16 nt, Bordetella pertussis
gaccaggucgaagcac

SEQ ID NO: 412069 - RNA, 18 nt, Bordetella pertussis
gaccaggugcgggccgcu

SEQ ID NO: 412070 - RNA, 19 nt, Bordetella pertussis
gaccaggugcgggccgcuc

SEQ ID NO: 412071 - RNA, 19 nt, Bordetella pertussis
gaccaguucggccagcagc

SEQ ID NO: 412072 - RNA, 22 nt, Bordetella pertussis
gaccauuucgauuucggcggcc

SEQ ID NO: 412073 - RNA, 20 nt, Bordetella pertussis
gacccagcaccgagcugccg

SEQ ID NO: 412074 - RNA, 15 nt, Bordetella pertussis
gacccgagcccuggc

SEQ ID NO: 412075 - RNA, 20 nt, Bordetella pertussis
gacccgauagccgcgcgccu

SEQ ID NO: 412076 - RNA, 21 nt, Bordetella pertussis
gacccgcaaaaccgggcccgg

SEQ ID NO: 412077 - RNA, 16 nt, Bordetella pertussis
gacccgcgcccagcug

SEQ ID NO: 412078 - RNA, 12 nt, Bordetella pertussis
gacccgcuggcu

SEQ ID NO: 412079 - RNA, 17 nt, Bordetella pertussis
gacccgcuggcuggcag

SEQ ID NO: 412080 - RNA, 16 nt, Bordetella pertussis
gacccguuugcgcagc

SEQ ID NO: 412081 - RNA, 18 nt, Bordetella pertussis
gacccguuugcgcagcuc

SEQ ID NO: 412082 - RNA, 12 nt, Bordetella pertussis
gacccuccucgc

SEQ ID NO: 412083 - RNA, 14 nt, Bordetella pertussis
gacccuccucgcuu

SEQ ID NO: 412084 - RNA, 22 nt, Bordetella pertussis
gacccuggccgaacgccgccgc

SEQ ID NO: 412085 - RNA, 14 nt, Bordetella pertussis
gaccggcggcgcuc

SEQ ID NO: 412086 - RNA, 20 nt, Bordetella pertussis
gaccggcuauaccgggcugg

SEQ ID NO: 412087 - RNA, 21 nt, Bordetella pertussis
gaccggcuauaccgggcuggu

SEQ ID NO: 412088 - RNA, 19 nt, Bordetella pertussis
gaccggcuucccguggcug

SEQ ID NO: 412089 - RNA, 17 nt, Bordetella pertussis
gaccgggccgaccaggc

SEQ ID NO: 412090 - RNA, 20 nt, Bordetella pertussis
gaccgggucgucgggcggcg

SEQ ID NO: 412091 - RNA, 19 nt, Bordetella pertussis
gaccgucagcaugccguug

SEQ ID NO: 412092 - RNA, 16 nt, Bordetella pertussis
gaccgugccgccgagg

SEQ ID NO: 412093 - RNA, 21 nt, Bordetella pertussis
gaccguuaucugcguuuucug

SEQ ID NO: 412094 - RNA, 16 nt, Bordetella pertussis
gaccuccaggcccagg

SEQ ID NO: 412095 - RNA, 21 nt, Bordetella pertussis
gaccucgcgccggucacgcug

SEQ ID NO: 412096 - RNA, 17 nt, Bordetella pertussis
gaccucggcaccgaggc

SEQ ID NO: 412097 - RNA, 15 nt, Bordetella pertussis
gaccucggcggcguc

SEQ ID NO: 412098 - RNA, 23 nt, Bordetella pertussis
gaccucggcggcgucgcuggcag

SEQ ID NO: 412099 - RNA, 17 nt, Bordetella pertussis
gaccucuucguugucgc

SEQ ID NO: 412100 - RNA, 22 nt, Bordetella pertussis
gaccuucggccaaucggccugc

SEQ ID NO: 412101 - RNA, 22 nt, Bordetella pertussis
gacgacaaacccgacgaugauc

SEQ ID NO: 412102 - RNA, 22 nt, Bordetella pertussis
gacgaauuucucggccagcgcc

SEQ ID NO: 412103 - RNA, 13 nt, Bordetella pertussis
gacgacagcggcg

SEQ ID NO: 412104 - RNA, 22 nt, Bordetella pertussis
gacgacgaaacccgggccgucg

SEQ ID NO: 412105 - RNA, 13 nt, Bordetella pertussis
gacgagacaggcg

SEQ ID NO: 412106 - RNA, 20 nt, Bordetella pertussis
gacgagacaggcgcgccauc

SEQ ID NO: 412107 - RNA, 19 nt, Bordetella pertussis
gacgagaaugcgccguccg

SEQ ID NO: 412108 - RNA, 22 nt, Bordetella pertussis
gacgagcaagcccacaccauca

SEQ ID NO: 412109 - RNA, 20 nt, Bordetella pertussis
gacgaggccgaguagcggcg

SEQ ID NO: 412110 - RNA, 18 nt, Bordetella pertussis
gacgaggggguguucucc

SEQ ID NO: 412111 - RNA, 15 nt, Bordetella pertussis
gacgaucggccugaa

SEQ ID NO: 412112 - RNA, 23 nt, Bordetella pertussis
gacgaugaucaugaugaugaugu

SEQ ID NO: 412113 - RNA, 15 nt, Bordetella pertussis
gacgaugcccugcgc

SEQ ID NO: 412114 - RNA, 21 nt, Bordetella pertussis
gacgaugcccugcgccagcgc

SEQ ID NO: 412115 - RNA, 20 nt, Bordetella pertussis
gacgauggucuugccgccgu

SEQ ID NO: 412116 - RNA, 22 nt, Bordetella pertussis
gacgauggucuugccgccgugc

SEQ ID NO: 412117 - RNA, 17 nt, Bordetella pertussis
gacgauguucaggccau

SEQ ID NO: 412118 - RNA, 22 nt, Bordetella pertussis
gacgauguucaggccaugcugg

SEQ ID NO: 412119 - RNA, 20 nt, Bordetella pertussis
gacgcaccuuucugcugcuc

SEQ ID NO: 412120 - RNA, 19 nt, Bordetella pertussis
gacgcagaccacgccggcg

SEQ ID NO: 412121 - RNA, 14 nt, Bordetella pertussis
gacgcagcagccgc

SEQ ID NO: 412122 - RNA, 19 nt, Bordetella pertussis
gacgcgcagcggcaggccc

SEQ ID NO: 412123 - RNA, 20 nt, Bordetella pertussis
gacgcgcaggccauugcugg

SEQ ID NO: 412124 - RNA, 14 nt, Bordetella pertussis
gacgcgcucgccgu

SEQ ID NO: 412125 - RNA, 19 nt, Bordetella pertussis
gacgcgcugccggaaaccc

SEQ ID NO: 412126 - RNA, 20 nt, Bordetella pertussis
gacgcgcuggccgacaagga

SEQ ID NO: 412127 - RNA, 18 nt, Bordetella pertussis
gacgcgcuguaggcgccg

SEQ ID NO: 412128 - RNA, 17 nt, Bordetella pertussis
gacgcgcuuccaggagu

SEQ ID NO: 412129 - RNA, 13 nt, Bordetella pertussis
gacgcggccggca

SEQ ID NO: 412130 - RNA, 12 nt, Bordetella pertussis
gacgcggcggcc

SEQ ID NO: 412131 - RNA, 21 nt, Bordetella pertussis
gacgcggcguacuggcgcggc

SEQ ID NO: 412132 - RNA, 22 nt, Bordetella pertussis
gacgcggcguacuggcgcggcg

SEQ ID NO: 412133 - RNA, 16 nt, Bordetella pertussis
gacgcggggacaggca

SEQ ID NO: 412134 - RNA, 18 nt, Bordetella pertussis
gacgcggggacaggcaca

SEQ ID NO: 412135 - RNA, 19 nt, Bordetella pertussis
gacgcggggacaggcacac

SEQ ID NO: 412136 - RNA, 19 nt, Bordetella pertussis
gacgcguacgaucuucugg

SEQ ID NO: 412137 - RNA, 17 nt, Bordetella pertussis
gacgcguucucgcgcuu

SEQ ID NO: 412138 - RNA, 18 nt, Bordetella pertussis
gacgcucauccaggcgcg

SEQ ID NO: 412139 - RNA, 20 nt, Bordetella pertussis
gacgcucgagguaggcggga

SEQ ID NO: 412140 - RNA, 17 nt, Bordetella pertussis
gacgcugacugcggugc

SEQ ID NO: 412141 - RNA, 17 nt, Bordetella pertussis
gacgcugauggccgcca

SEQ ID NO: 412142 - RNA, 13 nt, Bordetella pertussis
gacgcuggagcgc

SEQ ID NO: 412143 - RNA, 22 nt, Bordetella pertussis
gacgcuggucgagagccugggc

SEQ ID NO: 412144 - RNA, 17 nt, Bordetella pertussis
gacgcuguaacaacacg

SEQ ID NO: 412145 - RNA, 15 nt, Bordetella pertussis
gacggcaaugccugc

SEQ ID NO: 412146 - RNA, 13 nt, Bordetella pertussis
gacggcagcaccg

SEQ ID NO: 412147 - RNA, 22 nt, Bordetella pertussis
gacggcagccccgggugcaggu

SEQ ID NO: 412148 - RNA, 18 nt, Bordetella pertussis
gacgggaauccgcugcgc

SEQ ID NO: 412149 - RNA, 18 nt, Bordetella pertussis
gacgggcccguuuugcag

SEQ ID NO: 412150 - RNA, 14 nt, Bordetella pertussis
gacgggcggcggcg

SEQ ID NO: 412151 - RNA, 19 nt, Bordetella pertussis
gacggggaacaggcgcgcc

SEQ ID NO: 412152 - RNA, 22 nt, Bordetella pertussis
gacggggaacaggcgcgccagc

SEQ ID NO: 412153 - RNA, 15 nt, Bordetella pertussis
gacggggacgccggc

SEQ ID NO: 412154 - RNA, 16 nt, Bordetella pertussis
gacggggacgccggcg

SEQ ID NO: 412155 - RNA, 23 nt, Bordetella pertussis
gacggggacgccggcgggcaggc

SEQ ID NO: 412156 - RNA, 17 nt, Bordetella pertussis
gacggggcggcgccugc

SEQ ID NO: 412157 - RNA, 14 nt, Bordetella pertussis
gacggggugccugu

SEQ ID NO: 412158 - RNA, 21 nt, Bordetella pertussis
gacggguaucgucgaccugga

SEQ ID NO: 412159 - RNA, 15 nt, Bordetella pertussis
gacguaagugcccag

SEQ ID NO: 412160 - RNA, 15 nt, Bordetella pertussis
gacguccagcgccac

SEQ ID NO: 412161 - RNA, 21 nt, Bordetella pertussis
gacguccagcgccaccagcag

SEQ ID NO: 412162 - RNA, 13 nt, Bordetella pertussis
gacguccggcggg

SEQ ID NO: 412163 - RNA, 21 nt, Bordetella pertussis
gacgucgucgguggggcaggu

SEQ ID NO: 412164 - RNA, 22 nt, Bordetella pertussis
gacgucuucguacagccugccc

SEQ ID NO: 412165 - RNA, 15 nt, Bordetella pertussis
gacgugaaagcucca

SEQ ID NO: 412166 - RNA, 22 nt, Bordetella pertussis
gacgugcgcgaccgcgcggcgc

SEQ ID NO: 412167 - RNA, 22 nt, Bordetella pertussis
gacguggauggcuuuggcgaau

SEQ ID NO: 412168 - RNA, 18 nt, Bordetella pertussis
gacguugagcgccggggc

SEQ ID NO: 412169 - RNA, 20 nt, Bordetella pertussis
gacguuggcgaaugccuggu

SEQ ID NO: 412170 - RNA, 15 nt, Bordetella pertussis
gacucgaaacgggcg

SEQ ID NO: 412171 - RNA, 16 nt, Bordetella pertussis
gacucgccgugcuggg

SEQ ID NO: 412172 - RNA, 21 nt, Bordetella pertussis
gacucgcggucuggucuggca

SEQ ID NO: 412173 - RNA, 13 nt, Bordetella pertussis
gacucgggcaugc

SEQ ID NO: 412174 - RNA, 18 nt, Bordetella pertussis
gacucuuuuggagaugug

SEQ ID NO: 412175 - RNA, 14 nt, Bordetella pertussis
gacugcagcaggcu

SEQ ID NO: 412176 - RNA, 15 nt, Bordetella pertussis
gacugccccagcggc

SEQ ID NO: 412177 - RNA, 18 nt, Bordetella pertussis
gacugccccagcggcugg

SEQ ID NO: 412178 - RNA, 20 nt, Bordetella pertussis
gacugcggugccugucccca

SEQ ID NO: 412179 - RNA, 22 nt, Bordetella pertussis
gacugcuguacgacagcaaggg

SEQ ID NO: 412180 - RNA, 20 nt, Bordetella pertussis
gacuggacgaugagcugguc

SEQ ID NO: 412181 - RNA, 16 nt, Bordetella pertussis
gacuggauauggcgcc

SEQ ID NO: 412182 - RNA, 15 nt, Bordetella pertussis
gacuggcaccaaucc

SEQ ID NO: 412183 - RNA, 16 nt, Bordetella pertussis
gacuggcuggucaggc

SEQ ID NO: 412184 - RNA, 22 nt, Bordetella pertussis
gacugggcuugccggugcucgg

SEQ ID NO: 412185 - RNA, 21 nt, Bordetella pertussis
gacuguccggcaacaccaacc

SEQ ID NO: 412186 - RNA, 19 nt, Bordetella pertussis
gacuucaccgaggcgcugc

SEQ ID NO: 412187 - RNA, 21 nt, Bordetella pertussis
gacuucaccgaggcgcugccc

SEQ ID NO: 412188 - RNA, 13 nt, Bordetella pertussis
gacuucggcggcc

SEQ ID NO: 412189 - RNA, 20 nt, Bordetella pertussis
gacuucggcggccaugccga

SEQ ID NO: 412190 - RNA, 21 nt, Bordetella pertussis
gacuucggucagcuugccgcc

SEQ ID NO: 412191 - RNA, 21 nt, Bordetella pertussis
gacuucgucaacgcccugacg

SEQ ID NO: 412192 - RNA, 20 nt, Bordetella pertussis
gacuucgucgaucauggcgc

SEQ ID NO: 412193 - RNA, 18 nt, Bordetella pertussis
gacuugggcaggccuucg

SEQ ID NO: 412194 - RNA, 20 nt, Bordetella pertussis
gagaaaccgauggugccggg

SEQ ID NO: 412195 - RNA, 15 nt, Bordetella pertussis
gagaaagaagccccc

SEQ ID NO: 412196 - RNA, 18 nt, Bordetella pertussis
gagaaagaagcccccgcg

SEQ ID NO: 412197 - RNA, 23 nt, Bordetella pertussis
gagaaagaagcccccgcgcugcg

SEQ ID NO: 412198 - RNA, 18 nt, Bordetella pertussis
gagaaaggccgccacgaa

SEQ ID NO: 412199 - RNA, 16 nt, Bordetella pertussis
aaagcaagacagcaag

SEQ ID NO: 412200 - RNA, 17 nt, Bordetella pertussis
gagaacagccacacgcu

SEQ ID NO: 412201 - RNA, 13 nt, Bordetella pertussis
gagaacaggcggc

SEQ ID NO: 412202 - RNA, 23 nt, Bordetella pertussis
gagaacgagccggccgcgcccga

SEQ ID NO: 412203 - RNA, 18 nt, Bordetella pertussis
gagaagauuucccagagc

SEQ ID NO: 412204 - RNA, 22 nt, Bordetella pertussis
gagaagauuucccagagcuggg

SEQ ID NO: 412205 - RNA, 19 nt, Bordetella pertussis
gagaaggagcgagcgauga

SEQ ID NO: 412206 - RNA, 20 nt, Bordetella pertussis
gagaagggcuugaccagggc

SEQ ID NO: 412207 - RNA, 14 nt, Bordetella pertussis
gagaauccgcaggc

SEQ ID NO: 412208 - RNA, 21 nt, Bordetella pertussis
gagaaugcccaggaugcccuu

SEQ ID NO: 412209 - RNA, 15 nt, Bordetella pertussis
gagacaucaugcaga

SEQ ID NO: 412210 - RNA, 22 nt, Bordetella pertussis
gagaccaagcugcgcgaggacc

SEQ ID NO: 412211 - RNA, 19 nt, Bordetella pertussis
gagaccacgauggccggcg

SEQ ID NO: 412212 - RNA, 12 nt, Bordetella pertussis
gagaccagcagc

SEQ ID NO: 412213 - RNA, 12 nt, Bordetella pertussis
gagaccgcccgc

SEQ ID NO: 412214 - RNA, 15 nt, Bordetella pertussis
gagaccgcccgcugc

SEQ ID NO: 412215 - RNA, 18 nt, Bordetella pertussis
gagaccggcgccugcggc

SEQ ID NO: 412216 - RNA, 22 nt, Bordetella pertussis
gagaccuugugcggcagguuga

SEQ ID NO: 412217 - RNA, 23 nt, Bordetella pertussis
gagaccuugugcggcagguugaa

SEQ ID NO: 412218 - RNA, 22 nt, Bordetella pertussis
gagacgucuucguacagccugc

SEQ ID NO: 412219 - RNA, 16 nt, Bordetella pertussis
gagacuggcaccggcc

SEQ ID NO: 412220 - RNA, 13 nt, Bordetella pertussis
gagauagcccagc

SEQ ID NO: 412221 - RNA, 23 nt, Bordetella pertussis
gagauagcccagcaccugcaggc

SEQ ID NO: 412222 - RNA, 16 nt, Bordetella pertussis
gagauaggcggccagg

SEQ ID NO: 412223 - RNA, 20 nt, Bordetella pertussis
gagaugccgucgaaggccgc

SEQ ID NO: 412224 - RNA, 19 nt, Bordetella pertussis
gagauggguacagcgcgcc

SEQ ID NO: 412225 - RNA, 17 nt, Bordetella pertussis
gagauguccauggccug

SEQ ID NO: 412226 - RNA, 19 nt, Bordetella pertussis
gagauguccauggccugca

SEQ ID NO: 412227 - RNA, 21 nt, Bordetella pertussis
gagauguccauggccugcagg

SEQ ID NO: 412228 - RNA, 16 nt, Bordetella pertussis
gagauggcgcaggcgc

SEQ ID NO: 412229 - RNA, 22 nt, Bordetella pertussis
gagcaauugccggaucagcgcc

SEQ ID NO: 412230 - RNA, 18 nt, Bordetella pertussis
gagcaccacggcgcgcgc

SEQ ID NO: 412231 - RNA, 22 nt, Bordetella pertussis
gagcaccacguccuggggcgcg

SEQ ID NO: 412232 - RNA, 16 nt, Bordetella pertussis
gagcacccgcaggcgg

SEQ ID NO: 412233 - RNA, 16 nt, Bordetella pertussis
gagcaccgagaccggg

SEQ ID NO: 412234 - RNA, 19 nt, Bordetella pertussis
gagcacgcggcgcggcagg

SEQ ID NO: 412235 - RNA, 18 nt, Bordetella pertussis
gagcacggcguggcgcgc

SEQ ID NO: 412236 - RNA, 21 nt, Bordetella pertussis
gagcacggcguggcgcgcaca

SEQ ID NO: 412237 - RNA, 22 nt, Bordetella pertussis
gagcacggcguggcgcgcacac

SEQ ID NO: 412238 - RNA, 17 nt, Bordetella pertussis
gagcacguccagcggcg

SEQ ID NO: 412239 - RNA, 18 nt, Bordetella pertussis
gagcacguccagcggcgc

SEQ ID NO: 412240 - RNA, 15 nt, Bordetella pertussis
gagcaggcgcgcggu

SEQ ID NO: 412241 - RNA, 18 nt, Bordetella pertussis
gagcaggcgcaggccgcg

SEQ ID NO: 412242 - RNA, 16 nt, Bordetella pertussis
gagcagucgcgcagcc

SEQ ID NO: 412243 - RNA, 16 nt, Bordetella pertussis
gagcaucauggcgcgc

SEQ ID NO: 412244 - RNA, 18 nt, Bordetella pertussis
gagcaucuggcgcauggc

SEQ ID NO: 412245 - RNA, 20 nt, Bordetella pertussis
gagcaugcccuuugcagcca

SEQ ID NO: 412246 - RNA, 23 nt, Bordetella pertussis
gagcaugcgcagcgcgucggcgc

SEQ ID NO: 412247 - RNA, 18 nt, Bordetella pertussis
gagcauggcaugagcgcc

SEQ ID NO: 412248 - RNA, 19 nt, Bordetella pertussis
gagccaguccccgcaggga

SEQ ID NO: 412249 - RNA, 23 nt, Bordetella pertussis
gagccaugccgucuggcggcagc

SEQ ID NO: 412250 - RNA, 19 nt, Bordetella pertussis
gagcccaucaggugggccg

SEQ ID NO: 412251 - RNA, 23 nt, Bordetella pertussis
gagcccaucaggugggccgagcc

SEQ ID NO: 412252 - RNA, 21 nt, Bordetella pertussis
gagcccgcacauacaaggcgc

SEQ ID NO: 412253 - RNA, 20 nt, Bordetella pertussis
gagcccuucgacgcggcggc

SEQ ID NO: 412254 - RNA, 20 nt, Bordetella pertussis
gagccgcgcgcaugcgccuu

SEQ ID NO: 412255 - RNA, 22 nt, Bordetella pertussis
gagccggccaccucuucagccc

SEQ ID NO: 412256 - RNA, 19 nt, Bordetella pertussis
gagccggccagcgccacca

SEQ ID NO: 412257 - RNA, 18 nt, Bordetella pertussis
gagccgggcaccgagccg

SEQ ID NO: 412258 - RNA, 13 nt, Bordetella pertussis
gagccgggcgccg

SEQ ID NO: 412259 - RNA, 13 nt, Bordetella pertussis
gagccgguacagc

SEQ ID NO: 412260 - RNA, 22 nt, Bordetella pertussis
gagccgguacagccaggccagc

SEQ ID NO: 412261 - RNA, 16 nt, Bordetella pertussis
gagccugucccugcgg

SEQ ID NO: 412262 - RNA, 22 nt, Bordetella pertussis
gagcgaaugcgcguaguccgag

SEQ ID NO: 412263 - RNA, 19 nt, Bordetella pertussis
gagcuggucgaacgcuucc

SEQ ID NO: 412264 - RNA, 14 nt, Bordetella pertussis
gagcuggugauggu

SEQ ID NO: 412265 - RNA, 17 nt, Bordetella pertussis
gagcuguugcagcggcu

SEQ ID NO: 412266 - RNA, 18 nt, Bordetella pertussis
gagcuguugcagcggcuu

SEQ ID NO: 412267 - RNA, 15 nt, Bordetella pertussis
gagcuuggccggugc

SEQ ID NO: 412268 - RNA, 13 nt, Bordetella pertussis
gaggacaggccag

SEQ ID NO: 412269 - RNA, 13 nt, Bordetella pertussis
gaggacaggggcc

SEQ ID NO: 412270 - RNA, 13 nt, Bordetella pertussis
gaggaccgcgaug

SEQ ID NO: 412271 - RNA, 16 nt, Bordetella pertussis
gaggauaucggccagg

SEQ ID NO: 412272 - RNA, 19 nt, Bordetella pertussis
gaggauaucggccaggcgc

SEQ ID NO: 412273 - RNA, 13 nt, Bordetella pertussis
gaggaucaccgca

SEQ ID NO: 412274 - RNA, 15 nt, Bordetella pertussis
gaggauggcgaggug

SEQ ID NO: 412275 - RNA, 15 nt, Bordetella pertussis
gaggcaaucagcccc

SEQ ID NO: 412276 - RNA, 21 nt, Bordetella pertussis
gaggcaaucagccccaggcgc

SEQ ID NO: 412277 - RNA, 16 nt, Bordetella pertussis
gaggcggugggcaggg

SEQ ID NO: 412278 - RNA, 18 nt, Bordetella pertussis
gaggcugcgcgcgccagc

SEQ ID NO: 412279 - RNA, 18 nt, Bordetella pertussis
gaggcuucgauggcggcg

SEQ ID NO: 412280 - RNA, 19 nt, Bordetella pertussis
gaggcuucgauggcggcgg

SEQ ID NO: 412281 - RNA, 13 nt, Bordetella pertussis
gagggacaccgca

SEQ ID NO: 412282 - RNA, 22 nt, Bordetella pertussis
gagggacaccgcaggugccugu

SEQ ID NO: 412283 - RNA, 18 nt, Bordetella pertussis
gagggccuggucagcgcc

SEQ ID NO: 412284 - RNA, 12 nt, Bordetella pertussis
gagggcgcggcg

SEQ ID NO: 412285 - RNA, 13 nt, Bordetella pertussis
gagggcgcggcgc

SEQ ID NO: 412286 - RNA, 14 nt, Bordetella pertussis
gagggcgcggcgcc

SEQ ID NO: 412287 - RNA, 16 nt, Bordetella pertussis
gagggcgcgggccagc

SEQ ID NO: 412288 - RNA, 19 nt, Bordetella pertussis
gagggcgucaucggcgcgc

SEQ ID NO: 412289 - RNA, 13 nt, Bordetella pertussis
gaggucggggugg

SEQ ID NO: 412290 - RNA, 16 nt, Bordetella pertussis
gaggucuugccgaucg

SEQ ID NO: 412291 - RNA, 23 nt, Bordetella pertussis
gaggugaucgguaaugagcccga

SEQ ID NO: 412292 - RNA, 17 nt, Bordetella pertussis
gaggugaugauggccga

SEQ ID NO: 412293 - RNA, 13 nt, Bordetella pertussis
gaggugccagccu

SEQ ID NO: 412294 - RNA, 15 nt, Bordetella pertussis
gaggugcgccgcucg

SEQ ID NO: 412295 - RNA, 12 nt, Bordetella pertussis
gagguggcgggc

SEQ ID NO: 412296 - RNA, 17 nt, Bordetella pertussis
gagguugcaggccaggc

SEQ ID NO: 412297 - RNA, 17 nt, Bordetella pertussis
gaguaucccuaccgccu

SEQ ID NO: 412298 - RNA, 16 nt, Bordetella pertussis
gagugcccauggagac

SEQ ID NO: 412299 - RNA, 20 nt, Bordetella pertussis
gaguugaaggcuuucugcuu

SEQ ID NO: 412300 - RNA, 17 nt, Bordetella pertussis
gaguugaggaugcgcgc

SEQ ID NO: 412301 - RNA, 21 nt, Bordetella pertussis
gauacaaggugccuguccccg

SEQ ID NO: 412302 - RNA, 19 nt, Bordetella pertussis
gauaccaacugccugcagc

SEQ ID NO: 412303 - RNA, 18 nt, Bordetella pertussis
gauaccacgcgcggcggc

SEQ ID NO: 412304 - RNA, 13 nt, Bordetella pertussis
gauaccgccgccg

SEQ ID NO: 412305 - RNA, 15 nt, Bordetella pertussis
gauaccggcauggca

SEQ ID NO: 412306 - RNA, 14 nt, Bordetella pertussis
gauagcccagcacc

SEQ ID NO: 412307 - RNA, 15 nt, Bordetella pertussis
gauagcccagcaccu

SEQ ID NO: 412308 - RNA, 22 nt, Bordetella pertussis
gauagcccagcaccugcaggcc

SEQ ID NO: 412309 - RNA, 21 nt, Bordetella pertussis
gauagcccuugaucagcggcg

SEQ ID NO: 412310 - RNA, 23 nt, Bordetella pertussis
gauagcccuugaucagcggcggc

SEQ ID NO: 412311 - RNA, 23 nt, Bordetella pertussis
gauagccgcgcgccugcagcagc

SEQ ID NO: 412312 - RNA, 20 nt, Bordetella pertussis
gauauccagguaggcggcgc

SEQ ID NO: 412313 - RNA, 23 nt, Bordetella pertussis
gauaucccgcucggcuggagcuc

SEQ ID NO: 412314 - RNA, 22 nt, Bordetella pertussis
gauauccuugcgcucgcccagc

SEQ ID NO: 412315 - RNA, 17 nt, Bordetella pertussis
gaucacauaggccggca

SEQ ID NO: 412316 - RNA, 22 nt, Bordetella pertussis
gcaaccggucggccggcagcgg

SEQ ID NO: 412317 - RNA, 23 nt, Bordetella pertussis
gcaaccggucggccggcagcggc

SEQ ID NO: 412318 - RNA, 18 nt, Bordetella pertussis
gcaaccgucgccagcgcg

SEQ ID NO: 412319 - RNA, 23 nt, Bordetella pertussis
gcaaccgucggugaugcucugcc

SEQ ID NO: 412320 - RNA, 21 nt, Bordetella pertussis
gcaaccucgccgcgccagcug

SEQ ID NO: 412321 - RNA, 13 nt, Bordetella pertussis
gcaaccuggucaa

SEQ ID NO: 412322 - RNA, 22 nt, Bordetella pertussis
gcaacgcaggcgccgccccguc

SEQ ID NO: 412323 - RNA, 18 nt, Bordetella pertussis
gcaacgccacgcgcggau

SEQ ID NO: 412324 - RNA, 21 nt, Bordetella pertussis
gcaacgccgcccguccgggcg

SEQ ID NO: 412325 - RNA, 24 nt, Bordetella pertussis
gcaacgccggccauggcggccggc

SEQ ID NO: 412326 - RNA, 16 nt, Bordetella pertussis
gcaacgcgcgcgcgca

SEQ ID NO: 412327 - RNA, 14 nt, Bordetella pertussis
gcaacguggugcuc

SEQ ID NO: 412328 - RNA, 17 nt, Bordetella pertussis
gcaacguugcugcagcg

SEQ ID NO: 412329 - RNA, 16 nt, Bordetella pertussis
gcaacucuuccccguc

SEQ ID NO: 412330 - RNA, 19 nt, Bordetella pertussis
aaagcgcuucugccagacg

SEQ ID NO: 412331 - RNA, 14 nt, Bordetella pertussis
gcaacugguuggcc

SEQ ID NO: 412332 - RNA, 21 nt, Bordetella pertussis
gcaagacggcguuucuacugg

SEQ ID NO: 412333 - RNA, 16 nt, Bordetella pertussis
gcaagcaagccccagg

SEQ ID NO: 412334 - RNA, 17 nt, Bordetella pertussis
gcaagcaagccccaggc

SEQ ID NO: 412335 - RNA, 21 nt, Bordetella pertussis
gcaagccagcacguaaucgaa

SEQ ID NO: 412336 - RNA, 16 nt, Bordetella pertussis
gcaagccagggcagga

SEQ ID NO: 412337 - RNA, 12 nt, Bordetella pertussis
gcaagccccagg

SEQ ID NO: 412338 - RNA, 19 nt, Bordetella pertussis
gcaagccgccgcccucgcc

SEQ ID NO: 412339 - RNA, 13 nt, Bordetella pertussis
gcaagccggccgc

SEQ ID NO: 412340 - RNA, 20 nt, Bordetella pertussis
gcaagcgcgucgauggaguc

SEQ ID NO: 412341 - RNA, 17 nt, Bordetella pertussis
gcaagcgcucgccggcg

SEQ ID NO: 412342 - RNA, 17 nt, Bordetella pertussis
gcaagcgcuggaugguc

SEQ ID NO: 412343 - RNA, 17 nt, Bordetella pertussis
gcaagcggcguggggcc

SEQ ID NO: 412344 - RNA, 22 nt, Bordetella pertussis
gcaagcugcugcuggaccuggc

SEQ ID NO: 412345 - RNA, 16 nt, Bordetella pertussis
gcaagcuggccgaugu

SEQ ID NO: 412346 - RNA, 14 nt, Bordetella pertussis
gcaagcuggcggcg

SEQ ID NO: 412347 - RNA, 20 nt, Bordetella pertussis
gcaagcuggcggcgcgcggc

SEQ ID NO: 412348 - RNA, 21 nt, Bordetella pertussis
gcaaggaccaugcgcugggca

SEQ ID NO: 412349 - RNA, 19 nt, Bordetella pertussis
gcaaggcaugcgccagcgc

SEQ ID NO: 412350 - RNA, 22 nt, Bordetella pertussis
gcaaggcccgccgcggcaggcc

SEQ ID NO: 412351 - RNA, 12 nt, Bordetella pertussis
gcaaggccgcga

SEQ ID NO: 412352 - RNA, 15 nt, Bordetella pertussis
gcaaggccggcggca

SEQ ID NO: 412353 - RNA, 18 nt, Bordetella pertussis
gcaaggccugcucgggcg

SEQ ID NO: 412354 - RNA, 17 nt, Bordetella pertussis
gcaaggcggcaaacccg

SEQ ID NO: 412355 - RNA, 12 nt, Bordetella pertussis
gcaaggcgggcu

SEQ ID NO: 412356 - RNA, 18 nt, Bordetella pertussis
gcaaggcgucggccaggc

SEQ ID NO: 412357 - RNA, 12 nt, Bordetella pertussis
gcaagggccaga

SEQ ID NO: 412358 - RNA, 12 nt, Bordetella pertussis
gcaagggccagu

SEQ ID NO: 412359 - RNA, 15 nt, Bordetella pertussis
gcaagggccccagca

SEQ ID NO: 412360 - RNA, 21 nt, Bordetella pertussis
gcaaggggccagccuggcgcc

SEQ ID NO: 412361 - RNA, 19 nt, Bordetella pertussis
gcaagggugccuguccccg

SEQ ID NO: 412362 - RNA, 13 nt, Bordetella pertussis
gcaaggugaucga

SEQ ID NO: 412363 - RNA, 20 nt, Bordetella pertussis
gcaagguggcgugcagcagg

SEQ ID NO: 412364 - RNA, 15 nt, Bordetella pertussis
gcaagucagcccgcg

SEQ ID NO: 412365 - RNA, 18 nt, Bordetella pertussis
gcaaguccagcgugguga

SEQ ID NO: 412366 - RNA, 16 nt, Bordetella pertussis
gcaagucgacgcugau

SEQ ID NO: 412367 - RNA, 17 nt, Bordetella pertussis
gcaagucuucuucagca

SEQ ID NO: 412368 - RNA, 20 nt, Bordetella pertussis
gcaagugcuggcccgccagc

SEQ ID NO: 412369 - RNA, 15 nt, Bordetella pertussis
gcaaguucaucaucg

SEQ ID NO: 412370 - RNA, 15 nt, Bordetella pertussis
gcaauacgugcgcga

SEQ ID NO: 412371 - RNA, 16 nt, Bordetella pertussis
gcaauagaucauccag

SEQ ID NO: 412372 - RNA, 14 nt, Bordetella pertussis
gcaauaggccgcga

SEQ ID NO: 412373 - RNA, 23 nt, Bordetella pertussis
gcaauccccgcuuccugcugcgc

SEQ ID NO: 412374 - RNA, 15 nt, Bordetella pertussis
gcaauccgucaggca

SEQ ID NO: 412375 - RNA, 20 nt, Bordetella pertussis
gcaaucggagguaugcacga

SEQ ID NO: 412376 - RNA, 14 nt, Bordetella pertussis
gcaaucggcgugca

SEQ ID NO: 412377 - RNA, 16 nt, Bordetella pertussis
gcaaugcgcggcgcuc

SEQ ID NO: 412378 - RNA, 19 nt, Bordetella pertussis
gcaaugucgcaggccgcgg

SEQ ID NO: 412379 - RNA, 17 nt, Bordetella pertussis
gcaauucgaccggcagg

SEQ ID NO: 412380 - RNA, 19 nt, Bordetella pertussis
gcaauugccccagcacgaa

SEQ ID NO: 412381 - RNA, 22 nt, Bordetella pertussis
gcacaaagcggguugcggcagc

SEQ ID NO: 412382 - RNA, 13 nt, Bordetella pertussis
gcacaacccgccc

SEQ ID NO: 412383 - RNA, 22 nt, Bordetella pertussis
gcacaagggccccucgcggggc

SEQ ID NO: 412384 - RNA, 14 nt, Bordetella pertussis
gcacaccaucagcu

SEQ ID NO: 412385 - RNA, 17 nt, Bordetella pertussis
gcacaccaucagcugga

SEQ ID NO: 412386 - RNA, 21 nt, Bordetella pertussis
gcacacccuccuacgccauga

SEQ ID NO: 412387 - RNA, 23 nt, Bordetella pertussis
gcacacccuccuacgccaugaca

SEQ ID NO: 412388 - RNA, 23 nt, Bordetella pertussis
gcacaccgcccgaaagguccugg

SEQ ID NO: 412389 - RNA, 21 nt, Bordetella pertussis
gcacaccggucuacgccauga

SEQ ID NO: 412390 - RNA, 14 nt, Bordetella pertussis
gcacacgcgcuggg

SEQ ID NO: 412391 - RNA, 14 nt, Bordetella pertussis
gcacacuggccagc

SEQ ID NO: 412392 - RNA, 15 nt, Bordetella pertussis
gcacacuggccagca

SEQ ID NO: 412393 - RNA, 19 nt, Bordetella pertussis
gcacagcaccugguggcgc

SEQ ID NO: 412394 - RNA, 13 nt, Bordetella pertussis
gcacagccgcagc

SEQ ID NO: 412395 - RNA, 16 nt, Bordetella pertussis
gcacagccggggcgag

SEQ ID NO: 412396 - RNA, 12 nt, Bordetella pertussis
gcacagcgcggc

SEQ ID NO: 412397 - RNA, 13 nt, Bordetella pertussis
gcacagcgcggcg

SEQ ID NO: 412398 - RNA, 18 nt, Bordetella pertussis
gcacaggaacagccugcc

SEQ ID NO: 412399 - RNA, 17 nt, Bordetella pertussis
gcacauacaaggcgcgg

SEQ ID NO: 412400 - RNA, 19 nt, Bordetella pertussis
gcacauacaaggcgcggca

SEQ ID NO: 412401 - RNA, 15 nt, Bordetella pertussis
gcacauacgccgccg

SEQ ID NO: 412402 - RNA, 16 nt, Bordetella pertussis
gcacauccagcgccag

SEQ ID NO: 412403 - RNA, 19 nt, Bordetella pertussis
gcacauccagcgccagcac

SEQ ID NO: 412404 - RNA, 19 nt, Bordetella pertussis
gcacaucgacgucggccuc

SEQ ID NO: 412405 - RNA, 15 nt, Bordetella pertussis
gcacaugaugcccag

SEQ ID NO: 412406 - RNA, 17 nt, Bordetella pertussis
gcacaugaugcccagcg

SEQ ID NO: 412407 - RNA, 16 nt, Bordetella pertussis
gcacauggcgcgccgg

SEQ ID NO: 412408 - RNA, 17 nt, Bordetella pertussis
gcacauggcgcgccggc

SEQ ID NO: 412409 - RNA, 15 nt, Bordetella pertussis
gcacauggcggaugg

SEQ ID NO: 412410 - RNA, 13 nt, Bordetella pertussis
gcacaugggcgcg

SEQ ID NO: 412411 - RNA, 19 nt, Bordetella pertussis
gcaccaaucuugccaggcc

SEQ ID NO: 412412 - RNA, 23 nt, Bordetella pertussis
gcaccaaucuugccaggcccggc

SEQ ID NO: 412413 - RNA, 19 nt, Bordetella pertussis
gcaccaccaccaugugcuu

SEQ ID NO: 412414 - RNA, 15 nt, Bordetella pertussis
gcaccaccaccgccc

SEQ ID NO: 412415 - RNA, 18 nt, Bordetella pertussis
gcaccaccagcaccgcca

SEQ ID NO: 412416 - RNA, 19 nt, Bordetella pertussis
gcaccacggcggccaggcc

SEQ ID NO: 412417 - RNA, 23 nt, Bordetella pertussis
gcaccacggcggccaggccggcg

SEQ ID NO: 412418 - RNA, 11 nt, Bordetella pertussis
gcaccagcagg

SEQ ID NO: 412419 - RNA, 13 nt, Bordetella pertussis
gcaccagcaggcc

SEQ ID NO: 412420 - RNA, 14 nt, Bordetella pertussis
gcaccagcaggccg

SEQ ID NO: 412421 - RNA, 17 nt, Bordetella pertussis
gcaccagcagccccagc

SEQ ID NO: 412422 - RNA, 19 nt, Bordetella pertussis
gcaccagcagccccagcgu

SEQ ID NO: 412423 - RNA, 22 nt, Bordetella pertussis
gcaccagcccgaugcgccaggc

SEQ ID NO: 412424 - RNA, 14 nt, Bordetella pertussis
gcaccagcccgccc

SEQ ID NO: 412425 - RNA, 12 nt, Bordetella pertussis
gcaccagccggg

SEQ ID NO: 412426 - RNA, 21 nt, Bordetella pertussis
gcaccagcgcauugccgccgc

SEQ ID NO: 412427 - RNA, 16 nt, Bordetella pertussis
gcaccagcgcgccgau

SEQ ID NO: 412428 - RNA, 23 nt, Bordetella pertussis
gcaccagcgcgccgcgcgcggcg

SEQ ID NO: 412429 - RNA, 20 nt, Bordetella pertussis
gcaccagcuuggccugcgga

SEQ ID NO: 412430 - RNA, 18 nt, Bordetella pertussis
gcaccaggcccaugaagg

SEQ ID NO: 412431 - RNA, 19 nt, Bordetella pertussis
gcaccaggccgccggccag

SEQ ID NO: 412432 - RNA, 22 nt, Bordetella pertussis
gcaccaggccgccggccagcgc

SEQ ID NO: 412433 - RNA, 13 nt, Bordetella pertussis
gcaccaggccgcg

SEQ ID NO: 412434 - RNA, 14 nt, Bordetella pertussis
gcaccaggccugcc

SEQ ID NO: 412435 - RNA, 15 nt, Bordetella pertussis
gcaccaggcgcggcg

SEQ ID NO: 412436 - RNA, 20 nt, Bordetella pertussis
gcaccagggcgcgcagcagg

SEQ ID NO: 412437 - RNA, 20 nt, Bordetella pertussis
gcaccagguugcauccggcc

SEQ ID NO: 412438 - RNA, 17 nt, Bordetella pertussis
gcaccagucccgcaccg

SEQ ID NO: 412439 - RNA, 22 nt, Bordetella pertussis
gcaccagugcgccggcgcggcg

SEQ ID NO: 412440 - RNA, 14 nt, Bordetella pertussis
gcaccaguuuucuc

SEQ ID NO: 412441 - RNA, 16 nt, Bordetella pertussis
gcaccaugcgcagcaa

SEQ ID NO: 412442 - RNA, 19 nt, Bordetella pertussis
gcaccauggcgcccacggc

SEQ ID NO: 412443 - RNA, 23 nt, Bordetella pertussis
gcaccaugggcucgugcagcagg

SEQ ID NO: 412444 - RNA, 23 nt, Bordetella pertussis
gcaccaugugcgagagcuccagc

SEQ ID NO: 412445 - RNA, 13 nt, Bordetella pertussis
gcacccagccgga

SEQ ID NO: 412446 - RNA, 21 nt, Bordetella pertussis
gcacccagccggacccgcgcc

SEQ ID NO: 412447 - RNA, 18 nt, Bordetella pertussis
gcacccaggcgggcuggc

SEQ ID NO: 412448 - RNA, 14 nt, Bordetella pertussis
gcaccccagcaccc

SEQ ID NO: 412449 - RNA, 19 nt, Bordetella pertussis
gcacccccgaccgagccac

SEQ ID NO: 412450 - RNA, 18 nt, Bordetella pertussis
gcaccccggcgccgcguu

SEQ ID NO: 412451 - RNA, 21 nt, Bordetella pertussis
gcacccgaugacggggcggcg

SEQ ID NO: 412452 - RNA, 13 nt, Bordetella pertussis
gcacccgcacggg

SEQ ID NO: 412453 - RNA, 21 nt, Bordetella pertussis
gcacccgcaggcggcuggugc

SEQ ID NO: 412454 - RNA, 18 nt, Bordetella pertussis
gcacccgcaugguggcgc

SEQ ID NO: 412455 - RNA, 21 nt, Bordetella pertussis
gcacccgcggcgcaugcagcc

SEQ ID NO: 412456 - RNA, 23 nt, Bordetella pertussis
gcacccgcggcgcaugcagccgc

SEQ ID NO: 412457 - RNA, 23 nt, Bordetella pertussis
gcacccgucccugguccagcagc

SEQ ID NO: 412458 - RNA, 11 nt, Bordetella pertussis
gcacccugccc

SEQ ID NO: 412459 - RNA, 21 nt, Bordetella pertussis
gcacccugucauacgccauga

SEQ ID NO: 412460 - RNA, 16 nt, Bordetella pertussis
gcacccuugccgcagc

SEQ ID NO: 412461 - RNA, 19 nt, Bordetella pertussis
gcacccuugccgcagcggg

SEQ ID NO: 412462 - RNA, 17 nt, Bordetella pertussis
gcacccuugccgcagga

SEQ ID NO: 412463 - RNA, 22 nt, Bordetella pertussis
gcacccuugcucagucgggcag

SEQ ID NO: 412464 - RNA, 15 nt, Bordetella pertussis
gcaccgaacccugcc

SEQ ID NO: 412465 - RNA, 13 nt, Bordetella pertussis
gcaccgacaggcc

SEQ ID NO: 412466 - RNA, 16 nt, Bordetella pertussis
gcaccgaccagcgcgc

SEQ ID NO: 412467 - RNA, 22 nt, Bordetella pertussis
gcaccgaccagcgcgcgccggc

SEQ ID NO: 412468 - RNA, 18 nt, Bordetella pertussis
gcaccgagcacagcaacu

SEQ ID NO: 412469 - RNA, 15 nt, Bordetella pertussis
gcaccgagcugccgc

SEQ ID NO: 412470 - RNA, 17 nt, Bordetella pertussis
gcaccgagcugccgccu

SEQ ID NO: 412471 - RNA, 18 nt, Bordetella pertussis
gcaccgagcugccgccuu

SEQ ID NO: 412472 - RNA, 16 nt, Bordetella pertussis
gcaccgaugcgccggc

SEQ ID NO: 412473 - RNA, 17 nt, Bordetella pertussis
gcaccgaugcgccggcc

SEQ ID NO: 412474 - RNA, 15 nt, Bordetella pertussis
gcaccgccgcacagc

SEQ ID NO: 412475 - RNA, 12 nt, Bordetella pertussis
gcaccgccgccg

SEQ ID NO: 412476 - RNA, 17 nt, Bordetella pertussis
gcaccgcgcagcccggc

SEQ ID NO: 412477 - RNA, 15 nt, Bordetella pertussis
gcaccgcgccagcgc

SEQ ID NO: 412478 - RNA, 16 nt, Bordetella pertussis
gcaccgcgccagcgcc

SEQ ID NO: 412479 - RNA, 17 nt, Bordetella pertussis
gcaccgcgccagcgccg

SEQ ID NO: 412480 - RNA, 16 nt, Bordetella pertussis
gcaccgcgcgcacgac

SEQ ID NO: 412481 - RNA, 15 nt, Bordetella pertussis
gcaccgcggcgggcu

SEQ ID NO: 412482 - RNA, 17 nt, Bordetella pertussis
gcaccgcguggcgcugc

SEQ ID NO: 412483 - RNA, 22 nt, Bordetella pertussis
gcaccggauccugcggcgcggu

SEQ ID NO: 412484 - RNA, 16 nt, Bordetella pertussis
gcaccggcacgacggc

SEQ ID NO: 412485 - RNA, 22 nt, Bordetella pertussis
gcaccggcacgacggccuccgc

SEQ ID NO: 412486 - RNA, 21 nt, Bordetella pertussis
gcaccggcagcguaucgcccg

SEQ ID NO: 412487 - RNA, 14 nt, Bordetella pertussis
gcaccggccgccgc

SEQ ID NO: 412488 - RNA, 19 nt, Bordetella pertussis
gcaccggccggccgggcag

SEQ ID NO: 412489 - RNA, 16 nt, Bordetella pertussis
gcaccggcgccacggc

SEQ ID NO: 412490 - RNA, 19 nt, Bordetella pertussis
gcaccggcgugagcgccac

SEQ ID NO: 412491 - RNA, 19 nt, Bordetella pertussis
gcaccggguaauggcgcuc

SEQ ID NO: 412492 - RNA, 22 nt, Bordetella pertussis
gcaccggguaauggcgcuccag

SEQ ID NO: 412493 - RNA, 18 nt, Bordetella pertussis
gcaccggugggagccagu

SEQ ID NO: 412494 - RNA, 15 nt, Bordetella pertussis
gcaccgucacgcgcu

SEQ ID NO: 412495 - RNA, 14 nt, Bordetella pertussis
gcaccgugccggcg

SEQ ID NO: 412496 - RNA, 14 nt, Bordetella pertussis
gcaccucggcgccc

SEQ ID NO: 412497 - RNA, 18 nt, Bordetella pertussis
gcaccucggcgcccagcu

SEQ ID NO: 412498 - RNA, 18 nt, Bordetella pertussis
gcaccucggcgccgcggc

SEQ ID NO: 412499 - RNA, 20 nt, Bordetella pertussis
gcaccucggcguggcgggga

SEQ ID NO: 412500 - RNA, 23 nt, Bordetella pertussis
gcaccugaacaccggcgcgccug

SEQ ID NO: 412501 - RNA, 23 nt, Bordetella pertussis
gcaccugcaagauuucauggcgu

SEQ ID NO: 412502 - RNA, 18 nt, Bordetella pertussis
gcaccugcaggccgccgg

SEQ ID NO: 412503 - RNA, 19 nt, Bordetella pertussis
gcaccugcaggccgccggc

SEQ ID NO: 412504 - RNA, 18 nt, Bordetella pertussis
gcaccugcagggucagcc

SEQ ID NO: 412505 - RNA, 17 nt, Bordetella pertussis
gcaccugcgaccgagcc

SEQ ID NO: 412506 - RNA, 14 nt, Bordetella pertussis
gcaccugcuccagc

SEQ ID NO: 412507 - RNA, 18 nt, Bordetella pertussis
gcaccugcugcggcacgg

SEQ ID NO: 412508 - RNA, 20 nt, Bordetella pertussis
gcaccugggaggggccggcu

SEQ ID NO: 412509 - RNA, 21 nt, Bordetella pertussis
gcaccugggaggggccggcuu

SEQ ID NO: 412510 - RNA, 20 nt, Bordetella pertussis
gcaccuucugccgccaggca

SEQ ID NO: 412511 - RNA, 21 nt, Bordetella pertussis
gcaccuucugccgccaggcau

SEQ ID NO: 412512 - RNA, 15 nt, Bordetella pertussis
gcaccuugggcgccu

SEQ ID NO: 412513 - RNA, 23 nt, Bordetella pertussis
gcaccuuguacuggucgcgcagc

SEQ ID NO: 412514 - RNA, 16 nt, Bordetella pertussis
gcacgaacgacacccg

SEQ ID NO: 412515 - RNA, 15 nt, Bordetella pertussis
gcacgaagggcagca

SEQ ID NO: 412516 - RNA, 17 nt, Bordetella pertussis
gcacgaagggcagcagc

SEQ ID NO: 412517 - RNA, 14 nt, Bordetella pertussis
gcacgaccaggccg

SEQ ID NO: 412518 - RNA, 14 nt, Bordetella pertussis
gcacgaccugcgca

SEQ ID NO: 412519 - RNA, 15 nt, Bordetella pertussis
gcacgaccugcgcau

SEQ ID NO: 412520 - RNA, 22 nt, Bordetella pertussis
gcacgacgcugaugcccagccc

SEQ ID NO: 412521 - RNA, 18 nt, Bordetella pertussis
gcacgacgucgcgcggau

SEQ ID NO: 412522 - RNA, 19 nt, Bordetella pertussis
gcacgauauuggcgucggc

SEQ ID NO: 412523 - RNA, 20 nt, Bordetella pertussis
gcacgaucaccgccgcggcg

SEQ ID NO: 412524 - RNA, 21 nt, Bordetella pertussis
gcacgaucgcggcgcuggcga

SEQ ID NO: 412525 - RNA, 22 nt, Bordetella pertussis
gcacgaucggcgccuggccgcc

SEQ ID NO: 412526 - RNA, 15 nt, Bordetella pertussis
gcacgauggccgcgc

SEQ ID NO: 412527 - RNA, 13 nt, Bordetella pertussis
gcacgauggcgcc

SEQ ID NO: 412528 - RNA, 18 nt, Bordetella pertussis
gcacgauggcgccggcuu

SEQ ID NO: 412529 - RNA, 14 nt, Bordetella pertussis
gcacgauggcgcgc

SEQ ID NO: 412530 - RNA, 13 nt, Bordetella pertussis
gcacgauguugcc

SEQ ID NO: 412531 - RNA, 16 nt, Bordetella pertussis
gcacgauguugccgcc

SEQ ID NO: 412532 - RNA, 18 nt, Bordetella pertussis
gcacgauguugccgccgg

SEQ ID NO: 412533 - RNA, 19 nt, Bordetella pertussis
gcacgauguugccgccggc

SEQ ID NO: 412534 - RNA, 16 nt, Bordetella pertussis
gcacgauuucacccag

SEQ ID NO: 412535 - RNA, 21 nt, Bordetella pertussis
gcacgauuucgccgauccggu

SEQ ID NO: 412536 - RNA, 14 nt, Bordetella pertussis
gcacgauuuuucgc

SEQ ID NO: 412537 - RNA, 12 nt, Bordetella pertussis
gcacgauggggc

SEQ ID NO: 412538 - RNA, 14 nt, Bordetella pertussis
gcacgauggggccg

SEQ ID NO: 412539 - RNA, 15 nt, Bordetella pertussis
gcacgaugguaucgg

SEQ ID NO: 412540 - RNA, 22 nt, Bordetella pertussis
gcacgaugguaucggccgggcc

SEQ ID NO: 412541 - RNA, 17 nt, Bordetella pertussis
gcacgauggucagcggc

SEQ ID NO: 412542 - RNA, 19 nt, Bordetella pertussis
gcacgcaggauaccggagc

SEQ ID NO: 412543 - RNA, 22 nt, Bordetella pertussis
gcacgccauggucucguccacc

SEQ ID NO: 412544 - RNA, 14 nt, Bordetella pertussis
gcacgcccagccgc

SEQ ID NO: 412545 - RNA, 21 nt, Bordetella pertussis
gcacgcccagccgcagcaggc

SEQ ID NO: 412546 - RNA, 20 nt, Bordetella pertussis
gcacgcccgccugcagcagc

SEQ ID NO: 412547 - RNA, 16 nt, Bordetella pertussis
gcacgcccgcgcgcga

SEQ ID NO: 412548 - RNA, 16 nt, Bordetella pertussis
gcacgcccgcggcgcc

SEQ ID NO: 412549 - RNA, 17 nt, Bordetella pertussis
gcacgcccgccagcagc

SEQ ID NO: 412550 - RNA, 18 nt, Bordetella pertussis
gcacgcccgccagcagcu

SEQ ID NO: 412551 - RNA, 13 nt, Bordetella pertussis
gcacgccgcgccg

SEQ ID NO: 412552 - RNA, 15 nt, Bordetella pertussis
gcacgccgcgccggc

SEQ ID NO: 412553 - RNA, 13 nt, Bordetella pertussis
gcacgccggcggc

SEQ ID NO: 412554 - RNA, 15 nt, Bordetella pertussis
gcacgccggcggccc

SEQ ID NO: 412555 - RNA, 15 nt, Bordetella pertussis
gcacgccggcggcgc

SEQ ID NO: 412556 - RNA, 19 nt, Bordetella pertussis
gcacgccggcggcgcuggc

SEQ ID NO: 412557 - RNA, 12 nt, Bordetella pertussis
gcacgccgggcg

SEQ ID NO: 412558 - RNA, 16 nt, Bordetella pertussis
gcacgccgggcgcgcu

SEQ ID NO: 412559 - RNA, 19 nt, Bordetella pertussis
gcacgccgggcgcgcugcc

SEQ ID NO: 412560 - RNA, 18 nt, Bordetella pertussis
gcacgccgggcgcggccg

SEQ ID NO: 412561 - RNA, 14 nt, Bordetella pertussis
gcacgccggccugc

SEQ ID NO: 412562 - RNA, 17 nt, Bordetella pertussis
gcacgccggccuugcug

SEQ ID NO: 412563 - RNA, 19 nt, Bordetella pertussis
gcacgccggucgccagcga

SEQ ID NO: 412564 - RNA, 16 nt, Bordetella pertussis
gcacgccucgccggcc

SEQ ID NO: 412565 - RNA, 17 nt, Bordetella pertussis
gcacgccucgccggccc

SEQ ID NO: 412566 - RNA, 17 nt, Bordetella pertussis
gcacgccugccgcgccc

SEQ ID NO: 412567 - RNA, 21 nt, Bordetella pertussis
gcacgccugccgcgcccggcg

SEQ ID NO: 412568 - RNA, 16 nt, Bordetella pertussis
gcacgcgcaccaggcc

SEQ ID NO: 412569 - RNA, 20 nt, Bordetella pertussis
gcacgcgcaccaggccugcc

SEQ ID NO: 412570 - RNA, 14 nt, Bordetella pertussis
gcacgcgcgcggcg

SEQ ID NO: 412571 - RNA, 12 nt, Bordetella pertussis
gcacgcgcggca

SEQ ID NO: 412572 - RNA, 22 nt, Bordetella pertussis
gcacgcgcugaauccggggugc

SEQ ID NO: 412573 - RNA, 14 nt, Bordetella pertussis
gcacgcggccgcgc

SEQ ID NO: 412574 - RNA, 22 nt, Bordetella pertussis
gcacgcggccgcgggccgcugg

SEQ ID NO: 412575 - RNA, 14 nt, Bordetella pertussis
gcacgcggcgcagc

SEQ ID NO: 412576 - RNA, 15 nt, Bordetella pertussis
gcacgcggcgcggca

SEQ ID NO: 412577 - RNA, 16 nt, Bordetella pertussis
gcacgcgguccacgcc

SEQ ID NO: 412578 - RNA, 18 nt, Bordetella pertussis
gcacgcguucgggcggca

SEQ ID NO: 412579 - RNA, 17 nt, Bordetella pertussis
gcacgcguaugcccugc

SEQ ID NO: 412580 - RNA, 22 nt, Bordetella pertussis
gcacgcucagcaugcgcugggc

SEQ ID NO: 412581 - RNA, 23 nt, Bordetella pertussis
gcacgcucagcaugcgcugggcg

SEQ ID NO: 412582 - RNA, 18 nt, Bordetella pertussis
gcacgcucuacacggccg

SEQ ID NO: 412583 - RNA, 24 nt, Bordetella pertussis
gcacgcucugcaccuugggcgccu

SEQ ID NO: 412584 - RNA, 20 nt, Bordetella pertussis
gcacgcugaccgaagcgggc

SEQ ID NO: 412585 - RNA, 23 nt, Bordetella pertussis
gcacgcugaccgaagcgggcgag

SEQ ID NO: 412586 - RNA, 18 nt, Bordetella pertussis
gcacgcugaucgccggcg

SEQ ID NO: 412587 - RNA, 15 nt, Bordetella pertussis
gcacgcugcgcggcg

SEQ ID NO: 412588 - RNA, 19 nt, Bordetella pertussis
gcacgcugcgcggcggcuu

SEQ ID NO: 412589 - RNA, 16 nt, Bordetella pertussis
gcacgcuggcgcccgc

SEQ ID NO: 412590 - RNA, 18 nt, Bordetella pertussis
gcacgcuggcgcccgccu

SEQ ID NO: 412591 - RNA, 17 nt, Bordetella pertussis
gcacggccagcaccaug

SEQ ID NO: 412592 - RNA, 22 nt, Bordetella pertussis
gcacggccagcaccaugggcuc

SEQ ID NO: 412593 - RNA, 16 nt, Bordetella pertussis
gcacggccggccaggc

SEQ ID NO: 412594 - RNA, 19 nt, Bordetella pertussis
gcacggccuugucgcgccc

SEQ ID NO: 412595 - RNA, 14 nt, Bordetella pertussis
gcacgggccaugga

SEQ ID NO: 412596 - RNA, 15 nt, Bordetella pertussis
gcacgggcgagggcu

SEQ ID NO: 412597 - RNA, 19 nt, Bordetella pertussis
gcacgggcgccuguccccg

SEQ ID NO: 412598 - RNA, 18 nt, Bordetella pertussis
gcacgggcgcugcccagg

SEQ ID NO: 412599 - RNA, 13 nt, Bordetella pertussis
gcacggggacagg

SEQ ID NO: 412600 - RNA, 16 nt, Bordetella pertussis
gcacggggacaggcac

SEQ ID NO: 412601 - RNA, 15 nt, Bordetella pertussis
gcacggggacuggca

SEQ ID NO: 412602 - RNA, 14 nt, Bordetella pertussis
gcacggggcaucaa

SEQ ID NO: 412603 - RNA, 22 nt, Bordetella pertussis
gcacgggucaggcugcggcgga

SEQ ID NO: 412604 - RNA, 16 nt, Bordetella pertussis
gcacggcguggcgcgc

SEQ ID NO: 412605 - RNA, 20 nt, Bordetella pertussis
gcacgguccaggcggccgcg

SEQ ID NO: 412606 - RNA, 14 nt, Bordetella pertussis
gcacggucggcgcg

SEQ ID NO: 412607 - RNA, 15 nt, Bordetella pertussis
gcacggugccgcgcg

SEQ ID NO: 412608 - RNA, 17 nt, Bordetella pertussis
gcacggugccgcgcgcu

SEQ ID NO: 412609 - RNA, 19 nt, Bordetella pertussis
gcacggugccgcgcgcuuc

SEQ ID NO: 412610 - RNA, 22 nt, Bordetella pertussis
gcacgguggcgaaggccgccgc

SEQ ID NO: 412611 - RNA, 13 nt, Bordetella pertussis
gcacgguggcgcc

SEQ ID NO: 412612 - RNA, 19 nt, Bordetella pertussis
gcacggugggcagcagcac

SEQ ID NO: 412613 - RNA, 22 nt, Bordetella pertussis
gcacggugggcagcagcacgcc

SEQ ID NO: 412614 - RNA, 21 nt, Bordetella pertussis
gcacguaaucgaagccgggcg

SEQ ID NO: 412615 - RNA, 23 nt, Bordetella pertussis
gcacguccagagucugccuggcg

SEQ ID NO: 412616 - RNA, 15 nt, Bordetella pertussis
gcacgugacgccggc

SEQ ID NO: 412617 - RNA, 22 nt, Bordetella pertussis
gcacgugccggauggcgcggau

SEQ ID NO: 412618 - RNA, 22 nt, Bordetella pertussis
gcacgugccggccgccuccagg

SEQ ID NO: 412619 - RNA, 17 nt, Bordetella pertussis
gcacgugggcacgccgg

SEQ ID NO: 412620 - RNA, 18 nt, Bordetella pertussis
gcacgugggcacgccggc

SEQ ID NO: 412621 - RNA, 20 nt, Bordetella pertussis
gcacgugggcacgccggccu

SEQ ID NO: 412622 - RNA, 17 nt, Bordetella pertussis
gcacguggucgugcagg

SEQ ID NO: 412623 - RNA, 19 nt, Bordetella pertussis
gcacucgaccgccgggaca

SEQ ID NO: 412624 - RNA, 21 nt, Bordetella pertussis
gcacugagaaaggccgccacg

SEQ ID NO: 412625 - RNA, 20 nt, Bordetella pertussis
gcacugaugcuggucagccu

SEQ ID NO: 412626 - RNA, 13 nt, Bordetella pertussis
gcacugaucgccg

SEQ ID NO: 412627 - RNA, 16 nt, Bordetella pertussis
gcacugaucgccgccu

SEQ ID NO: 412628 - RNA, 16 nt, Bordetella pertussis
gcacuggcgcggcgcu

SEQ ID NO: 412629 - RNA, 14 nt, Bordetella pertussis
gcacuggguuuuuc

SEQ ID NO: 412630 - RNA, 23 nt, Bordetella pertussis
gcacugucggcguuccuggcgcu

SEQ ID NO: 412631 - RNA, 16 nt, Bordetella pertussis
gcacuucgggccaccc

SEQ ID NO: 412632 - RNA, 17 nt, Bordetella pertussis
gcagaaaccgccacagc

SEQ ID NO: 412633 - RNA, 20 nt, Bordetella pertussis
gcagaaaggaugcccgcggg

SEQ ID NO: 412634 - RNA, 13 nt, Bordetella pertussis
gcagaacagcagc

SEQ ID NO: 412635 - RNA, 14 nt, Bordetella pertussis
gcagaacagcagcg

SEQ ID NO: 412636 - RNA, 19 nt, Bordetella pertussis
gcagaacggaaacgcccag

SEQ ID NO: 412637 - RNA, 18 nt, Bordetella pertussis
gcagaagaacaccgugug

SEQ ID NO: 412638 - RNA, 16 nt, Bordetella pertussis
gcagaagcagccgcgc

SEQ ID NO: 412639 - RNA, 14 nt, Bordetella pertussis
gcagacccgcgccc

SEQ ID NO: 412640 - RNA, 15 nt, Bordetella pertussis
gcagacccuggcgcg

SEQ ID NO: 412641 - RNA, 19 nt, Bordetella pertussis
gcagacgaucauccaggcc

SEQ ID NO: 412642 - RNA, 16 nt, Bordetella pertussis
gcagacgcuucaggcc

SEQ ID NO: 412643 - RNA, 13 nt, Bordetella pertussis
gcagacggcggcu

SEQ ID NO: 412644 - RNA, 13 nt, Bordetella pertussis
gcagacuccagga

SEQ ID NO: 412645 - RNA, 15 nt, Bordetella pertussis
gcagacuccaggagc

SEQ ID NO: 412646 - RNA, 14 nt, Bordetella pertussis
gcagagggcgacgg

SEQ ID NO: 412647 - RNA, 15 nt, Bordetella pertussis
gcagauaccggcaug

SEQ ID NO: 412648 - RNA, 17 nt, Bordetella pertussis
gcagaugcgcgccaggc

SEQ ID NO: 412649 - RNA, 18 nt, Bordetella pertussis
gcagaugcgcgccaggcg

SEQ ID NO: 412650 - RNA, 16 nt, Bordetella pertussis
gcagauggccagcagc

SEQ ID NO: 412651 - RNA, 16 nt, Bordetella pertussis
gcagauggcccuugcc

SEQ ID NO: 412652 - RNA, 21 nt, Bordetella pertussis
gcagauggcguaggcggccuu

SEQ ID NO: 412653 - RNA, 14 nt, Bordetella pertussis
gcagaugggcggcg

SEQ ID NO: 412654 - RNA, 17 nt, Bordetella pertussis
gcagauugccgcgcggc

SEQ ID NO: 412655 - RNA, 15 nt, Bordetella pertussis
gcagcaacgccggcg

SEQ ID NO: 412656 - RNA, 19 nt, Bordetella pertussis
gcagcaacggugagccggc

SEQ ID NO: 412657 - RNA, 23 nt, Bordetella pertussis
gcagcaacggugagccggccacc

SEQ ID NO: 412658 - RNA, 14 nt, Bordetella pertussis
gcagcaagcugcug

SEQ ID NO: 412659 - RNA, 18 nt, Bordetella pertussis
gcagcaauugccccagca

SEQ ID NO: 412660 - RNA, 17 nt, Bordetella pertussis
gcagcacauagggcgag

SEQ ID NO: 412661 - RNA, 16 nt, Bordetella pertussis
gcagcacaugggcgcg

SEQ ID NO: 412662 - RNA, 20 nt, Bordetella pertussis
gcagcaccacaucgccggcg

SEQ ID NO: 412663 - RNA, 23 nt, Bordetella pertussis
gcagcaccacaucgccggcggcg

SEQ ID NO: 412664 - RNA, 23 nt, Bordetella pertussis
gcagcaccaggcuuugcgcgcca

SEQ ID NO: 412665 - RNA, 13 nt, Bordetella pertussis
gcagcaccgccag

SEQ ID NO: 412666 - RNA, 20 nt, Bordetella pertussis
gcagcaccggcgugagcgcc

SEQ ID NO: 412667 - RNA, 20 nt, Bordetella pertussis
gcagcaccgggaaguccgcc

SEQ ID NO: 412668 - RNA, 15 nt, Bordetella pertussis
gcagcaccucggggc

SEQ ID NO: 412669 - RNA, 18 nt, Bordetella pertussis
gcagcaccucggggcgcg

SEQ ID NO: 412670 - RNA, 23 nt, Bordetella pertussis
gcagcaccuucugccgccaggca

SEQ ID NO: 412671 - RNA, 23 nt, Bordetella pertussis
gcagcacgauggcgcccacggcc

SEQ ID NO: 412672 - RNA, 16 nt, Bordetella pertussis
gcagcacgcaccaggc

SEQ ID NO: 412673 - RNA, 14 nt, Bordetella pertussis
gcagcacgcagaug

SEQ ID NO: 412674 - RNA, 21 nt, Bordetella pertussis
gcagcacgccgcgccaggcau

SEQ ID NO: 412675 - RNA, 19 nt, Bordetella pertussis
gcagcacgcgcaccaggcc

SEQ ID NO: 412676 - RNA, 18 nt, Bordetella pertussis
gcagcacgcugcgcggcg

SEQ ID NO: 412677 - RNA, 19 nt, Bordetella pertussis
gcagcacggccacggccgg

SEQ ID NO: 412678 - RNA, 16 nt, Bordetella pertussis
gcagcacuaccugcgc

SEQ ID NO: 412679 - RNA, 18 nt, Bordetella pertussis
gcagcacgucguagcgcu

SEQ ID NO: 412680 - RNA, 20 nt, Bordetella pertussis
gcagcagauugccgcgcggc

SEQ ID NO: 412681 - RNA, 21 nt, Bordetella pertussis
gcagcagauugccgcgcggcg

SEQ ID NO: 412682 - RNA, 16 nt, Bordetella pertussis
gcagcagaucggcggc

SEQ ID NO: 412683 - RNA, 12 nt, Bordetella pertussis
gcagcagcagcg

SEQ ID NO: 412684 - RNA, 17 nt, Bordetella pertussis
gcagcagcagggccagg

SEQ ID NO: 412685 - RNA, 14 nt, Bordetella pertussis
gcagcagcgagccc

SEQ ID NO: 412686 - RNA, 15 nt, Bordetella pertussis
gcagcagcgccggca

SEQ ID NO: 412687 - RNA, 13 nt, Bordetella pertussis
gcagcagcgccuu

SEQ ID NO: 412688 - RNA, 13 nt, Bordetella pertussis
gcagcagcgggcu

SEQ ID NO: 412689 - RNA, 16 nt, Bordetella pertussis
gcagcaggaacaggcu

SEQ ID NO: 412690 - RNA, 22 nt, Bordetella pertussis
gcagcaggccguaaccggccag

SEQ ID NO: 412691 - RNA, 19 nt, Bordetella pertussis
gcagcaggccguugccgcu

SEQ ID NO: 412692 - RNA, 16 nt, Bordetella pertussis
gcagcaggcgcgcggc

SEQ ID NO: 412693 - RNA, 19 nt, Bordetella pertussis
gcagcaggcgcgcggccuc

SEQ ID NO: 412694 - RNA, 13 nt, Bordetella pertussis
gcagcaggccagg

SEQ ID NO: 412695 - RNA, 14 nt, Bordetella pertussis
gcagcaggccggcg

SEQ ID NO: 412696 - RNA, 18 nt, Bordetella pertussis
gcagcaggcugccgccgg

SEQ ID NO: 412697 - RNA, 16 nt, Bordetella pertussis
gcagcaggcuggccac

SEQ ID NO: 412698 - RNA, 23 nt, Bordetella pertussis
gcagcaguucggucagcgcggcg

SEQ ID NO: 412699 - RNA, 22 nt, Bordetella pertussis
gcagcaugaccgacaggcggcu

SEQ ID NO: 412700 - RNA, 21 nt, Bordetella pertussis
gcagcaugagcugaugcucgc

SEQ ID NO: 412701 - RNA, 14 nt, Bordetella pertussis
gcagcaugcggccc

SEQ ID NO: 412702 - RNA, 12 nt, Bordetella pertussis
gcagcaugugcu

SEQ ID NO: 412703 - RNA, 16 nt, Bordetella pertussis
gcagcaugugcucggg

SEQ ID NO: 412704 - RNA, 15 nt, Bordetella pertussis
gcagcauuucuucca

SEQ ID NO: 412705 - RNA, 13 nt, Bordetella pertussis
gcagccacgggau

SEQ ID NO: 412706 - RNA, 16 nt, Bordetella pertussis
gcagccacgggauguc

SEQ ID NO: 412707 - RNA, 23 nt, Bordetella pertussis
gcagccacuggaacagcuugggc

SEQ ID NO: 412708 - RNA, 23 nt, Bordetella pertussis
gcagccagaacaugagccaugcc

SEQ ID NO: 412709 - RNA, 14 nt, Bordetella pertussis
gcagccaguugggc

SEQ ID NO: 412710 - RNA, 20 nt, Bordetella pertussis
gcagccaguugggccagggc

SEQ ID NO: 412711 - RNA, 22 nt, Bordetella pertussis
gcagccauccucgcccagcggc

SEQ ID NO: 412712 - RNA, 15 nt, Bordetella pertussis
gcagccauucggcca

SEQ ID NO: 412713 - RNA, 14 nt, Bordetella pertussis
gcagccccagcgcc

SEQ ID NO: 412714 - RNA, 21 nt, Bordetella pertussis
gcagccccagcguccaggcgg

SEQ ID NO: 412715 - RNA, 17 nt, Bordetella pertussis
gcagccccgggugcagg

SEQ ID NO: 412716 - RNA, 14 nt, Bordetella pertussis
gcagcccggccaga

SEQ ID NO: 412717 - RNA, 19 nt, Bordetella pertussis
gcagcccggccagagccug

SEQ ID NO: 412718 - RNA, 14 nt, Bordetella pertussis
gcagcccgcgcgcc

SEQ ID NO: 412719 - RNA, 16 nt, Bordetella pertussis
gcagcccgcgcgccug

SEQ ID NO: 412720 - RNA, 15 nt, Bordetella pertussis
gcagccgacaggcgc

SEQ ID NO: 412721 - RNA, 21 nt, Bordetella pertussis
gcagccgacaggcgcgcaggc

SEQ ID NO: 412722 - RNA, 14 nt, Bordetella pertussis
gcagccgcaccagc

SEQ ID NO: 412723 - RNA, 15 nt, Bordetella pertussis
gcagccgccagcgcc

SEQ ID NO: 412724 - RNA, 15 nt, Bordetella pertussis
gcagccgccgcaggc

SEQ ID NO: 412725 - RNA, 16 nt, Bordetella pertussis
gcagccgcgcggccgg

SEQ ID NO: 412726 - RNA, 15 nt, Bordetella pertussis
gcagccggccaaggc

SEQ ID NO: 412727 - RNA, 20 nt, Bordetella pertussis
gcagccggccauggccgcca

SEQ ID NO: 412728 - RNA, 23 nt, Bordetella pertussis
gcagccggccauggccgccacac

SEQ ID NO: 412729 - RNA, 22 nt, Bordetella pertussis
gcagccggccccgcaaggggcc

SEQ ID NO: 412730 - RNA, 15 nt, Bordetella pertussis
gcagccgcuucacgc

SEQ ID NO: 412731 - RNA, 22 nt, Bordetella pertussis
gcagccgcuucacgcuguucuu

SEQ ID NO: 412732 - RNA, 15 nt, Bordetella pertussis
gcagccggcugcaag

SEQ ID NO: 412733 - RNA, 15 nt, Bordetella pertussis
gcagccgggcugccg

SEQ ID NO: 412734 - RNA, 23 nt, Bordetella pertussis
gcagccgggcugccggcagcagg

SEQ ID NO: 412735 - RNA, 11 nt, Bordetella pertussis
gcagccuuggu

SEQ ID NO: 412736 - RNA, 16 nt, Bordetella pertussis
gcagccuuggucagcg

SEQ ID NO: 412737 - RNA, 16 nt, Bordetella pertussis
gcagcgaccgcggcgg

SEQ ID NO: 412738 - RNA, 23 nt, Bordetella pertussis
gcagcgacucgccgugcugggcg

SEQ ID NO: 412739 - RNA, 14 nt, Bordetella pertussis
gcagcgagagcgcc

SEQ ID NO: 412740 - RNA, 20 nt, Bordetella pertussis
gcagcgacggccccagcgcc

SEQ ID NO: 412741 - RNA, 13 nt, Bordetella pertussis
gcagcgaggccuc

SEQ ID NO: 412742 - RNA, 22 nt, Bordetella pertussis
gcagcgaggccucgugcugcug

SEQ ID NO: 412743 - RNA, 15 nt, Bordetella pertussis
gcagcgaggcgcagc

SEQ ID NO: 412744 - RNA, 17 nt, Bordetella pertussis
gcagcgaggcgcgggcg

SEQ ID NO: 412745 - RNA, 14 nt, Bordetella pertussis
gcagcgcaggaugg

SEQ ID NO: 412746 - RNA, 19 nt, Bordetella pertussis
gcagcgcaucgccgcaggc

SEQ ID NO: 412747 - RNA, 17 nt, Bordetella pertussis
gcagcgccagggccagg

SEQ ID NO: 412748 - RNA, 19 nt, Bordetella pertussis
gcagcgccagggccaggcc

SEQ ID NO: 412749 - RNA, 18 nt, Bordetella pertussis
gcagcgccgcaacccgcu

SEQ ID NO: 412750 - RNA, 16 nt, Bordetella pertussis
gcagcgccgccaccuc

SEQ ID NO: 412751 - RNA, 12 nt, Bordetella pertussis
gcagcgccgcgc

SEQ ID NO: 412752 - RNA, 12 nt, Bordetella pertussis
gcagcgccgggg

SEQ ID NO: 412753 - RNA, 16 nt, Bordetella pertussis
gcagcgccggcugggc

SEQ ID NO: 412754 - RNA, 17 nt, Bordetella pertussis
gcagcgccggcugggcg

SEQ ID NO: 412755 - RNA, 15 nt, Bordetella pertussis
gcagcgcgccaggcg

SEQ ID NO: 412756 - RNA, 16 nt, Bordetella pertussis
gcagcgcgccaggcgc

SEQ ID NO: 412757 - RNA, 15 nt, Bordetella pertussis
gcagcgcgccgccga

SEQ ID NO: 412758 - RNA, 23 nt, Bordetella pertussis
gcagcgcgccgccgauguugaac

SEQ ID NO: 412759 - RNA, 13 nt, Bordetella pertussis
gcagcgcgccgga

SEQ ID NO: 412760 - RNA, 19 nt, Bordetella pertussis
gcagcgcgccgggcggguc

SEQ ID NO: 412761 - RNA, 12 nt, Bordetella pertussis
gcagcgcggccg

SEQ ID NO: 412762 - RNA, 15 nt, Bordetella pertussis
gcagcgcggccggca

SEQ ID NO: 412763 - RNA, 17 nt, Bordetella pertussis
gcagcgcgguggccagc

SEQ ID NO: 412764 - RNA, 17 nt, Bordetella pertussis
gcagcgcguccugccag

SEQ ID NO: 412765 - RNA, 21 nt, Bordetella pertussis
gcagcggacgguagcgcacgc

SEQ ID NO: 412766 - RNA, 19 nt, Bordetella pertussis
gcagcggcagcagcagcgc

SEQ ID NO: 412767 - RNA, 21 nt, Bordetella pertussis
gcagcggcagcucggcgaagc

SEQ ID NO: 412768 - RNA, 18 nt, Bordetella pertussis
gcagcggcaggcccugcc

SEQ ID NO: 412769 - RNA, 14 nt, Bordetella pertussis
gcagcggccgcgcg

SEQ ID NO: 412770 - RNA, 21 nt, Bordetella pertussis
gcagcggccgcgcgggcggcc

SEQ ID NO: 412771 - RNA, 13 nt, Bordetella pertussis
gcagcggcgacgg

SEQ ID NO: 412772 - RNA, 14 nt, Bordetella pertussis
gcagcggcgccaug

SEQ ID NO: 412773 - RNA, 14 nt, Bordetella pertussis
gcagcggcgcgcgc

SEQ ID NO: 412774 - RNA, 12 nt, Bordetella pertussis
gcagcggcggca

SEQ ID NO: 412775 - RNA, 16 nt, Bordetella pertussis
gcagcggcggcgcggu

SEQ ID NO: 412776 - RNA, 21 nt, Bordetella pertussis
gcagcggcuccccuggucagg

SEQ ID NO: 412777 - RNA, 20 nt, Bordetella pertussis
gcagcggcuucaugccggcg

SEQ ID NO: 412778 - RNA, 13 nt, Bordetella pertussis
gcagcggggacag

SEQ ID NO: 412779 - RNA, 16 nt, Bordetella pertussis
gcagcgucugcuggua

SEQ ID NO: 412780 - RNA, 21 nt, Bordetella pertussis
gcagcgucugcugguacagcc

SEQ ID NO: 412781 - RNA, 22 nt, Bordetella pertussis
gcagcgucugcugguacagccc

SEQ ID NO: 412782 - RNA, 23 nt, Bordetella pertussis
gcagcgugaugcggucggccaca

SEQ ID NO: 412783 - RNA, 16 nt, Bordetella pertussis
gcagcguggcgcgggu

SEQ ID NO: 412784 - RNA, 22 nt, Bordetella pertussis
gcagcguggcgcggguggccgg

SEQ ID NO: 412785 - RNA, 19 nt, Bordetella pertussis
gcagcguuacgcgaccagc

SEQ ID NO: 412786 - RNA, 14 nt, Bordetella pertussis
gcagcucgcgcgcu

SEQ ID NO: 412787 - RNA, 15 nt, Bordetella pertussis
gcagcucggccaccg

SEQ ID NO: 412788 - RNA, 22 nt, Bordetella pertussis
gcagcucggcgaagccgcagcg

SEQ ID NO: 412789 - RNA, 16 nt, Bordetella pertussis
gcagcucggugcagcc

SEQ ID NO: 412790 - RNA, 17 nt, Bordetella pertussis
gcagcucggugcagccc

SEQ ID NO: 412791 - RNA, 16 nt, Bordetella pertussis
gcaggaucugcaccuu

SEQ ID NO: 412792 - RNA, 21 nt, Bordetella pertussis
gcaggaugacguggcaguccu

SEQ ID NO: 412793 - RNA, 20 nt, Bordetella pertussis
gcaggaugaggcgccgggug

SEQ ID NO: 412794 - RNA, 22 nt, Bordetella pertussis
gcaggaugaggcgccggguggg

SEQ ID NO: 412795 - RNA, 14 nt, Bordetella pertussis
gcaggauggccaug

SEQ ID NO: 412796 - RNA, 19 nt, Bordetella pertussis
gcaggauggccaugcgcuu

SEQ ID NO: 412797 - RNA, 20 nt, Bordetella pertussis
gcaggcaagcugcuggcgcg

SEQ ID NO: 412798 - RNA, 19 nt, Bordetella pertussis
gcaggcaguuggcggcgca

SEQ ID NO: 412799 - RNA, 22 nt, Bordetella pertussis
gcaggcaguuggcggcgcagcc

SEQ ID NO: 412800 - RNA, 16 nt, Bordetella pertussis
gcaggccaggcucagc

SEQ ID NO: 412801 - RNA, 17 nt, Bordetella pertussis
gcaggcccaccggcaug

SEQ ID NO: 412802 - RNA, 15 nt, Bordetella pertussis
gcaggcccagccagc

SEQ ID NO: 412803 - RNA, 16 nt, Bordetella pertussis
gcaggcccagccagcc

SEQ ID NO: 412804 - RNA, 20 nt, Bordetella pertussis
gcaggcccagccagcccugg

SEQ ID NO: 412805 - RNA, 20 nt, Bordetella pertussis
gcaggcccagccagcggugc

SEQ ID NO: 412806 - RNA, 20 nt, Bordetella pertussis
gcaggcccaugacgccggug

SEQ ID NO: 412807 - RNA, 22 nt, Bordetella pertussis
gcaggccccgcuacguguccug

SEQ ID NO: 412808 - RNA, 14 nt, Bordetella pertussis
gcaggccccggccc

SEQ ID NO: 412809 - RNA, 18 nt, Bordetella pertussis
gcaggccccggcccggcg

SEQ ID NO: 412810 - RNA, 15 nt, Bordetella pertussis
gcaggcccgacagga

SEQ ID NO: 412811 - RNA, 21 nt, Bordetella pertussis
gcaggcccuccggcgccagca

SEQ ID NO: 412812 - RNA, 23 nt, Bordetella pertussis
gcaggcccuccggcgccagcaug

SEQ ID NO: 412813 - RNA, 17 nt, Bordetella pertussis
gcaggcccugggccagc

SEQ ID NO: 412814 - RNA, 22 nt, Bordetella pertussis
gcaggcccugggccagcagcug

SEQ ID NO: 412815 - RNA, 23 nt, Bordetella pertussis
gcaggcccugggcgagguagggc

SEQ ID NO: 412816 - RNA, 13 nt, Bordetella pertussis
gcaggcgcgugcu

SEQ ID NO: 412817 - RNA, 16 nt, Bordetella pertussis
gcaggcgcguggccac

SEQ ID NO: 412818 - RNA, 17 nt, Bordetella pertussis
gcaggcgcguggccacg

SEQ ID NO: 412819 - RNA, 13 nt, Bordetella pertussis
gcaggcgcugcgc

SEQ ID NO: 412820 - RNA, 12 nt, Bordetella pertussis
gcaggcggcggc

SEQ ID NO: 412821 - RNA, 22 nt, Bordetella pertussis
gcaggcggcuuucaugggccug

SEQ ID NO: 412822 - RNA, 13 nt, Bordetella pertussis
gcaggcgggcccg

SEQ ID NO: 412823 - RNA, 13 nt, Bordetella pertussis
gcaggcggcuggu

SEQ ID NO: 412824 - RNA, 18 nt, Bordetella pertussis
gcaggcggucgaggcgca

SEQ ID NO: 412825 - RNA, 14 nt, Bordetella pertussis
gcaggcggucggug

SEQ ID NO: 412826 - RNA, 18 nt, Bordetella pertussis
gcaggcuuucgcacagcc

SEQ ID NO: 412827 - RNA, 13 nt, Bordetella pertussis
gcagggacaggca

SEQ ID NO: 412828 - RNA, 16 nt, Bordetella pertussis
gcagggacaggcaccg

SEQ ID NO: 412829 - RNA, 19 nt, Bordetella pertussis
gcagggugacgggcugggc

SEQ ID NO: 412830 - RNA, 23 nt, Bordetella pertussis
gcagggugacgggcugggccgag

SEQ ID NO: 412831 - RNA, 22 nt, Bordetella pertussis
gcagggugccugucccggcugg

SEQ ID NO: 412832 - RNA, 17 nt, Bordetella pertussis
gcagguccaggccuggg

SEQ ID NO: 412833 - RNA, 16 nt, Bordetella pertussis
gcagguccggucgcgc

SEQ ID NO: 412834 - RNA, 22 nt, Bordetella pertussis
gcagguccggucgcgcgugcag

SEQ ID NO: 412835 - RNA, 14 nt, Bordetella pertussis
gcaggucggccagg

SEQ ID NO: 412836 - RNA, 15 nt, Bordetella pertussis
gcaggucggccagga

SEQ ID NO: 412837 - RNA, 20 nt, Bordetella pertussis
gcaggucgucgagccgggcc

SEQ ID NO: 412838 - RNA, 15 nt, Bordetella pertussis
gcaggugcggccgca

SEQ ID NO: 412839 - RNA, 16 nt, Bordetella pertussis
gcagguggaucgacga

SEQ ID NO: 412840 - RNA, 11 nt, Bordetella pertussis
gcagguggcau

SEQ ID NO: 412841 - RNA, 18 nt, Bordetella pertussis
gcagguggcgcuguccgg

SEQ ID NO: 412842 - RNA, 19 nt, Bordetella pertussis
gcaggugucgccccccaug

SEQ ID NO: 412843 - RNA, 18 nt, Bordetella pertussis
gcagguucaucgagaaca

SEQ ID NO: 412844 - RNA, 16 nt, Bordetella pertussis
gcagguuggagaucau

SEQ ID NO: 412845 - RNA, 22 nt, Bordetella pertussis
gcagguuggagaucaugaccac

SEQ ID NO: 412846 - RNA, 19 nt, Bordetella pertussis
gcaguacguacgcccggcc

SEQ ID NO: 412847 - RNA, 19 nt, Bordetella pertussis
gcauacaacuucagccagc

SEQ ID NO: 412848 - RNA, 20 nt, Bordetella pertussis
gcauacccugcgcgccgccg

SEQ ID NO: 412849 - RNA, 22 nt, Bordetella pertussis
gcauacgccgcugauggcgguc

SEQ ID NO: 412850 - RNA, 20 nt, Bordetella pertussis
gcauagguaucggcccgcgc

SEQ ID NO: 412851 - RNA, 16 nt, Bordetella pertussis
gcaucaauagcccgug

SEQ ID NO: 412852 - RNA, 12 nt, Bordetella pertussis
gcaucaccagcu

SEQ ID NO: 412853 - RNA, 21 nt, Bordetella pertussis
gcaucacgccgguguucucgc

SEQ ID NO: 412854 - RNA, 22 nt, Bordetella pertussis
gcaucagcagacccuggcgcgc

SEQ ID NO: 412855 - RNA, 17 nt, Bordetella pertussis
gcaucagcccuacccug

SEQ ID NO: 412856 - RNA, 14 nt, Bordetella pertussis
gcaucagcggcagc

SEQ ID NO: 412857 - RNA, 19 nt, Bordetella pertussis
gcaucagcuuggccaccac

SEQ ID NO: 412858 - RNA, 17 nt, Bordetella pertussis
gcaucccgcccccgccg

SEQ ID NO: 412859 - RNA, 15 nt, Bordetella pertussis
gcauccgcgccagga

SEQ ID NO: 412860 - RNA, 17 nt, Bordetella pertussis
gcauccggcccagcgcc

SEQ ID NO: 412861 - RNA, 23 nt, Bordetella pertussis
gcauccggugauuucggcgcauc

SEQ ID NO: 412862 - RNA, 23 nt, Bordetella pertussis
gcauccgguggugcugggcggcg

SEQ ID NO: 412863 - RNA, 16 nt, Bordetella pertussis
gcaucgcgcgccgccg

SEQ ID NO: 412864 - RNA, 13 nt, Bordetella pertussis
gcaucgcgcggca

SEQ ID NO: 412865 - RNA, 19 nt, Bordetella pertussis
gcaucgcggcagcccggca

SEQ ID NO: 412866 - RNA, 18 nt, Bordetella pertussis
gcaucggcacgggucagg

SEQ ID NO: 412867 - RNA, 21 nt, Bordetella pertussis
gcaucggccacgcugcccugc

SEQ ID NO: 412868 - RNA, 18 nt, Bordetella pertussis
gcaucggccaggcgccug

SEQ ID NO: 412869 - RNA, 18 nt, Bordetella pertussis
gcaucggccggauccagc

SEQ ID NO: 412870 - RNA, 16 nt, Bordetella pertussis
gcaucggcgccgcgcg

SEQ ID NO: 412871 - RNA, 15 nt, Bordetella pertussis
gcaucggcgccggcg

SEQ ID NO: 412872 - RNA, 22 nt, Bordetella pertussis
gcaucgggguuccacagcgccg

SEQ ID NO: 412873 - RNA, 15 nt, Bordetella pertussis
gcaucgucaggcagg

SEQ ID NO: 412874 - RNA, 23 nt, Bordetella pertussis
gcaugaaaaaagccccauugccu

SEQ ID NO: 412875 - RNA, 22 nt, Bordetella pertussis
gcaugaaaaagggcgcaccaug

SEQ ID NO: 412876 - RNA, 18 nt, Bordetella pertussis
gcaugaacggcagcgcgc

SEQ ID NO: 412877 - RNA, 15 nt, Bordetella pertussis
gcaugaagcgguggc

SEQ ID NO: 412878 - RNA, 20 nt, Bordetella pertussis
gcaugaccgccgccagcagc

SEQ ID NO: 412879 - RNA, 21 nt, Bordetella pertussis
gcaugaccgccgccagcagcg

SEQ ID NO: 412880 - RNA, 14 nt, Bordetella pertussis
gcaugaccgccggc

SEQ ID NO: 412881 - RNA, 20 nt, Bordetella pertussis
gcaugaccgcggacgccaug

SEQ ID NO: 412882 - RNA, 14 nt, Bordetella pertussis
gcaugaccugcagg

SEQ ID NO: 412883 - RNA, 20 nt, Bordetella pertussis
gcaugacggggucggggcag

SEQ ID NO: 412884 - RNA, 20 nt, Bordetella pertussis
gcaugccgaucagcgggcug

SEQ ID NO: 412885 - RNA, 21 nt, Bordetella pertussis
gcaugccgcugcaggucggga

SEQ ID NO: 412886 - RNA, 17 nt, Bordetella pertussis
gcaugcgacaugagcug

SEQ ID NO: 412887 - RNA, 18 nt, Bordetella pertussis
gcaugcgacaugagcugc

SEQ ID NO: 412888 - RNA, 19 nt, Bordetella pertussis
gcaugccguccacgcccag

SEQ ID NO: 412889 - RNA, 17 nt, Bordetella pertussis
gcaugcgcgcgacuucc

SEQ ID NO: 412890 - RNA, 17 nt, Bordetella pertussis
gcaugcgcgucuccagc

SEQ ID NO: 412891 - RNA, 20 nt, Bordetella pertussis
gcaugcgcgucuccagcgcc

SEQ ID NO: 412892 - RNA, 15 nt, Bordetella pertussis
gcaugcggcggacuc

SEQ ID NO: 412893 - RNA, 22 nt, Bordetella pertussis
gcaugcgguuucucagcgcgcu

SEQ ID NO: 412894 - RNA, 21 nt, Bordetella pertussis
gcaugcgugaagcccauggcg

SEQ ID NO: 412895 - RNA, 22 nt, Bordetella pertussis
gcaugcgugaagcccauggcgu

SEQ ID NO: 412896 - RNA, 14 nt, Bordetella pertussis
gcauggcgccgcgc

SEQ ID NO: 412897 - RNA, 19 nt, Bordetella pertussis
gcauggcgcgugcgcgcgc

SEQ ID NO: 412898 - RNA, 20 nt, Bordetella pertussis
gcauggcggccaggcgcgcc

SEQ ID NO: 412899 - RNA, 21 nt, Bordetella pertussis
gcauggcggucuccgguucgg

SEQ ID NO: 412900 - RNA, 20 nt, Bordetella pertussis
gcauggcgguggccagcgcc

SEQ ID NO: 412901 - RNA, 21 nt, Bordetella pertussis
gcaugggcacauacagcggag

SEQ ID NO: 412902 - RNA, 13 nt, Bordetella pertussis
gcaugggccaggc

SEQ ID NO: 412903 - RNA, 17 nt, Bordetella pertussis
gcaugggccaggcgcuc

SEQ ID NO: 412904 - RNA, 20 nt, Bordetella pertussis
gcaugggcccgggcgcgcug

SEQ ID NO: 412905 - RNA, 19 nt, Bordetella pertussis
gcaugggcgcaggccgcca

SEQ ID NO: 412906 - RNA, 16 nt, Bordetella pertussis
gcaugggcgcgcccgg

SEQ ID NO: 412907 - RNA, 19 nt, Bordetella pertussis
gcaugggcgcgcccggcga

SEQ ID NO: 412908 - RNA, 12 nt, Bordetella pertussis
gcaugggcggcc

SEQ ID NO: 412909 - RNA, 17 nt, Bordetella pertussis
gcauggggacuggcgcc

SEQ ID NO: 412910 - RNA, 14 nt, Bordetella pertussis
gcauggggcaggcg

SEQ ID NO: 412911 - RNA, 18 nt, Bordetella pertussis
gcauggggcaggcgcagc

SEQ ID NO: 412912 - RNA, 20 nt, Bordetella pertussis
gcaugucguggcgauagcgc

SEQ ID NO: 412913 - RNA, 19 nt, Bordetella pertussis
gcaugugccaccgcccagg

SEQ ID NO: 412914 - RNA, 21 nt, Bordetella pertussis
gcauucagcgcugcaugcccc

SEQ ID NO: 412915 - RNA, 13 nt, Bordetella pertussis
gccaaaaaaaacc

SEQ ID NO: 412916 - RNA, 20 nt, Bordetella pertussis
gccaacccggccucagcggc

SEQ ID NO: 412917 - RNA, 23 nt, Bordetella pertussis
gccaacccggccucagcggccgc

SEQ ID NO: 412918 - RNA, 18 nt, Bordetella pertussis
gccaaccccgagggcgcg

SEQ ID NO: 412919 - RNA, 21 nt, Bordetella pertussis
gccaacgcacaagggccccgc

SEQ ID NO: 412920 - RNA, 13 nt, Bordetella pertussis
gccaacgcggcgc

SEQ ID NO: 412921 - RNA, 21 nt, Bordetella pertussis
gccaacggaagagggcggggc

SEQ ID NO: 412922 - RNA, 22 nt, Bordetella pertussis
gccaacggaagagggcggggcg

SEQ ID NO: 412923 - RNA, 17 nt, Bordetella pertussis
gccaacggugccagucc

SEQ ID NO: 412924 - RNA, 22 nt, Bordetella pertussis
gccaacggugccagucccccug

SEQ ID NO: 412925 - RNA, 22 nt, Bordetella pertussis
gccaagacgcggggacaggcac

SEQ ID NO: 412926 - RNA, 23 nt, Bordetella pertussis
gccaagacgcggggacaggcaca

SEQ ID NO: 412927 - RNA, 15 nt, Bordetella pertussis
gccaagcgcgccggc

SEQ ID NO: 412928 - RNA, 13 nt, Bordetella pertussis
gccaagcggcagg

SEQ ID NO: 412929 - RNA, 13 nt, Bordetella pertussis
gccaagcuggaga

SEQ ID NO: 412930 - RNA, 23 nt, Bordetella pertussis
gccaagcuggagaagcgccgcgc

SEQ ID NO: 412931 - RNA, 21 nt, Bordetella pertussis
gccaaggcauuggcgccgcgc

SEQ ID NO: 412932 - RNA, 16 nt, Bordetella pertussis
gccaagggcgccgcgc

SEQ ID NO: 412933 - RNA, 17 nt, Bordetella pertussis
gccaagggcgcgccagc

SEQ ID NO: 412934 - RNA, 23 nt, Bordetella pertussis
gccaagugggcauagcguuuugu

SEQ ID NO: 412935 - RNA, 15 nt, Bordetella pertussis
gccaaugcgccgcgc

SEQ ID NO: 412936 - RNA, 15 nt, Bordetella pertussis
gccaauggccgcggc

SEQ ID NO: 412937 - RNA, 17 nt, Bordetella pertussis
gccaauggccgcggcgu

SEQ ID NO: 412938 - RNA, 22 nt, Bordetella pertussis
gccaauggccggugagauccag

SEQ ID NO: 412939 - RNA, 23 nt, Bordetella pertussis
gccaauggccggugagauccagc

SEQ ID NO: 412940 - RNA, 15 nt, Bordetella pertussis
gccaauggcggaugc

SEQ ID NO: 412941 - RNA, 19 nt, Bordetella pertussis
gccaauugcuugccugucc

SEQ ID NO: 412942 - RNA, 20 nt, Bordetella pertussis
gccaauugcuugccuguccc

SEQ ID NO: 412943 - RNA, 19 nt, Bordetella pertussis
gccacaaagggcgugucuc

SEQ ID NO: 412944 - RNA, 20 nt, Bordetella pertussis
gccacaaagggcgugucucu

SEQ ID NO: 412945 - RNA, 15 nt, Bordetella pertussis
gccacacgggcgccu

SEQ ID NO: 412946 - RNA, 16 nt, Bordetella pertussis
gccacacgggcgccug

SEQ ID NO: 412947 - RNA, 15 nt, Bordetella pertussis
gccacagauuggcca

SEQ ID NO: 412948 - RNA, 16 nt, Bordetella pertussis
gccacagcgccgcggc

SEQ ID NO: 412949 - RNA, 14 nt, Bordetella pertussis
gccacaggcugacg

SEQ ID NO: 412950 - RNA, 18 nt, Bordetella pertussis
gccaccaugucccuggcc

SEQ ID NO: 412951 - RNA, 13 nt, Bordetella pertussis
gccacccagggcu

SEQ ID NO: 412952 - RNA, 14 nt, Bordetella pertussis
gccaccccgucauc

SEQ ID NO: 412953 - RNA, 17 nt, Bordetella pertussis
gccaccccgucaucgcc

SEQ ID NO: 412954 - RNA, 21 nt, Bordetella pertussis
gccaccccgucaucgccgcgg

SEQ ID NO: 412955 - RNA, 22 nt, Bordetella pertussis
gccaccccgucaucgccgcggc

SEQ ID NO: 412956 - RNA, 17 nt, Bordetella pertussis
gccaccccguugcagcc

SEQ ID NO: 412957 - RNA, 21 nt, Bordetella pertussis
gccaccccguugcagcccagc

SEQ ID NO: 412958 - RNA, 13 nt, Bordetella pertussis
gccaccccgccgc

SEQ ID NO: 412959 - RNA, 12 nt, Bordetella pertussis
gccacccgccgc

SEQ ID NO: 412960 - RNA, 14 nt, Bordetella pertussis
gccacccgccgccg

SEQ ID NO: 412961 - RNA, 15 nt, Bordetella pertussis
gccacccgccgccgg

SEQ ID NO: 412962 - RNA, 17 nt, Bordetella pertussis
gccacccggaucgacag

SEQ ID NO: 412963 - RNA, 13 nt, Bordetella pertussis
gccacccugguac

SEQ ID NO: 412964 - RNA, 21 nt, Bordetella pertussis
gccaccgaagcggcguucugc

SEQ ID NO: 412965 - RNA, 15 nt, Bordetella pertussis
gccaccgcccccgcc

SEQ ID NO: 412966 - RNA, 19 nt, Bordetella pertussis
gccaccgcccaggcgcagc

SEQ ID NO: 412967 - RNA, 21 nt, Bordetella pertussis
gccaccgcccaggcgcagccc

SEQ ID NO: 412968 - RNA, 22 nt, Bordetella pertussis
gccaccuucgccgcgcacagcc

SEQ ID NO: 412969 - RNA, 17 nt, Bordetella pertussis
gccacgaaacccacggc

SEQ ID NO: 412970 - RNA, 22 nt, Bordetella pertussis
gccacgaagcgcagcaccgcgc

SEQ ID NO: 412971 - RNA, 19 nt, Bordetella pertussis
gccacgaagugcgccccca

SEQ ID NO: 412972 - RNA, 20 nt, Bordetella pertussis
gccacgaauuccucgccgcc

SEQ ID NO: 412973 - RNA, 21 nt, Bordetella pertussis
gccacgaauuccucgccgccc

SEQ ID NO: 412974 - RNA, 24 nt, Bordetella pertussis
gccacgaauuccucgccgcccagc

SEQ ID NO: 412975 - RNA, 23 nt, Bordetella pertussis
gccacggcaggcgccugcccugc

SEQ ID NO: 412976 - RNA, 18 nt, Bordetella pertussis
gccacggccugcccgggc

SEQ ID NO: 412977 - RNA, 19 nt, Bordetella pertussis
gccacggccugcccgggcg

SEQ ID NO: 412978 - RNA, 13 nt, Bordetella pertussis
gccacggcgguga

SEQ ID NO: 412979 - RNA, 23 nt, Bordetella pertussis
gccacggcggugaccaccaggcc

SEQ ID NO: 412980 - RNA, 17 nt, Bordetella pertussis
gccacggcggugcugaa

SEQ ID NO: 412981 - RNA, 22 nt, Bordetella pertussis
gccacggcggugcugaacgccu

SEQ ID NO: 412982 - RNA, 17 nt, Bordetella pertussis
gccacggcgucgccggc

SEQ ID NO: 412983 - RNA, 18 nt, Bordetella pertussis
gccacggcgucgccggcc

SEQ ID NO: 412984 - RNA, 17 nt, Bordetella pertussis
gccacggcgggccggcu

SEQ ID NO: 412985 - RNA, 18 nt, Bordetella pertussis
gccacggcgggccggcuc

SEQ ID NO: 412986 - RNA, 12 nt, Bordetella pertussis
gccacggcugga

SEQ ID NO: 412987 - RNA, 15 nt, Bordetella pertussis
gccacgggcccgcgc

SEQ ID NO: 412988 - RNA, 22 nt, Bordetella pertussis
gccacggucugcacgccgggcg

SEQ ID NO: 412989 - RNA, 16 nt, Bordetella pertussis
gccacgucgcucggcc

SEQ ID NO: 412990 - RNA, 17 nt, Bordetella pertussis
gccacgucggcggccgc

SEQ ID NO: 412991 - RNA, 19 nt, Bordetella pertussis
gccacgucggcggccgccu

SEQ ID NO: 412992 - RNA, 17 nt, Bordetella pertussis
gccacgugaagcgccgc

SEQ ID NO: 412993 - RNA, 19 nt, Bordetella pertussis
gccacgugaagcgccgcgc

SEQ ID NO: 412994 - RNA, 18 nt, Bordetella pertussis
gccacguguggcaggcca

SEQ ID NO: 412995 - RNA, 20 nt, Bordetella pertussis
gccacguguggcaggccagc

SEQ ID NO: 412996 - RNA, 20 nt, Bordetella pertussis
gccacguugaagcgcagcca

SEQ ID NO: 412997 - RNA, 15 nt, Bordetella pertussis
gccacguugauccag

SEQ ID NO: 412998 - RNA, 19 nt, Bordetella pertussis
gccacguugucgcgcguga

SEQ ID NO: 412999 - RNA, 17 nt, Bordetella pertussis
gccacucgaugggcgcg

SEQ ID NO: 413000 - RNA, 13 nt, Bordetella pertussis
gccacugccaggc

SEQ ID NO: 413001 - RNA, 14 nt, Bordetella pertussis
gccacugccaggcg

SEQ ID NO: 413002 - RNA, 17 nt, Bordetella pertussis
gccacugccaggcgccc

SEQ ID NO: 413003 - RNA, 14 nt, Bordetella pertussis
gccacugcgccugg

SEQ ID NO: 413004 - RNA, 13 nt, Bordetella pertussis
gccacugcggccc

SEQ ID NO: 413005 - RNA, 14 nt, Bordetella pertussis
gccacuggccgcgc

SEQ ID NO: 413006 - RNA, 15 nt, Bordetella pertussis
gccacuggccgcgcu

SEQ ID NO: 413007 - RNA, 16 nt, Bordetella pertussis
gccacuggccgcgcuc

SEQ ID NO: 413008 - RNA, 15 nt, Bordetella pertussis
gccacuucgcggccg

SEQ ID NO: 413009 - RNA, 17 nt, Bordetella pertussis
gccagggaaucacccga

SEQ ID NO: 413010 - RNA, 20 nt, Bordetella pertussis
gccagggaggcgaugcugac

SEQ ID NO: 413011 - RNA, 18 nt, Bordetella pertussis
gccagggagugcgaggac

SEQ ID NO: 413012 - RNA, 14 nt, Bordetella pertussis
gccagggcagggcg

SEQ ID NO: 413013 - RNA, 17 nt, Bordetella pertussis
gccagggcagggcgccg

SEQ ID NO: 413014 - RNA, 16 nt, Bordetella pertussis
gccagggccacgccgg

SEQ ID NO: 413015 - RNA, 17 nt, Bordetella pertussis
gccagggccacgccggc

SEQ ID NO: 413016 - RNA, 17 nt, Bordetella pertussis
gccagggccaggccgcc

SEQ ID NO: 413017 - RNA, 16 nt, Bordetella pertussis
gccagggccccuccgg

SEQ ID NO: 413018 - RNA, 13 nt, Bordetella pertussis
gccagggccgccg

SEQ ID NO: 413019 - RNA, 16 nt, Bordetella pertussis
gccagggccgccgcgc

SEQ ID NO: 413020 - RNA, 18 nt, Bordetella pertussis
gccagggccgccgcgccc

SEQ ID NO: 413021 - RNA, 22 nt, Bordetella pertussis
gccagggccucgcgggccuugg

SEQ ID NO: 413022 - RNA, 19 nt, Bordetella pertussis
gccagggcgaugcggcggc

SEQ ID NO: 413023 - RNA, 15 nt, Bordetella pertussis
gccagggcgccgcgg

SEQ ID NO: 413024 - RNA, 20 nt, Bordetella pertussis
gccagggcgccugccccggc

SEQ ID NO: 413025 - RNA, 14 nt, Bordetella pertussis
gccagggcgcggau

SEQ ID NO: 413026 - RNA, 13 nt, Bordetella pertussis
gccagggcggcug

SEQ ID NO: 413027 - RNA, 14 nt, Bordetella pertussis
gccagggcggggcc

SEQ ID NO: 413028 - RNA, 18 nt, Bordetella pertussis
gccaggggaugacgggcg

SEQ ID NO: 413029 - RNA, 20 nt, Bordetella pertussis
gccaggggcagcucggugca

SEQ ID NO: 413030 - RNA, 22 nt, Bordetella pertussis
gccaggggcagcucggugcagc

SEQ ID NO: 413031 - RNA, 15 nt, Bordetella pertussis
gccagggucugcugg

SEQ ID NO: 413032 - RNA, 15 nt, Bordetella pertussis
gccagggugccccgc

SEQ ID NO: 413033 - RNA, 19 nt, Bordetella pertussis
gccaggguuugcuggcgca

SEQ ID NO: 413034 - RNA, 14 nt, Bordetella pertussis
gccagguacaggcc

SEQ ID NO: 413035 - RNA, 16 nt, Bordetella pertussis
gccagguaggccggcg

SEQ ID NO: 413036 - RNA, 17 nt, Bordetella pertussis
gccagguauugcucggc

SEQ ID NO: 413037 - RNA, 20 nt, Bordetella pertussis
gccagguccguguucgacgc

SEQ ID NO: 413038 - RNA, 15 nt, Bordetella pertussis
gccaggucggccagc

SEQ ID NO: 413039 - RNA, 16 nt, Bordetella pertussis
gccaggucggccagcc

SEQ ID NO: 413040 - RNA, 19 nt, Bordetella pertussis
gccaggucggccagccggc

SEQ ID NO: 413041 - RNA, 18 nt, Bordetella pertussis
gccaggucggcggccagc

SEQ ID NO: 413042 - RNA, 15 nt, Bordetella pertussis
gccaggucggccacc

SEQ ID NO: 413043 - RNA, 16 nt, Bordetella pertussis
gccaggugcacagcgu

SEQ ID NO: 413044 - RNA, 18 nt, Bordetella pertussis
gccaggugcacagcgucc

SEQ ID NO: 413045 - RNA, 20 nt, Bordetella pertussis
gccagguggacagcgccagc

SEQ ID NO: 413046 - RNA, 16 nt, Bordetella pertussis
gccagguggcggcggc

SEQ ID NO: 413047 - RNA, 17 nt, Bordetella pertussis
gccagguggcggcggca

SEQ ID NO: 413048 - RNA, 22 nt, Bordetella pertussis
gccagguugggugcgccgccgg

SEQ ID NO: 413049 - RNA, 15 nt, Bordetella pertussis
gccaguacaggcugc

SEQ ID NO: 413050 - RNA, 22 nt, Bordetella pertussis
gccaguacaggcugccgucguc

SEQ ID NO: 413051 - RNA, 20 nt, Bordetella pertussis
gccaguaccugacccugcgc

SEQ ID NO: 413052 - RNA, 15 nt, Bordetella pertussis
gccaguagcgccggc

SEQ ID NO: 413053 - RNA, 19 nt, Bordetella pertussis
gccaguagcgugugcagga

SEQ ID NO: 413054 - RNA, 19 nt, Bordetella pertussis
gccaguaggcgccccaggc

SEQ ID NO: 413055 - RNA, 17 nt, Bordetella pertussis
gccaguccagcgcgccg

SEQ ID NO: 413056 - RNA, 21 nt, Bordetella pertussis
gccaguccccaugcggggacu

SEQ ID NO: 413057 - RNA, 20 nt, Bordetella pertussis
gccaguccccauguggggac

SEQ ID NO: 413058 - RNA, 22 nt, Bordetella pertussis
gccaguccccauguggggacag

SEQ ID NO: 413059 - RNA, 21 nt, Bordetella pertussis
gccagucccccgcggggacag

SEQ ID NO: 413060 - RNA, 17 nt, Bordetella pertussis
gccaguccccgcauggg

SEQ ID NO: 413061 - RNA, 13 nt, Bordetella pertussis
gccaguccccugc

SEQ ID NO: 413062 - RNA, 15 nt, Bordetella pertussis
gccaguccauccagc

SEQ ID NO: 413063 - RNA, 14 nt, Bordetella pertussis
gccaguccgcagcg

SEQ ID NO: 413064 - RNA, 18 nt, Bordetella pertussis
gccaguccgcgcucgccc

SEQ ID NO: 413065 - RNA, 18 nt, Bordetella pertussis
gccagucguucagcgucu

SEQ ID NO: 413066 - RNA, 20 nt, Bordetella pertussis
gccagucuccaggcucaggc

SEQ ID NO: 413067 - RNA, 20 nt, Bordetella pertussis
gccagugaaacgcgacgcgc

SEQ ID NO: 413068 - RNA, 16 nt, Bordetella pertussis
gccagugccucagguc

SEQ ID NO: 413069 - RNA, 23 nt, Bordetella pertussis
gccagugcuucgagauccgccgg

SEQ ID NO: 413070 - RNA, 16 nt, Bordetella pertussis
gccaguucguccgcuu

SEQ ID NO: 413071 - RNA, 16 nt, Bordetella pertussis
gccaguucuuccaucc

SEQ ID NO: 413072 - RNA, 13 nt, Bordetella pertussis
gccaguugccgcc

SEQ ID NO: 413073 - RNA, 15 nt, Bordetella pertussis
gccaguugccgccgc

SEQ ID NO: 413074 - RNA, 16 nt, Bordetella pertussis
gccaguugccgccgcc

SEQ ID NO: 413075 - RNA, 21 nt, Bordetella pertussis
gccaguugcggggcgcccagc

SEQ ID NO: 413076 - RNA, 16 nt, Bordetella pertussis
gccaguuguagcgguc

SEQ ID NO: 413077 - RNA, 21 nt, Bordetella pertussis
gccauaaggcuucucgaccag

SEQ ID NO: 413078 - RNA, 22 nt, Bordetella pertussis
gccauaaggcuucucgaccagg

SEQ ID NO: 413079 - RNA, 17 nt, Bordetella pertussis
gccauacagcaaggaca

SEQ ID NO: 413080 - RNA, 18 nt, Bordetella pertussis
gccauacagcaaggacaa

SEQ ID NO: 413081 - RNA, 14 nt, Bordetella pertussis
gccauacguccuuu

SEQ ID NO: 413082 - RNA, 14 nt, Bordetella pertussis
gccauaggccagcg

SEQ ID NO: 413083 - RNA, 16 nt, Bordetella pertussis
gccauccagccaggcc

SEQ ID NO: 413084 - RNA, 11 nt, Bordetella pertussis
gccauccaggu

SEQ ID NO: 413085 - RNA, 15 nt, Bordetella pertussis
gccaucgccauggcc

SEQ ID NO: 413086 - RNA, 16 nt, Bordetella pertussis
gccaucgccauggcca

SEQ ID NO: 413087 - RNA, 19 nt, Bordetella pertussis
gccaucgccgccacgugca

SEQ ID NO: 413088 - RNA, 20 nt, Bordetella pertussis
gccaucgccgccgccgggcu

SEQ ID NO: 413089 - RNA, 12 nt, Bordetella pertussis
gccaugaacucg

SEQ ID NO: 413090 - RNA, 15 nt, Bordetella pertussis
gccaugaucgccggc

SEQ ID NO: 413091 - RNA, 18 nt, Bordetella pertussis
gccaugcaacacgaccag

SEQ ID NO: 413092 - RNA, 17 nt, Bordetella pertussis
gccaugaugucgcgcgc

SEQ ID NO: 413093 - RNA, 19 nt, Bordetella pertussis
gccaugcacgggccaugga

SEQ ID NO: 413094 - RNA, 22 nt, Bordetella pertussis
gccaugcagcuggauggccugc

SEQ ID NO: 413095 - RNA, 17 nt, Bordetella pertussis
gccaugccaacgguugc

SEQ ID NO: 413096 - RNA, 16 nt, Bordetella pertussis
gccauggaggcgcagc

SEQ ID NO: 413097 - RNA, 22 nt, Bordetella pertussis
gccauggaggcgcagcgcggca

SEQ ID NO: 413098 - RNA, 18 nt, Bordetella pertussis
gccauggcagggcgccgc

SEQ ID NO: 413099 - RNA, 18 nt, Bordetella pertussis
gccauggcccuugccgcc

SEQ ID NO: 413100 - RNA, 20 nt, Bordetella pertussis
gccauggcccuugccgccuu

SEQ ID NO: 413101 - RNA, 18 nt, Bordetella pertussis
gccauggccgcgcggcgc

SEQ ID NO: 413102 - RNA, 18 nt, Bordetella pertussis
gccauggccggccgccgg

SEQ ID NO: 413103 - RNA, 20 nt, Bordetella pertussis
gccauggccggcguugccgu

SEQ ID NO: 413104 - RNA, 14 nt, Bordetella pertussis
gccauggacgccga

SEQ ID NO: 413105 - RNA, 16 nt, Bordetella pertussis
gccauggcgcuggcag

SEQ ID NO: 413106 - RNA, 15 nt, Bordetella pertussis
gccauggcggcggcc

SEQ ID NO: 413107 - RNA, 19 nt, Bordetella pertussis
gccauggcggcggccacga

SEQ ID NO: 413108 - RNA, 22 nt, Bordetella pertussis
gccaugucagucguccuccgcg

SEQ ID NO: 413109 - RNA, 18 nt, Bordetella pertussis
gccauucauccagcgcgc

SEQ ID NO: 413110 - RNA, 22 nt, Bordetella pertussis
gccauuccuuccgggcccgcgc

SEQ ID NO: 413111 - RNA, 22 nt, Bordetella pertussis
gccauucgauggcggcgcuggc

SEQ ID NO: 413112 - RNA, 21 nt, Bordetella pertussis
gccauucgucguagccgccga

SEQ ID NO: 413113 - RNA, 16 nt, Bordetella pertussis
gcccaagcccguggcg

SEQ ID NO: 413114 - RNA, 18 nt, Bordetella pertussis
gcccaauccgaucagcac

SEQ ID NO: 413115 - RNA, 23 nt, Bordetella pertussis
gcccagauccagcuugcguccca

SEQ ID NO: 413116 - RNA, 16 nt, Bordetella pertussis
gcccagaucugccgca

SEQ ID NO: 413117 - RNA, 19 nt, Bordetella pertussis
gcccagaucugccgcaaug

SEQ ID NO: 413118 - RNA, 13 nt, Bordetella pertussis
gcccagcaagggu

SEQ ID NO: 413119 - RNA, 15 nt, Bordetella pertussis
gcccagcaaggguuc

SEQ ID NO: 413120 - RNA, 22 nt, Bordetella pertussis
gcccagcaauuaugcguggccg

SEQ ID NO: 413121 - RNA, 15 nt, Bordetella pertussis
gcccagcaccacggg

SEQ ID NO: 413122 - RNA, 15 nt, Bordetella pertussis
gcccagcaccaggcc

SEQ ID NO: 413123 - RNA, 16 nt, Bordetella pertussis
gcccagcaccgccacc

SEQ ID NO: 413124 - RNA, 15 nt, Bordetella pertussis
gcccagcaccgccgc

SEQ ID NO: 413125 - RNA, 16 nt, Bordetella pertussis
gcccagcaccgccgcc

SEQ ID NO: 413126 - RNA, 19 nt, Bordetella pertussis
gcccagcaccgccgccagu

SEQ ID NO: 413127 - RNA, 20 nt, Bordetella pertussis
gcccagcaccucgacgcagc

SEQ ID NO: 413128 - RNA, 18 nt, Bordetella pertussis
gcccagcaccugcaggcc

SEQ ID NO: 413129 - RNA, 16 nt, Bordetella pertussis
gcccagcacgcgcgcc

SEQ ID NO: 413130 - RNA, 15 nt, Bordetella pertussis
gcccagcagcgccac

SEQ ID NO: 413131 - RNA, 16 nt, Bordetella pertussis
gcccagcagcuccucg

SEQ ID NO: 413132 - RNA, 14 nt, Bordetella pertussis
gcccagccgcagca

SEQ ID NO: 413133 - RNA, 17 nt, Bordetella pertussis
gcccagccgcagcaggc

SEQ ID NO: 413134 - RNA, 14 nt, Bordetella pertussis
gcccagcccugccc

SEQ ID NO: 413135 - RNA, 18 nt, Bordetella pertussis
gcccagccgcaugccggc

SEQ ID NO: 413136 - RNA, 19 nt, Bordetella pertussis
gcccagccgccugagcaca

SEQ ID NO: 413137 - RNA, 15 nt, Bordetella pertussis
gcccagccgcucggc

SEQ ID NO: 413138 - RNA, 11 nt, Bordetella pertussis
gcccagccggu

SEQ ID NO: 413139 - RNA, 15 nt, Bordetella pertussis
gcccagcgagccggc

SEQ ID NO: 413140 - RNA, 19 nt, Bordetella pertussis
gcccagcgagccggccagc

SEQ ID NO: 413141 - RNA, 20 nt, Bordetella pertussis
gcccagcgagccggccagcg

SEQ ID NO: 413142 - RNA, 16 nt, Bordetella pertussis
gcccagcgccagcagc

SEQ ID NO: 413143 - RNA, 15 nt, Bordetella pertussis
gcccagcgccagggc

SEQ ID NO: 413144 - RNA, 24 nt, Bordetella pertussis
gcccagcgccgccgacggcauggc

SEQ ID NO: 413145 - RNA, 19 nt, Bordetella pertussis
gcccagcgcgauucccugg

SEQ ID NO: 413146 - RNA, 13 nt, Bordetella pertussis
gcccagcgcgcca

SEQ ID NO: 413147 - RNA, 13 nt, Bordetella pertussis
gcccagcgccggc

SEQ ID NO: 413148 - RNA, 15 nt, Bordetella pertussis
gcccagcgcggcggc

SEQ ID NO: 413149 - RNA, 19 nt, Bordetella pertussis
gcccagcgcgucggccagc

SEQ ID NO: 413150 - RNA, 17 nt, Bordetella pertussis
gcccagcgcgugggcca

SEQ ID NO: 413151 - RNA, 20 nt, Bordetella pertussis
gcccagcgcgugggccagca

SEQ ID NO: 413152 - RNA, 23 nt, Bordetella pertussis
gcccagcggcaggcuggccggcg

SEQ ID NO: 413153 - RNA, 15 nt, Bordetella pertussis
gcccaggccagcgcc

SEQ ID NO: 413154 - RNA, 19 nt, Bordetella pertussis
gcccaggcccacgccgcgu

SEQ ID NO: 413155 - RNA, 18 nt, Bordetella pertussis
gcccaggcccagcgcgcc

SEQ ID NO: 413156 - RNA, 15 nt, Bordetella pertussis
gcccaggcccgccag

SEQ ID NO: 413157 - RNA, 18 nt, Bordetella pertussis
gcccaggcccuggcuggc

SEQ ID NO: 413158 - RNA, 23 nt, Bordetella pertussis
gcccaggcccuggcuggccagcc

SEQ ID NO: 413159 - RNA, 19 nt, Bordetella pertussis
gcccaggccgaaccacagc

SEQ ID NO: 413160 - RNA, 18 nt, Bordetella pertussis
gcccaggccgaucagcgg

SEQ ID NO: 413161 - RNA, 13 nt, Bordetella pertussis
gcccaggccgccg

SEQ ID NO: 413162 - RNA, 14 nt, Bordetella pertussis
gcccaggccgccgg

SEQ ID NO: 413163 - RNA, 15 nt, Bordetella pertussis
gcccaggccgccggc

SEQ ID NO: 413164 - RNA, 18 nt, Bordetella pertussis
gcccaggccgccggcggc

SEQ ID NO: 413165 - RNA, 14 nt, Bordetella pertussis
gcccaggccggcgc

SEQ ID NO: 413166 - RNA, 16 nt, Bordetella pertussis
gcccaggccggcgcgc

SEQ ID NO: 413167 - RNA, 17 nt, Bordetella pertussis
gcccaggccgggcgagc

SEQ ID NO: 413168 - RNA, 20 nt, Bordetella pertussis
gcccaggcgaauccgcaacc

SEQ ID NO: 413169 - RNA, 17 nt, Bordetella pertussis
gcccaggcgacccagca

SEQ ID NO: 413170 - RNA, 20 nt, Bordetella pertussis
gcccaggcgaugcccagcgc

SEQ ID NO: 413171 - RNA, 15 nt, Bordetella pertussis
gcccaggcgcagccc

SEQ ID NO: 413172 - RNA, 17 nt, Bordetella pertussis
gcccaggcgcgcuggcg

SEQ ID NO: 413173 - RNA, 22 nt, Bordetella pertussis
gcccaggcgcugguaguaggcc

SEQ ID NO: 413174 - RNA, 16 nt, Bordetella pertussis
gcccaggcggcccagc

SEQ ID NO: 413175 - RNA, 19 nt, Bordetella pertussis
gcccaggcgggccagguau

SEQ ID NO: 413176 - RNA, 20 nt, Bordetella pertussis
gcccaggcgggcgugcugca

SEQ ID NO: 413177 - RNA, 21 nt, Bordetella pertussis
gcccagguugcggccgccacc

SEQ ID NO: 413178 - RNA, 16 nt, Bordetella pertussis
gcccaguccagggugu

SEQ ID NO: 413179 - RNA, 13 nt, Bordetella pertussis
gcccagucccagg

SEQ ID NO: 413180 - RNA, 17 nt, Bordetella pertussis
gcccagucguccagcac

SEQ ID NO: 413181 - RNA, 18 nt, Bordetella pertussis
gcccagucguccagcacg

SEQ ID NO: 413182 - RNA, 16 nt, Bordetella pertussis
gcccaguucgcgcagc

SEQ ID NO: 413183 - RNA, 19 nt, Bordetella pertussis
gcccaguucgcgcagcagc

SEQ ID NO: 413184 - RNA, 15 nt, Bordetella pertussis
gcccaguucgcggcc

SEQ ID NO: 413185 - RNA, 21 nt, Bordetella pertussis
gcccaguucgcggccggccgg

SEQ ID NO: 413186 - RNA, 19 nt, Bordetella pertussis
gcccaguuccacgcggccg

SEQ ID NO: 413187 - RNA, 22 nt, Bordetella pertussis
gcccaguugaaucggcgcgagc

SEQ ID NO: 413188 - RNA, 21 nt, Bordetella pertussis
gcccaguugacgaugcccagg

SEQ ID NO: 413189 - RNA, 21 nt, Bordetella pertussis
gcccaucgcggucaucggcga

SEQ ID NO: 413190 - RNA, 14 nt, Bordetella pertussis
gcccaucugguuga

SEQ ID NO: 413191 - RNA, 21 nt, Bordetella pertussis
gcccaucugguugagcagcac

SEQ ID NO: 413192 - RNA, 19 nt, Bordetella pertussis
gcccaucuguacggccggc

SEQ ID NO: 413193 - RNA, 17 nt, Bordetella pertussis
gcccaugaaggcggcca

SEQ ID NO: 413194 - RNA, 23 nt, Bordetella pertussis
gcccaugacgaccuugcggccgc

SEQ ID NO: 413195 - RNA, 18 nt, Bordetella pertussis
gcccaugcgaucggccuc

SEQ ID NO: 413196 - RNA, 17 nt, Bordetella pertussis
gcccaugcgcauggcca

SEQ ID NO: 413197 - RNA, 19 nt, Bordetella pertussis
gcccaugcgcauggccagc

SEQ ID NO: 413198 - RNA, 15 nt, Bordetella pertussis
gcccaugcgcugcgc

SEQ ID NO: 413199 - RNA, 22 nt, Bordetella pertussis
gcccaugcgcuggcgcaaggac

SEQ ID NO: 413200 - RNA, 23 nt, Bordetella pertussis
gcccaugcggguuggcagucggc

SEQ ID NO: 413201 - RNA, 16 nt, Bordetella pertussis
gcccaugccgccgggc

SEQ ID NO: 413202 - RNA, 13 nt, Bordetella pertussis
gcccaugccgcgc

SEQ ID NO: 413203 - RNA, 23 nt, Bordetella pertussis
gcccauuucgauggccagggcga

SEQ ID NO: 413204 - RNA, 21 nt, Bordetella pertussis
gccccaacggccuucggcggc

SEQ ID NO: 413205 - RNA, 17 nt, Bordetella pertussis
gccccaccuggcggugc

SEQ ID NO: 413206 - RNA, 20 nt, Bordetella pertussis
gccccaccuugcccagcagc

SEQ ID NO: 413207 - RNA, 20 nt, Bordetella pertussis
gccccacgccgaugccgcgc

SEQ ID NO: 413208 - RNA, 12 nt, Bordetella pertussis
gccccagcagca

SEQ ID NO: 413209 - RNA, 14 nt, Bordetella pertussis
gccccagcagcacg

SEQ ID NO: 413210 - RNA, 16 nt, Bordetella pertussis
gccccagcagcacgcc

SEQ ID NO: 413211 - RNA, 20 nt, Bordetella pertussis
gccccagcacgaagggcagc

SEQ ID NO: 413212 - RNA, 23 nt, Bordetella pertussis
gccccagcacgaagggcagcagc

SEQ ID NO: 413213 - RNA, 18 nt, Bordetella pertussis
gccccagcgcccaggcga

SEQ ID NO: 413214 - RNA, 19 nt, Bordetella pertussis
gccccagcggcuggcgcac

SEQ ID NO: 413215 - RNA, 19 nt, Bordetella pertussis
gccccagcguccaggcggc

SEQ ID NO: 413216 - RNA, 20 nt, Bordetella pertussis
gccccagcguccaggcggcc

SEQ ID NO: 413217 - RNA, 21 nt, Bordetella pertussis
gccccagcuugucggccgcgc

SEQ ID NO: 413218 - RNA, 20 nt, Bordetella pertussis
gccccaggaugcgcaccggc

SEQ ID NO: 413219 - RNA, 15 nt, Bordetella pertussis
gccccaggcaggcgg

SEQ ID NO: 413220 - RNA, 17 nt, Bordetella pertussis
gccccaggcguacgagg

SEQ ID NO: 413221 - RNA, 19 nt, Bordetella pertussis
gccccaggcguacgaggac

SEQ ID NO: 413222 - RNA, 17 nt, Bordetella pertussis
gccccagguccgccggc

SEQ ID NO: 413223 - RNA, 18 nt, Bordetella pertussis
gccccagguccgccggca

SEQ ID NO: 413224 - RNA, 14 nt, Bordetella pertussis
gccccaguccaggc

SEQ ID NO: 413225 - RNA, 18 nt, Bordetella pertussis
gccccaguccaggccggc

SEQ ID NO: 413226 - RNA, 19 nt, Bordetella pertussis
gccccaguccaggccggcc

SEQ ID NO: 413227 - RNA, 12 nt, Bordetella pertussis
gcccccagcgcc

SEQ ID NO: 413228 - RNA, 21 nt, Bordetella pertussis
gcccccagcgccgucagcagc

SEQ ID NO: 413229 - RNA, 20 nt, Bordetella pertussis
gcccccagcgcgccugccca

SEQ ID NO: 413230 - RNA, 23 nt, Bordetella pertussis
gccccccgagggggcuuuuugcc

SEQ ID NO: 413231 - RNA, 15 nt, Bordetella pertussis
gccccccggcgcggc

SEQ ID NO: 413232 - RNA, 16 nt, Bordetella pertussis
gccccccggcgcggcc

SEQ ID NO: 413233 - RNA, 17 nt, Bordetella pertussis
gccccccggcgcggccg

SEQ ID NO: 413234 - RNA, 17 nt, Bordetella pertussis
gccccccguaggcggcc

SEQ ID NO: 413235 - RNA, 15 nt, Bordetella pertussis
gcccccgaaggccgc

SEQ ID NO: 413236 - RNA, 13 nt, Bordetella pertussis
gccccgacgcgcu

SEQ ID NO: 413237 - RNA, 15 nt, Bordetella pertussis
gccccgacgcgcuuc

SEQ ID NO: 413238 - RNA, 16 nt, Bordetella pertussis
gccccgacgcgcuucc

SEQ ID NO: 413239 - RNA, 23 nt, Bordetella pertussis
gccccgacgcggucgcccaaccc

SEQ ID NO: 413240 - RNA, 20 nt, Bordetella pertussis
gccccgauccgcgggcgggc

SEQ ID NO: 413241 - RNA, 19 nt, Bordetella pertussis
gccccgcaaggggccggcg

SEQ ID NO: 413242 - RNA, 20 nt, Bordetella pertussis
gccccgcaaggggccggcgc

SEQ ID NO: 413243 - RNA, 20 nt, Bordetella pertussis
gccccgcaugcgcagacugu

SEQ ID NO: 413244 - RNA, 19 nt, Bordetella pertussis
gccccgccacgucgccggc

SEQ ID NO: 413245 - RNA, 13 nt, Bordetella pertussis
gccccgcgucggc

SEQ ID NO: 413246 - RNA, 16 nt, Bordetella pertussis
gccccgcgucggcgaa

SEQ ID NO: 413247 - RNA, 20 nt, Bordetella pertussis
gccccgcuacguguccugcc

SEQ ID NO: 413248 - RNA, 18 nt, Bordetella pertussis
gccccgcuggccgucgcc

SEQ ID NO: 413249 - RNA, 16 nt, Bordetella pertussis
gccccgcuucgggccg

SEQ ID NO: 413250 - RNA, 20 nt, Bordetella pertussis
gccccggcaccaucgccgcc

SEQ ID NO: 413251 - RNA, 14 nt, Bordetella pertussis
gccccuagcgccgc

SEQ ID NO: 413252 - RNA, 16 nt, Bordetella pertussis
gccccuccggcgccgc

SEQ ID NO: 413253 - RNA, 22 nt, Bordetella pertussis
gccccucggcgggcuugucgcu

SEQ ID NO: 413254 - RNA, 20 nt, Bordetella pertussis
gccccucgcggaugaccugg

SEQ ID NO: 413255 - RNA, 22 nt, Bordetella pertussis
gccccugcccgucuauggccug

SEQ ID NO: 413256 - RNA, 16 nt, Bordetella pertussis
gccccugcccugcggc

SEQ ID NO: 413257 - RNA, 21 nt, Bordetella pertussis
gccccugcggggacaggcacc

SEQ ID NO: 413258 - RNA, 14 nt, Bordetella pertussis
gcccgacagcgccc

SEQ ID NO: 413259 - RNA, 14 nt, Bordetella pertussis
gcccgacaggaaca

SEQ ID NO: 413260 - RNA, 21 nt, Bordetella pertussis
gcccgacgacgacuacuggca

SEQ ID NO: 413261 - RNA, 21 nt, Bordetella pertussis
gcccgaugccuuggugggguc

SEQ ID NO: 413262 - RNA, 17 nt, Bordetella pertussis
gcccgaugcgccaggcc

SEQ ID NO: 413263 - RNA, 19 nt, Bordetella pertussis
gcccgaugcgccaggccuc

SEQ ID NO: 413264 - RNA, 22 nt, Bordetella pertussis
gcccgaugcucgccggcgccgc

SEQ ID NO: 413265 - RNA, 12 nt, Bordetella pertussis
gcccgauggugc

SEQ ID NO: 413266 - RNA, 23 nt, Bordetella pertussis
gcccgcaacgggccggccgccgg

SEQ ID NO: 413267 - RNA, 24 nt, Bordetella pertussis
gcccgcaagcauuugcgcgacggc

SEQ ID NO: 413268 - RNA, 18 nt, Bordetella pertussis
gcccgcaccgggcggccc

SEQ ID NO: 413269 - RNA, 15 nt, Bordetella pertussis
gcccgcacgggccga

SEQ ID NO: 413270 - RNA, 16 nt, Bordetella pertussis
gcccgcauccuucacg

SEQ ID NO: 413271 - RNA, 17 nt, Bordetella pertussis
gcccgcaucgcgcgccg

SEQ ID NO: 413272 - RNA, 18 nt, Bordetella pertussis
gcccgcaucgcgcgccgc

SEQ ID NO: 413273 - RNA, 22 nt, Bordetella pertussis
gcccgcaggcauugcgccagcc

SEQ ID NO: 413274 - RNA, 18 nt, Bordetella pertussis
gcccgcaugucccagcgc

SEQ ID NO: 413275 - RNA, 19 nt, Bordetella pertussis
gcccgcaugucccagcgcu

SEQ ID NO: 413276 - RNA, 22 nt, Bordetella pertussis
gcccgccaccaggaacgccagc

SEQ ID NO: 413277 - RNA, 13 nt, Bordetella pertussis
gcccgccagcagc

SEQ ID NO: 413278 - RNA, 12 nt, Bordetella pertussis
gcccgccagcgc

SEQ ID NO: 413279 - RNA, 13 nt, Bordetella pertussis
gcccgccagcgcg

SEQ ID NO: 413280 - RNA, 22 nt, Bordetella pertussis
gcccgccaggaagcgggccugc

SEQ ID NO: 413281 - RNA, 16 nt, Bordetella pertussis
gcccgccaggccaggu

SEQ ID NO: 413282 - RNA, 15 nt, Bordetella pertussis
gcccgccaucgccag

SEQ ID NO: 413283 - RNA, 18 nt, Bordetella pertussis
gcccgccaugcacgggcc

SEQ ID NO: 413284 - RNA, 17 nt, Bordetella pertussis
gcccgccggcacccggc

SEQ ID NO: 413285 - RNA, 14 nt, Bordetella pertussis
gcccgccggcgcgc

SEQ ID NO: 413286 - RNA, 21 nt, Bordetella pertussis
gcccgccggcgcgcgcgcgcc

SEQ ID NO: 413287 - RNA, 23 nt, Bordetella pertussis
gcccgccggcgcgcgcgcgccgc

SEQ ID NO: 413288 - RNA, 13 nt, Bordetella pertussis
gcccgccguggcc

SEQ ID NO: 413289 - RNA, 17 nt, Bordetella pertussis
gcccgccugcagcagcg

SEQ ID NO: 413290 - RNA, 12 nt, Bordetella pertussis
gcccgccugccg

SEQ ID NO: 413291 - RNA, 19 nt, Bordetella pertussis
gcccgccugcguggcgggc

SEQ ID NO: 413292 - RNA, 16 nt, Bordetella pertussis
gcccgccuucagcggg

SEQ ID NO: 413293 - RNA, 18 nt, Bordetella pertussis
gcccgccuucagcgggcc

SEQ ID NO: 413294 - RNA, 19 nt, Bordetella pertussis
gcccgggcuggccgccugc

SEQ ID NO: 413295 - RNA, 19 nt, Bordetella pertussis
gcccgggguugccaagaug

SEQ ID NO: 413296 - RNA, 13 nt, Bordetella pertussis
gcccgggugccug

SEQ ID NO: 413297 - RNA, 12 nt, Bordetella pertussis
gcccgggugggc

SEQ ID NO: 413298 - RNA, 15 nt, Bordetella pertussis
gcccggugcagccgc

SEQ ID NO: 413299 - RNA, 18 nt, Bordetella pertussis
gcccggugccugccccug

SEQ ID NO: 413300 - RNA, 20 nt, Bordetella pertussis
gcccguacgucaaggccugc

SEQ ID NO: 413301 - RNA, 23 nt, Bordetella pertussis
gcccguagcuggaccccuugcgg

SEQ ID NO: 413302 - RNA, 21 nt, Bordetella pertussis
gcccgucagcggcgcgcccac

SEQ ID NO: 413303 - RNA, 16 nt, Bordetella pertussis
gcccgucaugcgccgc

SEQ ID NO: 413304 - RNA, 19 nt, Bordetella pertussis
gcccgucaugcgccgcagc

SEQ ID NO: 413305 - RNA, 21 nt, Bordetella pertussis
gcccgucaugcgccgcagcac

SEQ ID NO: 413306 - RNA, 19 nt, Bordetella pertussis
gcccgucaugggcggggcc

SEQ ID NO: 413307 - RNA, 15 nt, Bordetella pertussis
gcccguccuggugca

SEQ ID NO: 413308 - RNA, 16 nt, Bordetella pertussis
gcccgucgcuggcgcg

SEQ ID NO: 413309 - RNA, 19 nt, Bordetella pertussis
gcccgucucgcgcgccagg

SEQ ID NO: 413310 - RNA, 14 nt, Bordetella pertussis
gcccgugccacggc

SEQ ID NO: 413311 - RNA, 21 nt, Bordetella pertussis
gcccgugcgcaacgcgcgcgc

SEQ ID NO: 413312 - RNA, 22 nt, Bordetella pertussis
gcccgugcgcggcgagccgcgc

SEQ ID NO: 413313 - RNA, 17 nt, Bordetella pertussis
gcccgugcgugcgccug

SEQ ID NO: 413314 - RNA, 21 nt, Bordetella pertussis
gcccgugcgugcgccuguccc

SEQ ID NO: 413315 - RNA, 20 nt, Bordetella pertussis
gcccgugcgugugccugucc

SEQ ID NO: 413316 - RNA, 21 nt, Bordetella pertussis
gcccgugcgugugccuguccc

SEQ ID NO: 413317 - RNA, 17 nt, Bordetella pertussis
gcccgugcgggugccug

SEQ ID NO: 413318 - RNA, 17 nt, Bordetella pertussis
gcccguuccacaggcga

SEQ ID NO: 413319 - RNA, 14 nt, Bordetella pertussis
gcccguugccgcgc

SEQ ID NO: 413320 - RNA, 17 nt, Bordetella pertussis
gcccguuggcaggccag

SEQ ID NO: 413321 - RNA, 17 nt, Bordetella pertussis
gcccguugcggcgccuc

SEQ ID NO: 413322 - RNA, 13 nt, Bordetella pertussis
gcccucaguccag

SEQ ID NO: 413323 - RNA, 14 nt, Bordetella pertussis
gcccucaguccagc

SEQ ID NO: 413324 - RNA, 19 nt, Bordetella pertussis
gcccucaguccagcuggcc

SEQ ID NO: 413325 - RNA, 17 nt, Bordetella pertussis
gcccuccucggccaggu

SEQ ID NO: 413326 - RNA, 18 nt, Bordetella pertussis
gcccucgauaugggcgcg

SEQ ID NO: 413327 - RNA, 15 nt, Bordetella pertussis
gcccucgcgccacca

SEQ ID NO: 413328 - RNA, 17 nt, Bordetella pertussis
gcccucgcgccaccaug

SEQ ID NO: 413329 - RNA, 13 nt, Bordetella pertussis
gcccucgcggccg

SEQ ID NO: 413330 - RNA, 14 nt, Bordetella pertussis
gcccucgcggccgu

SEQ ID NO: 413331 - RNA, 15 nt, Bordetella pertussis
gcccucgcgcacggu

SEQ ID NO: 413332 - RNA, 18 nt, Bordetella pertussis
gcccucggucagcgccag

SEQ ID NO: 413333 - RNA, 23 nt, Bordetella pertussis
gcccucggucagcgccagggugc

SEQ ID NO: 413334 - RNA, 19 nt, Bordetella pertussis
gcccucggucgucagcacg

SEQ ID NO: 413335 - RNA, 15 nt, Bordetella pertussis
gcccucgucgcggcc

SEQ ID NO: 413336 - RNA, 17 nt, Bordetella pertussis
gcccucuuccguuggcc

SEQ ID NO: 413337 - RNA, 19 nt, Bordetella pertussis
gcccucuucggcggccagc

SEQ ID NO: 413338 - RNA, 20 nt, Bordetella pertussis
gcccugcaccgucacgcgcu

SEQ ID NO: 413339 - RNA, 13 nt, Bordetella pertussis
gcccugcagcggc

SEQ ID NO: 413340 - RNA, 16 nt, Bordetella pertussis
gcccugcagcggccag

SEQ ID NO: 413341 - RNA, 22 nt, Bordetella pertussis
gcccugcagcggccaguccacc

SEQ ID NO: 413342 - RNA, 15 nt, Bordetella pertussis
gcccugcccgcacca

SEQ ID NO: 413343 - RNA, 21 nt, Bordetella pertussis
gcccugcccgcaccaugccga

SEQ ID NO: 413344 - RNA, 15 nt, Bordetella pertussis
gcccuggcagcuggc

SEQ ID NO: 413345 - RNA, 17 nt, Bordetella pertussis
gcccuggccacgcugcu

SEQ ID NO: 413346 - RNA, 15 nt, Bordetella pertussis
gcccuggcccaggcc

SEQ ID NO: 413347 - RNA, 10 nt, Bordetella pertussis
gcccuggccg

SEQ ID NO: 413348 - RNA, 18 nt, Bordetella pertussis
gcccuggcgcaggccggc

SEQ ID NO: 413349 - RNA, 20 nt, Bordetella pertussis
gcccuggcgcaggccggcgg

SEQ ID NO: 413350 - RNA, 16 nt, Bordetella pertussis
gcccuggcgccgcggc

SEQ ID NO: 413351 - RNA, 14 nt, Bordetella pertussis
gcccuggcgcuguu

SEQ ID NO: 413352 - RNA, 16 nt, Bordetella pertussis
gcccuggcggcgcagu

SEQ ID NO: 413353 - RNA, 13 nt, Bordetella pertussis
gcccuggcggcgg

SEQ ID NO: 413354 - RNA, 19 nt, Bordetella pertussis
gcccuggcguggcgcgcgc

SEQ ID NO: 413355 - RNA, 14 nt, Bordetella pertussis
gcccuggcuggcca

SEQ ID NO: 413356 - RNA, 20 nt, Bordetella pertussis
gcccuggcuggccagccggc

SEQ ID NO: 413357 - RNA, 15 nt, Bordetella pertussis
gcccuggcuggcggc

SEQ ID NO: 413358 - RNA, 19 nt, Bordetella pertussis
gcccugggcagcauucugg

SEQ ID NO: 413359 - RNA, 23 nt, Bordetella pertussis
gcccugggcagcauucuggugca

SEQ ID NO: 413360 - RNA, 14 nt, Bordetella pertussis
gcccugggccagcc

SEQ ID NO: 413361 - RNA, 14 nt, Bordetella pertussis
gcccugggcgcggc

SEQ ID NO: 413362 - RNA, 20 nt, Bordetella pertussis
gcccuggggccgcggcgcgc

SEQ ID NO: 413363 - RNA, 17 nt, Bordetella pertussis
gcccuguucgcgcggcc

SEQ ID NO: 413364 - RNA, 14 nt, Bordetella pertussis
gcccuucaggccag

SEQ ID NO: 413365 - RNA, 14 nt, Bordetella pertussis
gcccuuggcggccu

SEQ ID NO: 413366 - RNA, 20 nt, Bordetella pertussis
gcccuuggcggccuucauga

SEQ ID NO: 413367 - RNA, 17 nt, Bordetella pertussis
gcccuuguggccgccga

SEQ ID NO: 413368 - RNA, 21 nt, Bordetella pertussis
gccgaagaaauagcccgcggc

SEQ ID NO: 413369 - RNA, 18 nt, Bordetella pertussis
gccgaagaaccaguagca

SEQ ID NO: 413370 - RNA, 14 nt, Bordetella pertussis
gccgaagauggggg

SEQ ID NO: 413371 - RNA, 17 nt, Bordetella pertussis
gccgaagauucccgcgc

SEQ ID NO: 413372 - RNA, 15 nt, Bordetella pertussis
gccgaagggcagguc

SEQ ID NO: 413373 - RNA, 16 nt, Bordetella pertussis
gccgaagggcaggucg

SEQ ID NO: 413374 - RNA, 21 nt, Bordetella pertussis
gccgaaguaguuggucgagcg

SEQ ID NO: 413375 - RNA, 16 nt, Bordetella pertussis
gccgaagucggcgcgc

SEQ ID NO: 413376 - RNA, 20 nt, Bordetella pertussis
gccgaauccggccagcacgc

SEQ ID NO: 413377 - RNA, 22 nt, Bordetella pertussis
gccgacagcuugcgcuggcgcg

SEQ ID NO: 413378 - RNA, 17 nt, Bordetella pertussis
gccgacaggaaggcgag

SEQ ID NO: 413379 - RNA, 18 nt, Bordetella pertussis
gccgacaggcgcgcaggc

SEQ ID NO: 413380 - RNA, 22 nt, Bordetella pertussis
gccgacaggcgcgcaggcgggc

SEQ ID NO: 413381 - RNA, 18 nt, Bordetella pertussis
gccgacagguaggcgccg

SEQ ID NO: 413382 - RNA, 15 nt, Bordetella pertussis
gccgaccuccaggcc

SEQ ID NO: 413383 - RNA, 18 nt, Bordetella pertussis
gccgaccuccaggcccag

SEQ ID NO: 413384 - RNA, 16 nt, Bordetella pertussis
gccgaccucgucgggc

SEQ ID NO: 413385 - RNA, 18 nt, Bordetella pertussis
gccgacgaugaccaucac

SEQ ID NO: 413386 - RNA, 17 nt, Bordetella pertussis
gccgacgaugucgccgc

SEQ ID NO: 413387 - RNA, 18 nt, Bordetella pertussis
gccgacgaugucgccgcc

SEQ ID NO: 413388 - RNA, 13 nt, Bordetella pertussis
gccgacgccgcca

SEQ ID NO: 413389 - RNA, 16 nt, Bordetella pertussis
gccgacgcgcccgggc

SEQ ID NO: 413390 - RNA, 16 nt, Bordetella pertussis
gccgacgcgccgggcc

SEQ ID NO: 413391 - RNA, 16 nt, Bordetella pertussis
gccgacgcgcuguccg

SEQ ID NO: 413392 - RNA, 21 nt, Bordetella pertussis
gccgacggcaagaucgccggc

SEQ ID NO: 413393 - RNA, 16 nt, Bordetella pertussis
gccgacggcauggcgg

SEQ ID NO: 413394 - RNA, 21 nt, Bordetella pertussis
gccgacggcauggcggccagc

SEQ ID NO: 413395 - RNA, 16 nt, Bordetella pertussis
gccgacggccucggcc

SEQ ID NO: 413396 - RNA, 19 nt, Bordetella pertussis
gccgacggcgcuggcgagc

SEQ ID NO: 413397 - RNA, 14 nt, Bordetella pertussis
gccgacggcggcgc

SEQ ID NO: 413398 - RNA, 14 nt, Bordetella pertussis
gccgacgggcggcu

SEQ ID NO: 413399 - RNA, 23 nt, Bordetella pertussis
gccgacgggcggcugcuggccca

SEQ ID NO: 413400 - RNA, 22 nt, Bordetella pertussis
gccgacggggugccuguccccg

SEQ ID NO: 413401 - RNA, 16 nt, Bordetella pertussis
gccgaggcgggcagca

SEQ ID NO: 413402 - RNA, 18 nt, Bordetella pertussis
gccgaggcggugggcagg

SEQ ID NO: 413403 - RNA, 20 nt, Bordetella pertussis
gccgaggcggugggcagggc

SEQ ID NO: 413404 - RNA, 17 nt, Bordetella pertussis
gccgaggcugcgcgcgc

SEQ ID NO: 413405 - RNA, 16 nt, Bordetella pertussis
gccgaggugcccauca

SEQ ID NO: 413406 - RNA, 23 nt, Bordetella pertussis
gccgagucggcgauggcgcgcgc

SEQ ID NO: 413407 - RNA, 21 nt, Bordetella pertussis
gccgaguggaugcgcuugccg

SEQ ID NO: 413408 - RNA, 21 nt, Bordetella pertussis
gccgaucaccacgggcacgau

SEQ ID NO: 413409 - RNA, 14 nt, Bordetella pertussis
gccgaucagcacca

SEQ ID NO: 413410 - RNA, 14 nt, Bordetella pertussis
gccgaucagcaggu

SEQ ID NO: 413411 - RNA, 14 nt, Bordetella pertussis
gccgaucagcgaca

SEQ ID NO: 413412 - RNA, 18 nt, Bordetella pertussis
gccgaucagcgacagcag

SEQ ID NO: 413413 - RNA, 19 nt, Bordetella pertussis
gccgaucagcgacagcagg

SEQ ID NO: 413414 - RNA, 15 nt, Bordetella pertussis
gccgaucagcaccac

SEQ ID NO: 413415 - RNA, 20 nt, Bordetella pertussis
gccgauccagggccgcagca

SEQ ID NO: 413416 - RNA, 23 nt, Bordetella pertussis
gccgauccagggccgcagcaauu

SEQ ID NO: 413417 - RNA, 20 nt, Bordetella pertussis
gccgaugauggccauggcca

SEQ ID NO: 413418 - RNA, 14 nt, Bordetella pertussis
gccgaugccgcagu

SEQ ID NO: 413419 - RNA, 19 nt, Bordetella pertussis
gccgaugccgccaucaucc

SEQ ID NO: 413420 - RNA, 16 nt, Bordetella pertussis
gccgaugcgccaggcu

SEQ ID NO: 413421 - RNA, 15 nt, Bordetella pertussis
gccgaugcguccgcc

SEQ ID NO: 413422 - RNA, 19 nt, Bordetella pertussis
gccgaugcguccgccgugc

SEQ ID NO: 413423 - RNA, 15 nt, Bordetella pertussis
gccgaugcgccgcgc

SEQ ID NO: 413424 - RNA, 12 nt, Bordetella pertussis
gccgauggccuc

SEQ ID NO: 413425 - RNA, 21 nt, Bordetella pertussis
gccgauggccucgcugccagg

SEQ ID NO: 413426 - RNA, 21 nt, Bordetella pertussis
gccgaugcuuagcgcagcagc

SEQ ID NO: 413427 - RNA, 14 nt, Bordetella pertussis
gccgauggcgccgc

SEQ ID NO: 413428 - RNA, 16 nt, Bordetella pertussis
gccgauggcgcgcggc

SEQ ID NO: 413429 - RNA, 20 nt, Bordetella pertussis
gccgauggcgcgcggcuggg

SEQ ID NO: 413430 - RNA, 16 nt, Bordetella pertussis
gccgauggcgcggccg

SEQ ID NO: 413431 - RNA, 17 nt, Bordetella pertussis
gccgauggcgcggccgc

SEQ ID NO: 413432 - RNA, 16 nt, Bordetella pertussis
gccgaugucgccgccu

SEQ ID NO: 413433 - RNA, 21 nt, Bordetella pertussis
gccgaugucgccgccugcggc

SEQ ID NO: 413434 - RNA, 13 nt, Bordetella pertussis
gccgauguuuucc

SEQ ID NO: 413435 - RNA, 16 nt, Bordetella pertussis
gccgauugaggccagc

SEQ ID NO: 413436 - RNA, 18 nt, Bordetella pertussis
gccgauugaggccagcac

SEQ ID NO: 413437 - RNA, 22 nt, Bordetella pertussis
gccgcaauaccuucagcccggc

SEQ ID NO: 413438 - RNA, 15 nt, Bordetella pertussis
gccgcaccaggccgc

SEQ ID NO: 413439 - RNA, 17 nt, Bordetella pertussis
gccgcaccaggccgcgg

SEQ ID NO: 413440 - RNA, 14 nt, Bordetella pertussis
gccgcaccagcgcc

SEQ ID NO: 413441 - RNA, 20 nt, Bordetella pertussis
gccgcaggagucgcuccccg

SEQ ID NO: 413442 - RNA, 20 nt, Bordetella pertussis
gccgcagguccaggccuggg

SEQ ID NO: 413443 - RNA, 21 nt, Bordetella pertussis
gccgccaacgccaagcugcug

SEQ ID NO: 413444 - RNA, 23 nt, Bordetella pertussis
gccgccaacgcggcgcgugcaga

SEQ ID NO: 413445 - RNA, 15 nt, Bordetella pertussis
gccgccaagggcgcg

SEQ ID NO: 413446 - RNA, 22 nt, Bordetella pertussis
gccgccaagggcgcgccagcac

SEQ ID NO: 413447 - RNA, 13 nt, Bordetella pertussis
gccgccacaggcu

SEQ ID NO: 413448 - RNA, 21 nt, Bordetella pertussis
gccgccacccaggcggcaggc

SEQ ID NO: 413449 - RNA, 18 nt, Bordetella pertussis
gccgccaccagggcgccc

SEQ ID NO: 413450 - RNA, 21 nt, Bordetella pertussis
gccgccagcauggcggccagg

SEQ ID NO: 413451 - RNA, 22 nt, Bordetella pertussis
gccgccagcauggcggccaggc

SEQ ID NO: 413452 - RNA, 16 nt, Bordetella pertussis
gccgccagccgcuggc

SEQ ID NO: 413453 - RNA, 22 nt, Bordetella pertussis
gccgccagccgcuggcgcgccg

SEQ ID NO: 413454 - RNA, 13 nt, Bordetella pertussis
gccgccagccggc

SEQ ID NO: 413455 - RNA, 15 nt, Bordetella pertussis
gccgccagccggccc

SEQ ID NO: 413456 - RNA, 19 nt, Bordetella pertussis
gccgccagccggcccagca

SEQ ID NO: 413457 - RNA, 13 nt, Bordetella pertussis
gccgccagcgcgc

SEQ ID NO: 413458 - RNA, 18 nt, Bordetella pertussis
gccgccagcgcgccgccc

SEQ ID NO: 413459 - RNA, 12 nt, Bordetella pertussis
gccgccagcggc

SEQ ID NO: 413460 - RNA, 14 nt, Bordetella pertussis
gccgccaggucggc

SEQ ID NO: 413461 - RNA, 20 nt, Bordetella pertussis
gccgccaggucggccaccgc

SEQ ID NO: 413462 - RNA, 17 nt, Bordetella pertussis
gccgccaugcagcugga

SEQ ID NO: 413463 - RNA, 16 nt, Bordetella pertussis
gccgccaugcgccagc

SEQ ID NO: 413464 - RNA, 17 nt, Bordetella pertussis
gccgccaugcgccagca

SEQ ID NO: 413465 - RNA, 18 nt, Bordetella pertussis
gccgccauggcgcuggca

SEQ ID NO: 413466 - RNA, 13 nt, Bordetella pertussis
gccgccauggugc

SEQ ID NO: 413467 - RNA, 22 nt, Bordetella pertussis
gccgccauggugccgcgcaggc

SEQ ID NO: 413468 - RNA, 13 nt, Bordetella pertussis
gccgcccagcaug

SEQ ID NO: 413469 - RNA, 20 nt, Bordetella pertussis
gccgcccagcaugcgcgcga

SEQ ID NO: 413470 - RNA, 14 nt, Bordetella pertussis
gccgcccagccggc

SEQ ID NO: 413471 - RNA, 16 nt, Bordetella pertussis
gccgcccagccggccg

SEQ ID NO: 413472 - RNA, 16 nt, Bordetella pertussis
gccgcccaggcgcagc

SEQ ID NO: 413473 - RNA, 19 nt, Bordetella pertussis
gccgcccaggcgcagccgc

SEQ ID NO: 413474 - RNA, 22 nt, Bordetella pertussis
gccgcccaggucggacgcgccg

SEQ ID NO: 413475 - RNA, 16 nt, Bordetella pertussis
gccgcccaugccgccg

SEQ ID NO: 413476 - RNA, 17 nt, Bordetella pertussis
gccgcccaugccgccgg

SEQ ID NO: 413477 - RNA, 20 nt, Bordetella pertussis
gccgcccaugccgccgggca

SEQ ID NO: 413478 - RNA, 22 nt, Bordetella pertussis
gccgcccaugcgcauggccagc

SEQ ID NO: 413479 - RNA, 23 nt, Bordetella pertussis
gccgcccaugcgcauggccagca

SEQ ID NO: 413480 - RNA, 14 nt, Bordetella pertussis
gccgccccagcagc

SEQ ID NO: 413481 - RNA, 15 nt, Bordetella pertussis
gccgccccagcagca

SEQ ID NO: 413482 - RNA, 16 nt, Bordetella pertussis
gccgccccagcagcag

SEQ ID NO: 413483 - RNA, 12 nt, Bordetella pertussis
gccgccccaggc

SEQ ID NO: 413484 - RNA, 16 nt, Bordetella pertussis
gccgcccccagcgcgc

SEQ ID NO: 413485 - RNA, 14 nt, Bordetella pertussis
gccgcccgugcaga

SEQ ID NO: 413486 - RNA, 20 nt, Bordetella pertussis
gccgcccugccgccaagggc

SEQ ID NO: 413487 - RNA, 14 nt, Bordetella pertussis
gccgcccugcugcc

SEQ ID NO: 413488 - RNA, 18 nt, Bordetella pertussis
gccgcccuggccgcgccg

SEQ ID NO: 413489 - RNA, 14 nt, Bordetella pertussis
gccgcccuggcgcg

SEQ ID NO: 413490 - RNA, 14 nt, Bordetella pertussis
gccgcccuggucau

SEQ ID NO: 413491 - RNA, 15 nt, Bordetella pertussis
gccgccgaaccagcg

SEQ ID NO: 413492 - RNA, 19 nt, Bordetella pertussis
gccgccgaacggcagcagc

SEQ ID NO: 413493 - RNA, 17 nt, Bordetella pertussis
gccgccgaacggggccg

SEQ ID NO: 413494 - RNA, 19 nt, Bordetella pertussis
gccgccgaagccgccgccg

SEQ ID NO: 413495 - RNA, 17 nt, Bordetella pertussis
gccgccgacggcauggc

SEQ ID NO: 413496 - RNA, 16 nt, Bordetella pertussis
gccgccgaucugcuuc

SEQ ID NO: 413497 - RNA, 20 nt, Bordetella pertussis
gccgccgauggcgccaccuu

SEQ ID NO: 413498 - RNA, 20 nt, Bordetella pertussis
gccgccgauggcgcgcggcu

SEQ ID NO: 413499 - RNA, 22 nt, Bordetella pertussis
gccgccgauguugaacagcugg

SEQ ID NO: 413500 - RNA, 18 nt, Bordetella pertussis
gccgccggcagggccagc

SEQ ID NO: 413501 - RNA, 19 nt, Bordetella pertussis
gccgccggcagggccagcg

SEQ ID NO: 413502 - RNA, 22 nt, Bordetella pertussis
gccgccggcagggccagcgcca

SEQ ID NO: 413503 - RNA, 19 nt, Bordetella pertussis
gccgccggccagcgcggca

SEQ ID NO: 413504 - RNA, 14 nt, Bordetella pertussis
gccgccggccagcu

SEQ ID NO: 413505 - RNA, 16 nt, Bordetella pertussis
gccgccggccaccagc

SEQ ID NO: 413506 - RNA, 13 nt, Bordetella pertussis
gccgccggccagc

SEQ ID NO: 413507 - RNA, 15 nt, Bordetella pertussis
gccgccggcccagga

SEQ ID NO: 413508 - RNA, 14 nt, Bordetella pertussis
gccgccgggcgcgc

SEQ ID NO: 413509 - RNA, 20 nt, Bordetella pertussis
gccgccgggcgcgcgccggc

SEQ ID NO: 413510 - RNA, 14 nt, Bordetella pertussis
gccgccgggcugga

SEQ ID NO: 413511 - RNA, 22 nt, Bordetella pertussis
gccgccgggucgcugugcgcgg

SEQ ID NO: 413512 - RNA, 23 nt, Bordetella pertussis
gccgccggugauaugcgccaggc

SEQ ID NO: 413513 - RNA, 21 nt, Bordetella pertussis
gccgccggugcaccaggccac

SEQ ID NO: 413514 - RNA, 16 nt, Bordetella pertussis
gccgccguaggacagc

SEQ ID NO: 413515 - RNA, 22 nt, Bordetella pertussis
gccgccguaggacagccccagc

SEQ ID NO: 413516 - RNA, 17 nt, Bordetella pertussis
gccgccuaccagguggg

SEQ ID NO: 413517 - RNA, 20 nt, Bordetella pertussis
gccgccuauguaggcgccgc

SEQ ID NO: 413518 - RNA, 15 nt, Bordetella pertussis
gccgccucagcccgc

SEQ ID NO: 413519 - RNA, 19 nt, Bordetella pertussis
gccgccucgcgcuccagca

SEQ ID NO: 413520 - RNA, 16 nt, Bordetella pertussis
gccgccucggcggcca

SEQ ID NO: 413521 - RNA, 15 nt, Bordetella pertussis
gccgccugaaaccuc

SEQ ID NO: 413522 - RNA, 23 nt, Bordetella pertussis
gccgccugcgcaauucuuccucc

SEQ ID NO: 413523 - RNA, 18 nt, Bordetella pertussis
gccgccugcggcgcggcc

SEQ ID NO: 413524 - RNA, 22 nt, Bordetella pertussis
gccgccuggaccugacccccga

SEQ ID NO: 413525 - RNA, 19 nt, Bordetella pertussis
gccgcgaccgggccgaaga

SEQ ID NO: 413526 - RNA, 18 nt, Bordetella pertussis
gccgcgagcaugcgcagc

SEQ ID NO: 413527 - RNA, 13 nt, Bordetella pertussis
gccgcgaggcgca

SEQ ID NO: 413528 - RNA, 15 nt, Bordetella pertussis
gccgcgaggcgcagg

SEQ ID NO: 413529 - RNA, 17 nt, Bordetella pertussis
gccgcgaggcgcaggcc

SEQ ID NO: 413530 - RNA, 22 nt, Bordetella pertussis
gccgcgaggcgcaggccgacgc

SEQ ID NO: 413531 - RNA, 20 nt, Bordetella pertussis
gccgcgagguauuggccuug

SEQ ID NO: 413532 - RNA, 13 nt, Bordetella pertussis
gccgcgcaggccc

SEQ ID NO: 413533 - RNA, 20 nt, Bordetella pertussis
gccgcgcauuugccgcggcg

SEQ ID NO: 413534 - RNA, 12 nt, Bordetella pertussis
gccgcgcccagc

SEQ ID NO: 413535 - RNA, 13 nt, Bordetella pertussis
gccgcgcccagca

SEQ ID NO: 413536 - RNA, 15 nt, Bordetella pertussis
gccgcgcccagcagc

SEQ ID NO: 413537 - RNA, 16 nt, Bordetella pertussis
gccgcgcccagcagcg

SEQ ID NO: 413538 - RNA, 14 nt, Bordetella pertussis
gccgcgcccagccg

SEQ ID NO: 413539 - RNA, 17 nt, Bordetella pertussis
gccgcgcccagcgcggc

SEQ ID NO: 413540 - RNA, 20 nt, Bordetella pertussis
gccgcgcccagcgcggccuu

SEQ ID NO: 413541 - RNA, 22 nt, Bordetella pertussis
gccgcgcccaugcgcuggcgca

SEQ ID NO: 413542 - RNA, 20 nt, Bordetella pertussis
gccgcgccgggcgcgccggc

SEQ ID NO: 413543 - RNA, 16 nt, Bordetella pertussis
gccgcgccggucgccg

SEQ ID NO: 413544 - RNA, 13 nt, Bordetella pertussis
gccgcgccguucg

SEQ ID NO: 413545 - RNA, 22 nt, Bordetella pertussis
gccgcgccucggacgccuggcg

SEQ ID NO: 413546 - RNA, 18 nt, Bordetella pertussis
gccgcgccugcagcagcg

SEQ ID NO: 413547 - RNA, 23 nt, Bordetella pertussis
gccgcgccuugcccgucagggua

SEQ ID NO: 413548 - RNA, 22 nt, Bordetella pertussis
gccgcgcgacagccgcgccagc

SEQ ID NO: 413549 - RNA, 22 nt, Bordetella pertussis
gccgcgcgaugcgcggcccggc

SEQ ID NO: 413550 - RNA, 21 nt, Bordetella pertussis
gccgcgccuauaucgacggcg

SEQ ID NO: 413551 - RNA, 15 nt, Bordetella pertussis
gccgcgcgcagggcg

SEQ ID NO: 413552 - RNA, 13 nt, Bordetella pertussis
gccgcgcgccggc

SEQ ID NO: 413553 - RNA, 14 nt, Bordetella pertussis
gccgcgcgccggcg

SEQ ID NO: 413554 - RNA, 15 nt, Bordetella pertussis
gccgcgcgccggcgc

SEQ ID NO: 413555 - RNA, 17 nt, Bordetella pertussis
gccgcgcgccggcgccg

SEQ ID NO: 413556 - RNA, 17 nt, Bordetella pertussis
gccgcgcgccugcagca

SEQ ID NO: 413557 - RNA, 17 nt, Bordetella pertussis
gccgcgcgcgccaggcc

SEQ ID NO: 413558 - RNA, 13 nt, Bordetella pertussis
gccgcgcgcggca

SEQ ID NO: 413559 - RNA, 13 nt, Bordetella pertussis
gccgcgcgcggcc

SEQ ID NO: 413560 - RNA, 14 nt, Bordetella pertussis
gccgcgcgcggccc

SEQ ID NO: 413561 - RNA, 17 nt, Bordetella pertussis
gccgcgcgcggccggca

SEQ ID NO: 413562 - RNA, 22 nt, Bordetella pertussis
gccgcgcgcggccggcgcgccg

SEQ ID NO: 413563 - RNA, 14 nt, Bordetella pertussis
gccgcgcgcggcgg

SEQ ID NO: 413564 - RNA, 14 nt, Bordetella pertussis
gccgcgcgcgggcg

SEQ ID NO: 413565 - RNA, 17 nt, Bordetella pertussis
gccgcgcgcgggcgccc

SEQ ID NO: 413566 - RNA, 16 nt, Bordetella pertussis
gccgcgcgcgucgccg

SEQ ID NO: 413567 - RNA, 15 nt, Bordetella pertussis
gccgcgcgcgugccg

SEQ ID NO: 413568 - RNA, 21 nt, Bordetella pertussis
gccgcgcgcuucaggcgccgc

SEQ ID NO: 413569 - RNA, 14 nt, Bordetella pertussis
gccgcggacccagg

SEQ ID NO: 413570 - RNA, 19 nt, Bordetella pertussis
gccgcggacgaagccuagg

SEQ ID NO: 413571 - RNA, 18 nt, Bordetella pertussis
gccgcggcaagccgcggc

SEQ ID NO: 413572 - RNA, 17 nt, Bordetella pertussis
gccgcggcaugcugguu

SEQ ID NO: 413573 - RNA, 13 nt, Bordetella pertussis
gccgcggccacgc

SEQ ID NO: 413574 - RNA, 15 nt, Bordetella pertussis
gccgcggccaggccc

SEQ ID NO: 413575 - RNA, 17 nt, Bordetella pertussis
gccgcggccagcgccgc

SEQ ID NO: 413576 - RNA, 16 nt, Bordetella pertussis
gccggaauccuggcga

SEQ ID NO: 413577 - RNA, 19 nt, Bordetella pertussis
gccggacccgcgccgcagg

SEQ ID NO: 413578 - RNA, 20 nt, Bordetella pertussis
gccggacccgcgccgcaggc

SEQ ID NO: 413579 - RNA, 21 nt, Bordetella pertussis
gccggaccgcugugcgcguuc

SEQ ID NO: 413580 - RNA, 17 nt, Bordetella pertussis
gccggacgcggggaugg

SEQ ID NO: 413581 - RNA, 17 nt, Bordetella pertussis
gccggacgugggcgccu

SEQ ID NO: 413582 - RNA, 18 nt, Bordetella pertussis
gccggacucguccauggu

SEQ ID NO: 413583 - RNA, 22 nt, Bordetella pertussis
gccggacucguccauggugggc

SEQ ID NO: 413584 - RNA, 23 nt, Bordetella pertussis
gccggacucguccauggugggca

SEQ ID NO: 413585 - RNA, 17 nt, Bordetella pertussis
gccggacuggcgcgcac

SEQ ID NO: 413586 - RNA, 19 nt, Bordetella pertussis
gccggacugggcgucgcuc

SEQ ID NO: 413587 - RNA, 14 nt, Bordetella pertussis
gccggagcagcagc

SEQ ID NO: 413588 - RNA, 13 nt, Bordetella pertussis
gccggaggcgcgc

SEQ ID NO: 413589 - RNA, 13 nt, Bordetella pertussis
gccggaugcgcag

SEQ ID NO: 413590 - RNA, 15 nt, Bordetella pertussis
gccggaugcgcagga

SEQ ID NO: 413591 - RNA, 12 nt, Bordetella pertussis
gccggauggcgc

SEQ ID NO: 413592 - RNA, 23 nt, Bordetella pertussis
gccggauggcgcggaugaccugc

SEQ ID NO: 413593 - RNA, 23 nt, Bordetella pertussis
gccggauugcuugacgccgccga

SEQ ID NO: 413594 - RNA, 15 nt, Bordetella pertussis
gccggauuggcgcug

SEQ ID NO: 413595 - RNA, 16 nt, Bordetella pertussis
gccggauuggcgcugc

SEQ ID NO: 413596 - RNA, 13 nt, Bordetella pertussis
gccggcaaacccg

SEQ ID NO: 413597 - RNA, 17 nt, Bordetella pertussis
gccggcaaggggccagc

SEQ ID NO: 413598 - RNA, 13 nt, Bordetella pertussis
gccggcaagguca

SEQ ID NO: 413599 - RNA, 23 nt, Bordetella pertussis
gccggcaccacgaccggcucggg

SEQ ID NO: 413600 - RNA, 19 nt, Bordetella pertussis
gccggcaccagcgccacgc

SEQ ID NO: 413601 - RNA, 15 nt, Bordetella pertussis
gccggcaccaggauc

SEQ ID NO: 413602 - RNA, 13 nt, Bordetella pertussis
gccggcaccaucu

SEQ ID NO: 413603 - RNA, 14 nt, Bordetella pertussis
gccggcaccaucug

SEQ ID NO: 413604 - RNA, 17 nt, Bordetella pertussis
gccggcacggccggcca

SEQ ID NO: 413605 - RNA, 23 nt, Bordetella pertussis
gccggcacggccggccaggcgcc

SEQ ID NO: 413606 - RNA, 19 nt, Bordetella pertussis
gccggcacgccugccgcgc

SEQ ID NO: 413607 - RNA, 23 nt, Bordetella pertussis
gccggcacgccugccgcgcccgg

SEQ ID NO: 413608 - RNA, 17 nt, Bordetella pertussis
gccggcagaucggcgcu

SEQ ID NO: 413609 - RNA, 18 nt, Bordetella pertussis
gccggcagaucggcgcug

SEQ ID NO: 413610 - RNA, 21 nt, Bordetella pertussis
gccggcagaucggcgcuggcc

SEQ ID NO: 413611 - RNA, 13 nt, Bordetella pertussis
gccggcagcaggg

SEQ ID NO: 413612 - RNA, 22 nt, Bordetella pertussis
gccggcagcgcaaaacgcauga

SEQ ID NO: 413613 - RNA, 15 nt, Bordetella pertussis
gccggcagcgcgacc

SEQ ID NO: 413614 - RNA, 16 nt, Bordetella pertussis
gccggcagcgcgaccg

SEQ ID NO: 413615 - RNA, 16 nt, Bordetella pertussis
gccggcaggccggcca

SEQ ID NO: 413616 - RNA, 19 nt, Bordetella pertussis
gccggcaggcgcgccagcc

SEQ ID NO: 413617 - RNA, 22 nt, Bordetella pertussis
gccggcaggcgcgccagcccgc

SEQ ID NO: 413618 - RNA, 15 nt, Bordetella pertussis
gccggcagggcggcc

SEQ ID NO: 413619 - RNA, 14 nt, Bordetella pertussis
gccggcagugccug

SEQ ID NO: 413620 - RNA, 16 nt, Bordetella pertussis
gccggcauaggcggcg

SEQ ID NO: 413621 - RNA, 18 nt, Bordetella pertussis
gccggcauaggcggcgca

SEQ ID NO: 413622 - RNA, 20 nt, Bordetella pertussis
gccggcauaggcggcgcagg

SEQ ID NO: 413623 - RNA, 22 nt, Bordetella pertussis
gccggcauaggcggcgcaggcc

SEQ ID NO: 413624 - RNA, 23 nt, Bordetella pertussis
gccggcauaggcggcgcaggcca

SEQ ID NO: 413625 - RNA, 16 nt, Bordetella pertussis
gccggcaucggcggcu

SEQ ID NO: 413626 - RNA, 16 nt, Bordetella pertussis
gccggcaugcgccggc

SEQ ID NO: 413627 - RNA, 17 nt, Bordetella pertussis
gccggcaugcgccggcc

SEQ ID NO: 413628 - RNA, 17 nt, Bordetella pertussis
gccggcauuucgcuggg

SEQ ID NO: 413629 - RNA, 16 nt, Bordetella pertussis
gccggccaaggcaagc

SEQ ID NO: 413630 - RNA, 20 nt, Bordetella pertussis
gccggccaccagcggcgccg

SEQ ID NO: 413631 - RNA, 23 nt, Bordetella pertussis
gccggccagccauugccgcacga

SEQ ID NO: 413632 - RNA, 11 nt, Bordetella pertussis
gccggccagcc

SEQ ID NO: 413633 - RNA, 13 nt, Bordetella pertussis
gccggccagcgcc

SEQ ID NO: 413634 - RNA, 16 nt, Bordetella pertussis
gccggccagcgccagu

SEQ ID NO: 413635 - RNA, 21 nt, Bordetella pertussis
gccggccagcgccugggcgcg

SEQ ID NO: 413636 - RNA, 16 nt, Bordetella pertussis
gccggccaggcgccgc

SEQ ID NO: 413637 - RNA, 17 nt, Bordetella pertussis
gccggccaggcgccgcu

SEQ ID NO: 413638 - RNA, 16 nt, Bordetella pertussis
gccggccagguagugc

SEQ ID NO: 413639 - RNA, 18 nt, Bordetella pertussis
gccggccaguggcgcggc

SEQ ID NO: 413640 - RNA, 19 nt, Bordetella pertussis
gccggccaucaggugcagg

SEQ ID NO: 413641 - RNA, 15 nt, Bordetella pertussis
gccggccauggccgc

SEQ ID NO: 413642 - RNA, 17 nt, Bordetella pertussis
gccggccauggcggccg

SEQ ID NO: 413643 - RNA, 19 nt, Bordetella pertussis
gccggccauggcggccggc

SEQ ID NO: 413644 - RNA, 12 nt, Bordetella pertussis
gccggccagcug

SEQ ID NO: 413645 - RNA, 21 nt, Bordetella pertussis
gccggcccaaggccccgcgac

SEQ ID NO: 413646 - RNA, 15 nt, Bordetella pertussis
gccggccccauccuc

SEQ ID NO: 413647 - RNA, 16 nt, Bordetella pertussis
gccggcccgccccacg

SEQ ID NO: 413648 - RNA, 15 nt, Bordetella pertussis
gccggcccgcgcgcc

SEQ ID NO: 413649 - RNA, 16 nt, Bordetella pertussis
gccggcccugccgccc

SEQ ID NO: 413650 - RNA, 20 nt, Bordetella pertussis
gccggccgacggcgcuggcg

SEQ ID NO: 413651 - RNA, 13 nt, Bordetella pertussis
gccggccgccaug

SEQ ID NO: 413652 - RNA, 20 nt, Bordetella pertussis
gccggccgcccaggcgcagc

SEQ ID NO: 413653 - RNA, 12 nt, Bordetella pertussis
gccggccgccga

SEQ ID NO: 413654 - RNA, 14 nt, Bordetella pertussis
gccggccgccgggc

SEQ ID NO: 413655 - RNA, 19 nt, Bordetella pertussis
gccggccgccgggccgcga

SEQ ID NO: 413656 - RNA, 13 nt, Bordetella pertussis
gccggccgccggc

SEQ ID NO: 413657 - RNA, 16 nt, Bordetella pertussis
gccggccgcgcccagc

SEQ ID NO: 413658 - RNA, 14 nt, Bordetella pertussis
gccggccgcgcccg

SEQ ID NO: 413659 - RNA, 14 nt, Bordetella pertussis
gccggccgcgccgc

SEQ ID NO: 413660 - RNA, 13 nt, Bordetella pertussis
gccggccgcgcgc

SEQ ID NO: 413661 - RNA, 20 nt, Bordetella pertussis
gccggccgcgcgcgccaugu

SEQ ID NO: 413662 - RNA, 22 nt, Bordetella pertussis
gccggccgcggggcuggccagc

SEQ ID NO: 413663 - RNA, 17 nt, Bordetella pertussis
gccggccguuucaggcc

SEQ ID NO: 413664 - RNA, 13 nt, Bordetella pertussis
gccggccucggcc

SEQ ID NO: 413665 - RNA, 22 nt, Bordetella pertussis
gccggccucuucgucgccggcg

SEQ ID NO: 413666 - RNA, 12 nt, Bordetella pertussis
gccggccugcag

SEQ ID NO: 413667 - RNA, 16 nt, Bordetella pertussis
gccggccugcaggcuc

SEQ ID NO: 413668 - RNA, 16 nt, Bordetella pertussis
gccggccugcgccagc

SEQ ID NO: 413669 - RNA, 20 nt, Bordetella pertussis
gccggccugcgccgggcgcg

SEQ ID NO: 413670 - RNA, 19 nt, Bordetella pertussis
gccggccugcgucgccacc

SEQ ID NO: 413671 - RNA, 12 nt, Bordetella pertussis
gccggccuggcg

SEQ ID NO: 413672 - RNA, 14 nt, Bordetella pertussis
gccggccuggcgcg

SEQ ID NO: 413673 - RNA, 15 nt, Bordetella pertussis
gccggccuggcgcgc

SEQ ID NO: 413674 - RNA, 20 nt, Bordetella pertussis
gccggccuggcgcgcggccu

SEQ ID NO: 413675 - RNA, 14 nt, Bordetella pertussis
gccggccuggcggg

SEQ ID NO: 413676 - RNA, 16 nt, Bordetella pertussis
gccggccugggcggcg

SEQ ID NO: 413677 - RNA, 18 nt, Bordetella pertussis
gccggccuggggacgggc

SEQ ID NO: 413678 - RNA, 15 nt, Bordetella pertussis
gccggccuguucuuu

SEQ ID NO: 413679 - RNA, 18 nt, Bordetella pertussis
gccggcgaauaugcccuc

SEQ ID NO: 413680 - RNA, 21 nt, Bordetella pertussis
gccggcgaauaugcccucuuc

SEQ ID NO: 413681 - RNA, 18 nt, Bordetella pertussis
gccggcgaaugccggccg

SEQ ID NO: 413682 - RNA, 18 nt, Bordetella pertussis
gccggcgacgccgcggug

SEQ ID NO: 413683 - RNA, 18 nt, Bordetella pertussis
gccggcgacguggcgcuc

SEQ ID NO: 413684 - RNA, 17 nt, Bordetella pertussis
gccggcgauauggccag

SEQ ID NO: 413685 - RNA, 18 nt, Bordetella pertussis
gccggcgauauggccagg

SEQ ID NO: 413686 - RNA, 19 nt, Bordetella pertussis
gccggcgauauggccaggg

SEQ ID NO: 413687 - RNA, 22 nt, Bordetella pertussis
gccggcgauauggccagggucg

SEQ ID NO: 413688 - RNA, 22 nt, Bordetella pertussis
gccggcgaugaagucgcggccc

SEQ ID NO: 413689 - RNA, 22 nt, Bordetella pertussis
gccggcgaugauggggucgccg

SEQ ID NO: 413690 - RNA, 17 nt, Bordetella pertussis
gccggcgcaacgggccg

SEQ ID NO: 413691 - RNA, 21 nt, Bordetella pertussis
gccggcgcaguuccggcgggc

SEQ ID NO: 413692 - RNA, 20 nt, Bordetella pertussis
gccggcgcaugagccggcag

SEQ ID NO: 413693 - RNA, 13 nt, Bordetella pertussis
gccggcgccagcc

SEQ ID NO: 413694 - RNA, 17 nt, Bordetella pertussis
gccggcgccagccgcuc

SEQ ID NO: 413695 - RNA, 16 nt, Bordetella pertussis
gccggcgcccccagca

SEQ ID NO: 413696 - RNA, 19 nt, Bordetella pertussis
gccggcgcccccagcagcg

SEQ ID NO: 413697 - RNA, 14 nt, Bordetella pertussis
gccggcgcccggca

SEQ ID NO: 413698 - RNA, 22 nt, Bordetella pertussis
gccggcgcccuugaugccgucg

SEQ ID NO: 413699 - RNA, 12 nt, Bordetella pertussis
gccggcgccggc

SEQ ID NO: 413700 - RNA, 17 nt, Bordetella pertussis
gccggcgccggcgcgcc

SEQ ID NO: 413701 - RNA, 19 nt, Bordetella pertussis
gccggcgccggcgcgccgc

SEQ ID NO: 413702 - RNA, 17 nt, Bordetella pertussis
gccggcgccuuggccug

SEQ ID NO: 413703 - RNA, 14 nt, Bordetella pertussis
gccggcgcgaccgc

SEQ ID NO: 413704 - RNA, 17 nt, Bordetella pertussis
gccggcgcgccggccgc

SEQ ID NO: 413705 - RNA, 22 nt, Bordetella pertussis
gccggcgcgccgggccagaccu

SEQ ID NO: 413706 - RNA, 23 nt, Bordetella pertussis
gccggcgcgcgaucucgggcagg

SEQ ID NO: 413707 - RNA, 14 nt, Bordetella pertussis
gccggcgcgcgcag

SEQ ID NO: 413708 - RNA, 13 nt, Bordetella pertussis
gccggcgcgcgcg

SEQ ID NO: 413709 - RNA, 17 nt, Bordetella pertussis
gccggcgcgcgcguaca

SEQ ID NO: 413710 - RNA, 16 nt, Bordetella pertussis
gccggcgcgcggccgu

SEQ ID NO: 413711 - RNA, 12 nt, Bordetella pertussis
gccggcgcggcg

SEQ ID NO: 413712 - RNA, 12 nt, Bordetella pertussis
gccggcgcggca

SEQ ID NO: 413713 - RNA, 15 nt, Bordetella pertussis
gccggcgcggcugcu

SEQ ID NO: 413714 - RNA, 16 nt, Bordetella pertussis
gccggcgcggcugcug

SEQ ID NO: 413715 - RNA, 15 nt, Bordetella pertussis
gccggcgcgggcgca

SEQ ID NO: 413716 - RNA, 19 nt, Bordetella pertussis
gccggcgcguccacgccgu

SEQ ID NO: 413717 - RNA, 15 nt, Bordetella pertussis
gccggcgcgugcugg

SEQ ID NO: 413718 - RNA, 23 nt, Bordetella pertussis
gccggcgcuacagggugccgcgc

SEQ ID NO: 413719 - RNA, 20 nt, Bordetella pertussis
gccggcgcucagcgacgcgc

SEQ ID NO: 413720 - RNA, 16 nt, Bordetella pertussis
gccggcgcugcgcagc

SEQ ID NO: 413721 - RNA, 12 nt, Bordetella pertussis
gccggcgcugcu

SEQ ID NO: 413722 - RNA, 21 nt, Bordetella pertussis
gccggcggcacgcugcgcagg

SEQ ID NO: 413723 - RNA, 19 nt, Bordetella pertussis
gccggcggcauucagcgcu

SEQ ID NO: 413724 - RNA, 20 nt, Bordetella pertussis
gccggcggccagcgcgccgc

SEQ ID NO: 413725 - RNA, 15 nt, Bordetella pertussis
gccggcggccuccgc

SEQ ID NO: 413726 - RNA, 17 nt, Bordetella pertussis
gccggcggccuccgcgc

SEQ ID NO: 413727 - RNA, 15 nt, Bordetella pertussis
gccggcggccugcag

SEQ ID NO: 413728 - RNA, 16 nt, Bordetella pertussis
gccggcggccuggacc

SEQ ID NO: 413729 - RNA, 15 nt, Bordetella pertussis
gccggcggcgccggc

SEQ ID NO: 413730 - RNA, 12 nt, Bordetella pertussis
gccggcggcgcu

SEQ ID NO: 413731 - RNA, 16 nt, Bordetella pertussis
gccggcggcgcuggcg

SEQ ID NO: 413732 - RNA, 21 nt, Bordetella pertussis
gccggcgggcgcugccugccg

SEQ ID NO: 413733 - RNA, 18 nt, Bordetella pertussis
gccggcgggcggcugccc

SEQ ID NO: 413734 - RNA, 22 nt, Bordetella pertussis
gccggcgggcggcugcccgggc

SEQ ID NO: 413735 - RNA, 21 nt, Bordetella pertussis
gccggcggcgucggcgcccgg

SEQ ID NO: 413736 - RNA, 18 nt, Bordetella pertussis
gccggcggcgugcccugc

SEQ ID NO: 413737 - RNA, 22 nt, Bordetella pertussis
gccggcggucgcgcuggcccgc

SEQ ID NO: 413738 - RNA, 21 nt, Bordetella pertussis
gccggcgucacgcggccgggc

SEQ ID NO: 413739 - RNA, 20 nt, Bordetella pertussis
gccggcguccugcggcggca

SEQ ID NO: 413740 - RNA, 22 nt, Bordetella pertussis
gccggcgucgcucaggguacgg

SEQ ID NO: 413741 - RNA, 19 nt, Bordetella pertussis
gccggcguguucagcgcgc

SEQ ID NO: 413742 - RNA, 13 nt, Bordetella pertussis
gccggcguucugg

SEQ ID NO: 413743 - RNA, 17 nt, Bordetella pertussis
gccggcguucuggucag

SEQ ID NO: 413744 - RNA, 19 nt, Bordetella pertussis
gccggcguucuggucagcc

SEQ ID NO: 413745 - RNA, 22 nt, Bordetella pertussis
gccggcguucuucagcgcgcuc

SEQ ID NO: 413746 - RNA, 22 nt, Bordetella pertussis
gccggcguugccguuucagggg

SEQ ID NO: 413747 - RNA, 18 nt, Bordetella pertussis
gccggcguugcgcccugc

SEQ ID NO: 413748 - RNA, 15 nt, Bordetella pertussis
gccggcucagccccc

SEQ ID NO: 413749 - RNA, 23 nt, Bordetella pertussis
gccggcucaggccagcgacccgc

SEQ ID NO: 413750 - RNA, 15 nt, Bordetella pertussis
gccggcuccaguccc

SEQ ID NO: 413751 - RNA, 14 nt, Bordetella pertussis
gccggcucccgcgc

SEQ ID NO: 413752 - RNA, 15 nt, Bordetella pertussis
gccggcucggcggca

SEQ ID NO: 413753 - RNA, 15 nt, Bordetella pertussis
gccggcugcaccagc

SEQ ID NO: 413754 - RNA, 22 nt, Bordetella pertussis
gccggcugcaccagcgcgccgc

SEQ ID NO: 413755 - RNA, 14 nt, Bordetella pertussis
gccggcugcgcgcc

SEQ ID NO: 413756 - RNA, 18 nt, Bordetella pertussis
gccggcugggcguucucg

SEQ ID NO: 413757 - RNA, 14 nt, Bordetella pertussis
gccggcuucagccg

SEQ ID NO: 413758 - RNA, 19 nt, Bordetella pertussis
gccggcuucagccgcaagc

SEQ ID NO: 413759 - RNA, 21 nt, Bordetella pertussis
gccggcuucagccgcaagcug

SEQ ID NO: 413760 - RNA, 16 nt, Bordetella pertussis
gccggcuuccagcagc

SEQ ID NO: 413761 - RNA, 17 nt, Bordetella pertussis
gccggcuuccagcagca

SEQ ID NO: 413762 - RNA, 13 nt, Bordetella pertussis
gccggcuugcgca

SEQ ID NO: 413763 - RNA, 16 nt, Bordetella pertussis
gccggcuugcgccagc

SEQ ID NO: 413764 - RNA, 20 nt, Bordetella pertussis
gccggcuuucagcgccgagc

SEQ ID NO: 413765 - RNA, 21 nt, Bordetella pertussis
gccggcuuucagcgccgagcg

SEQ ID NO: 413766 - RNA, 12 nt, Bordetella pertussis
gccgggaaggcg

SEQ ID NO: 413767 - RNA, 17 nt, Bordetella pertussis
gccgggacaggcacccg

SEQ ID NO: 413768 - RNA, 18 nt, Bordetella pertussis
gccgggauccacgccgcc

SEQ ID NO: 413769 - RNA, 21 nt, Bordetella pertussis
gccgggcaagcagauggccau

SEQ ID NO: 413770 - RNA, 20 nt, Bordetella pertussis
gccgggcaccgagccgcagg

SEQ ID NO: 413771 - RNA, 22 nt, Bordetella pertussis
gccgggcacguaguacagcagc

SEQ ID NO: 413772 - RNA, 14 nt, Bordetella pertussis
gccgggcagcccgc

SEQ ID NO: 413773 - RNA, 16 nt, Bordetella pertussis
gccgggcagcccgcgc

SEQ ID NO: 413774 - RNA, 16 nt, Bordetella pertussis
gccgggcaggccgcgc

SEQ ID NO: 413775 - RNA, 18 nt, Bordetella pertussis
gccgggcaguccuggcug

SEQ ID NO: 413776 - RNA, 20 nt, Bordetella pertussis
gccgggcaguccuggcuggg

SEQ ID NO: 413777 - RNA, 16 nt, Bordetella pertussis
gccgggcaguucgggc

SEQ ID NO: 413778 - RNA, 18 nt, Bordetella pertussis
gccgggccaaggugccug

SEQ ID NO: 413779 - RNA, 17 nt, Bordetella pertussis
gccgggccagcgcgauc

SEQ ID NO: 413780 - RNA, 17 nt, Bordetella pertussis
gccgggcccggcgcgcc

SEQ ID NO: 413781 - RNA, 16 nt, Bordetella pertussis
gccgggccgcgcccac

SEQ ID NO: 413782 - RNA, 16 nt, Bordetella pertussis
gccgggccgcgccgcc

SEQ ID NO: 413783 - RNA, 16 nt, Bordetella pertussis
gccgggccgugcgccg

SEQ ID NO: 413784 - RNA, 19 nt, Bordetella pertussis
gccgggccgugcgccgggc

SEQ ID NO: 413785 - RNA, 17 nt, Bordetella pertussis
gccgggccuagcccggc

SEQ ID NO: 413786 - RNA, 14 nt, Bordetella pertussis
gccgggccugcccg

SEQ ID NO: 413787 - RNA, 15 nt, Bordetella pertussis
gccgggccuggugcc

SEQ ID NO: 413788 - RNA, 12 nt, Bordetella pertussis
gccgggcgccgc

SEQ ID NO: 413789 - RNA, 15 nt, Bordetella pertussis
gccgggcgcgccggc

SEQ ID NO: 413790 - RNA, 14 nt, Bordetella pertussis
gccgggcgcccagc

SEQ ID NO: 413791 - RNA, 13 nt, Bordetella pertussis
gccgggcgcgcug

SEQ ID NO: 413792 - RNA, 15 nt, Bordetella pertussis
gccgggcgcgcugcc

SEQ ID NO: 413793 - RNA, 21 nt, Bordetella pertussis
gccgggcgcggccaggcgcuc

SEQ ID NO: 413794 - RNA, 19 nt, Bordetella pertussis
gccgggcgcggccgccgcc

SEQ ID NO: 413795 - RNA, 14 nt, Bordetella pertussis
gccgggcgcggcgc

SEQ ID NO: 413796 - RNA, 18 nt, Bordetella pertussis
gccgggcgcggcgcccgc

SEQ ID NO: 413797 - RNA, 22 nt, Bordetella pertussis
gccgggcggcgagaugccgucg

SEQ ID NO: 413798 - RNA, 15 nt, Bordetella pertussis
gccgggcggcgcggg

SEQ ID NO: 413799 - RNA, 22 nt, Bordetella pertussis
gccgggcucgaugaccagcagc

SEQ ID NO: 413800 - RNA, 19 nt, Bordetella pertussis
gccgggcucggccaccaug

SEQ ID NO: 413801 - RNA, 14 nt, Bordetella pertussis
gccgggcuggaucc

SEQ ID NO: 413802 - RNA, 15 nt, Bordetella pertussis
gccgggcuggauccg

SEQ ID NO: 413803 - RNA, 21 nt, Bordetella pertussis
gccgggcuggauccggcgcug

SEQ ID NO: 413804 - RNA, 20 nt, Bordetella pertussis
gccgggcuggugcgccgugc

SEQ ID NO: 413805 - RNA, 14 nt, Bordetella pertussis
gccgggcuugcgca

SEQ ID NO: 413806 - RNA, 17 nt, Bordetella pertussis
gccggggaagccgccgg

SEQ ID NO: 413807 - RNA, 19 nt, Bordetella pertussis
gccggggccgcccagcacc

SEQ ID NO: 413808 - RNA, 14 nt, Bordetella pertussis
gccggggccgcccu

SEQ ID NO: 413809 - RNA, 15 nt, Bordetella pertussis
gccggggccgcccug

SEQ ID NO: 413810 - RNA, 16 nt, Bordetella pertussis
gccggggccgcccugc

SEQ ID NO: 413811 - RNA, 12 nt, Bordetella pertussis
gccggggcgcac

SEQ ID NO: 413812 - RNA, 17 nt, Bordetella pertussis
gccggggcgcaccggca

SEQ ID NO: 413813 - RNA, 14 nt, Bordetella pertussis
gccggggcggcgca

SEQ ID NO: 413814 - RNA, 23 nt, Bordetella pertussis
gccgggguuggaguuugcgggug

SEQ ID NO: 413815 - RNA, 16 nt, Bordetella pertussis
gccggguccggccgcg

SEQ ID NO: 413816 - RNA, 17 nt, Bordetella pertussis
gccggguccggccgcgc

SEQ ID NO: 413817 - RNA, 15 nt, Bordetella pertussis
gccgggucgaggucg

SEQ ID NO: 413818 - RNA, 14 nt, Bordetella pertussis
gccgggucgcgcag

SEQ ID NO: 413819 - RNA, 15 nt, Bordetella pertussis
gccgggucgcgcagc

SEQ ID NO: 413820 - RNA, 19 nt, Bordetella pertussis
gccgggucgcgcagcaggg

SEQ ID NO: 413821 - RNA, 19 nt, Bordetella pertussis
gccgggucuggccggccgc

SEQ ID NO: 413822 - RNA, 20 nt, Bordetella pertussis
gccgggucuggccggccgcg

SEQ ID NO: 413823 - RNA, 17 nt, Bordetella pertussis
gccggguggguucgggc

SEQ ID NO: 413824 - RNA, 18 nt, Bordetella pertussis
gccggguggguucgggcg

SEQ ID NO: 413825 - RNA, 19 nt, Bordetella pertussis
gccggguggucgcgcccgc

SEQ ID NO: 413826 - RNA, 18 nt, Bordetella pertussis
gccggguguuccggcgcg

SEQ ID NO: 413827 - RNA, 15 nt, Bordetella pertussis
gccggguuucucgac

SEQ ID NO: 413828 - RNA, 22 nt, Bordetella pertussis
gccggguuuuuacaugccgcgc

SEQ ID NO: 413829 - RNA, 23 nt, Bordetella pertussis
gccggguuuuuacaugccgcgcg

SEQ ID NO: 413830 - RNA, 20 nt, Bordetella pertussis
gccgguaaccgacgcagcgc

SEQ ID NO: 413831 - RNA, 20 nt, Bordetella pertussis
gccgguacagccaggccagc

SEQ ID NO: 413832 - RNA, 15 nt, Bordetella pertussis
gccgguagcgcuggg

SEQ ID NO: 413833 - RNA, 14 nt, Bordetella pertussis
gccgguaucgcggc

SEQ ID NO: 413834 - RNA, 15 nt, Bordetella pertussis
gccgguaucgcggcg

SEQ ID NO: 413835 - RNA, 17 nt, Bordetella pertussis
gccgguaucgcggcgca

SEQ ID NO: 413836 - RNA, 16 nt, Bordetella pertussis
gccggucacgcuggug

SEQ ID NO: 413837 - RNA, 12 nt, Bordetella pertussis
gccgguccagcg

SEQ ID NO: 413838 - RNA, 14 nt, Bordetella pertussis
gccgguccagcgcc

SEQ ID NO: 413839 - RNA, 15 nt, Bordetella pertussis
gccgguccgccucgc

SEQ ID NO: 413840 - RNA, 13 nt, Bordetella pertussis
gccggucgagaua

SEQ ID NO: 413841 - RNA, 17 nt, Bordetella pertussis
gccggucgccgcgggca

SEQ ID NO: 413842 - RNA, 19 nt, Bordetella pertussis
gccggucggccgcuccgcc

SEQ ID NO: 413843 - RNA, 22 nt, Bordetella pertussis
gccggucggccgcuccgccaug

SEQ ID NO: 413844 - RNA, 21 nt, Bordetella pertussis
gccggucuaugucgaggaccu

SEQ ID NO: 413845 - RNA, 15 nt, Bordetella pertussis
gccggugaccgccag

SEQ ID NO: 413846 - RNA, 17 nt, Bordetella pertussis
gccggugaccgccagca

SEQ ID NO: 413847 - RNA, 20 nt, Bordetella pertussis
gccggugaacaccagggugg

SEQ ID NO: 413848 - RNA, 22 nt, Bordetella pertussis
gccggugaugcccgaggcggcg

SEQ ID NO: 413849 - RNA, 18 nt, Bordetella pertussis
gccggugaugcggcgcgc

SEQ ID NO: 413850 - RNA, 18 nt, Bordetella pertussis
gccggugauguacgcauc

SEQ ID NO: 413851 - RNA, 17 nt, Bordetella pertussis
gccggugcaucggccgg

SEQ ID NO: 413852 - RNA, 12 nt, Bordetella pertussis
gccggugcgcag

SEQ ID NO: 413853 - RNA, 15 nt, Bordetella pertussis
gccggugcgcagcac

SEQ ID NO: 413854 - RNA, 14 nt, Bordetella pertussis
gccggugcgcgugg

SEQ ID NO: 413855 - RNA, 16 nt, Bordetella pertussis
gccggugcgcgugggc

SEQ ID NO: 413856 - RNA, 18 nt, Bordetella pertussis
gccggugcucggccagcg

SEQ ID NO: 413857 - RNA, 13 nt, Bordetella pertussis
gccggugggcagg

SEQ ID NO: 413858 - RNA, 19 nt, Bordetella pertussis
gccggugggcgcguucuug

SEQ ID NO: 413859 - RNA, 18 nt, Bordetella pertussis
gccgguguucucgcuggu

SEQ ID NO: 413860 - RNA, 15 nt, Bordetella pertussis
gccgguucgggcggg

SEQ ID NO: 413861 - RNA, 15 nt, Bordetella pertussis
gccgguugcgcgccg

SEQ ID NO: 413862 - RNA, 19 nt, Bordetella pertussis
gccgguuuuuuugcgccgc

SEQ ID NO: 413863 - RNA, 15 nt, Bordetella pertussis
gccguaccagcgcga

SEQ ID NO: 413864 - RNA, 19 nt, Bordetella pertussis
gccguaccaguacaccggc

SEQ ID NO: 413865 - RNA, 14 nt, Bordetella pertussis
gccguaccccagca

SEQ ID NO: 413866 - RNA, 18 nt, Bordetella pertussis
gccguaccugcagcaggc

SEQ ID NO: 413867 - RNA, 19 nt, Bordetella pertussis
gccguacgagugcaggccc

SEQ ID NO: 413868 - RNA, 20 nt, Bordetella pertussis
gccguacgcggcgcccgcgc

SEQ ID NO: 413869 - RNA, 13 nt, Bordetella pertussis
gccguacuuggcg

SEQ ID NO: 413870 - RNA, 20 nt, Bordetella pertussis
gccguaggacagccccagca

SEQ ID NO: 413871 - RNA, 17 nt, Bordetella pertussis
gccguaggcgccggccu

SEQ ID NO: 413872 - RNA, 14 nt, Bordetella pertussis
gccgucagcagcag

SEQ ID NO: 413873 - RNA, 21 nt, Bordetella pertussis
gccgucagcagcgcggcgccg

SEQ ID NO: 413874 - RNA, 13 nt, Bordetella pertussis
gccgucauggcgg

SEQ ID NO: 413875 - RNA, 18 nt, Bordetella pertussis
gccguccacgaaggcagc

SEQ ID NO: 413876 - RNA, 17 nt, Bordetella pertussis
gccguccacgcccagcg

SEQ ID NO: 413877 - RNA, 22 nt, Bordetella pertussis
gccguccacgcccagcgccggc

SEQ ID NO: 413878 - RNA, 14 nt, Bordetella pertussis
gccguccagcgcgg

SEQ ID NO: 413879 - RNA, 15 nt, Bordetella pertussis
gccguccagcgcggc

SEQ ID NO: 413880 - RNA, 16 nt, Bordetella pertussis
gccguccagcgcggca

SEQ ID NO: 413881 - RNA, 16 nt, Bordetella pertussis
gccguccagcgcggcg

SEQ ID NO: 413882 - RNA, 18 nt, Bordetella pertussis
gccguccagcgcggcgcc

SEQ ID NO: 413883 - RNA, 20 nt, Bordetella pertussis
gccgucgaacuccugcagca

SEQ ID NO: 413884 - RNA, 15 nt, Bordetella pertussis
gccgucgaagccggc

SEQ ID NO: 413885 - RNA, 17 nt, Bordetella pertussis
gccgucgaagccggcgc

SEQ ID NO: 413886 - RNA, 19 nt, Bordetella pertussis
gccgucgaaggccgcaacc

SEQ ID NO: 413887 - RNA, 22 nt, Bordetella pertussis
gccgucgagaaugacgguggug

SEQ ID NO: 413888 - RNA, 19 nt, Bordetella pertussis
gccgucgagccgggcgccg

SEQ ID NO: 413889 - RNA, 16 nt, Bordetella pertussis
gccgucgagcgcggcc

SEQ ID NO: 413890 - RNA, 20 nt, Bordetella pertussis
gccgucgaugaugcgguuga

SEQ ID NO: 413891 - RNA, 19 nt, Bordetella pertussis
gccgucgcccuggcggcgg

SEQ ID NO: 413892 - RNA, 21 nt, Bordetella pertussis
gccgucgcccuggcggcgguc

SEQ ID NO: 413893 - RNA, 15 nt, Bordetella pertussis
gccgucgccgaucgg

SEQ ID NO: 413894 - RNA, 14 nt, Bordetella pertussis
gccgucgguggugg

SEQ ID NO: 413895 - RNA, 20 nt, Bordetella pertussis
gccgucguugacggggacgc

SEQ ID NO: 413896 - RNA, 18 nt, Bordetella pertussis
gccgucuacaggcccagc

SEQ ID NO: 413897 - RNA, 14 nt, Bordetella pertussis
gccgugcccggcgg

SEQ ID NO: 413898 - RNA, 13 nt, Bordetella pertussis
gccgugcccggcg

SEQ ID NO: 413899 - RNA, 16 nt, Bordetella pertussis
gccgugcgagcacggc

SEQ ID NO: 413900 - RNA, 23 nt, Bordetella pertussis
gccgugcgaggcgaacaggcaca

SEQ ID NO: 413901 - RNA, 19 nt, Bordetella pertussis
gccguggccgggcccggcg

SEQ ID NO: 413902 - RNA, 17 nt, Bordetella pertussis
gccguggcgauccaggg

SEQ ID NO: 413903 - RNA, 16 nt, Bordetella pertussis
gccguggcgcaccagg

SEQ ID NO: 413904 - RNA, 14 nt, Bordetella pertussis
gccguggcggccug

SEQ ID NO: 413905 - RNA, 22 nt, Bordetella pertussis
gccguggcguugacggcccagc

SEQ ID NO: 413906 - RNA, 21 nt, Bordetella pertussis
gccguggcgugcaggccggcg

SEQ ID NO: 413907 - RNA, 18 nt, Bordetella pertussis
gccguucgucgcgcagca

SEQ ID NO: 413908 - RNA, 17 nt, Bordetella pertussis
gccguugaucugguuca

SEQ ID NO: 413909 - RNA, 15 nt, Bordetella pertussis
gccuacggcggcggc

SEQ ID NO: 413910 - RNA, 17 nt, Bordetella pertussis
gccuaugaagacgcgcu

SEQ ID NO: 413911 - RNA, 13 nt, Bordetella pertussis
gccuauuggcugu

SEQ ID NO: 413912 - RNA, 20 nt, Bordetella pertussis
gccuauuuggcggccuggcc

SEQ ID NO: 413913 - RNA, 23 nt, Bordetella pertussis
gccucaaccuucucgaugcgcgc

SEQ ID NO: 413914 - RNA, 17 nt, Bordetella pertussis
gccucaacuggccggcc

SEQ ID NO: 413915 - RNA, 20 nt, Bordetella pertussis
gccugaaccaggccgccagg

SEQ ID NO: 413916 - RNA, 20 nt, Bordetella pertussis
gccugacgugcgccacagca

SEQ ID NO: 413917 - RNA, 21 nt, Bordetella pertussis
gccugacgugcgccacagcau

SEQ ID NO: 413918 - RNA, 16 nt, Bordetella pertussis
gccugacguucggggc

SEQ ID NO: 413919 - RNA, 12 nt, Bordetella pertussis
gccugagcaccg

SEQ ID NO: 413920 - RNA, 18 nt, Bordetella pertussis
gccugagcaccgccgcgu

SEQ ID NO: 413921 - RNA, 17 nt, Bordetella pertussis
gccugauucccaggccc

SEQ ID NO: 413922 - RNA, 22 nt, Bordetella pertussis
gccugcaaguccagcgugguga

SEQ ID NO: 413923 - RNA, 15 nt, Bordetella pertussis
gccugcaaugcggcc

SEQ ID NO: 413924 - RNA, 17 nt, Bordetella pertussis
gccugcaaugcggccag

SEQ ID NO: 413925 - RNA, 16 nt, Bordetella pertussis
gccugcaccgccgcgc

SEQ ID NO: 413926 - RNA, 14 nt, Bordetella pertussis
gccugcacgcucuu

SEQ ID NO: 413927 - RNA, 18 nt, Bordetella pertussis
gccugcacgcucuugagc

SEQ ID NO: 413928 - RNA, 22 nt, Bordetella pertussis
gccugcacggugggcagcagca

SEQ ID NO: 413929 - RNA, 17 nt, Bordetella pertussis
gccugcagaccagcacc

SEQ ID NO: 413930 - RNA, 24 nt, Bordetella pertussis
gccugcagaccagcaccggcacga

SEQ ID NO: 413931 - RNA, 18 nt, Bordetella pertussis
gccugcagcacggccacg

SEQ ID NO: 413932 - RNA, 19 nt, Bordetella pertussis
gccugcagcacggccacgg

SEQ ID NO: 413933 - RNA, 21 nt, Bordetella pertussis
gccugcagcacggccacggcc

SEQ ID NO: 413934 - RNA, 15 nt, Bordetella pertussis
gccugcagcagcggc

SEQ ID NO: 413935 - RNA, 15 nt, Bordetella pertussis
gccugcagcgcgcgc

SEQ ID NO: 413936 - RNA, 17 nt, Bordetella pertussis
gccugcaggaagccugc

SEQ ID NO: 413937 - RNA, 15 nt, Bordetella pertussis
gccugcaggcccagc

SEQ ID NO: 413938 - RNA, 16 nt, Bordetella pertussis
gccugcaggcccagca

SEQ ID NO: 413939 - RNA, 18 nt, Bordetella pertussis
gccugcaggucuucgggc

SEQ ID NO: 413940 - RNA, 19 nt, Bordetella pertussis
gccugcaggugccgccggc

SEQ ID NO: 413941 - RNA, 19 nt, Bordetella pertussis
gccugcaguucggccgcca

SEQ ID NO: 413942 - RNA, 21 nt, Bordetella pertussis
gccugcaguucggccgccagg

SEQ ID NO: 413943 - RNA, 15 nt, Bordetella pertussis
gccugcauguccagc

SEQ ID NO: 413944 - RNA, 13 nt, Bordetella pertussis
gccugcauccggc

SEQ ID NO: 413945 - RNA, 21 nt, Bordetella pertussis
gccugcauccggcccagcgcc

SEQ ID NO: 413946 - RNA, 20 nt, Bordetella pertussis
gccugccaagcgccgcggcc

SEQ ID NO: 413947 - RNA, 21 nt, Bordetella pertussis
gccugccaagcgccgcggcca

SEQ ID NO: 413948 - RNA, 13 nt, Bordetella pertussis
gccugccaccagc

SEQ ID NO: 413949 - RNA, 17 nt, Bordetella pertussis
gccugccaccagcgcgc

SEQ ID NO: 413950 - RNA, 24 nt, Bordetella pertussis
gccugccaccagcgcgccagcaga

SEQ ID NO: 413951 - RNA, 18 nt, Bordetella pertussis
gccugccagaacagccgc

SEQ ID NO: 413952 - RNA, 20 nt, Bordetella pertussis
gccugccagaacagccgcga

SEQ ID NO: 413953 - RNA, 14 nt, Bordetella pertussis
gccugccagccugc

SEQ ID NO: 413954 - RNA, 18 nt, Bordetella pertussis
gccugccauccggccgca

SEQ ID NO: 413955 - RNA, 16 nt, Bordetella pertussis
gccugcccaggccagc

SEQ ID NO: 413956 - RNA, 19 nt, Bordetella pertussis
gccugcccaggccagcgcc

SEQ ID NO: 413957 - RNA, 14 nt, Bordetella pertussis
gccugcccauggcc

SEQ ID NO: 413958 - RNA, 17 nt, Bordetella pertussis
gccugcccauggccugc

SEQ ID NO: 413959 - RNA, 17 nt, Bordetella pertussis
gccugccccgccugcgc

SEQ ID NO: 413960 - RNA, 17 nt, Bordetella pertussis
gccugccccggcagaga

SEQ ID NO: 413961 - RNA, 17 nt, Bordetella pertussis
gccugccccugcgggga

SEQ ID NO: 413962 - RNA, 17 nt, Bordetella pertussis
gccugcccgcacgggcc

SEQ ID NO: 413963 - RNA, 22 nt, Bordetella pertussis
gccugcccgcacgggccgacgg

SEQ ID NO: 413964 - RNA, 22 nt, Bordetella pertussis
gccugcgagagauagcccagca

SEQ ID NO: 413965 - RNA, 15 nt, Bordetella pertussis
gccugcgccaccagc

SEQ ID NO: 413966 - RNA, 23 nt, Bordetella pertussis
gccugcgccacguccagcacggc

SEQ ID NO: 413967 - RNA, 15 nt, Bordetella pertussis
gccugcgccagccgc

SEQ ID NO: 413968 - RNA, 21 nt, Bordetella pertussis
gccugcgccagcuccagccgc

SEQ ID NO: 413969 - RNA, 21 nt, Bordetella pertussis
gccugcgccauggcgcgcaga

SEQ ID NO: 413970 - RNA, 16 nt, Bordetella pertussis
gccugcgccauguggc

SEQ ID NO: 413971 - RNA, 13 nt, Bordetella pertussis
gccugcgccgccg

SEQ ID NO: 413972 - RNA, 20 nt, Bordetella pertussis
gccugcgccgggcgcggcca

SEQ ID NO: 413973 - RNA, 21 nt, Bordetella pertussis
gccugcgccgggcgcggccag

SEQ ID NO: 413974 - RNA, 20 nt, Bordetella pertussis
gccugcgccgucugcgccgc

SEQ ID NO: 413975 - RNA, 20 nt, Bordetella pertussis
gccugcgcgaaacccccugg

SEQ ID NO: 413976 - RNA, 22 nt, Bordetella pertussis
gccugcgggcugaugcaggccu

SEQ ID NO: 413977 - RNA, 20 nt, Bordetella pertussis
gccugcgggugcgccugcag

SEQ ID NO: 413978 - RNA, 20 nt, Bordetella pertussis
gccugcguggcgggccgcgc

SEQ ID NO: 413979 - RNA, 17 nt, Bordetella pertussis
gccugcgugucaggcgg

SEQ ID NO: 413980 - RNA, 21 nt, Bordetella pertussis
gccugcucgaccugcucgggc

SEQ ID NO: 413981 - RNA, 15 nt, Bordetella pertussis
gccugcucgcaggcc

SEQ ID NO: 413982 - RNA, 18 nt, Bordetella pertussis
gccugcucgcaggccugc

SEQ ID NO: 413983 - RNA, 23 nt, Bordetella pertussis
gccugcucgcccacauagcggcc

SEQ ID NO: 413984 - RNA, 16 nt, Bordetella pertussis
gccugcucgccggcca

SEQ ID NO: 413985 - RNA, 16 nt, Bordetella pertussis
gccugcucgggcgccu

SEQ ID NO: 413986 - RNA, 24 nt, Bordetella pertussis
gccugcuuguacaggcgcggcacg

SEQ ID NO: 413987 - RNA, 16 nt, Bordetella pertussis
gccuggaagcuggcca

SEQ ID NO: 413988 - RNA, 21 nt, Bordetella pertussis
gccuggaagugaugccgccgg

SEQ ID NO: 413989 - RNA, 16 nt, Bordetella pertussis
gccuggaggccgagcg

SEQ ID NO: 413990 - RNA, 19 nt, Bordetella pertussis
gccuggaggccgagcgcga

SEQ ID NO: 413991 - RNA, 21 nt, Bordetella pertussis
gccuggaggccgagcgcgagc

SEQ ID NO: 413992 - RNA, 24 nt, Bordetella pertussis
gccuggaccggcuccggccgcuuc

SEQ ID NO: 413993 - RNA, 12 nt, Bordetella pertussis
gccuggaccuga

SEQ ID NO: 413994 - RNA, 15 nt, Bordetella pertussis
gccuggaugugcagg

SEQ ID NO: 413995 - RNA, 21 nt, Bordetella pertussis
gccuggcagaugcgcgccagg

SEQ ID NO: 413996 - RNA, 21 nt, Bordetella pertussis
gccuggugcccgacgccgcgc

SEQ ID NO: 413997 - RNA, 15 nt, Bordetella pertussis
gccugguuggccgcc

SEQ ID NO: 413998 - RNA, 17 nt, Bordetella pertussis
gccugguuggccgccug

SEQ ID NO: 413999 - RNA, 24 nt, Bordetella pertussis
gccugucuguuugcgcaguggcga

SEQ ID NO: 414000 - RNA, 19 nt, Bordetella pertussis
gccuuacgcgguccgcagc

SEQ ID NO: 414001 - RNA, 22 nt, Bordetella pertussis
gccuucauggcgucguccagcu

SEQ ID NO: 414002 - RNA, 19 nt, Bordetella pertussis
gccuucauuuccugguuca

SEQ ID NO: 414003 - RNA, 19 nt, Bordetella pertussis
gccuuccaaguugcucaug

SEQ ID NO: 414004 - RNA, 23 nt, Bordetella pertussis
gccuuccaaguugcucauggcgg

SEQ ID NO: 414005 - RNA, 13 nt, Bordetella pertussis
gccuuccaccagc

SEQ ID NO: 414006 - RNA, 17 nt, Bordetella pertussis
gccuucccaggcgaggc

SEQ ID NO: 414007 - RNA, 23 nt, Bordetella pertussis
gccuucccggccgaaaccgccgc

SEQ ID NO: 414008 - RNA, 20 nt, Bordetella pertussis
gccuuccggcagcggccagc

SEQ ID NO: 414009 - RNA, 18 nt, Bordetella pertussis
gccuuccugggcgccggc

SEQ ID NO: 414010 - RNA, 23 nt, Bordetella pertussis
gccuuccuugaacugcgcggucu

SEQ ID NO: 414011 - RNA, 19 nt, Bordetella pertussis
gccuucgagcugcacccac

SEQ ID NO: 414012 - RNA, 15 nt, Bordetella pertussis
gccuucgaggccggc

SEQ ID NO: 414013 - RNA, 15 nt, Bordetella pertussis
gccuucuuucgcgag

SEQ ID NO: 414014 - RNA, 11 nt, Bordetella pertussis
gccuugccgcc

SEQ ID NO: 414015 - RNA, 14 nt, Bordetella pertussis
gccuugccgccgug

SEQ ID NO: 414016 - RNA, 19 nt, Bordetella pertussis
gccuugcgcgacagcaggc

SEQ ID NO: 414017 - RNA, 16 nt, Bordetella pertussis
gccuugcgcggcgagc

SEQ ID NO: 414018 - RNA, 22 nt, Bordetella pertussis
gccuugcgcuuuuuucuccagc

SEQ ID NO: 414019 - RNA, 22 nt, Bordetella pertussis
gccuugcggcgaugcacccagg

SEQ ID NO: 414020 - RNA, 17 nt, Bordetella pertussis
gccuugcugaaccugcu

SEQ ID NO: 414021 - RNA, 18 nt, Bordetella pertussis
gccuugcugcccgacggc

SEQ ID NO: 414022 - RNA, 16 nt, Bordetella pertussis
gcgaaaaagcccgcgc

SEQ ID NO: 414023 - RNA, 13 nt, Bordetella pertussis
gcgaaacagcagc

SEQ ID NO: 414024 - RNA, 21 nt, Bordetella pertussis
gcgaaacccgcugggccagca

SEQ ID NO: 414025 - RNA, 20 nt, Bordetella pertussis
gcgaauccaccggcgcgcgc

SEQ ID NO: 414026 - RNA, 18 nt, Bordetella pertussis
gcgaaucccuuggucggu

SEQ ID NO: 414027 - RNA, 15 nt, Bordetella pertussis
gcgaaugccugguag

SEQ ID NO: 414028 - RNA, 18 nt, Bordetella pertussis
gcgacaaauagccgaccg

SEQ ID NO: 414029 - RNA, 21 nt, Bordetella pertussis
gcgacaaauagccgaccgcgc

SEQ ID NO: 414030 - RNA, 17 nt, Bordetella pertussis
gcgacaaccgcggcgac

SEQ ID NO: 414031 - RNA, 17 nt, Bordetella pertussis
gcgacacaaggcggccg

SEQ ID NO: 414032 - RNA, 21 nt, Bordetella pertussis
gcgacacccccagggcgcgcc

SEQ ID NO: 414033 - RNA, 14 nt, Bordetella pertussis
gcgacacccgcggc

SEQ ID NO: 414034 - RNA, 15 nt, Bordetella pertussis
gcgacacccgcggcc

SEQ ID NO: 414035 - RNA, 13 nt, Bordetella pertussis
gcgacaccgcggc

SEQ ID NO: 414036 - RNA, 15 nt, Bordetella pertussis
gcgacaccgcggccu

SEQ ID NO: 414037 - RNA, 18 nt, Bordetella pertussis
gcgacaccgcggccuugc

SEQ ID NO: 414038 - RNA, 12 nt, Bordetella pertussis
gcgacagcagca

SEQ ID NO: 414039 - RNA, 17 nt, Bordetella pertussis
gcgacagcagcaugcgg

SEQ ID NO: 414040 - RNA, 12 nt, Bordetella pertussis
gcgacagcaggc

SEQ ID NO: 414041 - RNA, 19 nt, Bordetella pertussis
gcgacagcagggccaggcc

SEQ ID NO: 414042 - RNA, 16 nt, Bordetella pertussis
gcgacagccaggccag

SEQ ID NO: 414043 - RNA, 21 nt, Bordetella pertussis
gcgacagccaggccagcgcca

SEQ ID NO: 414044 - RNA, 22 nt, Bordetella pertussis
gcgacagccaggccagcgccag

SEQ ID NO: 414045 - RNA, 13 nt, Bordetella pertussis
gcgacagccgcgc

SEQ ID NO: 414046 - RNA, 12 nt, Bordetella pertussis
gcgacagcgaca

SEQ ID NO: 414047 - RNA, 20 nt, Bordetella pertussis
gcgacagcgacagccaggcc

SEQ ID NO: 414048 - RNA, 19 nt, Bordetella pertussis
gcgacagcgauuucuucug

SEQ ID NO: 414049 - RNA, 21 nt, Bordetella pertussis
gcgacagcuugaugggcgagg

SEQ ID NO: 414050 - RNA, 15 nt, Bordetella pertussis
gcgacaggcccgcgg

SEQ ID NO: 414051 - RNA, 19 nt, Bordetella pertussis
gcgacaggcccgcggccgc

SEQ ID NO: 414052 - RNA, 15 nt, Bordetella pertussis
gcgacaggcgcgccc

SEQ ID NO: 414053 - RNA, 21 nt, Bordetella pertussis
gcgacaggcggugcgcgcggc

SEQ ID NO: 414054 - RNA, 22 nt, Bordetella pertussis
gcgacaguucgccccccgaggc

SEQ ID NO: 414055 - RNA, 22 nt, Bordetella pertussis
gcgacauagaucuccggcgccu

SEQ ID NO: 414056 - RNA, 20 nt, Bordetella pertussis
gcgacaugagcugcgcgugc

SEQ ID NO: 414057 - RNA, 15 nt, Bordetella pertussis
gcgaccaccagcacc

SEQ ID NO: 414058 - RNA, 16 nt, Bordetella pertussis
gcgaccacggucuggc

SEQ ID NO: 414059 - RNA, 18 nt, Bordetella pertussis
gcgaccaggcccauggcg

SEQ ID NO: 414060 - RNA, 21 nt, Bordetella pertussis
gcgaccaggcuggagucgggc

SEQ ID NO: 414061 - RNA, 16 nt, Bordetella pertussis
gcgaccaggugcgggc

SEQ ID NO: 414062 - RNA, 21 nt, Bordetella pertussis
gcgacccagaacccggccggc

SEQ ID NO: 414063 - RNA, 22 nt, Bordetella pertussis
gcgacccagaacccggccggcg

SEQ ID NO: 414064 - RNA, 19 nt, Bordetella pertussis
gcgacccgauagccgcgcg

SEQ ID NO: 414065 - RNA, 20 nt, Bordetella pertussis
gcgacccgcaaaaccgggcc

SEQ ID NO: 414066 - RNA, 17 nt, Bordetella pertussis
gcgacccguggcccggg

SEQ ID NO: 414067 - RNA, 14 nt, Bordetella pertussis
gcgaccgccggccg

SEQ ID NO: 414068 - RNA, 14 nt, Bordetella pertussis
gcgaccgccuccag

SEQ ID NO: 414069 - RNA, 22 nt, Bordetella pertussis
gcgaccgccuccagcgcggcgg

SEQ ID NO: 414070 - RNA, 13 nt, Bordetella pertussis
gcgaccgccgcgg

SEQ ID NO: 414071 - RNA, 20 nt, Bordetella pertussis
gcgaccgcgaaccggugcug

SEQ ID NO: 414072 - RNA, 14 nt, Bordetella pertussis
gcgaccggcgccgg

SEQ ID NO: 414073 - RNA, 14 nt, Bordetella pertussis
gcgaccucggcggc

SEQ ID NO: 414074 - RNA, 21 nt, Bordetella pertussis
gcgaccucgggacggcccugc

SEQ ID NO: 414075 - RNA, 15 nt, Bordetella pertussis
gcgaccugcgcgacc

SEQ ID NO: 414076 - RNA, 14 nt, Bordetella pertussis
gcgaccugcgggcg

SEQ ID NO: 414077 - RNA, 15 nt, Bordetella pertussis
gcgacgaacccgggc

SEQ ID NO: 414078 - RNA, 16 nt, Bordetella pertussis
gcgacgaaucggucac

SEQ ID NO: 414079 - RNA, 15 nt, Bordetella pertussis
gcgacgaccccgccg

SEQ ID NO: 414080 - RNA, 18 nt, Bordetella pertussis
gcgacgaccccgccgugc

SEQ ID NO: 414081 - RNA, 20 nt, Bordetella pertussis
gcgacgaccccgccgugccg

SEQ ID NO: 414082 - RNA, 18 nt, Bordetella pertussis
gcgacgacagcggcgagc

SEQ ID NO: 414083 - RNA, 22 nt, Bordetella pertussis
gcgacgacuacgcgcuggcgca

SEQ ID NO: 414084 - RNA, 16 nt, Bordetella pertussis
gcgacgaucuccaccc

SEQ ID NO: 414085 - RNA, 17 nt, Bordetella pertussis
gcgacgaucuccacccc

SEQ ID NO: 414086 - RNA, 20 nt, Bordetella pertussis
gcgacgaucuccacccccgg

SEQ ID NO: 414087 - RNA, 12 nt, Bordetella pertussis
gcgacgaugccg

SEQ ID NO: 414088 - RNA, 22 nt, Bordetella pertussis
gcgacgcaacagacccgggccg

SEQ ID NO: 414089 - RNA, 22 nt, Bordetella pertussis
gcgacgcauauccaggcggcgc

SEQ ID NO: 414090 - RNA, 18 nt, Bordetella pertussis
gcgacgcaugucagcgcc

SEQ ID NO: 414091 - RNA, 21 nt, Bordetella pertussis
gcgacgcccagccugccggcg

SEQ ID NO: 414092 - RNA, 16 nt, Bordetella pertussis
gcgacgccgccgaugg

SEQ ID NO: 414093 - RNA, 15 nt, Bordetella pertussis
gcgacgccugcgcca

SEQ ID NO: 414094 - RNA, 20 nt, Bordetella pertussis
gcgacgccgcggugcugggc

SEQ ID NO: 414095 - RNA, 14 nt, Bordetella pertussis
gcgacgcgcgccgg

SEQ ID NO: 414096 - RNA, 16 nt, Bordetella pertussis
gcgacgcgcgccggcg

SEQ ID NO: 414097 - RNA, 17 nt, Bordetella pertussis
gcgacgcggcguacugg

SEQ ID NO: 414098 - RNA, 13 nt, Bordetella pertussis
gcgacgcuggcga

SEQ ID NO: 414099 - RNA, 23 nt, Bordetella pertussis
gcgacgcuggcgaugcccaccag

SEQ ID NO: 414100 - RNA, 22 nt, Bordetella pertussis
gcgacggucaggggcaggcgca

SEQ ID NO: 414101 - RNA, 18 nt, Bordetella pertussis
gcgacgucgggcagggcg

SEQ ID NO: 414102 - RNA, 17 nt, Bordetella pertussis
gcgacugccccagcggc

SEQ ID NO: 414103 - RNA, 14 nt, Bordetella pertussis
gcgacuggcggcug

SEQ ID NO: 414104 - RNA, 20 nt, Bordetella pertussis
gcgacuuccucgacccgcgc

SEQ ID NO: 414105 - RNA, 16 nt, Bordetella pertussis
gcgacuucggcggcca

SEQ ID NO: 414106 - RNA, 16 nt, Bordetella pertussis
gcgacuugucgcgccc

SEQ ID NO: 414107 - RNA, 15 nt, Bordetella pertussis
gcgagauggggcgga

SEQ ID NO: 414108 - RNA, 11 nt, Bordetella pertussis
gcgagcaggcc

SEQ ID NO: 414109 - RNA, 12 nt, Bordetella pertussis
gcgagcgccgcc

SEQ ID NO: 414110 - RNA, 13 nt, Bordetella pertussis
gcgagcgccucgc

SEQ ID NO: 414111 - RNA, 23 nt, Bordetella pertussis
gcgagcgcggcauagcccaggcc

SEQ ID NO: 414112 - RNA, 24 nt, Bordetella pertussis
gcgagcgcggcgcgcgccagggcg

SEQ ID NO: 414113 - RNA, 13 nt, Bordetella pertussis
gcgagcggccagc

SEQ ID NO: 414114 - RNA, 20 nt, Bordetella pertussis
gcgagcggcggccgcgucca

SEQ ID NO: 414115 - RNA, 20 nt, Bordetella pertussis
gcgagcggcgugcgcgugca

SEQ ID NO: 414116 - RNA, 16 nt, Bordetella pertussis
gcgagcgggccggucg

SEQ ID NO: 414117 - RNA, 19 nt, Bordetella pertussis
gcgaggaggugcgccgcuc

SEQ ID NO: 414118 - RNA, 15 nt, Bordetella pertussis
gcgaggaugccgcgc

SEQ ID NO: 414119 - RNA, 23 nt, Bordetella pertussis
gcgaggccgcuucgugcggccgc

SEQ ID NO: 414120 - RNA, 12 nt, Bordetella pertussis
gcgaggcggccu

SEQ ID NO: 414121 - RNA, 13 nt, Bordetella pertussis
gcgaggcggccuu

SEQ ID NO: 414122 - RNA, 15 nt, Bordetella pertussis
gcgaggcggccuuga

SEQ ID NO: 414123 - RNA, 12 nt, Bordetella pertussis
gcgaggcggcga

SEQ ID NO: 414124 - RNA, 12 nt, Bordetella pertussis
gcgaggcggcgg

SEQ ID NO: 414125 - RNA, 13 nt, Bordetella pertussis
gcgaggcggggcu

SEQ ID NO: 414126 - RNA, 18 nt, Bordetella pertussis
gcgaggcggggcuggcgc

SEQ ID NO: 414127 - RNA, 15 nt, Bordetella pertussis
gcgaggcuggcgccc

SEQ ID NO: 414128 - RNA, 22 nt, Bordetella pertussis
gcgaggcuuuuuuucgccgggc

SEQ ID NO: 414129 - RNA, 13 nt, Bordetella pertussis
gcgagggucaggc

SEQ ID NO: 414130 - RNA, 18 nt, Bordetella pertussis
gcgagguagggcgcggcc

SEQ ID NO: 414131 - RNA, 19 nt, Bordetella pertussis
gcgagguagggcgcggcca

SEQ ID NO: 414132 - RNA, 15 nt, Bordetella pertussis
gcgaggugccggacg

SEQ ID NO: 414133 - RNA, 14 nt, Bordetella pertussis
gcgagguggcgcuc

SEQ ID NO: 414134 - RNA, 18 nt, Bordetella pertussis
gcgagguggcgcucgcgc

SEQ ID NO: 414135 - RNA, 18 nt, Bordetella pertussis
gcgagguugcaggccagg

SEQ ID NO: 414136 - RNA, 22 nt, Bordetella pertussis
gcgaguagacgcagccgcagua

SEQ ID NO: 414137 - RNA, 19 nt, Bordetella pertussis
gcgaguauucacgccgcga

SEQ ID NO: 414138 - RNA, 13 nt, Bordetella pertussis
gcgagugcgcccc

SEQ ID NO: 414139 - RNA, 15 nt, Bordetella pertussis
gcgauagcgccgcgc

SEQ ID NO: 414140 - RNA, 22 nt, Bordetella pertussis
gcgaucaggcggugccccggcc

SEQ ID NO: 414141 - RNA, 13 nt, Bordetella pertussis
gcgauccagcagc

SEQ ID NO: 414142 - RNA, 14 nt, Bordetella pertussis
gcgauccagcagcg

SEQ ID NO: 414143 - RNA, 19 nt, Bordetella pertussis
gcgauccagcagcguggcc

SEQ ID NO: 414144 - RNA, 21 nt, Bordetella pertussis
gcgauccagcagcguggccac

SEQ ID NO: 414145 - RNA, 14 nt, Bordetella pertussis
gcgauccaggccac

SEQ ID NO: 414146 - RNA, 20 nt, Bordetella pertussis
gcgauccagggccgccagca

SEQ ID NO: 414147 - RNA, 17 nt, Bordetella pertussis
gcgauccgcgccaggcg

SEQ ID NO: 414148 - RNA, 23 nt, Bordetella pertussis
gcgaucgaauggucggccucggc

SEQ ID NO: 414149 - RNA, 13 nt, Bordetella pertussis
gcgaucgccagca

SEQ ID NO: 414150 - RNA, 21 nt, Bordetella pertussis
gcgaucgccuguaucugcgcc

SEQ ID NO: 414151 - RNA, 16 nt, Bordetella pertussis
gcgcgaaccccuccgg

SEQ ID NO: 414152 - RNA, 15 nt, Bordetella pertussis
gcgcgaacgccugcc

SEQ ID NO: 414153 - RNA, 16 nt, Bordetella pertussis
gcgcgaacgcgcgccg

SEQ ID NO: 414154 - RNA, 14 nt, Bordetella pertussis
gcgcgaacgcggcc

SEQ ID NO: 414155 - RNA, 14 nt, Bordetella pertussis
gcgcgaaggccgcc

SEQ ID NO: 414156 - RNA, 22 nt, Bordetella pertussis
gcgcgaaugcguguuccagcgc

SEQ ID NO: 414157 - RNA, 23 nt, Bordetella pertussis
gcgcgaaugcguguuccagcgcc

SEQ ID NO: 414158 - RNA, 20 nt, Bordetella pertussis
gcgcgacaggcccgcggccg

SEQ ID NO: 414159 - RNA, 13 nt, Bordetella pertussis
gcgcgagcagggc

SEQ ID NO: 414160 - RNA, 22 nt, Bordetella pertussis
gcgcgagccgcccacgggcgcc

SEQ ID NO: 414161 - RNA, 14 nt, Bordetella pertussis
gcgcgagcgcgugg

SEQ ID NO: 414162 - RNA, 14 nt, Bordetella pertussis
gcgcgagcggcgug

SEQ ID NO: 414163 - RNA, 21 nt, Bordetella pertussis
gcgcgagcggcgugcgcgugc

SEQ ID NO: 414164 - RNA, 13 nt, Bordetella pertussis
gcgcgaggcggcg

SEQ ID NO: 414165 - RNA, 14 nt, Bordetella pertussis
gcgcgaggcggcgg

SEQ ID NO: 414166 - RNA, 16 nt, Bordetella pertussis
gcgcgagcgcacaggc

SEQ ID NO: 414167 - RNA, 16 nt, Bordetella pertussis
gcgcgaggugggcggc

SEQ ID NO: 414168 - RNA, 13 nt, Bordetella pertussis
gcgcgauccgcgc

SEQ ID NO: 414169 - RNA, 18 nt, Bordetella pertussis
gcgcgauccgcgccaggc

SEQ ID NO: 414170 - RNA, 17 nt, Bordetella pertussis
gcgcgaucgccagcagg

SEQ ID NO: 414171 - RNA, 18 nt, Bordetella pertussis
gcgcgaucgccagcaggc

SEQ ID NO: 414172 - RNA, 19 nt, Bordetella pertussis
gcgcgaucgccagcaggcg

SEQ ID NO: 414173 - RNA, 17 nt, Bordetella pertussis
gcgcgcaaugcgcggcg

SEQ ID NO: 414174 - RNA, 19 nt, Bordetella pertussis
gcgcgcaaugcgcggcgcu

SEQ ID NO: 414175 - RNA, 18 nt, Bordetella pertussis
gcgcgcacaaacgcacga

SEQ ID NO: 414176 - RNA, 16 nt, Bordetella pertussis
gcgcgcacaagcgcga

SEQ ID NO: 414177 - RNA, 13 nt, Bordetella pertussis
gcgcgcaccagcc

SEQ ID NO: 414178 - RNA, 15 nt, Bordetella pertussis
gcgcgcacgggcgag

SEQ ID NO: 414179 - RNA, 16 nt, Bordetella pertussis
gcgcgcagacgcgcuc

SEQ ID NO: 414180 - RNA, 20 nt, Bordetella pertussis
gcgcgcagacgcgcucaggc

SEQ ID NO: 414181 - RNA, 16 nt, Bordetella pertussis
gcgcgcagcacgccga

SEQ ID NO: 414182 - RNA, 12 nt, Bordetella pertussis
gcgcgcagcaga

SEQ ID NO: 414183 - RNA, 14 nt, Bordetella pertussis
gcgcgcagcgccug

SEQ ID NO: 414184 - RNA, 13 nt, Bordetella pertussis
gcgcgcagcuccc

SEQ ID NO: 414185 - RNA, 22 nt, Bordetella pertussis
gcgcgcaggcaguuggcggcgc

SEQ ID NO: 414186 - RNA, 15 nt, Bordetella pertussis
gcgcgcaggccucgc

SEQ ID NO: 414187 - RNA, 17 nt, Bordetella pertussis
gcgcgcaggcgggccuc

SEQ ID NO: 414188 - RNA, 14 nt, Bordetella pertussis
gcgcgccaggcgau

SEQ ID NO: 414189 - RNA, 19 nt, Bordetella pertussis
gcgcgccaguugcgcaccg

SEQ ID NO: 414190 - RNA, 16 nt, Bordetella pertussis
gcgcgccauggccggc

SEQ ID NO: 414191 - RNA, 17 nt, Bordetella pertussis
gcgcgcccaccagggug

SEQ ID NO: 414192 - RNA, 14 nt, Bordetella pertussis
gcgcgccaugguga

SEQ ID NO: 414193 - RNA, 20 nt, Bordetella pertussis
gcgcgcccagccccgcggcc

SEQ ID NO: 414194 - RNA, 17 nt, Bordetella pertussis
gcgcgcccagcgcgccg

SEQ ID NO: 414195 - RNA, 13 nt, Bordetella pertussis
gcgcgcccccacg

SEQ ID NO: 414196 - RNA, 16 nt, Bordetella pertussis
gcgcgcccgcaggcgg

SEQ ID NO: 414197 - RNA, 15 nt, Bordetella pertussis
gcgcgcccggcgcgc

SEQ ID NO: 414198 - RNA, 17 nt, Bordetella pertussis
gcgcgcccggcgcgccu

SEQ ID NO: 414199 - RNA, 20 nt, Bordetella pertussis
gcgcgccgaccaggucgggc

SEQ ID NO: 414200 - RNA, 13 nt, Bordetella pertussis
gcgcgccgggccg

SEQ ID NO: 414201 - RNA, 15 nt, Bordetella pertussis
gcgcgccgggccggc

SEQ ID NO: 414202 - RNA, 16 nt, Bordetella pertussis
gcgcgccgggccuagc

SEQ ID NO: 414203 - RNA, 19 nt, Bordetella pertussis
gcgcgccgggcgggucggc

SEQ ID NO: 414204 - RNA, 14 nt, Bordetella pertussis
gcgcgccgaagcgc

SEQ ID NO: 414205 - RNA, 19 nt, Bordetella pertussis
gcgcgccgaagcgcaggcc

SEQ ID NO: 414206 - RNA, 14 nt, Bordetella pertussis
gcgcgccgggggcg

SEQ ID NO: 414207 - RNA, 18 nt, Bordetella pertussis
gcgcgccguacagccgcg

SEQ ID NO: 414208 - RNA, 21 nt, Bordetella pertussis
gcgcgccguacagccgcggca

SEQ ID NO: 414209 - RNA, 16 nt, Bordetella pertussis
gcgcgccguccgggcc

SEQ ID NO: 414210 - RNA, 17 nt, Bordetella pertussis
gcgcgccgucgggggcc

SEQ ID NO: 414211 - RNA, 20 nt, Bordetella pertussis
gcgcgccgucgggggccggc

SEQ ID NO: 414212 - RNA, 21 nt, Bordetella pertussis
gcgcgccguucagggacgggc

SEQ ID NO: 414213 - RNA, 16 nt, Bordetella pertussis
gcgcgccuccagcucc

SEQ ID NO: 414214 - RNA, 16 nt, Bordetella pertussis
gcgcgccucggcgcgc

SEQ ID NO: 414215 - RNA, 22 nt, Bordetella pertussis
gcgcgccucggcgcgcgcggcg

SEQ ID NO: 414216 - RNA, 13 nt, Bordetella pertussis
gcgcgccugcagc

SEQ ID NO: 414217 - RNA, 15 nt, Bordetella pertussis
gcgcgccugcccagg

SEQ ID NO: 414218 - RNA, 23 nt, Bordetella pertussis
gcgcgccugccccgccugcgcca

SEQ ID NO: 414219 - RNA, 12 nt, Bordetella pertussis
gcgcgccugccg

SEQ ID NO: 414220 - RNA, 16 nt, Bordetella pertussis
gcgcgccugcgcgccg

SEQ ID NO: 414221 - RNA, 14 nt, Bordetella pertussis
gcgcgccuggcgcg

SEQ ID NO: 414222 - RNA, 17 nt, Bordetella pertussis
gcgcgccuggcgcgccc

SEQ ID NO: 414223 - RNA, 21 nt, Bordetella pertussis
gcgcgccugcucgaccugcuc

SEQ ID NO: 414224 - RNA, 19 nt, Bordetella pertussis
gcgcgccuucggcaggcgc

SEQ ID NO: 414225 - RNA, 16 nt, Bordetella pertussis
gcgcgcggccaguucg

SEQ ID NO: 414226 - RNA, 16 nt, Bordetella pertussis
gcgcgcggccggccgc

SEQ ID NO: 414227 - RNA, 19 nt, Bordetella pertussis
gcgcgcggccggcgcgccg

SEQ ID NO: 414228 - RNA, 16 nt, Bordetella pertussis
gcgcgcggccugggcg

SEQ ID NO: 414229 - RNA, 14 nt, Bordetella pertussis
gcgcgcggcgcagc

SEQ ID NO: 414230 - RNA, 14 nt, Bordetella pertussis
gcgcgcggcgcggc

SEQ ID NO: 414231 - RNA, 14 nt, Bordetella pertussis
gcgcgcggcugggu

SEQ ID NO: 414232 - RNA, 17 nt, Bordetella pertussis
gcgcgcgggccagcaga

SEQ ID NO: 414233 - RNA, 13 nt, Bordetella pertussis
gcgcgcgggcccu

SEQ ID NO: 414234 - RNA, 14 nt, Bordetella pertussis
gcgcgcgggcgcgc

SEQ ID NO: 414235 - RNA, 15 nt, Bordetella pertussis
gcgcgcgggcgcgcc

SEQ ID NO: 414236 - RNA, 16 nt, Bordetella pertussis
gcgcgcgguccauggu

SEQ ID NO: 414237 - RNA, 21 nt, Bordetella pertussis
gcgcgcgguccauggugaugc

SEQ ID NO: 414238 - RNA, 15 nt, Bordetella pertussis
gcgcgcggucggugc

SEQ ID NO: 414239 - RNA, 23 nt, Bordetella pertussis
gcgcgcgguguucgagccggacg

SEQ ID NO: 414240 - RNA, 18 nt, Bordetella pertussis
gcgcgcgguugagcgcca

SEQ ID NO: 414241 - RNA, 14 nt, Bordetella pertussis
gcgcgcguacagcc

SEQ ID NO: 414242 - RNA, 17 nt, Bordetella pertussis
gcgcgcguacagccggg

SEQ ID NO: 414243 - RNA, 13 nt, Bordetella pertussis
gcgcgcgugcagg

SEQ ID NO: 414244 - RNA, 23 nt, Bordetella pertussis
gcgcgcguucaggucgccguucu

SEQ ID NO: 414245 - RNA, 12 nt, Bordetella pertussis
gcgcgcuccagc

SEQ ID NO: 414246 - RNA, 15 nt, Bordetella pertussis
gcgcgcucggcgccg

SEQ ID NO: 414247 - RNA, 22 nt, Bordetella pertussis
gcgcggaucgaaaccggcgcgc

SEQ ID NO: 414248 - RNA, 16 nt, Bordetella pertussis
gcgcggaugugggggu

SEQ ID NO: 414249 - RNA, 19 nt, Bordetella pertussis
gcgcggaugaucgcgcagc

SEQ ID NO: 414250 - RNA, 23 nt, Bordetella pertussis
gcgcggauuucgcgaugcucgau

SEQ ID NO: 414251 - RNA, 13 nt, Bordetella pertussis
gcgcggccacggc

SEQ ID NO: 414252 - RNA, 18 nt, Bordetella pertussis
gcgcggccacggccugcc

SEQ ID NO: 414253 - RNA, 13 nt, Bordetella pertussis
gcgcggccagcac

SEQ ID NO: 414254 - RNA, 21 nt, Bordetella pertussis
gcgcggccagcaccggcccga

SEQ ID NO: 414255 - RNA, 14 nt, Bordetella pertussis
gcgcggccagcagc

SEQ ID NO: 414256 - RNA, 13 nt, Bordetella pertussis
gcgcggccagcgc

SEQ ID NO: 414257 - RNA, 20 nt, Bordetella pertussis
gcgcggccaggucggcgucg

SEQ ID NO: 414258 - RNA, 13 nt, Bordetella pertussis
gcgcggccaugcc

SEQ ID NO: 414259 - RNA, 12 nt, Bordetella pertussis
gcgcggcccgcc

SEQ ID NO: 414260 - RNA, 13 nt, Bordetella pertussis
gcgcggcccggcg

SEQ ID NO: 414261 - RNA, 16 nt, Bordetella pertussis
gcgcggccgagcgggc

SEQ ID NO: 414262 - RNA, 21 nt, Bordetella pertussis
gcgcggccgccggcggcgccg

SEQ ID NO: 414263 - RNA, 19 nt, Bordetella pertussis
gcgcggccggaggccgccc

SEQ ID NO: 414264 - RNA, 15 nt, Bordetella pertussis
gcgcggccggccgcg

SEQ ID NO: 414265 - RNA, 13 nt, Bordetella pertussis
gcgcggccgggcu

SEQ ID NO: 414266 - RNA, 12 nt, Bordetella pertussis
gcgcggccgggg

SEQ ID NO: 414267 - RNA, 14 nt, Bordetella pertussis
gcgcggccgggucg

SEQ ID NO: 414268 - RNA, 14 nt, Bordetella pertussis
gcgcggcggcagcg

SEQ ID NO: 414269 - RNA, 17 nt, Bordetella pertussis
gcgcggcgggcgcuggc

SEQ ID NO: 414270 - RNA, 20 nt, Bordetella pertussis
gcgcggcgggcggcgcggcc

SEQ ID NO: 414271 - RNA, 22 nt, Bordetella pertussis
gcgcggcgggcucagcccgccu

SEQ ID NO: 414272 - RNA, 17 nt, Bordetella pertussis
gcgcggcggugccgccc

SEQ ID NO: 414273 - RNA, 16 nt, Bordetella pertussis
gcgcggcgguggcggu

SEQ ID NO: 414274 - RNA, 13 nt, Bordetella pertussis
gcgcggcggcgug

SEQ ID NO: 414275 - RNA, 16 nt, Bordetella pertussis
gcgcggcggcuugccg

SEQ ID NO: 414276 - RNA, 20 nt, Bordetella pertussis
gcgcggcgucgaaggccgcc

SEQ ID NO: 414277 - RNA, 14 nt, Bordetella pertussis
gcgcggcucgccgg

SEQ ID NO: 414278 - RNA, 16 nt, Bordetella pertussis
gcgcggcucgccggcc

SEQ ID NO: 414279 - RNA, 15 nt, Bordetella pertussis
gcgcggcugcugggc

SEQ ID NO: 414280 - RNA, 18 nt, Bordetella pertussis
gcgcggcugcugggcaug

SEQ ID NO: 414281 - RNA, 15 nt, Bordetella pertussis
gcgcggcuggggcug

SEQ ID NO: 414282 - RNA, 16 nt, Bordetella pertussis
gcgcggcugggucggc

SEQ ID NO: 414283 - RNA, 22 nt, Bordetella pertussis
gcgcggcuugcagcggacggcg

SEQ ID NO: 414284 - RNA, 23 nt, Bordetella pertussis
gcgcggcuuuuucucggccucgc

SEQ ID NO: 414285 - RNA, 19 nt, Bordetella pertussis
gcgcgggccacugcgccug

SEQ ID NO: 414286 - RNA, 15 nt, Bordetella pertussis
gcgcgggccagcaga

SEQ ID NO: 414287 - RNA, 15 nt, Bordetella pertussis
gcgcgggcgcgcagc

SEQ ID NO: 414288 - RNA, 16 nt, Bordetella pertussis
gcgcgggcgcgcagcg

SEQ ID NO: 414289 - RNA, 14 nt, Bordetella pertussis
gcgcgggcgcgccg

SEQ ID NO: 414290 - RNA, 18 nt, Bordetella pertussis
gcgcgggcgcggcaggcg

SEQ ID NO: 414291 - RNA, 13 nt, Bordetella pertussis
gcgcgggcggccc

SEQ ID NO: 414292 - RNA, 15 nt, Bordetella pertussis
gcgcgggcggcccgc

SEQ ID NO: 414293 - RNA, 13 nt, Bordetella pertussis
gcgcgggcggcua

SEQ ID NO: 414294 - RNA, 21 nt, Bordetella pertussis
gcgcgggcggcuaggcgcagc

SEQ ID NO: 414295 - RNA, 21 nt, Bordetella pertussis
gcgcgggcggucggcgcggcg

SEQ ID NO: 414296 - RNA, 12 nt, Bordetella pertussis
gcgcggggcacc

SEQ ID NO: 414297 - RNA, 15 nt, Bordetella pertussis
gcgcggggccaggcg

SEQ ID NO: 414298 - RNA, 14 nt, Bordetella pertussis
gcgcgggggugcgc

SEQ ID NO: 414299 - RNA, 16 nt, Bordetella pertussis
gcgcggguccaggccc

SEQ ID NO: 414300 - RNA, 22 nt, Bordetella pertussis
gcgcggguccuugccgggcucg

SEQ ID NO: 414301 - RNA, 22 nt, Bordetella pertussis
gcgcggguaggcaaagcgcagc

SEQ ID NO: 414302 - RNA, 18 nt, Bordetella pertussis
gcgcgggucuugagcggc

SEQ ID NO: 414303 - RNA, 23 nt, Bordetella pertussis
gcgcggguggccggaucgagcgc

SEQ ID NO: 414304 - RNA, 22 nt, Bordetella pertussis
gcgcgguacgcaccgccgccgg

SEQ ID NO: 414305 - RNA, 15 nt, Bordetella pertussis
gcgcgguagcgcccc

SEQ ID NO: 414306 - RNA, 15 nt, Bordetella pertussis
gcgcgguauccaggu

SEQ ID NO: 414307 - RNA, 17 nt, Bordetella pertussis
gcgcgguauggccgccc

SEQ ID NO: 414308 - RNA, 17 nt, Bordetella pertussis
gcgcgguauucgcugcu

SEQ ID NO: 414309 - RNA, 19 nt, Bordetella pertussis
gcgcgguccacgcccuggc

SEQ ID NO: 414310 - RNA, 15 nt, Bordetella pertussis
gcgcggugccgccug

SEQ ID NO: 414311 - RNA, 14 nt, Bordetella pertussis
gcgcgguggccagc

SEQ ID NO: 414312 - RNA, 20 nt, Bordetella pertussis
gcgcgguggccaugcugggc

SEQ ID NO: 414313 - RNA, 15 nt, Bordetella pertussis
gcgcgguggccgccg

SEQ ID NO: 414314 - RNA, 14 nt, Bordetella pertussis
gcgcgguggccgcu

SEQ ID NO: 414315 - RNA, 15 nt, Bordetella pertussis
gcgcgguggccgcuu

SEQ ID NO: 414316 - RNA, 23 nt, Bordetella pertussis
gcgcgguggccgcuucggcggcc

SEQ ID NO: 414317 - RNA, 16 nt, Bordetella pertussis
gcgcggugucgccgcc

SEQ ID NO: 414318 - RNA, 18 nt, Bordetella pertussis
gcgcgguugagcgccagg

SEQ ID NO: 414319 - RNA, 17 nt, Bordetella pertussis
gcgcguacagccgggug

SEQ ID NO: 414320 - RNA, 19 nt, Bordetella pertussis
gcgcguaggcgcgcgcauc

SEQ ID NO: 414321 - RNA, 15 nt, Bordetella pertussis
gcgcguaucggcgcg

SEQ ID NO: 414322 - RNA, 15 nt, Bordetella pertussis
gcgcguauggcggcg

SEQ ID NO: 414323 - RNA, 16 nt, Bordetella pertussis
gcgcguauggcggcgc

SEQ ID NO: 414324 - RNA, 16 nt, Bordetella pertussis
gcgcgucaggccgggc

SEQ ID NO: 414325 - RNA, 17 nt, Bordetella pertussis
gcgcgucaggccgggca

SEQ ID NO: 414326 - RNA, 19 nt, Bordetella pertussis
gcgcguccaggcgguccug

SEQ ID NO: 414327 - RNA, 19 nt, Bordetella pertussis
gcgcguccaggugcggcgg

SEQ ID NO: 414328 - RNA, 14 nt, Bordetella pertussis
gcgcguccugcgcc

SEQ ID NO: 414329 - RNA, 19 nt, Bordetella pertussis
gcgcguccugggccgagcg

SEQ ID NO: 414330 - RNA, 18 nt, Bordetella pertussis
gcgcguccuuggcggccu

SEQ ID NO: 414331 - RNA, 15 nt, Bordetella pertussis
gcgcgucgacagcau

SEQ ID NO: 414332 - RNA, 15 nt, Bordetella pertussis
gcgcgucgcgcggcg

SEQ ID NO: 414333 - RNA, 21 nt, Bordetella pertussis
gcgcgucgcguagcgcggccg

SEQ ID NO: 414334 - RNA, 14 nt, Bordetella pertussis
gcgcgucggcgccg

SEQ ID NO: 414335 - RNA, 16 nt, Bordetella pertussis
gcgcgucggcgcgcgc

SEQ ID NO: 414336 - RNA, 20 nt, Bordetella pertussis
gcgcgucggcgcgcgcgacu

SEQ ID NO: 414337 - RNA, 21 nt, Bordetella pertussis
gcgcgucggcgcgcgcgacuc

SEQ ID NO: 414338 - RNA, 19 nt, Bordetella pertussis
gcgcgucguacuggugggc

SEQ ID NO: 414339 - RNA, 16 nt, Bordetella pertussis
gcgcgucgugcccgcc

SEQ ID NO: 414340 - RNA, 17 nt, Bordetella pertussis
gcgcgucuggaggacga

SEQ ID NO: 414341 - RNA, 22 nt, Bordetella pertussis
gcgcgugcagcgccgcgcgcuc

SEQ ID NO: 414342 - RNA, 13 nt, Bordetella pertussis
gcgcgugcagggu

SEQ ID NO: 414343 - RNA, 20 nt, Bordetella pertussis
gcgcgugcagggucagggug

SEQ ID NO: 414344 - RNA, 14 nt, Bordetella pertussis
gcgcgugccgcgca

SEQ ID NO: 414345 - RNA, 14 nt, Bordetella pertussis
gcgcgugcggggcg

SEQ ID NO: 414346 - RNA, 14 nt, Bordetella pertussis
gcgcguggccagca

SEQ ID NO: 414347 - RNA, 19 nt, Bordetella pertussis
gcgcguggccggcgacggc

SEQ ID NO: 414348 - RNA, 14 nt, Bordetella pertussis
gcgcguggccgggg

SEQ ID NO: 414349 - RNA, 20 nt, Bordetella pertussis
gcgcgugggcaggugcuugg

SEQ ID NO: 414350 - RNA, 22 nt, Bordetella pertussis
gcgcgugucccagccggcggca

SEQ ID NO: 414351 - RNA, 21 nt, Bordetella pertussis
gcgcgugugguuggcgcugcu

SEQ ID NO: 414352 - RNA, 15 nt, Bordetella pertussis
gcgcguucagcagca

SEQ ID NO: 414353 - RNA, 22 nt, Bordetella pertussis
gcgcguucagggcgccgcggcg

SEQ ID NO: 414354 - RNA, 17 nt, Bordetella pertussis
gcgcguucaggucgccg

SEQ ID NO: 414355 - RNA, 22 nt, Bordetella pertussis
gcgcguucucagccgcccgccg

SEQ ID NO: 414356 - RNA, 16 nt, Bordetella pertussis
gcgcguugccggugcg

SEQ ID NO: 414357 - RNA, 20 nt, Bordetella pertussis
gcgcguugcgcaucgcgcac

SEQ ID NO: 414358 - RNA, 22 nt, Bordetella pertussis
gcgcuacagggugccgcgccgg

SEQ ID NO: 414359 - RNA, 23 nt, Bordetella pertussis
gcgcuacgacgagaucgcgccua

SEQ ID NO: 414360 - RNA, 21 nt, Bordetella pertussis
gcgcuaugggggcgagcgggc

SEQ ID NO: 414361 - RNA, 23 nt, Bordetella pertussis
gcgcucagcaccaggccgccggc

SEQ ID NO: 414362 - RNA, 18 nt, Bordetella pertussis
gcgcucaggccgccggcg

SEQ ID NO: 414363 - RNA, 21 nt, Bordetella pertussis
gcgcucaggccgccggcgcgg

SEQ ID NO: 414364 - RNA, 21 nt, Bordetella pertussis
gcgcucagggggcgccccaac

SEQ ID NO: 414365 - RNA, 20 nt, Bordetella pertussis
gcgcucauggcgcaugacga

SEQ ID NO: 414366 - RNA, 19 nt, Bordetella pertussis
gcgcucauguucgggcgcg

SEQ ID NO: 414367 - RNA, 11 nt, Bordetella pertussis
gcgcuccagca

SEQ ID NO: 414368 - RNA, 13 nt, Bordetella pertussis
gcgcuccagcccu

SEQ ID NO: 414369 - RNA, 16 nt, Bordetella pertussis
gcgcuccaugcggcgg

SEQ ID NO: 414370 - RNA, 17 nt, Bordetella pertussis
gcgcuccaugcggcggc

SEQ ID NO: 414371 - RNA, 18 nt, Bordetella pertussis
gcgcuccauggcgccggc

SEQ ID NO: 414372 - RNA, 14 nt, Bordetella pertussis
gcgcucccgccaac

SEQ ID NO: 414373 - RNA, 19 nt, Bordetella pertussis
gcgcugaccugcacgaugg

SEQ ID NO: 414374 - RNA, 18 nt, Bordetella pertussis
gcgcuuccucgaccaggu

SEQ ID NO: 414375 - RNA, 21 nt, Bordetella pertussis
gcgcuuccucgaccaggucca

SEQ ID NO: 414376 - RNA, 23 nt, Bordetella pertussis
gcgcuucgugcagcgcgugggcc

SEQ ID NO: 414377 - RNA, 15 nt, Bordetella pertussis
gcgcuugccgcccac

SEQ ID NO: 414378 - RNA, 14 nt, Bordetella pertussis
gcgcuuggcaggcg

SEQ ID NO: 414379 - RNA, 13 nt, Bordetella pertussis
gcgcuuggcccug

SEQ ID NO: 414380 - RNA, 14 nt, Bordetella pertussis
gcgcuuggcccugc

SEQ ID NO: 414381 - RNA, 18 nt, Bordetella pertussis
gcggacuggccgcgccgc

SEQ ID NO: 414382 - RNA, 22 nt, Bordetella pertussis
gcggacuucgcuuucgguggcg

SEQ ID NO: 414383 - RNA, 13 nt, Bordetella pertussis
gcggaggcggccg

SEQ ID NO: 414384 - RNA, 14 nt, Bordetella pertussis
gcggaggcggccgc

SEQ ID NO: 414385 - RNA, 22 nt, Bordetella pertussis
gcggaggcggccgcgggcggcg

SEQ ID NO: 414386 - RNA, 21 nt, Bordetella pertussis
gcggaggugucgccgcccaug

SEQ ID NO: 414387 - RNA, 20 nt, Bordetella pertussis
gcggagucgccccgacgcgc

SEQ ID NO: 414388 - RNA, 19 nt, Bordetella pertussis
gcggaucaagcggcccgcg

SEQ ID NO: 414389 - RNA, 21 nt, Bordetella pertussis
gcggaucuucccgccauggga

SEQ ID NO: 414390 - RNA, 19 nt, Bordetella pertussis
gcggaugaacgaccagcac

SEQ ID NO: 414391 - RNA, 20 nt, Bordetella pertussis
gcggaugaacgaccagcacg

SEQ ID NO: 414392 - RNA, 21 nt, Bordetella pertussis
gcggaugaugcggcgccacgc

SEQ ID NO: 414393 - RNA, 14 nt, Bordetella pertussis
gcggaugcagcagc

SEQ ID NO: 414394 - RNA, 22 nt, Bordetella pertussis
gcggaugcgguacugcggcgcc

SEQ ID NO: 414395 - RNA, 23 nt, Bordetella pertussis
gcggaugguaguacucgcugcgc

SEQ ID NO: 414396 - RNA, 15 nt, Bordetella pertussis
gcggauggucgagcg

SEQ ID NO: 414397 - RNA, 17 nt, Bordetella pertussis
gcggauggucgagcgcc

SEQ ID NO: 414398 - RNA, 13 nt, Bordetella pertussis
gcggauggugcuc

SEQ ID NO: 414399 - RNA, 15 nt, Bordetella pertussis
gcggauucaggcgau

SEQ ID NO: 414400 - RNA, 15 nt, Bordetella pertussis
gcggcaagcagccgg

SEQ ID NO: 414401 - RNA, 16 nt, Bordetella pertussis
gcggcaagccgcggcg

SEQ ID NO: 414402 - RNA, 16 nt, Bordetella pertussis
gcggcaaugcgcgcgc

SEQ ID NO: 414403 - RNA, 19 nt, Bordetella pertussis
gcggcacaaccuggcgcgc

SEQ ID NO: 414404 - RNA, 15 nt, Bordetella pertussis
gcggcaccagcaggc

SEQ ID NO: 414405 - RNA, 20 nt, Bordetella pertussis
gcggcacugaugcuggucag

SEQ ID NO: 414406 - RNA, 22 nt, Bordetella pertussis
gcggcagaucuccggauccagc

SEQ ID NO: 414407 - RNA, 18 nt, Bordetella pertussis
gcggcagcagcagcgcgg

SEQ ID NO: 414408 - RNA, 12 nt, Bordetella pertussis
gcggcagcagcg

SEQ ID NO: 414409 - RNA, 15 nt, Bordetella pertussis
gcggcagcagcgaga

SEQ ID NO: 414410 - RNA, 11 nt, Bordetella pertussis
gcggcagcagg

SEQ ID NO: 414411 - RNA, 14 nt, Bordetella pertussis
gcggcagcagggcc

SEQ ID NO: 414412 - RNA, 15 nt, Bordetella pertussis
gcggcagcauggcgc

SEQ ID NO: 414413 - RNA, 21 nt, Bordetella pertussis
gcggcagcauggcgcgcgggc

SEQ ID NO: 414414 - RNA, 15 nt, Bordetella pertussis
gcggcagcgccgggu

SEQ ID NO: 414415 - RNA, 12 nt, Bordetella pertussis
gcggcagcgcga

SEQ ID NO: 414416 - RNA, 16 nt, Bordetella pertussis
gcggcagcgcgcagga

SEQ ID NO: 414417 - RNA, 16 nt, Bordetella pertussis
gcggcagccggccaug

SEQ ID NO: 414418 - RNA, 21 nt, Bordetella pertussis
gcggcaggggcucgcgcccga

SEQ ID NO: 414419 - RNA, 18 nt, Bordetella pertussis
gcggcagggugugccugu

SEQ ID NO: 414420 - RNA, 14 nt, Bordetella pertussis
gcggcaggucgggu

SEQ ID NO: 414421 - RNA, 13 nt, Bordetella pertussis
gcggcaggucggu

SEQ ID NO: 414422 - RNA, 23 nt, Bordetella pertussis
gcggcaggugcgucacgcacagc

SEQ ID NO: 414423 - RNA, 14 nt, Bordetella pertussis
gcggccagccggcg

SEQ ID NO: 414424 - RNA, 13 nt, Bordetella pertussis
gcggccagccggg

SEQ ID NO: 414425 - RNA, 22 nt, Bordetella pertussis
gcggccagccggguggucgcgc

SEQ ID NO: 414426 - RNA, 18 nt, Bordetella pertussis
gcggccagccugccgcgg

SEQ ID NO: 414427 - RNA, 20 nt, Bordetella pertussis
gcggccagccugccgcggcc

SEQ ID NO: 414428 - RNA, 19 nt, Bordetella pertussis
gcggccagcgccgcgccgg

SEQ ID NO: 414429 - RNA, 14 nt, Bordetella pertussis
gcggccagcgccgg

SEQ ID NO: 414430 - RNA, 14 nt, Bordetella pertussis
gcggccagcgcgcc

SEQ ID NO: 414431 - RNA, 15 nt, Bordetella pertussis
gcggccagcgcgccg

SEQ ID NO: 414432 - RNA, 13 nt, Bordetella pertussis
gcggccagcgcgg

SEQ ID NO: 414433 - RNA, 16 nt, Bordetella pertussis
gcggccagcgcggcgg

SEQ ID NO: 414434 - RNA, 19 nt, Bordetella pertussis
gcggccagcucggcggccg

SEQ ID NO: 414435 - RNA, 21 nt, Bordetella pertussis
gcggccagcucggcggccgcc

SEQ ID NO: 414436 - RNA, 18 nt, Bordetella pertussis
gcggccaggaucgcggcc

SEQ ID NO: 414437 - RNA, 17 nt, Bordetella pertussis
gcggccaggcccaugcc

SEQ ID NO: 414438 - RNA, 20 nt, Bordetella pertussis
gcggccaggcccaugccgcc

SEQ ID NO: 414439 - RNA, 14 nt, Bordetella pertussis
gcggccaggccggc

SEQ ID NO: 414440 - RNA, 16 nt, Bordetella pertussis
gcggccaggccggggc

SEQ ID NO: 414441 - RNA, 18 nt, Bordetella pertussis
gcggccaggccggugggc

SEQ ID NO: 414442 - RNA, 11 nt, Bordetella pertussis
gcggccaggcg

SEQ ID NO: 414443 - RNA, 14 nt, Bordetella pertussis
gcggccaggcgcgc

SEQ ID NO: 414444 - RNA, 21 nt, Bordetella pertussis
gcggccaggcucugggcggag

SEQ ID NO: 414445 - RNA, 18 nt, Bordetella pertussis
gcggccagggucaggggc

SEQ ID NO: 414446 - RNA, 22 nt, Bordetella pertussis
gcggccagggucaggggcaggu

SEQ ID NO: 414447 - RNA, 19 nt, Bordetella pertussis
gcggccagggugccccgcc

SEQ ID NO: 414448 - RNA, 20 nt, Bordetella pertussis
gcggccagggugccccgccg

SEQ ID NO: 414449 - RNA, 15 nt, Bordetella pertussis
gcggccagggccugc

SEQ ID NO: 414450 - RNA, 20 nt, Bordetella pertussis
gcggccagggccugcgggcc

SEQ ID NO: 414451 - RNA, 17 nt, Bordetella pertussis
gcggccaucgccauggc

SEQ ID NO: 414452 - RNA, 23 nt, Bordetella pertussis
gcggccaucgccauggccacgac

SEQ ID NO: 414453 - RNA, 15 nt, Bordetella pertussis
gcggccaucgccgcc

SEQ ID NO: 414454 - RNA, 19 nt, Bordetella pertussis
gcggccaucgccgccacgu

SEQ ID NO: 414455 - RNA, 17 nt, Bordetella pertussis
gcggccaugcccaggcc

SEQ ID NO: 414456 - RNA, 16 nt, Bordetella pertussis
gcggccaugccgacgg

SEQ ID NO: 414457 - RNA, 17 nt, Bordetella pertussis
gcggccaugcgccgcuu

SEQ ID NO: 414458 - RNA, 19 nt, Bordetella pertussis
gcggccaugcggugcgccg

SEQ ID NO: 414459 - RNA, 21 nt, Bordetella pertussis
gcggccgccugcgccgaggcg

SEQ ID NO: 414460 - RNA, 14 nt, Bordetella pertussis
gcggccgcgcgggc

SEQ ID NO: 414461 - RNA, 17 nt, Bordetella pertussis
gcggccgcgcgggcggc

SEQ ID NO: 414462 - RNA, 21 nt, Bordetella pertussis
gcggccgcgcuggcgcuggcc

SEQ ID NO: 414463 - RNA, 12 nt, Bordetella pertussis
gcggccgcgggc

SEQ ID NO: 414464 - RNA, 17 nt, Bordetella pertussis
gcggccgcgggcagcaa

SEQ ID NO: 414465 - RNA, 21 nt, Bordetella pertussis
gcggccgcgggcggcgcgccc

SEQ ID NO: 414466 - RNA, 18 nt, Bordetella pertussis
gcggccgcgggcgugcug

SEQ ID NO: 414467 - RNA, 21 nt, Bordetella pertussis
gcggccgcgggcgugcuggca

SEQ ID NO: 414468 - RNA, 15 nt, Bordetella pertussis
gcggccgcguccagc

SEQ ID NO: 414469 - RNA, 22 nt, Bordetella pertussis
gcggccgcgucgaucagcgcgg

SEQ ID NO: 414470 - RNA, 14 nt, Bordetella pertussis
gcggccgcgucggc

SEQ ID NO: 414471 - RNA, 16 nt, Bordetella pertussis
gcggccgcgucggccu

SEQ ID NO: 414472 - RNA, 17 nt, Bordetella pertussis
gcggccgcgucggccuc

SEQ ID NO: 414473 - RNA, 18 nt, Bordetella pertussis
gcggccggacagggccgc

SEQ ID NO: 414474 - RNA, 17 nt, Bordetella pertussis
gcggccggaggccgccc

SEQ ID NO: 414475 - RNA, 19 nt, Bordetella pertussis
gcggccggaggccgcccac

SEQ ID NO: 414476 - RNA, 16 nt, Bordetella pertussis
gcggccggcaccagga

SEQ ID NO: 414477 - RNA, 20 nt, Bordetella pertussis
gcggccggcaggccggccag

SEQ ID NO: 414478 - RNA, 23 nt, Bordetella pertussis
gcggccggcaggccggccagcaa

SEQ ID NO: 414479 - RNA, 15 nt, Bordetella pertussis
gcggccggcacgccc

SEQ ID NO: 414480 - RNA, 16 nt, Bordetella pertussis
gcggccggcacgccga

SEQ ID NO: 414481 - RNA, 14 nt, Bordetella pertussis
gcggccggccagcc

SEQ ID NO: 414482 - RNA, 14 nt, Bordetella pertussis
gcggccggccgcgc

SEQ ID NO: 414483 - RNA, 16 nt, Bordetella pertussis
gcggccggcgcgccgg

SEQ ID NO: 414484 - RNA, 17 nt, Bordetella pertussis
gcggccggcgcgccggc

SEQ ID NO: 414485 - RNA, 19 nt, Bordetella pertussis
gcggccggcgcgccggccu

SEQ ID NO: 414486 - RNA, 15 nt, Bordetella pertussis
gcggccggcgcgcgc

SEQ ID NO: 414487 - RNA, 17 nt, Bordetella pertussis
gcggccggcgcgcgcga

SEQ ID NO: 414488 - RNA, 20 nt, Bordetella pertussis
gcggccggcguugcgcccug

SEQ ID NO: 414489 - RNA, 14 nt, Bordetella pertussis
gcggccggcggcgc

SEQ ID NO: 414490 - RNA, 18 nt, Bordetella pertussis
gcggccgggcuaucccaa

SEQ ID NO: 414491 - RNA, 20 nt, Bordetella pertussis
gcggccgggcuaucccaacc

SEQ ID NO: 414492 - RNA, 20 nt, Bordetella pertussis
gcggccgggcucaggcugcg

SEQ ID NO: 414493 - RNA, 13 nt, Bordetella pertussis
gcggccggggccg

SEQ ID NO: 414494 - RNA, 15 nt, Bordetella pertussis
gcggccggggccgcc

SEQ ID NO: 414495 - RNA, 19 nt, Bordetella pertussis
gcggccggggccgcccugg

SEQ ID NO: 414496 - RNA, 21 nt, Bordetella pertussis
gcggccgguaucgacgcgcgu

SEQ ID NO: 414497 - RNA, 21 nt, Bordetella pertussis
gcggccggucagggaggcugu

SEQ ID NO: 414498 - RNA, 13 nt, Bordetella pertussis
gcggccgguggcg

SEQ ID NO: 414499 - RNA, 18 nt, Bordetella pertussis
gcggccgucggcgcuggc

SEQ ID NO: 414500 - RNA, 16 nt, Bordetella pertussis
gcggccgucgguggug

SEQ ID NO: 414501 - RNA, 22 nt, Bordetella pertussis
gcggccgucgugcagcgugggc

SEQ ID NO: 414502 - RNA, 18 nt, Bordetella pertussis
gcggccgggucggccugc

SEQ ID NO: 414503 - RNA, 15 nt, Bordetella pertussis
gcggccguggcggcc

SEQ ID NO: 414504 - RNA, 16 nt, Bordetella pertussis
gcggccguggcggccu

SEQ ID NO: 414505 - RNA, 17 nt, Bordetella pertussis
gcggccguugcuccagc

SEQ ID NO: 414506 - RNA, 23 nt, Bordetella pertussis
gcggccguugcuccagccaggcg

SEQ ID NO: 414507 - RNA, 20 nt, Bordetella pertussis
gcggccuaucaccugggcaa

SEQ ID NO: 414508 - RNA, 16 nt, Bordetella pertussis
gcggccuaugugcagg

SEQ ID NO: 414509 - RNA, 20 nt, Bordetella pertussis
gcggccuaugugcaggccac

SEQ ID NO: 414510 - RNA, 18 nt, Bordetella pertussis
gcggccucgccggccugg

SEQ ID NO: 414511 - RNA, 15 nt, Bordetella pertussis
gcggccucggccagc

SEQ ID NO: 414512 - RNA, 16 nt, Bordetella pertussis
gcggccucggcgggcg

SEQ ID NO: 414513 - RNA, 19 nt, Bordetella pertussis
gcggccucggcgggcggcg

SEQ ID NO: 414514 - RNA, 19 nt, Bordetella pertussis
gcggccugcaggccguucc

SEQ ID NO: 414515 - RNA, 14 nt, Bordetella pertussis
gcggccuggaccug

SEQ ID NO: 414516 - RNA, 17 nt, Bordetella pertussis
gcggccuggaccugagc

SEQ ID NO: 414517 - RNA, 18 nt, Bordetella pertussis
gcggccuggccgcgcgcc

SEQ ID NO: 414518 - RNA, 20 nt, Bordetella pertussis
gcggccuggccgcgcgccug

SEQ ID NO: 414519 - RNA, 22 nt, Bordetella pertussis
gcggccuggcgguaugcggcgc

SEQ ID NO: 414520 - RNA, 14 nt, Bordetella pertussis
gcggccugggaggc

SEQ ID NO: 414521 - RNA, 20 nt, Bordetella pertussis
gcggccugggcggcgcgcuc

SEQ ID NO: 414522 - RNA, 15 nt, Bordetella pertussis
gcggccugggcgggc

SEQ ID NO: 414523 - RNA, 18 nt, Bordetella pertussis
gcggccuucaccccgcca

SEQ ID NO: 414524 - RNA, 16 nt, Bordetella pertussis
gcggccuucgccggug

SEQ ID NO: 414525 - RNA, 19 nt, Bordetella pertussis
gcggccuuggucgcgaccu

SEQ ID NO: 414526 - RNA, 11 nt, Bordetella pertussis
gcggccuuggc

SEQ ID NO: 414527 - RNA, 13 nt, Bordetella pertussis
gcggccuuggccg

SEQ ID NO: 414528 - RNA, 21 nt, Bordetella pertussis
gcggcgaaaugucgagcgcga

SEQ ID NO: 414529 - RNA, 18 nt, Bordetella pertussis
gcggcgacacccccaggg

SEQ ID NO: 414530 - RNA, 19 nt, Bordetella pertussis
gcggcgacgaugccgcaga

SEQ ID NO: 414531 - RNA, 17 nt, Bordetella pertussis
gcggcgacgcagcacgg

SEQ ID NO: 414532 - RNA, 20 nt, Bordetella pertussis
gcggcgacggcgucggccug

SEQ ID NO: 414533 - RNA, 14 nt, Bordetella pertussis
gcggcgagcgcggc

SEQ ID NO: 414534 - RNA, 17 nt, Bordetella pertussis
gcggcgagcgcggcgau

SEQ ID NO: 414535 - RNA, 14 nt, Bordetella pertussis
gcggcgagcucggc

SEQ ID NO: 414536 - RNA, 17 nt, Bordetella pertussis
gcggcgagcgccgccag

SEQ ID NO: 414537 - RNA, 19 nt, Bordetella pertussis
gcggcgagcgccgccaggc

SEQ ID NO: 414538 - RNA, 23 nt, Bordetella pertussis
gcggcgaucaacgugcgccaggc

SEQ ID NO: 414539 - RNA, 16 nt, Bordetella pertussis
gcggcgaucacgccgu

SEQ ID NO: 414540 - RNA, 18 nt, Bordetella pertussis
gcggcgauccgccgcggc

SEQ ID NO: 414541 - RNA, 21 nt, Bordetella pertussis
gcggcgauccgccgcggccag

SEQ ID NO: 414542 - RNA, 22 nt, Bordetella pertussis
gcggcgaucgaauggucggccu

SEQ ID NO: 414543 - RNA, 16 nt, Bordetella pertussis
gcggcgaucucgcgcg

SEQ ID NO: 414544 - RNA, 19 nt, Bordetella pertussis
gcggcgaucucgcgcgcgc

SEQ ID NO: 414545 - RNA, 21 nt, Bordetella pertussis
gcggcgaugccggccagcagc

SEQ ID NO: 414546 - RNA, 19 nt, Bordetella pertussis
gcggcgauuucuacgccga

SEQ ID NO: 414547 - RNA, 18 nt, Bordetella pertussis
gcggcgcccggugcgcgc

SEQ ID NO: 414548 - RNA, 22 nt, Bordetella pertussis
gcggcgcccggugcgcgcaggg

SEQ ID NO: 414549 - RNA, 14 nt, Bordetella pertussis
gcggcgccgccggc

SEQ ID NO: 414550 - RNA, 15 nt, Bordetella pertussis
gcggcgccgccggcg

SEQ ID NO: 414551 - RNA, 19 nt, Bordetella pertussis
gcggcgccgccggcggccu

SEQ ID NO: 414552 - RNA, 22 nt, Bordetella pertussis
gcggcgccgccggcggccugga

SEQ ID NO: 414553 - RNA, 13 nt, Bordetella pertussis
gcggcgccggccg

SEQ ID NO: 414554 - RNA, 19 nt, Bordetella pertussis
gcggcgccggugaccgcca

SEQ ID NO: 414555 - RNA, 13 nt, Bordetella pertussis
gcggcgccugccu

SEQ ID NO: 414556 - RNA, 14 nt, Bordetella pertussis
gcggcgccugccug

SEQ ID NO: 414557 - RNA, 23 nt, Bordetella pertussis
gcggcgccugccugccgagcgcu

SEQ ID NO: 414558 - RNA, 17 nt, Bordetella pertussis
gcggcgccugcgcgcgc

SEQ ID NO: 414559 - RNA, 21 nt, Bordetella pertussis
gcggcgccugcgcgcgcuggg

SEQ ID NO: 414560 - RNA, 15 nt, Bordetella pertussis
gcggcgccugggccu

SEQ ID NO: 414561 - RNA, 23 nt, Bordetella pertussis
gcggcgccugggccuucuugucg

SEQ ID NO: 414562 - RNA, 17 nt, Bordetella pertussis
gcggcgccuggggcgug

SEQ ID NO: 414563 - RNA, 14 nt, Bordetella pertussis
gcggcgcgaacggc

SEQ ID NO: 414564 - RNA, 22 nt, Bordetella pertussis
gcggcgcgaccugcgcgaccgc

SEQ ID NO: 414565 - RNA, 12 nt, Bordetella pertussis
gcggcuggcugu

SEQ ID NO: 414566 - RNA, 16 nt, Bordetella pertussis
gcggcuggggcugcug

SEQ ID NO: 414567 - RNA, 13 nt, Bordetella pertussis
gcggcugggugcg

SEQ ID NO: 414568 - RNA, 12 nt, Bordetella pertussis
gcggcuggucaa

SEQ ID NO: 414569 - RNA, 17 nt, Bordetella pertussis
gcggcuggugccgacgg

SEQ ID NO: 414570 - RNA, 13 nt, Bordetella pertussis
gcggcugucgggc

SEQ ID NO: 414571 - RNA, 23 nt, Bordetella pertussis
gcggcuguagucgccgcugccgg

SEQ ID NO: 414572 - RNA, 19 nt, Bordetella pertussis
gcggcuucaggcgcgcggc

SEQ ID NO: 414573 - RNA, 16 nt, Bordetella pertussis
gcggcuucgcgcagca

SEQ ID NO: 414574 - RNA, 16 nt, Bordetella pertussis
gcgggauggucgcggc

SEQ ID NO: 414575 - RNA, 16 nt, Bordetella pertussis
gcgggcaaacggcggc

SEQ ID NO: 414576 - RNA, 20 nt, Bordetella pertussis
gcgggcaaacggcggcaggc

SEQ ID NO: 414577 - RNA, 15 nt, Bordetella pertussis
gcgggcagcggcgac

SEQ ID NO: 414578 - RNA, 19 nt, Bordetella pertussis
gcgggcaucgcccaccaug

SEQ ID NO: 414579 - RNA, 17 nt, Bordetella pertussis
gcgggcaucgcccugcu

SEQ ID NO: 414580 - RNA, 16 nt, Bordetella pertussis
gcgggcccgcucggcc

SEQ ID NO: 414581 - RNA, 22 nt, Bordetella pertussis
gcgggcccgcucggccagcagu

SEQ ID NO: 414582 - RNA, 23 nt, Bordetella pertussis
gcgggcccgucgcgccaggccgg

SEQ ID NO: 414583 - RNA, 14 nt, Bordetella pertussis
gcgggccgccgcac

SEQ ID NO: 414584 - RNA, 16 nt, Bordetella pertussis
gcgggccgcgccgcgg

SEQ ID NO: 414585 - RNA, 18 nt, Bordetella pertussis
gcgggccgcgcuggaaga

SEQ ID NO: 414586 - RNA, 14 nt, Bordetella pertussis
gcgggccgcugguc

SEQ ID NO: 414587 - RNA, 14 nt, Bordetella pertussis
gcgggccggcgcgc

SEQ ID NO: 414588 - RNA, 16 nt, Bordetella pertussis
gcgggccggcgcgccu

SEQ ID NO: 414589 - RNA, 16 nt, Bordetella pertussis
gcgggccggcugggcg

SEQ ID NO: 414590 - RNA, 17 nt, Bordetella pertussis
gcgggccggcugggcgg

SEQ ID NO: 414591 - RNA, 17 nt, Bordetella pertussis
gcgggccgggcaggccg

SEQ ID NO: 414592 - RNA, 19 nt, Bordetella pertussis
gcgggccuacuugccggcg

SEQ ID NO: 414593 - RNA, 21 nt, Bordetella pertussis
gcgggccuacuugccggcgcu

SEQ ID NO: 414594 - RNA, 16 nt, Bordetella pertussis
gcgggccugccgcgcg

SEQ ID NO: 414595 - RNA, 16 nt, Bordetella pertussis
gcgggccugggcgucg

SEQ ID NO: 414596 - RNA, 15 nt, Bordetella pertussis
gcgggcgcgcccggc

SEQ ID NO: 414597 - RNA, 20 nt, Bordetella pertussis
gcgggcgcgccgucgcuggg

SEQ ID NO: 414598 - RNA, 12 nt, Bordetella pertussis
gcgggcgcgcgc

SEQ ID NO: 414599 - RNA, 13 nt, Bordetella pertussis
gcgggcgcgcgcc

SEQ ID NO: 414600 - RNA, 22 nt, Bordetella pertussis
gcgggcgcgguauucgcugcug

SEQ ID NO: 414601 - RNA, 13 nt, Bordetella pertussis
gcgggcgcugcgc

SEQ ID NO: 414602 - RNA, 14 nt, Bordetella pertussis
gcgggcggccgacg

SEQ ID NO: 414603 - RNA, 18 nt, Bordetella pertussis
gcgggcggccggcgcguc

SEQ ID NO: 414604 - RNA, 14 nt, Bordetella pertussis
gcgggcggcgcgcc

SEQ ID NO: 414605 - RNA, 15 nt, Bordetella pertussis
gcgggcggcgcgccc

SEQ ID NO: 414606 - RNA, 16 nt, Bordetella pertussis
gcgggcggcggcgcgu

SEQ ID NO: 414607 - RNA, 15 nt, Bordetella pertussis
gcgggcggcgccagc

SEQ ID NO: 414608 - RNA, 16 nt, Bordetella pertussis
gcgggcggcgccggcc

SEQ ID NO: 414609 - RNA, 12 nt, Bordetella pertussis
gcgggcggcggc

SEQ ID NO: 414610 - RNA, 16 nt, Bordetella pertussis
gcggggcggcaggucg

SEQ ID NO: 414611 - RNA, 21 nt, Bordetella pertussis
gcggggcggcaggucgcgcga

SEQ ID NO: 414612 - RNA, 12 nt, Bordetella pertussis
gcggggcggcgg

SEQ ID NO: 414613 - RNA, 23 nt, Bordetella pertussis
gcggggcgugagcaggcgccugc

SEQ ID NO: 414614 - RNA, 15 nt, Bordetella pertussis
gcgggggacgcccgc

SEQ ID NO: 414615 - RNA, 21 nt, Bordetella pertussis
gcgggggacgcccgcccgcug

SEQ ID NO: 414616 - RNA, 12 nt, Bordetella pertussis
gcgggggcaggc

SEQ ID NO: 414617 - RNA, 14 nt, Bordetella pertussis
gcggggugccugca

SEQ ID NO: 414618 - RNA, 13 nt, Bordetella pertussis
gcggggugccugu

SEQ ID NO: 414619 - RNA, 21 nt, Bordetella pertussis
gcgggguggcacagccgcagc

SEQ ID NO: 414620 - RNA, 17 nt, Bordetella pertussis
gcgggguuggccgccag

SEQ ID NO: 414621 - RNA, 18 nt, Bordetella pertussis
gcggguaaugccggugcg

SEQ ID NO: 414622 - RNA, 14 nt, Bordetella pertussis
gcggguggccgcuc

SEQ ID NO: 414623 - RNA, 19 nt, Bordetella pertussis
gcggguggccgcuccagag

SEQ ID NO: 414624 - RNA, 19 nt, Bordetella pertussis
gcggguggccucgcccugg

SEQ ID NO: 414625 - RNA, 13 nt, Bordetella pertussis
gcggguggcggcg

SEQ ID NO: 414626 - RNA, 20 nt, Bordetella pertussis
gcgggugucgcucccccaug

SEQ ID NO: 414627 - RNA, 17 nt, Bordetella pertussis
gcggguucgacgccggc

SEQ ID NO: 414628 - RNA, 23 nt, Bordetella pertussis
gcggguucggcgguuccagccug

SEQ ID NO: 414629 - RNA, 17 nt, Bordetella pertussis
gcggguugcgcgccagc

SEQ ID NO: 414630 - RNA, 22 nt, Bordetella pertussis
gcggguuggucgucagcgccgc

SEQ ID NO: 414631 - RNA, 16 nt, Bordetella pertussis
gcgguacgcccagcug

SEQ ID NO: 414632 - RNA, 14 nt, Bordetella pertussis
gcgguacgcgggca

SEQ ID NO: 414633 - RNA, 15 nt, Bordetella pertussis
gcgguacgcgggcau

SEQ ID NO: 414634 - RNA, 23 nt, Bordetella pertussis
gcgguaggcgcccgacggcgcgc

SEQ ID NO: 414635 - RNA, 21 nt, Bordetella pertussis
gcgguagggcgauggcgcguc

SEQ ID NO: 414636 - RNA, 20 nt, Bordetella pertussis
gcgguagguagcgcgcagcu

SEQ ID NO: 414637 - RNA, 21 nt, Bordetella pertussis
gcgguagguagcgcgcagcuc

SEQ ID NO: 414638 - RNA, 21 nt, Bordetella pertussis
gcgguagguaugguuggccac

SEQ ID NO: 414639 - RNA, 16 nt, Bordetella pertussis
gcggucagccagagcg

SEQ ID NO: 414640 - RNA, 17 nt, Bordetella pertussis
gcggucagucgggacgg

SEQ ID NO: 414641 - RNA, 19 nt, Bordetella pertussis
gcgguccacgcccuggcug

SEQ ID NO: 414642 - RNA, 16 nt, Bordetella pertussis
gcgguccacagcccgg

SEQ ID NO: 414643 - RNA, 13 nt, Bordetella pertussis
gcgguccagcacg

SEQ ID NO: 414644 - RNA, 15 nt, Bordetella pertussis
gcgguccaggaagcg

SEQ ID NO: 414645 - RNA, 14 nt, Bordetella pertussis
gcgguccaugguga

SEQ ID NO: 414646 - RNA, 14 nt, Bordetella pertussis
gcggucccgagcgc

SEQ ID NO: 414647 - RNA, 21 nt, Bordetella pertussis
gcgguccgaugucgaggauca

SEQ ID NO: 414648 - RNA, 19 nt, Bordetella pertussis
gcgguccggggcgggcgcg

SEQ ID NO: 414649 - RNA, 19 nt, Bordetella pertussis
gcgguccguacgccacuuc

SEQ ID NO: 414650 - RNA, 16 nt, Bordetella pertussis
gcggucgaggcgcagu

SEQ ID NO: 414651 - RNA, 19 nt, Bordetella pertussis
gcggucgaugaagcccgag

SEQ ID NO: 414652 - RNA, 22 nt, Bordetella pertussis
gcggucgaugaagcccgagcgg

SEQ ID NO: 414653 - RNA, 21 nt, Bordetella pertussis
gcggucgauguccagcgccag

SEQ ID NO: 414654 - RNA, 20 nt, Bordetella pertussis
gcggucgcauuggccgccgc

SEQ ID NO: 414655 - RNA, 22 nt, Bordetella pertussis
gcggucgcgcuggcccgcgcga

SEQ ID NO: 414656 - RNA, 16 nt, Bordetella pertussis
gcggucuugcgcugga

SEQ ID NO: 414657 - RNA, 17 nt, Bordetella pertussis
gcggugaaggcgcccgg

SEQ ID NO: 414658 - RNA, 15 nt, Bordetella pertussis
gcggugaccaccagg

SEQ ID NO: 414659 - RNA, 15 nt, Bordetella pertussis
gcggugaggcggccg

SEQ ID NO: 414660 - RNA, 21 nt, Bordetella pertussis
gcggugaucugcucgccgcgc

SEQ ID NO: 414661 - RNA, 17 nt, Bordetella pertussis
gcggugcaagcggccgg

SEQ ID NO: 414662 - RNA, 20 nt, Bordetella pertussis
gcggugcaggggccgcacgc

SEQ ID NO: 414663 - RNA, 24 nt, Bordetella pertussis
gcggugcaucucggcaucggccac

SEQ ID NO: 414664 - RNA, 15 nt, Bordetella pertussis
gcggugccgccuggc

SEQ ID NO: 414665 - RNA, 13 nt, Bordetella pertussis
gcggugccgcgca

SEQ ID NO: 414666 - RNA, 16 nt, Bordetella pertussis
gcggugccgcgcaccc

SEQ ID NO: 414667 - RNA, 13 nt, Bordetella pertussis
gcggugccugugc

SEQ ID NO: 414668 - RNA, 17 nt, Bordetella pertussis
gcggugccugugcccgc

SEQ ID NO: 414669 - RNA, 20 nt, Bordetella pertussis
gcggugcgcaccaggcccau

SEQ ID NO: 414670 - RNA, 21 nt, Bordetella pertussis
gcggugcgccgcaugcggcgg

SEQ ID NO: 414671 - RNA, 15 nt, Bordetella pertussis
gcggugcgcgcggcc

SEQ ID NO: 414672 - RNA, 21 nt, Bordetella pertussis
gcggugcgcggcgcagcccag

SEQ ID NO: 414673 - RNA, 15 nt, Bordetella pertussis
gcggugcggccucgg

SEQ ID NO: 414674 - RNA, 16 nt, Bordetella pertussis
gcggugcggccucggc

SEQ ID NO: 414675 - RNA, 15 nt, Bordetella pertussis
gcggugcgggugggc

SEQ ID NO: 414676 - RNA, 15 nt, Bordetella pertussis
gcggugcgugcgccc

SEQ ID NO: 414677 - RNA, 17 nt, Bordetella pertussis
gcgguggccagcgccug

SEQ ID NO: 414678 - RNA, 15 nt, Bordetella pertussis
gcgguggccagcgug

SEQ ID NO: 414679 - RNA, 19 nt, Bordetella pertussis
gcgguggccaugcugggcg

SEQ ID NO: 414680 - RNA, 16 nt, Bordetella pertussis
gcgguggccgccgcgc

SEQ ID NO: 414681 - RNA, 21 nt, Bordetella pertussis
gcgguggccgccgcgcgccgc

SEQ ID NO: 414682 - RNA, 15 nt, Bordetella pertussis
gcggugggcagggcg

SEQ ID NO: 414683 - RNA, 14 nt, Bordetella pertussis
gcgguggugggcag

SEQ ID NO: 414684 - RNA, 20 nt, Bordetella pertussis
gcgguguagaccaccagcag

SEQ ID NO: 414685 - RNA, 15 nt, Bordetella pertussis
gcggugucgcaccgc

SEQ ID NO: 414686 - RNA, 19 nt, Bordetella pertussis
gcggugucggacaacugcg

SEQ ID NO: 414687 - RNA, 20 nt, Bordetella pertussis
gcgguguugcucgugcuggc

SEQ ID NO: 414688 - RNA, 12 nt, Bordetella pertussis
gcgguuccagcc

SEQ ID NO: 414689 - RNA, 16 nt, Bordetella pertussis
gcgguucguagccggu

SEQ ID NO: 414690 - RNA, 22 nt, Bordetella pertussis
gcgguucgucagggccgcagca

SEQ ID NO: 414691 - RNA, 22 nt, Bordetella pertussis
gcgguucguccucgucggccau

SEQ ID NO: 414692 - RNA, 22 nt, Bordetella pertussis
gcgguucugggcccgaucgccg

SEQ ID NO: 414693 - RNA, 19 nt, Bordetella pertussis
gcgguugaaggcgaacggc

SEQ ID NO: 414694 - RNA, 20 nt, Bordetella pertussis
gcgguugaucagggccgcca

SEQ ID NO: 414695 - RNA, 18 nt, Bordetella pertussis
gcgguugcgaggcggccu

SEQ ID NO: 414696 - RNA, 20 nt, Bordetella pertussis
gcgguuggccuugacggcgc

SEQ ID NO: 414697 - RNA, 18 nt, Bordetella pertussis
gcgguugguuugcggcgc

SEQ ID NO: 414698 - RNA, 19 nt, Bordetella pertussis
gcgguuguugcccaccgcc

SEQ ID NO: 414699 - RNA, 14 nt, Bordetella pertussis
gcgguuucggccgg

SEQ ID NO: 414700 - RNA, 19 nt, Bordetella pertussis
gcgguuucucagcgcgcuu

SEQ ID NO: 414701 - RNA, 22 nt, Bordetella pertussis
gcgguuuuucuuuggccgcgcg

SEQ ID NO: 414702 - RNA, 15 nt, Bordetella pertussis
gcguaauagcuggcg

SEQ ID NO: 414703 - RNA, 21 nt, Bordetella pertussis
gcguaauagcuggcggcgcgc

SEQ ID NO: 414704 - RNA, 13 nt, Bordetella pertussis
gcguacagcaggg

SEQ ID NO: 414705 - RNA, 19 nt, Bordetella pertussis
gcguacaggugcuggguca

SEQ ID NO: 414706 - RNA, 14 nt, Bordetella pertussis
gcguaccagcccag

SEQ ID NO: 414707 - RNA, 15 nt, Bordetella pertussis
gcguaccagcccagu

SEQ ID NO: 414708 - RNA, 18 nt, Bordetella pertussis
gcguaccaggcagccggc

SEQ ID NO: 414709 - RNA, 22 nt, Bordetella pertussis
gcguaccaggcagccggccccg

SEQ ID NO: 414710 - RNA, 14 nt, Bordetella pertussis
gcguaccucgguga

SEQ ID NO: 414711 - RNA, 18 nt, Bordetella pertussis
gcguaccucggugaggau

SEQ ID NO: 414712 - RNA, 14 nt, Bordetella pertussis
gcguacgaggaccu

SEQ ID NO: 414713 - RNA, 22 nt, Bordetella pertussis
gcguacgcuuaucgcggcgcgg

SEQ ID NO: 414714 - RNA, 18 nt, Bordetella pertussis
gcguacuggcgcggcggc

SEQ ID NO: 414715 - RNA, 22 nt, Bordetella pertussis
gcguagaccaccugcucgguga

SEQ ID NO: 414716 - RNA, 16 nt, Bordetella pertussis
gcguaggccuucaccu

SEQ ID NO: 414717 - RNA, 15 nt, Bordetella pertussis
gcguaguagcccagg

SEQ ID NO: 414718 - RNA, 14 nt, Bordetella pertussis
gcguaucgccgccg

SEQ ID NO: 414719 - RNA, 20 nt, Bordetella pertussis
gcguaucgccgccgccggca

SEQ ID NO: 414720 - RNA, 18 nt, Bordetella pertussis
gcguaucggcgcgagcga

SEQ ID NO: 414721 - RNA, 19 nt, Bordetella pertussis
gcguaucgggguucugucc

SEQ ID NO: 414722 - RNA, 19 nt, Bordetella pertussis
gcguaucugaucggacugg

SEQ ID NO: 414723 - RNA, 19 nt, Bordetella pertussis
gcguauggcccgccaccac

SEQ ID NO: 414724 - RNA, 14 nt, Bordetella pertussis
gcguauggcggcgc

SEQ ID NO: 414725 - RNA, 18 nt, Bordetella pertussis
gcguauucgguggcgcgc

SEQ ID NO: 414726 - RNA, 12 nt, Bordetella pertussis
gcguaugcccug

SEQ ID NO: 414727 - RNA, 16 nt, Bordetella pertussis
gcgucaagccagcggc

SEQ ID NO: 414728 - RNA, 20 nt, Bordetella pertussis
gcgucaaggggcuguaccug

SEQ ID NO: 414729 - RNA, 17 nt, Bordetella pertussis
gcgucaauccgccgcca

SEQ ID NO: 414730 - RNA, 21 nt, Bordetella pertussis
gcgucaauccgccgccagcac

SEQ ID NO: 414731 - RNA, 14 nt, Bordetella pertussis
gcgucaccagcagg

SEQ ID NO: 414732 - RNA, 20 nt, Bordetella pertussis
gcgucagcacaucgcccggc

SEQ ID NO: 414733 - RNA, 18 nt, Bordetella pertussis
gcgucagcgugcgccccg

SEQ ID NO: 414734 - RNA, 14 nt, Bordetella pertussis
gcgucaggccgggc

SEQ ID NO: 414735 - RNA, 17 nt, Bordetella pertussis
gcgucaggcgagcgcgg

SEQ ID NO: 414736 - RNA, 18 nt, Bordetella pertussis
gcgucaggcgagcgcggc

SEQ ID NO: 414737 - RNA, 21 nt, Bordetella pertussis
gcgucaggcgagcgcggcggg

SEQ ID NO: 414738 - RNA, 19 nt, Bordetella pertussis
gcguccaagcagacccgcg

SEQ ID NO: 414739 - RNA, 21 nt, Bordetella pertussis
gcguccaagcagacccgcgcc

SEQ ID NO: 414740 - RNA, 23 nt, Bordetella pertussis
gcguccaccuugacgcgcaggcc

SEQ ID NO: 414741 - RNA, 15 nt, Bordetella pertussis
gcguccacgcgggug

SEQ ID NO: 414742 - RNA, 23 nt, Bordetella pertussis
gcguccacggcaucggccagcau

SEQ ID NO: 414743 - RNA, 21 nt, Bordetella pertussis
gcguccagccugcccgggcag

SEQ ID NO: 414744 - RNA, 19 nt, Bordetella pertussis
gcguccagcgcgcggccuc

SEQ ID NO: 414745 - RNA, 16 nt, Bordetella pertussis
gcguccaggcccuggc

SEQ ID NO: 414746 - RNA, 20 nt, Bordetella pertussis
gcguccaggcccuggcggcg

SEQ ID NO: 414747 - RNA, 21 nt, Bordetella pertussis
gcguccaggcccuggcggcgc

SEQ ID NO: 414748 - RNA, 14 nt, Bordetella pertussis
gcguccaggcgcgc

SEQ ID NO: 414749 - RNA, 15 nt, Bordetella pertussis
gcguccaggcugccg

SEQ ID NO: 414750 - RNA, 17 nt, Bordetella pertussis
gcguccaggcugccggc

SEQ ID NO: 414751 - RNA, 18 nt, Bordetella pertussis
gcguccaggugcggcggc

SEQ ID NO: 414752 - RNA, 19 nt, Bordetella pertussis
gcguccagguugggcacca

SEQ ID NO: 414753 - RNA, 23 nt, Bordetella pertussis
gcguccaucuggaccgcgcgcga

SEQ ID NO: 414754 - RNA, 13 nt, Bordetella pertussis
gcguccaugcagg

SEQ ID NO: 414755 - RNA, 20 nt, Bordetella pertussis
gcguccauuagggcccagcu

SEQ ID NO: 414756 - RNA, 22 nt, Bordetella pertussis
gcguccauuagggcccagcugc

SEQ ID NO: 414757 - RNA, 19 nt, Bordetella pertussis
gcgucccggugaucguccu

SEQ ID NO: 414758 - RNA, 12 nt, Bordetella pertussis
gcguccgcccgc

SEQ ID NO: 414759 - RNA, 19 nt, Bordetella pertussis
gcguccgccgugcaggccc

SEQ ID NO: 414760 - RNA, 15 nt, Bordetella pertussis
gcguccgcgcgccgc

SEQ ID NO: 414761 - RNA, 15 nt, Bordetella pertussis
gcguccgcucaugcc

SEQ ID NO: 414762 - RNA, 22 nt, Bordetella pertussis
gcguccgucggguugccgcugc

SEQ ID NO: 414763 - RNA, 16 nt, Bordetella pertussis
gcguccucggccuggc

SEQ ID NO: 414764 - RNA, 15 nt, Bordetella pertussis
gcguccugcggcggc

SEQ ID NO: 414765 - RNA, 20 nt, Bordetella pertussis
gcguccugggccgagcgcgc

SEQ ID NO: 414766 - RNA, 19 nt, Bordetella pertussis
gcguccuuggcggccuugc

SEQ ID NO: 414767 - RNA, 17 nt, Bordetella pertussis
gcgucgaacggccgggc

SEQ ID NO: 414768 - RNA, 16 nt, Bordetella pertussis
gcgucgaaggcggccg

SEQ ID NO: 414769 - RNA, 19 nt, Bordetella pertussis
gcgucgaccgcgggcgcgc

SEQ ID NO: 414770 - RNA, 17 nt, Bordetella pertussis
gcgucgacggugcgcgc

SEQ ID NO: 414771 - RNA, 18 nt, Bordetella pertussis
gcgucgagcgcgacgcgc

SEQ ID NO: 414772 - RNA, 12 nt, Bordetella pertussis
gcgucgagcggc

SEQ ID NO: 414773 - RNA, 18 nt, Bordetella pertussis
gcgucgagcacgcggcgc

SEQ ID NO: 414774 - RNA, 21 nt, Bordetella pertussis
gcgucgauccggcagcagcag

SEQ ID NO: 414775 - RNA, 23 nt, Bordetella pertussis
gcgucgaucuucgccugcauggu

SEQ ID NO: 414776 - RNA, 20 nt, Bordetella pertussis
gcgucgauggcguacagcag

SEQ ID NO: 414777 - RNA, 17 nt, Bordetella pertussis
gcgucgccggccaggca

SEQ ID NO: 414778 - RNA, 15 nt, Bordetella pertussis
gcgucgcgcggcggc

SEQ ID NO: 414779 - RNA, 16 nt, Bordetella pertussis
gcgucgcgaugcgcca

SEQ ID NO: 414780 - RNA, 17 nt, Bordetella pertussis
gcgucgcuggcagccuu

SEQ ID NO: 414781 - RNA, 17 nt, Bordetella pertussis
gcgucgcuggccggacg

SEQ ID NO: 414782 - RNA, 18 nt, Bordetella pertussis
gcgucgcucugcgcggca

SEQ ID NO: 414783 - RNA, 15 nt, Bordetella pertussis
gcgucggacgcgcgc

SEQ ID NO: 414784 - RNA, 15 nt, Bordetella pertussis
gcgucggccagcgcc

SEQ ID NO: 414785 - RNA, 13 nt, Bordetella pertussis
gcgucggccaggc

SEQ ID NO: 414786 - RNA, 15 nt, Bordetella pertussis
gcgucggccaggccg

SEQ ID NO: 414787 - RNA, 21 nt, Bordetella pertussis
gcgucggccauggcgcuguug

SEQ ID NO: 414788 - RNA, 13 nt, Bordetella pertussis
gcgucggccuggu

SEQ ID NO: 414789 - RNA, 21 nt, Bordetella pertussis
gcgucggcgaagcuguccuuc

SEQ ID NO: 414790 - RNA, 20 nt, Bordetella pertussis
gcgucggcgcccggcgccgc

SEQ ID NO: 414791 - RNA, 14 nt, Bordetella pertussis
gcgucggcgcgcgc

SEQ ID NO: 414792 - RNA, 16 nt, Bordetella pertussis
gcgucggcgcggucgg

SEQ ID NO: 414793 - RNA, 13 nt, Bordetella pertussis
gcgucggcggccc

SEQ ID NO: 414794 - RNA, 18 nt, Bordetella pertussis
gcgucggcggcccacagc

SEQ ID NO: 414795 - RNA, 23 nt, Bordetella pertussis
gcgucgggcacguccggaucuuc

SEQ ID NO: 414796 - RNA, 16 nt, Bordetella pertussis
gcgucgggggcggccg

SEQ ID NO: 414797 - RNA, 14 nt, Bordetella pertussis
gcgucgggucagcc

SEQ ID NO: 414798 - RNA, 19 nt, Bordetella pertussis
gcgucguccguggccggcg

SEQ ID NO: 414799 - RNA, 15 nt, Bordetella pertussis
gcgucguccugcagc

SEQ ID NO: 414800 - RNA, 20 nt, Bordetella pertussis
gcgucgucgcgguccagcac

SEQ ID NO: 414801 - RNA, 22 nt, Bordetella pertussis
gcgucgucguuucccagcaagc

SEQ ID NO: 414802 - RNA, 17 nt, Bordetella pertussis
gcgucuccagcgccggc

SEQ ID NO: 414803 - RNA, 23 nt, Bordetella pertussis
gcgucucggaaaacuggcgggug

SEQ ID NO: 414804 - RNA, 17 nt, Bordetella pertussis
gcgucucggccuguucg

SEQ ID NO: 414805 - RNA, 14 nt, Bordetella pertussis
gcgucugcccgcgg

SEQ ID NO: 414806 - RNA, 15 nt, Bordetella pertussis
gcgucugcccgcggu

SEQ ID NO: 414807 - RNA, 17 nt, Bordetella pertussis
gcgucugcccgcggucc

SEQ ID NO: 414808 - RNA, 19 nt, Bordetella pertussis
gcgucuucggcgcggcggg

SEQ ID NO: 414809 - RNA, 15 nt, Bordetella pertussis
gcgugaaaggccagc

SEQ ID NO: 414810 - RNA, 18 nt, Bordetella pertussis
gcgugaaaggccagcggc

SEQ ID NO: 414811 - RNA, 17 nt, Bordetella pertussis
gcgugaccgcgacgcgc

SEQ ID NO: 414812 - RNA, 16 nt, Bordetella pertussis
gcgugaccggacuguc

SEQ ID NO: 414813 - RNA, 19 nt, Bordetella pertussis
gcgugaccgacaggccugg

SEQ ID NO: 414814 - RNA, 16 nt, Bordetella pertussis
gcgugacgcgcggguc

SEQ ID NO: 414815 - RNA, 20 nt, Bordetella pertussis
gcgugacguagcgguagggc

SEQ ID NO: 414816 - RNA, 15 nt, Bordetella pertussis
gcgugacggcggcgc

SEQ ID NO: 414817 - RNA, 17 nt, Bordetella pertussis
gcgugacggcggcgcgc

SEQ ID NO: 414818 - RNA, 17 nt, Bordetella pertussis
gcgugagcaggcgccug

SEQ ID NO: 414819 - RNA, 21 nt, Bordetella pertussis
gcgugaugcccaggcccuggc

SEQ ID NO: 414820 - RNA, 21 nt, Bordetella pertussis
gcgugaugccgucgagcgcgg

SEQ ID NO: 414821 - RNA, 15 nt, Bordetella pertussis
gcgugcagccauucg

SEQ ID NO: 414822 - RNA, 13 nt, Bordetella pertussis
gcgugcaggccgc

SEQ ID NO: 414823 - RNA, 13 nt, Bordetella pertussis
gcgugccagcagg

SEQ ID NO: 414824 - RNA, 19 nt, Bordetella pertussis
gcgugccagcaggucgcgc

SEQ ID NO: 414825 - RNA, 21 nt, Bordetella pertussis
gcgugccagguguaggccagu

SEQ ID NO: 414826 - RNA, 22 nt, Bordetella pertussis
gcgugcccguugccgcgcgcga

SEQ ID NO: 414827 - RNA, 22 nt, Bordetella pertussis
gcgugccgacgaugccgccgcc

SEQ ID NO: 414828 - RNA, 17 nt, Bordetella pertussis
gcgugccgcaggccagc

SEQ ID NO: 414829 - RNA, 12 nt, Bordetella pertussis
gcgugccgccca

SEQ ID NO: 414830 - RNA, 12 nt, Bordetella pertussis
gcgugccgccgg

SEQ ID NO: 414831 - RNA, 22 nt, Bordetella pertussis
gcgugccgggaugcugcucggc

SEQ ID NO: 414832 - RNA, 12 nt, Bordetella pertussis
gcgugccugucc

SEQ ID NO: 414833 - RNA, 14 nt, Bordetella pertussis
gcgugcgcaucagc

SEQ ID NO: 414834 - RNA, 18 nt, Bordetella pertussis
gcgugcgcgaccuccggc

SEQ ID NO: 414835 - RNA, 17 nt, Bordetella pertussis
gcgugcggaugcagcag

SEQ ID NO: 414836 - RNA, 18 nt, Bordetella pertussis
gcgugcggaugcagcagc

SEQ ID NO: 414837 - RNA, 12 nt, Bordetella pertussis
gcgugcggaugg

SEQ ID NO: 414838 - RNA, 17 nt, Bordetella pertussis
gcgugcggcccagccgc

SEQ ID NO: 414839 - RNA, 14 nt, Bordetella pertussis
gcgugcgcggcgug

SEQ ID NO: 414840 - RNA, 15 nt, Bordetella pertussis
gcgugcggggcggca

SEQ ID NO: 414841 - RNA, 13 nt, Bordetella pertussis
gcgugcuggcgca

SEQ ID NO: 414842 - RNA, 16 nt, Bordetella pertussis
gcgugcuggcgcagca

SEQ ID NO: 414843 - RNA, 17 nt, Bordetella pertussis
gcguggaaccgccgcuu

SEQ ID NO: 414844 - RNA, 20 nt, Bordetella pertussis
gcguggaacgaccacggaau

SEQ ID NO: 414845 - RNA, 18 nt, Bordetella pertussis
gcguggaagguccacggc

SEQ ID NO: 414846 - RNA, 19 nt, Bordetella pertussis
gcguggauuuugcggaagg

SEQ ID NO: 414847 - RNA, 19 nt, Bordetella pertussis
gcguggccaccaggcgcgc

SEQ ID NO: 414848 - RNA, 13 nt, Bordetella pertussis
gcguggccgccgg

SEQ ID NO: 414849 - RNA, 18 nt, Bordetella pertussis
gcguggccucuugcguga

SEQ ID NO: 414850 - RNA, 20 nt, Bordetella pertussis
gcguggccugcccgucgggc

SEQ ID NO: 414851 - RNA, 14 nt, Bordetella pertussis
gcguggcgacgcgc

SEQ ID NO: 414852 - RNA, 23 nt, Bordetella pertussis
gcguggcgcgcacacuggccagc

SEQ ID NO: 414853 - RNA, 15 nt, Bordetella pertussis
gcguggcgcgccagc

SEQ ID NO: 414854 - RNA, 15 nt, Bordetella pertussis
gcguggcgcgcccgc

SEQ ID NO: 414855 - RNA, 13 nt, Bordetella pertussis
gcguggcgcgcgc

SEQ ID NO: 414856 - RNA, 15 nt, Bordetella pertussis
gcguggcgcgcgccg

SEQ ID NO: 414857 - RNA, 16 nt, Bordetella pertussis
gcguggcggccaggcc

SEQ ID NO: 414858 - RNA, 12 nt, Bordetella pertussis
gcguggcggcgc

SEQ ID NO: 414859 - RNA, 12 nt, Bordetella pertussis
gcguggcggcgu

SEQ ID NO: 414860 - RNA, 23 nt, Bordetella pertussis
gcguggcguaauagcuggcggcg

SEQ ID NO: 414861 - RNA, 17 nt, Bordetella pertussis
gcguggcgugccgcagc

SEQ ID NO: 414862 - RNA, 17 nt, Bordetella pertussis
gcgugggcggcggcaug

SEQ ID NO: 414863 - RNA, 17 nt, Bordetella pertussis
gcguggggacgcgggcc

SEQ ID NO: 414864 - RNA, 19 nt, Bordetella pertussis
gcguggggagcgcggcccg

SEQ ID NO: 414865 - RNA, 18 nt, Bordetella pertussis
gcgugguaucgcgccagc

SEQ ID NO: 414866 - RNA, 20 nt, Bordetella pertussis
gcgugguaucgcgccagcgc

SEQ ID NO: 414867 - RNA, 21 nt, Bordetella pertussis
gcgugguaucgcgccagcgcc

SEQ ID NO: 414868 - RNA, 16 nt, Bordetella pertussis
gcgugguauugguggu

SEQ ID NO: 414869 - RNA, 20 nt, Bordetella pertussis
gcgugguauugguggucugg

SEQ ID NO: 414870 - RNA, 16 nt, Bordetella pertussis
gcguguaggcggccgg

SEQ ID NO: 414871 - RNA, 16 nt, Bordetella pertussis
gcgugugcccagcacc

SEQ ID NO: 414872 - RNA, 21 nt, Bordetella pertussis
gcguguggugaaagccgccgg

SEQ ID NO: 414873 - RNA, 23 nt, Bordetella pertussis
gcguucaccaggaagcgcgccug

SEQ ID NO: 414874 - RNA, 14 nt, Bordetella pertussis
gcguucagcagcag

SEQ ID NO: 414875 - RNA, 15 nt, Bordetella pertussis
gcguucaggcgcggc

SEQ ID NO: 414876 - RNA, 19 nt, Bordetella pertussis
gcguucagggcgccgcggc

SEQ ID NO: 414877 - RNA, 19 nt, Bordetella pertussis
gcguucgaaagccagcgcc

SEQ ID NO: 414878 - RNA, 15 nt, Bordetella pertussis
gcguucgacgggcag

SEQ ID NO: 414879 - RNA, 14 nt, Bordetella pertussis
gcguucgcaccagu

SEQ ID NO: 414880 - RNA, 14 nt, Bordetella pertussis
gcguucgccgcagc

SEQ ID NO: 414881 - RNA, 22 nt, Bordetella pertussis
gcguucgcggugggcagcggca

SEQ ID NO: 414882 - RNA, 15 nt, Bordetella pertussis
gcguucggccacuuc

SEQ ID NO: 414883 - RNA, 16 nt, Bordetella pertussis
gcguucggccacuucc

SEQ ID NO: 414884 - RNA, 14 nt, Bordetella pertussis
gcguucggccagcc

SEQ ID NO: 414885 - RNA, 16 nt, Bordetella pertussis
gcguucgguggcgugg

SEQ ID NO: 414886 - RNA, 18 nt, Bordetella pertussis
gcguucugcagcgcggug

SEQ ID NO: 414887 - RNA, 19 nt, Bordetella pertussis
gcguugaucaucggcccga

SEQ ID NO: 414888 - RNA, 14 nt, Bordetella pertussis
gcguugccggccug

SEQ ID NO: 414889 - RNA, 14 nt, Bordetella pertussis
gcguugcgcccugc

SEQ ID NO: 414890 - RNA, 20 nt, Bordetella pertussis
gcguugcuggcaaagcgcgc

SEQ ID NO: 414891 - RNA, 15 nt, Bordetella pertussis
gcguuggcauggcgc

SEQ ID NO: 414892 - RNA, 14 nt, Bordetella pertussis
gcguuggcgcggcg

SEQ ID NO: 414893 - RNA, 14 nt, Bordetella pertussis
gcguuggcggccgg

SEQ ID NO: 414894 - RNA, 16 nt, Bordetella pertussis
gcguuucccucggugc

SEQ ID NO: 414895 - RNA, 18 nt, Bordetella pertussis
gcguuucggucagggcga

SEQ ID NO: 414896 - RNA, 22 nt, Bordetella pertussis
gcguuuucuggccuuccugcug

SEQ ID NO: 414897 - RNA, 16 nt, Bordetella pertussis
gcguuuuggcgagcag

SEQ ID NO: 414898 - RNA, 14 nt, Bordetella pertussis
gcuacacccugcuc

SEQ ID NO: 414899 - RNA, 16 nt, Bordetella pertussis
gcuacaccgugcuggc

SEQ ID NO: 414900 - RNA, 21 nt, Bordetella pertussis
gcuaccacguggucuggaaug

SEQ ID NO: 414901 - RNA, 13 nt, Bordetella pertussis
gcuaccccggcag

SEQ ID NO: 414902 - RNA, 14 nt, Bordetella pertussis
gcuaccccggcagc

SEQ ID NO: 414903 - RNA, 20 nt, Bordetella pertussis
gcuacgcgggcuugcugccc

SEQ ID NO: 414904 - RNA, 19 nt, Bordetella pertussis
gcuacguguccugccgggg

SEQ ID NO: 414905 - RNA, 12 nt, Bordetella pertussis
gcuagccaccga

SEQ ID NO: 414906 - RNA, 17 nt, Bordetella pertussis
gcuaggcgcagcaggcc

SEQ ID NO: 414907 - RNA, 18 nt, Bordetella pertussis
gcuaggcgcagcaggcca

SEQ ID NO: 414908 - RNA, 16 nt, Bordetella pertussis
gcuauaccgucguccu

SEQ ID NO: 414909 - RNA, 18 nt, Bordetella pertussis
gcuaucguggcuggcgag

SEQ ID NO: 414910 - RNA, 21 nt, Bordetella pertussis
gcuaugcaggcuuugcuggcc

SEQ ID NO: 414911 - RNA, 18 nt, Bordetella pertussis
gcuaugcgggcuugcugc

SEQ ID NO: 414912 - RNA, 14 nt, Bordetella pertussis
gcucaacggccacc

SEQ ID NO: 414913 - RNA, 17 nt, Bordetella pertussis
gcucaaccucgacgcgc

SEQ ID NO: 414914 - RNA, 19 nt, Bordetella pertussis
gcucaaccucgacgcgcau

SEQ ID NO: 414915 - RNA, 22 nt, Bordetella pertussis
gcucacagggucaaggcgcggc

SEQ ID NO: 414916 - RNA, 16 nt, Bordetella pertussis
gcucagagccccagga

SEQ ID NO: 414917 - RNA, 17 nt, Bordetella pertussis
gcucagagccccaggaa

SEQ ID NO: 414918 - RNA, 15 nt, Bordetella pertussis
gcucagcaccaggcc

SEQ ID NO: 414919 - RNA, 19 nt, Bordetella pertussis
gcucagcaccaggccgccg

SEQ ID NO: 414920 - RNA, 20 nt, Bordetella pertussis
gcucagcaccaggccgccgg

SEQ ID NO: 414921 - RNA, 22 nt, Bordetella pertussis
gcucagcaccaggccgccggcc

SEQ ID NO: 414922 - RNA, 11 nt, Bordetella pertussis
gcucagcagcg

SEQ ID NO: 414923 - RNA, 19 nt, Bordetella pertussis
gcucagccuugucgcgggc

SEQ ID NO: 414924 - RNA, 17 nt, Bordetella pertussis
gcucagcgccaucaucg

SEQ ID NO: 414925 - RNA, 18 nt, Bordetella pertussis
gcucagcgcggcgcggcc

SEQ ID NO: 414926 - RNA, 15 nt, Bordetella pertussis
gcucaggaaccagcg

SEQ ID NO: 414927 - RNA, 15 nt, Bordetella pertussis
gcucaggccgccggc

SEQ ID NO: 414928 - RNA, 15 nt, Bordetella pertussis
gcucaggccugcacg

SEQ ID NO: 414929 - RNA, 14 nt, Bordetella pertussis
gcucaggcgcggau

SEQ ID NO: 414930 - RNA, 17 nt, Bordetella pertussis
gcucaggcugcgcgucg

SEQ ID NO: 414931 - RNA, 21 nt, Bordetella pertussis
gcucagggggcgccccaacgc

SEQ ID NO: 414932 - RNA, 20 nt, Bordetella pertussis
gcucagguagaccacgcgcu

SEQ ID NO: 414933 - RNA, 20 nt, Bordetella pertussis
gcucagucggccuggcgcuc

SEQ ID NO: 414934 - RNA, 19 nt, Bordetella pertussis
gcucagucgggcagcgccc

SEQ ID NO: 414935 - RNA, 22 nt, Bordetella pertussis
gcucaguugguagagcagcuca

SEQ ID NO: 414936 - RNA, 20 nt, Bordetella pertussis
gcucauggaggggcgcaggc

SEQ ID NO: 414937 - RNA, 15 nt, Bordetella pertussis
gcucauucggcgcgc

SEQ ID NO: 414938 - RNA, 17 nt, Bordetella pertussis
gcucauucggcgcgcuc

SEQ ID NO: 414939 - RNA, 16 nt, Bordetella pertussis
gcuccacgugcggcag

SEQ ID NO: 414940 - RNA, 14 nt, Bordetella pertussis
gcuccagagcgcgc

SEQ ID NO: 414941 - RNA, 16 nt, Bordetella pertussis
gcuccagcucagcagc

SEQ ID NO: 414942 - RNA, 16 nt, Bordetella pertussis
gcuccagcuggcgcac

SEQ ID NO: 414943 - RNA, 21 nt, Bordetella pertussis
gcuccaggaaaaccuccuccg

SEQ ID NO: 414944 - RNA, 23 nt, Bordetella pertussis
gcuccaggccggcaugcgccggc

SEQ ID NO: 414945 - RNA, 12 nt, Bordetella pertussis
gcucccaguucu

SEQ ID NO: 414946 - RNA, 19 nt, Bordetella pertussis
gcucccccaugcggggaca

SEQ ID NO: 414947 - RNA, 21 nt, Bordetella pertussis
gcucccccaugcggggacagg

SEQ ID NO: 414948 - RNA, 14 nt, Bordetella pertussis
gcuccccgggcacc

SEQ ID NO: 414949 - RNA, 15 nt, Bordetella pertussis
gcuccccgggcacca

SEQ ID NO: 414950 - RNA, 16 nt, Bordetella pertussis
gcuccccugcuaaggg

SEQ ID NO: 414951 - RNA, 14 nt, Bordetella pertussis
gcucccgcgcugcc

SEQ ID NO: 414952 - RNA, 20 nt, Bordetella pertussis
gcucccgcgcugccgcugca

SEQ ID NO: 414953 - RNA, 17 nt, Bordetella pertussis
gcucgcgcagcaggccg

SEQ ID NO: 414954 - RNA, 14 nt, Bordetella pertussis
gcucgcgcaggcgu

SEQ ID NO: 414955 - RNA, 14 nt, Bordetella pertussis
gcucgcgccaggcc

SEQ ID NO: 414956 - RNA, 15 nt, Bordetella pertussis
gcucgcgccaggccc

SEQ ID NO: 414957 - RNA, 21 nt, Bordetella pertussis
gcucgcgcccaucucggccgc

SEQ ID NO: 414958 - RNA, 16 nt, Bordetella pertussis
gcucgcgcgcaguccu

SEQ ID NO: 414959 - RNA, 17 nt, Bordetella pertussis
gcucgcgcgcgcgggcg

SEQ ID NO: 414960 - RNA, 17 nt, Bordetella pertussis
gcucgcgcucgcccggc

SEQ ID NO: 414961 - RNA, 20 nt, Bordetella pertussis
gcucgcgcucggccagcaug

SEQ ID NO: 414962 - RNA, 15 nt, Bordetella pertussis
gcucgcgcugcagga

SEQ ID NO: 414963 - RNA, 17 nt, Bordetella pertussis
gcucgcgcugcgcgccg

SEQ ID NO: 414964 - RNA, 18 nt, Bordetella pertussis
gcucgcgcugcgcgccgc

SEQ ID NO: 414965 - RNA, 15 nt, Bordetella pertussis
gcucggaccuggcca

SEQ ID NO: 414966 - RNA, 17 nt, Bordetella pertussis
gcucggaccuggccagc

SEQ ID NO: 414967 - RNA, 16 nt, Bordetella pertussis
gcucggccacgcgcug

SEQ ID NO: 414968 - RNA, 14 nt, Bordetella pertussis
gcucggcauggcga

SEQ ID NO: 414969 - RNA, 19 nt, Bordetella pertussis
gcucggccucggucagggu

SEQ ID NO: 414970 - RNA, 20 nt, Bordetella pertussis
gcucggccucggucagggug

SEQ ID NO: 414971 - RNA, 19 nt, Bordetella pertussis
gcucggcgaagccgcagcg

SEQ ID NO: 414972 - RNA, 17 nt, Bordetella pertussis
gcucggcgccgggcugg

SEQ ID NO: 414973 - RNA, 20 nt, Bordetella pertussis
gcucggcggcaucguucagg

SEQ ID NO: 414974 - RNA, 18 nt, Bordetella pertussis
gcucggcuuccugccgca

SEQ ID NO: 414975 - RNA, 20 nt, Bordetella pertussis
gcucgggacgcaggcccaug

SEQ ID NO: 414976 - RNA, 19 nt, Bordetella pertussis
gcucgggcagcagcagggc

SEQ ID NO: 414977 - RNA, 13 nt, Bordetella pertussis
gcucgggcagcuc

SEQ ID NO: 414978 - RNA, 13 nt, Bordetella pertussis
gcucgggcgccuc

SEQ ID NO: 414979 - RNA, 19 nt, Bordetella pertussis
gcucgguguggauggcggu

SEQ ID NO: 414980 - RNA, 21 nt, Bordetella pertussis
gcucguagaucuugccggccg

SEQ ID NO: 414981 - RNA, 22 nt, Bordetella pertussis
gcucguagaucuugccggccgu

SEQ ID NO: 414982 - RNA, 20 nt, Bordetella pertussis
gcucguagcugucgaccgga

SEQ ID NO: 414983 - RNA, 14 nt, Bordetella pertussis
gcucgucccccuac

SEQ ID NO: 414984 - RNA, 21 nt, Bordetella pertussis
gcucgucccccuacugcccuc

SEQ ID NO: 414985 - RNA, 22 nt, Bordetella pertussis
gcucguugcgcaagccgcccgc

SEQ ID NO: 414986 - RNA, 17 nt, Bordetella pertussis
gcucugaucgcgcugga

SEQ ID NO: 414987 - RNA, 21 nt, Bordetella pertussis
gcucugcaccuugggcgccug

SEQ ID NO: 414988 - RNA, 16 nt, Bordetella pertussis
gcucuggcacaccagc

SEQ ID NO: 414989 - RNA, 22 nt, Bordetella pertussis
gcucuggcacaccagcgccagg

SEQ ID NO: 414990 - RNA, 23 nt, Bordetella pertussis
gcucuggcccgccucaaccuucu

SEQ ID NO: 414991 - RNA, 21 nt, Bordetella pertussis
gcucuuccaucuacgugcugg

SEQ ID NO: 414992 - RNA, 19 nt, Bordetella pertussis
gcucuuccgagauggccuu

SEQ ID NO: 414993 - RNA, 14 nt, Bordetella pertussis
gcucuugaccuggg

SEQ ID NO: 414994 - RNA, 14 nt, Bordetella pertussis
gcucuugagcgcgg

SEQ ID NO: 414995 - RNA, 18 nt, Bordetella pertussis
gcucuugagcgcggccuc

SEQ ID NO: 414996 - RNA, 19 nt, Bordetella pertussis
gcucuugcucaucaccagc

SEQ ID NO: 414997 - RNA, 22 nt, Bordetella pertussis
gcucuuggcaaccucgccgcgc

SEQ ID NO: 414998 - RNA, 24 nt, Bordetella pertussis
gcucuuuuucgagccgcagaacag

SEQ ID NO: 414999 - RNA, 15 nt, Bordetella pertussis
gcugaccagcgcguc

SEQ ID NO: 415000 - RNA, 19 nt, Bordetella pertussis
gcugaccgaagcgcgggcg

SEQ ID NO: 415001 - RNA, 18 nt, Bordetella pertussis
gcugaccgacgugcgccg

SEQ ID NO: 415002 - RNA, 14 nt, Bordetella pertussis
gcugaccggccugg

SEQ ID NO: 415003 - RNA, 15 nt, Bordetella pertussis
gcugaccggccuggu

SEQ ID NO: 415004 - RNA, 14 nt, Bordetella pertussis
gcugaccggcggca

SEQ ID NO: 415005 - RNA, 20 nt, Bordetella pertussis
gcugacgcgauacugcgcau

SEQ ID NO: 415006 - RNA, 18 nt, Bordetella pertussis
gcugaugagaucgcccgc

SEQ ID NO: 415007 - RNA, 15 nt, Bordetella pertussis
gcugaugcaggccug

SEQ ID NO: 415008 - RNA, 21 nt, Bordetella pertussis
gcugaugcgcgucaggcgagc

SEQ ID NO: 415009 - RNA, 23 nt, Bordetella pertussis
gcugaugcgcgucaggcgagcgc

SEQ ID NO: 415010 - RNA, 21 nt, Bordetella pertussis
gcugauggccgccagcggcug

SEQ ID NO: 415011 - RNA, 15 nt, Bordetella pertussis
gcugauggccuugga

SEQ ID NO: 415012 - RNA, 17 nt, Bordetella pertussis
gcugauggcggucacca

SEQ ID NO: 415013 - RNA, 21 nt, Bordetella pertussis
gcugcaauugcgcggccaugc

SEQ ID NO: 415014 - RNA, 15 nt, Bordetella pertussis
gcugcacagggacca

SEQ ID NO: 415015 - RNA, 15 nt, Bordetella pertussis
gcugcaccagcgcgc

SEQ ID NO: 415016 - RNA, 20 nt, Bordetella pertussis
gcugcacgauguugccgccg

SEQ ID NO: 415017 - RNA, 18 nt, Bordetella pertussis
gcugcacgcgcgcgggcg

SEQ ID NO: 415018 - RNA, 14 nt, Bordetella pertussis
gcugcacgcggccg

SEQ ID NO: 415019 - RNA, 17 nt, Bordetella pertussis
gcugcaguaugcaaccg

SEQ ID NO: 415020 - RNA, 15 nt, Bordetella pertussis
gcugcaugggcggcc

SEQ ID NO: 415021 - RNA, 16 nt, Bordetella pertussis
gcugcaugggcggccc

SEQ ID NO: 415022 - RNA, 18 nt, Bordetella pertussis
gcugcauguccugcaggu

SEQ ID NO: 415023 - RNA, 20 nt, Bordetella pertussis
gcugccagugguccaucagg

SEQ ID NO: 415024 - RNA, 18 nt, Bordetella pertussis
gcugccaugccgcgcgcc

SEQ ID NO: 415025 - RNA, 17 nt, Bordetella pertussis
gcugccauuccagcucc

SEQ ID NO: 415026 - RNA, 15 nt, Bordetella pertussis
gcugcccaccgccgu

SEQ ID NO: 415027 - RNA, 13 nt, Bordetella pertussis
gcugcccagccac

SEQ ID NO: 415028 - RNA, 19 nt, Bordetella pertussis
gcugccccccgagggggcu

SEQ ID NO: 415029 - RNA, 17 nt, Bordetella pertussis
gcugcccgaagcgcagc

SEQ ID NO: 415030 - RNA, 22 nt, Bordetella pertussis
gcugcccuacgacacgcucaag

SEQ ID NO: 415031 - RNA, 19 nt, Bordetella pertussis
gcugcccucgcccgugcgc

SEQ ID NO: 415032 - RNA, 23 nt, Bordetella pertussis
gcugcccucggucagcgccaggg

SEQ ID NO: 415033 - RNA, 14 nt, Bordetella pertussis
gcugcccugcugcu

SEQ ID NO: 415034 - RNA, 18 nt, Bordetella pertussis
gcugcccuggcccaggcc

SEQ ID NO: 415035 - RNA, 14 nt, Bordetella pertussis
gcugcccuugcugu

SEQ ID NO: 415036 - RNA, 15 nt, Bordetella pertussis
gcugcggcgcggcgc

SEQ ID NO: 415037 - RNA, 14 nt, Bordetella pertussis
gcugcgggccggcg

SEQ ID NO: 415038 - RNA, 19 nt, Bordetella pertussis
gcugcgggcgcaagccagc

SEQ ID NO: 415039 - RNA, 14 nt, Bordetella pertussis
gcugcgggcggccu

SEQ ID NO: 415040 - RNA, 22 nt, Bordetella pertussis
gcugcgguuguauugcgucagg

SEQ ID NO: 415041 - RNA, 17 nt, Bordetella pertussis
gcugcgucuugagcagg

SEQ ID NO: 415042 - RNA, 17 nt, Bordetella pertussis
gcugcucgagcaugcgg

SEQ ID NO: 415043 - RNA, 16 nt, Bordetella pertussis
gcugcucgcggcacug

SEQ ID NO: 415044 - RNA, 17 nt, Bordetella pertussis
gcugcucgcggcacuga

SEQ ID NO: 415045 - RNA, 15 nt, Bordetella pertussis
gcugcucuccaugcu

SEQ ID NO: 415046 - RNA, 19 nt, Bordetella pertussis
gcugcugaccgacggccug

SEQ ID NO: 415047 - RNA, 12 nt, Bordetella pertussis
gcugcugcagcc

SEQ ID NO: 415048 - RNA, 17 nt, Bordetella pertussis
gcugcugucgcgcgacu

SEQ ID NO: 415049 - RNA, 14 nt, Bordetella pertussis
gcugcuugaccuug

SEQ ID NO: 415050 - RNA, 17 nt, Bordetella pertussis
gcugcuugaccuuggcu

SEQ ID NO: 415051 - RNA, 14 nt, Bordetella pertussis
gcugcuuucccugu

SEQ ID NO: 415052 - RNA, 19 nt, Bordetella pertussis
gcuggaccccuugcggccg

SEQ ID NO: 415053 - RNA, 12 nt, Bordetella pertussis
gcuggacccgcu

SEQ ID NO: 415054 - RNA, 13 nt, Bordetella pertussis
gcuggaccgccug

SEQ ID NO: 415055 - RNA, 17 nt, Bordetella pertussis
gcuggaccgccuggccu

SEQ ID NO: 415056 - RNA, 15 nt, Bordetella pertussis
gcuggaccugcuguu

SEQ ID NO: 415057 - RNA, 15 nt, Bordetella pertussis
gcuggaccuggccac

SEQ ID NO: 415058 - RNA, 22 nt, Bordetella pertussis
gcuggacgaggcgauggucggc

SEQ ID NO: 415059 - RNA, 21 nt, Bordetella pertussis
gcuggacgcuuucggggcgca

SEQ ID NO: 415060 - RNA, 16 nt, Bordetella pertussis
gcuggagaccggcaug

SEQ ID NO: 415061 - RNA, 20 nt, Bordetella pertussis
gcuggagaucgccgagcggc

SEQ ID NO: 415062 - RNA, 19 nt, Bordetella pertussis
gcuggacuauggccuggau

SEQ ID NO: 415063 - RNA, 18 nt, Bordetella pertussis
gcuggagcgccacgccgu

SEQ ID NO: 415064 - RNA, 14 nt, Bordetella pertussis
gcuggaggccggcg

SEQ ID NO: 415065 - RNA, 23 nt, Bordetella pertussis
gcuggaggccggcgugcuguccg

SEQ ID NO: 415066 - RNA, 14 nt, Bordetella pertussis
gcuggcagccuuga

SEQ ID NO: 415067 - RNA, 18 nt, Bordetella pertussis
gcuggcauggaacgggcg

SEQ ID NO: 415068 - RNA, 16 nt, Bordetella pertussis
gcuggccaagcgcgcc

SEQ ID NO: 415069 - RNA, 17 nt, Bordetella pertussis
gcuggccaagcgcgccg

SEQ ID NO: 415070 - RNA, 22 nt, Bordetella pertussis
gcuggccaccgucgccaccuuc

SEQ ID NO: 415071 - RNA, 11 nt, Bordetella pertussis
gcuggccacgu

SEQ ID NO: 415072 - RNA, 20 nt, Bordetella pertussis
gcuggccagcgguacgccga

SEQ ID NO: 415073 - RNA, 14 nt, Bordetella pertussis
gcuggccagcuggc

SEQ ID NO: 415074 - RNA, 23 nt, Bordetella pertussis
gcuggcccacucggugcgcgcgc

SEQ ID NO: 415075 - RNA, 15 nt, Bordetella pertussis
gcuggcccagcuggg

SEQ ID NO: 415076 - RNA, 17 nt, Bordetella pertussis
gcuggcccagcugggcg

SEQ ID NO: 415077 - RNA, 14 nt, Bordetella pertussis
gcuggccccagaug

SEQ ID NO: 415078 - RNA, 14 nt, Bordetella pertussis
gcuggcccgccagc

SEQ ID NO: 415079 - RNA, 11 nt, Bordetella pertussis
gcuggcccggg

SEQ ID NO: 415080 - RNA, 13 nt, Bordetella pertussis
gcuggcccgucau

SEQ ID NO: 415081 - RNA, 12 nt, Bordetella pertussis
gcuggcccgcgc

SEQ ID NO: 415082 - RNA, 12 nt, Bordetella pertussis
gcuggcccuggc

SEQ ID NO: 415083 - RNA, 18 nt, Bordetella pertussis
gcuggccgacgcgcuggu

SEQ ID NO: 415084 - RNA, 22 nt, Bordetella pertussis
gcuggccgaucaccugcaggcc

SEQ ID NO: 415085 - RNA, 19 nt, Bordetella pertussis
gcuggccgaucugcugggc

SEQ ID NO: 415086 - RNA, 23 nt, Bordetella pertussis
gcuggccgaucugcugggccggg

SEQ ID NO: 415087 - RNA, 12 nt, Bordetella pertussis
gcuggccgccgc

SEQ ID NO: 415088 - RNA, 16 nt, Bordetella pertussis
gcuggccgccgcgcuc

SEQ ID NO: 415089 - RNA, 19 nt, Bordetella pertussis
gcuggccgccggcgcggug

SEQ ID NO: 415090 - RNA, 18 nt, Bordetella pertussis
gcuggccgcgcccgccgc

SEQ ID NO: 415091 - RNA, 18 nt, Bordetella pertussis
gcuggccggcguggccug

SEQ ID NO: 415092 - RNA, 15 nt, Bordetella pertussis
gcuggcgaggaccug

SEQ ID NO: 415093 - RNA, 19 nt, Bordetella pertussis
gcuggcgaucaggccgccc

SEQ ID NO: 415094 - RNA, 15 nt, Bordetella pertussis
gcuggcgaugcccac

SEQ ID NO: 415095 - RNA, 19 nt, Bordetella pertussis
gcuggcgaugcccaccagc

SEQ ID NO: 415096 - RNA, 20 nt, Bordetella pertussis
gcuggcgaugcccaccagcc

SEQ ID NO: 415097 - RNA, 20 nt, Bordetella pertussis
gcuggcgcagcagcgccggc

SEQ ID NO: 415098 - RNA, 22 nt, Bordetella pertussis
gcuggcgcagcagcgccggcag

SEQ ID NO: 415099 - RNA, 14 nt, Bordetella pertussis
gcuggcgcagcagg

SEQ ID NO: 415100 - RNA, 15 nt, Bordetella pertussis
gcuggcgcagcaggc

SEQ ID NO: 415101 - RNA, 19 nt, Bordetella pertussis
gcuggcgcauggcuggucc

SEQ ID NO: 415102 - RNA, 18 nt, Bordetella pertussis
gcuggcgcaccaggcugg

SEQ ID NO: 415103 - RNA, 14 nt, Bordetella pertussis
gcuggcgcccgccu

SEQ ID NO: 415104 - RNA, 16 nt, Bordetella pertussis
gcuggcgcgcaccauc

SEQ ID NO: 415105 - RNA, 22 nt, Bordetella pertussis
gcuggcgcgagaaccaggccac

SEQ ID NO: 415106 - RNA, 15 nt, Bordetella pertussis
gcuggcgcggaccug

SEQ ID NO: 415107 - RNA, 17 nt, Bordetella pertussis
gcuggcgcggccguuug

SEQ ID NO: 415108 - RNA, 22 nt, Bordetella pertussis
gcuggcgcggcuggcgauggug

SEQ ID NO: 415109 - RNA, 20 nt, Bordetella pertussis
gcuggcgcgucggcgcgcgc

SEQ ID NO: 415110 - RNA, 14 nt, Bordetella pertussis
gcuggcgcgucugg

SEQ ID NO: 415111 - RNA, 17 nt, Bordetella pertussis
gcuggcgcuggccgccc

SEQ ID NO: 415112 - RNA, 17 nt, Bordetella pertussis
gcuggcgcuuggccagc

SEQ ID NO: 415113 - RNA, 15 nt, Bordetella pertussis
gcuggcggcccugcc

SEQ ID NO: 415114 - RNA, 17 nt, Bordetella pertussis
gcuggcggcgcaggccg

SEQ ID NO: 415115 - RNA, 20 nt, Bordetella pertussis
gcuggcggcgcgcggcuggg

SEQ ID NO: 415116 - RNA, 16 nt, Bordetella pertussis
gcuggcggcgcugguc

SEQ ID NO: 415117 - RNA, 22 nt, Bordetella pertussis
gcuggcgucgcgcuucuugucc

SEQ ID NO: 415118 - RNA, 17 nt, Bordetella pertussis
gcuggcguucagcgggc

SEQ ID NO: 415119 - RNA, 18 nt, Bordetella pertussis
gcuggcguuugcgcgcgc

SEQ ID NO: 415120 - RNA, 17 nt, Bordetella pertussis
gcuggcugagcaggccg

SEQ ID NO: 415121 - RNA, 16 nt, Bordetella pertussis
gcuggcugcccuggcg

SEQ ID NO: 415122 - RNA, 14 nt, Bordetella pertussis
gcuggcugggccug

SEQ ID NO: 415123 - RNA, 18 nt, Bordetella pertussis
gcuggcuguucgccaugu

SEQ ID NO: 415124 - RNA, 23 nt, Bordetella pertussis
gcuggcuguucgccauguucagc

SEQ ID NO: 415125 - RNA, 18 nt, Bordetella pertussis
gcuggcuucggcgcuggg

SEQ ID NO: 415126 - RNA, 19 nt, Bordetella pertussis
gcuggcuucggcgcugggc

SEQ ID NO: 415127 - RNA, 16 nt, Bordetella pertussis
gcugggacaggcacuc

SEQ ID NO: 415128 - RNA, 18 nt, Bordetella pertussis
gcugggacaggcacucug

SEQ ID NO: 415129 - RNA, 22 nt, Bordetella pertussis
gcugggaggcgugcugcaccug

SEQ ID NO: 415130 - RNA, 20 nt, Bordetella pertussis
gcugggauggguacgccggc

SEQ ID NO: 415131 - RNA, 23 nt, Bordetella pertussis
gcugggauggguacgccggccug

SEQ ID NO: 415132 - RNA, 22 nt, Bordetella pertussis
gcugggcacauccagcgccagc

SEQ ID NO: 415133 - RNA, 14 nt, Bordetella pertussis
gcugggcaggcugg

SEQ ID NO: 415134 - RNA, 21 nt, Bordetella pertussis
gcugggcaggcuggcgcgguc

SEQ ID NO: 415135 - RNA, 17 nt, Bordetella pertussis
gcugggcaugggcggcc

SEQ ID NO: 415136 - RNA, 21 nt, Bordetella pertussis
gcugggccagaccgcgcgcac

SEQ ID NO: 415137 - RNA, 15 nt, Bordetella pertussis
gcugggccggcgcgc

SEQ ID NO: 415138 - RNA, 17 nt, Bordetella pertussis
gcugggccggcgcgcgc

SEQ ID NO: 415139 - RNA, 21 nt, Bordetella pertussis
gcugggccugcugucgcuggg

SEQ ID NO: 415140 - RNA, 13 nt, Bordetella pertussis
gcugggcgcgcac

SEQ ID NO: 415141 - RNA, 17 nt, Bordetella pertussis
gcugggcgcgccgcugc

SEQ ID NO: 415142 - RNA, 15 nt, Bordetella pertussis
gcugggcggccuugg

SEQ ID NO: 415143 - RNA, 18 nt, Bordetella pertussis
gcugggcggccuuggccg

SEQ ID NO: 415144 - RNA, 22 nt, Bordetella pertussis
gcugggcggccuuggccgcagc

SEQ ID NO: 415145 - RNA, 16 nt, Bordetella pertussis
gcugggcggcgggcac

SEQ ID NO: 415146 - RNA, 13 nt, Bordetella pertussis
gcugggcggcgug

SEQ ID NO: 415147 - RNA, 20 nt, Bordetella pertussis
gcugggcggcgugaccgcga

SEQ ID NO: 415148 - RNA, 13 nt, Bordetella pertussis
gcugggcgggcug

SEQ ID NO: 415149 - RNA, 16 nt, Bordetella pertussis
gcugggcgggcuggug

SEQ ID NO: 415150 - RNA, 20 nt, Bordetella pertussis
gcugggcgguugcgcugcug

SEQ ID NO: 415151 - RNA, 15 nt, Bordetella pertussis
gcuggggcaggcacu

SEQ ID NO: 415152 - RNA, 19 nt, Bordetella pertussis
gcuggggcugcugggccgg

SEQ ID NO: 415153 - RNA, 19 nt, Bordetella pertussis
gcugggguggagcgcggcg

SEQ ID NO: 415154 - RNA, 15 nt, Bordetella pertussis
gcugggucaucagca

SEQ ID NO: 415155 - RNA, 21 nt, Bordetella pertussis
gcuggguguagucgcggccgu

SEQ ID NO: 415156 - RNA, 14 nt, Bordetella pertussis
gcugguacagcccc

SEQ ID NO: 415157 - RNA, 16 nt, Bordetella pertussis
gcugguaguaggccac

SEQ ID NO: 415158 - RNA, 17 nt, Bordetella pertussis
gcugguaguaggccacu

SEQ ID NO: 415159 - RNA, 15 nt, Bordetella pertussis
gcuggucaaccuggu

SEQ ID NO: 415160 - RNA, 14 nt, Bordetella pertussis
gcuggugcuggugc

SEQ ID NO: 415161 - RNA, 18 nt, Bordetella pertussis
gcuggugcuggugcuggu

SEQ ID NO: 415162 - RNA, 19 nt, Bordetella pertussis
gcuggugcuggugcuggug

SEQ ID NO: 415163 - RNA, 18 nt, Bordetella pertussis
gcugguggccaccagccc

SEQ ID NO: 415164 - RNA, 22 nt, Bordetella pertussis
gcuguaccucagccugcuggug

SEQ ID NO: 415165 - RNA, 17 nt, Bordetella pertussis
gcuguccggcgcucgcc

SEQ ID NO: 415166 - RNA, 14 nt, Bordetella pertussis
gcugucgcgcugcc

SEQ ID NO: 415167 - RNA, 23 nt, Bordetella pertussis
gcugucggcgaugaacagguacc

SEQ ID NO: 415168 - RNA, 16 nt, Bordetella pertussis
gcugucggcgcuggcc

SEQ ID NO: 415169 - RNA, 15 nt, Bordetella pertussis
gcugucggucagcac

SEQ ID NO: 415170 - RNA, 20 nt, Bordetella pertussis
gcugugccccacacgcgcgc

SEQ ID NO: 415171 - RNA, 17 nt, Bordetella pertussis
gcugugcccgccccauu

SEQ ID NO: 415172 - RNA, 14 nt, Bordetella pertussis
gcugugcgauggca

SEQ ID NO: 415173 - RNA, 13 nt, Bordetella pertussis
gcuguggccgcgg

SEQ ID NO: 415174 - RNA, 16 nt, Bordetella pertussis
gcuguggccgcggccc

SEQ ID NO: 415175 - RNA, 13 nt, Bordetella pertussis
gcuguggcgcgcc

SEQ ID NO: 415176 - RNA, 17 nt, Bordetella pertussis
gcuuucgccgcgggccu

SEQ ID NO: 415177 - RNA, 21 nt, Bordetella pertussis
gcuuucggucucgcgcggccg

SEQ ID NO: 415178 - RNA, 19 nt, Bordetella pertussis
gcuuucuaucaucaggccc

SEQ ID NO: 415179 - RNA, 15 nt, Bordetella pertussis
gcuuuucgcaccuca

SEQ ID NO: 415180 - RNA, 19 nt, Bordetella pertussis
gcuuuucgcaccucacggu

SEQ ID NO: 415181 - RNA, 13 nt, Bordetella pertussis
gcuuuuugccuug

SEQ ID NO: 415182 - RNA, 17 nt, Bordetella pertussis
gcuuuuugccuugggca

SEQ ID NO: 415183 - RNA, 12 nt, Bordetella pertussis
gcuuuuuugccu

SEQ ID NO: 415184 - RNA, 20 nt, Bordetella pertussis
ggaaacagauugaacugcug

SEQ ID NO: 415185 - RNA, 22 nt, Bordetella pertussis
ggaaacgcccagcccugcccgc

SEQ ID NO: 415186 - RNA, 15 nt, Bordetella pertussis
ggaaacggaaacugc

SEQ ID NO: 415187 - RNA, 14 nt, Bordetella pertussis
ggaaagaggccagg

SEQ ID NO: 415188 - RNA, 18 nt, Bordetella pertussis
ggaaagaggccaggcccu

SEQ ID NO: 415189 - RNA, 15 nt, Bordetella pertussis
ggaaagcgccgccgc

SEQ ID NO: 415190 - RNA, 18 nt, Bordetella pertussis
ggaaauccgccgggugug

SEQ ID NO: 415191 - RNA, 23 nt, Bordetella pertussis
ggaaauccgggcgcugcgccggc

SEQ ID NO: 415192 - RNA, 19 nt, Bordetella pertussis
ggaaauccguaguccagca

SEQ ID NO: 415193 - RNA, 23 nt, Bordetella pertussis
ggaaauccguaguccagcagcag

SEQ ID NO: 415194 - RNA, 15 nt, Bordetella pertussis
ggaaaugccgcgcgc

SEQ ID NO: 415195 - RNA, 18 nt, Bordetella pertussis
ggaaaugccgcgcgcagg

SEQ ID NO: 415196 - RNA, 15 nt, Bordetella pertussis
ggaaaugccguccag

SEQ ID NO: 415197 - RNA, 19 nt, Bordetella pertussis
ggaaccgcaccggaggcgc

SEQ ID NO: 415198 - RNA, 21 nt, Bordetella pertussis
ggaaccgcgguacgcgggcau

SEQ ID NO: 415199 - RNA, 14 nt, Bordetella pertussis
ggaagagggcgggg

SEQ ID NO: 415200 - RNA, 21 nt, Bordetella pertussis
ggaagaucacauaggccggca

SEQ ID NO: 415201 - RNA, 18 nt, Bordetella pertussis
ggaagauguggucggcgc

SEQ ID NO: 415202 - RNA, 14 nt, Bordetella pertussis
ggaagcagcccagc

SEQ ID NO: 415203 - RNA, 21 nt, Bordetella pertussis
ggaagcugucggcgcuggcca

SEQ ID NO: 415204 - RNA, 22 nt, Bordetella pertussis
ggaagcugucggcgcuggccau

SEQ ID NO: 415205 - RNA, 13 nt, Bordetella pertussis
ggaaggccgccgc

SEQ ID NO: 415206 - RNA, 17 nt, Bordetella pertussis
ggaaucauuggccagcg

SEQ ID NO: 415207 - RNA, 23 nt, Bordetella pertussis
ggacauccguuucccgauuccag

SEQ ID NO: 415208 - RNA, 17 nt, Bordetella pertussis
ggaccaauaccugaucu

SEQ ID NO: 415209 - RNA, 17 nt, Bordetella pertussis
ggaccaauacgccgcca

SEQ ID NO: 415210 - RNA, 21 nt, Bordetella pertussis
ggaccagcgguugcgccagcu

SEQ ID NO: 415211 - RNA, 16 nt, Bordetella pertussis
ggaccagucgacccac

SEQ ID NO: 415212 - RNA, 15 nt, Bordetella pertussis
ggaccaugcgcuggg

SEQ ID NO: 415213 - RNA, 16 nt, Bordetella pertussis
ggaccaugcgcugggc

SEQ ID NO: 415214 - RNA, 15 nt, Bordetella pertussis
ggaccccgaagcaca

SEQ ID NO: 415215 - RNA, 22 nt, Bordetella pertussis
ggaccccguggucgccagcacg

SEQ ID NO: 415216 - RNA, 15 nt, Bordetella pertussis
ggacccggagcugcc

SEQ ID NO: 415217 - RNA, 18 nt, Bordetella pertussis
ggaccugagccaggcgcc

SEQ ID NO: 415218 - RNA, 19 nt, Bordetella pertussis
ggaccugccguucgcgcug

SEQ ID NO: 415219 - RNA, 13 nt, Bordetella pertussis
ggaccuggccagc

SEQ ID NO: 415220 - RNA, 22 nt, Bordetella pertussis
ggacgaugcgcgaagcgcccug

SEQ ID NO: 415221 - RNA, 17 nt, Bordetella pertussis
ggacgauggccugugcg

SEQ ID NO: 415222 - RNA, 22 nt, Bordetella pertussis
ggacgcaaccggucggccggca

SEQ ID NO: 415223 - RNA, 18 nt, Bordetella pertussis
ggacgcaccuuucugcug

SEQ ID NO: 415224 - RNA, 23 nt, Bordetella pertussis
ggacgcaccuuucugcugcucgc

SEQ ID NO: 415225 - RNA, 13 nt, Bordetella pertussis
ggacgcagcuucu

SEQ ID NO: 415226 - RNA, 15 nt, Bordetella pertussis
ggacgcaggcccagc

SEQ ID NO: 415227 - RNA, 22 nt, Bordetella pertussis
ggacgccaccagugcgccggcg

SEQ ID NO: 415228 - RNA, 16 nt, Bordetella pertussis
ggacgccauggcggcg

SEQ ID NO: 415229 - RNA, 21 nt, Bordetella pertussis
ggacgcccuggcgcaggccgg

SEQ ID NO: 415230 - RNA, 23 nt, Bordetella pertussis
ggacgcccuggcgcaggccggcg

SEQ ID NO: 415231 - RNA, 20 nt, Bordetella pertussis
ggacgccgaccucggcaccg

SEQ ID NO: 415232 - RNA, 19 nt, Bordetella pertussis
ggacgccggcgggcaggcg

SEQ ID NO: 415233 - RNA, 20 nt, Bordetella pertussis
ggacgccuggcgcggcccca

SEQ ID NO: 415234 - RNA, 21 nt, Bordetella pertussis
ggacggccaggggcagcucgg

SEQ ID NO: 415235 - RNA, 19 nt, Bordetella pertussis
ggacgggccaggccgaugc

SEQ ID NO: 415236 - RNA, 14 nt, Bordetella pertussis
ggacgggcgcacag

SEQ ID NO: 415237 - RNA, 16 nt, Bordetella pertussis
ggacgucugagcgccg

SEQ ID NO: 415238 - RNA, 20 nt, Bordetella pertussis
ggacgucugagcgccggggu

SEQ ID NO: 415239 - RNA, 18 nt, Bordetella pertussis
ggagaaaucgccgccggc

SEQ ID NO: 415240 - RNA, 14 nt, Bordetella pertussis
ggagaacugcucga

SEQ ID NO: 415241 - RNA, 16 nt, Bordetella pertussis
ggagacacgcuagggc

SEQ ID NO: 415242 - RNA, 16 nt, Bordetella pertussis
ggagacaucaugcaga

SEQ ID NO: 415243 - RNA, 20 nt, Bordetella pertussis
ggagaguucggugucggcgu

SEQ ID NO: 415244 - RNA, 22 nt, Bordetella pertussis
ggagaguucggugucggcgucc

SEQ ID NO: 415245 - RNA, 22 nt, Bordetella pertussis
ggagauccggccuuccaaguug

SEQ ID NO: 415246 - RNA, 15 nt, Bordetella pertussis
ggagaucgccgagcg

SEQ ID NO: 415247 - RNA, 18 nt, Bordetella pertussis
ggagauggguacagcgcg

SEQ ID NO: 415248 - RNA, 13 nt, Bordetella pertussis
ggagccguucugg

SEQ ID NO: 415249 - RNA, 21 nt, Bordetella pertussis
ggagccuguccccgccggggc

SEQ ID NO: 415250 - RNA, 23 nt, Bordetella pertussis
ggagcgacacccgcggccagggu

SEQ ID NO: 415251 - RNA, 13 nt, Bordetella pertussis
ggagcgcgggccg

SEQ ID NO: 415252 - RNA, 22 nt, Bordetella pertussis
ggagcggcucgccgcuccggca

SEQ ID NO: 415253 - RNA, 18 nt, Bordetella pertussis
ggagcgguugaaauccuu

SEQ ID NO: 415254 - RNA, 20 nt, Bordetella pertussis
ggagcgguugaaauccuuca

SEQ ID NO: 415255 - RNA, 15 nt, Bordetella pertussis
ggagcucguccccac

SEQ ID NO: 415256 - RNA, 23 nt, Bordetella pertussis
ggaggaagggugcggcgccacug

SEQ ID NO: 415257 - RNA, 17 nt, Bordetella pertussis
ggaggauacggccagcg

SEQ ID NO: 415258 - RNA, 13 nt, Bordetella pertussis
ggaggcgcagcgc

SEQ ID NO: 415259 - RNA, 13 nt, Bordetella pertussis
ggaggcgccgcgg

SEQ ID NO: 415260 - RNA, 15 nt, Bordetella pertussis
ggaggcggcggccgu

SEQ ID NO: 415261 - RNA, 23 nt, Bordetella pertussis
ggaggcuuugucguugauggggc

SEQ ID NO: 415262 - RNA, 16 nt, Bordetella pertussis
ggagggcuccaggcug

SEQ ID NO: 415263 - RNA, 19 nt, Bordetella pertussis
ggagggcuccaggcugagc

SEQ ID NO: 415264 - RNA, 14 nt, Bordetella pertussis
ggaggggccggcuu

SEQ ID NO: 415265 - RNA, 23 nt, Bordetella pertussis
ggagguaugcacgaccaggccgu

SEQ ID NO: 415266 - RNA, 22 nt, Bordetella pertussis
ggagguggcuggugccaguccc

SEQ ID NO: 415267 - RNA, 20 nt, Bordetella pertussis
ggaguagccgcucagguaga

SEQ ID NO: 415268 - RNA, 17 nt, Bordetella pertussis
ggagucggcgccgcgca

SEQ ID NO: 415269 - RNA, 15 nt, Bordetella pertussis
ggagucggucagccu

SEQ ID NO: 415270 - RNA, 14 nt, Bordetella pertussis
ggagucgugcagga

SEQ ID NO: 415271 - RNA, 18 nt, Bordetella pertussis
ggagugcgaggacgaccu

SEQ ID NO: 415272 - RNA, 21 nt, Bordetella pertussis
ggauagcgccguaccagcgcg

SEQ ID NO: 415273 - RNA, 18 nt, Bordetella pertussis
ggauagcggugcaggggc

SEQ ID NO: 415274 - RNA, 18 nt, Bordetella pertussis
ggauaggccucggccacc

SEQ ID NO: 415275 - RNA, 20 nt, Bordetella pertussis
ggaucacccagcggcuggcc

SEQ ID NO: 415276 - RNA, 17 nt, Bordetella pertussis
ggaucaccguucuuccg

SEQ ID NO: 415277 - RNA, 17 nt, Bordetella pertussis
ggaucaccgccggcggc

SEQ ID NO: 415278 - RNA, 18 nt, Bordetella pertussis
ggaucacgcuaaauacgc

SEQ ID NO: 415279 - RNA, 16 nt, Bordetella pertussis
ggaucacgugccagcc

SEQ ID NO: 415280 - RNA, 16 nt, Bordetella pertussis
ggauccccagcacaua

SEQ ID NO: 415281 - RNA, 21 nt, Bordetella pertussis
ggauccgccggugucggggcc

SEQ ID NO: 415282 - RNA, 14 nt, Bordetella pertussis
ggauccggcagcac

SEQ ID NO: 415283 - RNA, 15 nt, Bordetella pertussis
ggauccggcgcuggc

SEQ ID NO: 415284 - RNA, 14 nt, Bordetella pertussis
ggauccgugcggcg

SEQ ID NO: 415285 - RNA, 15 nt, Bordetella pertussis
ggaucgcgccaggcg

SEQ ID NO: 415286 - RNA, 14 nt, Bordetella pertussis
ggaucgcgcccagc

SEQ ID NO: 415287 - RNA, 15 nt, Bordetella pertussis
ggaucgcgcccagcg

SEQ ID NO: 415288 - RNA, 23 nt, Bordetella pertussis
ggauuguugcgaaacccgcuggg

SEQ ID NO: 415289 - RNA, 13 nt, Bordetella pertussis
ggauuuccagcuc

SEQ ID NO: 415290 - RNA, 19 nt, Bordetella pertussis
ggcaaacggcggcaggccg

SEQ ID NO: 415291 - RNA, 18 nt, Bordetella pertussis
ggcaaagucggggcgccg

SEQ ID NO: 415292 - RNA, 14 nt, Bordetella pertussis
ggcaacgugcaggc

SEQ ID NO: 415293 - RNA, 16 nt, Bordetella pertussis
ggcaacgugcaggcca

SEQ ID NO: 415294 - RNA, 14 nt, Bordetella pertussis
ggcaaucagcccca

SEQ ID NO: 415295 - RNA, 16 nt, Bordetella pertussis
ggcaaugguccagcag

SEQ ID NO: 415296 - RNA, 15 nt, Bordetella pertussis
ggcaaugucgcaggc

SEQ ID NO: 415297 - RNA, 19 nt, Bordetella pertussis
ggcaaugucgcaggccgcg

SEQ ID NO: 415298 - RNA, 19 nt, Bordetella pertussis
ggcacaaccuggcgcgcgg

SEQ ID NO: 415299 - RNA, 14 nt, Bordetella pertussis
ggcacaccagcgcc

SEQ ID NO: 415300 - RNA, 17 nt, Bordetella pertussis
ggcacaccagcgccagg

SEQ ID NO: 415301 - RNA, 14 nt, Bordetella pertussis
ggcacacccuccua

SEQ ID NO: 415302 - RNA, 13 nt, Bordetella pertussis
ggcacagcgcggc

SEQ ID NO: 415303 - RNA, 14 nt, Bordetella pertussis
ggcacagcgcggcg

SEQ ID NO: 415304 - RNA, 23 nt, Bordetella pertussis
ggcacagcgcggcgaaggcgcgg

SEQ ID NO: 415305 - RNA, 14 nt, Bordetella pertussis
ggcacaggaacagc

SEQ ID NO: 415306 - RNA, 17 nt, Bordetella pertussis
ggcacaggccaucggcg

SEQ ID NO: 415307 - RNA, 15 nt, Bordetella pertussis
ggcacauccagcgcc

SEQ ID NO: 415308 - RNA, 18 nt, Bordetella pertussis
ggcaccaccaccgcccgc

SEQ ID NO: 415309 - RNA, 13 nt, Bordetella pertussis
ggcaccagcaggc

SEQ ID NO: 415310 - RNA, 15 nt, Bordetella pertussis
ggcaccagcaggccg

SEQ ID NO: 415311 - RNA, 16 nt, Bordetella pertussis
ggcaccagcaggccgg

SEQ ID NO: 415312 - RNA, 21 nt, Bordetella pertussis
ggcaccagcgccacgcccagg

SEQ ID NO: 415313 - RNA, 16 nt, Bordetella pertussis
ggcaccaucgccgccu

SEQ ID NO: 415314 - RNA, 20 nt, Bordetella pertussis
ggcaccaucucccgcaggcc

SEQ ID NO: 415315 - RNA, 19 nt, Bordetella pertussis
ggcaccaugcgcgagggca

SEQ ID NO: 415316 - RNA, 20 nt, Bordetella pertussis
ggcacccccgaccgagccac

SEQ ID NO: 415317 - RNA, 17 nt, Bordetella pertussis
ggcacccgcgcgcagcg

SEQ ID NO: 415318 - RNA, 16 nt, Bordetella pertussis
ggcacccggcucagcc

SEQ ID NO: 415319 - RNA, 20 nt, Bordetella pertussis
ggcacccggcucagccucga

SEQ ID NO: 415320 - RNA, 23 nt, Bordetella pertussis
ggcaccgaacccugccucagacc

SEQ ID NO: 415321 - RNA, 19 nt, Bordetella pertussis
ggcaccgaacgggcguggc

SEQ ID NO: 415322 - RNA, 24 nt, Bordetella pertussis
ggcaccgaauacgucagagcccuu

SEQ ID NO: 415323 - RNA, 14 nt, Bordetella pertussis
ggcaccgagccgca

SEQ ID NO: 415324 - RNA, 17 nt, Bordetella pertussis
ggcaccgccgcacagcc

SEQ ID NO: 415325 - RNA, 15 nt, Bordetella pertussis
ggcaccgcgcagccc

SEQ ID NO: 415326 - RNA, 17 nt, Bordetella pertussis
ggcaccgcgcagcccgg

SEQ ID NO: 415327 - RNA, 18 nt, Bordetella pertussis
ggcaccgugaugcgcgcc

SEQ ID NO: 415328 - RNA, 20 nt, Bordetella pertussis
ggcaccgugaugcgcgccgc

SEQ ID NO: 415329 - RNA, 23 nt, Bordetella pertussis
ggcaccgugaugucgccgucggc

SEQ ID NO: 415330 - RNA, 13 nt, Bordetella pertussis
ggcaccucggccg

SEQ ID NO: 415331 - RNA, 15 nt, Bordetella pertussis
ggcaccucggccggg

SEQ ID NO: 415332 - RNA, 18 nt, Bordetella pertussis
ggcaccucggccggggcg

SEQ ID NO: 415333 - RNA, 19 nt, Bordetella pertussis
ggcaccucguucacccccc

SEQ ID NO: 415334 - RNA, 21 nt, Bordetella pertussis
ggcaccugcugcuugaccuug

SEQ ID NO: 415335 - RNA, 16 nt, Bordetella pertussis
ggcaccugggccuuca

SEQ ID NO: 415336 - RNA, 22 nt, Bordetella pertussis
ggcaccuuuuuccuugcgggcc

SEQ ID NO: 415337 - RNA, 23 nt, Bordetella pertussis
ggcaccuuuuuccuugcgggccu

SEQ ID NO: 415338 - RNA, 19 nt, Bordetella pertussis
ggcacgaaaagccgcggcc

SEQ ID NO: 415339 - RNA, 21 nt, Bordetella pertussis
ggcacgacgcugaugcccagc

SEQ ID NO: 415340 - RNA, 14 nt, Bordetella pertussis
ggcacgacggccuc

SEQ ID NO: 415341 - RNA, 16 nt, Bordetella pertussis
ggcacgacggccuccg

SEQ ID NO: 415342 - RNA, 15 nt, Bordetella pertussis
ggcacgacgcguuug

SEQ ID NO: 415343 - RNA, 15 nt, Bordetella pertussis
ggcacgaucaccgcc

SEQ ID NO: 415344 - RNA, 15 nt, Bordetella pertussis
ggcacgaucggcgcc

SEQ ID NO: 415345 - RNA, 18 nt, Bordetella pertussis
ggcacgauggccgcgccc

SEQ ID NO: 415346 - RNA, 16 nt, Bordetella pertussis
ggcacgcacagcaugc

SEQ ID NO: 415347 - RNA, 15 nt, Bordetella pertussis
ggcacgccggcggcg

SEQ ID NO: 415348 - RNA, 14 nt, Bordetella pertussis
ggcacgccggcggc

SEQ ID NO: 415349 - RNA, 17 nt, Bordetella pertussis
ggcacgccucgccggcc

SEQ ID NO: 415350 - RNA, 14 nt, Bordetella pertussis
ggcacgcgccagcu

SEQ ID NO: 415351 - RNA, 15 nt, Bordetella pertussis
ggcacgcgccaggcg

SEQ ID NO: 415352 - RNA, 12 nt, Bordetella pertussis
ggcacgcgcgcc

SEQ ID NO: 415353 - RNA, 22 nt, Bordetella pertussis
ggcacgcugcgcaggcgcgcgg

SEQ ID NO: 415354 - RNA, 15 nt, Bordetella pertussis
ggcacggccagcauu

SEQ ID NO: 415355 - RNA, 16 nt, Bordetella pertussis
ggcacggccagcggcg

SEQ ID NO: 415356 - RNA, 20 nt, Bordetella pertussis
ggcacggccggccaggcgcc

SEQ ID NO: 415357 - RNA, 14 nt, Bordetella pertussis
ggcacgggucaggc

SEQ ID NO: 415358 - RNA, 16 nt, Bordetella pertussis
ggcacgggucaggcug

SEQ ID NO: 415359 - RNA, 21 nt, Bordetella pertussis
ggcacgggucaggcugcggcg

SEQ ID NO: 415360 - RNA, 15 nt, Bordetella pertussis
ggcacguaguacagc

SEQ ID NO: 415361 - RNA, 20 nt, Bordetella pertussis
ggcacgucauugcaucgcag

SEQ ID NO: 415362 - RNA, 23 nt, Bordetella pertussis
ggcacgucauugcaucgcagcag

SEQ ID NO: 415363 - RNA, 20 nt, Bordetella pertussis
ggcacguccggcacggcggc

SEQ ID NO: 415364 - RNA, 16 nt, Bordetella pertussis
ggcacucggccauggu

SEQ ID NO: 415365 - RNA, 20 nt, Bordetella pertussis
ggcacucuugccgcugcgcg

SEQ ID NO: 415366 - RNA, 14 nt, Bordetella pertussis
ggcacugaugcugg

SEQ ID NO: 415367 - RNA, 16 nt, Bordetella pertussis
ggcacuggcgcggcgc

SEQ ID NO: 415368 - RNA, 22 nt, Bordetella pertussis
ggcacugucggcguuccuggcg

SEQ ID NO: 415369 - RNA, 23 nt, Bordetella pertussis
ggcagcaauucgaccggcagggu

SEQ ID NO: 415370 - RNA, 15 nt, Bordetella pertussis
ggcagcaccgcugcu

SEQ ID NO: 415371 - RNA, 18 nt, Bordetella pertussis
ggcagcacgauggcgccc

SEQ ID NO: 415372 - RNA, 19 nt, Bordetella pertussis
ggcagcacgcgcaccaggc

SEQ ID NO: 415373 - RNA, 21 nt, Bordetella pertussis
ggcagcacgcgcaccaggccu

SEQ ID NO: 415374 - RNA, 17 nt, Bordetella pertussis
ggcagcacuaccugcgc

SEQ ID NO: 415375 - RNA, 17 nt, Bordetella pertussis
ggcagcaccggggcagg

SEQ ID NO: 415376 - RNA, 22 nt, Bordetella pertussis
ggcagcagaucggcggccuggg

SEQ ID NO: 415377 - RNA, 16 nt, Bordetella pertussis
ggcagcagcagcgcgg

SEQ ID NO: 415378 - RNA, 14 nt, Bordetella pertussis
ggcagcagcagcgu

SEQ ID NO: 415379 - RNA, 13 nt, Bordetella pertussis
ggcagcagcaggg

SEQ ID NO: 415380 - RNA, 13 nt, Bordetella pertussis
ggcagcagcaguu

SEQ ID NO: 415381 - RNA, 23 nt, Bordetella pertussis
ggcagcagcaguugcagcaugau

SEQ ID NO: 415382 - RNA, 14 nt, Bordetella pertussis
ggcagcagcgcgcc

SEQ ID NO: 415383 - RNA, 15 nt, Bordetella pertussis
ggcagcagcgcgccg

SEQ ID NO: 415384 - RNA, 21 nt, Bordetella pertussis
ggcagcagcgcgccgggcggg

SEQ ID NO: 415385 - RNA, 13 nt, Bordetella pertussis
ggcagcagcgcgc

SEQ ID NO: 415386 - RNA, 15 nt, Bordetella pertussis
ggcagcaggccggcg

SEQ ID NO: 415387 - RNA, 20 nt, Bordetella pertussis
ggcagcaggcugccgccggc

SEQ ID NO: 415388 - RNA, 21 nt, Bordetella pertussis
ggcagcaggcugccgccggcg

SEQ ID NO: 415389 - RNA, 12 nt, Bordetella pertussis
ggcagcgcggcc

SEQ ID NO: 415390 - RNA, 13 nt, Bordetella pertussis
ggcagcggccagc

SEQ ID NO: 415391 - RNA, 15 nt, Bordetella pertussis
ggcagcggccgcgcg

SEQ ID NO: 415392 - RNA, 17 nt, Bordetella pertussis
ggcagcggccgcgcggg

SEQ ID NO: 415393 - RNA, 21 nt, Bordetella pertussis
ggcagcggagcgacggcagau

SEQ ID NO: 415394 - RNA, 16 nt, Bordetella pertussis
ggcagcgggccgcagc

SEQ ID NO: 415395 - RNA, 19 nt, Bordetella pertussis
ggcaguacgagcggcggcu

SEQ ID NO: 415396 - RNA, 21 nt, Bordetella pertussis
ggcaguccucguugcccgcgg

SEQ ID NO: 415397 - RNA, 18 nt, Bordetella pertussis
ggcagucggcaggagccu

SEQ ID NO: 415398 - RNA, 22 nt, Bordetella pertussis
ggcagugucaggaugcccuggg

SEQ ID NO: 415399 - RNA, 17 nt, Bordetella pertussis
ggcaguugcuggcggcc

SEQ ID NO: 415400 - RNA, 16 nt, Bordetella pertussis
ggcaguuggcggcgca

SEQ ID NO: 415401 - RNA, 20 nt, Bordetella pertussis
ggcauacgccgauggcgcgg

SEQ ID NO: 415402 - RNA, 18 nt, Bordetella pertussis
ggcauaggcggcgcaggc

SEQ ID NO: 415403 - RNA, 24 nt, Bordetella pertussis
ggcaucccugcuugcgcggaccuu

SEQ ID NO: 415404 - RNA, 23 nt, Bordetella pertussis
ggcaucgagauugagcacgcaug

SEQ ID NO: 415405 - RNA, 18 nt, Bordetella pertussis
ggcaucuguccgcgccgg

SEQ ID NO: 415406 - RNA, 19 nt, Bordetella pertussis
ggcaucuguccgcgccggg

SEQ ID NO: 415407 - RNA, 23 nt, Bordetella pertussis
ggcaugaaacggcaagagccugg

SEQ ID NO: 415408 - RNA, 16 nt, Bordetella pertussis
ggcaugaccgcggacg

SEQ ID NO: 415409 - RNA, 17 nt, Bordetella pertussis
ggcaugcaccgcguggc

SEQ ID NO: 415410 - RNA, 14 nt, Bordetella pertussis
ggcauggcgaucga

SEQ ID NO: 415411 - RNA, 18 nt, Bordetella pertussis
ggcauggcgccgcgccgc

SEQ ID NO: 415412 - RNA, 15 nt, Bordetella pertussis
ggcaugggcccgggc

SEQ ID NO: 415413 - RNA, 20 nt, Bordetella pertussis
ggcaugggcgugccgcgcug

SEQ ID NO: 415414 - RNA, 16 nt, Bordetella pertussis
ggcauggggcaggcgc

SEQ ID NO: 415415 - RNA, 18 nt, Bordetella pertussis
ggcaugguagcgguccag

SEQ ID NO: 415416 - RNA, 21 nt, Bordetella pertussis
ggcaugguagcgguccagcug

SEQ ID NO: 415417 - RNA, 17 nt, Bordetella pertussis
ggcauggucgaugaagu

SEQ ID NO: 415418 - RNA, 14 nt, Bordetella pertussis
ggccaacagcucgc

SEQ ID NO: 415419 - RNA, 22 nt, Bordetella pertussis
ggccaacagcucgcgccagggc

SEQ ID NO: 415420 - RNA, 23 nt, Bordetella pertussis
ggccaaccacgagcugcagcccg

SEQ ID NO: 415421 - RNA, 21 nt, Bordetella pertussis
ggccaaccccgagggcgcggc

SEQ ID NO: 415422 - RNA, 20 nt, Bordetella pertussis
ggccaacgccacgcccaucu

SEQ ID NO: 415423 - RNA, 17 nt, Bordetella pertussis
ggccaacggcuggcugg

SEQ ID NO: 415424 - RNA, 14 nt, Bordetella pertussis
ggccaagacgcggg

SEQ ID NO: 415425 - RNA, 20 nt, Bordetella pertussis
ggccaagacgguaucugucc

SEQ ID NO: 415426 - RNA, 21 nt, Bordetella pertussis
ggccaagacgguaucuguccc

SEQ ID NO: 415427 - RNA, 13 nt, Bordetella pertussis
ggccaagauccag

SEQ ID NO: 415428 - RNA, 18 nt, Bordetella pertussis
ggccacaagcggccccag

SEQ ID NO: 415429 - RNA, 22 nt, Bordetella pertussis
ggccacaucaucgaccaccagc

SEQ ID NO: 415430 - RNA, 22 nt, Bordetella pertussis
ggccacauggucgcccagcaga

SEQ ID NO: 415431 - RNA, 19 nt, Bordetella pertussis
ggccaccaggccgucggcc

SEQ ID NO: 415432 - RNA, 22 nt, Bordetella pertussis
ggccaccaggccgucggccagg

SEQ ID NO: 415433 - RNA, 21 nt, Bordetella pertussis
ggccaccaggguuuccucgcc

SEQ ID NO: 415434 - RNA, 22 nt, Bordetella pertussis
ggccaccaggguuuccucgccg

SEQ ID NO: 415435 - RNA, 22 nt, Bordetella pertussis
ggccaccccguugcagcccagc

SEQ ID NO: 415436 - RNA, 13 nt, Bordetella pertussis
ggccacccugccg

SEQ ID NO: 415437 - RNA, 17 nt, Bordetella pertussis
ggccaccgacggcgcgg

SEQ ID NO: 415438 - RNA, 14 nt, Bordetella pertussis
ggccacggccgggc

SEQ ID NO: 415439 - RNA, 17 nt, Bordetella pertussis
ggccacggccgggccuc

SEQ ID NO: 415440 - RNA, 18 nt, Bordetella pertussis
ggccacggccgggccuca

SEQ ID NO: 415441 - RNA, 14 nt, Bordetella pertussis
ggccacggcgguga

SEQ ID NO: 415442 - RNA, 13 nt, Bordetella pertussis
ggccacggcugga

SEQ ID NO: 415443 - RNA, 14 nt, Bordetella pertussis
ggccacggcuggaa

SEQ ID NO: 415444 - RNA, 13 nt, Bordetella pertussis
ggccacguccggg

SEQ ID NO: 415445 - RNA, 14 nt, Bordetella pertussis
ggccagcagcacga

SEQ ID NO: 415446 - RNA, 20 nt, Bordetella pertussis
ggccagcagcgcaucgcgcg

SEQ ID NO: 415447 - RNA, 14 nt, Bordetella pertussis
ggccagcagcgcgu

SEQ ID NO: 415448 - RNA, 18 nt, Bordetella pertussis
ggccagcagcggcagguc

SEQ ID NO: 415449 - RNA, 22 nt, Bordetella pertussis
ggccagcaggagcccgcugccg

SEQ ID NO: 415450 - RNA, 22 nt, Bordetella pertussis
ggccagcauacccugcgcgccg

SEQ ID NO: 415451 - RNA, 19 nt, Bordetella pertussis
ggccagcauuaccagcaac

SEQ ID NO: 415452 - RNA, 17 nt, Bordetella pertussis
ggccagccacgccggcg

SEQ ID NO: 415453 - RNA, 20 nt, Bordetella pertussis
ggccagccagcgccgcagcg

SEQ ID NO: 415454 - RNA, 18 nt, Bordetella pertussis
ggccagccaggcgguggc

SEQ ID NO: 415455 - RNA, 18 nt, Bordetella pertussis
ggccagccccggcgcgcc

SEQ ID NO: 415456 - RNA, 15 nt, Bordetella pertussis
ggccagcccgcgcgc

SEQ ID NO: 415457 - RNA, 17 nt, Bordetella pertussis
ggccagcccgcgcgcgu

SEQ ID NO: 415458 - RNA, 16 nt, Bordetella pertussis
ggccagccggcccagc

SEQ ID NO: 415459 - RNA, 19 nt, Bordetella pertussis
ggccagccugcccgucgac

SEQ ID NO: 415460 - RNA, 18 nt, Bordetella pertussis
ggccagccugccgcggcc

SEQ ID NO: 415461 - RNA, 13 nt, Bordetella pertussis
ggccagccugugc

SEQ ID NO: 415462 - RNA, 14 nt, Bordetella pertussis
ggccagcgacccgc

SEQ ID NO: 415463 - RNA, 16 nt, Bordetella pertussis
ggccagcgaggccgcu

SEQ ID NO: 415464 - RNA, 14 nt, Bordetella pertussis
ggccagcgccacca

SEQ ID NO: 415465 - RNA, 19 nt, Bordetella pertussis
ggccagcgccgaaauaugg

SEQ ID NO: 415466 - RNA, 15 nt, Bordetella pertussis
ggccagcgccgcggc

SEQ ID NO: 415467 - RNA, 16 nt, Bordetella pertussis
ggccagcgccgcggcc

SEQ ID NO: 415468 - RNA, 20 nt, Bordetella pertussis
ggccagcgccgcggccggcg

SEQ ID NO: 415469 - RNA, 17 nt, Bordetella pertussis
ggccagcgccgcgguga

SEQ ID NO: 415470 - RNA, 23 nt, Bordetella pertussis
ggccagcgcgaucucgcgcaggg

SEQ ID NO: 415471 - RNA, 24 nt, Bordetella pertussis
ggccagcgcgaucucgcgcagggu

SEQ ID NO: 415472 - RNA, 14 nt, Bordetella pertussis
ggccagcgcgcagg

SEQ ID NO: 415473 - RNA, 16 nt, Bordetella pertussis
ggccagcgcgcaggug

SEQ ID NO: 415474 - RNA, 19 nt, Bordetella pertussis
ggccagcgcgccggccagg

SEQ ID NO: 415475 - RNA, 13 nt, Bordetella pertussis
ggccagcgcgcgg

SEQ ID NO: 415476 - RNA, 15 nt, Bordetella pertussis
ggccagcgcgcggcg

SEQ ID NO: 415477 - RNA, 16 nt, Bordetella pertussis
ggccagcgccuggaug

SEQ ID NO: 415478 - RNA, 12 nt, Bordetella pertussis
ggccagcgcggc

SEQ ID NO: 415479 - RNA, 15 nt, Bordetella pertussis
ggccagcgcggcggc

SEQ ID NO: 415480 - RNA, 14 nt, Bordetella pertussis
ggccagcgcgucga

SEQ ID NO: 415481 - RNA, 14 nt, Bordetella pertussis
ggccagcggcagga

SEQ ID NO: 415482 - RNA, 14 nt, Bordetella pertussis
ggccagcggcaggc

SEQ ID NO: 415483 - RNA, 15 nt, Bordetella pertussis
ggccagcggcaggcc

SEQ ID NO: 415484 - RNA, 20 nt, Bordetella pertussis
ggccagcggcaggcccagcu

SEQ ID NO: 415485 - RNA, 15 nt, Bordetella pertussis
ggccagcggcagggg

SEQ ID NO: 415486 - RNA, 20 nt, Bordetella pertussis
ggccagcggcgguucguccu

SEQ ID NO: 415487 - RNA, 17 nt, Bordetella pertussis
ggccagcgguacgccga

SEQ ID NO: 415488 - RNA, 20 nt, Bordetella pertussis
ggccagcgguacgccgaacu

SEQ ID NO: 415489 - RNA, 17 nt, Bordetella pertussis
ggccagcgugccgguga

SEQ ID NO: 415490 - RNA, 14 nt, Bordetella pertussis
ggccagcuccaccg

SEQ ID NO: 415491 - RNA, 13 nt, Bordetella pertussis
ggccagcuccagg

SEQ ID NO: 415492 - RNA, 13 nt, Bordetella pertussis
ggccagcuccccg

SEQ ID NO: 415493 - RNA, 15 nt, Bordetella pertussis
ggccagcuccccggg

SEQ ID NO: 415494 - RNA, 20 nt, Bordetella pertussis
ggccaggacggugucgcuga

SEQ ID NO: 415495 - RNA, 16 nt, Bordetella pertussis
ggccaggaucgcggcc

SEQ ID NO: 415496 - RNA, 11 nt, Bordetella pertussis
ggccaggccau

SEQ ID NO: 415497 - RNA, 14 nt, Bordetella pertussis
ggccaggccauggc

SEQ ID NO: 415498 - RNA, 18 nt, Bordetella pertussis
ggccaggcccacggcgcc

SEQ ID NO: 415499 - RNA, 14 nt, Bordetella pertussis
ggccaggcccucgc

SEQ ID NO: 415500 - RNA, 12 nt, Bordetella pertussis
ggccaggcccug

SEQ ID NO: 415501 - RNA, 14 nt, Bordetella pertussis
ggccaggccgaacg

SEQ ID NO: 415502 - RNA, 22 nt, Bordetella pertussis
ggccaggccgauuucggccgcc

SEQ ID NO: 415503 - RNA, 13 nt, Bordetella pertussis
ggccaggccgccg

SEQ ID NO: 415504 - RNA, 22 nt, Bordetella pertussis
ggccaggccgguggaccagggc

SEQ ID NO: 415505 - RNA, 22 nt, Bordetella pertussis
ggccaggcgccgcucagcgcgg

SEQ ID NO: 415506 - RNA, 14 nt, Bordetella pertussis
ggccaggcgccggc

SEQ ID NO: 415507 - RNA, 17 nt, Bordetella pertussis
ggccaggugcacagcgu

SEQ ID NO: 415508 - RNA, 14 nt, Bordetella pertussis
ggccagguggcggc

SEQ ID NO: 415509 - RNA, 17 nt, Bordetella pertussis
ggccagguggcggcggc

SEQ ID NO: 415510 - RNA, 18 nt, Bordetella pertussis
ggccagguggcggcggca

SEQ ID NO: 415511 - RNA, 19 nt, Bordetella pertussis
ggccaggugcgccaugcgg

SEQ ID NO: 415512 - RNA, 21 nt, Bordetella pertussis
ggccaguacgucggacagggc

SEQ ID NO: 415513 - RNA, 14 nt, Bordetella pertussis
ggccagugccugga

SEQ ID NO: 415514 - RNA, 23 nt, Bordetella pertussis
ggccagugccuggacgcgcuggc

SEQ ID NO: 415515 - RNA, 20 nt, Bordetella pertussis
ggccaucaggugcaggguug

SEQ ID NO: 415516 - RNA, 16 nt, Bordetella pertussis
ggccaucgaagccaga

SEQ ID NO: 415517 - RNA, 21 nt, Bordetella pertussis
ggccaucgccgccgccgggcu

SEQ ID NO: 415518 - RNA, 12 nt, Bordetella pertussis
ggccaucgcggu

SEQ ID NO: 415519 - RNA, 18 nt, Bordetella pertussis
ggccaucggcgccaagcg

SEQ ID NO: 415520 - RNA, 14 nt, Bordetella pertussis
ggccauggcgguga

SEQ ID NO: 415521 - RNA, 22 nt, Bordetella pertussis
ggccaugucagucguccuccgc

SEQ ID NO: 415522 - RNA, 17 nt, Bordetella pertussis
ggccauguucuucaggc

SEQ ID NO: 415523 - RNA, 24 nt, Bordetella pertussis
ggccaucguacgcgugggcggcgg

SEQ ID NO: 415524 - RNA, 14 nt, Bordetella pertussis
ggcccaagcccgug

SEQ ID NO: 415525 - RNA, 17 nt, Bordetella pertussis
ggccgagcuccucgagc

SEQ ID NO: 415526 - RNA, 21 nt, Bordetella pertussis
ggccgagcuccucgagcgugg

SEQ ID NO: 415527 - RNA, 13 nt, Bordetella pertussis
ggccgagcgcggc

SEQ ID NO: 415528 - RNA, 13 nt, Bordetella pertussis
ggccgaggaccug

SEQ ID NO: 415529 - RNA, 14 nt, Bordetella pertussis
ggccgaggccagcg

SEQ ID NO: 415530 - RNA, 14 nt, Bordetella pertussis
ggccgaggccaggu

SEQ ID NO: 415531 - RNA, 18 nt, Bordetella pertussis
ggccgaggccagguuggg

SEQ ID NO: 415532 - RNA, 20 nt, Bordetella pertussis
ggccgaggcgccgccgugcg

SEQ ID NO: 415533 - RNA, 20 nt, Bordetella pertussis
ggccgauacgcgugcgcggc

SEQ ID NO: 415534 - RNA, 16 nt, Bordetella pertussis
ggccgauagccgcggc

SEQ ID NO: 415535 - RNA, 15 nt, Bordetella pertussis
ggccgauagccguga

SEQ ID NO: 415536 - RNA, 16 nt, Bordetella pertussis
ggccgaguagcggcgc

SEQ ID NO: 415537 - RNA, 23 nt, Bordetella pertussis
ggccgaucagcaccacggcggcc

SEQ ID NO: 415538 - RNA, 17 nt, Bordetella pertussis
ggccgaucugcugggcc

SEQ ID NO: 415539 - RNA, 21 nt, Bordetella pertussis
ggccgaucugcugggccgggu

SEQ ID NO: 415540 - RNA, 17 nt, Bordetella pertussis
ggccgauggucagcaug

SEQ ID NO: 415541 - RNA, 20 nt, Bordetella pertussis
ggccgauggcguccagcagc

SEQ ID NO: 415542 - RNA, 21 nt, Bordetella pertussis
ggccgauggcguccagcagca

SEQ ID NO: 415543 - RNA, 20 nt, Bordetella pertussis
ggccgauuccagcgccgccu

SEQ ID NO: 415544 - RNA, 21 nt, Bordetella pertussis
ggccgauuucgcgcgccagcg

SEQ ID NO: 415545 - RNA, 18 nt, Bordetella pertussis
ggccgauuucggccgccg

SEQ ID NO: 415546 - RNA, 15 nt, Bordetella pertussis
ggccgcaaccaggga

SEQ ID NO: 415547 - RNA, 23 nt, Bordetella pertussis
ggccgcaacccacccccagcagc

SEQ ID NO: 415548 - RNA, 22 nt, Bordetella pertussis
ggccgcaagcaagccccaggca

SEQ ID NO: 415549 - RNA, 14 nt, Bordetella pertussis
ggccgcacgcggcc

SEQ ID NO: 415550 - RNA, 13 nt, Bordetella pertussis
ggccgcagcaauu

SEQ ID NO: 415551 - RNA, 21 nt, Bordetella pertussis
ggccgcagcauggcgccagcu

SEQ ID NO: 415552 - RNA, 14 nt, Bordetella pertussis
ggccgcagccggcu

SEQ ID NO: 415553 - RNA, 17 nt, Bordetella pertussis
ggccgcagccggcugca

SEQ ID NO: 415554 - RNA, 13 nt, Bordetella pertussis
ggccgcagggcgu

SEQ ID NO: 415555 - RNA, 24 nt, Bordetella pertussis
ggccgcaugcgugaagcccauggc

SEQ ID NO: 415556 - RNA, 13 nt, Bordetella pertussis
ggccgcauuggga

SEQ ID NO: 415557 - RNA, 21 nt, Bordetella pertussis
ggccgcauugggacgcggccu

SEQ ID NO: 415558 - RNA, 22 nt, Bordetella pertussis
ggccgcauugggacgcggccuu

SEQ ID NO: 415559 - RNA, 16 nt, Bordetella pertussis
ggccgccaccagcgcg

SEQ ID NO: 415560 - RNA, 22 nt, Bordetella pertussis
ggccgccaccagcgcgucgccg

SEQ ID NO: 415561 - RNA, 15 nt, Bordetella pertussis
ggccgccacccaggc

SEQ ID NO: 415562 - RNA, 17 nt, Bordetella pertussis
ggccgccacccaggcgg

SEQ ID NO: 415563 - RNA, 17 nt, Bordetella pertussis
ggccgccaccugggccg

SEQ ID NO: 415564 - RNA, 12 nt, Bordetella pertussis
ggccgccacgaa

SEQ ID NO: 415565 - RNA, 21 nt, Bordetella pertussis
ggccgccacgaaacccacggc

SEQ ID NO: 415566 - RNA, 21 nt, Bordetella pertussis
ggccgccacgcccuggcagcu

SEQ ID NO: 415567 - RNA, 12 nt, Bordetella pertussis
ggccgccagcaa

SEQ ID NO: 415568 - RNA, 13 nt, Bordetella pertussis
ggccgccagcacc

SEQ ID NO: 415569 - RNA, 13 nt, Bordetella pertussis
ggccgccagccgg

SEQ ID NO: 415570 - RNA, 22 nt, Bordetella pertussis
ggccgccagccggcccagcacg

SEQ ID NO: 415571 - RNA, 20 nt, Bordetella pertussis
ggccgccagccggcccgaca

SEQ ID NO: 415572 - RNA, 14 nt, Bordetella pertussis
ggccgccagcgcca

SEQ ID NO: 415573 - RNA, 13 nt, Bordetella pertussis
ggccgccagcggc

SEQ ID NO: 415574 - RNA, 14 nt, Bordetella pertussis
ggccgccagcggcu

SEQ ID NO: 415575 - RNA, 16 nt, Bordetella pertussis
ggccgccagcggcugg

SEQ ID NO: 415576 - RNA, 18 nt, Bordetella pertussis
ggccgccagcggcuggcg

SEQ ID NO: 415577 - RNA, 11 nt, Bordetella pertussis
ggccgccagga

SEQ ID NO: 415578 - RNA, 14 nt, Bordetella pertussis
ggccgccagggccg

SEQ ID NO: 415579 - RNA, 14 nt, Bordetella pertussis
ggccgcccagcauu

SEQ ID NO: 415580 - RNA, 12 nt, Bordetella pertussis
ggccgcccagcg

SEQ ID NO: 415581 - RNA, 14 nt, Bordetella pertussis
ggccgcccagcgca

SEQ ID NO: 415582 - RNA, 22 nt, Bordetella pertussis
ggccgcccagcgcauaggacgc

SEQ ID NO: 415583 - RNA, 16 nt, Bordetella pertussis
ggccgcccagcgccug

SEQ ID NO: 415584 - RNA, 19 nt, Bordetella pertussis
ggccgcccaggcgcagccg

SEQ ID NO: 415585 - RNA, 15 nt, Bordetella pertussis
ggccgcccccagcgc

SEQ ID NO: 415586 - RNA, 19 nt, Bordetella pertussis
ggccgcccccagcgcgccu

SEQ ID NO: 415587 - RNA, 16 nt, Bordetella pertussis
ggccgcccgccccggc

SEQ ID NO: 415588 - RNA, 18 nt, Bordetella pertussis
ggccgcccgcggccugca

SEQ ID NO: 415589 - RNA, 16 nt, Bordetella pertussis
ggccgccgaacggcag

SEQ ID NO: 415590 - RNA, 14 nt, Bordetella pertussis
ggccgccgcacagc

SEQ ID NO: 415591 - RNA, 23 nt, Bordetella pertussis
ggccgccgccaccaccucggccu

SEQ ID NO: 415592 - RNA, 17 nt, Bordetella pertussis
ggccgccgccagcgcgc

SEQ ID NO: 415593 - RNA, 13 nt, Bordetella pertussis
ggccgccgcccgc

SEQ ID NO: 415594 - RNA, 20 nt, Bordetella pertussis
ggccgccgcccgccucaggc

SEQ ID NO: 415595 - RNA, 16 nt, Bordetella pertussis
ggccgccgcgcccagc

SEQ ID NO: 415596 - RNA, 13 nt, Bordetella pertussis
ggccgccgcggcc

SEQ ID NO: 415597 - RNA, 14 nt, Bordetella pertussis
ggccgccgcggccu

SEQ ID NO: 415598 - RNA, 14 nt, Bordetella pertussis
ggccgccgcgggcg

SEQ ID NO: 415599 - RNA, 14 nt, Bordetella pertussis
ggccgccggccagc

SEQ ID NO: 415600 - RNA, 15 nt, Bordetella pertussis
ggccgccggccagcg

SEQ ID NO: 415601 - RNA, 18 nt, Bordetella pertussis
ggccgccggccagcgcgg

SEQ ID NO: 415602 - RNA, 13 nt, Bordetella pertussis
ggccgccggcgcg

SEQ ID NO: 415603 - RNA, 14 nt, Bordetella pertussis
ggccgccggcggcg

SEQ ID NO: 415604 - RNA, 19 nt, Bordetella pertussis
ggccgccuccaggcggcgg

SEQ ID NO: 415605 - RNA, 20 nt, Bordetella pertussis
ggccgccuccaggcggcggu

SEQ ID NO: 415606 - RNA, 15 nt, Bordetella pertussis
ggccgccucggcggc

SEQ ID NO: 415607 - RNA, 16 nt, Bordetella pertussis
ggccgccucggcggcc

SEQ ID NO: 415608 - RNA, 17 nt, Bordetella pertussis
ggccgcgaacgcgccgg

SEQ ID NO: 415609 - RNA, 18 nt, Bordetella pertussis
ggccgcgaacgcgccggc

SEQ ID NO: 415610 - RNA, 19 nt, Bordetella pertussis
ggccgccuuuucgcagcgg

SEQ ID NO: 415611 - RNA, 22 nt, Bordetella pertussis
ggccgccuuuucgcagcggaug

SEQ ID NO: 415612 - RNA, 19 nt, Bordetella pertussis
ggccgcgacauagcgcugg

SEQ ID NO: 415613 - RNA, 13 nt, Bordetella pertussis
ggccgcgcaaggc

SEQ ID NO: 415614 - RNA, 15 nt, Bordetella pertussis
ggccgcgcaaggccu

SEQ ID NO: 415615 - RNA, 18 nt, Bordetella pertussis
ggccgcgcaaggccugcu

SEQ ID NO: 415616 - RNA, 20 nt, Bordetella pertussis
ggccgcgcaaggccugcucg

SEQ ID NO: 415617 - RNA, 17 nt, Bordetella pertussis
ggccgcgcaaggcggcc

SEQ ID NO: 415618 - RNA, 21 nt, Bordetella pertussis
ggccgcgcaaggcggcccggc

SEQ ID NO: 415619 - RNA, 13 nt, Bordetella pertussis
ggccgcgcagcac

SEQ ID NO: 415620 - RNA, 13 nt, Bordetella pertussis
ggccgcgcagggc

SEQ ID NO: 415621 - RNA, 15 nt, Bordetella pertussis
ggccgcgccacaggc

SEQ ID NO: 415622 - RNA, 16 nt, Bordetella pertussis
ggccgcgcccacagga

SEQ ID NO: 415623 - RNA, 13 nt, Bordetella pertussis
ggccgcgcccagc

SEQ ID NO: 415624 - RNA, 16 nt, Bordetella pertussis
ggccgcgcccagcgcg

SEQ ID NO: 415625 - RNA, 17 nt, Bordetella pertussis
ggccgcgcccagcgugu

SEQ ID NO: 415626 - RNA, 14 nt, Bordetella pertussis
ggccgcgcccaugc

SEQ ID NO: 415627 - RNA, 20 nt, Bordetella pertussis
ggccgcgcccaugcgcuggc

SEQ ID NO: 415628 - RNA, 17 nt, Bordetella pertussis
ggccgcgcaugccagcu

SEQ ID NO: 415629 - RNA, 16 nt, Bordetella pertussis
ggccgcgccgcgccgg

SEQ ID NO: 415630 - RNA, 13 nt, Bordetella pertussis
ggccgcgccgcug

SEQ ID NO: 415631 - RNA, 17 nt, Bordetella pertussis
ggccgcgccgccgcccu

SEQ ID NO: 415632 - RNA, 13 nt, Bordetella pertussis
ggccgcgcgcagc

SEQ ID NO: 415633 - RNA, 14 nt, Bordetella pertussis
ggccgcgcgcagcg

SEQ ID NO: 415634 - RNA, 17 nt, Bordetella pertussis
ggccgcgcgccggcgcc

SEQ ID NO: 415635 - RNA, 12 nt, Bordetella pertussis
ggccgcgcgccu

SEQ ID NO: 415636 - RNA, 19 nt, Bordetella pertussis
ggccgcgcgcgccaggccu

SEQ ID NO: 415637 - RNA, 18 nt, Bordetella pertussis
ggccgcgcggcgccugcc

SEQ ID NO: 415638 - RNA, 23 nt, Bordetella pertussis
ggccgcgcgggccuggcucaggc

SEQ ID NO: 415639 - RNA, 21 nt, Bordetella pertussis
ggccgcgcgcauccaggugcc

SEQ ID NO: 415640 - RNA, 14 nt, Bordetella pertussis
ggccgcgcucaggc

SEQ ID NO: 415641 - RNA, 21 nt, Bordetella pertussis
ggccgcgcucaggccgcuggg

SEQ ID NO: 415642 - RNA, 21 nt, Bordetella pertussis
ggccgcgcugcugcaggccgg

SEQ ID NO: 415643 - RNA, 18 nt, Bordetella pertussis
ggccgcgcuggcgcuggc

SEQ ID NO: 415644 - RNA, 14 nt, Bordetella pertussis
ggccgcggccaggc

SEQ ID NO: 415645 - RNA, 17 nt, Bordetella pertussis
ggccgcggcccagcgcg

SEQ ID NO: 415646 - RNA, 16 nt, Bordetella pertussis
ggccgcggccggcacg

SEQ ID NO: 415647 - RNA, 22 nt, Bordetella pertussis
ggccgcggccggcacgcccagc

SEQ ID NO: 415648 - RNA, 14 nt, Bordetella pertussis
ggccgcggcgagcu

SEQ ID NO: 415649 - RNA, 12 nt, Bordetella pertussis
ggccgcggcgcc

SEQ ID NO: 415650 - RNA, 14 nt, Bordetella pertussis
ggccgcgggccgcu

SEQ ID NO: 415651 - RNA, 19 nt, Bordetella pertussis
ggccgcggggcuggccagc

SEQ ID NO: 415652 - RNA, 20 nt, Bordetella pertussis
ggccgcggggcuggccagcu

SEQ ID NO: 415653 - RNA, 22 nt, Bordetella pertussis
ggccgcggggcuggccagcugg

SEQ ID NO: 415654 - RNA, 17 nt, Bordetella pertussis
ggccgcggguggccgcu

SEQ ID NO: 415655 - RNA, 23 nt, Bordetella pertussis
ggccgcgguaaugacgcagccgc

SEQ ID NO: 415656 - RNA, 20 nt, Bordetella pertussis
ggccgcggucagccagagcg

SEQ ID NO: 415657 - RNA, 22 nt, Bordetella pertussis
ggccgcgggcggcgcgcccagc

SEQ ID NO: 415658 - RNA, 22 nt, Bordetella pertussis
ggccgcguaggcggucagcugg

SEQ ID NO: 415659 - RNA, 15 nt, Bordetella pertussis
ggccgcguccagcgc

SEQ ID NO: 415660 - RNA, 16 nt, Bordetella pertussis
ggccgcguccagcgcg

SEQ ID NO: 415661 - RNA, 17 nt, Bordetella pertussis
ggccgcguccagcgcgc

SEQ ID NO: 415662 - RNA, 22 nt, Bordetella pertussis
ggccgcguccagcgcgcggccu

SEQ ID NO: 415663 - RNA, 13 nt, Bordetella pertussis
ggccgcgucggcc

SEQ ID NO: 415664 - RNA, 20 nt, Bordetella pertussis
ggccgcgucgaucagcgcgg

SEQ ID NO: 415665 - RNA, 16 nt, Bordetella pertussis
ggccgcuacggcgguc

SEQ ID NO: 415666 - RNA, 19 nt, Bordetella pertussis
ggccgcuccagagcgcgca

SEQ ID NO: 415667 - RNA, 13 nt, Bordetella pertussis
ggccgcugggcac

SEQ ID NO: 415668 - RNA, 19 nt, Bordetella pertussis
ggccgcuggucaccgcccc

SEQ ID NO: 415669 - RNA, 22 nt, Bordetella pertussis
ggccgcuggucaccgccccgac

SEQ ID NO: 415670 - RNA, 15 nt, Bordetella pertussis
ggccgcuucggcggc

SEQ ID NO: 415671 - RNA, 16 nt, Bordetella pertussis
ggccgcuucggcggcc

SEQ ID NO: 415672 - RNA, 13 nt, Bordetella pertussis
ggccggacagggc

SEQ ID NO: 415673 - RNA, 23 nt, Bordetella pertussis
ggccggacagggccgcgagcaug

SEQ ID NO: 415674 - RNA, 21 nt, Bordetella pertussis
ggccggaacugaugccgaccg

SEQ ID NO: 415675 - RNA, 16 nt, Bordetella pertussis
ggccggacgcaaccgg

SEQ ID NO: 415676 - RNA, 13 nt, Bordetella pertussis
ggccggagccagg

SEQ ID NO: 415677 - RNA, 16 nt, Bordetella pertussis
ggccggauccagcugc

SEQ ID NO: 415678 - RNA, 19 nt, Bordetella pertussis
ggccggcaaggggccagcc

SEQ ID NO: 415679 - RNA, 21 nt, Bordetella pertussis
ggccggcaccacgaccggcuc

SEQ ID NO: 415680 - RNA, 16 nt, Bordetella pertussis
ggccggcacgcccagc

SEQ ID NO: 415681 - RNA, 17 nt, Bordetella pertussis
ggccggcacggccggcc

SEQ ID NO: 415682 - RNA, 21 nt, Bordetella pertussis
ggccggcacggccggccaggc

SEQ ID NO: 415683 - RNA, 13 nt, Bordetella pertussis
ggccggcagcggc

SEQ ID NO: 415684 - RNA, 14 nt, Bordetella pertussis
ggccggcagcggcg

SEQ ID NO: 415685 - RNA, 20 nt, Bordetella pertussis
ggccggcaggccggccagca

SEQ ID NO: 415686 - RNA, 16 nt, Bordetella pertussis
ggccggcaugcgccgg

SEQ ID NO: 415687 - RNA, 21 nt, Bordetella pertussis
ggccggcccaguccagggugu

SEQ ID NO: 415688 - RNA, 12 nt, Bordetella pertussis
ggccggccgccg

SEQ ID NO: 415689 - RNA, 14 nt, Bordetella pertussis
ggccggccgccggc

SEQ ID NO: 415690 - RNA, 15 nt, Bordetella pertussis
ggccggccgccggcg

SEQ ID NO: 415691 - RNA, 22 nt, Bordetella pertussis
ggccggccgcguggccgcgcug

SEQ ID NO: 415692 - RNA, 12 nt, Bordetella pertussis
ggccggccgggc

SEQ ID NO: 415693 - RNA, 23 nt, Bordetella pertussis
ggccggccugcaggugccgccgg

SEQ ID NO: 415694 - RNA, 16 nt, Bordetella pertussis
ggccggccugccggcg

SEQ ID NO: 415695 - RNA, 15 nt, Bordetella pertussis
ggccggccugcuugg

SEQ ID NO: 415696 - RNA, 21 nt, Bordetella pertussis
ggccggccuuggccauguccu

SEQ ID NO: 415697 - RNA, 15 nt, Bordetella pertussis
ggccggcgaugaagu

SEQ ID NO: 415698 - RNA, 22 nt, Bordetella pertussis
ggccggcgaugaagucgcggcc

SEQ ID NO: 415699 - RNA, 15 nt, Bordetella pertussis
ggccggcgcacgccg

SEQ ID NO: 415700 - RNA, 16 nt, Bordetella pertussis
ggccggcgccagccgc

SEQ ID NO: 415701 - RNA, 13 nt, Bordetella pertussis
ggccggcgcgccc

SEQ ID NO: 415702 - RNA, 15 nt, Bordetella pertussis
ggccggcgcgccggc

SEQ ID NO: 415703 - RNA, 21 nt, Bordetella pertussis
ggccggcgcgcucgcugccgg

SEQ ID NO: 415704 - RNA, 17 nt, Bordetella pertussis
ggccggcgcgucgccgg

SEQ ID NO: 415705 - RNA, 17 nt, Bordetella pertussis
ggccggcgcggcagccu

SEQ ID NO: 415706 - RNA, 23 nt, Bordetella pertussis
ggccggcggcagccggccauggc

SEQ ID NO: 415707 - RNA, 16 nt, Bordetella pertussis
ggccggcggcgagcgc

SEQ ID NO: 415708 - RNA, 19 nt, Bordetella pertussis
ggccggcguugcgcccugc

SEQ ID NO: 415709 - RNA, 19 nt, Bordetella pertussis
ggccggcuacagcucgccg

SEQ ID NO: 415710 - RNA, 21 nt, Bordetella pertussis
ggccggcuacagcucgccggc

SEQ ID NO: 415711 - RNA, 13 nt, Bordetella pertussis
ggccggcucgccg

SEQ ID NO: 415712 - RNA, 16 nt, Bordetella pertussis
ggccggcugcgcgccg

SEQ ID NO: 415713 - RNA, 16 nt, Bordetella pertussis
ggccggcugggcggcc

SEQ ID NO: 415714 - RNA, 17 nt, Bordetella pertussis
ggccggcugggcggccu

SEQ ID NO: 415715 - RNA, 18 nt, Bordetella pertussis
ggccggcugggcggccuu

SEQ ID NO: 415716 - RNA, 20 nt, Bordetella pertussis
ggccggcugcaccagcgcgc

SEQ ID NO: 415717 - RNA, 14 nt, Bordetella pertussis
ggccgggcaggccg

SEQ ID NO: 415718 - RNA, 20 nt, Bordetella pertussis
ggccgggcaguccuggcugg

SEQ ID NO: 415719 - RNA, 13 nt, Bordetella pertussis
ggccgggccagcg

SEQ ID NO: 415720 - RNA, 16 nt, Bordetella pertussis
ggccgggcccggcgcg

SEQ ID NO: 415721 - RNA, 18 nt, Bordetella pertussis
ggccgggcccggcgcgcc

SEQ ID NO: 415722 - RNA, 15 nt, Bordetella pertussis
ggccgggccggcggg

SEQ ID NO: 415723 - RNA, 12 nt, Bordetella pertussis
ggccgggcgcca

SEQ ID NO: 415724 - RNA, 17 nt, Bordetella pertussis
ggccgggcgccaggcug

SEQ ID NO: 415725 - RNA, 14 nt, Bordetella pertussis
ggccgggcgcccag

SEQ ID NO: 415726 - RNA, 14 nt, Bordetella pertussis
ggccgggcgcggcg

SEQ ID NO: 415727 - RNA, 16 nt, Bordetella pertussis
ggccgggcgcggcgcc

SEQ ID NO: 415728 - RNA, 21 nt, Bordetella pertussis
ggccgggcguacguacugcca

SEQ ID NO: 415729 - RNA, 17 nt, Bordetella pertussis
ggccggggaagccgccg

SEQ ID NO: 415730 - RNA, 15 nt, Bordetella pertussis
ggccggggccgcccu

SEQ ID NO: 415731 - RNA, 17 nt, Bordetella pertussis
ggccggggccgcccugc

SEQ ID NO: 415732 - RNA, 18 nt, Bordetella pertussis
ggccggggccgcccuggu

SEQ ID NO: 415733 - RNA, 17 nt, Bordetella pertussis
ggccgggguccugaggc

SEQ ID NO: 415734 - RNA, 19 nt, Bordetella pertussis
ggccgggguccugaggcca

SEQ ID NO: 415735 - RNA, 23 nt, Bordetella pertussis
ggccgggucgcgcagcagggccu

SEQ ID NO: 415736 - RNA, 15 nt, Bordetella pertussis
ggccgguaaggcgcu

SEQ ID NO: 415737 - RNA, 15 nt, Bordetella pertussis
ggccgguaucggccu

SEQ ID NO: 415738 - RNA, 17 nt, Bordetella pertussis
ggccggucagcccaggc

SEQ ID NO: 415739 - RNA, 21 nt, Bordetella pertussis
ggccggucagcccaggcgggc

SEQ ID NO: 415740 - RNA, 18 nt, Bordetella pertussis
ggccggugaugcggcgcg

SEQ ID NO: 415741 - RNA, 20 nt, Bordetella pertussis
ggccggugcaucggccggcg

SEQ ID NO: 415742 - RNA, 23 nt, Bordetella pertussis
ggccgguuucggccugcaggccc

SEQ ID NO: 415743 - RNA, 15 nt, Bordetella pertussis
ggccguacauggcca

SEQ ID NO: 415744 - RNA, 21 nt, Bordetella pertussis
ggccguagcguuggcggccgg

SEQ ID NO: 415745 - RNA, 23 nt, Bordetella pertussis
ggccgucaccgccgccgcgccgc

SEQ ID NO: 415746 - RNA, 13 nt, Bordetella pertussis
ggccgucagcagc

SEQ ID NO: 415747 - RNA, 14 nt, Bordetella pertussis
ggccgucagcagca

SEQ ID NO: 415748 - RNA, 16 nt, Bordetella pertussis
ggccgucagcagcagg

SEQ ID NO: 415749 - RNA, 17 nt, Bordetella pertussis
ggccgucgagccgggcg

SEQ ID NO: 415750 - RNA, 13 nt, Bordetella pertussis
ggccgucggggcc

SEQ ID NO: 415751 - RNA, 21 nt, Bordetella pertussis
ggccgucuacaggcccagcgc

SEQ ID NO: 415752 - RNA, 22 nt, Bordetella pertussis
ggccgucuacaggcccagcgcc

SEQ ID NO: 415753 - RNA, 22 nt, Bordetella pertussis
ggccgugaucuugaugccgccc

SEQ ID NO: 415754 - RNA, 22 nt, Bordetella pertussis
ggccgugccgcccgguucgccg

SEQ ID NO: 415755 - RNA, 16 nt, Bordetella pertussis
ggccgugcgccagcgc

SEQ ID NO: 415756 - RNA, 12 nt, Bordetella pertussis
ggccgugcgccc

SEQ ID NO: 415757 - RNA, 15 nt, Bordetella pertussis
ggccguggcccagcc

SEQ ID NO: 415758 - RNA, 16 nt, Bordetella pertussis
ggccguggccgggccc

SEQ ID NO: 415759 - RNA, 14 nt, Bordetella pertussis
ggccguggcggccu

SEQ ID NO: 415760 - RNA, 19 nt, Bordetella pertussis
ggccguggcgugcaggccg

SEQ ID NO: 415761 - RNA, 16 nt, Bordetella pertussis
ggccguugcuccagcc

SEQ ID NO: 415762 - RNA, 15 nt, Bordetella pertussis
ggccguuggccagcg

SEQ ID NO: 415763 - RNA, 16 nt, Bordetella pertussis
ggccguuggccagcgc

SEQ ID NO: 415764 - RNA, 17 nt, Bordetella pertussis
ggccguuggccagcgcc

SEQ ID NO: 415765 - RNA, 16 nt, Bordetella pertussis
ggccguuggcgcgccu

SEQ ID NO: 415766 - RNA, 18 nt, Bordetella pertussis
ggccguuggcgugcagcc

SEQ ID NO: 415767 - RNA, 20 nt, Bordetella pertussis
ggccguuuacuccccagacg

SEQ ID NO: 415768 - RNA, 21 nt, Bordetella pertussis
ggccguuucaggccugcggcg

SEQ ID NO: 415769 - RNA, 17 nt, Bordetella pertussis
ggccguuuccucuggag

SEQ ID NO: 415770 - RNA, 15 nt, Bordetella pertussis
ggccguuguccuggc

SEQ ID NO: 415771 - RNA, 21 nt, Bordetella pertussis
ggccguuguccuggcgcgcca

SEQ ID NO: 415772 - RNA, 21 nt, Bordetella pertussis
ggccguuugccccucggcggg

SEQ ID NO: 415773 - RNA, 17 nt, Bordetella pertussis
ggccuacugggccagau

SEQ ID NO: 415774 - RNA, 17 nt, Bordetella pertussis
ggccuacuucggcagcu

SEQ ID NO: 415775 - RNA, 21 nt, Bordetella pertussis
ggccucagcggccgcugccgc

SEQ ID NO: 415776 - RNA, 17 nt, Bordetella pertussis
ggccucaucgagcgccu

SEQ ID NO: 415777 - RNA, 13 nt, Bordetella pertussis
ggccuccagcauc

SEQ ID NO: 415778 - RNA, 17 nt, Bordetella pertussis
ggccucccggaccagca

SEQ ID NO: 415779 - RNA, 22 nt, Bordetella pertussis
ggccucccggaccagcaguugc

SEQ ID NO: 415780 - RNA, 16 nt, Bordetella pertussis
ggccucgaagcccggc

SEQ ID NO: 415781 - RNA, 23 nt, Bordetella pertussis
ggccucgcgcagggcggccucga

SEQ ID NO: 415782 - RNA, 12 nt, Bordetella pertussis
ggccucgcgcuc

SEQ ID NO: 415783 - RNA, 14 nt, Bordetella pertussis
ggccucgcgcucgc

SEQ ID NO: 415784 - RNA, 17 nt, Bordetella pertussis
ggccucgcgcucgcgcu

SEQ ID NO: 415785 - RNA, 17 nt, Bordetella pertussis
ggccucgcggcgcagca

SEQ ID NO: 415786 - RNA, 14 nt, Bordetella pertussis
ggccucgcgggccu

SEQ ID NO: 415787 - RNA, 14 nt, Bordetella pertussis
ggccucgccggccu

SEQ ID NO: 415788 - RNA, 17 nt, Bordetella pertussis
ggccucgccggccuggc

SEQ ID NO: 415789 - RNA, 14 nt, Bordetella pertussis
ggccucggccagcu

SEQ ID NO: 415790 - RNA, 16 nt, Bordetella pertussis
ggccucggccagcugg

SEQ ID NO: 415791 - RNA, 16 nt, Bordetella pertussis
ggccucggcgaagugc

SEQ ID NO: 415792 - RNA, 13 nt, Bordetella pertussis
ggccucggcggcc

SEQ ID NO: 415793 - RNA, 15 nt, Bordetella pertussis
ggccucggcggccuc

SEQ ID NO: 415794 - RNA, 16 nt, Bordetella pertussis
ggccucggcggccucc

SEQ ID NO: 415795 - RNA, 17 nt, Bordetella pertussis
ggccucggcgggcggcg

SEQ ID NO: 415796 - RNA, 17 nt, Bordetella pertussis
ggccucggucagggugg

SEQ ID NO: 415797 - RNA, 21 nt, Bordetella pertussis
ggccucgucgaccacgccggc

SEQ ID NO: 415798 - RNA, 17 nt, Bordetella pertussis
ggccucuucgucgccgg

SEQ ID NO: 415799 - RNA, 18 nt, Bordetella pertussis
ggccucuucgucgccggc

SEQ ID NO: 415800 - RNA, 22 nt, Bordetella pertussis
ggccucuugcgugacccggggc

SEQ ID NO: 415801 - RNA, 15 nt, Bordetella pertussis
ggccugacgggccuc

SEQ ID NO: 415802 - RNA, 19 nt, Bordetella pertussis
ggccugcacgcucuugagc

SEQ ID NO: 415803 - RNA, 17 nt, Bordetella pertussis
ggccugcagaccagcac

SEQ ID NO: 415804 - RNA, 17 nt, Bordetella pertussis
ggccugcaggcccagca

SEQ ID NO: 415805 - RNA, 19 nt, Bordetella pertussis
ggccugcaggccguuccag

SEQ ID NO: 415806 - RNA, 23 nt, Bordetella pertussis
ggccugcaggcucuugaccagcu

SEQ ID NO: 415807 - RNA, 21 nt, Bordetella pertussis
ggccugcaggugccgccggcg

SEQ ID NO: 415808 - RNA, 20 nt, Bordetella pertussis
ggccugcaguucggccgcca

SEQ ID NO: 415809 - RNA, 14 nt, Bordetella pertussis
ggccugccaccagc

SEQ ID NO: 415810 - RNA, 14 nt, Bordetella pertussis
ggccugcccauggc

SEQ ID NO: 415811 - RNA, 13 nt, Bordetella pertussis
ggccugcccgggc

SEQ ID NO: 415812 - RNA, 14 nt, Bordetella pertussis
ggccugcccgggca

SEQ ID NO: 415813 - RNA, 16 nt, Bordetella pertussis
ggccugccggcgcgcc

SEQ ID NO: 415814 - RNA, 20 nt, Bordetella pertussis
ggccugcgccgggcgcggcc

SEQ ID NO: 415815 - RNA, 13 nt, Bordetella pertussis
ggccugcgcgccg

SEQ ID NO: 415816 - RNA, 13 nt, Bordetella pertussis
ggccugcggcgcc

SEQ ID NO: 415817 - RNA, 14 nt, Bordetella pertussis
ggccugcggcgcca

SEQ ID NO: 415818 - RNA, 19 nt, Bordetella pertussis
ggccugcggcgccagcgcc

SEQ ID NO: 415819 - RNA, 17 nt, Bordetella pertussis
ggccugcgggccgggca

SEQ ID NO: 415820 - RNA, 14 nt, Bordetella pertussis
ggccugcgucgcca

SEQ ID NO: 415821 - RNA, 18 nt, Bordetella pertussis
ggccugcgugucaggcgg

SEQ ID NO: 415822 - RNA, 15 nt, Bordetella pertussis
ggccugcucgcaggc

SEQ ID NO: 415823 - RNA, 20 nt, Bordetella pertussis
ggccugcugcaauucgccga

SEQ ID NO: 415824 - RNA, 14 nt, Bordetella pertussis
ggccugcugcagca

SEQ ID NO: 415825 - RNA, 19 nt, Bordetella pertussis
ggccugcuuggcgcgcagc

SEQ ID NO: 415826 - RNA, 20 nt, Bordetella pertussis
ggccugcuuggcgcgcagca

SEQ ID NO: 415827 - RNA, 15 nt, Bordetella pertussis
ggccugcuugaagac

SEQ ID NO: 415828 - RNA, 22 nt, Bordetella pertussis
ggccugcuugaagacgcccagg

SEQ ID NO: 415829 - RNA, 17 nt, Bordetella pertussis
ggccuggaugugcaggc

SEQ ID NO: 415830 - RNA, 22 nt, Bordetella pertussis
ggccuggcacaucggcccuggc

SEQ ID NO: 415831 - RNA, 14 nt, Bordetella pertussis
ggccuggcccagcu

SEQ ID NO: 415832 - RNA, 23 nt, Bordetella pertussis
ggccuggcccagcuccagcuggc

SEQ ID NO: 415833 - RNA, 18 nt, Bordetella pertussis
ggccuggccccaggcgcc

SEQ ID NO: 415834 - RNA, 20 nt, Bordetella pertussis
ggccuggccgccggcggcgc

SEQ ID NO: 415835 - RNA, 13 nt, Bordetella pertussis
ggccuggccgggg

SEQ ID NO: 415836 - RNA, 15 nt, Bordetella pertussis
ggccuggcgcgcauc

SEQ ID NO: 415837 - RNA, 18 nt, Bordetella pertussis
ggccuggcgcgcaucggc

SEQ ID NO: 415838 - RNA, 17 nt, Bordetella pertussis
ggccuggcgcgcggccu

SEQ ID NO: 415839 - RNA, 15 nt, Bordetella pertussis
ggccuggcgcuccuc

SEQ ID NO: 415840 - RNA, 18 nt, Bordetella pertussis
ggccuggcgcuccucgcg

SEQ ID NO: 415841 - RNA, 17 nt, Bordetella pertussis
ggccugggaggcgcuga

SEQ ID NO: 415842 - RNA, 15 nt, Bordetella pertussis
ggccugggccauggc

SEQ ID NO: 415843 - RNA, 18 nt, Bordetella pertussis
ggccugggcgcgguccag

SEQ ID NO: 415844 - RNA, 13 nt, Bordetella pertussis
ggccugggcggcg

SEQ ID NO: 415845 - RNA, 14 nt, Bordetella pertussis
ggccugggcggcgc

SEQ ID NO: 415846 - RNA, 15 nt, Bordetella pertussis
ggccugggcggcggc

SEQ ID NO: 415847 - RNA, 18 nt, Bordetella pertussis
ggccuggguggccagcug

SEQ ID NO: 415848 - RNA, 22 nt, Bordetella pertussis
ggccuggucaugacgggcggcg

SEQ ID NO: 415849 - RNA, 13 nt, Bordetella pertussis
ggccuguccggca

SEQ ID NO: 415850 - RNA, 16 nt, Bordetella pertussis
ggccugucuguuugcg

SEQ ID NO: 415851 - RNA, 17 nt, Bordetella pertussis
ggccuucgaccugcccg

SEQ ID NO: 415852 - RNA, 20 nt, Bordetella pertussis
ggccuucgcgguaggacggc

SEQ ID NO: 415853 - RNA, 14 nt, Bordetella pertussis
ggccuucggcggcg

SEQ ID NO: 415854 - RNA, 15 nt, Bordetella pertussis
ggccuucggcggcgc

SEQ ID NO: 415855 - RNA, 22 nt, Bordetella pertussis
ggccuucggcgaucugggccuc

SEQ ID NO: 415856 - RNA, 21 nt, Bordetella pertussis
ggccuugagcaucugcggcac

SEQ ID NO: 415857 - RNA, 13 nt, Bordetella pertussis
ggccuugccauug

SEQ ID NO: 415858 - RNA, 23 nt, Bordetella pertussis
ggccuugccauuggucugugggc

SEQ ID NO: 415859 - RNA, 17 nt, Bordetella pertussis
ggccuuggccagcagcg

SEQ ID NO: 415860 - RNA, 13 nt, Bordetella pertussis
ggccuuggccgca

SEQ ID NO: 415861 - RNA, 17 nt, Bordetella pertussis
ggccuuggccgcagccg

SEQ ID NO: 415862 - RNA, 13 nt, Bordetella pertussis
ggccuuggccugg

SEQ ID NO: 415863 - RNA, 13 nt, Bordetella pertussis
ggccuuggccuug

SEQ ID NO: 415864 - RNA, 15 nt, Bordetella pertussis
ggccuuggccuuggc

SEQ ID NO: 415865 - RNA, 13 nt, Bordetella pertussis
ggccuuggcggcc

SEQ ID NO: 415866 - RNA, 17 nt, Bordetella pertussis
ggcgaacguggccugcu

SEQ ID NO: 415867 - RNA, 23 nt, Bordetella pertussis
ggcgaacugggcgucguccugca

SEQ ID NO: 415868 - RNA, 22 nt, Bordetella pertussis
ggcgaagccaucgacaagcgcu

SEQ ID NO: 415869 - RNA, 23 nt, Bordetella pertussis
ggcgaagcgcgccucgugcgagg

SEQ ID NO: 415870 - RNA, 20 nt, Bordetella pertussis
ggcgaagcgcgggaagcgcu

SEQ ID NO: 415871 - RNA, 19 nt, Bordetella pertussis
ggcgaagccuugcgcggcc

SEQ ID NO: 415872 - RNA, 23 nt, Bordetella pertussis
ggcgaagccuugcgcggccagca

SEQ ID NO: 415873 - RNA, 23 nt, Bordetella pertussis
ggcgaagucauguagcggccgcc

SEQ ID NO: 415874 - RNA, 13 nt, Bordetella pertussis
ggcgaagugcccg

SEQ ID NO: 415875 - RNA, 20 nt, Bordetella pertussis
ggcgaaucaguucgcgcagg

SEQ ID NO: 415876 - RNA, 19 nt, Bordetella pertussis
ggcgaauccaccggcgcgc

SEQ ID NO: 415877 - RNA, 23 nt, Bordetella pertussis
ggcgaggacaggccagugccugg

SEQ ID NO: 415878 - RNA, 19 nt, Bordetella pertussis
ggcgaggcgcuggccggcg

SEQ ID NO: 415879 - RNA, 16 nt, Bordetella pertussis
ggcgaggcggggcugg

SEQ ID NO: 415880 - RNA, 19 nt, Bordetella pertussis
ggcgagguagggcgcggcc

SEQ ID NO: 415881 - RNA, 16 nt, Bordetella pertussis
ggcgaucaggccgccc

SEQ ID NO: 415882 - RNA, 13 nt, Bordetella pertussis
ggcgauccgccgc

SEQ ID NO: 415883 - RNA, 21 nt, Bordetella pertussis
ggcgauccgccgcggccagcg

SEQ ID NO: 415884 - RNA, 20 nt, Bordetella pertussis
ggcgaucgaacgcggccaga

SEQ ID NO: 415885 - RNA, 23 nt, Bordetella pertussis
ggcgaucucguccugcaggaagg

SEQ ID NO: 415886 - RNA, 15 nt, Bordetella pertussis
ggcgaugcggcggcc

SEQ ID NO: 415887 - RNA, 22 nt, Bordetella pertussis
ggcgaugcggcggccgaagcgc

SEQ ID NO: 415888 - RNA, 13 nt, Bordetella pertussis
ggcgaugcgggcc

SEQ ID NO: 415889 - RNA, 16 nt, Bordetella pertussis
ggcgaugcgggcggcg

SEQ ID NO: 415890 - RNA, 21 nt, Bordetella pertussis
ggcgauggcaucgggcagggc

SEQ ID NO: 415891 - RNA, 19 nt, Bordetella pertussis
ggcgauggccgggagcggc

SEQ ID NO: 415892 - RNA, 21 nt, Bordetella pertussis
ggcgauggccugauggguguc

SEQ ID NO: 415893 - RNA, 15 nt, Bordetella pertussis
ggcgauggcgcggcc

SEQ ID NO: 415894 - RNA, 18 nt, Bordetella pertussis
ggcgauggcgcgucgccg

SEQ ID NO: 415895 - RNA, 19 nt, Bordetella pertussis
ggcgauggcgcgucgccgc

SEQ ID NO: 415896 - RNA, 15 nt, Bordetella pertussis
ggcgaugggcaccug

SEQ ID NO: 415897 - RNA, 17 nt, Bordetella pertussis
ggcgaugggcaccugcu

SEQ ID NO: 415898 - RNA, 15 nt, Bordetella pertussis
ggcgauggucugggu

SEQ ID NO: 415899 - RNA, 13 nt, Bordetella pertussis
ggcgcaagccagc

SEQ ID NO: 415900 - RNA, 14 nt, Bordetella pertussis
ggcgcaagccagca

SEQ ID NO: 415901 - RNA, 15 nt, Bordetella pertussis
ggcgcaagcgcgccg

SEQ ID NO: 415902 - RNA, 23 nt, Bordetella pertussis
ggcgcacaguugcaggccaugcu

SEQ ID NO: 415903 - RNA, 16 nt, Bordetella pertussis
ggcgcagauggcggcg

SEQ ID NO: 415904 - RNA, 17 nt, Bordetella pertussis
ggcgcagaugggcggcg

SEQ ID NO: 415905 - RNA, 14 nt, Bordetella pertussis
ggcgcagcacgccg

SEQ ID NO: 415906 - RNA, 12 nt, Bordetella pertussis
ggcgcagcaggc

SEQ ID NO: 415907 - RNA, 14 nt, Bordetella pertussis
ggcgcagcaggcca

SEQ ID NO: 415908 - RNA, 20 nt, Bordetella pertussis
ggcgcagcaggcgcgcggcc

SEQ ID NO: 415909 - RNA, 19 nt, Bordetella pertussis
ggcgcagcauuucggcgcc

SEQ ID NO: 415910 - RNA, 22 nt, Bordetella pertussis
ggcgcagcauuucggcgccgcc

SEQ ID NO: 415911 - RNA, 13 nt, Bordetella pertussis
ggcgcagcccagc

SEQ ID NO: 415912 - RNA, 14 nt, Bordetella pertussis
ggcgcagcccagcg

SEQ ID NO: 415913 - RNA, 15 nt, Bordetella pertussis
ggcgcagcgcagcuu

SEQ ID NO: 415914 - RNA, 19 nt, Bordetella pertussis
ggcgcaguuccggcgggcc

SEQ ID NO: 415915 - RNA, 15 nt, Bordetella pertussis
ggcgcagucgcgcac

SEQ ID NO: 415916 - RNA, 18 nt, Bordetella pertussis
ggcgcauauggagccagg

SEQ ID NO: 415917 - RNA, 23 nt, Bordetella pertussis
ggcgcauauggagccaggcggcg

SEQ ID NO: 415918 - RNA, 16 nt, Bordetella pertussis
ggcgcaucgacagcgc

SEQ ID NO: 415919 - RNA, 14 nt, Bordetella pertussis
ggcgcaucggcgcc

SEQ ID NO: 415920 - RNA, 21 nt, Bordetella pertussis
ggcgcaugacgaggugccugu

SEQ ID NO: 415921 - RNA, 15 nt, Bordetella pertussis
ggcgcaugagccggc

SEQ ID NO: 415922 - RNA, 18 nt, Bordetella pertussis
ggcgcaugagccggcaga

SEQ ID NO: 415923 - RNA, 15 nt, Bordetella pertussis
ggcgcaugcagccgc

SEQ ID NO: 415924 - RNA, 13 nt, Bordetella pertussis
ggcgcaugcugga

SEQ ID NO: 415925 - RNA, 15 nt, Bordetella pertussis
ggcgcauggccggcg

SEQ ID NO: 415926 - RNA, 17 nt, Bordetella pertussis
ggcgcauucgcgccuga

SEQ ID NO: 415927 - RNA, 16 nt, Bordetella pertussis
ggcgccaaagcacagg

SEQ ID NO: 415928 - RNA, 20 nt, Bordetella pertussis
ggcgcauuggcccugcuggg

SEQ ID NO: 415929 - RNA, 18 nt, Bordetella pertussis
ggcgccaagcggcaggcg

SEQ ID NO: 415930 - RNA, 16 nt, Bordetella pertussis
ggcgccacagggccug

SEQ ID NO: 415931 - RNA, 16 nt, Bordetella pertussis
ggcgccaugaucgccg

SEQ ID NO: 415932 - RNA, 14 nt, Bordetella pertussis
ggcgccauucuucg

SEQ ID NO: 415933 - RNA, 14 nt, Bordetella pertussis
ggcgcccagcgcca

SEQ ID NO: 415934 - RNA, 14 nt, Bordetella pertussis
ggcgcccagcgcgu

SEQ ID NO: 415935 - RNA, 22 nt, Bordetella pertussis
ggcgcccagcgcgucggccagc

SEQ ID NO: 415936 - RNA, 11 nt, Bordetella pertussis
ggcgcccagcu

SEQ ID NO: 415937 - RNA, 13 nt, Bordetella pertussis
ggcgcccagcugg

SEQ ID NO: 415938 - RNA, 14 nt, Bordetella pertussis
ggcgcccagcuggc

SEQ ID NO: 415939 - RNA, 21 nt, Bordetella pertussis
ggcgcccagcuggcgccccuu

SEQ ID NO: 415940 - RNA, 16 nt, Bordetella pertussis
ggcgcccaggcccagc

SEQ ID NO: 415941 - RNA, 18 nt, Bordetella pertussis
ggcgcccaggcccagcgc

SEQ ID NO: 415942 - RNA, 20 nt, Bordetella pertussis
ggcgccccaacgcggccagc

SEQ ID NO: 415943 - RNA, 13 nt, Bordetella pertussis
ggcgcccccagca

SEQ ID NO: 415944 - RNA, 15 nt, Bordetella pertussis
ggcgcccccgcggcg

SEQ ID NO: 415945 - RNA, 12 nt, Bordetella pertussis
ggcgcccgccga

SEQ ID NO: 415946 - RNA, 18 nt, Bordetella pertussis
ggcgcccgccgccgggcg

SEQ ID NO: 415947 - RNA, 12 nt, Bordetella pertussis
ggcgcccgcgca

SEQ ID NO: 415948 - RNA, 13 nt, Bordetella pertussis
ggcgcccgcggcc

SEQ ID NO: 415949 - RNA, 16 nt, Bordetella pertussis
ggcgcccgccugcgcc

SEQ ID NO: 415950 - RNA, 13 nt, Bordetella pertussis
ggcgcccggccgg

SEQ ID NO: 415951 - RNA, 13 nt, Bordetella pertussis
ggcgcccggcggc

SEQ ID NO: 415952 - RNA, 15 nt, Bordetella pertussis
ggcgcccggcggcgc

SEQ ID NO: 415953 - RNA, 16 nt, Bordetella pertussis
ggcgcccggccggccu

SEQ ID NO: 415954 - RNA, 14 nt, Bordetella pertussis
ggcgcccggccugc

SEQ ID NO: 415955 - RNA, 17 nt, Bordetella pertussis
ggcgcccugcagggcau

SEQ ID NO: 415956 - RNA, 23 nt, Bordetella pertussis
ggcgcccuugaugccgucggcga

SEQ ID NO: 415957 - RNA, 16 nt, Bordetella pertussis
ggcgccgaaggcggcg

SEQ ID NO: 415958 - RNA, 18 nt, Bordetella pertussis
ggcgccgaaggcggcgcc

SEQ ID NO: 415959 - RNA, 20 nt, Bordetella pertussis
ggcgccgaaggcggcgccgg

SEQ ID NO: 415960 - RNA, 16 nt, Bordetella pertussis
ggcgccgacccugccc

SEQ ID NO: 415961 - RNA, 15 nt, Bordetella pertussis
ggcgccgacgcgcug

SEQ ID NO: 415962 - RNA, 15 nt, Bordetella pertussis
ggcgccgacggcgcc

SEQ ID NO: 415963 - RNA, 22 nt, Bordetella pertussis
ggcgccgacggcgcccugcagg

SEQ ID NO: 415964 - RNA, 16 nt, Bordetella pertussis
ggcgccgacuuccugg

SEQ ID NO: 415965 - RNA, 12 nt, Bordetella pertussis
ggcgccgagggc

SEQ ID NO: 415966 - RNA, 22 nt, Bordetella pertussis
ggcgccgaucagcaggucggcg

SEQ ID NO: 415967 - RNA, 19 nt, Bordetella pertussis
ggcgccgauccagcccacc

SEQ ID NO: 415968 - RNA, 19 nt, Bordetella pertussis
ggcgccgauuucgccgccg

SEQ ID NO: 415969 - RNA, 19 nt, Bordetella pertussis
ggcgccgcaacaggcagcu

SEQ ID NO: 415970 - RNA, 14 nt, Bordetella pertussis
ggcgccgcacgccg

SEQ ID NO: 415971 - RNA, 20 nt, Bordetella pertussis
ggcgccgcagugcgcgcgcc

SEQ ID NO: 415972 - RNA, 14 nt, Bordetella pertussis
ggcgccggccagcg

SEQ ID NO: 415973 - RNA, 13 nt, Bordetella pertussis
ggcgccggccgcg

SEQ ID NO: 415974 - RNA, 19 nt, Bordetella pertussis
ggcgccggccgcgcgcgcc

SEQ ID NO: 415975 - RNA, 15 nt, Bordetella pertussis
ggcgccggccaggau

SEQ ID NO: 415976 - RNA, 18 nt, Bordetella pertussis
ggcgccggccaggaugag

SEQ ID NO: 415977 - RNA, 13 nt, Bordetella pertussis
ggcgccggccuca

SEQ ID NO: 415978 - RNA, 15 nt, Bordetella pertussis
ggcgccggccuccag

SEQ ID NO: 415979 - RNA, 23 nt, Bordetella pertussis
ggcgccggccuccagcaucgccg

SEQ ID NO: 415980 - RNA, 17 nt, Bordetella pertussis
ggcgccggcgcccggca

SEQ ID NO: 415981 - RNA, 17 nt, Bordetella pertussis
ggcgccggcgccgggca

SEQ ID NO: 415982 - RNA, 15 nt, Bordetella pertussis
ggcgccggcgcgccg

SEQ ID NO: 415983 - RNA, 14 nt, Bordetella pertussis
ggcgccggcggccu

SEQ ID NO: 415984 - RNA, 17 nt, Bordetella pertussis
ggcgccggcggccuccg

SEQ ID NO: 415985 - RNA, 19 nt, Bordetella pertussis
ggcgccgugcccgacggac

SEQ ID NO: 415986 - RNA, 20 nt, Bordetella pertussis
ggcgccguuuucagcgcagg

SEQ ID NO: 415987 - RNA, 23 nt, Bordetella pertussis
ggcgccguuuucagcgcaggcug

SEQ ID NO: 415988 - RNA, 18 nt, Bordetella pertussis
ggcgccuacacgguggcg

SEQ ID NO: 415989 - RNA, 21 nt, Bordetella pertussis
ggcgccuacacgguggcggug

SEQ ID NO: 415990 - RNA, 22 nt, Bordetella pertussis
ggcgccguucgucgcgcagcag

SEQ ID NO: 415991 - RNA, 22 nt, Bordetella pertussis
ggcgccuauugcgacgccgccg

SEQ ID NO: 415992 - RNA, 19 nt, Bordetella pertussis
ggcgccugcgcgcgcuggg

SEQ ID NO: 415993 - RNA, 15 nt, Bordetella pertussis
ggcgccugcggcagg

SEQ ID NO: 415994 - RNA, 22 nt, Bordetella pertussis
ggcgccugcucacgccccgccc

SEQ ID NO: 415995 - RNA, 18 nt, Bordetella pertussis
ggcgccuggccgcccagc

SEQ ID NO: 415996 - RNA, 18 nt, Bordetella pertussis
ggcgccuggucgcgcgcc

SEQ ID NO: 415997 - RNA, 21 nt, Bordetella pertussis
ggcgccuguccccgcugcggc

SEQ ID NO: 415998 - RNA, 22 nt, Bordetella pertussis
ggcgccugucccgcugggggcg

SEQ ID NO: 415999 - RNA, 17 nt, Bordetella pertussis
ggcgccuuccggcagcg

SEQ ID NO: 416000 - RNA, 20 nt, Bordetella pertussis
ggcgccuuccggcagcggcc

SEQ ID NO: 416001 - RNA, 18 nt, Bordetella pertussis
ggcgccuucggcgcggcg

SEQ ID NO: 416002 - RNA, 21 nt, Bordetella pertussis
ggcgccuugccgccgcgcagg

SEQ ID NO: 416003 - RNA, 16 nt, Bordetella pertussis
ggcgcgagcgccgggc

SEQ ID NO: 416004 - RNA, 17 nt, Bordetella pertussis
ggcgcgagcgccgggcg

SEQ ID NO: 416005 - RNA, 14 nt, Bordetella pertussis
ggcgcgaggcggcg

SEQ ID NO: 416006 - RNA, 20 nt, Bordetella pertussis
ggcgcgagguggcgcucgcg

SEQ ID NO: 416007 - RNA, 13 nt, Bordetella pertussis
ggcgcgauagcgc

SEQ ID NO: 416008 - RNA, 19 nt, Bordetella pertussis
ggcgcgauccuucgcggcc

SEQ ID NO: 416009 - RNA, 14 nt, Bordetella pertussis
ggcgcgaugggccu

SEQ ID NO: 416010 - RNA, 16 nt, Bordetella pertussis
ggcgcgaugggccugc

SEQ ID NO: 416011 - RNA, 18 nt, Bordetella pertussis
ggcgcgaugggccugccc

SEQ ID NO: 416012 - RNA, 21 nt, Bordetella pertussis
ggcgcgcaaaccgacgcggcc

SEQ ID NO: 416013 - RNA, 13 nt, Bordetella pertussis
ggcgcgcagcacg

SEQ ID NO: 416014 - RNA, 14 nt, Bordetella pertussis
ggcgcgcagcagac

SEQ ID NO: 416015 - RNA, 13 nt, Bordetella pertussis
ggcgcgcagcagc

SEQ ID NO: 416016 - RNA, 14 nt, Bordetella pertussis
ggcgcgcagcagcg

SEQ ID NO: 416017 - RNA, 14 nt, Bordetella pertussis
ggcgcgcagcaggc

SEQ ID NO: 416018 - RNA, 16 nt, Bordetella pertussis
ggcgcgcagcaggccc

SEQ ID NO: 416019 - RNA, 20 nt, Bordetella pertussis
ggcgcgcaccugggaggggc

SEQ ID NO: 416020 - RNA, 22 nt, Bordetella pertussis
ggcgcgcagcgccugcaggcgg

SEQ ID NO: 416021 - RNA, 23 nt, Bordetella pertussis
ggcgcgcagcgccugcaggcggu

SEQ ID NO: 416022 - RNA, 14 nt, Bordetella pertussis
ggcgcgcagcgcga

SEQ ID NO: 416023 - RNA, 16 nt, Bordetella pertussis
ggcgcgcagcgcgacc

SEQ ID NO: 416024 - RNA, 16 nt, Bordetella pertussis
ggcgcgccggccgcca

SEQ ID NO: 416025 - RNA, 19 nt, Bordetella pertussis
ggcgcgccggccgccagca

SEQ ID NO: 416026 - RNA, 23 nt, Bordetella pertussis
ggcgcgccggccgccagcaaggc

SEQ ID NO: 416027 - RNA, 21 nt, Bordetella pertussis
ggcgcgccggccgcggggcug

SEQ ID NO: 416028 - RNA, 21 nt, Bordetella pertussis
ggcgcgccggccugcgccggg

SEQ ID NO: 416029 - RNA, 23 nt, Bordetella pertussis
ggcgcgccggccugcgccgggcg

SEQ ID NO: 416030 - RNA, 15 nt, Bordetella pertussis
ggcgcgccggcgggc

SEQ ID NO: 416031 - RNA, 17 nt, Bordetella pertussis
ggcgcgccgggccggcg

SEQ ID NO: 416032 - RNA, 19 nt, Bordetella pertussis
ggcgcgccgggccggcggg

SEQ ID NO: 416033 - RNA, 20 nt, Bordetella pertussis
ggcgcgccgucgcuggggcg

SEQ ID NO: 416034 - RNA, 21 nt, Bordetella pertussis
ggcgcgccgucgcuggggcgc

SEQ ID NO: 416035 - RNA, 22 nt, Bordetella pertussis
ggcgcgccgucgcuggggcgca

SEQ ID NO: 416036 - RNA, 15 nt, Bordetella pertussis
ggcgcgccguggcug

SEQ ID NO: 416037 - RNA, 16 nt, Bordetella pertussis
ggcgcgcgcaagccgc

SEQ ID NO: 416038 - RNA, 18 nt, Bordetella pertussis
ggcgcgcgcaagccgccg

SEQ ID NO: 416039 - RNA, 18 nt, Bordetella pertussis
ggcgcgcgcaucggccgg

SEQ ID NO: 416040 - RNA, 20 nt, Bordetella pertussis
ggcgcgcgcaucgggauccg

SEQ ID NO: 416041 - RNA, 18 nt, Bordetella pertussis
ggcgcgcgccagcggcug

SEQ ID NO: 416042 - RNA, 18 nt, Bordetella pertussis
ggcgcgcgccaggcccag

SEQ ID NO: 416043 - RNA, 15 nt, Bordetella pertussis
ggcgcgcgccagggc

SEQ ID NO: 416044 - RNA, 22 nt, Bordetella pertussis
ggcgcgcgccagggcgccgcgg

SEQ ID NO: 416045 - RNA, 17 nt, Bordetella pertussis
ggcgcgcgaucucgggc

SEQ ID NO: 416046 - RNA, 19 nt, Bordetella pertussis
ggcgcgcgcccaggccagc

SEQ ID NO: 416047 - RNA, 16 nt, Bordetella pertussis
ggcgcgcgccgaugcg

SEQ ID NO: 416048 - RNA, 23 nt, Bordetella pertussis
ggcgcgcgccgaugcgccaggcu

SEQ ID NO: 416049 - RNA, 21 nt, Bordetella pertussis
ggcgcgcgccgcgccggggcg

SEQ ID NO: 416050 - RNA, 14 nt, Bordetella pertussis
ggcgcgcgccggcg

SEQ ID NO: 416051 - RNA, 20 nt, Bordetella pertussis
ggcgcgcgccggcggccugc

SEQ ID NO: 416052 - RNA, 21 nt, Bordetella pertussis
ggcgcgcgccggcggccugca

SEQ ID NO: 416053 - RNA, 20 nt, Bordetella pertussis
ggcgcgcgccugcucgaccu

SEQ ID NO: 416054 - RNA, 19 nt, Bordetella pertussis
ggcgcgcgcgacuccaccg

SEQ ID NO: 416055 - RNA, 15 nt, Bordetella pertussis
ggcgcgcgcggccag

SEQ ID NO: 416056 - RNA, 15 nt, Bordetella pertussis
ggcgcgcgcggcgcc

SEQ ID NO: 416057 - RNA, 16 nt, Bordetella pertussis
ggcgcgcgcggucggu

SEQ ID NO: 416058 - RNA, 19 nt, Bordetella pertussis
ggcgcgcgcugcacggccu

SEQ ID NO: 416059 - RNA, 14 nt, Bordetella pertussis
ggcgcgcgccccgc

SEQ ID NO: 416060 - RNA, 18 nt, Bordetella pertussis
ggcgcggcgggcucagcc

SEQ ID NO: 416061 - RNA, 19 nt, Bordetella pertussis
ggcgcggcgguccucgccg

SEQ ID NO: 416062 - RNA, 21 nt, Bordetella pertussis
ggcgcggcggugccugucccc

SEQ ID NO: 416063 - RNA, 15 nt, Bordetella pertussis
ggcgcggcgguggcg

SEQ ID NO: 416064 - RNA, 22 nt, Bordetella pertussis
ggcgcggcgucgaaggccgccg

SEQ ID NO: 416065 - RNA, 15 nt, Bordetella pertussis
ggcgcggcugcuggg

SEQ ID NO: 416066 - RNA, 17 nt, Bordetella pertussis
ggcgcggcugcugggca

SEQ ID NO: 416067 - RNA, 14 nt, Bordetella pertussis
ggcgcggcuggaug

SEQ ID NO: 416068 - RNA, 17 nt, Bordetella pertussis
ggcgcggcucgccggcc

SEQ ID NO: 416069 - RNA, 17 nt, Bordetella pertussis
ggcgcggcugcccucgg

SEQ ID NO: 416070 - RNA, 22 nt, Bordetella pertussis
ggcgcggcuuucgccggaggcg

SEQ ID NO: 416071 - RNA, 13 nt, Bordetella pertussis
ggcgcgggcggcc

SEQ ID NO: 416072 - RNA, 17 nt, Bordetella pertussis
ggcgcgggcggucggcg

SEQ ID NO: 416073 - RNA, 21 nt, Bordetella pertussis
ggcgcgggucuugagcggccc

SEQ ID NO: 416074 - RNA, 17 nt, Bordetella pertussis
ggcgcgguagcgccccu

SEQ ID NO: 416075 - RNA, 19 nt, Bordetella pertussis
ggcgcgguauucgcugcug

SEQ ID NO: 416076 - RNA, 14 nt, Bordetella pertussis
ggcgcgugccagca

SEQ ID NO: 416077 - RNA, 22 nt, Bordetella pertussis
ggcgcgugcggaugcagcagcg

SEQ ID NO: 416078 - RNA, 20 nt, Bordetella pertussis
ggcgcgugcucaucggcagg

SEQ ID NO: 416079 - RNA, 20 nt, Bordetella pertussis
ggcgcgugcuggcgcagcag

SEQ ID NO: 416080 - RNA, 20 nt, Bordetella pertussis
ggcgcguggccacggcgucg

SEQ ID NO: 416081 - RNA, 14 nt, Bordetella pertussis
ggcgcgugggcagg

SEQ ID NO: 416082 - RNA, 16 nt, Bordetella pertussis
ggcgcguucagcagca

SEQ ID NO: 416083 - RNA, 18 nt, Bordetella pertussis
ggcgcguucagcagcagg

SEQ ID NO: 416084 - RNA, 19 nt, Bordetella pertussis
ggcgcguucagcagcaggc

SEQ ID NO: 416085 - RNA, 21 nt, Bordetella pertussis
ggcgcguucagcagcaggccc

SEQ ID NO: 416086 - RNA, 16 nt, Bordetella pertussis
ggcgcguuccaugcga

SEQ ID NO: 416087 - RNA, 13 nt, Bordetella pertussis
ggcgcguucgccg

SEQ ID NO: 416088 - RNA, 19 nt, Bordetella pertussis
ggcgcguucgccgcagccg

SEQ ID NO: 416089 - RNA, 20 nt, Bordetella pertussis
ggcgcguucgccgcagccgu

SEQ ID NO: 416090 - RNA, 21 nt, Bordetella pertussis
ggcgcguugcgcaucgcgcac

SEQ ID NO: 416091 - RNA, 16 nt, Bordetella pertussis
ggcgcucagagcccca

SEQ ID NO: 416092 - RNA, 22 nt, Bordetella pertussis
ggcgcucagccgugccgcgcgc

SEQ ID NO: 416093 - RNA, 14 nt, Bordetella pertussis
ggcgcucagcgcgc

SEQ ID NO: 416094 - RNA, 16 nt, Bordetella pertussis
ggcgcucagcgcgccg

SEQ ID NO: 416095 - RNA, 21 nt, Bordetella pertussis
ggcgcucaggaaccagcggcu

SEQ ID NO: 416096 - RNA, 14 nt, Bordetella pertussis
ggcgcucgaaaaag

SEQ ID NO: 416097 - RNA, 13 nt, Bordetella pertussis
ggcgcucgcgcgc

SEQ ID NO: 416098 - RNA, 19 nt, Bordetella pertussis
ggcgcucgagcgccugcag

SEQ ID NO: 416099 - RNA, 22 nt, Bordetella pertussis
ggcgcucgcccucgcgccacca

SEQ ID NO: 416100 - RNA, 15 nt, Bordetella pertussis
ggcgcucgcgggugc

SEQ ID NO: 416101 - RNA, 15 nt, Bordetella pertussis
ggcgcucggccucga

SEQ ID NO: 416102 - RNA, 14 nt, Bordetella pertussis
ggcgcucgggcgcg

SEQ ID NO: 416103 - RNA, 16 nt, Bordetella pertussis
ggcgcugaccugcacg

SEQ ID NO: 416104 - RNA, 16 nt, Bordetella pertussis
ggcgcuggccgcccgc

SEQ ID NO: 416105 - RNA, 22 nt, Bordetella pertussis
ggcgcuggccggcgugcccaau

SEQ ID NO: 416106 - RNA, 19 nt, Bordetella pertussis
ggcgcuggccuggccgccg

SEQ ID NO: 416107 - RNA, 20 nt, Bordetella pertussis
ggcgcuggccuggccgccgg

SEQ ID NO: 416108 - RNA, 22 nt, Bordetella pertussis
ggcgcuggccuggccgccggcg

SEQ ID NO: 416109 - RNA, 19 nt, Bordetella pertussis
ggcgcuggcgcauggcugg

SEQ ID NO: 416110 - RNA, 18 nt, Bordetella pertussis
ggcgcuggcgcgcggcug

SEQ ID NO: 416111 - RNA, 15 nt, Bordetella pertussis
ggcgcuggcguccag

SEQ ID NO: 416112 - RNA, 21 nt, Bordetella pertussis
ggcgcuggcguccagccugcc

SEQ ID NO: 416113 - RNA, 19 nt, Bordetella pertussis
ggcgcuggcguucagcggg

SEQ ID NO: 416114 - RNA, 17 nt, Bordetella pertussis
ggcgcuggggaagcgcu

SEQ ID NO: 416115 - RNA, 17 nt, Bordetella pertussis
ggcgcuguuuccgggcc

SEQ ID NO: 416116 - RNA, 20 nt, Bordetella pertussis
ggcgcuguuuccgggccugg

SEQ ID NO: 416117 - RNA, 23 nt, Bordetella pertussis
ggcgcuucgucggccgccagcca

SEQ ID NO: 416118 - RNA, 23 nt, Bordetella pertussis
ggcgcuugacccguuugcgcagc

SEQ ID NO: 416119 - RNA, 16 nt, Bordetella pertussis
ggcgcuugcgcagggc

SEQ ID NO: 416120 - RNA, 21 nt, Bordetella pertussis
ggcggaaaacagcaccagcau

SEQ ID NO: 416121 - RNA, 14 nt, Bordetella pertussis
ggcggcccagcgug

SEQ ID NO: 416122 - RNA, 19 nt, Bordetella pertussis
ggcggcccagcguggcggu

SEQ ID NO: 416123 - RNA, 12 nt, Bordetella pertussis
ggcggcccaggc

SEQ ID NO: 416124 - RNA, 14 nt, Bordetella pertussis
ggcggcccggcggc

SEQ ID NO: 416125 - RNA, 15 nt, Bordetella pertussis
ggcggcccggcggca

SEQ ID NO: 416126 - RNA, 15 nt, Bordetella pertussis
ggcggccgcccagca

SEQ ID NO: 416127 - RNA, 16 nt, Bordetella pertussis
ggcggccgcccagcag

SEQ ID NO: 416128 - RNA, 12 nt, Bordetella pertussis
ggcggccgccuu

SEQ ID NO: 416129 - RNA, 12 nt, Bordetella pertussis
ggcggccgcggg

SEQ ID NO: 416130 - RNA, 14 nt, Bordetella pertussis
ggcggccgcgggcg

SEQ ID NO: 416131 - RNA, 17 nt, Bordetella pertussis
ggcggccgcgggcggcg

SEQ ID NO: 416132 - RNA, 20 nt, Bordetella pertussis
ggcggccgcguccagcgcgc

SEQ ID NO: 416133 - RNA, 13 nt, Bordetella pertussis
ggcggccggcagg

SEQ ID NO: 416134 - RNA, 22 nt, Bordetella pertussis
ggcggcgaacacgucgcgggcg

SEQ ID NO: 416135 - RNA, 15 nt, Bordetella pertussis
ggcggcgaccggcgc

SEQ ID NO: 416136 - RNA, 19 nt, Bordetella pertussis
ggcggcgacgcagcacggc

SEQ ID NO: 416137 - RNA, 15 nt, Bordetella pertussis
ggcggcgcagccgcc

SEQ ID NO: 416138 - RNA, 14 nt, Bordetella pertussis
ggcggcgcaggcca

SEQ ID NO: 416139 - RNA, 18 nt, Bordetella pertussis
ggcggcgcaucagcgcgc

SEQ ID NO: 416140 - RNA, 20 nt, Bordetella pertussis
ggcggcgcccauuccgagcg

SEQ ID NO: 416141 - RNA, 23 nt, Bordetella pertussis
ggcggcgccggugaccgccagca

SEQ ID NO: 416142 - RNA, 16 nt, Bordetella pertussis
ggcggcgcgcccagcg

SEQ ID NO: 416143 - RNA, 13 nt, Bordetella pertussis
ggcggcggguggc

SEQ ID NO: 416144 - RNA, 14 nt, Bordetella pertussis
ggcggcggguggcg

SEQ ID NO: 416145 - RNA, 21 nt, Bordetella pertussis
ggcggcgucgcuggcagccuu

SEQ ID NO: 416146 - RNA, 22 nt, Bordetella pertussis
ggcggcguuccugggcacgccg

SEQ ID NO: 416147 - RNA, 14 nt, Bordetella pertussis
ggcggcuaggcgca

SEQ ID NO: 416148 - RNA, 16 nt, Bordetella pertussis
ggcggcuaggcgcagc

SEQ ID NO: 416149 - RNA, 17 nt, Bordetella pertussis
ggcggcuaggcgcagca

SEQ ID NO: 416150 - RNA, 14 nt, Bordetella pertussis
ggcggcugaagaag

SEQ ID NO: 416151 - RNA, 17 nt, Bordetella pertussis
ggcggcugcccgggcug

SEQ ID NO: 416152 - RNA, 12 nt, Bordetella pertussis
ggcggcugucgg

SEQ ID NO: 416153 - RNA, 18 nt, Bordetella pertussis
ggcggcugucgggcggcg

SEQ ID NO: 416154 - RNA, 20 nt, Bordetella pertussis
ggcggcuuccuggucacccg

SEQ ID NO: 416155 - RNA, 16 nt, Bordetella pertussis
ggcggcuucgcgcagc

SEQ ID NO: 416156 - RNA, 17 nt, Bordetella pertussis
ggcggcuucgcgcagca

SEQ ID NO: 416157 - RNA, 20 nt, Bordetella pertussis
ggcggcuucggccgucagca

SEQ ID NO: 416158 - RNA, 22 nt, Bordetella pertussis
ggcggcuucggccgucagcagc

SEQ ID NO: 416159 - RNA, 15 nt, Bordetella pertussis
ggcggcuugcggucc

SEQ ID NO: 416160 - RNA, 14 nt, Bordetella pertussis
ggcggucagcgcgg

SEQ ID NO: 416161 - RNA, 14 nt, Bordetella pertussis
ggcggucccgagcg

SEQ ID NO: 416162 - RNA, 20 nt, Bordetella pertussis
ggcggucccgagcgcucccg

SEQ ID NO: 416163 - RNA, 17 nt, Bordetella pertussis
ggcgguccugguugaag

SEQ ID NO: 416164 - RNA, 14 nt, Bordetella pertussis
ggcggucgcgcugg

SEQ ID NO: 416165 - RNA, 23 nt, Bordetella pertussis
ggcggucuguuuuuuugggggcc

SEQ ID NO: 416166 - RNA, 21 nt, Bordetella pertussis
ggcggugaccaccaggccgcc

SEQ ID NO: 416167 - RNA, 16 nt, Bordetella pertussis
ggcggugaucugcucg

SEQ ID NO: 416168 - RNA, 19 nt, Bordetella pertussis
ggcggugaucugcucgccg

SEQ ID NO: 416169 - RNA, 19 nt, Bordetella pertussis
ggcggugcgcgcggccgag

SEQ ID NO: 416170 - RNA, 20 nt, Bordetella pertussis
ggcggugcgcgcggccgagg

SEQ ID NO: 416171 - RNA, 15 nt, Bordetella pertussis
ggcggugcggccucg

SEQ ID NO: 416172 - RNA, 18 nt, Bordetella pertussis
ggcggugcucgaggugca

SEQ ID NO: 416173 - RNA, 21 nt, Bordetella pertussis
ggcggugcugaacgccucggg

SEQ ID NO: 416174 - RNA, 14 nt, Bordetella pertussis
ggcgguggccagcg

SEQ ID NO: 416175 - RNA, 15 nt, Bordetella pertussis
ggcgguugcgcugcu

SEQ ID NO: 416176 - RNA, 22 nt, Bordetella pertussis
ggcgguuggccuugacggcgcg

SEQ ID NO: 416177 - RNA, 20 nt, Bordetella pertussis
ggcgguuggugucgcgcagc

SEQ ID NO: 416178 - RNA, 23 nt, Bordetella pertussis
ggcgguuuuucuuuggccgcgcg

SEQ ID NO: 416179 - RNA, 14 nt, Bordetella pertussis
ggcguaaggccgcc

SEQ ID NO: 416180 - RNA, 15 nt, Bordetella pertussis
ggcguaaggccgccg

SEQ ID NO: 416181 - RNA, 18 nt, Bordetella pertussis
ggcguaaggccgccggcc

SEQ ID NO: 416182 - RNA, 16 nt, Bordetella pertussis
ggcguaaggcugcagc

SEQ ID NO: 416183 - RNA, 23 nt, Bordetella pertussis
ggcguaauugggcugguagggga

SEQ ID NO: 416184 - RNA, 18 nt, Bordetella pertussis
ggcguaccaggcagccgg

SEQ ID NO: 416185 - RNA, 18 nt, Bordetella pertussis
ggcguaccgguccagaug

SEQ ID NO: 416186 - RNA, 18 nt, Bordetella pertussis
ggcguacgacggggugcc

SEQ ID NO: 416187 - RNA, 21 nt, Bordetella pertussis
ggcguagaaagccagugccuc

SEQ ID NO: 416188 - RNA, 14 nt, Bordetella pertussis
ggcgucacgcggcc

SEQ ID NO: 416189 - RNA, 21 nt, Bordetella pertussis
ggcgucacgcggccgggcaca

SEQ ID NO: 416190 - RNA, 15 nt, Bordetella pertussis
ggcguccacggcauc

SEQ ID NO: 416191 - RNA, 20 nt, Bordetella pertussis
ggcgucaucggcgcgcagca

SEQ ID NO: 416192 - RNA, 16 nt, Bordetella pertussis
ggcguccagccugccc

SEQ ID NO: 416193 - RNA, 23 nt, Bordetella pertussis
ggcguccagccugcccgggcagc

SEQ ID NO: 416194 - RNA, 13 nt, Bordetella pertussis
ggcgucccaggcc

SEQ ID NO: 416195 - RNA, 21 nt, Bordetella pertussis
ggcguccauuagggcccagcu

SEQ ID NO: 416196 - RNA, 22 nt, Bordetella pertussis
ggcguccauuagggcccagcug

SEQ ID NO: 416197 - RNA, 19 nt, Bordetella pertussis
ggcguccgcgucgccgccg

SEQ ID NO: 416198 - RNA, 15 nt, Bordetella pertussis
ggcguccggccccag

SEQ ID NO: 416199 - RNA, 18 nt, Bordetella pertussis
ggcgucgaaggccgccgg

SEQ ID NO: 416200 - RNA, 16 nt, Bordetella pertussis
ggcgucgaaggcggcc

SEQ ID NO: 416201 - RNA, 18 nt, Bordetella pertussis
ggcgucgaaggcggccgg

SEQ ID NO: 416202 - RNA, 22 nt, Bordetella pertussis
ggcgucgaaggcggccggcagg

SEQ ID NO: 416203 - RNA, 21 nt, Bordetella pertussis
ggcgucgaagguuucgcugcg

SEQ ID NO: 416204 - RNA, 18 nt, Bordetella pertussis
ggcgucgaucggcgcgcc

SEQ ID NO: 416205 - RNA, 16 nt, Bordetella pertussis
ggcgucgcccggggcg

SEQ ID NO: 416206 - RNA, 20 nt, Bordetella pertussis
ggcgucgcccggggcggcgu

SEQ ID NO: 416207 - RNA, 19 nt, Bordetella pertussis
ggcgucgcugcuggcggcg

SEQ ID NO: 416208 - RNA, 17 nt, Bordetella pertussis
ggcgucgcuggcagccu

SEQ ID NO: 416209 - RNA, 15 nt, Bordetella pertussis
ggcgucggccaggcc

SEQ ID NO: 416210 - RNA, 14 nt, Bordetella pertussis
ggcgucggccgccg

SEQ ID NO: 416211 - RNA, 13 nt, Bordetella pertussis
ggcgucgggcagc

SEQ ID NO: 416212 - RNA, 14 nt, Bordetella pertussis
ggcgucgggcagca

SEQ ID NO: 416213 - RNA, 16 nt, Bordetella pertussis
ggcgucgggcaguugc

SEQ ID NO: 416214 - RNA, 16 nt, Bordetella pertussis
ggcgucgggggcggcc

SEQ ID NO: 416215 - RNA, 19 nt, Bordetella pertussis
ggcgucguccugcagcagg

SEQ ID NO: 416216 - RNA, 13 nt, Bordetella pertussis
ggcgucguggggc

SEQ ID NO: 416217 - RNA, 22 nt, Bordetella pertussis
ggcgucguggggcgcggcggcg

SEQ ID NO: 416218 - RNA, 20 nt, Bordetella pertussis
ggcgucguuggccgcguagc

SEQ ID NO: 416219 - RNA, 17 nt, Bordetella pertussis
ggcgugaaaggccagcg

SEQ ID NO: 416220 - RNA, 19 nt, Bordetella pertussis
ggcgugaaaggccagcggc

SEQ ID NO: 416221 - RNA, 16 nt, Bordetella pertussis
ggcgugaccagcugca

SEQ ID NO: 416222 - RNA, 17 nt, Bordetella pertussis
ggcgugaccagcugcac

SEQ ID NO: 416223 - RNA, 20 nt, Bordetella pertussis
ggcgugacguugccgcgcgc

SEQ ID NO: 416224 - RNA, 22 nt, Bordetella pertussis
ggcgugcacgcguaugcccugc

SEQ ID NO: 416225 - RNA, 13 nt, Bordetella pertussis
ggcgugcagcagg

SEQ ID NO: 416226 - RNA, 14 nt, Bordetella pertussis
ggcgugcaggccgg

SEQ ID NO: 416227 - RNA, 19 nt, Bordetella pertussis
ggcgugcaggccggcggcg

SEQ ID NO: 416228 - RNA, 12 nt, Bordetella pertussis
ggcgugcccagg

SEQ ID NO: 416229 - RNA, 13 nt, Bordetella pertussis
ggcgugcccaggg

SEQ ID NO: 416230 - RNA, 21 nt, Bordetella pertussis
ggcgugccgcgcaggucggcg

SEQ ID NO: 416231 - RNA, 13 nt, Bordetella pertussis
ggcgugcgcuggc

SEQ ID NO: 416232 - RNA, 16 nt, Bordetella pertussis
ggcguggccgcaguca

SEQ ID NO: 416233 - RNA, 18 nt, Bordetella pertussis
ggcguggccgcagucagg

SEQ ID NO: 416234 - RNA, 15 nt, Bordetella pertussis
ggcguggccugcccg

SEQ ID NO: 416235 - RNA, 15 nt, Bordetella pertussis
ggcguggcgacagca

SEQ ID NO: 416236 - RNA, 17 nt, Bordetella pertussis
ggcguggcaggugcggc

SEQ ID NO: 416237 - RNA, 15 nt, Bordetella pertussis
ggcguggcgcagggu

SEQ ID NO: 416238 - RNA, 17 nt, Bordetella pertussis
ggcguggcggccaggcc

SEQ ID NO: 416239 - RNA, 22 nt, Bordetella pertussis
ggcguguccagcggcgccagcg

SEQ ID NO: 416240 - RNA, 17 nt, Bordetella pertussis
ggcguucagcgggcgcg

SEQ ID NO: 416241 - RNA, 22 nt, Bordetella pertussis
ggcguucgacgggcaggcccag

SEQ ID NO: 416242 - RNA, 20 nt, Bordetella pertussis
ggcguucgcggugggcagcg

SEQ ID NO: 416243 - RNA, 22 nt, Bordetella pertussis
ggcguucggcaccggcagccau

SEQ ID NO: 416244 - RNA, 18 nt, Bordetella pertussis
ggcguucgcgcgcggggu

SEQ ID NO: 416245 - RNA, 17 nt, Bordetella pertussis
ggcguucugcagcgcgg

SEQ ID NO: 416246 - RNA, 21 nt, Bordetella pertussis
ggcguugacguggcugagcca

SEQ ID NO: 416247 - RNA, 23 nt, Bordetella pertussis
ggcguuggccgggucgcgcagca

SEQ ID NO: 416248 - RNA, 15 nt, Bordetella pertussis
ggcguugugccggcg

SEQ ID NO: 416249 - RNA, 17 nt, Bordetella pertussis
ggcuaccacguggucug

SEQ ID NO: 416250 - RNA, 19 nt, Bordetella pertussis
ggcuaccacguggucugga

SEQ ID NO: 416251 - RNA, 14 nt, Bordetella pertussis
ggcuacgacccgcu

SEQ ID NO: 416252 - RNA, 14 nt, Bordetella pertussis
ggcuacgaccugaa

SEQ ID NO: 416253 - RNA, 23 nt, Bordetella pertussis
ggcucagccccccguaggcggcc

SEQ ID NO: 416254 - RNA, 17 nt, Bordetella pertussis
ggcucagcccgccuggc

SEQ ID NO: 416255 - RNA, 16 nt, Bordetella pertussis
ggcucaggcggccagg

SEQ ID NO: 416256 - RNA, 18 nt, Bordetella pertussis
ggcucaggcggccagggc

SEQ ID NO: 416257 - RNA, 20 nt, Bordetella pertussis
ggcucaggcugcgcgucggc

SEQ ID NO: 416258 - RNA, 14 nt, Bordetella pertussis
ggcucaggccagcg

SEQ ID NO: 416259 - RNA, 16 nt, Bordetella pertussis
ggcucagucggccugg

SEQ ID NO: 416260 - RNA, 18 nt, Bordetella pertussis
ggcuccccugcuaaggga

SEQ ID NO: 416261 - RNA, 12 nt, Bordetella pertussis
ggcuccccuggu

SEQ ID NO: 416262 - RNA, 20 nt, Bordetella pertussis
ggcucccgcuggcggcacac

SEQ ID NO: 416263 - RNA, 18 nt, Bordetella pertussis
ggcuccgauagcggcgcc

SEQ ID NO: 416264 - RNA, 15 nt, Bordetella pertussis
ggcuccggcuugccg

SEQ ID NO: 416265 - RNA, 22 nt, Bordetella pertussis
ggcuccggcuugccgaaggugc

SEQ ID NO: 416266 - RNA, 21 nt, Bordetella pertussis
ggcuccguuccgaugcuggug

SEQ ID NO: 416267 - RNA, 19 nt, Bordetella pertussis
ggugaccggcgugacgcgc

SEQ ID NO: 416268 - RNA, 21 nt, Bordetella pertussis
ggugaccggggcguccaccgc

SEQ ID NO: 416269 - RNA, 23 nt, Bordetella pertussis
ggugaccuggggguucgugggcg

SEQ ID NO: 416270 - RNA, 18 nt, Bordetella pertussis
ggugacgcuggagcgcgg

SEQ ID NO: 416271 - RNA, 22 nt, Bordetella pertussis
ggugacgcuggagcgcggcggc

SEQ ID NO: 416272 - RNA, 16 nt, Bordetella pertussis
ggugacgggcugggcc

SEQ ID NO: 416273 - RNA, 17 nt, Bordetella pertussis
ggugagcaagcgcugga

SEQ ID NO: 416274 - RNA, 19 nt, Bordetella pertussis
ggugagcaagcgcuggaug

SEQ ID NO: 416275 - RNA, 15 nt, Bordetella pertussis
ggugaggggccagcc

SEQ ID NO: 416276 - RNA, 18 nt, Bordetella pertussis
ggugaggggccagccugg

SEQ ID NO: 416277 - RNA, 22 nt, Bordetella pertussis
ggugagggugaccaugucgccg

SEQ ID NO: 416278 - RNA, 20 nt, Bordetella pertussis
ggugauccacugcagcaguu

SEQ ID NO: 416279 - RNA, 14 nt, Bordetella pertussis
ggugauguccugca

SEQ ID NO: 416280 - RNA, 17 nt, Bordetella pertussis
ggugauguccugcaggc

SEQ ID NO: 416281 - RNA, 14 nt, Bordetella pertussis
ggugaugucgccgg

SEQ ID NO: 416282 - RNA, 22 nt, Bordetella pertussis
ggugcaagcggccggccugcgg

SEQ ID NO: 416283 - RNA, 20 nt, Bordetella pertussis
ggugcacagcgucccagcca

SEQ ID NO: 416284 - RNA, 20 nt, Bordetella pertussis
ggugcaccaggccacccgcc

SEQ ID NO: 416285 - RNA, 19 nt, Bordetella pertussis
ggugcacguggaugaugcg

SEQ ID NO: 416286 - RNA, 19 nt, Bordetella pertussis
ggugcacgugggcacgccg

SEQ ID NO: 416287 - RNA, 13 nt, Bordetella pertussis
ggugcagcccagc

SEQ ID NO: 416288 - RNA, 15 nt, Bordetella pertussis
ggugcagcggcagca

SEQ ID NO: 416289 - RNA, 20 nt, Bordetella pertussis
ggugcaggguuggcgcgccg

SEQ ID NO: 416290 - RNA, 21 nt, Bordetella pertussis
ggugcaggucaucgcgcuggc

SEQ ID NO: 416291 - RNA, 24 nt, Bordetella pertussis
ggugcagcuucuugaacucggcca

SEQ ID NO: 416292 - RNA, 23 nt, Bordetella pertussis
ggugcaucucggcaucggccacg

SEQ ID NO: 416293 - RNA, 15 nt, Bordetella pertussis
ggugcauucguccag

SEQ ID NO: 416294 - RNA, 23 nt, Bordetella pertussis
ggugccaguccccauguggggac

SEQ ID NO: 416295 - RNA, 21 nt, Bordetella pertussis
ggugccagucccccgcgggga

SEQ ID NO: 416296 - RNA, 22 nt, Bordetella pertussis
ggugccaucgauaugggcggcc

SEQ ID NO: 416297 - RNA, 23 nt, Bordetella pertussis
ggugcccagcgagcggggcuggu

SEQ ID NO: 416298 - RNA, 13 nt, Bordetella pertussis
ggugcccguagca

SEQ ID NO: 416299 - RNA, 14 nt, Bordetella pertussis
ggugccgcagacgg

SEQ ID NO: 416300 - RNA, 14 nt, Bordetella pertussis
ggugccgccgagca

SEQ ID NO: 416301 - RNA, 15 nt, Bordetella pertussis
ggugccgccuggcca

SEQ ID NO: 416302 - RNA, 16 nt, Bordetella pertussis
ggugccgcgcaggccc

SEQ ID NO: 416303 - RNA, 18 nt, Bordetella pertussis
ggugccgcgcaggcccuu

SEQ ID NO: 416304 - RNA, 20 nt, Bordetella pertussis
ggugccgcgcgcggccggca

SEQ ID NO: 416305 - RNA, 20 nt, Bordetella pertussis
ggugccgcguaugcggcagc

SEQ ID NO: 416306 - RNA, 23 nt, Bordetella pertussis
ggugccguaauccgugguggggc

SEQ ID NO: 416307 - RNA, 15 nt, Bordetella pertussis
ggugccguccagcgc

SEQ ID NO: 416308 - RNA, 18 nt, Bordetella pertussis
ggugccguucggccagcg

SEQ ID NO: 416309 - RNA, 21 nt, Bordetella pertussis
ggugccguucggccagcgcgc

SEQ ID NO: 416310 - RNA, 13 nt, Bordetella pertussis
ggugccugccccu

SEQ ID NO: 416311 - RNA, 21 nt, Bordetella pertussis
ggugccugcuugcaggaagcg

SEQ ID NO: 416312 - RNA, 12 nt, Bordetella pertussis
ggugccuguccc

SEQ ID NO: 416313 - RNA, 15 nt, Bordetella pertussis
ggugccuguccccgc

SEQ ID NO: 416314 - RNA, 20 nt, Bordetella pertussis
ggugccuguccccgcgggga

SEQ ID NO: 416315 - RNA, 16 nt, Bordetella pertussis
ggugccuguccccgcu

SEQ ID NO: 416316 - RNA, 14 nt, Bordetella pertussis
ggugccugugcccg

SEQ ID NO: 416317 - RNA, 21 nt, Bordetella pertussis
ggugccuguucccgccgggcc

SEQ ID NO: 416318 - RNA, 23 nt, Bordetella pertussis
ggugcgacugcaggaugaggcgc

SEQ ID NO: 416319 - RNA, 16 nt, Bordetella pertussis
ggugcgauagcgccgc

SEQ ID NO: 416320 - RNA, 14 nt, Bordetella pertussis
ggugcgcagccggg

SEQ ID NO: 416321 - RNA, 16 nt, Bordetella pertussis
ggugcgcagccgggcu

SEQ ID NO: 416322 - RNA, 21 nt, Bordetella pertussis
ggugcgcagccgggcugccgg

SEQ ID NO: 416323 - RNA, 16 nt, Bordetella pertussis
ggugcgcagcggcagg

SEQ ID NO: 416324 - RNA, 19 nt, Bordetella pertussis
ggugcgcaccuugcccacg

SEQ ID NO: 416325 - RNA, 16 nt, Bordetella pertussis
ggugcgcagcaggugg

SEQ ID NO: 416326 - RNA, 20 nt, Bordetella pertussis
ggugcgccgcaugcggcggc

SEQ ID NO: 416327 - RNA, 15 nt, Bordetella pertussis
ggugcgccgccgccg

SEQ ID NO: 416328 - RNA, 23 nt, Bordetella pertussis
ggugcgccgccgccgcggccugg

SEQ ID NO: 416329 - RNA, 18 nt, Bordetella pertussis
ggugcgcgcagggcggcc

SEQ ID NO: 416330 - RNA, 20 nt, Bordetella pertussis
ggugcgcgcagggcggccgg

SEQ ID NO: 416331 - RNA, 14 nt, Bordetella pertussis
ggugcgcgugggca

SEQ ID NO: 416332 - RNA, 19 nt, Bordetella pertussis
ggugcgcgugggcacccgg

SEQ ID NO: 416333 - RNA, 15 nt, Bordetella pertussis
ggugcggaucacggg

SEQ ID NO: 416334 - RNA, 16 nt, Bordetella pertussis
ggugcggccgguggcg

SEQ ID NO: 416335 - RNA, 23 nt, Bordetella pertussis
ggugcggccucggcgggcggcgc

SEQ ID NO: 416336 - RNA, 14 nt, Bordetella pertussis
ggugcgggagccgg

SEQ ID NO: 416337 - RNA, 16 nt, Bordetella pertussis
ggugcgggccgcgcug

SEQ ID NO: 416338 - RNA, 14 nt, Bordetella pertussis
ggugcgggccggcg

SEQ ID NO: 416339 - RNA, 16 nt, Bordetella pertussis
ggugcgggccggcgcg

SEQ ID NO: 416340 - RNA, 19 nt, Bordetella pertussis
ggugcgggugggcgcgccg

SEQ ID NO: 416341 - RNA, 14 nt, Bordetella pertussis
ggugcugccgccga

SEQ ID NO: 416342 - RNA, 17 nt, Bordetella pertussis
ggugcugccgccgaugu

SEQ ID NO: 416343 - RNA, 16 nt, Bordetella pertussis
ggugcugggcuuugcc

SEQ ID NO: 416344 - RNA, 22 nt, Bordetella pertussis
ggugcuggugccgcuggcggcc

SEQ ID NO: 416345 - RNA, 16 nt, Bordetella pertussis
ggugcuggugcuggug

SEQ ID NO: 416346 - RNA, 18 nt, Bordetella pertussis
ggugcuguuucgcgagga

SEQ ID NO: 416347 - RNA, 16 nt, Bordetella pertussis
ggugcuugaugcccag

SEQ ID NO: 416348 - RNA, 18 nt, Bordetella pertussis
ggugcuugaugcccagcu

SEQ ID NO: 416349 - RNA, 17 nt, Bordetella pertussis
gguggaaaugccggcgg

SEQ ID NO: 416350 - RNA, 18 nt, Bordetella pertussis
gguggaaaugccggcggc

SEQ ID NO: 416351 - RNA, 16 nt, Bordetella pertussis
gguggacagcgccagc

SEQ ID NO: 416352 - RNA, 22 nt, Bordetella pertussis
gguggacagcgccagcccgcug

SEQ ID NO: 416353 - RNA, 20 nt, Bordetella pertussis
gguggacgccaagaccgcgg

SEQ ID NO: 416354 - RNA, 14 nt, Bordetella pertussis
gguggacggccagc

SEQ ID NO: 416355 - RNA, 18 nt, Bordetella pertussis
gguggagcgcggcgcugg

SEQ ID NO: 416356 - RNA, 12 nt, Bordetella pertussis
gguggccagcag

SEQ ID NO: 416357 - RNA, 13 nt, Bordetella pertussis
gguggccaguucc

SEQ ID NO: 416358 - RNA, 21 nt, Bordetella pertussis
gguggcccgcaccgggcggcc

SEQ ID NO: 416359 - RNA, 22 nt, Bordetella pertussis
gguggccgcgcaugccagcuug

SEQ ID NO: 416360 - RNA, 19 nt, Bordetella pertussis
gguggccgcuccagagcgc

SEQ ID NO: 416361 - RNA, 14 nt, Bordetella pertussis
gguggcggggcgca

SEQ ID NO: 416362 - RNA, 13 nt, Bordetella pertussis
gguggcuggugcc

SEQ ID NO: 416363 - RNA, 14 nt, Bordetella pertussis
gguggcuggugcca

SEQ ID NO: 416364 - RNA, 15 nt, Bordetella pertussis
gguggcugcgcaggu

SEQ ID NO: 416365 - RNA, 17 nt, Bordetella pertussis
ggugggcauccagcggc

SEQ ID NO: 416366 - RNA, 14 nt, Bordetella pertussis
ggugggcggcagca

SEQ ID NO: 416367 - RNA, 13 nt, Bordetella pertussis
gguggggcagcag

SEQ ID NO: 416368 - RNA, 16 nt, Bordetella pertussis
gguggggccgggcucg

SEQ ID NO: 416369 - RNA, 15 nt, Bordetella pertussis
gguggucugccaguc

SEQ ID NO: 416370 - RNA, 18 nt, Bordetella pertussis
gguggugcagcggcagca

SEQ ID NO: 416371 - RNA, 19 nt, Bordetella pertussis
gguggugcagcggcagcau

SEQ ID NO: 416372 - RNA, 20 nt, Bordetella pertussis
gguggugcagcggcagcaug

SEQ ID NO: 416373 - RNA, 14 nt, Bordetella pertussis
gguggugcugggcg

SEQ ID NO: 416374 - RNA, 19 nt, Bordetella pertussis
gguggugcugggcggcggg

SEQ ID NO: 416375 - RNA, 19 nt, Bordetella pertussis
gguggugccugcuugcagg

SEQ ID NO: 416376 - RNA, 20 nt, Bordetella pertussis
gguggugucggcggccagca

SEQ ID NO: 416377 - RNA, 23 nt, Bordetella pertussis
gguguagaagaacagcagauggc

SEQ ID NO: 416378 - RNA, 20 nt, Bordetella pertussis
ggugucccucggagccuguc

SEQ ID NO: 416379 - RNA, 16 nt, Bordetella pertussis
ggugucggcggccagc

SEQ ID NO: 416380 - RNA, 17 nt, Bordetella pertussis
ggugucggggccgggcc

SEQ ID NO: 416381 - RNA, 14 nt, Bordetella pertussis
gguguucgagccgg

SEQ ID NO: 416382 - RNA, 21 nt, Bordetella pertussis
gguucaugacguccggcgggc

SEQ ID NO: 416383 - RNA, 14 nt, Bordetella pertussis
gguuccagccuggc

SEQ ID NO: 416384 - RNA, 12 nt, Bordetella pertussis
gguuccugccca

SEQ ID NO: 416385 - RNA, 21 nt, Bordetella pertussis
gguucgcccaccaccagcggc

SEQ ID NO: 416386 - RNA, 21 nt, Bordetella pertussis
gguucgucagggccgcagcac

SEQ ID NO: 416387 - RNA, 21 nt, Bordetella pertussis
gguucuguccggcgcuggcuu

SEQ ID NO: 416388 - RNA, 13 nt, Bordetella pertussis
gguugaaggccgc

SEQ ID NO: 416389 - RNA, 21 nt, Bordetella pertussis
gguugaaguugcucggcggca

SEQ ID NO: 416390 - RNA, 14 nt, Bordetella pertussis
gguugagucuggag

SEQ ID NO: 416391 - RNA, 13 nt, Bordetella pertussis
gguugcagcgcgc

SEQ ID NO: 416392 - RNA, 17 nt, Bordetella pertussis
gguugccgaaggguugc

SEQ ID NO: 416393 - RNA, 14 nt, Bordetella pertussis
gguugcgcugcugu

SEQ ID NO: 416394 - RNA, 16 nt, Bordetella pertussis
gguuggccagcuccag

SEQ ID NO: 416395 - RNA, 21 nt, Bordetella pertussis
gguuuagcgcguaucgaauuc

SEQ ID NO: 416396 - RNA, 13 nt, Bordetella pertussis
gguuugguagcag

SEQ ID NO: 416397 - RNA, 24 nt, Bordetella pertussis
gguuuuucauuggagcucgcucag

SEQ ID NO: 416398 - RNA, 21 nt, Bordetella pertussis
guaaagccgcacgcccgccug

SEQ ID NO: 416399 - RNA, 18 nt, Bordetella pertussis
guaagcaccagguugcau

SEQ ID NO: 416400 - RNA, 22 nt, Bordetella pertussis
guaagcccacucacgcaaggcc

SEQ ID NO: 416401 - RNA, 16 nt, Bordetella pertussis
guaagcgcuggacgcc

SEQ ID NO: 416402 - RNA, 15 nt, Bordetella pertussis
guaaggccgccggcc

SEQ ID NO: 416403 - RNA, 17 nt, Bordetella pertussis
guaauaguggucgccgg

SEQ ID NO: 416404 - RNA, 14 nt, Bordetella pertussis
guacacggccagca

SEQ ID NO: 416405 - RNA, 21 nt, Bordetella pertussis
guacacguuggggaaccgcac

SEQ ID NO: 416406 - RNA, 16 nt, Bordetella pertussis
guacagccaggccagc

SEQ ID NO: 416407 - RNA, 19 nt, Bordetella pertussis
guacagccaggccagcagc

SEQ ID NO: 416408 - RNA, 17 nt, Bordetella pertussis
guacagccccagcgcca

SEQ ID NO: 416409 - RNA, 16 nt, Bordetella pertussis
guacaggccggcggcg

SEQ ID NO: 416410 - RNA, 14 nt, Bordetella pertussis
guacaggugcuggg

SEQ ID NO: 416411 - RNA, 16 nt, Bordetella pertussis
guacaucauccccagc

SEQ ID NO: 416412 - RNA, 14 nt, Bordetella pertussis
guaccaauacagga

SEQ ID NO: 416413 - RNA, 13 nt, Bordetella pertussis
guaccagcccagc

SEQ ID NO: 416414 - RNA, 23 nt, Bordetella pertussis
guaccaguacaccggcgugcaga

SEQ ID NO: 416415 - RNA, 19 nt, Bordetella pertussis
guacccaugcggggcggcg

SEQ ID NO: 416416 - RNA, 17 nt, Bordetella pertussis
guaccgccgccugcgcg

SEQ ID NO: 416417 - RNA, 20 nt, Bordetella pertussis
guaccgguagcccgcgugga

SEQ ID NO: 416418 - RNA, 15 nt, Bordetella pertussis
guaccguccuggcag

SEQ ID NO: 416419 - RNA, 22 nt, Bordetella pertussis
guacgacgagcgcaccauggcg

SEQ ID NO: 416420 - RNA, 23 nt, Bordetella pertussis
guacgaggcauacaggcuguggc

SEQ ID NO: 416421 - RNA, 15 nt, Bordetella pertussis
guacgagugcaggcc

SEQ ID NO: 416422 - RNA, 16 nt, Bordetella pertussis
guacgagugcaggccc

SEQ ID NO: 416423 - RNA, 17 nt, Bordetella pertussis
guacgccacuuccuugc

SEQ ID NO: 416424 - RNA, 15 nt, Bordetella pertussis
guacgcccagcuggg

SEQ ID NO: 416425 - RNA, 22 nt, Bordetella pertussis
guacgccgaacaagguccaggc

SEQ ID NO: 416426 - RNA, 12 nt, Bordetella pertussis
guacgcgggcau

SEQ ID NO: 416427 - RNA, 16 nt, Bordetella pertussis
guacggcccuggucua

SEQ ID NO: 416428 - RNA, 20 nt, Bordetella pertussis
guacggcgaugccggcgcug

SEQ ID NO: 416429 - RNA, 14 nt, Bordetella pertussis
guacggcugcacca

SEQ ID NO: 416430 - RNA, 14 nt, Bordetella pertussis
guacgucaaggccu

SEQ ID NO: 416431 - RNA, 19 nt, Bordetella pertussis
guacgucaaggccugcccg

SEQ ID NO: 416432 - RNA, 15 nt, Bordetella pertussis
guacguggccccagg

SEQ ID NO: 416433 - RNA, 23 nt, Bordetella pertussis
guacuccuaucuuucgggcgcgg

SEQ ID NO: 416434 - RNA, 20 nt, Bordetella pertussis
guacucgccgucgaaacacg

SEQ ID NO: 416435 - RNA, 17 nt, Bordetella pertussis
guacucgcgcggguccu

SEQ ID NO: 416436 - RNA, 14 nt, Bordetella pertussis
guacucggccaggc

SEQ ID NO: 416437 - RNA, 15 nt, Bordetella pertussis
guacucggccaggcc

SEQ ID NO: 416438 - RNA, 21 nt, Bordetella pertussis
guacucguacgaagcaaacag

SEQ ID NO: 416439 - RNA, 16 nt, Bordetella pertussis
guacuggcgcggcggc

SEQ ID NO: 416440 - RNA, 19 nt, Bordetella pertussis
guacuggcgcggcggccag

SEQ ID NO: 416441 - RNA, 11 nt, Bordetella pertussis
guacuggcugg

SEQ ID NO: 416442 - RNA, 20 nt, Bordetella pertussis
guacugggccaccuuggugg

SEQ ID NO: 416443 - RNA, 17 nt, Bordetella pertussis
guagaccaccagcagga

SEQ ID NO: 416444 - RNA, 21 nt, Bordetella pertussis
guagaccaccagcaggaugga

SEQ ID NO: 416445 - RNA, 23 nt, Bordetella pertussis
guagaccgcguugaccggcuggc

SEQ ID NO: 416446 - RNA, 16 nt, Bordetella pertussis
guagaccgggucgggc

SEQ ID NO: 416447 - RNA, 23 nt, Bordetella pertussis
guagagcgccgcgugguggcgca

SEQ ID NO: 416448 - RNA, 20 nt, Bordetella pertussis
guagaucagccgcugcagca

SEQ ID NO: 416449 - RNA, 13 nt, Bordetella pertussis
guagaugggcagg

SEQ ID NO: 416450 - RNA, 23 nt, Bordetella pertussis
guagcacacgccgauugaggcca

SEQ ID NO: 416451 - RNA, 21 nt, Bordetella pertussis
guagcaggcgcgcucaggccg

SEQ ID NO: 416452 - RNA, 20 nt, Bordetella pertussis
guagcccauguucuggucuc

SEQ ID NO: 416453 - RNA, 15 nt, Bordetella pertussis
guagcccuggcgcug

SEQ ID NO: 416454 - RNA, 20 nt, Bordetella pertussis
guagcccuggcgcugcagcg

SEQ ID NO: 416455 - RNA, 18 nt, Bordetella pertussis
guagccgaauccggccag

SEQ ID NO: 416456 - RNA, 19 nt, Bordetella pertussis
guagccgaauccggccagc

SEQ ID NO: 416457 - RNA, 20 nt, Bordetella pertussis
guagccgaauccggccagca

SEQ ID NO: 416458 - RNA, 22 nt, Bordetella pertussis
guagccgaauccggccagcacg

SEQ ID NO: 416459 - RNA, 21 nt, Bordetella pertussis
guagccgaugaccggccaggc

SEQ ID NO: 416460 - RNA, 23 nt, Bordetella pertussis
guagccgaugaccggccaggcgc

SEQ ID NO: 416461 - RNA, 18 nt, Bordetella pertussis
guagcccuuguggccgcc

SEQ ID NO: 416462 - RNA, 17 nt, Bordetella pertussis
guagccgggucuggccg

SEQ ID NO: 416463 - RNA, 19 nt, Bordetella pertussis
guagccggugcgcagcacc

SEQ ID NO: 416464 - RNA, 17 nt, Bordetella pertussis
guagccgccgacgauga

SEQ ID NO: 416465 - RNA, 10 nt, Bordetella pertussis
guagcgcagg

SEQ ID NO: 416466 - RNA, 23 nt, Bordetella pertussis
guagcgcgcagcucccccacgcc

SEQ ID NO: 416467 - RNA, 14 nt, Bordetella pertussis
guagcgcggccggg

SEQ ID NO: 416468 - RNA, 15 nt, Bordetella pertussis
guagcgcguggccag

SEQ ID NO: 416469 - RNA, 23 nt, Bordetella pertussis
guagcgccggcuugcgccagcca

SEQ ID NO: 416470 - RNA, 15 nt, Bordetella pertussis
guagcgcugcagcca

SEQ ID NO: 416471 - RNA, 21 nt, Bordetella pertussis
guagcggaucgcggcgcggcu

SEQ ID NO: 416472 - RNA, 11 nt, Bordetella pertussis
guagcggauga

SEQ ID NO: 416473 - RNA, 15 nt, Bordetella pertussis
guagcgggcggcggc

SEQ ID NO: 416474 - RNA, 14 nt, Bordetella pertussis
guagcgguccagcu

SEQ ID NO: 416475 - RNA, 17 nt, Bordetella pertussis
guagcgguccagcugcg

SEQ ID NO: 416476 - RNA, 13 nt, Bordetella pertussis
guagcgguccggg

SEQ ID NO: 416477 - RNA, 22 nt, Bordetella pertussis
guagcucgaccaucauggccag

SEQ ID NO: 416478 - RNA, 16 nt, Bordetella pertussis
guagcugcgccgcauu

SEQ ID NO: 416479 - RNA, 14 nt, Bordetella pertussis
guaggacagcccca

SEQ ID NO: 416480 - RNA, 22 nt, Bordetella pertussis
guaggacagccccagcagcacg

SEQ ID NO: 416481 - RNA, 17 nt, Bordetella pertussis
guaggcaaagcgcagca

SEQ ID NO: 416482 - RNA, 23 nt, Bordetella pertussis
guaggcaaagcgcggcugcgggc

SEQ ID NO: 416483 - RNA, 13 nt, Bordetella pertussis
guaggccggcacg

SEQ ID NO: 416484 - RNA, 16 nt, Bordetella pertussis
guaggccuggucgggg

SEQ ID NO: 416485 - RNA, 17 nt, Bordetella pertussis
guaggcgccgcgcccgu

SEQ ID NO: 416486 - RNA, 18 nt, Bordetella pertussis
guaggcgcgguccaccuc

SEQ ID NO: 416487 - RNA, 20 nt, Bordetella pertussis
guaggcgcgguccaccucgu

SEQ ID NO: 416488 - RNA, 15 nt, Bordetella pertussis
guaggcggccaggcc

SEQ ID NO: 416489 - RNA, 14 nt, Bordetella pertussis
guaggcggucagcu

SEQ ID NO: 416490 - RNA, 18 nt, Bordetella pertussis
guaggucaggcccacgcc

SEQ ID NO: 416491 - RNA, 20 nt, Bordetella pertussis
guaguacacauaaucggccc

SEQ ID NO: 416492 - RNA, 14 nt, Bordetella pertussis
guaguacagcagca

SEQ ID NO: 416493 - RNA, 23 nt, Bordetella pertussis
guaguacucgccguugucgacga

SEQ ID NO: 416494 - RNA, 21 nt, Bordetella pertussis
guaguccaucgcguccaggcc

SEQ ID NO: 416495 - RNA, 15 nt, Bordetella pertussis
guagucgccgcugcc

SEQ ID NO: 416496 - RNA, 14 nt, Bordetella pertussis
guagucggccacca

SEQ ID NO: 416497 - RNA, 18 nt, Bordetella pertussis
guagucggcgcccagcuc

SEQ ID NO: 416498 - RNA, 15 nt, Bordetella pertussis
guagugguguagcca

SEQ ID NO: 416499 - RNA, 14 nt, Bordetella pertussis
guaguugggcgccu

SEQ ID NO: 416500 - RNA, 18 nt, Bordetella pertussis
guaucaacuuccagcgcc

SEQ ID NO: 416501 - RNA, 17 nt, Bordetella pertussis
guaucccucgcccagcg

SEQ ID NO: 416502 - RNA, 15 nt, Bordetella pertussis
guaucccggccaggc

SEQ ID NO: 416503 - RNA, 16 nt, Bordetella pertussis
guaucccggccaggcg

SEQ ID NO: 416504 - RNA, 19 nt, Bordetella pertussis
guaucgcggcgcaggcggg

SEQ ID NO: 416505 - RNA, 23 nt, Bordetella pertussis
guaucuguccccgcggggacagg

SEQ ID NO: 416506 - RNA, 23 nt, Bordetella pertussis
guaugacagggugccuguccccg

SEQ ID NO: 416507 - RNA, 13 nt, Bordetella pertussis
guaugccugccag

SEQ ID NO: 416508 - RNA, 17 nt, Bordetella pertussis
guaugcggcgcccaggc

SEQ ID NO: 416509 - RNA, 22 nt, Bordetella pertussis
guaugcggcgcccaggcccagc

SEQ ID NO: 416510 - RNA, 14 nt, Bordetella pertussis
guauggccgcccag

SEQ ID NO: 416511 - RNA, 20 nt, Bordetella pertussis
guauggcggcaacgugcagg

SEQ ID NO: 416512 - RNA, 14 nt, Bordetella pertussis
guauucgcgcuggc

SEQ ID NO: 416513 - RNA, 15 nt, Bordetella pertussis
guauucgcgcuggcg

SEQ ID NO: 416514 - RNA, 12 nt, Bordetella pertussis
guauugcugcug

SEQ ID NO: 416515 - RNA, 14 nt, Bordetella pertussis
guauugugcaugcg

SEQ ID NO: 416516 - RNA, 17 nt, Bordetella pertussis
gucaaccacgccaagga

SEQ ID NO: 416517 - RNA, 21 nt, Bordetella pertussis
gucaacggcaagaagauccgc

SEQ ID NO: 416518 - RNA, 15 nt, Bordetella pertussis
gucaaggccugcccg

SEQ ID NO: 416519 - RNA, 17 nt, Bordetella pertussis
gucaaggcggggcuccu

SEQ ID NO: 416520 - RNA, 13 nt, Bordetella pertussis
gucaagggcggcc

SEQ ID NO: 416521 - RNA, 15 nt, Bordetella pertussis
gucaaggggcuguac

SEQ ID NO: 416522 - RNA, 22 nt, Bordetella pertussis
gucaaggggcuguaccuggcga

SEQ ID NO: 416523 - RNA, 19 nt, Bordetella pertussis
gucaauagguuguauucgu

SEQ ID NO: 416524 - RNA, 13 nt, Bordetella pertussis
gucacaccccacc

SEQ ID NO: 416525 - RNA, 13 nt, Bordetella pertussis
gucaccagcaggc

SEQ ID NO: 416526 - RNA, 16 nt, Bordetella pertussis
gucagcaaccccagca

SEQ ID NO: 416527 - RNA, 18 nt, Bordetella pertussis
gucagcaaccccagcagc

SEQ ID NO: 416528 - RNA, 14 nt, Bordetella pertussis
gucagcggcgcgcc

SEQ ID NO: 416529 - RNA, 22 nt, Bordetella pertussis
gucagcggcgcgcccaccaggg

SEQ ID NO: 416530 - RNA, 16 nt, Bordetella pertussis
gucagcgugcgccccg

SEQ ID NO: 416531 - RNA, 23 nt, Bordetella pertussis
gucagcucaagaagaagccgggc

SEQ ID NO: 416532 - RNA, 18 nt, Bordetella pertussis
gucagcugggcaugcacg

SEQ ID NO: 416533 - RNA, 15 nt, Bordetella pertussis
gucagcuugccgccc

SEQ ID NO: 416534 - RNA, 23 nt, Bordetella pertussis
gucaggaugcccuggguggcggg

SEQ ID NO: 416535 - RNA, 19 nt, Bordetella pertussis
gucaguccguggcgcggcc

SEQ ID NO: 416536 - RNA, 17 nt, Bordetella pertussis
gucagucguccuccgcg

SEQ ID NO: 416537 - RNA, 14 nt, Bordetella pertussis
gucaguugaagacg

SEQ ID NO: 416538 - RNA, 15 nt, Bordetella pertussis
gucaguuuccaucgg

SEQ ID NO: 416539 - RNA, 19 nt, Bordetella pertussis
gucaugaugucggccaggg

SEQ ID NO: 416540 - RNA, 16 nt, Bordetella pertussis
gucaugcccuccucgg

SEQ ID NO: 416541 - RNA, 17 nt, Bordetella pertussis
gucaugcccuccucggc

SEQ ID NO: 416542 - RNA, 18 nt, Bordetella pertussis
gucaugcccuccucggcc

SEQ ID NO: 416543 - RNA, 20 nt, Bordetella pertussis
gucaugcccuccucggccag

SEQ ID NO: 416544 - RNA, 16 nt, Bordetella pertussis
gucaugcgcaccuugu

SEQ ID NO: 416545 - RNA, 18 nt, Bordetella pertussis
gucaugcugucgcucaug

SEQ ID NO: 416546 - RNA, 20 nt, Bordetella pertussis
gucauugcaucgcagcagaa

SEQ ID NO: 416547 - RNA, 19 nt, Bordetella pertussis
guccaccucgucguccagc

SEQ ID NO: 416548 - RNA, 22 nt, Bordetella pertussis
guccaccuugacgcgcaggcca

SEQ ID NO: 416549 - RNA, 17 nt, Bordetella pertussis
guccacgaaggcagcac

SEQ ID NO: 416550 - RNA, 17 nt, Bordetella pertussis
guccacgaaggcgccga

SEQ ID NO: 416551 - RNA, 23 nt, Bordetella pertussis
guccacgaaggcgccgaaauugg

SEQ ID NO: 416552 - RNA, 20 nt, Bordetella pertussis
guccacgaugucguccagcu

SEQ ID NO: 416553 - RNA, 20 nt, Bordetella pertussis
guccacgcccggugccugcc

SEQ ID NO: 416554 - RNA, 13 nt, Bordetella pertussis
guccacgcccugg

SEQ ID NO: 416555 - RNA, 17 nt, Bordetella pertussis
guccacgccgaaguggc

SEQ ID NO: 416556 - RNA, 19 nt, Bordetella pertussis
guccacggcauggccagcu

SEQ ID NO: 416557 - RNA, 23 nt, Bordetella pertussis
guccagcaccagggcgcgcagca

SEQ ID NO: 416558 - RNA, 17 nt, Bordetella pertussis
guccagcaccggcugcc

SEQ ID NO: 416559 - RNA, 22 nt, Bordetella pertussis
guccagcacggccgcggccggc

SEQ ID NO: 416560 - RNA, 16 nt, Bordetella pertussis
guccagcagcagcgcc

SEQ ID NO: 416561 - RNA, 13 nt, Bordetella pertussis
guccagcagcagg

SEQ ID NO: 416562 - RNA, 20 nt, Bordetella pertussis
guccaggcgguuggccuuga

SEQ ID NO: 416563 - RNA, 20 nt, Bordetella pertussis
guccaggguguccuggucgg

SEQ ID NO: 416564 - RNA, 20 nt, Bordetella pertussis
guccauuagggcccagcugc

SEQ ID NO: 416565 - RNA, 13 nt, Bordetella pertussis
guccccacagggg

SEQ ID NO: 416566 - RNA, 19 nt, Bordetella pertussis
guccccaccgggacaggca

SEQ ID NO: 416567 - RNA, 20 nt, Bordetella pertussis
guccccacggggacaggcac

SEQ ID NO: 416568 - RNA, 16 nt, Bordetella pertussis
guccccagauccgcaa

SEQ ID NO: 416569 - RNA, 15 nt, Bordetella pertussis
guccccaugcggccc

SEQ ID NO: 416570 - RNA, 14 nt, Bordetella pertussis
gucccccuacugcc

SEQ ID NO: 416571 - RNA, 23 nt, Bordetella pertussis
guccccgcacggggacaggcacg

SEQ ID NO: 416572 - RNA, 21 nt, Bordetella pertussis
guccccgcacggggacuggca

SEQ ID NO: 416573 - RNA, 21 nt, Bordetella pertussis
guccccgcaggagcaugcccu

SEQ ID NO: 416574 - RNA, 23 nt, Bordetella pertussis
guccccgcaggagcaugcccuuu

SEQ ID NO: 416575 - RNA, 15 nt, Bordetella pertussis
guccccgcagggaca

SEQ ID NO: 416576 - RNA, 19 nt, Bordetella pertussis
guccccgcagggacaggca

SEQ ID NO: 416577 - RNA, 14 nt, Bordetella pertussis
guccccgcaugggg

SEQ ID NO: 416578 - RNA, 21 nt, Bordetella pertussis
guccccgcgcggggggcugac

SEQ ID NO: 416579 - RNA, 19 nt, Bordetella pertussis
guccccgcggggacaggca

SEQ ID NO: 416580 - RNA, 21 nt, Bordetella pertussis
guccccgcggggacaggcucc

SEQ ID NO: 416581 - RNA, 21 nt, Bordetella pertussis
guccccgcugggacaggcaca

SEQ ID NO: 416582 - RNA, 21 nt, Bordetella pertussis
guccccgcugggacaggcacu

SEQ ID NO: 416583 - RNA, 19 nt, Bordetella pertussis
gucccggcggggacaggcg

SEQ ID NO: 416584 - RNA, 21 nt, Bordetella pertussis
gucccggcggggacaggcgcc

SEQ ID NO: 416585 - RNA, 15 nt, Bordetella pertussis
gucccggcugggaca

SEQ ID NO: 416586 - RNA, 21 nt, Bordetella pertussis
gucccucggagccugucccug

SEQ ID NO: 416587 - RNA, 18 nt, Bordetella pertussis
gucccugcgggggcaggc

SEQ ID NO: 416588 - RNA, 12 nt, Bordetella pertussis
gucccuggccau

SEQ ID NO: 416589 - RNA, 13 nt, Bordetella pertussis
guccgaaccaccc

SEQ ID NO: 416590 - RNA, 15 nt, Bordetella pertussis
guccgaaccacccgg

SEQ ID NO: 416591 - RNA, 19 nt, Bordetella pertussis
guccgaaccacccggccau

SEQ ID NO: 416592 - RNA, 22 nt, Bordetella pertussis
guccgaaccgaccgccacgaag

SEQ ID NO: 416593 - RNA, 16 nt, Bordetella pertussis
guccgaauacgccacg

SEQ ID NO: 416594 - RNA, 22 nt, Bordetella pertussis
guccgccaugcgaugcugcagg

SEQ ID NO: 416595 - RNA, 17 nt, Bordetella pertussis
guccgcccgcuccacca

SEQ ID NO: 416596 - RNA, 14 nt, Bordetella pertussis
guccgccgugcagg

SEQ ID NO: 416597 - RNA, 16 nt, Bordetella pertussis
guccgguauccuggcg

SEQ ID NO: 416598 - RNA, 18 nt, Bordetella pertussis
guccgguauccuggcgcg

SEQ ID NO: 416599 - RNA, 17 nt, Bordetella pertussis
guccgucucgcccaggc

SEQ ID NO: 416600 - RNA, 23 nt, Bordetella pertussis
guccucgacguaagugcccaggc

SEQ ID NO: 416601 - RNA, 21 nt, Bordetella pertussis
guccucgcacgugacgccggc

SEQ ID NO: 416602 - RNA, 11 nt, Bordetella pertussis
guccucggcca

SEQ ID NO: 416603 - RNA, 14 nt, Bordetella pertussis
guccucggccagcc

SEQ ID NO: 416604 - RNA, 14 nt, Bordetella pertussis
guccucggccuggc

SEQ ID NO: 416605 - RNA, 15 nt, Bordetella pertussis
guccucggccuggcc

SEQ ID NO: 416606 - RNA, 14 nt, Bordetella pertussis
guccucgucggcga

SEQ ID NO: 416607 - RNA, 15 nt, Bordetella pertussis
guccucuacuggcug

SEQ ID NO: 416608 - RNA, 16 nt, Bordetella pertussis
guccugaccggcggcg

SEQ ID NO: 416609 - RNA, 11 nt, Bordetella pertussis
guccuggagac

SEQ ID NO: 416610 - RNA, 14 nt, Bordetella pertussis
guccuggcaggccg

SEQ ID NO: 416611 - RNA, 14 nt, Bordetella pertussis
guccuggccacugc

SEQ ID NO: 416612 - RNA, 13 nt, Bordetella pertussis
guccuggcggccg

SEQ ID NO: 416613 - RNA, 20 nt, Bordetella pertussis
guccuggcggccgcccagca

SEQ ID NO: 416614 - RNA, 17 nt, Bordetella pertussis
guccuggucgaccaggc

SEQ ID NO: 416615 - RNA, 15 nt, Bordetella pertussis
guccugguggaccug

SEQ ID NO: 416616 - RNA, 14 nt, Bordetella pertussis
gucgaacagcgaga

SEQ ID NO: 416617 - RNA, 14 nt, Bordetella pertussis
gucgaacagcugca

SEQ ID NO: 416618 - RNA, 14 nt, Bordetella pertussis
gucgaacggccggg

SEQ ID NO: 416619 - RNA, 13 nt, Bordetella pertussis
gucgaagcaggcg

SEQ ID NO: 416620 - RNA, 17 nt, Bordetella pertussis
gucgaaggcggccggca

SEQ ID NO: 416621 - RNA, 21 nt, Bordetella pertussis
gucgaaggcggccggcaggcc

SEQ ID NO: 416622 - RNA, 19 nt, Bordetella pertussis
gucgaagguuucgcugcgc

SEQ ID NO: 416623 - RNA, 19 nt, Bordetella pertussis
gucgaaguagaacgccggc

SEQ ID NO: 416624 - RNA, 16 nt, Bordetella pertussis
gucgaaugcacgggcg

SEQ ID NO: 416625 - RNA, 14 nt, Bordetella pertussis
gucgagagccuggg

SEQ ID NO: 416626 - RNA, 14 nt, Bordetella pertussis
gucgagcaccgcgc

SEQ ID NO: 416627 - RNA, 16 nt, Bordetella pertussis
gucgagcacgcggcgc

SEQ ID NO: 416628 - RNA, 20 nt, Bordetella pertussis
gucgagcacgcggcgcggca

SEQ ID NO: 416629 - RNA, 23 nt, Bordetella pertussis
gucgagguaagugggcugcggcg

SEQ ID NO: 416630 - RNA, 16 nt, Bordetella pertussis
gucgaguucggcgcgc

SEQ ID NO: 416631 - RNA, 18 nt, Bordetella pertussis
gucgaguucggcgcgccc

SEQ ID NO: 416632 - RNA, 12 nt, Bordetella pertussis
gucgaugaaaua

SEQ ID NO: 416633 - RNA, 19 nt, Bordetella pertussis
gucgaugaccagcgccggc

SEQ ID NO: 416634 - RNA, 18 nt, Bordetella pertussis
gucgaugacgcgccgcgc

SEQ ID NO: 416635 - RNA, 14 nt, Bordetella pertussis
gucgaugaugacga

SEQ ID NO: 416636 - RNA, 22 nt, Bordetella pertussis
gucgaugccaguuguaguggug

SEQ ID NO: 416637 - RNA, 14 nt, Bordetella pertussis
gucgaugccgacca

SEQ ID NO: 416638 - RNA, 16 nt, Bordetella pertussis
gucgaugccggcggcc

SEQ ID NO: 416639 - RNA, 14 nt, Bordetella pertussis
gucgaugcgcgcgc

SEQ ID NO: 416640 - RNA, 21 nt, Bordetella pertussis
gucgauggcguacagcagggu

SEQ ID NO: 416641 - RNA, 16 nt, Bordetella pertussis
gucgcaggccgcggcc

SEQ ID NO: 416642 - RNA, 17 nt, Bordetella pertussis
gucgccaccgcccagaa

SEQ ID NO: 416643 - RNA, 13 nt, Bordetella pertussis
gucgccagcgacg

SEQ ID NO: 416644 - RNA, 23 nt, Bordetella pertussis
gucgcgauugaguucgcgcgccg

SEQ ID NO: 416645 - RNA, 22 nt, Bordetella pertussis
gucgcgcaauacgccgccggcg

SEQ ID NO: 416646 - RNA, 22 nt, Bordetella pertussis
gucgcgcacccgcaggccguug

SEQ ID NO: 416647 - RNA, 14 nt, Bordetella pertussis
gucgcgcacgcugg

SEQ ID NO: 416648 - RNA, 16 nt, Bordetella pertussis
gucgcgcacgcuggca

SEQ ID NO: 416649 - RNA, 13 nt, Bordetella pertussis
gucgcgcagcagg

SEQ ID NO: 416650 - RNA, 19 nt, Bordetella pertussis
gucgcgccagcggccgucg

SEQ ID NO: 416651 - RNA, 20 nt, Bordetella pertussis
gucgcgccaggccggcggcg

SEQ ID NO: 416652 - RNA, 12 nt, Bordetella pertussis
gucgcgccgcga

SEQ ID NO: 416653 - RNA, 16 nt, Bordetella pertussis
gucgcgcgcaucgccg

SEQ ID NO: 416654 - RNA, 15 nt, Bordetella pertussis
gucgcgcgccaggcg

SEQ ID NO: 416655 - RNA, 22 nt, Bordetella pertussis
gucgcgcggcggcaccagcagg

SEQ ID NO: 416656 - RNA, 17 nt, Bordetella pertussis
gucgcgcgugcaggccg

SEQ ID NO: 416657 - RNA, 13 nt, Bordetella pertussis
gucgcgcugcaau

SEQ ID NO: 416658 - RNA, 14 nt, Bordetella pertussis
gucgcgguccagca

SEQ ID NO: 416659 - RNA, 17 nt, Bordetella pertussis
gucgcggugcgccacga

SEQ ID NO: 416660 - RNA, 18 nt, Bordetella pertussis
gucgcucauggaggggcg

SEQ ID NO: 416661 - RNA, 17 nt, Bordetella pertussis
gucgcucccccaugcgg

SEQ ID NO: 416662 - RNA, 14 nt, Bordetella pertussis
gucggacagggccc

SEQ ID NO: 416663 - RNA, 17 nt, Bordetella pertussis
gucggacgcgccgggcg

SEQ ID NO: 416664 - RNA, 16 nt, Bordetella pertussis
gucggccagggcggcg

SEQ ID NO: 416665 - RNA, 19 nt, Bordetella pertussis
gucggccaugcgauaggcg

SEQ ID NO: 416666 - RNA, 16 nt, Bordetella pertussis
gucggccauggcgcug

SEQ ID NO: 416667 - RNA, 23 nt, Bordetella pertussis
gucggccgaaccgcgcagccgcu

SEQ ID NO: 416668 - RNA, 20 nt, Bordetella pertussis
gucggccgaccacuggaagc

SEQ ID NO: 416669 - RNA, 12 nt, Bordetella pertussis
gucggccgccgc

SEQ ID NO: 416670 - RNA, 17 nt, Bordetella pertussis
gucggccugccagccug

SEQ ID NO: 416671 - RNA, 16 nt, Bordetella pertussis
gucggccucaucgagc

SEQ ID NO: 416672 - RNA, 14 nt, Bordetella pertussis
gucggccuggcgcu

SEQ ID NO: 416673 - RNA, 21 nt, Bordetella pertussis
gucggcgcagauggcggcgau

SEQ ID NO: 416674 - RNA, 21 nt, Bordetella pertussis
gucggcgcccggcgccgcgcg

SEQ ID NO: 416675 - RNA, 14 nt, Bordetella pertussis
gucggcggccagcg

SEQ ID NO: 416676 - RNA, 16 nt, Bordetella pertussis
gucggggugccguucg

SEQ ID NO: 416677 - RNA, 13 nt, Bordetella pertussis
gucggguccagca

SEQ ID NO: 416678 - RNA, 21 nt, Bordetella pertussis
gucggguccagcacgccuugc

SEQ ID NO: 416679 - RNA, 14 nt, Bordetella pertussis
gucggucagccuga

SEQ ID NO: 416680 - RNA, 17 nt, Bordetella pertussis
gucguagaccgccgcgc

SEQ ID NO: 416681 - RNA, 15 nt, Bordetella pertussis
gucguagcgccagcg

SEQ ID NO: 416682 - RNA, 16 nt, Bordetella pertussis
gucguagugcgcgccg

SEQ ID NO: 416683 - RNA, 20 nt, Bordetella pertussis
gucgucaugauguagcccau

SEQ ID NO: 416684 - RNA, 19 nt, Bordetella pertussis
gucguccacgcccggugcc

SEQ ID NO: 416685 - RNA, 22 nt, Bordetella pertussis
gucguccacgcccggugccugc

SEQ ID NO: 416686 - RNA, 17 nt, Bordetella pertussis
gucguccguggccggcg

SEQ ID NO: 416687 - RNA, 12 nt, Bordetella pertussis
gucguccucggc

SEQ ID NO: 416688 - RNA, 18 nt, Bordetella pertussis
gucgucgcgcuggcccca

SEQ ID NO: 416689 - RNA, 13 nt, Bordetella pertussis
gucgucggcgcug

SEQ ID NO: 416690 - RNA, 20 nt, Bordetella pertussis
gucgucggcgcugcagcgca

SEQ ID NO: 416691 - RNA, 12 nt, Bordetella pertussis
gucguuucccag

SEQ ID NO: 416692 - RNA, 16 nt, Bordetella pertussis
gucguuucccagcaag

SEQ ID NO: 416693 - RNA, 20 nt, Bordetella pertussis
gucuacaggcccagcgccag

SEQ ID NO: 416694 - RNA, 16 nt, Bordetella pertussis
gucuauggccugcagg

SEQ ID NO: 416695 - RNA, 17 nt, Bordetella pertussis
gucuauggccugcagga

SEQ ID NO: 416696 - RNA, 17 nt, Bordetella pertussis
gugauaugcgccaggcc

SEQ ID NO: 416697 - RNA, 16 nt, Bordetella pertussis
gugaugauccugcugg

SEQ ID NO: 416698 - RNA, 16 nt, Bordetella pertussis
gugaugcccaggcccu

SEQ ID NO: 416699 - RNA, 17 nt, Bordetella pertussis
gugaugccccagguccg

SEQ ID NO: 416700 - RNA, 19 nt, Bordetella pertussis
gugaugcccgaggcggcgc

SEQ ID NO: 416701 - RNA, 13 nt, Bordetella pertussis
gugaugccgacca

SEQ ID NO: 416702 - RNA, 14 nt, Bordetella pertussis
gugaugcggcgcgc

SEQ ID NO: 416703 - RNA, 16 nt, Bordetella pertussis
gugaugcggcgcgccg

SEQ ID NO: 416704 - RNA, 22 nt, Bordetella pertussis
gugauggcguagccguccucgc

SEQ ID NO: 416705 - RNA, 15 nt, Bordetella pertussis
gugauggggccgggc

SEQ ID NO: 416706 - RNA, 14 nt, Bordetella pertussis
gugcaccaggccac

SEQ ID NO: 416707 - RNA, 13 nt, Bordetella pertussis
gugcaccaggugg

SEQ ID NO: 416708 - RNA, 16 nt, Bordetella pertussis
gugcagccagcggccg

SEQ ID NO: 416709 - RNA, 16 nt, Bordetella pertussis
gugcagcccagcacca

SEQ ID NO: 416710 - RNA, 22 nt, Bordetella pertussis
gugcagcccagcaccacggcau

SEQ ID NO: 416711 - RNA, 20 nt, Bordetella pertussis
gugcagccauucggccaggu

SEQ ID NO: 416712 - RNA, 16 nt, Bordetella pertussis
gugcagccgccgcagg

SEQ ID NO: 416713 - RNA, 14 nt, Bordetella pertussis
gugcagcgcacggu

SEQ ID NO: 416714 - RNA, 20 nt, Bordetella pertussis
gugcagcgcacgguccaggc

SEQ ID NO: 416715 - RNA, 21 nt, Bordetella pertussis
gugcagcgacuugucgcgccc

SEQ ID NO: 416716 - RNA, 18 nt, Bordetella pertussis
gugcagcgccgcgcgcuc

SEQ ID NO: 416717 - RNA, 19 nt, Bordetella pertussis
gugcaggguuggcgcgccg

SEQ ID NO: 416718 - RNA, 16 nt, Bordetella pertussis
gugcaugacggccagg

SEQ ID NO: 416719 - RNA, 17 nt, Bordetella pertussis
gugcaugacggccagga

SEQ ID NO: 416720 - RNA, 14 nt, Bordetella pertussis
gugcaugcgcgcca

SEQ ID NO: 416721 - RNA, 19 nt, Bordetella pertussis
gugccaccgcccaggcgca

SEQ ID NO: 416722 - RNA, 21 nt, Bordetella pertussis
gugccagcaggucgcgcacgc

SEQ ID NO: 416723 - RNA, 18 nt, Bordetella pertussis
gugccaguccccaugcgg

SEQ ID NO: 416724 - RNA, 17 nt, Bordetella pertussis
gugccagucccccgcgg

SEQ ID NO: 416725 - RNA, 23 nt, Bordetella pertussis
gugccaguccccugcggggacag

SEQ ID NO: 416726 - RNA, 20 nt, Bordetella pertussis
gugccaucgauaugggcggc

SEQ ID NO: 416727 - RNA, 15 nt, Bordetella pertussis
gugcccagcaccagg

SEQ ID NO: 416728 - RNA, 22 nt, Bordetella pertussis
gugcccagcaccaggccgaacu

SEQ ID NO: 416729 - RNA, 21 nt, Bordetella pertussis
gugcccagcgagaucagcacc

SEQ ID NO: 416730 - RNA, 16 nt, Bordetella pertussis
gugcccagcgagcggg

SEQ ID NO: 416731 - RNA, 17 nt, Bordetella pertussis
gugcccaguucgcggcc

SEQ ID NO: 416732 - RNA, 21 nt, Bordetella pertussis
gugcccgccacccagggcuug

SEQ ID NO: 416733 - RNA, 17 nt, Bordetella pertussis
gugcccgcgaagcagcc

SEQ ID NO: 416734 - RNA, 13 nt, Bordetella pertussis
gugcccgcuggcc

SEQ ID NO: 416735 - RNA, 11 nt, Bordetella pertussis
gugcccggcgg

SEQ ID NO: 416736 - RNA, 19 nt, Bordetella pertussis
gugcccucgcugcgcguca

SEQ ID NO: 416737 - RNA, 23 nt, Bordetella pertussis
gugcccugcggcgcggccagcac

SEQ ID NO: 416738 - RNA, 22 nt, Bordetella pertussis
gugcccuugaccgacgugcugc

SEQ ID NO: 416739 - RNA, 14 nt, Bordetella pertussis
gugccgcagcgagg

SEQ ID NO: 416740 - RNA, 14 nt, Bordetella pertussis
gugccgcaggccag

SEQ ID NO: 416741 - RNA, 13 nt, Bordetella pertussis
gugccgccgagca

SEQ ID NO: 416742 - RNA, 14 nt, Bordetella pertussis
gugccgccgagcag

SEQ ID NO: 416743 - RNA, 15 nt, Bordetella pertussis
gugccgccgagcagg

SEQ ID NO: 416744 - RNA, 18 nt, Bordetella pertussis
gugccgccgaggaucagc

SEQ ID NO: 416745 - RNA, 19 nt, Bordetella pertussis
gugccgccggcgcggcugc

SEQ ID NO: 416746 - RNA, 15 nt, Bordetella pertussis
gugccgcgagaaaau

SEQ ID NO: 416747 - RNA, 15 nt, Bordetella pertussis
gugccgcgcaggccc

SEQ ID NO: 416748 - RNA, 14 nt, Bordetella pertussis
gugccgcgcgcggc

SEQ ID NO: 416749 - RNA, 19 nt, Bordetella pertussis
gugccgcgcgcggccggca

SEQ ID NO: 416750 - RNA, 22 nt, Bordetella pertussis
gugccgcgcugggcgcugcugc

SEQ ID NO: 416751 - RNA, 23 nt, Bordetella pertussis
gugccgcggcgcggcccgccacg

SEQ ID NO: 416752 - RNA, 14 nt, Bordetella pertussis
gugccggccgucuu

SEQ ID NO: 416753 - RNA, 13 nt, Bordetella pertussis
gugccgggccugg

SEQ ID NO: 416754 - RNA, 14 nt, Bordetella pertussis
gugccgggccuggu

SEQ ID NO: 416755 - RNA, 12 nt, Bordetella pertussis
gugccgggcuug

SEQ ID NO: 416756 - RNA, 22 nt, Bordetella pertussis
gugccugccccugcggggacag

SEQ ID NO: 416757 - RNA, 19 nt, Bordetella pertussis
gugccugcgaacgcccggc

SEQ ID NO: 416758 - RNA, 11 nt, Bordetella pertussis
gugccuguccc

SEQ ID NO: 416759 - RNA, 21 nt, Bordetella pertussis
gugccugucccaaccgggaca

SEQ ID NO: 416760 - RNA, 16 nt, Bordetella pertussis
gugccugucccagcgg

SEQ ID NO: 416761 - RNA, 23 nt, Bordetella pertussis
gugccugucccagcggggacagg

SEQ ID NO: 416762 - RNA, 17 nt, Bordetella pertussis
gugccuguccccacagg

SEQ ID NO: 416763 - RNA, 16 nt, Bordetella pertussis
gugccuguccccacau

SEQ ID NO: 416764 - RNA, 18 nt, Bordetella pertussis
gugccuguccccacaugg

SEQ ID NO: 416765 - RNA, 21 nt, Bordetella pertussis
gugccuguccccaccgggaca

SEQ ID NO: 416766 - RNA, 23 nt, Bordetella pertussis
gugccuguccccacggggacagg

SEQ ID NO: 416767 - RNA, 18 nt, Bordetella pertussis
gugccuguccccgcacgg

SEQ ID NO: 416768 - RNA, 19 nt, Bordetella pertussis
gugccuguccccgcacggg

SEQ ID NO: 416769 - RNA, 17 nt, Bordetella pertussis
gugccuguccccgccgg

SEQ ID NO: 416770 - RNA, 16 nt, Bordetella pertussis
gugccuguccccgcgg

SEQ ID NO: 416771 - RNA, 21 nt, Bordetella pertussis
gugccuguccccgcggggaca

SEQ ID NO: 416772 - RNA, 23 nt, Bordetella pertussis
gugccuguccccgcggggacagg

SEQ ID NO: 416773 - RNA, 19 nt, Bordetella pertussis
gugccuguccccgcuggga

SEQ ID NO: 416774 - RNA, 22 nt, Bordetella pertussis
gugccuguccccguggggacag

SEQ ID NO: 416775 - RNA, 23 nt, Bordetella pertussis
gugccuguccccguggggacaga

SEQ ID NO: 416776 - RNA, 16 nt, Bordetella pertussis
gugccugucccugccg

SEQ ID NO: 416777 - RNA, 15 nt, Bordetella pertussis
gugccuguccucccc

SEQ ID NO: 416778 - RNA, 22 nt, Bordetella pertussis
gugccuguccuccccgcugacc

SEQ ID NO: 416779 - RNA, 19 nt, Bordetella pertussis
gugccugcuugcaggaagc

SEQ ID NO: 416780 - RNA, 17 nt, Bordetella pertussis
gugccuggcuccccggg

SEQ ID NO: 416781 - RNA, 22 nt, Bordetella pertussis
gugcgacugcaggaugaggcgc

SEQ ID NO: 416782 - RNA, 19 nt, Bordetella pertussis
gugcgaggcgaacaggcac

SEQ ID NO: 416783 - RNA, 21 nt, Bordetella pertussis
gugcgaggcgaacaggcacag

SEQ ID NO: 416784 - RNA, 16 nt, Bordetella pertussis
gugcgauggcacggca

SEQ ID NO: 416785 - RNA, 19 nt, Bordetella pertussis
gugcgcaccuugcccacgc

SEQ ID NO: 416786 - RNA, 12 nt, Bordetella pertussis
gugcgccaggca

SEQ ID NO: 416787 - RNA, 22 nt, Bordetella pertussis
gugcgccaggcaaaggcccagg

SEQ ID NO: 416788 - RNA, 14 nt, Bordetella pertussis
gugcgcccauggcg

SEQ ID NO: 416789 - RNA, 20 nt, Bordetella pertussis
gugcgccgccgccgcggccu

SEQ ID NO: 416790 - RNA, 14 nt, Bordetella pertussis
gugcgccggcggcg

SEQ ID NO: 416791 - RNA, 15 nt, Bordetella pertussis
gugcgccgugcccgg

SEQ ID NO: 416792 - RNA, 15 nt, Bordetella pertussis
gugcgccuguccccg

SEQ ID NO: 416793 - RNA, 17 nt, Bordetella pertussis
gugcgcgaccuccggca

SEQ ID NO: 416794 - RNA, 14 nt, Bordetella pertussis
gugcgcgccaaaag

SEQ ID NO: 416795 - RNA, 23 nt, Bordetella pertussis
gugcgcgccaggucgcgcaccag

SEQ ID NO: 416796 - RNA, 13 nt, Bordetella pertussis
gugcgcgggcgcg

SEQ ID NO: 416797 - RNA, 14 nt, Bordetella pertussis
gugcgcgggcgcgg

SEQ ID NO: 416798 - RNA, 20 nt, Bordetella pertussis
gugcgcgggcgcggcaggcg

SEQ ID NO: 416799 - RNA, 16 nt, Bordetella pertussis
gugcgcuggcugggcc

SEQ ID NO: 416800 - RNA, 15 nt, Bordetella pertussis
gugcggaggcggccg

SEQ ID NO: 416801 - RNA, 20 nt, Bordetella pertussis
gugcggauggucgagcgccu

SEQ ID NO: 416802 - RNA, 21 nt, Bordetella pertussis
gugcggcccagccgcucggcc

SEQ ID NO: 416803 - RNA, 17 nt, Bordetella pertussis
gugcggcguggcggggc

SEQ ID NO: 416804 - RNA, 17 nt, Bordetella pertussis
gugcgggacggccaggg

SEQ ID NO: 416805 - RNA, 16 nt, Bordetella pertussis
gugcgggagccggcaa

SEQ ID NO: 416806 - RNA, 14 nt, Bordetella pertussis
gugcggggugccug

SEQ ID NO: 416807 - RNA, 15 nt, Bordetella pertussis
gugcgucacgcacag

SEQ ID NO: 416808 - RNA, 22 nt, Bordetella pertussis
gugcgucacgcacagcaccugg

SEQ ID NO: 416809 - RNA, 12 nt, Bordetella pertussis
gugcguccagga

SEQ ID NO: 416810 - RNA, 13 nt, Bordetella pertussis
gugcgugcggcug

SEQ ID NO: 416811 - RNA, 13 nt, Bordetella pertussis
gugcgugugccug

SEQ ID NO: 416812 - RNA, 20 nt, Bordetella pertussis
gugcucaucggcaggccggc

SEQ ID NO: 416813 - RNA, 20 nt, Bordetella pertussis
gugcugacggugccggccag

SEQ ID NO: 416814 - RNA, 21 nt, Bordetella pertussis
gugcugaucgaucgcccgcuc

SEQ ID NO: 416815 - RNA, 18 nt, Bordetella pertussis
gugcugcaccugcgucug

SEQ ID NO: 416816 - RNA, 16 nt, Bordetella pertussis
gugcugccgccgaugu

SEQ ID NO: 416817 - RNA, 12 nt, Bordetella pertussis
gugcugcggcug

SEQ ID NO: 416818 - RNA, 13 nt, Bordetella pertussis
gugcugcggcuga

SEQ ID NO: 416819 - RNA, 11 nt, Bordetella pertussis
gugcugcuguu

SEQ ID NO: 416820 - RNA, 16 nt, Bordetella pertussis
gugcugcugggcgcca

SEQ ID NO: 416821 - RNA, 15 nt, Bordetella pertussis
gugcuugccgcagcg

SEQ ID NO: 416822 - RNA, 17 nt, Bordetella pertussis
gugcuugccgcagcggc

SEQ ID NO: 416823 - RNA, 20 nt, Bordetella pertussis
gugcuugccgcagcggccau

SEQ ID NO: 416824 - RNA, 22 nt, Bordetella pertussis
gugcuugaugcccagcucaugg

SEQ ID NO: 416825 - RNA, 20 nt, Bordetella pertussis
guggacgccgccggcccagg

SEQ ID NO: 416826 - RNA, 13 nt, Bordetella pertussis
guggacggccagc

SEQ ID NO: 416827 - RNA, 14 nt, Bordetella pertussis
guggccgagcgcac

SEQ ID NO: 416828 - RNA, 13 nt, Bordetella pertussis
guggccgcgcaag

SEQ ID NO: 416829 - RNA, 15 nt, Bordetella pertussis
guggccgcgcugcug

SEQ ID NO: 416830 - RNA, 23 nt, Bordetella pertussis
guggccgcgcugcugcaggccgg

SEQ ID NO: 416831 - RNA, 21 nt, Bordetella pertussis
guggccgcuucggcggccaug

SEQ ID NO: 416832 - RNA, 13 nt, Bordetella pertussis
guggccggcgcgc

SEQ ID NO: 416833 - RNA, 17 nt, Bordetella pertussis
guggccggcgcgcggcc

SEQ ID NO: 416834 - RNA, 21 nt, Bordetella pertussis
guggccggcgcggcagccugg

SEQ ID NO: 416835 - RNA, 15 nt, Bordetella pertussis
guggccggcgggggc

SEQ ID NO: 416836 - RNA, 16 nt, Bordetella pertussis
guggccggcgggggcg

SEQ ID NO: 416837 - RNA, 17 nt, Bordetella pertussis
guggccgcgguccgggc

SEQ ID NO: 416838 - RNA, 20 nt, Bordetella pertussis
guggccguagagggucuggc

SEQ ID NO: 416839 - RNA, 16 nt, Bordetella pertussis
guggcgcccggcggcg

SEQ ID NO: 416840 - RNA, 22 nt, Bordetella pertussis
guggcgcccggcggcgcggcga

SEQ ID NO: 416841 - RNA, 19 nt, Bordetella pertussis
guggcgccgaaggcggcgc

SEQ ID NO: 416842 - RNA, 18 nt, Bordetella pertussis
guggcgccgucgcgcugu

SEQ ID NO: 416843 - RNA, 13 nt, Bordetella pertussis
guggcgccguucc

SEQ ID NO: 416844 - RNA, 22 nt, Bordetella pertussis
guggcgcgcacacuggccagca

SEQ ID NO: 416845 - RNA, 17 nt, Bordetella pertussis
guggcgcgccagcgcca

SEQ ID NO: 416846 - RNA, 16 nt, Bordetella pertussis
guggcgcgccuccagc

SEQ ID NO: 416847 - RNA, 18 nt, Bordetella pertussis
guggcgcgcgugcugggc

SEQ ID NO: 416848 - RNA, 16 nt, Bordetella pertussis
guggcgcuggcggcug

SEQ ID NO: 416849 - RNA, 17 nt, Bordetella pertussis
guggcgcuggcggcugc

SEQ ID NO: 416850 - RNA, 15 nt, Bordetella pertussis
guggcgcuguccggc

SEQ ID NO: 416851 - RNA, 20 nt, Bordetella pertussis
guggcgcuccaugcggcggc

SEQ ID NO: 416852 - RNA, 14 nt, Bordetella pertussis
guggcggacaggcc

SEQ ID NO: 416853 - RNA, 18 nt, Bordetella pertussis
guggcggccgcgggcagc

SEQ ID NO: 416854 - RNA, 15 nt, Bordetella pertussis
guggcggcgacggcg

SEQ ID NO: 416855 - RNA, 20 nt, Bordetella pertussis
guggcugaaaucccccgcgu

SEQ ID NO: 416856 - RNA, 16 nt, Bordetella pertussis
guggcugaacaucagc

SEQ ID NO: 416857 - RNA, 21 nt, Bordetella pertussis
guggcugcgcaggucggccag

SEQ ID NO: 416858 - RNA, 16 nt, Bordetella pertussis
guggcuggcgaggacc

SEQ ID NO: 416859 - RNA, 16 nt, Bordetella pertussis
guggcuucagggcuga

SEQ ID NO: 416860 - RNA, 14 nt, Bordetella pertussis
gugggccggcuucu

SEQ ID NO: 416861 - RNA, 16 nt, Bordetella pertussis
gugggcgaacuggucg

SEQ ID NO: 416862 - RNA, 22 nt, Bordetella pertussis
gugggcgaugcauucggcggcc

SEQ ID NO: 416863 - RNA, 12 nt, Bordetella pertussis
gugggcgcgcuc

SEQ ID NO: 416864 - RNA, 13 nt, Bordetella pertussis
gugguagaccggg

SEQ ID NO: 416865 - RNA, 16 nt, Bordetella pertussis
gugguaguacaaggcg

SEQ ID NO: 416866 - RNA, 13 nt, Bordetella pertussis
guggucgcgggug

SEQ ID NO: 416867 - RNA, 23 nt, Bordetella pertussis
guggucggcgccgaggcggucga

SEQ ID NO: 416868 - RNA, 21 nt, Bordetella pertussis
guggucuuccaggcgcaggcg

SEQ ID NO: 416869 - RNA, 20 nt, Bordetella pertussis
guggugaaagccgccggcgc

SEQ ID NO: 416870 - RNA, 15 nt, Bordetella pertussis
guggugcgccucgaa

SEQ ID NO: 416871 - RNA, 17 nt, Bordetella pertussis
guggugcucaguuucuu

SEQ ID NO: 416872 - RNA, 13 nt, Bordetella pertussis
guggugcugacgg

SEQ ID NO: 416873 - RNA, 11 nt, Bordetella pertussis
guggugcugcu

SEQ ID NO: 416874 - RNA, 17 nt, Bordetella pertussis
guggugcugggcggcgg

SEQ ID NO: 416875 - RNA, 20 nt, Bordetella pertussis
gugguggcgaaauggugcgg

SEQ ID NO: 416876 - RNA, 18 nt, Bordetella pertussis
gugucgaacggaaacccu

SEQ ID NO: 416877 - RNA, 15 nt, Bordetella pertussis
guguccugccggggc

SEQ ID NO: 416878 - RNA, 18 nt, Bordetella pertussis
gugucgcaccgcaaggaa

SEQ ID NO: 416879 - RNA, 16 nt, Bordetella pertussis
gugucgccgcccaugc

SEQ ID NO: 416880 - RNA, 14 nt, Bordetella pertussis
gugucgccguggcg

SEQ ID NO: 416881 - RNA, 13 nt, Bordetella pertussis
gugucggccacca

SEQ ID NO: 416882 - RNA, 14 nt, Bordetella pertussis
gugucggccaccac

SEQ ID NO: 416883 - RNA, 22 nt, Bordetella pertussis
guguugggaguucugguaggug

SEQ ID NO: 416884 - RNA, 20 nt, Bordetella pertussis
guguuguucagguuggcaac

SEQ ID NO: 416885 - RNA, 14 nt, Bordetella pertussis
guuacagcuuuucg

SEQ ID NO: 416886 - RNA, 11 nt, Bordetella pertussis
guucagcagca

SEQ ID NO: 416887 - RNA, 15 nt, Bordetella pertussis
guucagcagcaggcc

SEQ ID NO: 416888 - RNA, 16 nt, Bordetella pertussis
guucagcagcaggccc

SEQ ID NO: 416889 - RNA, 18 nt, Bordetella pertussis
guucaugcguucggccag

SEQ ID NO: 416890 - RNA, 19 nt, Bordetella pertussis
guucaugucgcgggugcgg

SEQ ID NO: 416891 - RNA, 17 nt, Bordetella pertussis
guuccagaugcgcagca

SEQ ID NO: 416892 - RNA, 22 nt, Bordetella pertussis
guuccagccaguacaggcugcc

SEQ ID NO: 416893 - RNA, 11 nt, Bordetella pertussis
guuccagcaug

SEQ ID NO: 416894 - RNA, 12 nt, Bordetella pertussis
guucccuacccg

SEQ ID NO: 416895 - RNA, 19 nt, Bordetella pertussis
guucccuacccgccgggcg

SEQ ID NO: 416896 - RNA, 13 nt, Bordetella pertussis
guuccgugcgcgc

SEQ ID NO: 416897 - RNA, 13 nt, Bordetella pertussis
guucgaccaggaa

SEQ ID NO: 416898 - RNA, 13 nt, Bordetella pertussis
guucgagcaggcg

SEQ ID NO: 416899 - RNA, 16 nt, Bordetella pertussis
guucgagcaggcgcgc

SEQ ID NO: 416900 - RNA, 20 nt, Bordetella pertussis
guucggccagcggcaggccc

SEQ ID NO: 416901 - RNA, 15 nt, Bordetella pertussis
guucggccggcggcc

SEQ ID NO: 416902 - RNA, 16 nt, Bordetella pertussis
guucguauugcugcug

SEQ ID NO: 416903 - RNA, 13 nt, Bordetella pertussis
guucgugauccug

SEQ ID NO: 416904 - RNA, 15 nt, Bordetella pertussis
guucugcgcguccug

SEQ ID NO: 416905 - RNA, 24 nt, Bordetella pertussis
guucuggaucgcgcccagcgagcu

SEQ ID NO: 416906 - RNA, 18 nt, Bordetella pertussis
guucuggcugcgcgccug

SEQ ID NO: 416907 - RNA, 22 nt, Bordetella pertussis
guucuggcugcgcgccuggcac

SEQ ID NO: 416908 - RNA, 17 nt, Bordetella pertussis
guucuucaggcuccagu

SEQ ID NO: 416909 - RNA, 19 nt, Bordetella pertussis
guucuugcccuugaauucc

SEQ ID NO: 416910 - RNA, 18 nt, Bordetella pertussis
guucuuggagaacugcuc

SEQ ID NO: 416911 - RNA, 13 nt, Bordetella pertussis
guugaacugcagg

SEQ ID NO: 416912 - RNA, 14 nt, Bordetella pertussis
guugaacugcaggc

SEQ ID NO: 416913 - RNA, 21 nt, Bordetella pertussis
guugaaccgcaacgccagcag

SEQ ID NO: 416914 - RNA, 16 nt, Bordetella pertussis
guugaagcgcagccac

SEQ ID NO: 416915 - RNA, 18 nt, Bordetella pertussis
guugaaggcgaugggcac

SEQ ID NO: 416916 - RNA, 16 nt, Bordetella pertussis
guugaccgagcccggc

SEQ ID NO: 416917 - RNA, 14 nt, Bordetella pertussis
guugaccggcuggc

SEQ ID NO: 416918 - RNA, 22 nt, Bordetella pertussis
guugaccugcuggggguuggcc

SEQ ID NO: 416919 - RNA, 19 nt, Bordetella pertussis
guugacgaucucgcccugc

SEQ ID NO: 416920 - RNA, 16 nt, Bordetella pertussis
guugacgaugcccagg

SEQ ID NO: 416921 - RNA, 15 nt, Bordetella pertussis
guugacggcccagcu

SEQ ID NO: 416922 - RNA, 22 nt, Bordetella pertussis
guugagcagcaccugguccugc

SEQ ID NO: 416923 - RNA, 19 nt, Bordetella pertussis
guugaucucgcccagcagg

SEQ ID NO: 416924 - RNA, 24 nt, Bordetella pertussis
guugcccagauccagcuugcgucc

SEQ ID NO: 416925 - RNA, 16 nt, Bordetella pertussis
guugcccgaaggcagc

SEQ ID NO: 416926 - RNA, 23 nt, Bordetella pertussis
guugccgaugcgguaggcccagc

SEQ ID NO: 416927 - RNA, 18 nt, Bordetella pertussis
guugccgccggccagggc

SEQ ID NO: 416928 - RNA, 13 nt, Bordetella pertussis
guuggcaggccag

SEQ ID NO: 416929 - RNA, 15 nt, Bordetella pertussis
guuggcaggccagca

SEQ ID NO: 416930 - RNA, 16 nt, Bordetella pertussis
guuggcaggccagcau

SEQ ID NO: 416931 - RNA, 17 nt, Bordetella pertussis
guuguucaggaaggccc

SEQ ID NO: 416932 - RNA, 18 nt, Bordetella pertussis
guuuuccacagccaggcc

SEQ ID NO: 416933 - RNA, 13 nt, Bordetella pertussis
guuuucgcuggcg

SEQ ID NO: 416934 - RNA, 21 nt, Bordetella pertussis
guuuucuggccuuccugcuga

SEQ ID NO: 416935 - RNA, 16 nt, Bordetella pertussis
uaaagcgccggcccgc

SEQ ID NO: 416936 - RNA, 14 nt, Bordetella pertussis
uaacgaaucgcugc

SEQ ID NO: 416937 - RNA, 14 nt, Bordetella pertussis
uaauugggcggcau

SEQ ID NO: 416938 - RNA, 21 nt, Bordetella pertussis
uacaacaucaaugacauggcc

SEQ ID NO: 416939 - RNA, 15 nt, Bordetella pertussis
uacacaugcuugcca

SEQ ID NO: 416940 - RNA, 21 nt, Bordetella pertussis
uacacggccgccaccugggcc

SEQ ID NO: 416941 - RNA, 15 nt, Bordetella pertussis
uacacuggcccuggc

SEQ ID NO: 416942 - RNA, 12 nt, Bordetella pertussis
uacagcaaggac

SEQ ID NO: 416943 - RNA, 18 nt, Bordetella pertussis
uacagccccagcgccagc

SEQ ID NO: 416944 - RNA, 14 nt, Bordetella pertussis
uacagcggagccgc

SEQ ID NO: 416945 - RNA, 14 nt, Bordetella pertussis
uacagcuccuugac

SEQ ID NO: 416946 - RNA, 22 nt, Bordetella pertussis
uacaggcccagcgccagcagca

SEQ ID NO: 416947 - RNA, 13 nt, Bordetella pertussis
uaccgccagcucg

SEQ ID NO: 416948 - RNA, 13 nt, Bordetella pertussis
uaccgccgccgcu

SEQ ID NO: 416949 - RNA, 18 nt, Bordetella pertussis
uaccucagccugcuggug

SEQ ID NO: 416950 - RNA, 19 nt, Bordetella pertussis
uaccucagccugcuggugc

SEQ ID NO: 416951 - RNA, 14 nt, Bordetella pertussis
uaccuucagcccgg

SEQ ID NO: 416952 - RNA, 16 nt, Bordetella pertussis
uaccuucagcccggcg

SEQ ID NO: 416953 - RNA, 16 nt, Bordetella pertussis
uaccuucugcaaggcc

SEQ ID NO: 416954 - RNA, 14 nt, Bordetella pertussis
uacgcuggaagaga

SEQ ID NO: 416955 - RNA, 17 nt, Bordetella pertussis
uacggacgagcgcagca

SEQ ID NO: 416956 - RNA, 23 nt, Bordetella pertussis
uacggauaauugggcggcaucuc

SEQ ID NO: 416957 - RNA, 17 nt, Bordetella pertussis
uacggcaagguccaggc

SEQ ID NO: 416958 - RNA, 13 nt, Bordetella pertussis
uacgggcgcggcg

SEQ ID NO: 416959 - RNA, 11 nt, Bordetella pertussis
uacguggcccc

SEQ ID NO: 416960 - RNA, 18 nt, Bordetella pertussis
uacgugguggugcgggcc

SEQ ID NO: 416961 - RNA, 21 nt, Bordetella pertussis
uacgugguggugcgggccgcg

SEQ ID NO: 416962 - RNA, 11 nt, Bordetella pertussis
uacuccaucug

SEQ ID NO: 416963 - RNA, 20 nt, Bordetella pertussis
uacuucguggcgcagcuccg

SEQ ID NO: 416964 - RNA, 15 nt, Bordetella pertussis
uacuuguccgccacc

SEQ ID NO: 416965 - RNA, 18 nt, Bordetella pertussis
uagaaguaggcggccagg

SEQ ID NO: 416966 - RNA, 20 nt, Bordetella pertussis
uagaaguucucgcgcuugcu

SEQ ID NO: 416967 - RNA, 19 nt, Bordetella pertussis
uagacauugcccagcacca

SEQ ID NO: 416968 - RNA, 15 nt, Bordetella pertussis
uagaccacgcgcugc

SEQ ID NO: 416969 - RNA, 19 nt, Bordetella pertussis
uagacgcgcagcggcaggc

SEQ ID NO: 416970 - RNA, 24 nt, Bordetella pertussis
uagagcugcggcgcggcgcgugcc

SEQ ID NO: 416971 - RNA, 18 nt, Bordetella pertussis
uagagggucuggcggccg

SEQ ID NO: 416972 - RNA, 21 nt, Bordetella pertussis
uagaugccgaacagccagggc

SEQ ID NO: 416973 - RNA, 12 nt, Bordetella pertussis
uagaugcgcgcg

SEQ ID NO: 416974 - RNA, 21 nt, Bordetella pertussis
uagauggaaucauuggccagc

SEQ ID NO: 416975 - RNA, 12 nt, Bordetella pertussis
uagauggccagg

SEQ ID NO: 416976 - RNA, 21 nt, Bordetella pertussis
uagcaggcgcgcucaggccgc

SEQ ID NO: 416977 - RNA, 13 nt, Bordetella pertussis
uagcccagcaccu

SEQ ID NO: 416978 - RNA, 11 nt, Bordetella pertussis
uagcccauggc

SEQ ID NO: 416979 - RNA, 19 nt, Bordetella pertussis
uagcccauguugaacugca

SEQ ID NO: 416980 - RNA, 17 nt, Bordetella pertussis
uagcccggcgccacccc

SEQ ID NO: 416981 - RNA, 22 nt, Bordetella pertussis
uagccgaagaaccaguagcaca

SEQ ID NO: 416982 - RNA, 18 nt, Bordetella pertussis
uagccgaauccggccagc

SEQ ID NO: 416983 - RNA, 17 nt, Bordetella pertussis
uagccgaucuggcccuu

SEQ ID NO: 416984 - RNA, 22 nt, Bordetella pertussis
uagccgcgcgccugcagcagcg

SEQ ID NO: 416985 - RNA, 20 nt, Bordetella pertussis
uagccgcugcgcgcggccug

SEQ ID NO: 416986 - RNA, 22 nt, Bordetella pertussis
uagccgcugcgcgcggccuggc

SEQ ID NO: 416987 - RNA, 16 nt, Bordetella pertussis
uagccggaaugcacca

SEQ ID NO: 416988 - RNA, 18 nt, Bordetella pertussis
uagccgggucuggccggc

SEQ ID NO: 416989 - RNA, 21 nt, Bordetella pertussis
uagcgcacgcaccgcgccagc

SEQ ID NO: 416990 - RNA, 13 nt, Bordetella pertussis
uagcgcagcagcg

SEQ ID NO: 416991 - RNA, 19 nt, Bordetella pertussis
uagcgcaucgcgaugcgca

SEQ ID NO: 416992 - RNA, 17 nt, Bordetella pertussis
uagcgcaugaugcugcc

SEQ ID NO: 416993 - RNA, 21 nt, Bordetella pertussis
uagcgccguaccagcgcgaac

SEQ ID NO: 416994 - RNA, 15 nt, Bordetella pertussis
uagcgcgcagcuccc

SEQ ID NO: 416995 - RNA, 15 nt, Bordetella pertussis
uagcgcguggccagc

SEQ ID NO: 416996 - RNA, 21 nt, Bordetella pertussis
uagcgguggcgggccagcucc

SEQ ID NO: 416997 - RNA, 19 nt, Bordetella pertussis
uagcgguaucccaccugca

SEQ ID NO: 416998 - RNA, 15 nt, Bordetella pertussis
uagcgguccagcugc

SEQ ID NO: 416999 - RNA, 21 nt, Bordetella pertussis
uagcucgaccaucauggccag

SEQ ID NO: 417000 - RNA, 23 nt, Bordetella pertussis
uagcucgaccaucauggccaggg

SEQ ID NO: 417001 - RNA, 14 nt, Bordetella pertussis
uagcuggcggcgcg

SEQ ID NO: 417002 - RNA, 19 nt, Bordetella pertussis
uaggacagccccagcagca

SEQ ID NO: 417003 - RNA, 16 nt, Bordetella pertussis
uaggcaaagcgcagca

SEQ ID NO: 417004 - RNA, 19 nt, Bordetella pertussis
uaggccaccccguugcagc

SEQ ID NO: 417005 - RNA, 14 nt, Bordetella pertussis
uaggccuggucggg

SEQ ID NO: 417006 - RNA, 13 nt, Bordetella pertussis
uaggcgcgcacca

SEQ ID NO: 417007 - RNA, 16 nt, Bordetella pertussis
uaggcgcgcaccagcc

SEQ ID NO: 417008 - RNA, 17 nt, Bordetella pertussis
uaggcgcgcaccagccc

SEQ ID NO: 417009 - RNA, 18 nt, Bordetella pertussis
uaggcgcgcaccagcccg

SEQ ID NO: 417010 - RNA, 15 nt, Bordetella pertussis
uaggcgcuguuggcc

SEQ ID NO: 417011 - RNA, 11 nt, Bordetella pertussis
uaggcggccuu

SEQ ID NO: 417012 - RNA, 18 nt, Bordetella pertussis
uaggcggcgcaggccagc

SEQ ID NO: 417013 - RNA, 16 nt, Bordetella pertussis
uaggcugcagccaguu

SEQ ID NO: 417014 - RNA, 19 nt, Bordetella pertussis
uagggccauggcagggcgc

SEQ ID NO: 417015 - RNA, 14 nt, Bordetella pertussis
uagggcccagcugc

SEQ ID NO: 417016 - RNA, 16 nt, Bordetella pertussis
uagggcgacugcagca

SEQ ID NO: 417017 - RNA, 17 nt, Bordetella pertussis
uagggcgacugcagcag

SEQ ID NO: 417018 - RNA, 12 nt, Bordetella pertussis
uagggcgcggcc

SEQ ID NO: 417019 - RNA, 18 nt, Bordetella pertussis
uaguagccgaauccggcc

SEQ ID NO: 417020 - RNA, 21 nt, Bordetella pertussis
uaguagccgaauccggccagc

SEQ ID NO: 417021 - RNA, 18 nt, Bordetella pertussis
uagugcccccacgcugcg

SEQ ID NO: 417022 - RNA, 15 nt, Bordetella pertussis
uaguugguggcaggc

SEQ ID NO: 417023 - RNA, 21 nt, Bordetella pertussis
uauagaugcgcggggccaggc

SEQ ID NO: 417024 - RNA, 19 nt, Bordetella pertussis
uauauagaggaccauaguu

SEQ ID NO: 417025 - RNA, 17 nt, Bordetella pertussis
uauccacgccacuggcc

SEQ ID NO: 417026 - RNA, 15 nt, Bordetella pertussis
uauucaucacgggcg

SEQ ID NO: 417027 - RNA, 12 nt, Bordetella pertussis
uauuccugcugg

SEQ ID NO: 417028 - RNA, 17 nt, Bordetella pertussis
uauugaugcagcacguc

SEQ ID NO: 417029 - RNA, 15 nt, Bordetella pertussis
uauugcuccacaggc

SEQ ID NO: 417030 - RNA, 17 nt, Bordetella pertussis
uauugugcaugcgcgcc

SEQ ID NO: 417031 - RNA, 20 nt, Bordetella pertussis
uauuuccggccgcacugggu

SEQ ID NO: 417032 - RNA, 14 nt, Bordetella pertussis
uauuuggcggccug

SEQ ID NO: 417033 - RNA, 21 nt, Bordetella pertussis
uauuuggcggccuggccgcgc

SEQ ID NO: 417034 - RNA, 13 nt, Bordetella pertussis
ucaacgggccgcu

SEQ ID NO: 417035 - RNA, 19 nt, Bordetella pertussis
ucaacgugcgccaggcaaa

SEQ ID NO: 417036 - RNA, 13 nt, Bordetella pertussis
ucaagcagcgccg

SEQ ID NO: 417037 - RNA, 16 nt, Bordetella pertussis
ucaagccagcggcgcg

SEQ ID NO: 417038 - RNA, 18 nt, Bordetella pertussis
ucaagcggcccgcgcccu

SEQ ID NO: 417039 - RNA, 23 nt, Bordetella pertussis
ucaagcgucgauggcguacagca

SEQ ID NO: 417040 - RNA, 19 nt, Bordetella pertussis
ucaaggccaugaucaggcc

SEQ ID NO: 417041 - RNA, 14 nt, Bordetella pertussis
ucaaggcgcggccg

SEQ ID NO: 417042 - RNA, 15 nt, Bordetella pertussis
ucaaggcgcggccgu

SEQ ID NO: 417043 - RNA, 15 nt, Bordetella pertussis
ucaaggggcuguacc

SEQ ID NO: 417044 - RNA, 16 nt, Bordetella pertussis
ucaaugcggcggcgcu

SEQ ID NO: 417045 - RNA, 20 nt, Bordetella pertussis
ucaaugcggcggcgcuggcc

SEQ ID NO: 417046 - RNA, 14 nt, Bordetella pertussis
ucacaccccaccac

SEQ ID NO: 417047 - RNA, 19 nt, Bordetella pertussis
ucacagacgaucacggugg

SEQ ID NO: 417048 - RNA, 22 nt, Bordetella pertussis
ucaccagcccggcggugaccug

SEQ ID NO: 417049 - RNA, 15 nt, Bordetella pertussis
ucacccacagcagcg

SEQ ID NO: 417050 - RNA, 13 nt, Bordetella pertussis
ucacccagcggcu

SEQ ID NO: 417051 - RNA, 13 nt, Bordetella pertussis
ucacccagggugu

SEQ ID NO: 417052 - RNA, 20 nt, Bordetella pertussis
ucaccccgcccggcggcgcg

SEQ ID NO: 417053 - RNA, 16 nt, Bordetella pertussis
ucaccccugcgcugca

SEQ ID NO: 417054 - RNA, 14 nt, Bordetella pertussis
ucaccgaacuguca

SEQ ID NO: 417055 - RNA, 20 nt, Bordetella pertussis
ucaccgacaggaugggcgcu

SEQ ID NO: 417056 - RNA, 15 nt, Bordetella pertussis
ucaccgccgcgaccg

SEQ ID NO: 417057 - RNA, 14 nt, Bordetella pertussis
ucaccgccgcggcg

SEQ ID NO: 417058 - RNA, 15 nt, Bordetella pertussis
ucaccgcgccgggcg

SEQ ID NO: 417059 - RNA, 18 nt, Bordetella pertussis
ucaccggccccaucaugu

SEQ ID NO: 417060 - RNA, 20 nt, Bordetella pertussis
ucaccuucaacaucgcccug

SEQ ID NO: 417061 - RNA, 21 nt, Bordetella pertussis
ucaccuuuccgaucagcugcg

SEQ ID NO: 417062 - RNA, 15 nt, Bordetella pertussis
ucacgaaagcgccca

SEQ ID NO: 417063 - RNA, 15 nt, Bordetella pertussis
ucacgaacagcgcca

SEQ ID NO: 417064 - RNA, 19 nt, Bordetella pertussis
ucacgaacagcgccaggcu

SEQ ID NO: 417065 - RNA, 22 nt, Bordetella pertussis
ucacgaaccgcagaagcagccg

SEQ ID NO: 417066 - RNA, 17 nt, Bordetella pertussis
ucacgacacgcccagca

SEQ ID NO: 417067 - RNA, 12 nt, Bordetella pertussis
ucacgagcaggu

SEQ ID NO: 417068 - RNA, 23 nt, Bordetella pertussis
ucacgaucuggccgauggccucg

SEQ ID NO: 417069 - RNA, 21 nt, Bordetella pertussis
ucacgcugguggccaccagcc

SEQ ID NO: 417070 - RNA, 17 nt, Bordetella pertussis
ucacgggcgaagcggac

SEQ ID NO: 417071 - RNA, 17 nt, Bordetella pertussis
ucacgggcgccagcagc

SEQ ID NO: 417072 - RNA, 23 nt, Bordetella pertussis
ucacgggcuguucgcgcagcagg

SEQ ID NO: 417073 - RNA, 17 nt, Bordetella pertussis
ucacggucuggcccacg

SEQ ID NO: 417074 - RNA, 18 nt, Bordetella pertussis
ucacuccauagcgccgcu

SEQ ID NO: 417075 - RNA, 14 nt, Bordetella pertussis
ucagccaucaucau

SEQ ID NO: 417076 - RNA, 15 nt, Bordetella pertussis
ucagccaucaucauc

SEQ ID NO: 417077 - RNA, 16 nt, Bordetella pertussis
ucagccaucaucaucg

SEQ ID NO: 417078 - RNA, 19 nt, Bordetella pertussis
ucagccgcaagcuggcggc

SEQ ID NO: 417079 - RNA, 16 nt, Bordetella pertussis
ucagccggccauggcc

SEQ ID NO: 417080 - RNA, 18 nt, Bordetella pertussis
ucagccggccauggcccu

SEQ ID NO: 417081 - RNA, 14 nt, Bordetella pertussis
ucagccgugccgcg

SEQ ID NO: 417082 - RNA, 14 nt, Bordetella pertussis
ucagccgugucgcc

SEQ ID NO: 417083 - RNA, 15 nt, Bordetella pertussis
ucagccugcuggugc

SEQ ID NO: 417084 - RNA, 17 nt, Bordetella pertussis
ucagccugcuggugcug

SEQ ID NO: 417085 - RNA, 23 nt, Bordetella pertussis
ucagccugguagaguacugcguu

SEQ ID NO: 417086 - RNA, 22 nt, Bordetella pertussis
ucagcgaaugcgacagcgacag

SEQ ID NO: 417087 - RNA, 16 nt, Bordetella pertussis
ucagcgccuggcuucc

SEQ ID NO: 417088 - RNA, 21 nt, Bordetella pertussis
ucagcgcgacgaagccggaac

SEQ ID NO: 417089 - RNA, 17 nt, Bordetella pertussis
ucagcgcgccagcgcgc

SEQ ID NO: 417090 - RNA, 22 nt, Bordetella pertussis
ucagcgcgcccgcuuccuuggg

SEQ ID NO: 417091 - RNA, 19 nt, Bordetella pertussis
ucagcgcggcgcacagggc

SEQ ID NO: 417092 - RNA, 17 nt, Bordetella pertussis
ucagcgcggcgccggcc

SEQ ID NO: 417093 - RNA, 19 nt, Bordetella pertussis
ucagcgcgucacgcugaac

SEQ ID NO: 417094 - RNA, 17 nt, Bordetella pertussis
ucagcuggaucugguga

SEQ ID NO: 417095 - RNA, 16 nt, Bordetella pertussis
ucagcugcuguuggcc

SEQ ID NO: 417096 - RNA, 16 nt, Bordetella pertussis
ucagcuucagccuggg

SEQ ID NO: 417097 - RNA, 17 nt, Bordetella pertussis
ucagcuucagccugggc

SEQ ID NO: 417098 - RNA, 18 nt, Bordetella pertussis
ucagcuucagccugggcc

SEQ ID NO: 417099 - RNA, 19 nt, Bordetella pertussis
ucagcuucagccugggccu

SEQ ID NO: 417100 - RNA, 19 nt, Bordetella pertussis
ucagcuugaugccggcguu

SEQ ID NO: 417101 - RNA, 16 nt, Bordetella pertussis
ucagcuuggccaccac

SEQ ID NO: 417102 - RNA, 21 nt, Bordetella pertussis
ucagcuuggcguacggcugca

SEQ ID NO: 417103 - RNA, 18 nt, Bordetella pertussis
ucagcuuggucacggccu

SEQ ID NO: 417104 - RNA, 21 nt, Bordetella pertussis
ucaggaacauguccaccagcc

SEQ ID NO: 417105 - RNA, 14 nt, Bordetella pertussis
ucaggaaccagcgg

SEQ ID NO: 417106 - RNA, 17 nt, Bordetella pertussis
ucaggaaccagcggcug

SEQ ID NO: 417107 - RNA, 15 nt, Bordetella pertussis
ucaggaugccgccuu

SEQ ID NO: 417108 - RNA, 16 nt, Bordetella pertussis
ucagggccgcagcacc

SEQ ID NO: 417109 - RNA, 11 nt, Bordetella pertussis
ucagggccgcc

SEQ ID NO: 417110 - RNA, 21 nt, Bordetella pertussis
ucagggccgccagggcggcug

SEQ ID NO: 417111 - RNA, 22 nt, Bordetella pertussis
ucagggcgaacgggguggccgg

SEQ ID NO: 417112 - RNA, 22 nt, Bordetella pertussis
ucagggcgaucuugccggccug

SEQ ID NO: 417113 - RNA, 17 nt, Bordetella pertussis
ucaggggcucggccagg

SEQ ID NO: 417114 - RNA, 15 nt, Bordetella pertussis
ucagggugaggguga

SEQ ID NO: 417115 - RNA, 21 nt, Bordetella pertussis
ucagguguucgcgcaccagcg

SEQ ID NO: 417116 - RNA, 24 nt, Bordetella pertussis
ucagguguucgcgcaccagcggaa

SEQ ID NO: 417117 - RNA, 20 nt, Bordetella pertussis
ucagguuugcgggugccagu

SEQ ID NO: 417118 - RNA, 15 nt, Bordetella pertussis
ucaguccgcccagcc

SEQ ID NO: 417119 - RNA, 13 nt, Bordetella pertussis
ucaguccguggcg

SEQ ID NO: 417120 - RNA, 19 nt, Bordetella pertussis
ucaguccucaugcgggaca

SEQ ID NO: 417121 - RNA, 21 nt, Bordetella pertussis
ucaucacgggcgccagcagcg

SEQ ID NO: 417122 - RNA, 13 nt, Bordetella pertussis
ucaucaggaugaa

SEQ ID NO: 417123 - RNA, 16 nt, Bordetella pertussis
ucaucaucgcgcuggc

SEQ ID NO: 417124 - RNA, 11 nt, Bordetella pertussis
ucauccacagg

SEQ ID NO: 417125 - RNA, 11 nt, Bordetella pertussis
ucauccaggcc

SEQ ID NO: 417126 - RNA, 21 nt, Bordetella pertussis
ucauccagguggcggacaggc

SEQ ID NO: 417127 - RNA, 21 nt, Bordetella pertussis
ucaucgaugcgccgcaccagc

SEQ ID NO: 417128 - RNA, 21 nt, Bordetella pertussis
ucaucgggccggcggcagccg

SEQ ID NO: 417129 - RNA, 17 nt, Bordetella pertussis
ucaucgggugcggcgcc

SEQ ID NO: 417130 - RNA, 18 nt, Bordetella pertussis
ucaucgggugcggcgccu

SEQ ID NO: 417131 - RNA, 13 nt, Bordetella pertussis
ucaucgugcucgu

SEQ ID NO: 417132 - RNA, 23 nt, Bordetella pertussis
ucaucugggcgucgaaggcggcc

SEQ ID NO: 417133 - RNA, 20 nt, Bordetella pertussis
ucaugaucuggccgaccagc

SEQ ID NO: 417134 - RNA, 21 nt, Bordetella pertussis
ucaugaugcgcugggccaggc

SEQ ID NO: 417135 - RNA, 18 nt, Bordetella pertussis
ucaugaugucggccaggg

SEQ ID NO: 417136 - RNA, 23 nt, Bordetella pertussis
ucaugcccaugccgccaugcagc

SEQ ID NO: 417137 - RNA, 15 nt, Bordetella pertussis
ucaugccgaacagca

SEQ ID NO: 417138 - RNA, 16 nt, Bordetella pertussis
ucaugccgaccacggc

SEQ ID NO: 417139 - RNA, 13 nt, Bordetella pertussis
ucaugccggcguu

SEQ ID NO: 417140 - RNA, 17 nt, Bordetella pertussis
ucaugcgaaaucuucug

SEQ ID NO: 417141 - RNA, 17 nt, Bordetella pertussis
ucaugcgcugcacggug

SEQ ID NO: 417142 - RNA, 19 nt, Bordetella pertussis
ucaugcgcugcuggccaag

SEQ ID NO: 417143 - RNA, 21 nt, Bordetella pertussis
ucauggccagccgcuugaagu

SEQ ID NO: 417144 - RNA, 12 nt, Bordetella pertussis
ucauggccaggg

SEQ ID NO: 417145 - RNA, 22 nt, Bordetella pertussis
ucauggcguagagcagugugcc

SEQ ID NO: 417146 - RNA, 15 nt, Bordetella pertussis
ucauggcggcaggcg

SEQ ID NO: 417147 - RNA, 18 nt, Bordetella pertussis
ucauggcggcaggcgcga

SEQ ID NO: 417148 - RNA, 16 nt, Bordetella pertussis
ucaugggccugggcgc

SEQ ID NO: 417149 - RNA, 13 nt, Bordetella pertussis
ucaugggcggcga

SEQ ID NO: 417150 - RNA, 14 nt, Bordetella pertussis
ucaugggcggggcc

SEQ ID NO: 417151 - RNA, 19 nt, Bordetella pertussis
ucauggucgaccagcagcc

SEQ ID NO: 417152 - RNA, 22 nt, Bordetella pertussis
ucauguaaggcgcaugccacca

SEQ ID NO: 417153 - RNA, 14 nt, Bordetella pertussis
ucauuuccugguuc

SEQ ID NO: 417154 - RNA, 13 nt, Bordetella pertussis
uccacagccaggc

SEQ ID NO: 417155 - RNA, 14 nt, Bordetella pertussis
uccacagccaggcc

SEQ ID NO: 417156 - RNA, 14 nt, Bordetella pertussis
uccacagcccggcc

SEQ ID NO: 417157 - RNA, 22 nt, Bordetella pertussis
uccacagguauucgggaugggc

SEQ ID NO: 417158 - RNA, 16 nt, Bordetella pertussis
uccacauccgcgcugc

SEQ ID NO: 417159 - RNA, 11 nt, Bordetella pertussis
uccaccaaggg

SEQ ID NO: 417160 - RNA, 13 nt, Bordetella pertussis
uccaccaccaggc

SEQ ID NO: 417161 - RNA, 14 nt, Bordetella pertussis
uccaccaccaggcc

SEQ ID NO: 417162 - RNA, 12 nt, Bordetella pertussis
uccaccaccauc

SEQ ID NO: 417163 - RNA, 14 nt, Bordetella pertussis
uccaccacccaggc

SEQ ID NO: 417164 - RNA, 20 nt, Bordetella pertussis
uccaccaccuucagggcgcc

SEQ ID NO: 417165 - RNA, 15 nt, Bordetella pertussis
uccaccgccagcccg

SEQ ID NO: 417166 - RNA, 14 nt, Bordetella pertussis
uccaccucgucguc

SEQ ID NO: 417167 - RNA, 18 nt, Bordetella pertussis
uccacgaaggcagcaccu

SEQ ID NO: 417168 - RNA, 19 nt, Bordetella pertussis
uccacgaaggcagcaccuc

SEQ ID NO: 417169 - RNA, 22 nt, Bordetella pertussis
uccagcaccagggcgcgcagca

SEQ ID NO: 417170 - RNA, 16 nt, Bordetella pertussis
uccagcaccggcugcc

SEQ ID NO: 417171 - RNA, 20 nt, Bordetella pertussis
uccagcaccggcugccaggg

SEQ ID NO: 417172 - RNA, 19 nt, Bordetella pertussis
uccagcacgacgacggccg

SEQ ID NO: 417173 - RNA, 14 nt, Bordetella pertussis
uccagcacgcggcg

SEQ ID NO: 417174 - RNA, 22 nt, Bordetella pertussis
uccagcacgcggcgcagcaucu

SEQ ID NO: 417175 - RNA, 16 nt, Bordetella pertussis
uccagcacggcgagga

SEQ ID NO: 417176 - RNA, 19 nt, Bordetella pertussis
uccagcacggcgaggaugc

SEQ ID NO: 417177 - RNA, 17 nt, Bordetella pertussis
uccagcagaucgcggcg

SEQ ID NO: 417178 - RNA, 11 nt, Bordetella pertussis
uccagcagcag

SEQ ID NO: 417179 - RNA, 15 nt, Bordetella pertussis
uccagcagcguggcc

SEQ ID NO: 417180 - RNA, 16 nt, Bordetella pertussis
uccagcagcguggcca

SEQ ID NO: 417181 - RNA, 22 nt, Bordetella pertussis
uccagcagcguggccaccaggc

SEQ ID NO: 417182 - RNA, 23 nt, Bordetella pertussis
uccagccaccaugucccuggcca

SEQ ID NO: 417183 - RNA, 14 nt, Bordetella pertussis
uccagccaggccuc

SEQ ID NO: 417184 - RNA, 20 nt, Bordetella pertussis
uccagccaguacaggcugcc

SEQ ID NO: 417185 - RNA, 18 nt, Bordetella pertussis
uccagccauggaagcggc

SEQ ID NO: 417186 - RNA, 22 nt, Bordetella pertussis
uccagccauggaagcggcagac

SEQ ID NO: 417187 - RNA, 14 nt, Bordetella pertussis
uccagcccgugggc

SEQ ID NO: 417188 - RNA, 14 nt, Bordetella pertussis
uccagccugcccgg

SEQ ID NO: 417189 - RNA, 20 nt, Bordetella pertussis
uccagccugcccgggcagca

SEQ ID NO: 417190 - RNA, 17 nt, Bordetella pertussis
uccagcgacuccggccg

SEQ ID NO: 417191 - RNA, 23 nt, Bordetella pertussis
uccagcgacuccggccgggccag

SEQ ID NO: 417192 - RNA, 14 nt, Bordetella pertussis
uccagcguggcgca

SEQ ID NO: 417193 - RNA, 17 nt, Bordetella pertussis
uccagcucagcagcgcc

SEQ ID NO: 417194 - RNA, 17 nt, Bordetella pertussis
uccagcuccagcgcgcc

SEQ ID NO: 417195 - RNA, 15 nt, Bordetella pertussis
uccagcuccagcgcu

SEQ ID NO: 417196 - RNA, 15 nt, Bordetella pertussis
uccagcugcgaaagc

SEQ ID NO: 417197 - RNA, 19 nt, Bordetella pertussis
uccagcugcgaaagcgcgu

SEQ ID NO: 417198 - RNA, 17 nt, Bordetella pertussis
uccagcuucaucaccuu

SEQ ID NO: 417199 - RNA, 17 nt, Bordetella pertussis
uccaggaaagcgccgcc

SEQ ID NO: 417200 - RNA, 14 nt, Bordetella pertussis
uccaggaagcagcc

SEQ ID NO: 417201 - RNA, 12 nt, Bordetella pertussis
uccaggcugccg

SEQ ID NO: 417202 - RNA, 19 nt, Bordetella pertussis
uccagggccgccagcaccu

SEQ ID NO: 417203 - RNA, 19 nt, Bordetella pertussis
uccagggcgaucagcaccg

SEQ ID NO: 417204 - RNA, 16 nt, Bordetella pertussis
uccaguacgaaggggc

SEQ ID NO: 417205 - RNA, 21 nt, Bordetella pertussis
ucgccaccucgaucaccaccg

SEQ ID NO: 417206 - RNA, 23 nt, Bordetella pertussis
ucgccagcaggcccugggcgagg

SEQ ID NO: 417207 - RNA, 12 nt, Bordetella pertussis
ucgccagcgccg

SEQ ID NO: 417208 - RNA, 18 nt, Bordetella pertussis
ucgccagcggcagcgcgc

SEQ ID NO: 417209 - RNA, 22 nt, Bordetella pertussis
ucgccagcggcagcgcgcagga

SEQ ID NO: 417210 - RNA, 13 nt, Bordetella pertussis
ucgccaucugcug

SEQ ID NO: 417211 - RNA, 15 nt, Bordetella pertussis
ucgccaucugcugcg

SEQ ID NO: 417212 - RNA, 13 nt, Bordetella pertussis
ucgcccagcaccu

SEQ ID NO: 417213 - RNA, 22 nt, Bordetella pertussis
ucgcccagcagauaccggcaug

SEQ ID NO: 417214 - RNA, 19 nt, Bordetella pertussis
ucgcccaugaucagggccg

SEQ ID NO: 417215 - RNA, 18 nt, Bordetella pertussis
ucgcccauugcggcgggc

SEQ ID NO: 417216 - RNA, 19 nt, Bordetella pertussis
ucgcccccgaaggccgcgc

SEQ ID NO: 417217 - RNA, 21 nt, Bordetella pertussis
ucgcccgcauagacgccgacc

SEQ ID NO: 417218 - RNA, 17 nt, Bordetella pertussis
ucgcccggcuccaggcc

SEQ ID NO: 417219 - RNA, 19 nt, Bordetella pertussis
ucgcccgggcgccggcacg

SEQ ID NO: 417220 - RNA, 21 nt, Bordetella pertussis
ucgcccugucggugaugaucc

SEQ ID NO: 417221 - RNA, 21 nt, Bordetella pertussis
ucgcccuucagguagccgaag

SEQ ID NO: 417222 - RNA, 18 nt, Bordetella pertussis
ucgcccuugauggccucg

SEQ ID NO: 417223 - RNA, 18 nt, Bordetella pertussis
ucgcccuugcggcgaggc

SEQ ID NO: 417224 - RNA, 16 nt, Bordetella pertussis
ucgcccuuguaguggc

SEQ ID NO: 417225 - RNA, 16 nt, Bordetella pertussis
ucgccgaagcaaugca

SEQ ID NO: 417226 - RNA, 15 nt, Bordetella pertussis
ucgccgacccgggcg

SEQ ID NO: 417227 - RNA, 15 nt, Bordetella pertussis
ucgccgagccgggcc

SEQ ID NO: 417228 - RNA, 15 nt, Bordetella pertussis
ucgccgcaccaggcc

SEQ ID NO: 417229 - RNA, 16 nt, Bordetella pertussis
ucgccgcaccaggccg

SEQ ID NO: 417230 - RNA, 14 nt, Bordetella pertussis
ucgccgcaguucca

SEQ ID NO: 417231 - RNA, 23 nt, Bordetella pertussis
ucgccgccagcuuggugcucagu

SEQ ID NO: 417232 - RNA, 14 nt, Bordetella pertussis
ucgccgcccugcug

SEQ ID NO: 417233 - RNA, 15 nt, Bordetella pertussis
ucgccgcccugcugc

SEQ ID NO: 417234 - RNA, 17 nt, Bordetella pertussis
ucgccgcccugcugccc

SEQ ID NO: 417235 - RNA, 13 nt, Bordetella pertussis
ucgccgccgccau

SEQ ID NO: 417236 - RNA, 16 nt, Bordetella pertussis
ucgccgccgcgcacca

SEQ ID NO: 417237 - RNA, 22 nt, Bordetella pertussis
ucgccgccgccgggcuggaucc

SEQ ID NO: 417238 - RNA, 17 nt, Bordetella pertussis
ucgccgccugcggcgcg

SEQ ID NO: 417239 - RNA, 18 nt, Bordetella pertussis
ucgccgcugccgggcucg

SEQ ID NO: 417240 - RNA, 14 nt, Bordetella pertussis
ucgccgcuggccag

SEQ ID NO: 417241 - RNA, 15 nt, Bordetella pertussis
ucgccgcuggccagc

SEQ ID NO: 417242 - RNA, 16 nt, Bordetella pertussis
ucgccggccagcgcgg

SEQ ID NO: 417243 - RNA, 17 nt, Bordetella pertussis
ucgccggccagcgcggu

SEQ ID NO: 417244 - RNA, 20 nt, Bordetella pertussis
ucgccggcgaugacggcuuc

SEQ ID NO: 417245 - RNA, 19 nt, Bordetella pertussis
ucgccggcgcaacgggccg

SEQ ID NO: 417246 - RNA, 14 nt, Bordetella pertussis
ucgccggcgcugcg

SEQ ID NO: 417247 - RNA, 15 nt, Bordetella pertussis
ucgccggcgcugcug

SEQ ID NO: 417248 - RNA, 20 nt, Bordetella pertussis
ucgccggcgcugcugucgcg

SEQ ID NO: 417249 - RNA, 16 nt, Bordetella pertussis
ucgccggcggcguggc

SEQ ID NO: 417250 - RNA, 22 nt, Bordetella pertussis
ucgccgugcugggcggccaggc

SEQ ID NO: 417251 - RNA, 15 nt, Bordetella pertussis
ucgccuccccaggcc

SEQ ID NO: 417252 - RNA, 15 nt, Bordetella pertussis
ucgccucgaugaagg

SEQ ID NO: 417253 - RNA, 19 nt, Bordetella pertussis
ucgccucggcgguugcccg

SEQ ID NO: 417254 - RNA, 22 nt, Bordetella pertussis
ucgccucggcgguugcccgccc

SEQ ID NO: 417255 - RNA, 18 nt, Bordetella pertussis
ucgccucggucugcuuca

SEQ ID NO: 417256 - RNA, 19 nt, Bordetella pertussis
ucgccuggccggcuugcau

SEQ ID NO: 417257 - RNA, 12 nt, Bordetella pertussis
ucgccuggggca

SEQ ID NO: 417258 - RNA, 22 nt, Bordetella pertussis
ucgcgaaagcgcugcgccgcgg

SEQ ID NO: 417259 - RNA, 15 nt, Bordetella pertussis
ucgcgaaagcggcgu

SEQ ID NO: 417260 - RNA, 21 nt, Bordetella pertussis
ucgcgaagguguccggaugca

SEQ ID NO: 417261 - RNA, 18 nt, Bordetella pertussis
ucgcgcaacgccgggucg

SEQ ID NO: 417262 - RNA, 12 nt, Bordetella pertussis
ucgcgcacagca

SEQ ID NO: 417263 - RNA, 22 nt, Bordetella pertussis
ucgcgcacagcauggccaccag

SEQ ID NO: 417264 - RNA, 18 nt, Bordetella pertussis
ucgcgcacccgcaggccg

SEQ ID NO: 417265 - RNA, 21 nt, Bordetella pertussis
ucgcgcaccgaggugccggcg

SEQ ID NO: 417266 - RNA, 19 nt, Bordetella pertussis
ucgcgcaccgcaugggcca

SEQ ID NO: 417267 - RNA, 16 nt, Bordetella pertussis
ucgcgcacggugcgca

SEQ ID NO: 417268 - RNA, 20 nt, Bordetella pertussis
ucgcgcagcaccgccagcgc

SEQ ID NO: 417269 - RNA, 13 nt, Bordetella pertussis
ucgcgcagcagcu

SEQ ID NO: 417270 - RNA, 14 nt, Bordetella pertussis
ucgcgcagcaggcc

SEQ ID NO: 417271 - RNA, 15 nt, Bordetella pertussis
ucgcgcagcaggccg

SEQ ID NO: 417272 - RNA, 15 nt, Bordetella pertussis
ucgcgcagcagggcc

SEQ ID NO: 417273 - RNA, 17 nt, Bordetella pertussis
ucgcgcagcagggccug

SEQ ID NO: 417274 - RNA, 19 nt, Bordetella pertussis
ucgcgcagccacagcgcgu

SEQ ID NO: 417275 - RNA, 14 nt, Bordetella pertussis
ucgcgcagcgccug

SEQ ID NO: 417276 - RNA, 18 nt, Bordetella pertussis
ucgcgcagcgccuggccg

SEQ ID NO: 417277 - RNA, 13 nt, Bordetella pertussis
ucgcgcagcggcg

SEQ ID NO: 417278 - RNA, 22 nt, Bordetella pertussis
ucgcgcauuucgaacaaggcgg

SEQ ID NO: 417279 - RNA, 13 nt, Bordetella pertussis
ucgcgccaccaug

SEQ ID NO: 417280 - RNA, 15 nt, Bordetella pertussis
ucgcgccagcggccg

SEQ ID NO: 417281 - RNA, 13 nt, Bordetella pertussis
ucgcgccaggccg

SEQ ID NO: 417282 - RNA, 19 nt, Bordetella pertussis
ucgcgccaggcgccgggcc

SEQ ID NO: 417283 - RNA, 14 nt, Bordetella pertussis
ucgcgcccgagcgc

SEQ ID NO: 417284 - RNA, 18 nt, Bordetella pertussis
ucgcgccggccgacggcg

SEQ ID NO: 417285 - RNA, 23 nt, Bordetella pertussis
ucgcgccggccgacggcgcuggc

SEQ ID NO: 417286 - RNA, 15 nt, Bordetella pertussis
ucgcgcgagaccagc

SEQ ID NO: 417287 - RNA, 18 nt, Bordetella pertussis
ucgcgcgcaucgccgaac

SEQ ID NO: 417288 - RNA, 21 nt, Bordetella pertussis
ucgcgcgccaggugcacggug

SEQ ID NO: 417289 - RNA, 14 nt, Bordetella pertussis
ucgcgcgccggcag

SEQ ID NO: 417290 - RNA, 19 nt, Bordetella pertussis
ucgcgcgcgcggauccagc

SEQ ID NO: 417291 - RNA, 15 nt, Bordetella pertussis
ucgcgcgcgcgggcg

SEQ ID NO: 417292 - RNA, 12 nt, Bordetella pertussis
ucgcgcgcggac

SEQ ID NO: 417293 - RNA, 18 nt, Bordetella pertussis
ucgcgcggauccuugacg

SEQ ID NO: 417294 - RNA, 16 nt, Bordetella pertussis
ucgcgcgugcaggccg

SEQ ID NO: 417295 - RNA, 15 nt, Bordetella pertussis
ucgcgcuccaugggc

SEQ ID NO: 417296 - RNA, 19 nt, Bordetella pertussis
ucgcgcucgcgcucggcca

SEQ ID NO: 417297 - RNA, 15 nt, Bordetella pertussis
ucgcgcucggccagc

SEQ ID NO: 417298 - RNA, 19 nt, Bordetella pertussis
ucgcgcucggccagcgcgc

SEQ ID NO: 417299 - RNA, 22 nt, Bordetella pertussis
ucgcgcugcccaccgccguggc

SEQ ID NO: 417300 - RNA, 23 nt, Bordetella pertussis
ucgcgcugcccaccgccguggcc

SEQ ID NO: 417301 - RNA, 19 nt, Bordetella pertussis
ucgcgcugcgacagcagca

SEQ ID NO: 417302 - RNA, 20 nt, Bordetella pertussis
ucgcgcugcgacagcagcau

SEQ ID NO: 417303 - RNA, 15 nt, Bordetella pertussis
ucgcgcugcgcgccg

SEQ ID NO: 417304 - RNA, 15 nt, Bordetella pertussis
ucgcgcuucuugucc

SEQ ID NO: 417305 - RNA, 21 nt, Bordetella pertussis
ucgcggaaauccgggcgcugc

SEQ ID NO: 417306 - RNA, 15 nt, Bordetella pertussis
ucgcgcuugcggccg

SEQ ID NO: 417307 - RNA, 14 nt, Bordetella pertussis
ucgcggaugaccug

SEQ ID NO: 417308 - RNA, 21 nt, Bordetella pertussis
ucgcggcacgaaaagccgcgg

SEQ ID NO: 417309 - RNA, 21 nt, Bordetella pertussis
ucgcggcagcccggcacgucg

SEQ ID NO: 417310 - RNA, 16 nt, Bordetella pertussis
ucgcggcccgccaggg

SEQ ID NO: 417311 - RNA, 13 nt, Bordetella pertussis
ucgcggccggccg

SEQ ID NO: 417312 - RNA, 14 nt, Bordetella pertussis
ucgcggcgcaggcg

SEQ ID NO: 417313 - RNA, 18 nt, Bordetella pertussis
ucgcggcgcggcgcaggc

SEQ ID NO: 417314 - RNA, 21 nt, Bordetella pertussis
ucgcggcggguucgcagggcg

SEQ ID NO: 417315 - RNA, 14 nt, Bordetella pertussis
ucgcggcugggcaa

SEQ ID NO: 417316 - RNA, 13 nt, Bordetella pertussis
ucgcgggccaggc

SEQ ID NO: 417317 - RNA, 21 nt, Bordetella pertussis
ucgcgggcccgcucggccagc

SEQ ID NO: 417318 - RNA, 15 nt, Bordetella pertussis
ucgcgggccaggccg

SEQ ID NO: 417319 - RNA, 15 nt, Bordetella pertussis
ucgcgguacaggcug

SEQ ID NO: 417320 - RNA, 21 nt, Bordetella pertussis
ucgcggucgggaucauccugu

SEQ ID NO: 417321 - RNA, 15 nt, Bordetella pertussis
ucgcggugcaagcgg

SEQ ID NO: 417322 - RNA, 16 nt, Bordetella pertussis
ucgcggugcaagcggc

SEQ ID NO: 417323 - RNA, 16 nt, Bordetella pertussis
ucgcggugggcagcgg

SEQ ID NO: 417324 - RNA, 23 nt, Bordetella pertussis
ucgcgguucaggguggccgcgac

SEQ ID NO: 417325 - RNA, 15 nt, Bordetella pertussis
ucgcguagcgcggcc

SEQ ID NO: 417326 - RNA, 17 nt, Bordetella pertussis
ucgcgucggccaaggcc

SEQ ID NO: 417327 - RNA, 21 nt, Bordetella pertussis
ucgcucaacagcuugcccacg

SEQ ID NO: 417328 - RNA, 22 nt, Bordetella pertussis
ucgcucaggguacggcgaugcc

SEQ ID NO: 417329 - RNA, 14 nt, Bordetella pertussis
ucgcuccccgugcg

SEQ ID NO: 417330 - RNA, 21 nt, Bordetella pertussis
ucgcucccccaugcggggaca

SEQ ID NO: 417331 - RNA, 22 nt, Bordetella pertussis
ucgcugaccggcguauggcccg

SEQ ID NO: 417332 - RNA, 18 nt, Bordetella pertussis
ucgcugacgcguucuuca

SEQ ID NO: 417333 - RNA, 14 nt, Bordetella pertussis
ucgcugccggcguc

SEQ ID NO: 417334 - RNA, 21 nt, Bordetella pertussis
ucgcugcgcgucaaggggcug

SEQ ID NO: 417335 - RNA, 19 nt, Bordetella pertussis
ucgcugcucgacagcagcc

SEQ ID NO: 417336 - RNA, 23 nt, Bordetella pertussis
ucgcuggagaccggcauggugua

SEQ ID NO: 417337 - RNA, 15 nt, Bordetella pertussis
ucgcuggcagccuug

SEQ ID NO: 417338 - RNA, 11 nt, Bordetella pertussis
ucgcuggccau

SEQ ID NO: 417339 - RNA, 11 nt, Bordetella pertussis
ucgcuggggcg

SEQ ID NO: 417340 - RNA, 13 nt, Bordetella pertussis
ucgcuuuccaggg

SEQ ID NO: 417341 - RNA, 22 nt, Bordetella pertussis
ucggaagacauggcgcgcgcca

SEQ ID NO: 417342 - RNA, 21 nt, Bordetella pertussis
ucggacgggccgaugaagacg

SEQ ID NO: 417343 - RNA, 22 nt, Bordetella pertussis
ucggagaaaucgccgccggcgg

SEQ ID NO: 417344 - RNA, 15 nt, Bordetella pertussis
ucggauugcggugcc

SEQ ID NO: 417345 - RNA, 17 nt, Bordetella pertussis
ucggcaaccugcacgcg

SEQ ID NO: 417346 - RNA, 23 nt, Bordetella pertussis
ucggcaaccugcacgcgggcgcu

SEQ ID NO: 417347 - RNA, 16 nt, Bordetella pertussis
ucggcaccgaggccga

SEQ ID NO: 417348 - RNA, 17 nt, Bordetella pertussis
ucggcaggugcagaaac

SEQ ID NO: 417349 - RNA, 15 nt, Bordetella pertussis
ucggcauggccagga

SEQ ID NO: 417350 - RNA, 16 nt, Bordetella pertussis
ucggcauggccaggaa

SEQ ID NO: 417351 - RNA, 13 nt, Bordetella pertussis
ucggcauggucgg

SEQ ID NO: 417352 - RNA, 16 nt, Bordetella pertussis
ucggccaaggccggcg

SEQ ID NO: 417353 - RNA, 14 nt, Bordetella pertussis
ucggccaccaggcc

SEQ ID NO: 417354 - RNA, 16 nt, Bordetella pertussis
ucggccacgcugcccu

SEQ ID NO: 417355 - RNA, 19 nt, Bordetella pertussis
ucggccacgcugcccugcu

SEQ ID NO: 417356 - RNA, 20 nt, Bordetella pertussis
ucggccacgcugcccugcug

SEQ ID NO: 417357 - RNA, 15 nt, Bordetella pertussis
ucggccacgcgcugc

SEQ ID NO: 417358 - RNA, 17 nt, Bordetella pertussis
ucggccagcagcgccug

SEQ ID NO: 417359 - RNA, 15 nt, Bordetella pertussis
ucggccagcaguguu

SEQ ID NO: 417360 - RNA, 11 nt, Bordetella pertussis
ucggccagcgc

SEQ ID NO: 417361 - RNA, 16 nt, Bordetella pertussis
ucggccagcgccgaaa

SEQ ID NO: 417362 - RNA, 17 nt, Bordetella pertussis
ucggccagcgcgcggcc

SEQ ID NO: 417363 - RNA, 19 nt, Bordetella pertussis
ucggccagcgcgcggcgca

SEQ ID NO: 417364 - RNA, 14 nt, Bordetella pertussis
ucggccagcgugcc

SEQ ID NO: 417365 - RNA, 20 nt, Bordetella pertussis
ucggccagcgugccggugac

SEQ ID NO: 417366 - RNA, 15 nt, Bordetella pertussis
ucggccagcuugccg

SEQ ID NO: 417367 - RNA, 19 nt, Bordetella pertussis
ucggccaggaaagccggcg

SEQ ID NO: 417368 - RNA, 17 nt, Bordetella pertussis
ucggccaggcgccagau

SEQ ID NO: 417369 - RNA, 18 nt, Bordetella pertussis
ucggccgaaccgcgcagc

SEQ ID NO: 417370 - RNA, 19 nt, Bordetella pertussis
ucggccgaaccgcgcagcc

SEQ ID NO: 417371 - RNA, 22 nt, Bordetella pertussis
ucggccgccgccgugacgcuga

SEQ ID NO: 417372 - RNA, 13 nt, Bordetella pertussis
ucggccgccggcg

SEQ ID NO: 417373 - RNA, 18 nt, Bordetella pertussis
ucggccgcgcccaggucc

SEQ ID NO: 417374 - RNA, 14 nt, Bordetella pertussis
ucggccgcgccgcc

SEQ ID NO: 417375 - RNA, 20 nt, Bordetella pertussis
ucggccgcuccgccauggag

SEQ ID NO: 417376 - RNA, 11 nt, Bordetella pertussis
ucggccggcaa

SEQ ID NO: 417377 - RNA, 17 nt, Bordetella pertussis
ucggccggcugcgcgcc

SEQ ID NO: 417378 - RNA, 12 nt, Bordetella pertussis
ucggccgggccg

SEQ ID NO: 417379 - RNA, 17 nt, Bordetella pertussis
ucggccgggccgggcac

SEQ ID NO: 417380 - RNA, 13 nt, Bordetella pertussis
ucggccgucuggg

SEQ ID NO: 417381 - RNA, 20 nt, Bordetella pertussis
ucggccucaucgagcgccug

SEQ ID NO: 417382 - RNA, 22 nt, Bordetella pertussis
ucggccucaucgagcgccuggg

SEQ ID NO: 417383 - RNA, 17 nt, Bordetella pertussis
ucggccucgcgcagggc

SEQ ID NO: 417384 - RNA, 19 nt, Bordetella pertussis
ucggccucgcggcgcagca

SEQ ID NO: 417385 - RNA, 18 nt, Bordetella pertussis
ucggccugccaccagcgc

SEQ ID NO: 417386 - RNA, 22 nt, Bordetella pertussis
ucggccugcccguucacgcgca

SEQ ID NO: 417387 - RNA, 19 nt, Bordetella pertussis
ucggccugcgccaccagcu

SEQ ID NO: 417388 - RNA, 19 nt, Bordetella pertussis
ucggccugcucgcaggccu

SEQ ID NO: 417389 - RNA, 23 nt, Bordetella pertussis
ucggccugggcgcgaugggccug

SEQ ID NO: 417390 - RNA, 21 nt, Bordetella pertussis
ucggcgaagccgcagcggcag

SEQ ID NO: 417391 - RNA, 21 nt, Bordetella pertussis
ucggcgaagccuugcgcggcc

SEQ ID NO: 417392 - RNA, 21 nt, Bordetella pertussis
ucggcgaccaggugcgggccg

SEQ ID NO: 417393 - RNA, 20 nt, Bordetella pertussis
ucggcgacuucggcggccug

SEQ ID NO: 417394 - RNA, 18 nt, Bordetella pertussis
ucggcgauggcgcgcgcc

SEQ ID NO: 417395 - RNA, 20 nt, Bordetella pertussis
ucggcgcaaccggcccgaag

SEQ ID NO: 417396 - RNA, 13 nt, Bordetella pertussis
ucggcgcccggcg

SEQ ID NO: 417397 - RNA, 16 nt, Bordetella pertussis
ucggcgcccggcgccg

SEQ ID NO: 417398 - RNA, 20 nt, Bordetella pertussis
ucggcgccgaucagcagguc

SEQ ID NO: 417399 - RNA, 18 nt, Bordetella pertussis
ucggcgccgcgcugaucc

SEQ ID NO: 417400 - RNA, 12 nt, Bordetella pertussis
ucggcgccggcg

SEQ ID NO: 417401 - RNA, 13 nt, Bordetella pertussis
ucggcgccgggcg

SEQ ID NO: 417402 - RNA, 14 nt, Bordetella pertussis
ucggcgccgggcug

SEQ ID NO: 417403 - RNA, 17 nt, Bordetella pertussis
ucggcgcgagcgaugcc

SEQ ID NO: 417404 - RNA, 23 nt, Bordetella pertussis
ucggcgcgcgccaggcccagggc

SEQ ID NO: 417405 - RNA, 20 nt, Bordetella pertussis
ucggcgcgcgcugcacggcc

SEQ ID NO: 417406 - RNA, 12 nt, Bordetella pertussis
ucggcgcgcgcc

SEQ ID NO: 417407 - RNA, 20 nt, Bordetella pertussis
ucggcggccagcagcggcag

SEQ ID NO: 417408 - RNA, 21 nt, Bordetella pertussis
ucggcggccagccggcgcgcc

SEQ ID NO: 417409 - RNA, 14 nt, Bordetella pertussis
ucggcggccagcgc

SEQ ID NO: 417410 - RNA, 17 nt, Bordetella pertussis
ucggcggccagcgcgcc

SEQ ID NO: 417411 - RNA, 13 nt, Bordetella pertussis
ucggcggccaggc

SEQ ID NO: 417412 - RNA, 14 nt, Bordetella pertussis
ucggcggccaggcc

SEQ ID NO: 417413 - RNA, 16 nt, Bordetella pertussis
ucggcggcccacagcg

SEQ ID NO: 417414 - RNA, 19 nt, Bordetella pertussis
ucggcggcccacagcgccc

SEQ ID NO: 417415 - RNA, 14 nt, Bordetella pertussis
ucggcggccgccuu

SEQ ID NO: 417416 - RNA, 23 nt, Bordetella pertussis
ucggcggccugcuuggcagccuu

SEQ ID NO: 417417 - RNA, 13 nt, Bordetella pertussis
ucggcggccuggg

SEQ ID NO: 417418 - RNA, 20 nt, Bordetella pertussis
ucggcggccugggccauggc

SEQ ID NO: 417419 - RNA, 23 nt, Bordetella pertussis
ucggcggcgucgcuggcagccuu

SEQ ID NO: 417420 - RNA, 18 nt, Bordetella pertussis
ucggcggugaugucgccg

SEQ ID NO: 417421 - RNA, 16 nt, Bordetella pertussis
ucggcguacugcugca

SEQ ID NO: 417422 - RNA, 19 nt, Bordetella pertussis
ucggcgugacguugccgcg

SEQ ID NO: 417423 - RNA, 17 nt, Bordetella pertussis
ucggcucaguccaaggu

SEQ ID NO: 417424 - RNA, 17 nt, Bordetella pertussis
ucggcucgagcaagggc

SEQ ID NO: 417425 - RNA, 18 nt, Bordetella pertussis
ucggcucgagcaagggcc

SEQ ID NO: 417426 - RNA, 15 nt, Bordetella pertussis
ucggcuugcacgccg

SEQ ID NO: 417427 - RNA, 18 nt, Bordetella pertussis
ucggcuugccgcgcggcg

SEQ ID NO: 417428 - RNA, 15 nt, Bordetella pertussis
ucggcuugcgcggcg

SEQ ID NO: 417429 - RNA, 21 nt, Bordetella pertussis
ucggcuugcguuggcauggcg

SEQ ID NO: 417430 - RNA, 19 nt, Bordetella pertussis
ucgggaaugaugcagcugu

SEQ ID NO: 417431 - RNA, 21 nt, Bordetella pertussis
ucgggaccgaacaccaccgag

SEQ ID NO: 417432 - RNA, 17 nt, Bordetella pertussis
ucgggacgcaggagucg

SEQ ID NO: 417433 - RNA, 17 nt, Bordetella pertussis
ucgggaucauccuguuc

SEQ ID NO: 417434 - RNA, 16 nt, Bordetella pertussis
ucgggaugccccgccc

SEQ ID NO: 417435 - RNA, 14 nt, Bordetella pertussis
ucgggcaagcggcg

SEQ ID NO: 417436 - RNA, 12 nt, Bordetella pertussis
ucgggcacggcc

SEQ ID NO: 417437 - RNA, 17 nt, Bordetella pertussis
ucgggcacguccggauc

SEQ ID NO: 417438 - RNA, 20 nt, Bordetella pertussis
ucgggcagcagcagggccag

SEQ ID NO: 417439 - RNA, 22 nt, Bordetella pertussis
ucgggcagcagcagggccaggc

SEQ ID NO: 417440 - RNA, 14 nt, Bordetella pertussis
ucgggcagcaggcg

SEQ ID NO: 417441 - RNA, 15 nt, Bordetella pertussis
ucgggcagcgcggcg

SEQ ID NO: 417442 - RNA, 21 nt, Bordetella pertussis
ucgggccacccgccgccggcg

SEQ ID NO: 417443 - RNA, 17 nt, Bordetella pertussis
ucgggcugcggcuccug

SEQ ID NO: 417444 - RNA, 18 nt, Bordetella pertussis
ucggggaaauugacggcg

SEQ ID NO: 417445 - RNA, 23 nt, Bordetella pertussis
ucggggacaggcaccgaaguguc

SEQ ID NO: 417446 - RNA, 20 nt, Bordetella pertussis
ucggggcaacgacgcaggcg

SEQ ID NO: 417447 - RNA, 19 nt, Bordetella pertussis
ucggggcgcaagaucugga

SEQ ID NO: 417448 - RNA, 20 nt, Bordetella pertussis
ucggggcgcucgagcgccug

SEQ ID NO: 417449 - RNA, 18 nt, Bordetella pertussis
ucggggggugcgaggcga

SEQ ID NO: 417450 - RNA, 15 nt, Bordetella pertussis
ucggguaaagcggug

SEQ ID NO: 417451 - RNA, 16 nt, Bordetella pertussis
ucggguccagcacgcc

SEQ ID NO: 417452 - RNA, 14 nt, Bordetella pertussis
ucggucagcugcug

SEQ ID NO: 417453 - RNA, 16 nt, Bordetella pertussis
ucggucagcugcuguu

SEQ ID NO: 417454 - RNA, 15 nt, Bordetella pertussis
ucgguccagcggaag

SEQ ID NO: 417455 - RNA, 23 nt, Bordetella pertussis
ucggucgccuguaucagcgccug

SEQ ID NO: 417456 - RNA, 16 nt, Bordetella pertussis
ucggugaugcucugcc

SEQ ID NO: 417457 - RNA, 16 nt, Bordetella pertussis
ucggugcacacgccuu

SEQ ID NO: 417458 - RNA, 16 nt, Bordetella pertussis
ucggugcagcccagca

SEQ ID NO: 417459 - RNA, 16 nt, Bordetella pertussis
ucggugcgcagcggca

SEQ ID NO: 417460 - RNA, 17 nt, Bordetella pertussis
ucggugcgcagcggcag

SEQ ID NO: 417461 - RNA, 18 nt, Bordetella pertussis
ucggugcgcagcggcagg

SEQ ID NO: 417462 - RNA, 14 nt, Bordetella pertussis
ucgguggccagcca

SEQ ID NO: 417463 - RNA, 13 nt, Bordetella pertussis
ucgguggggcagg

SEQ ID NO: 417464 - RNA, 13 nt, Bordetella pertussis
ucguaaggcugcg

SEQ ID NO: 417465 - RNA, 19 nt, Bordetella pertussis
ucguacagccugcccuggu

SEQ ID NO: 417466 - RNA, 15 nt, Bordetella pertussis
ucguagcccucgccc

SEQ ID NO: 417467 - RNA, 14 nt, Bordetella pertussis
ucguagugcgcgcc

SEQ ID NO: 417468 - RNA, 12 nt, Bordetella pertussis
ucgucagcagca

SEQ ID NO: 417469 - RNA, 14 nt, Bordetella pertussis
ucgucagcagcacg

SEQ ID NO: 417470 - RNA, 21 nt, Bordetella pertussis
ucgucaugauguagcccaugu

SEQ ID NO: 417471 - RNA, 21 nt, Bordetella pertussis
ucguccagguugagucuggag

SEQ ID NO: 417472 - RNA, 16 nt, Bordetella pertussis
ucguccaucgccugca

SEQ ID NO: 417473 - RNA, 14 nt, Bordetella pertussis
ucguccccacgggg

SEQ ID NO: 417474 - RNA, 16 nt, Bordetella pertussis
ucgucccccuacugcc

SEQ ID NO: 417475 - RNA, 12 nt, Bordetella pertussis
ucguccgcuucg

SEQ ID NO: 417476 - RNA, 19 nt, Bordetella pertussis
ucguccgcggcccgcccgc

SEQ ID NO: 417477 - RNA, 15 nt, Bordetella pertussis
ucguccucggugcug

SEQ ID NO: 417478 - RNA, 16 nt, Bordetella pertussis
ucguccugccauugcg

SEQ ID NO: 417479 - RNA, 22 nt, Bordetella pertussis
ucgucgaacagcaucagcuugg

SEQ ID NO: 417480 - RNA, 15 nt, Bordetella pertussis
ucgucgaugaugacg

SEQ ID NO: 417481 - RNA, 19 nt, Bordetella pertussis
ucgucgccaccgcccagaa

SEQ ID NO: 417482 - RNA, 23 nt, Bordetella pertussis
ucgucgcgguccagcaccagggc

SEQ ID NO: 417483 - RNA, 23 nt, Bordetella pertussis
ucgucggcaaccgucgccagcgc

SEQ ID NO: 417484 - RNA, 21 nt, Bordetella pertussis
ucgucggcaccuucgcgcagc

SEQ ID NO: 417485 - RNA, 19 nt, Bordetella pertussis
ucgucggcgcgcgccaggc

SEQ ID NO: 417486 - RNA, 14 nt, Bordetella pertussis
ucgucguagcgcca

SEQ ID NO: 417487 - RNA, 14 nt, Bordetella pertussis
ucgucguccaggcg

SEQ ID NO: 417488 - RNA, 16 nt, Bordetella pertussis
ucgucgucggcaccuu

SEQ ID NO: 417489 - RNA, 18 nt, Bordetella pertussis
ucgucuuuuuacaggcag

SEQ ID NO: 417490 - RNA, 15 nt, Bordetella pertussis
ucgugauccugacca

SEQ ID NO: 417491 - RNA, 17 nt, Bordetella pertussis
ucgugcagcaggggcug

SEQ ID NO: 417492 - RNA, 15 nt, Bordetella pertussis
ucgugccgcacggug

SEQ ID NO: 417493 - RNA, 21 nt, Bordetella pertussis
ucgugcgugaccacgaucaug

SEQ ID NO: 417494 - RNA, 20 nt, Bordetella pertussis
ucguggaagaucacauaggc

SEQ ID NO: 417495 - RNA, 21 nt, Bordetella pertussis
ucguggcgcgccuccagcucc

SEQ ID NO: 417496 - RNA, 16 nt, Bordetella pertussis
ucguggcuggcgagga

SEQ ID NO: 417497 - RNA, 15 nt, Bordetella pertussis
ucguggggcgcggcg

SEQ ID NO: 417498 - RNA, 12 nt, Bordetella pertussis
ucguguuauagu

SEQ ID NO: 417499 - RNA, 13 nt, Bordetella pertussis
ucguucacgcccg

SEQ ID NO: 417500 - RNA, 14 nt, Bordetella pertussis
ucguucguauugcu

SEQ ID NO: 417501 - RNA, 13 nt, Bordetella pertussis
ucguuggccgcgu

SEQ ID NO: 417502 - RNA, 16 nt, Bordetella pertussis
ucguuucccagcaagc

SEQ ID NO: 417503 - RNA, 16 nt, Bordetella pertussis
ucuacccgcgcgagcu

SEQ ID NO: 417504 - RNA, 20 nt, Bordetella pertussis
ucuacgccgaauugcuggag

SEQ ID NO: 417505 - RNA, 22 nt, Bordetella pertussis
ucuacgccgaauugcuggagcg

SEQ ID NO: 417506 - RNA, 14 nt, Bordetella pertussis
ucuauggccugcag

SEQ ID NO: 417507 - RNA, 20 nt, Bordetella pertussis
ucucagccgcccgccgggcc

SEQ ID NO: 417508 - RNA, 22 nt, Bordetella pertussis
ucucaggccgaggcugcgcgcg

SEQ ID NO: 417509 - RNA, 14 nt, Bordetella pertussis
ucuccacccccggg

SEQ ID NO: 417510 - RNA, 13 nt, Bordetella pertussis
ucuccacuggccu

SEQ ID NO: 417511 - RNA, 21 nt, Bordetella pertussis
ucuccagcgccggcagcccca

SEQ ID NO: 417512 - RNA, 13 nt, Bordetella pertussis
ucuccagcgcggc

SEQ ID NO: 417513 - RNA, 21 nt, Bordetella pertussis
ucuccagcgcgucggccaggc

SEQ ID NO: 417514 - RNA, 24 nt, Bordetella pertussis
ucuccagcgcgucggccaggcgcc

SEQ ID NO: 417515 - RNA, 23 nt, Bordetella pertussis
ucuccaugcugaaaaccaacggg

SEQ ID NO: 417516 - RNA, 19 nt, Bordetella pertussis
ucucgaacgccgcgucgcu

SEQ ID NO: 417517 - RNA, 21 nt, Bordetella pertussis
ucucgaagaagcagccgcgcu

SEQ ID NO: 417518 - RNA, 18 nt, Bordetella pertussis
ucucgacccgcucggcca

SEQ ID NO: 417519 - RNA, 12 nt, Bordetella pertussis
ucucggccacgg

SEQ ID NO: 417520 - RNA, 13 nt, Bordetella pertussis
ucucggccagcag

SEQ ID NO: 417521 - RNA, 16 nt, Bordetella pertussis
ucucggccgcggcguu

SEQ ID NO: 417522 - RNA, 18 nt, Bordetella pertussis
ucucgugccccgcaugcg

SEQ ID NO: 417523 - RNA, 22 nt, Bordetella pertussis
ucucuccauggcagcucgcuaa

SEQ ID NO: 417524 - RNA, 19 nt, Bordetella pertussis
ucugcaccuugggcgccug

SEQ ID NO: 417525 - RNA, 22 nt, Bordetella pertussis
ucugcaccuugggcgccugcgg

SEQ ID NO: 417526 - RNA, 21 nt, Bordetella pertussis
ucugcacgccgggcgcgcugc

SEQ ID NO: 417527 - RNA, 14 nt, Bordetella pertussis
ucugcacgaggcgc

SEQ ID NO: 417528 - RNA, 21 nt, Bordetella pertussis
ucugcaggugccugucccagc

SEQ ID NO: 417529 - RNA, 21 nt, Bordetella pertussis
ucugcaugccgaccaccagca

SEQ ID NO: 417530 - RNA, 22 nt, Bordetella pertussis
ucugcauguacucggccaggcc

SEQ ID NO: 417531 - RNA, 13 nt, Bordetella pertussis
ucugccacaucac

SEQ ID NO: 417532 - RNA, 18 nt, Bordetella pertussis
ucuggauggcguauggaa

SEQ ID NO: 417533 - RNA, 19 nt, Bordetella pertussis
ucuggcacaccagcgccag

SEQ ID NO: 417534 - RNA, 16 nt, Bordetella pertussis
ucuggcacgcuugccg

SEQ ID NO: 417535 - RNA, 21 nt, Bordetella pertussis
ucuggcagugcgccuggcuga

SEQ ID NO: 417536 - RNA, 21 nt, Bordetella pertussis
ucugggcgcggaacagccugg

SEQ ID NO: 417537 - RNA, 15 nt, Bordetella pertussis
ucuggucuggcaacg

SEQ ID NO: 417538 - RNA, 14 nt, Bordetella pertussis
ucugguccacggcg

SEQ ID NO: 417539 - RNA, 13 nt, Bordetella pertussis
ucuggugcagcgg

SEQ ID NO: 417540 - RNA, 15 nt, Bordetella pertussis
ucugguugagcagca

SEQ ID NO: 417541 - RNA, 19 nt, Bordetella pertussis
ucugguuuuucgaagagca

SEQ ID NO: 417542 - RNA, 19 nt, Bordetella pertussis
ucuguccugauucacaggc

SEQ ID NO: 417543 - RNA, 19 nt, Bordetella pertussis
ucugucgcggaugucaguu

SEQ ID NO: 417544 - RNA, 12 nt, Bordetella pertussis
ucuucacguagc

SEQ ID NO: 417545 - RNA, 16 nt, Bordetella pertussis
ucuuccauccugaugu

SEQ ID NO: 417546 - RNA, 14 nt, Bordetella pertussis
ucuucgccuggccg

SEQ ID NO: 417547 - RNA, 14 nt, Bordetella pertussis
ugaaaccgcaggca

SEQ ID NO: 417548 - RNA, 19 nt, Bordetella pertussis
ugaacacgcggugcaucuc

SEQ ID NO: 417549 - RNA, 20 nt, Bordetella pertussis
ugaacgauucuuuccuggcc

SEQ ID NO: 417550 - RNA, 14 nt, Bordetella pertussis
ugaacgccgggccg

SEQ ID NO: 417551 - RNA, 22 nt, Bordetella pertussis
ugaagccguccuuggcgccggc

SEQ ID NO: 417552 - RNA, 19 nt, Bordetella pertussis
ugaagcgccgccacaggcu

SEQ ID NO: 417553 - RNA, 21 nt, Bordetella pertussis
ugaagcgccgccacaggcuga

SEQ ID NO: 417554 - RNA, 14 nt, Bordetella pertussis
ugaaggcggccagc

SEQ ID NO: 417555 - RNA, 18 nt, Bordetella pertussis
ugaaggggcuccccugcu

SEQ ID NO: 417556 - RNA, 20 nt, Bordetella pertussis
ugaaguucaugcucuugcuc

SEQ ID NO: 417557 - RNA, 19 nt, Bordetella pertussis
ugaccagcaccagcgccug

SEQ ID NO: 417558 - RNA, 17 nt, Bordetella pertussis
ugaccagcacgaugguc

SEQ ID NO: 417559 - RNA, 14 nt, Bordetella pertussis
ugaccagcgcggcc

SEQ ID NO: 417560 - RNA, 15 nt, Bordetella pertussis
ugaccagcgcggccg

SEQ ID NO: 417561 - RNA, 21 nt, Bordetella pertussis
ugaccagcgcgucgcacuggg

SEQ ID NO: 417562 - RNA, 21 nt, Bordetella pertussis
ugaccaucacgagcagguugg

SEQ ID NO: 417563 - RNA, 20 nt, Bordetella pertussis
ugaccgcaugcugcagcugc

SEQ ID NO: 417564 - RNA, 18 nt, Bordetella pertussis
ugaccgccgccagcagcg

SEQ ID NO: 417565 - RNA, 14 nt, Bordetella pertussis
ugaccgccgcgccg

SEQ ID NO: 417566 - RNA, 23 nt, Bordetella pertussis
ugaccgccgcgccgguggccagc

SEQ ID NO: 417567 - RNA, 16 nt, Bordetella pertussis
ugaccgcguaggccuu

SEQ ID NO: 417568 - RNA, 14 nt, Bordetella pertussis
ugaccggccaggcg

SEQ ID NO: 417569 - RNA, 20 nt, Bordetella pertussis
ugaccggcuauaccgggcug

SEQ ID NO: 417570 - RNA, 15 nt, Bordetella pertussis
ugaccucgcccaggc

SEQ ID NO: 417571 - RNA, 16 nt, Bordetella pertussis
ugaccucgcccaggcc

SEQ ID NO: 417572 - RNA, 12 nt, Bordetella pertussis
ugaccucggccu

SEQ ID NO: 417573 - RNA, 17 nt, Bordetella pertussis
ugaccugcucgucgcca

SEQ ID NO: 417574 - RNA, 21 nt, Bordetella pertussis
ugacgaaacgcgcguccuugg

SEQ ID NO: 417575 - RNA, 17 nt, Bordetella pertussis
ugacugcggugccuguc

SEQ ID NO: 417576 - RNA, 22 nt, Bordetella pertussis
ugacugugcagccacgccuggc

SEQ ID NO: 417577 - RNA, 20 nt, Bordetella pertussis
ugagaaaagugaucaccgcc

SEQ ID NO: 417578 - RNA, 14 nt, Bordetella pertussis
ugagaaugcccagg

SEQ ID NO: 417579 - RNA, 19 nt, Bordetella pertussis
ugagacacggcaguaugac

SEQ ID NO: 417580 - RNA, 21 nt, Bordetella pertussis
ugagaugccagcggcgcagcc

SEQ ID NO: 417581 - RNA, 22 nt, Bordetella pertussis
ugagcaccacguccuggggcgc

SEQ ID NO: 417582 - RNA, 19 nt, Bordetella pertussis
ugagcaccagcagccccag

SEQ ID NO: 417583 - RNA, 14 nt, Bordetella pertussis
ugagcagcaccugg

SEQ ID NO: 417584 - RNA, 16 nt, Bordetella pertussis
ugagcagcaugugcuc

SEQ ID NO: 417585 - RNA, 16 nt, Bordetella pertussis
ugagcaggcgccugcc

SEQ ID NO: 417586 - RNA, 17 nt, Bordetella pertussis
ugagccaggcgcccggc

SEQ ID NO: 417587 - RNA, 14 nt, Bordetella pertussis
ugagcgccagcucg

SEQ ID NO: 417588 - RNA, 17 nt, Bordetella pertussis
ugagcgccgacgggccg

SEQ ID NO: 417589 - RNA, 21 nt, Bordetella pertussis
ugagcgccgccgccauggucg

SEQ ID NO: 417590 - RNA, 11 nt, Bordetella pertussis
ugagcgccggg

SEQ ID NO: 417591 - RNA, 13 nt, Bordetella pertussis
ugagcgccggggc

SEQ ID NO: 417592 - RNA, 23 nt, Bordetella pertussis
ugagcgccggggcguggccgcag

SEQ ID NO: 417593 - RNA, 22 nt, Bordetella pertussis
ugagcgcgccgccguaggacag

SEQ ID NO: 417594 - RNA, 17 nt, Bordetella pertussis
ugaggaugcgcgcggcc

SEQ ID NO: 417595 - RNA, 15 nt, Bordetella pertussis
ugaggaugugcagcg

SEQ ID NO: 417596 - RNA, 20 nt, Bordetella pertussis
ugaggauguucaugaccgcc

SEQ ID NO: 417597 - RNA, 15 nt, Bordetella pertussis
ugaggccagcacgcc

SEQ ID NO: 417598 - RNA, 14 nt, Bordetella pertussis
ugaguucuggcauc

SEQ ID NO: 417599 - RNA, 17 nt, Bordetella pertussis
ugaguuuggcgaaggcg

SEQ ID NO: 417600 - RNA, 13 nt, Bordetella pertussis
ugaucuugugcau

SEQ ID NO: 417601 - RNA, 12 nt, Bordetella pertussis
ugaugcagcacg

SEQ ID NO: 417602 - RNA, 21 nt, Bordetella pertussis
ugaugcccagcucauggcaca

SEQ ID NO: 417603 - RNA, 12 nt, Bordetella pertussis
ugaugcccagga

SEQ ID NO: 417604 - RNA, 20 nt, Bordetella pertussis
ugaugcccaugcgcugcgcc

SEQ ID NO: 417605 - RNA, 17 nt, Bordetella pertussis
ugaugcccuucggcaug

SEQ ID NO: 417606 - RNA, 15 nt, Bordetella pertussis
ugaugccgccgaacc

SEQ ID NO: 417607 - RNA, 13 nt, Bordetella pertussis
ugaugccuguccc

SEQ ID NO: 417608 - RNA, 16 nt, Bordetella pertussis
ugaugccugucccgca

SEQ ID NO: 417609 - RNA, 22 nt, Bordetella pertussis
ugaugccugucccgcacgcagc

SEQ ID NO: 417610 - RNA, 13 nt, Bordetella pertussis
ugaugcgcugggc

SEQ ID NO: 417611 - RNA, 19 nt, Bordetella pertussis
ugaugcugccgggcaugaa

SEQ ID NO: 417612 - RNA, 15 nt, Bordetella pertussis
ugauggaggccagga

SEQ ID NO: 417613 - RNA, 16 nt, Bordetella pertussis
ugauggaggccaggau

SEQ ID NO: 417614 - RNA, 12 nt, Bordetella pertussis
ugauggccaggu

SEQ ID NO: 417615 - RNA, 17 nt, Bordetella pertussis
ugauggccgcgcgcagc

SEQ ID NO: 417616 - RNA, 19 nt, Bordetella pertussis
ugauggccucggcggccuc

SEQ ID NO: 417617 - RNA, 14 nt, Bordetella pertussis
ugauggggccgggc

SEQ ID NO: 417618 - RNA, 16 nt, Bordetella pertussis
ugauggggccgggcgc

SEQ ID NO: 417619 - RNA, 14 nt, Bordetella pertussis
ugauguagcccaug

SEQ ID NO: 417620 - RNA, 19 nt, Bordetella pertussis
ugcacccaggcgccgaucc

SEQ ID NO: 417621 - RNA, 21 nt, Bordetella pertussis
ugcaccgaagcaucccagucg

SEQ ID NO: 417622 - RNA, 19 nt, Bordetella pertussis
ugcaccgcguggcgcugcg

SEQ ID NO: 417623 - RNA, 17 nt, Bordetella pertussis
ugcaccuugggcgccug

SEQ ID NO: 417624 - RNA, 22 nt, Bordetella pertussis
ugcacgauauuggcgucggccg

SEQ ID NO: 417625 - RNA, 21 nt, Bordetella pertussis
ugcacgaucuugauccaggaa

SEQ ID NO: 417626 - RNA, 18 nt, Bordetella pertussis
ugcacgaugcccagggcc

SEQ ID NO: 417627 - RNA, 19 nt, Bordetella pertussis
ugcacgaugcccagggccg

SEQ ID NO: 417628 - RNA, 15 nt, Bordetella pertussis
ugcacgcagcgcagg

SEQ ID NO: 417629 - RNA, 15 nt, Bordetella pertussis
ugcacgcccgcggcg

SEQ ID NO: 417630 - RNA, 22 nt, Bordetella pertussis
ugcacgcccgcggcgcccagcu

SEQ ID NO: 417631 - RNA, 16 nt, Bordetella pertussis
ugcacgcgcgcgggcg

SEQ ID NO: 417632 - RNA, 22 nt, Bordetella pertussis
ugcacgcucuugagcgcggccu

SEQ ID NO: 417633 - RNA, 23 nt, Bordetella pertussis
ugcacgcucuugagcgcggccuc

SEQ ID NO: 417634 - RNA, 16 nt, Bordetella pertussis
ugcacgggccauggau

SEQ ID NO: 417635 - RNA, 20 nt, Bordetella pertussis
ugcacgggcgcugcccagga

SEQ ID NO: 417636 - RNA, 16 nt, Bordetella pertussis
ugcacggccuugucgc

SEQ ID NO: 417637 - RNA, 18 nt, Bordetella pertussis
ugcacggugggcagcagc

SEQ ID NO: 417638 - RNA, 19 nt, Bordetella pertussis
ugcacggugggcagcagca

SEQ ID NO: 417639 - RNA, 18 nt, Bordetella pertussis
ugcagaaaccccagggga

SEQ ID NO: 417640 - RNA, 20 nt, Bordetella pertussis
ugcagaacagggugccgccc

SEQ ID NO: 417641 - RNA, 13 nt, Bordetella pertussis
ugcagcaggcgca

SEQ ID NO: 417642 - RNA, 22 nt, Bordetella pertussis
ugcagcaggcgcaccagcgcgc

SEQ ID NO: 417643 - RNA, 14 nt, Bordetella pertussis
ugcagcaggcuggg

SEQ ID NO: 417644 - RNA, 12 nt, Bordetella pertussis
ugcagcagguag

SEQ ID NO: 417645 - RNA, 12 nt, Bordetella pertussis
ugcagccagcgg

SEQ ID NO: 417646 - RNA, 14 nt, Bordetella pertussis
ugcagccagcggcc

SEQ ID NO: 417647 - RNA, 18 nt, Bordetella pertussis
ugcagccacgccuggccg

SEQ ID NO: 417648 - RNA, 21 nt, Bordetella pertussis
ugcagccacgccuggccgcgc

SEQ ID NO: 417649 - RNA, 12 nt, Bordetella pertussis
ugcagcgcacca

SEQ ID NO: 417650 - RNA, 16 nt, Bordetella pertussis
ugcagcgccucgggau

SEQ ID NO: 417651 - RNA, 14 nt, Bordetella pertussis
ugcagcgcgccagg

SEQ ID NO: 417652 - RNA, 17 nt, Bordetella pertussis
ugcagcuguagcccugg

SEQ ID NO: 417653 - RNA, 15 nt, Bordetella pertussis
ugcagcugcgccagc

SEQ ID NO: 417654 - RNA, 19 nt, Bordetella pertussis
ugcaggacgaacaggccgc

SEQ ID NO: 417655 - RNA, 18 nt, Bordetella pertussis
ugcaggaucgcggccagc

SEQ ID NO: 417656 - RNA, 21 nt, Bordetella pertussis
ugcaggauggcgucgaccgcc

SEQ ID NO: 417657 - RNA, 15 nt, Bordetella pertussis
ugcaggauggggcgg

SEQ ID NO: 417658 - RNA, 18 nt, Bordetella pertussis
ugcaggccaucgcggucg

SEQ ID NO: 417659 - RNA, 13 nt, Bordetella pertussis
ugcaggcccagca

SEQ ID NO: 417660 - RNA, 17 nt, Bordetella pertussis
ugcaggcccgacaggaa

SEQ ID NO: 417661 - RNA, 19 nt, Bordetella pertussis
ugcaggcccgacaggaaca

SEQ ID NO: 417662 - RNA, 18 nt, Bordetella pertussis
ugcaggccgccggccagc

SEQ ID NO: 417663 - RNA, 17 nt, Bordetella pertussis
ugcaggcgccagucccc

SEQ ID NO: 417664 - RNA, 17 nt, Bordetella pertussis
ugcaggccgggcagucc

SEQ ID NO: 417665 - RNA, 15 nt, Bordetella pertussis
ugcaggcgcugcgca

SEQ ID NO: 417666 - RNA, 12 nt, Bordetella pertussis
ugcaggcucuug

SEQ ID NO: 417667 - RNA, 23 nt, Bordetella pertussis
ugcaggcuggacccggagcugcc

SEQ ID NO: 417668 - RNA, 13 nt, Bordetella pertussis
ugcagggccaggu

SEQ ID NO: 417669 - RNA, 19 nt, Bordetella pertussis
ugcagggccuggaagcugg

SEQ ID NO: 417670 - RNA, 15 nt, Bordetella pertussis
ugcagggcugcgaug

SEQ ID NO: 417671 - RNA, 14 nt, Bordetella pertussis
ugcaggggccgcac

SEQ ID NO: 417672 - RNA, 19 nt, Bordetella pertussis
ugcaggggguggcggccgu

SEQ ID NO: 417673 - RNA, 18 nt, Bordetella pertussis
ugcagggugucggccagg

SEQ ID NO: 417674 - RNA, 16 nt, Bordetella pertussis
ugcaugaaccgcagcg

SEQ ID NO: 417675 - RNA, 21 nt, Bordetella pertussis
ugcaugaccgccgccagcagc

SEQ ID NO: 417676 - RNA, 22 nt, Bordetella pertussis
ugcaugaccgccgccagcagcg

SEQ ID NO: 417677 - RNA, 21 nt, Bordetella pertussis
ugcaugccgaccaccagcacc

SEQ ID NO: 417678 - RNA, 16 nt, Bordetella pertussis
ugcaugcgcacggaca

SEQ ID NO: 417679 - RNA, 18 nt, Bordetella pertussis
ugcauguacucggccagg

SEQ ID NO: 417680 - RNA, 14 nt, Bordetella pertussis
ugcauguaguucac

SEQ ID NO: 417681 - RNA, 16 nt, Bordetella pertussis
ugcauguccugcaggu

SEQ ID NO: 417682 - RNA, 21 nt, Bordetella pertussis
ugcauguguucgaagaggguu

SEQ ID NO: 417683 - RNA, 18 nt, Bordetella pertussis
ugccaagauggcccaggg

SEQ ID NO: 417684 - RNA, 23 nt, Bordetella pertussis
ugccaaggaucaccguucuuccg

SEQ ID NO: 417685 - RNA, 15 nt, Bordetella pertussis
ugccagcccccugcg

SEQ ID NO: 417686 - RNA, 22 nt, Bordetella pertussis
ugccagccgcuggcgaucaggc

SEQ ID NO: 417687 - RNA, 11 nt, Bordetella pertussis
ugccagccugu

SEQ ID NO: 417688 - RNA, 13 nt, Bordetella pertussis
ugccagcggcgca

SEQ ID NO: 417689 - RNA, 21 nt, Bordetella pertussis
ugccagcuggcccaguucggc

SEQ ID NO: 417690 - RNA, 13 nt, Bordetella pertussis
ugccaggcccggc

SEQ ID NO: 417691 - RNA, 14 nt, Bordetella pertussis
ugccaggcgcccca

SEQ ID NO: 417692 - RNA, 16 nt, Bordetella pertussis
ugccaggcgccgcguc

SEQ ID NO: 417693 - RNA, 21 nt, Bordetella pertussis
ugccagggccuggcacaucgg

SEQ ID NO: 417694 - RNA, 21 nt, Bordetella pertussis
ugccaggugaacaccucgaac

SEQ ID NO: 417695 - RNA, 17 nt, Bordetella pertussis
ugccaguaggcgcccca

SEQ ID NO: 417696 - RNA, 16 nt, Bordetella pertussis
ugccaguccccaugcg

SEQ ID NO: 417697 - RNA, 15 nt, Bordetella pertussis
ugccaguccccugcg

SEQ ID NO: 417698 - RNA, 21 nt, Bordetella pertussis
ugccaguccccugcggggaca

SEQ ID NO: 417699 - RNA, 14 nt, Bordetella pertussis
ugccagucuccagg

SEQ ID NO: 417700 - RNA, 17 nt, Bordetella pertussis
ugccagucuccaggcuc

SEQ ID NO: 417701 - RNA, 18 nt, Bordetella pertussis
ugccauaggccagcgccu

SEQ ID NO: 417702 - RNA, 19 nt, Bordetella pertussis
ugccauaggccagcgccuu

SEQ ID NO: 417703 - RNA, 15 nt, Bordetella pertussis
ugccauccagccagg

SEQ ID NO: 417704 - RNA, 16 nt, Bordetella pertussis
ugccauccagccaggc

SEQ ID NO: 417705 - RNA, 17 nt, Bordetella pertussis
ugccauccagccaggcc

SEQ ID NO: 417706 - RNA, 20 nt, Bordetella pertussis
ugccauccagccaggccgca

SEQ ID NO: 417707 - RNA, 19 nt, Bordetella pertussis
ugccaugccccauccagcg

SEQ ID NO: 417708 - RNA, 18 nt, Bordetella pertussis
ugccaugccgcgcgccuu

SEQ ID NO: 417709 - RNA, 16 nt, Bordetella pertussis
ugccauuccagcuccg

SEQ ID NO: 417710 - RNA, 15 nt, Bordetella pertussis
ugccauuggucugug

SEQ ID NO: 417711 - RNA, 22 nt, Bordetella pertussis
ugcccaccgacaugaccgcguc

SEQ ID NO: 417712 - RNA, 18 nt, Bordetella pertussis
ugcccaccgccguggccg

SEQ ID NO: 417713 - RNA, 15 nt, Bordetella pertussis
ugcccaccuuccugc

SEQ ID NO: 417714 - RNA, 17 nt, Bordetella pertussis
ugcccaccuuccugcug

SEQ ID NO: 417715 - RNA, 15 nt, Bordetella pertussis
ugcccacgcgcuccu

SEQ ID NO: 417716 - RNA, 20 nt, Bordetella pertussis
ugcccacucccguaagcagg

SEQ ID NO: 417717 - RNA, 12 nt, Bordetella pertussis
ugcccagcacca

SEQ ID NO: 417718 - RNA, 16 nt, Bordetella pertussis
ugcccagcaccacggg

SEQ ID NO: 417719 - RNA, 14 nt, Bordetella pertussis
ugcccagcagcucc

SEQ ID NO: 417720 - RNA, 21 nt, Bordetella pertussis
ugcccagcgagaucagcaccg

SEQ ID NO: 417721 - RNA, 17 nt, Bordetella pertussis
ugcccagcgagcggggc

SEQ ID NO: 417722 - RNA, 16 nt, Bordetella pertussis
ugcccagcgccagggc

SEQ ID NO: 417723 - RNA, 17 nt, Bordetella pertussis
ugcccagcgccagggcc

SEQ ID NO: 417724 - RNA, 19 nt, Bordetella pertussis
ugcccagcgccgccgacgg

SEQ ID NO: 417725 - RNA, 21 nt, Bordetella pertussis
ugcccagcguguaggcggccg

SEQ ID NO: 417726 - RNA, 19 nt, Bordetella pertussis
ugcccaggaugcccuuggc

SEQ ID NO: 417727 - RNA, 16 nt, Bordetella pertussis
ugcccaggccagcgcc

SEQ ID NO: 417728 - RNA, 17 nt, Bordetella pertussis
ugcccaggccagcgccg

SEQ ID NO: 417729 - RNA, 23 nt, Bordetella pertussis
ugcccaggcccgccagggccaug

SEQ ID NO: 417730 - RNA, 17 nt, Bordetella pertussis
ugcccaggcccuggcug

SEQ ID NO: 417731 - RNA, 20 nt, Bordetella pertussis
ugcccaguucgcggccggcc

SEQ ID NO: 417732 - RNA, 21 nt, Bordetella pertussis
ugcccaucaggccgaugcguc

SEQ ID NO: 417733 - RNA, 15 nt, Bordetella pertussis
ugcccaugcgcugcg

SEQ ID NO: 417734 - RNA, 21 nt, Bordetella pertussis
ugcccauggggugcuccugcc

SEQ ID NO: 417735 - RNA, 18 nt, Bordetella pertussis
ugccccaacggcgcaccg

SEQ ID NO: 417736 - RNA, 20 nt, Bordetella pertussis
ugccccaacggcgcaccguc

SEQ ID NO: 417737 - RNA, 22 nt, Bordetella pertussis
ugccccacggguaccaggcucc

SEQ ID NO: 417738 - RNA, 12 nt, Bordetella pertussis
ugccccagcacg

SEQ ID NO: 417739 - RNA, 14 nt, Bordetella pertussis
ugccccaguccagg

SEQ ID NO: 417740 - RNA, 15 nt, Bordetella pertussis
ugccccauccagcgg

SEQ ID NO: 417741 - RNA, 19 nt, Bordetella pertussis
ugccccauggcaugcaccg

SEQ ID NO: 417742 - RNA, 13 nt, Bordetella pertussis
ugccccccgaggg

SEQ ID NO: 417743 - RNA, 19 nt, Bordetella pertussis
ugccccccgagggggcuuu

SEQ ID NO: 417744 - RNA, 23 nt, Bordetella pertussis
ugccccgauccgcgggcgggccg

SEQ ID NO: 417745 - RNA, 15 nt, Bordetella pertussis
ugccccuccgggucg

SEQ ID NO: 417746 - RNA, 22 nt, Bordetella pertussis
ugccccuccgggucgcggcacg

SEQ ID NO: 417747 - RNA, 15 nt, Bordetella pertussis
ugccccugcggggac

SEQ ID NO: 417748 - RNA, 16 nt, Bordetella pertussis
ugccccugcggggaca

SEQ ID NO: 417749 - RNA, 22 nt, Bordetella pertussis
ugccccugcggggacaggcacc

SEQ ID NO: 417750 - RNA, 21 nt, Bordetella pertussis
ugccccuugcccaacgcggcg

SEQ ID NO: 417751 - RNA, 16 nt, Bordetella pertussis
ugcccgaagcgcagca

SEQ ID NO: 417752 - RNA, 20 nt, Bordetella pertussis
ugcccgaagcgcagcaccag

SEQ ID NO: 417753 - RNA, 19 nt, Bordetella pertussis
ugcccgacggcgccgaucc

SEQ ID NO: 417754 - RNA, 21 nt, Bordetella pertussis
ugcccgagcgcgacagcacca

SEQ ID NO: 417755 - RNA, 22 nt, Bordetella pertussis
ugcccgagcgcgacagcaccaa

SEQ ID NO: 417756 - RNA, 14 nt, Bordetella pertussis
ugcccgaggcggcg

SEQ ID NO: 417757 - RNA, 17 nt, Bordetella pertussis
ugcccgcaacgccgccc

SEQ ID NO: 417758 - RNA, 20 nt, Bordetella pertussis
ugcccgccccgugcaccaug

SEQ ID NO: 417759 - RNA, 20 nt, Bordetella pertussis
ugcccgccgccgcccacgcc

SEQ ID NO: 417760 - RNA, 22 nt, Bordetella pertussis
ugcccgcgcaccaggcgcggcg

SEQ ID NO: 417761 - RNA, 15 nt, Bordetella pertussis
ugcccgcuggccaug

SEQ ID NO: 417762 - RNA, 14 nt, Bordetella pertussis
ugcccggcgggccg

SEQ ID NO: 417763 - RNA, 19 nt, Bordetella pertussis
ugcccgggcaccagguccu

SEQ ID NO: 417764 - RNA, 15 nt, Bordetella pertussis
ugcccgggcuggccg

SEQ ID NO: 417765 - RNA, 18 nt, Bordetella pertussis
ugcccguacgucaaggcc

SEQ ID NO: 417766 - RNA, 14 nt, Bordetella pertussis
ugcccgucagggua

SEQ ID NO: 417767 - RNA, 20 nt, Bordetella pertussis
ugcccgugccuugccggccg

SEQ ID NO: 417768 - RNA, 18 nt, Bordetella pertussis
ugcccguugccgcgcgcg

SEQ ID NO: 417769 - RNA, 15 nt, Bordetella pertussis
ugcccuccucggcca

SEQ ID NO: 417770 - RNA, 19 nt, Bordetella pertussis
ugcccucgggcgacaggcg

SEQ ID NO: 417771 - RNA, 22 nt, Bordetella pertussis
ugcccugcggcuugggcccggc

SEQ ID NO: 417772 - RNA, 16 nt, Bordetella pertussis
ugcccuggauggccug

SEQ ID NO: 417773 - RNA, 13 nt, Bordetella pertussis
ugcccuggccacg

SEQ ID NO: 417774 - RNA, 14 nt, Bordetella pertussis
ugcccuucgcggcu

SEQ ID NO: 417775 - RNA, 18 nt, Bordetella pertussis
ugcccuucggcaugcugc

SEQ ID NO: 417776 - RNA, 17 nt, Bordetella pertussis
ugcccuugagcgugggc

SEQ ID NO: 417777 - RNA, 17 nt, Bordetella pertussis
ugcccuuugcagccaga

SEQ ID NO: 417778 - RNA, 13 nt, Bordetella pertussis
ugccgaacagcau

SEQ ID NO: 417779 - RNA, 14 nt, Bordetella pertussis
ugccgaacagcaug

SEQ ID NO: 417780 - RNA, 18 nt, Bordetella pertussis
ugccgaacagccagggca

SEQ ID NO: 417781 - RNA, 18 nt, Bordetella pertussis
ugccgaacugucgcgcca

SEQ ID NO: 417782 - RNA, 15 nt, Bordetella pertussis
ugccgaagcgcgcgu

SEQ ID NO: 417783 - RNA, 21 nt, Bordetella pertussis
ugccgaccaggcugcgcgccg

SEQ ID NO: 417784 - RNA, 20 nt, Bordetella pertussis
ugccgauccagcgccugggg

SEQ ID NO: 417785 - RNA, 16 nt, Bordetella pertussis
ugccgauugugcauga

SEQ ID NO: 417786 - RNA, 23 nt, Bordetella pertussis
ugccgcaaccgucgaccggcccg

SEQ ID NO: 417787 - RNA, 23 nt, Bordetella pertussis
ugccgcacgaucgcgccggccug

SEQ ID NO: 417788 - RNA, 22 nt, Bordetella pertussis
ugccgcacgguggcgccgucgc

SEQ ID NO: 417789 - RNA, 19 nt, Bordetella pertussis
ugccgcagaugucaguccu

SEQ ID NO: 417790 - RNA, 12 nt, Bordetella pertussis
ugccgcagcacc

SEQ ID NO: 417791 - RNA, 13 nt, Bordetella pertussis
ugccgcagcacca

SEQ ID NO: 417792 - RNA, 15 nt, Bordetella pertussis
ugccgcagcggggac

SEQ ID NO: 417793 - RNA, 22 nt, Bordetella pertussis
ugccgcagcggggacaggcgcc

SEQ ID NO: 417794 - RNA, 23 nt, Bordetella pertussis
ugccgcagcggggacaggcgccc

SEQ ID NO: 417795 - RNA, 14 nt, Bordetella pertussis
ugccgcaggccagc

SEQ ID NO: 417796 - RNA, 17 nt, Bordetella pertussis
ugccgcaguugaacacg

SEQ ID NO: 417797 - RNA, 15 nt, Bordetella pertussis
ugccgcaucccgccc

SEQ ID NO: 417798 - RNA, 16 nt, Bordetella pertussis
ugccgccaacgcggcg

SEQ ID NO: 417799 - RNA, 19 nt, Bordetella pertussis
ugccgccaacgcggcgcgu

SEQ ID NO: 417800 - RNA, 17 nt, Bordetella pertussis
ugccgccaugcgccagc

SEQ ID NO: 417801 - RNA, 22 nt, Bordetella pertussis
ugccgccaugcgccagcaggau

SEQ ID NO: 417802 - RNA, 20 nt, Bordetella pertussis
ugccgcccaccgugaccagc

SEQ ID NO: 417803 - RNA, 17 nt, Bordetella pertussis
ugccgcccacugccagg

SEQ ID NO: 417804 - RNA, 19 nt, Bordetella pertussis
ugccgcccacugccaggcg

SEQ ID NO: 417805 - RNA, 13 nt, Bordetella pertussis
ugccgcccacgcc

SEQ ID NO: 417806 - RNA, 23 nt, Bordetella pertussis
ugccgcccagcaugcgcgcgacu

SEQ ID NO: 417807 - RNA, 21 nt, Bordetella pertussis
ugccgcccgcaugcagguccu

SEQ ID NO: 417808 - RNA, 18 nt, Bordetella pertussis
ugccgccgcccgacagca

SEQ ID NO: 417809 - RNA, 16 nt, Bordetella pertussis
ugccgccgcgcagccg

SEQ ID NO: 417810 - RNA, 23 nt, Bordetella pertussis
ugccgccggcgcggcugcugggc

SEQ ID NO: 417811 - RNA, 22 nt, Bordetella pertussis
ugccgccgggcaugcaccaggc

SEQ ID NO: 417812 - RNA, 16 nt, Bordetella pertussis
ugccgccgugaugccg

SEQ ID NO: 417813 - RNA, 19 nt, Bordetella pertussis
ugccgccgugaugccgccc

SEQ ID NO: 417814 - RNA, 23 nt, Bordetella pertussis
ugccgccgugcuucucguagaac

SEQ ID NO: 417815 - RNA, 13 nt, Bordetella pertussis
ugccgccuggcca

SEQ ID NO: 417816 - RNA, 19 nt, Bordetella pertussis
ugccgccuucgccgugguc

SEQ ID NO: 417817 - RNA, 14 nt, Bordetella pertussis
ugccgcgaggcgca

SEQ ID NO: 417818 - RNA, 17 nt, Bordetella pertussis
ugccgcgcacccaggcc

SEQ ID NO: 417819 - RNA, 21 nt, Bordetella pertussis
ugccgcgcccggcggccaggc

SEQ ID NO: 417820 - RNA, 12 nt, Bordetella pertussis
ugccgcgcgcgu

SEQ ID NO: 417821 - RNA, 12 nt, Bordetella pertussis
ugccgcgcggcg

SEQ ID NO: 417822 - RNA, 15 nt, Bordetella pertussis
ugccgcgcggcgcgu

SEQ ID NO: 417823 - RNA, 18 nt, Bordetella pertussis
ugccgcgcgguggggcgc

SEQ ID NO: 417824 - RNA, 22 nt, Bordetella pertussis
ugccgcggauugccguccuggc

SEQ ID NO: 417825 - RNA, 23 nt, Bordetella pertussis
ugccgcggcaaauggggcggccg

SEQ ID NO: 417826 - RNA, 20 nt, Bordetella pertussis
ugccgcggcaugcugguugg

SEQ ID NO: 417827 - RNA, 16 nt, Bordetella pertussis
ugccgcggcgcggccc

SEQ ID NO: 417828 - RNA, 20 nt, Bordetella pertussis
ugccgcggcgcggcccgcca

SEQ ID NO: 417829 - RNA, 20 nt, Bordetella pertussis
ugccgcgggcggcgccggcc

SEQ ID NO: 417830 - RNA, 18 nt, Bordetella pertussis
ugccgcucaauucggccu

SEQ ID NO: 417831 - RNA, 15 nt, Bordetella pertussis
ugccgcugcaggccc

SEQ ID NO: 417832 - RNA, 23 nt, Bordetella pertussis
ugccgcugcccagcgucagcugg

SEQ ID NO: 417833 - RNA, 21 nt, Bordetella pertussis
ugccgcuggugaucugcugcg

SEQ ID NO: 417834 - RNA, 20 nt, Bordetella pertussis
ugccgcuggcggcccugccg

SEQ ID NO: 417835 - RNA, 18 nt, Bordetella pertussis
ugccgcuguggcgcgcca

SEQ ID NO: 417836 - RNA, 21 nt, Bordetella pertussis
ugccggacgccgacugggugc

SEQ ID NO: 417837 - RNA, 16 nt, Bordetella pertussis
ugccggagcagcagcg

SEQ ID NO: 417838 - RNA, 21 nt, Bordetella pertussis
ugccggagcagcagcgggcuu

SEQ ID NO: 417839 - RNA, 13 nt, Bordetella pertussis
ugccggcagcagg

SEQ ID NO: 417840 - RNA, 20 nt, Bordetella pertussis
ugccggcggccuaugugcag

SEQ ID NO: 417841 - RNA, 18 nt, Bordetella pertussis
ugccguaggcgccggccu

SEQ ID NO: 417842 - RNA, 13 nt, Bordetella pertussis
ugccgucacgcgu

SEQ ID NO: 417843 - RNA, 21 nt, Bordetella pertussis
ugccguggacgugcgcgaccg

SEQ ID NO: 417844 - RNA, 16 nt, Bordetella pertussis
ugccguuauauauaga

SEQ ID NO: 417845 - RNA, 14 nt, Bordetella pertussis
ugccuauuggcugu

SEQ ID NO: 417846 - RNA, 19 nt, Bordetella pertussis
ugccucaacuggccggccu

SEQ ID NO: 417847 - RNA, 19 nt, Bordetella pertussis
ugccugcgaacgcccggcc

SEQ ID NO: 417848 - RNA, 17 nt, Bordetella pertussis
ugccuggacgcgcuggc

SEQ ID NO: 417849 - RNA, 16 nt, Bordetella pertussis
ugccugggugcuggug

SEQ ID NO: 417850 - RNA, 17 nt, Bordetella pertussis
ugccugggugcuggugc

SEQ ID NO: 417851 - RNA, 13 nt, Bordetella pertussis
ugcgacagcagca

SEQ ID NO: 417852 - RNA, 14 nt, Bordetella pertussis
ugcgacagcagcau

SEQ ID NO: 417853 - RNA, 17 nt, Bordetella pertussis
ugcgacagcgacagcca

SEQ ID NO: 417854 - RNA, 20 nt, Bordetella pertussis
ugcgacagcgacagccaggc

SEQ ID NO: 417855 - RNA, 13 nt, Bordetella pertussis
ugcgacaggcgca

SEQ ID NO: 417856 - RNA, 15 nt, Bordetella pertussis
ugcgacaugagcugc

SEQ ID NO: 417857 - RNA, 19 nt, Bordetella pertussis
ugcgacgauccggcgaccg

SEQ ID NO: 417858 - RNA, 13 nt, Bordetella pertussis
ugcgacugcagga

SEQ ID NO: 417859 - RNA, 19 nt, Bordetella pertussis
ugcgagagauagcccagca

SEQ ID NO: 417860 - RNA, 21 nt, Bordetella pertussis
ugcgagagauagcccagcacc

SEQ ID NO: 417861 - RNA, 22 nt, Bordetella pertussis
ugcgagagauagcccagcaccu

SEQ ID NO: 417862 - RNA, 20 nt, Bordetella pertussis
ugcgagcagaugcaccggcc

SEQ ID NO: 417863 - RNA, 15 nt, Bordetella pertussis
ugcgcaacgcgcgcg

SEQ ID NO: 417864 - RNA, 14 nt, Bordetella pertussis
ugcgcaagccgccc

SEQ ID NO: 417865 - RNA, 21 nt, Bordetella pertussis
ugcgcacgggcgagggcugcc

SEQ ID NO: 417866 - RNA, 23 nt, Bordetella pertussis
ugcgcagcagcgcgguggccagc

SEQ ID NO: 417867 - RNA, 15 nt, Bordetella pertussis
ugcgcagccgggcug

SEQ ID NO: 417868 - RNA, 12 nt, Bordetella pertussis
ugcgcagcgcgg

SEQ ID NO: 417869 - RNA, 19 nt, Bordetella pertussis
ugcgcaggcgcgcgggggu

SEQ ID NO: 417870 - RNA, 13 nt, Bordetella pertussis
ugcgcagggcggg

SEQ ID NO: 417871 - RNA, 22 nt, Bordetella pertussis
ugcgcagggcgggcggugcggc

SEQ ID NO: 417872 - RNA, 15 nt, Bordetella pertussis
ugcgcaguggcgagg

SEQ ID NO: 417873 - RNA, 21 nt, Bordetella pertussis
ugcgcaucgaucagcgcgccg

SEQ ID NO: 417874 - RNA, 19 nt, Bordetella pertussis
ugcgcaucgcgaccgccaa

SEQ ID NO: 417875 - RNA, 19 nt, Bordetella pertussis
ugcgcaugggcgcaggccg

SEQ ID NO: 417876 - RNA, 11 nt, Bordetella pertussis
ugcgcccaugg

SEQ ID NO: 417877 - RNA, 20 nt, Bordetella pertussis
ugcgccccgcuggccgucgc

SEQ ID NO: 417878 - RNA, 15 nt, Bordetella pertussis
aaauggaugcgcgcc

SEQ ID NO: 417879 - RNA, 23 nt, Bordetella pertussis
aaauggggcggccgggagccugu

SEQ ID NO: 417880 - RNA, 21 nt, Bordetella pertussis
ugcgccguccgugagugcagc

SEQ ID NO: 417881 - RNA, 17 nt, Bordetella pertussis
ugcgccguccucaggcc

SEQ ID NO: 417882 - RNA, 12 nt, Bordetella pertussis
ugcgccuggccg

SEQ ID NO: 417883 - RNA, 16 nt, Bordetella pertussis
ugcgccuggcugaggu

SEQ ID NO: 417884 - RNA, 14 nt, Bordetella pertussis
ugcgccugcugguc

SEQ ID NO: 417885 - RNA, 16 nt, Bordetella pertussis
ugcgccuuacuuguac

SEQ ID NO: 417886 - RNA, 23 nt, Bordetella pertussis
ugcgcgaagcggaaacgcgcgcg

SEQ ID NO: 417887 - RNA, 16 nt, Bordetella pertussis
ugcgcgaaggccgccc

SEQ ID NO: 417888 - RNA, 16 nt, Bordetella pertussis
ugcgcgacagcaggcc

SEQ ID NO: 417889 - RNA, 16 nt, Bordetella pertussis
ugcgcgaggugccgga

SEQ ID NO: 417890 - RNA, 21 nt, Bordetella pertussis
ugcgcgaugagcuggcgcagg

SEQ ID NO: 417891 - RNA, 13 nt, Bordetella pertussis
ugcgcgcagggcg

SEQ ID NO: 417892 - RNA, 16 nt, Bordetella pertussis
ugcgcgcagggcggcc

SEQ ID NO: 417893 - RNA, 24 nt, Bordetella pertussis
ugcgcgccaaaaggcagcaggcug

SEQ ID NO: 417894 - RNA, 13 nt, Bordetella pertussis
ugcgcgccacgac

SEQ ID NO: 417895 - RNA, 23 nt, Bordetella pertussis
ugcgcgccagcucgcgcagcagg

SEQ ID NO: 417896 - RNA, 12 nt, Bordetella pertussis
ugcgcgccgacc

SEQ ID NO: 417897 - RNA, 23 nt, Bordetella pertussis
ugcgcgccgccggugcaccaggc

SEQ ID NO: 417898 - RNA, 15 nt, Bordetella pertussis
ugcgcgccgcucuug

SEQ ID NO: 417899 - RNA, 23 nt, Bordetella pertussis
ugcgcgccggcgccuuggccugg

SEQ ID NO: 417900 - RNA, 23 nt, Bordetella pertussis
ugcgcgccguacagccgcggcag

SEQ ID NO: 417901 - RNA, 19 nt, Bordetella pertussis
ugcgcgcgagcggcggccg

SEQ ID NO: 417902 - RNA, 13 nt, Bordetella pertussis
ugcgcgcgcagcc

SEQ ID NO: 417903 - RNA, 13 nt, Bordetella pertussis
ugcgcggccaccc

SEQ ID NO: 417904 - RNA, 17 nt, Bordetella pertussis
ugcgcggccacccugcc

SEQ ID NO: 417905 - RNA, 16 nt, Bordetella pertussis
ugcgcggccagcaccg

SEQ ID NO: 417906 - RNA, 21 nt, Bordetella pertussis
ugcgcggccgagcgggccagc

SEQ ID NO: 417907 - RNA, 19 nt, Bordetella pertussis
ugcgcggcgagcgccgcca

SEQ ID NO: 417908 - RNA, 23 nt, Bordetella pertussis
ugcgcggcgagcgccgccaggcc

SEQ ID NO: 417909 - RNA, 18 nt, Bordetella pertussis
ugcgcggcgcucagagcc

SEQ ID NO: 417910 - RNA, 21 nt, Bordetella pertussis
ugcgcggcgcucagagcccca

SEQ ID NO: 417911 - RNA, 18 nt, Bordetella pertussis
ugcgcggcggugccgccc

SEQ ID NO: 417912 - RNA, 19 nt, Bordetella pertussis
ugcgcggcguguagagcug

SEQ ID NO: 417913 - RNA, 16 nt, Bordetella pertussis
ugcgcgggcgcgggcu

SEQ ID NO: 417914 - RNA, 15 nt, Bordetella pertussis
ugcgcggggccaggc

SEQ ID NO: 417915 - RNA, 19 nt, Bordetella pertussis
ugcgcggucacaucugucc

SEQ ID NO: 417916 - RNA, 21 nt, Bordetella pertussis
ugcgcguacguggcgcggcug

SEQ ID NO: 417917 - RNA, 15 nt, Bordetella pertussis
ugcgcguaguccgag

SEQ ID NO: 417918 - RNA, 15 nt, Bordetella pertussis
ugcgcgucuccagcg

SEQ ID NO: 417919 - RNA, 17 nt, Bordetella pertussis
ugcgcgucuccagcgcc

SEQ ID NO: 417920 - RNA, 15 nt, Bordetella pertussis
ugcgcgugcgcaggu

SEQ ID NO: 417921 - RNA, 20 nt, Bordetella pertussis
ugcgcgugggcacccggccg

SEQ ID NO: 417922 - RNA, 15 nt, Bordetella pertussis
ugcgcguuccggccg

SEQ ID NO: 417923 - RNA, 15 nt, Bordetella pertussis
ugcgcguugagcagc

SEQ ID NO: 417924 - RNA, 18 nt, Bordetella pertussis
ugcgcugcuggaggccgg

SEQ ID NO: 417925 - RNA, 22 nt, Bordetella pertussis
ugcggacccaguucggccgcca

SEQ ID NO: 417926 - RNA, 14 nt, Bordetella pertussis
ugcggacgccagcc

SEQ ID NO: 417927 - RNA, 15 nt, Bordetella pertussis
ugcggacgcgugugc

SEQ ID NO: 417928 - RNA, 15 nt, Bordetella pertussis
ugcggaggcggccgc

SEQ ID NO: 417929 - RNA, 12 nt, Bordetella pertussis
ugcggcccagcc

SEQ ID NO: 417930 - RNA, 14 nt, Bordetella pertussis
ugcggccgccaccc

SEQ ID NO: 417931 - RNA, 21 nt, Bordetella pertussis
ugcggccgcgcaccugcugcg

SEQ ID NO: 417932 - RNA, 17 nt, Bordetella pertussis
ugcggccgucgccgccc

SEQ ID NO: 417933 - RNA, 17 nt, Bordetella pertussis
ugcggccgugcgccagc

SEQ ID NO: 417934 - RNA, 19 nt, Bordetella pertussis
ugcggccgugcgccagcgc

SEQ ID NO: 417935 - RNA, 20 nt, Bordetella pertussis
ugcggccgugcgccagcgcc

SEQ ID NO: 417936 - RNA, 17 nt, Bordetella pertussis
ugcggccguugcuccag

SEQ ID NO: 417937 - RNA, 23 nt, Bordetella pertussis
ugcggccguugcuccagccaggc

SEQ ID NO: 417938 - RNA, 17 nt, Bordetella pertussis
ugcgggcaucgcccugc

SEQ ID NO: 417939 - RNA, 12 nt, Bordetella pertussis
ugcgggccgcgc

SEQ ID NO: 417940 - RNA, 14 nt, Bordetella pertussis
ugcgggccgggcag

SEQ ID NO: 417941 - RNA, 18 nt, Bordetella pertussis
ugcgggccgggcaggccg

SEQ ID NO: 417942 - RNA, 14 nt, Bordetella pertussis
ugcgggccuggauc

SEQ ID NO: 417943 - RNA, 23 nt, Bordetella pertussis
ugcgggccuacuucggcagcuug

SEQ ID NO: 417944 - RNA, 22 nt, Bordetella pertussis
ugcgggcggccugggaggcgcu

SEQ ID NO: 417945 - RNA, 17 nt, Bordetella pertussis
ugcgggcuugcugcccc

SEQ ID NO: 417946 - RNA, 18 nt, Bordetella pertussis
ugcgggcuugcugccccc

SEQ ID NO: 417947 - RNA, 14 nt, Bordetella pertussis
ugcggggacaggca

SEQ ID NO: 417948 - RNA, 15 nt, Bordetella pertussis
ugcggggacaggcac

SEQ ID NO: 417949 - RNA, 21 nt, Bordetella pertussis
ugcggggacaggcacccugcc

SEQ ID NO: 417950 - RNA, 16 nt, Bordetella pertussis
ugcggggcgcccagcg

SEQ ID NO: 417951 - RNA, 20 nt, Bordetella pertussis
ugcgggugggcgcgccgcga

SEQ ID NO: 417952 - RNA, 18 nt, Bordetella pertussis
ugcggguguugucaugcg

SEQ ID NO: 417953 - RNA, 15 nt, Bordetella pertussis
ugcggguuggcaguc

SEQ ID NO: 417954 - RNA, 19 nt, Bordetella pertussis
ugcgguacugcggcgccug

SEQ ID NO: 417955 - RNA, 16 nt, Bordetella pertussis
ugcgguaggcccagca

SEQ ID NO: 417956 - RNA, 21 nt, Bordetella pertussis
ugcguaucugaucggacuggg

SEQ ID NO: 417957 - RNA, 15 nt, Bordetella pertussis
ugcguucggccagcc

SEQ ID NO: 417958 - RNA, 15 nt, Bordetella pertussis
uggcaaagcgcgcgu

SEQ ID NO: 417959 - RNA, 20 nt, Bordetella pertussis
uggcacagcgcggcgaaggc

SEQ ID NO: 417960 - RNA, 21 nt, Bordetella pertussis
uggcacaggccaucggcgcca

SEQ ID NO: 417961 - RNA, 22 nt, Bordetella pertussis
uggcacccgccaauugcuugcc

SEQ ID NO: 417962 - RNA, 11 nt, Bordetella pertussis
uggcagccuug

SEQ ID NO: 417963 - RNA, 15 nt, Bordetella pertussis
uggcagcuggcgcgg

SEQ ID NO: 417964 - RNA, 18 nt, Bordetella pertussis
uggcagcuggcgcgggcg

SEQ ID NO: 417965 - RNA, 14 nt, Bordetella pertussis
uggcaggaggcggc

SEQ ID NO: 417966 - RNA, 13 nt, Bordetella pertussis
uggcaggccgcuu

SEQ ID NO: 417967 - RNA, 17 nt, Bordetella pertussis
uggccagccaggcggug

SEQ ID NO: 417968 - RNA, 22 nt, Bordetella pertussis
uggccagcgcgacggccucguc

SEQ ID NO: 417969 - RNA, 13 nt, Bordetella pertussis
uggccagcggggc

SEQ ID NO: 417970 - RNA, 17 nt, Bordetella pertussis
uggccagcuccagguag

SEQ ID NO: 417971 - RNA, 18 nt, Bordetella pertussis
uggccagcuggcggcgca

SEQ ID NO: 417972 - RNA, 23 nt, Bordetella pertussis
uggccagcuggcggcgcagcacc

SEQ ID NO: 417973 - RNA, 19 nt, Bordetella pertussis
uggccaucaagaaggucga

SEQ ID NO: 417974 - RNA, 18 nt, Bordetella pertussis
uggccaugcaccagcaca

SEQ ID NO: 417975 - RNA, 12 nt, Bordetella pertussis
uggccaugcugg

SEQ ID NO: 417976 - RNA, 13 nt, Bordetella pertussis
uggccaugcuggg

SEQ ID NO: 417977 - RNA, 14 nt, Bordetella pertussis
uggccaugcugggc

SEQ ID NO: 417978 - RNA, 16 nt, Bordetella pertussis
uggccaugcugggcgg

SEQ ID NO: 417979 - RNA, 21 nt, Bordetella pertussis
uggccgagcgcggcaugcgca

SEQ ID NO: 417980 - RNA, 18 nt, Bordetella pertussis
uggccgauacgcgugcgc

SEQ ID NO: 417981 - RNA, 23 nt, Bordetella pertussis
uggccgauacgcgugcgcggccg

SEQ ID NO: 417982 - RNA, 14 nt, Bordetella pertussis
uggccgaucugcug

SEQ ID NO: 417983 - RNA, 17 nt, Bordetella pertussis
uggccgaucugcugggc

SEQ ID NO: 417984 - RNA, 20 nt, Bordetella pertussis
uggccgaucugcugggccgg

SEQ ID NO: 417985 - RNA, 23 nt, Bordetella pertussis
uggccgauggccucgcugccagg

SEQ ID NO: 417986 - RNA, 19 nt, Bordetella pertussis
uggccgccacacgaggacc

SEQ ID NO: 417987 - RNA, 14 nt, Bordetella pertussis
uggccgccaccagc

SEQ ID NO: 417988 - RNA, 18 nt, Bordetella pertussis
uggccgccaccagcgcgu

SEQ ID NO: 417989 - RNA, 23 nt, Bordetella pertussis
uggccgccagcguaucgccgccg

SEQ ID NO: 417990 - RNA, 11 nt, Bordetella pertussis
uggccgcccag

SEQ ID NO: 417991 - RNA, 16 nt, Bordetella pertussis
uggccgcccagcgccu

SEQ ID NO: 417992 - RNA, 16 nt, Bordetella pertussis
uggccgcccgcggccu

SEQ ID NO: 417993 - RNA, 14 nt, Bordetella pertussis
uggccgcccuggcg

SEQ ID NO: 417994 - RNA, 19 nt, Bordetella pertussis
uggccgccgaacggcagca

SEQ ID NO: 417995 - RNA, 10 nt, Bordetella pertussis
uggccgccgc

SEQ ID NO: 417996 - RNA, 19 nt, Bordetella pertussis
uggccgccauggcgcuggc

SEQ ID NO: 417997 - RNA, 12 nt, Bordetella pertussis
uggccgccgcca

SEQ ID NO: 417998 - RNA, 20 nt, Bordetella pertussis
uggccgccgcgcucaccgag

SEQ ID NO: 417999 - RNA, 15 nt, Bordetella pertussis
uggccgccgcggccu

SEQ ID NO: 418000 - RNA, 16 nt, Bordetella pertussis
uggccgccgcggccuc

SEQ ID NO: 418001 - RNA, 13 nt, Bordetella pertussis
uggccgccugcug

SEQ ID NO: 418002 - RNA, 15 nt, Bordetella pertussis
uggccgcgcaaggcc

SEQ ID NO: 418003 - RNA, 18 nt, Bordetella pertussis
uggccgcgcccagcgcgg

SEQ ID NO: 418004 - RNA, 21 nt, Bordetella pertussis
uggccgcgcccagcgcggccu

SEQ ID NO: 418005 - RNA, 20 nt, Bordetella pertussis
uggccgcgccgcuggcggcc

SEQ ID NO: 418006 - RNA, 12 nt, Bordetella pertussis
uggccgcgcgcc

SEQ ID NO: 418007 - RNA, 19 nt, Bordetella pertussis
uggccgcgcgccggcgccg

SEQ ID NO: 418008 - RNA, 23 nt, Bordetella pertussis
uggccgcgcggcgccugccugcc

SEQ ID NO: 418009 - RNA, 20 nt, Bordetella pertussis
uggccgcgcucagccuuguc

SEQ ID NO: 418010 - RNA, 20 nt, Bordetella pertussis
uggccgcgcucaggccgcug

SEQ ID NO: 418011 - RNA, 12 nt, Bordetella pertussis
uggccgcggccc

SEQ ID NO: 418012 - RNA, 15 nt, Bordetella pertussis
uggccgcggcccagc

SEQ ID NO: 418013 - RNA, 19 nt, Bordetella pertussis
uggccgcggcccagcgcgg

SEQ ID NO: 418014 - RNA, 13 nt, Bordetella pertussis
uggccgcgcugcu

SEQ ID NO: 418015 - RNA, 17 nt, Bordetella pertussis
uggccgcggcgugcugc

SEQ ID NO: 418016 - RNA, 23 nt, Bordetella pertussis
uggccgcgguaaugacgcagccg

SEQ ID NO: 418017 - RNA, 21 nt, Bordetella pertussis
uggccgcguaggcggucagcu

SEQ ID NO: 418018 - RNA, 23 nt, Bordetella pertussis
uggccgcguaggcggucagcugg

SEQ ID NO: 418019 - RNA, 23 nt, Bordetella pertussis
uggccgcuucggcggccauggca

SEQ ID NO: 418020 - RNA, 18 nt, Bordetella pertussis
uggccgcuucggcggccg

SEQ ID NO: 418021 - RNA, 22 nt, Bordetella pertussis
uggccgcuucggcggccgcguc

SEQ ID NO: 418022 - RNA, 18 nt, Bordetella pertussis
uggccggccgcguucagc

SEQ ID NO: 418023 - RNA, 13 nt, Bordetella pertussis
uggccggccuggc

SEQ ID NO: 418024 - RNA, 15 nt, Bordetella pertussis
uggccggcgcggcag

SEQ ID NO: 418025 - RNA, 16 nt, Bordetella pertussis
uggccggcgcggcagc

SEQ ID NO: 418026 - RNA, 21 nt, Bordetella pertussis
uggccggcgcggcagccuggg

SEQ ID NO: 418027 - RNA, 14 nt, Bordetella pertussis
uggccggcgggggc

SEQ ID NO: 418028 - RNA, 18 nt, Bordetella pertussis
uggccggcgggggcgggu

SEQ ID NO: 418029 - RNA, 19 nt, Bordetella pertussis
uggccggcguggccugccc

SEQ ID NO: 418030 - RNA, 20 nt, Bordetella pertussis
uggccggcguggccugcccg

SEQ ID NO: 418031 - RNA, 18 nt, Bordetella pertussis
uggccgggagcggccagc

SEQ ID NO: 418032 - RNA, 20 nt, Bordetella pertussis
uggccgggagcggccagcaa

SEQ ID NO: 418033 - RNA, 22 nt, Bordetella pertussis
uggccgggagcggccagcaagc

SEQ ID NO: 418034 - RNA, 16 nt, Bordetella pertussis
uggccggggcgucguc

SEQ ID NO: 418035 - RNA, 22 nt, Bordetella pertussis
uggccggugaugcggcgcgccg

SEQ ID NO: 418036 - RNA, 22 nt, Bordetella pertussis
uggccgguucgaugaccugggc

SEQ ID NO: 418037 - RNA, 15 nt, Bordetella pertussis
uggccgucgccgccc

SEQ ID NO: 418038 - RNA, 22 nt, Bordetella pertussis
uggccgucgccgcccugcugcc

SEQ ID NO: 418039 - RNA, 11 nt, Bordetella pertussis
uggccgucguc

SEQ ID NO: 418040 - RNA, 15 nt, Bordetella pertussis
uggccguuggccagc

SEQ ID NO: 418041 - RNA, 16 nt, Bordetella pertussis
uggccuaccacgcaug

SEQ ID NO: 418042 - RNA, 19 nt, Bordetella pertussis
uggccuugcugcccgacgg

SEQ ID NO: 418043 - RNA, 14 nt, Bordetella pertussis
uggccuuggcggcc

SEQ ID NO: 418044 - RNA, 17 nt, Bordetella pertussis
uggcgaagaacaccgcc

SEQ ID NO: 418045 - RNA, 23 nt, Bordetella pertussis
uggcgaagaacaccgccgcgccg

SEQ ID NO: 418046 - RNA, 20 nt, Bordetella pertussis
uggcgaacgugcgcgccagc

SEQ ID NO: 418047 - RNA, 18 nt, Bordetella pertussis
uggcgaagaccgugaucg

SEQ ID NO: 418048 - RNA, 23 nt, Bordetella pertussis
uggcgaggacaggccagugccug

SEQ ID NO: 418049 - RNA, 22 nt, Bordetella pertussis
uggcgaggaccugaccaucgaa

SEQ ID NO: 418050 - RNA, 16 nt, Bordetella pertussis
uggcgauagcgcucca

SEQ ID NO: 418051 - RNA, 16 nt, Bordetella pertussis
uggcgaucaccgacag

SEQ ID NO: 418052 - RNA, 14 nt, Bordetella pertussis
uggcgauccaugug

SEQ ID NO: 418053 - RNA, 19 nt, Bordetella pertussis
uggcgaucgaacgcggcca

SEQ ID NO: 418054 - RNA, 15 nt, Bordetella pertussis
uggcgccgacccugc

SEQ ID NO: 418055 - RNA, 16 nt, Bordetella pertussis
uggcgccgacccugcc

SEQ ID NO: 418056 - RNA, 17 nt, Bordetella pertussis
uggcgccgacccugccc

SEQ ID NO: 418057 - RNA, 18 nt, Bordetella pertussis
uggcgccgacccugcccg

SEQ ID NO: 418058 - RNA, 20 nt, Bordetella pertussis
uggcgccgacccugcccggc

SEQ ID NO: 418059 - RNA, 16 nt, Bordetella pertussis
uggcgccgauggcgcc

SEQ ID NO: 418060 - RNA, 13 nt, Bordetella pertussis
uggcgccgcgccg

SEQ ID NO: 418061 - RNA, 16 nt, Bordetella pertussis
uggcgccgcgccgccg

SEQ ID NO: 418062 - RNA, 14 nt, Bordetella pertussis
uggcgccgcggccg

SEQ ID NO: 418063 - RNA, 23 nt, Bordetella pertussis
uggcgccggccaccgccugugcc

SEQ ID NO: 418064 - RNA, 14 nt, Bordetella pertussis
uggcgccggccagc

SEQ ID NO: 418065 - RNA, 18 nt, Bordetella pertussis
uggcgccggccagcgcgc

SEQ ID NO: 418066 - RNA, 17 nt, Bordetella pertussis
uggcgccggugcagguc

SEQ ID NO: 418067 - RNA, 17 nt, Bordetella pertussis
uggcgccguuccugcag

SEQ ID NO: 418068 - RNA, 18 nt, Bordetella pertussis
uggcgccguuccugcagc

SEQ ID NO: 418069 - RNA, 21 nt, Bordetella pertussis
uggcgccguucgucgcgcagc

SEQ ID NO: 418070 - RNA, 17 nt, Bordetella pertussis
uggcgccuuccggcagc

SEQ ID NO: 418071 - RNA, 18 nt, Bordetella pertussis
uggcgcgugucaugcugu

SEQ ID NO: 418072 - RNA, 13 nt, Bordetella pertussis
uggcgcuccagcc

SEQ ID NO: 418073 - RNA, 16 nt, Bordetella pertussis
uggcgcugcacaggga

SEQ ID NO: 418074 - RNA, 15 nt, Bordetella pertussis
uggcgcugcugcugg

SEQ ID NO: 418075 - RNA, 13 nt, Bordetella pertussis
uggcgcuggcagg

SEQ ID NO: 418076 - RNA, 22 nt, Bordetella pertussis
uggcgcuguuuccgggccuggc

SEQ ID NO: 418077 - RNA, 18 nt, Bordetella pertussis
uggcggacacgcccuggc

SEQ ID NO: 418078 - RNA, 22 nt, Bordetella pertussis
uggcggaccgaacggccgguca

SEQ ID NO: 418079 - RNA, 18 nt, Bordetella pertussis
uggcggaucucggccagc

SEQ ID NO: 418080 - RNA, 18 nt, Bordetella pertussis
uggcggcuggcgcggccg

SEQ ID NO: 418081 - RNA, 16 nt, Bordetella pertussis
uggcggcugucgggcg

SEQ ID NO: 418082 - RNA, 12 nt, Bordetella pertussis
uggcgggccagc

SEQ ID NO: 418083 - RNA, 21 nt, Bordetella pertussis
uggcgggcgccugcggcaggc

SEQ ID NO: 418084 - RNA, 15 nt, Bordetella pertussis
uggcgggugcugcag

SEQ ID NO: 418085 - RNA, 21 nt, Bordetella pertussis
uggcgggugcugcagcgcacc

SEQ ID NO: 418086 - RNA, 20 nt, Bordetella pertussis
uggcgguagacgccgggacg

SEQ ID NO: 418087 - RNA, 14 nt, Bordetella pertussis
uggcggucaccaac

SEQ ID NO: 418088 - RNA, 23 nt, Bordetella pertussis
uggcggugaaggcgcccgggcug

SEQ ID NO: 418089 - RNA, 18 nt, Bordetella pertussis
uggcgguggccagcgccu

SEQ ID NO: 418090 - RNA, 16 nt, Bordetella pertussis
uggcgucggccacguc

SEQ ID NO: 418091 - RNA, 15 nt, Bordetella pertussis
uggcgucgggggcgg

SEQ ID NO: 418092 - RNA, 12 nt, Bordetella pertussis
uggcgugcagcc

SEQ ID NO: 418093 - RNA, 14 nt, Bordetella pertussis
uggcgugcaggcug

SEQ ID NO: 418094 - RNA, 17 nt, Bordetella pertussis
uggcgugucuccgggcg

SEQ ID NO: 418095 - RNA, 15 nt, Bordetella pertussis
uggcguugccggccu

SEQ ID NO: 418096 - RNA, 18 nt, Bordetella pertussis
uggcguugcgcaccaugu

SEQ ID NO: 418097 - RNA, 20 nt, Bordetella pertussis
uggcguugcgcaccaugugc

SEQ ID NO: 418098 - RNA, 21 nt, Bordetella pertussis
uggcuucgcgcacauccagcc

SEQ ID NO: 418099 - RNA, 14 nt, Bordetella pertussis
uggcuugcagcgcc

SEQ ID NO: 418100 - RNA, 16 nt, Bordetella pertussis
uggcuuggcggccagg

SEQ ID NO: 418101 - RNA, 17 nt, Bordetella pertussis
uggcuuggcggccagga

SEQ ID NO: 418102 - RNA, 13 nt, Bordetella pertussis
ugggaggggccgg

SEQ ID NO: 418103 - RNA, 23 nt, Bordetella pertussis
ugggcacauccagcgccagcacc

SEQ ID NO: 418104 - RNA, 17 nt, Bordetella pertussis
ugggcaccaccaccgcc

SEQ ID NO: 418105 - RNA, 16 nt, Bordetella pertussis
ugggcagaacggaaac

SEQ ID NO: 418106 - RNA, 14 nt, Bordetella pertussis
ugggcagcagcacg

SEQ ID NO: 418107 - RNA, 16 nt, Bordetella pertussis
ugggcgccggccagga

SEQ ID NO: 418108 - RNA, 16 nt, Bordetella pertussis
ugggcgcgaugggccu

SEQ ID NO: 418109 - RNA, 15 nt, Bordetella pertussis
ugggcgcgcccggcg

SEQ ID NO: 418110 - RNA, 17 nt, Bordetella pertussis
ugggcgcgcgcccaggc

SEQ ID NO: 418111 - RNA, 24 nt, Bordetella pertussis
ugggcgcggaacagccuggucagg

SEQ ID NO: 418112 - RNA, 14 nt, Bordetella pertussis
ugggcgccuugccg

SEQ ID NO: 418113 - RNA, 18 nt, Bordetella pertussis
ugggcgcggcgcgcgccg

SEQ ID NO: 418114 - RNA, 16 nt, Bordetella pertussis
ugggcgcgguccagca

SEQ ID NO: 418115 - RNA, 14 nt, Bordetella pertussis
ugggcgcuuggccc

SEQ ID NO: 418116 - RNA, 18 nt, Bordetella pertussis
ugggcggccucggccagc

SEQ ID NO: 418117 - RNA, 15 nt, Bordetella pertussis
ugggcggccuuggcc

SEQ ID NO: 418118 - RNA, 23 nt, Bordetella pertussis
ugggcggcggcgaugccgcuggc

SEQ ID NO: 418119 - RNA, 17 nt, Bordetella pertussis
ugggcgguugcgcugcu

SEQ ID NO: 418120 - RNA, 13 nt, Bordetella pertussis
ugggcgucccagg

SEQ ID NO: 418121 - RNA, 18 nt, Bordetella pertussis
ugggcgucguccugcagc

SEQ ID NO: 418122 - RNA, 16 nt, Bordetella pertussis
ugggcguggcgcgcgu

SEQ ID NO: 418123 - RNA, 14 nt, Bordetella pertussis
uggggacaggcacc

SEQ ID NO: 418124 - RNA, 23 nt, Bordetella pertussis
uggggacaggcacccgaggguca

SEQ ID NO: 418125 - RNA, 19 nt, Bordetella pertussis
uggggacuggcaccugcaa

SEQ ID NO: 418126 - RNA, 15 nt, Bordetella pertussis
uggggagcgcggccc

SEQ ID NO: 418127 - RNA, 14 nt, Bordetella pertussis
uggggcagccaucc

SEQ ID NO: 418128 - RNA, 17 nt, Bordetella pertussis
uggggcaggcacuggcg

SEQ ID NO: 418129 - RNA, 15 nt, Bordetella pertussis
uggggcaggcgcagc

SEQ ID NO: 418130 - RNA, 14 nt, Bordetella pertussis
uggggcccgcaucc

SEQ ID NO: 418131 - RNA, 22 nt, Bordetella pertussis
uggggccgcggcgcgcgcggcg

SEQ ID NO: 418132 - RNA, 15 nt, Bordetella pertussis
uggggccgggcgcca

SEQ ID NO: 418133 - RNA, 16 nt, Bordetella pertussis
uggggcgaggucagca

SEQ ID NO: 418134 - RNA, 18 nt, Bordetella pertussis
uggggcggcccagcggca

SEQ ID NO: 418135 - RNA, 15 nt, Bordetella pertussis
uggggcggcccggcg

SEQ ID NO: 418136 - RNA, 10 nt, Bordetella pertussis
uggggcuguc

SEQ ID NO: 418137 - RNA, 19 nt, Bordetella pertussis
ugggggauuuuugggcagg

SEQ ID NO: 418138 - RNA, 13 nt, Bordetella pertussis
ugggggcuggagg

SEQ ID NO: 418139 - RNA, 14 nt, Bordetella pertussis
ugggggcuggaggc

SEQ ID NO: 418140 - RNA, 12 nt, Bordetella pertussis
uggguggccagc

SEQ ID NO: 418141 - RNA, 22 nt, Bordetella pertussis
uggguguggccaugcaccagca

SEQ ID NO: 418142 - RNA, 17 nt, Bordetella pertussis
uggguucaggccuguuc

SEQ ID NO: 418143 - RNA, 21 nt, Bordetella pertussis
ugguacagccccagcgccagc

SEQ ID NO: 418144 - RNA, 17 nt, Bordetella pertussis
ugguacgacgagcgcac

SEQ ID NO: 418145 - RNA, 16 nt, Bordetella pertussis
ugguagaucagcgcgu

SEQ ID NO: 418146 - RNA, 15 nt, Bordetella pertussis
ugguaucgcgccagc

SEQ ID NO: 418147 - RNA, 14 nt, Bordetella pertussis
ugguaucggccggg

SEQ ID NO: 418148 - RNA, 14 nt, Bordetella pertussis
uggucacacugucg

SEQ ID NO: 418149 - RNA, 21 nt, Bordetella pertussis
uggucacacugucgccacggg

SEQ ID NO: 418150 - RNA, 21 nt, Bordetella pertussis
uggucacccggcgcaugcugg

SEQ ID NO: 418151 - RNA, 14 nt, Bordetella pertussis
uggucagccugggc

SEQ ID NO: 418152 - RNA, 22 nt, Bordetella pertussis
uggucagccugggcgccuggcu

SEQ ID NO: 418153 - RNA, 17 nt, Bordetella pertussis
uggucagccuggggcag

SEQ ID NO: 418154 - RNA, 20 nt, Bordetella pertussis
uggucagcggcauuuccauu

SEQ ID NO: 418155 - RNA, 20 nt, Bordetella pertussis
uggucaucgauggccacgaa

SEQ ID NO: 418156 - RNA, 18 nt, Bordetella pertussis
uggucaucgccaugcugc

SEQ ID NO: 418157 - RNA, 19 nt, Bordetella pertussis
uggucaucgccaugcugcc

SEQ ID NO: 418158 - RNA, 12 nt, Bordetella pertussis
uggucaugcccu

SEQ ID NO: 418159 - RNA, 22 nt, Bordetella pertussis
uggucgaacgcuuccugggccu

SEQ ID NO: 418160 - RNA, 22 nt, Bordetella pertussis
uggucgacccacuugagcagcg

SEQ ID NO: 418161 - RNA, 20 nt, Bordetella pertussis
uggucgccagcacgcgcagc

SEQ ID NO: 418162 - RNA, 16 nt, Bordetella pertussis
uggucgcccagcagau

SEQ ID NO: 418163 - RNA, 15 nt, Bordetella pertussis
uggucgccucgaccu

SEQ ID NO: 418164 - RNA, 20 nt, Bordetella pertussis
uggucgcgaccaccgugaua

SEQ ID NO: 418165 - RNA, 21 nt, Bordetella pertussis
uggucgcgcagcugccugagc

SEQ ID NO: 418166 - RNA, 12 nt, Bordetella pertussis
uggucgcggccg

SEQ ID NO: 418167 - RNA, 17 nt, Bordetella pertussis
uggucgcgggccaggcc

SEQ ID NO: 418168 - RNA, 18 nt, Bordetella pertussis
uggucggcauggccagga

SEQ ID NO: 418169 - RNA, 13 nt, Bordetella pertussis
uggucggcguggu

SEQ ID NO: 418170 - RNA, 14 nt, Bordetella pertussis
uggugaaacagcau

SEQ ID NO: 418171 - RNA, 16 nt, Bordetella pertussis
uggugaaagccgccgg

SEQ ID NO: 418172 - RNA, 16 nt, Bordetella pertussis
uggugacccguccguc

SEQ ID NO: 418173 - RNA, 19 nt, Bordetella pertussis
uggugacguugaccuugcc

SEQ ID NO: 418174 - RNA, 22 nt, Bordetella pertussis
uguacaccaccaccaccucguc

SEQ ID NO: 418175 - RNA, 15 nt, Bordetella pertussis
uguaccgccgggucg

SEQ ID NO: 418176 - RNA, 15 nt, Bordetella pertussis
uguaccguacccgcg

SEQ ID NO: 418177 - RNA, 18 nt, Bordetella pertussis
uguaccguacccgcgccg

SEQ ID NO: 418178 - RNA, 17 nt, Bordetella pertussis
uguaccguucgcugccc

SEQ ID NO: 418179 - RNA, 18 nt, Bordetella pertussis
uguaccucagccugcugg

SEQ ID NO: 418180 - RNA, 18 nt, Bordetella pertussis
uguagagggucuggccgg

SEQ ID NO: 418181 - RNA, 21 nt, Bordetella pertussis
uguagagcaggccgcccagcg

SEQ ID NO: 418182 - RNA, 23 nt, Bordetella pertussis
uguagcucaguugguagagcagc

SEQ ID NO: 418183 - RNA, 13 nt, Bordetella pertussis
uguaggccagguu

SEQ ID NO: 418184 - RNA, 14 nt, Bordetella pertussis
uguaggcgccggcg

SEQ ID NO: 418185 - RNA, 18 nt, Bordetella pertussis
uguaggcgggcagcggcg

SEQ ID NO: 418186 - RNA, 23 nt, Bordetella pertussis
uguaggucagcgccuugccgccg

SEQ ID NO: 418187 - RNA, 16 nt, Bordetella pertussis
uguaguucagcaguuc

SEQ ID NO: 418188 - RNA, 22 nt, Bordetella pertussis
uguauagaugcgcggggccagg

SEQ ID NO: 418189 - RNA, 16 nt, Bordetella pertussis
ugucagucguccuccg

SEQ ID NO: 418190 - RNA, 17 nt, Bordetella pertussis
ugucaguuuccaucggg

SEQ ID NO: 418191 - RNA, 12 nt, Bordetella pertussis
uguccaccagcc

SEQ ID NO: 418192 - RNA, 17 nt, Bordetella pertussis
uguccaccauccugccc

SEQ ID NO: 418193 - RNA, 18 nt, Bordetella pertussis
uguccaccauccugcccc

SEQ ID NO: 418194 - RNA, 21 nt, Bordetella pertussis
uguccagcgcgcccagcgcgc

SEQ ID NO: 418195 - RNA, 14 nt, Bordetella pertussis
uguccagcuccagc

SEQ ID NO: 418196 - RNA, 17 nt, Bordetella pertussis
uguccagcuccagcgcu

SEQ ID NO: 418197 - RNA, 12 nt, Bordetella pertussis
uguccagcggcg

SEQ ID NO: 418198 - RNA, 15 nt, Bordetella pertussis
uguccaggccggggc

SEQ ID NO: 418199 - RNA, 20 nt, Bordetella pertussis
uguccaggccggggccgccc

SEQ ID NO: 418200 - RNA, 14 nt, Bordetella pertussis
ugucgccgcggccg

SEQ ID NO: 418201 - RNA, 13 nt, Bordetella pertussis
ugucgccguggcg

SEQ ID NO: 418202 - RNA, 20 nt, Bordetella pertussis
ugucggugauccacugcagc

SEQ ID NO: 418203 - RNA, 13 nt, Bordetella pertussis
ugucggugaugau

SEQ ID NO: 418204 - RNA, 14 nt, Bordetella pertussis
ugucguacaggccg

SEQ ID NO: 418205 - RNA, 15 nt, Bordetella pertussis
ugucuaucauggccu

SEQ ID NO: 418206 - RNA, 12 nt, Bordetella pertussis
ugugcagcgcac

SEQ ID NO: 418207 - RNA, 19 nt, Bordetella pertussis
ugugcaggccgaggaccug

SEQ ID NO: 418208 - RNA, 12 nt, Bordetella pertussis
ugugccuguccc

SEQ ID NO: 418209 - RNA, 15 nt, Bordetella pertussis
ugugccugucccagc

SEQ ID NO: 418210 - RNA, 16 nt, Bordetella pertussis
ugugccugucccagcg

SEQ ID NO: 418211 - RNA, 16 nt, Bordetella pertussis
ugugccuguccccgcu

SEQ ID NO: 418212 - RNA, 22 nt, Bordetella pertussis
ugugcgagggcucgaccgccgc

SEQ ID NO: 418213 - RNA, 21 nt, Bordetella pertussis
ugugcgcgggcgcgggcuguc

SEQ ID NO: 418214 - RNA, 20 nt, Bordetella pertussis
ugugcggcgugagcacgacg

SEQ ID NO: 418215 - RNA, 18 nt, Bordetella pertussis
ugugcggcguggcggggc

SEQ ID NO: 418216 - RNA, 20 nt, Bordetella pertussis
uguggcaggcgucggccagc

SEQ ID NO: 418217 - RNA, 23 nt, Bordetella pertussis
uguggcgacgcccagccugccgg

SEQ ID NO: 418218 - RNA, 14 nt, Bordetella pertussis
ugugggggacaggc

SEQ ID NO: 418219 - RNA, 20 nt, Bordetella pertussis
ugugggggacaggcacgccg

SEQ ID NO: 418220 - RNA, 18 nt, Bordetella pertussis
uguggggggucaggccgu

SEQ ID NO: 418221 - RNA, 12 nt, Bordetella pertussis
uguuauuuuucc

SEQ ID NO: 418222 - RNA, 22 nt, Bordetella pertussis
uguuauuuuuccaugcaugcga

SEQ ID NO: 418223 - RNA, 17 nt, Bordetella pertussis
uguuccagcgccuggcg

SEQ ID NO: 418224 - RNA, 15 nt, Bordetella pertussis
uguucgauggcggcc

SEQ ID NO: 418225 - RNA, 12 nt, Bordetella pertussis
uguucgccgcac

SEQ ID NO: 418226 - RNA, 17 nt, Bordetella pertussis
uguucgccgcaccaggc

SEQ ID NO: 418227 - RNA, 19 nt, Bordetella pertussis
uguucgcgcaauugcuucu

SEQ ID NO: 418228 - RNA, 16 nt, Bordetella pertussis
uguucgcgcaccagcg

SEQ ID NO: 418229 - RNA, 18 nt, Bordetella pertussis
uguucgugauccugacca

SEQ ID NO: 418230 - RNA, 16 nt, Bordetella pertussis
uguucuucaggcucca

SEQ ID NO: 418231 - RNA, 20 nt, Bordetella pertussis
uguucuuguugcucuugacc

SEQ ID NO: 418232 - RNA, 14 nt, Bordetella pertussis
uguugaacugcagg

SEQ ID NO: 418233 - RNA, 21 nt, Bordetella pertussis
uguugaccaccacgcuggcuu

SEQ ID NO: 418234 - RNA, 14 nt, Bordetella pertussis
uguugaccacgccc

SEQ ID NO: 418235 - RNA, 13 nt, Bordetella pertussis
uguugcaggaucu

SEQ ID NO: 418236 - RNA, 16 nt, Bordetella pertussis
uguugcauucccggac

SEQ ID NO: 418237 - RNA, 16 nt, Bordetella pertussis
uguugcccaccgccag

SEQ ID NO: 418238 - RNA, 14 nt, Bordetella pertussis
uguugcuggccacc

SEQ ID NO: 418239 - RNA, 17 nt, Bordetella pertussis
uguuggccgccagccgg

SEQ ID NO: 418240 - RNA, 16 nt, Bordetella pertussis
uguuggcgccggccgc

SEQ ID NO: 418241 - RNA, 13 nt, Bordetella pertussis
uguugggccaccu

SEQ ID NO: 418242 - RNA, 16 nt, Bordetella pertussis
uguuucucgcucuugg

SEQ ID NO: 418243 - RNA, 17 nt, Bordetella pertussis
uuaaugaaacugcaaaa

SEQ ID NO: 418244 - RNA, 21 nt, Bordetella pertussis
uuacgccgagaagauuuccca

SEQ ID NO: 418245 - RNA, 12 nt, Bordetella pertussis
uuauuuccucag

SEQ ID NO: 418246 - RNA, 17 nt, Bordetella pertussis
uucacgccggcgcgccg

SEQ ID NO: 418247 - RNA, 16 nt, Bordetella pertussis
uucagcgcgccagcgc

SEQ ID NO: 418248 - RNA, 21 nt, Bordetella pertussis
uucagguagguggacacgccc

SEQ ID NO: 418249 - RNA, 23 nt, Bordetella pertussis
uucaucaaacgcggcgccgccgg

SEQ ID NO: 418250 - RNA, 20 nt, Bordetella pertussis
uucaugcucuugaacgccuu

SEQ ID NO: 418251 - RNA, 20 nt, Bordetella pertussis
uuccccgaaacucaccgccg

SEQ ID NO: 418252 - RNA, 11 nt, Bordetella pertussis
uucccguggcu

SEQ ID NO: 418253 - RNA, 19 nt, Bordetella pertussis
uucccuggcgcgccagcuc

SEQ ID NO: 418254 - RNA, 20 nt, Bordetella pertussis
uuccggcaucaguucaggcu

SEQ ID NO: 418255 - RNA, 21 nt, Bordetella pertussis
uucgaaguauuucaggaugcc

SEQ ID NO: 418256 - RNA, 17 nt, Bordetella pertussis
uucgacgggcaggccca

SEQ ID NO: 418257 - RNA, 18 nt, Bordetella pertussis
uucgagcaggcgcaggcc

SEQ ID NO: 418258 - RNA, 20 nt, Bordetella pertussis
uucgagccgcagaacagcag

SEQ ID NO: 418259 - RNA, 17 nt, Bordetella pertussis
uucgauggcggccaggg

SEQ ID NO: 418260 - RNA, 17 nt, Bordetella pertussis
uucgcccaccaccagcg

SEQ ID NO: 418261 - RNA, 21 nt, Bordetella pertussis
uucgcccagcgcuugcacgcc

SEQ ID NO: 418262 - RNA, 19 nt, Bordetella pertussis
uucgcgcgccagcgcggcg

SEQ ID NO: 418263 - RNA, 21 nt, Bordetella pertussis
uucgcgcgcgguauccagguc

SEQ ID NO: 418264 - RNA, 13 nt, Bordetella pertussis
uucgcgcaccagc

SEQ ID NO: 418265 - RNA, 20 nt, Bordetella pertussis
uucggccagcagcuuggcca

SEQ ID NO: 418266 - RNA, 15 nt, Bordetella pertussis
uucggccgccaggua

SEQ ID NO: 418267 - RNA, 15 nt, Bordetella pertussis
uucggccgccagguc

SEQ ID NO: 418268 - RNA, 22 nt, Bordetella pertussis
uucggcgacgaucuccaccccc

SEQ ID NO: 418269 - RNA, 22 nt, Bordetella pertussis
uucggcgcggcgggcucagccc

SEQ ID NO: 418270 - RNA, 15 nt, Bordetella pertussis
uucggggcagggcgc

SEQ ID NO: 418271 - RNA, 18 nt, Bordetella pertussis
uucggucagcuugccgcc

SEQ ID NO: 418272 - RNA, 21 nt, Bordetella pertussis
uucgucauggucgaccagcag

SEQ ID NO: 418273 - RNA, 15 nt, Bordetella pertussis
uucgucgcgcagcag

SEQ ID NO: 418274 - RNA, 16 nt, Bordetella pertussis
uucgucggcgcucuug

SEQ ID NO: 418275 - RNA, 18 nt, Bordetella pertussis
uucgucggcgcucuuggg

SEQ ID NO: 418276 - RNA, 19 nt, Bordetella pertussis
uucgucgucgccaccgccc

SEQ ID NO: 418277 - RNA, 17 nt, Bordetella pertussis
uucuggccuuccugcug

SEQ ID NO: 418278 - RNA, 20 nt, Bordetella pertussis
uucuggcgcagcaaggcgcg

SEQ ID NO: 418279 - RNA, 20 nt, Bordetella pertussis
uucuuccaguucgcuuucca

SEQ ID NO: 418280 - RNA, 13 nt, Bordetella pertussis
uucuucuuggcca

SEQ ID NO: 418281 - RNA, 15 nt, Bordetella pertussis
uucuucuuggccaga

SEQ ID NO: 418282 - RNA, 19 nt, Bordetella pertussis
uugagcacguccagcggcg

SEQ ID NO: 418283 - RNA, 15 nt, Bordetella pertussis
uugagcgccagggcc

SEQ ID NO: 418284 - RNA, 22 nt, Bordetella pertussis
uugagcguggcguccaugcuga

SEQ ID NO: 418285 - RNA, 23 nt, Bordetella pertussis
uugaggaacuggacggcgcuggg

SEQ ID NO: 418286 - RNA, 18 nt, Bordetella pertussis
uugaggaugcgcgcggcc

SEQ ID NO: 418287 - RNA, 14 nt, Bordetella pertussis
uugaguacgacgcc

SEQ ID NO: 418288 - RNA, 12 nt, Bordetella pertussis
uugauggccggg

SEQ ID NO: 418289 - RNA, 16 nt, Bordetella pertussis
uugcagccacaggccc

SEQ ID NO: 418290 - RNA, 13 nt, Bordetella pertussis
uugcaggccaggc

SEQ ID NO: 418291 - RNA, 15 nt, Bordetella pertussis
uugcaggccaggcuc

SEQ ID NO: 418292 - RNA, 12 nt, Bordetella pertussis
uugcaucuccag

SEQ ID NO: 418293 - RNA, 15 nt, Bordetella pertussis
uugcgcgccuuggcg

SEQ ID NO: 418294 - RNA, 16 nt, Bordetella pertussis
uugcgcuuggcaggcg

SEQ ID NO: 418295 - RNA, 17 nt, Bordetella pertussis
uugcggcaccugcugcu

SEQ ID NO: 418296 - RNA, 23 nt, Bordetella pertussis
uugcgggccuacuucggcagcuu

SEQ ID NO: 418297 - RNA, 23 nt, Bordetella pertussis
uugcgggugggcauccagcggca

SEQ ID NO: 418298 - RNA, 19 nt, Bordetella pertussis
uugcuguccagucuggaug

SEQ ID NO: 418299 - RNA, 22 nt, Bordetella pertussis
uuggacagcaguucggccggcg

SEQ ID NO: 418300 - RNA, 23 nt, Bordetella pertussis
uuggacagcaguucggccggcgg

SEQ ID NO: 418301 - RNA, 15 nt, Bordetella pertussis
uuggacaggcgugcg

SEQ ID NO: 418302 - RNA, 12 nt, Bordetella pertussis
uuggcaggccag

SEQ ID NO: 418303 - RNA, 17 nt, Bordetella pertussis
uuggccagcagcgcauc

SEQ ID NO: 418304 - RNA, 14 nt, Bordetella pertussis
uuggccagcgccgc

SEQ ID NO: 418305 - RNA, 17 nt, Bordetella pertussis
uuggccgcgcgccggcg

SEQ ID NO: 418306 - RNA, 12 nt, Bordetella pertussis
uuggccugcccu

SEQ ID NO: 418307 - RNA, 15 nt, Bordetella pertussis
uuggccuugacggcg

SEQ ID NO: 418308 - RNA, 22 nt, Bordetella pertussis
uuggccuugcccaggcugggcc

SEQ ID NO: 418309 - RNA, 12 nt, Bordetella pertussis
uuggccugggcc

SEQ ID NO: 418310 - RNA, 19 nt, Bordetella pertussis
uuggcgaucucguccugca

SEQ ID NO: 418311 - RNA, 17 nt, Bordetella pertussis
uuggcgcccagcgccau

SEQ ID NO: 418312 - RNA, 13 nt, Bordetella pertussis
uuggcgcgcagca

SEQ ID NO: 418313 - RNA, 22 nt, Bordetella pertussis
uuggcgcgcggauccagcgagg

SEQ ID NO: 418314 - RNA, 13 nt, Bordetella pertussis
uuggcggcgcagc

SEQ ID NO: 418315 - RNA, 14 nt, Bordetella pertussis
uuggcggcuuccug

SEQ ID NO: 418316 - RNA, 19 nt, Bordetella pertussis
uuggcggcuuccuggucac

SEQ ID NO: 418317 - RNA, 13 nt, Bordetella pertussis
uuggcguacggcg

SEQ ID NO: 418318 - RNA, 23 nt, Bordetella pertussis
uuggcuguaucuggccugucugg

SEQ ID NO: 418319 - RNA, 15 nt, Bordetella pertussis
uugggcaaaaaaaga

SEQ ID NO: 418320 - RNA, 18 nt, Bordetella pertussis
uuggugucauagcgccag

SEQ ID NO: 418321 - RNA, 17 nt, Bordetella pertussis
uuguacgacgucuugcu

SEQ ID NO: 418322 - RNA, 20 nt, Bordetella pertussis
uuguccgccacccuggcacg

SEQ ID NO: 418323 - RNA, 19 nt, Bordetella pertussis
uuguccuggucgaccaggc

SEQ ID NO: 418324 - RNA, 20 nt, Bordetella pertussis
uugucgaccaguuggcccuu

SEQ ID NO: 418325 - RNA, 22 nt, Bordetella pertussis
uugucgcgcgagaccagcggau

SEQ ID NO: 418326 - RNA, 22 nt, Bordetella pertussis
uugucgcgcgugagcgaaucca

SEQ ID NO: 418327 - RNA, 19 nt, Bordetella pertussis
uugugcagcaacgccggcg

SEQ ID NO: 418328 - RNA, 18 nt, Bordetella pertussis
uugugcguuggcgcggcg

SEQ ID NO: 418329 - RNA, 13 nt, Bordetella pertussis
uuguggccgccga

SEQ ID NO: 418330 - RNA, 19 nt, Bordetella pertussis
uuguuccacgaggucuugc

SEQ ID NO: 418331 - RNA, 21 nt, Bordetella pertussis
uuguuccacgaggucuugccg

SEQ ID NO: 418332 - RNA, 17 nt, Bordetella pertussis
uuuacccugaacucuuc

SEQ ID NO: 418333 - RNA, 19 nt, Bordetella pertussis
aacacaucgagggcgucau

SEQ ID NO: 418334 - RNA, 20 nt, Bordetella pertussis
aacaccagguuuuccacagc

SEQ ID NO: 418335 - RNA, 16 nt, Bordetella pertussis
aacacgaccagcaggc

SEQ ID NO: 418336 - RNA, 15 nt, Bordetella pertussis
aacacgaugccucga

SEQ ID NO: 418337 - RNA, 16 nt, Bordetella pertussis
aacacgcggugcaucu

SEQ ID NO: 418338 - RNA, 12 nt, Bordetella pertussis
aacagcagcgug

SEQ ID NO: 418339 - RNA, 13 nt, Bordetella pertussis
aacagcaucagcg

SEQ ID NO: 418340 - RNA, 18 nt, Bordetella pertussis
aacagccgccccagcagc

SEQ ID NO: 418341 - RNA, 19 nt, Bordetella pertussis
aacagccgccccagcagca

SEQ ID NO: 418342 - RNA, 20 nt, Bordetella pertussis
aacagccgccccagcagcag

SEQ ID NO: 418343 - RNA, 22 nt, Bordetella pertussis
aacagccgccccagcagcagcg

SEQ ID NO: 418344 - RNA, 14 nt, Bordetella pertussis
aacagccuggucag

SEQ ID NO: 418345 - RNA, 15 nt, Bordetella pertussis
aacagcgccggcagc

SEQ ID NO: 418346 - RNA, 16 nt, Bordetella pertussis
aacagcuugcccggcg

SEQ ID NO: 418347 - RNA, 17 nt, Bordetella pertussis
aacagcuugcccggcgu

SEQ ID NO: 418348 - RNA, 18 nt, Bordetella pertussis
aacaggcgcgccagccgc

SEQ ID NO: 418349 - RNA, 21 nt, Bordetella pertussis
aacaguacuacaguaugggcu

SEQ ID NO: 418350 - RNA, 20 nt, Bordetella pertussis
aacaugacguucuccagcgc

SEQ ID NO: 418351 - RNA, 17 nt, Bordetella pertussis
aacaugacuucggucag

SEQ ID NO: 418352 - RNA, 19 nt, Bordetella pertussis
aacauguucacgcccagga

SEQ ID NO: 418353 - RNA, 18 nt, Bordetella pertussis
aaccaaggagucccuuca

SEQ ID NO: 418354 - RNA, 19 nt, Bordetella pertussis
aaccacaggguggcgccca

SEQ ID NO: 418355 - RNA, 13 nt, Bordetella pertussis
aaccagaucaggu

SEQ ID NO: 418356 - RNA, 15 nt, Bordetella pertussis
aaccagaucaggucg

SEQ ID NO: 418357 - RNA, 22 nt, Bordetella pertussis
aaccaggcugcccuggcccagg

SEQ ID NO: 418358 - RNA, 23 nt, Bordetella pertussis
aaccaggcugcccuggcccaggc

SEQ ID NO: 418359 - RNA, 18 nt, Bordetella pertussis
aacccacccccagcagca

SEQ ID NO: 418360 - RNA, 19 nt, Bordetella pertussis
aacccagcagcggcagcag

SEQ ID NO: 418361 - RNA, 12 nt, Bordetella pertussis
aaccccagcagc

SEQ ID NO: 418362 - RNA, 11 nt, Bordetella pertussis
aacccgcccgg

SEQ ID NO: 418363 - RNA, 14 nt, Bordetella pertussis
aacccgcugggcca

SEQ ID NO: 418364 - RNA, 18 nt, Bordetella pertussis
aacccggcgaagccggca

SEQ ID NO: 418365 - RNA, 22 nt, Bordetella pertussis
aacccguuccccaucaucugcg

SEQ ID NO: 418366 - RNA, 19 nt, Bordetella pertussis
aacccucgcacggccguca

SEQ ID NO: 418367 - RNA, 17 nt, Bordetella pertussis
aaccgaaaugccgcagc

SEQ ID NO: 418368 - RNA, 15 nt, Bordetella pertussis
aaccgauccagcccg

SEQ ID NO: 418369 - RNA, 16 nt, Bordetella pertussis
aaccgcaacgccagca

SEQ ID NO: 418370 - RNA, 18 nt, Bordetella pertussis
aaccgcaacgccagcagg

SEQ ID NO: 418371 - RNA, 20 nt, Bordetella pertussis
aaccgcaggcaagcugcugg

SEQ ID NO: 418372 - RNA, 19 nt, Bordetella pertussis
aaccggaacaccagcaagc

SEQ ID NO: 418373 - RNA, 13 nt, Bordetella pertussis
aaccggugcuggu

SEQ ID NO: 418374 - RNA, 14 nt, Bordetella pertussis
aaccgucgccagcg

SEQ ID NO: 418375 - RNA, 20 nt, Bordetella pertussis
aaccucgacgcgcauuucga

SEQ ID NO: 418376 - RNA, 19 nt, Bordetella pertussis
aaccugcuggccgccggcg

SEQ ID NO: 418377 - RNA, 15 nt, Bordetella pertussis
aaccugguuacucug

SEQ ID NO: 418378 - RNA, 17 nt, Bordetella pertussis
aacgaauaaucgccggu

SEQ ID NO: 418379 - RNA, 21 nt, Bordetella pertussis
aacgacagaccguagcgcagg

SEQ ID NO: 418380 - RNA, 15 nt, Bordetella pertussis
aacgacgcaggcgcc

SEQ ID NO: 418381 - RNA, 12 nt, Bordetella pertussis
aacgacuuggcg

SEQ ID NO: 418382 - RNA, 20 nt, Bordetella pertussis
aacgacuuggcgcaaaccac

SEQ ID NO: 418383 - RNA, 23 nt, Bordetella pertussis
aacgacuugggcaguucgcccgg

SEQ ID NO: 418384 - RNA, 18 nt, Bordetella pertussis
aacgaggacaaccaggaa

SEQ ID NO: 418385 - RNA, 13 nt, Bordetella pertussis
aacgauucuuucc

SEQ ID NO: 418386 - RNA, 13 nt, Bordetella pertussis
aacgccagcagca

SEQ ID NO: 418387 - RNA, 12 nt, Bordetella pertussis
aacgccagcagg

SEQ ID NO: 418388 - RNA, 22 nt, Bordetella pertussis
aacgcccagguugcggccgcca

SEQ ID NO: 418389 - RNA, 22 nt, Bordetella pertussis
aacgccgccgcagccgccagcg

SEQ ID NO: 418390 - RNA, 17 nt, Bordetella pertussis
aacgccgccggcagggc

SEQ ID NO: 418391 - RNA, 22 nt, Bordetella pertussis
aacgccgccggcagggccagcg

SEQ ID NO: 418392 - RNA, 20 nt, Bordetella pertussis
aacgccgcgcucagcaccag

SEQ ID NO: 418393 - RNA, 23 nt, Bordetella pertussis
aacgccggccgccauggccggcg

SEQ ID NO: 418394 - RNA, 23 nt, Bordetella pertussis
aacgccgggccgugcgccgggcg

SEQ ID NO: 418395 - RNA, 14 nt, Bordetella pertussis
aacgccugccagaa

SEQ ID NO: 418396 - RNA, 16 nt, Bordetella pertussis
aacgcgcgcgcccugc

SEQ ID NO: 418397 - RNA, 22 nt, Bordetella pertussis
aacgcgcguccuuggcggccuu

SEQ ID NO: 418398 - RNA, 22 nt, Bordetella pertussis
aacgcggcgcgugcagaucugc

SEQ ID NO: 418399 - RNA, 18 nt, Bordetella pertussis
aacgcuugacggccagga

SEQ ID NO: 418400 - RNA, 17 nt, Bordetella pertussis
aacggcagcagcgcgcc

SEQ ID NO: 418401 - RNA, 14 nt, Bordetella pertussis
aacggccaagcagc

SEQ ID NO: 418402 - RNA, 11 nt, Bordetella pertussis
aacggccacca

SEQ ID NO: 418403 - RNA, 17 nt, Bordetella pertussis
aacggccaccagggccc

SEQ ID NO: 418404 - RNA, 15 nt, Bordetella pertussis
aacggccccgccagg

SEQ ID NO: 418405 - RNA, 19 nt, Bordetella pertussis
aacggccccgccagggcgg

SEQ ID NO: 418406 - RNA, 20 nt, Bordetella pertussis
aacggccggucagcccaggc

SEQ ID NO: 418407 - RNA, 23 nt, Bordetella pertussis
aacggccggucagcccaggcggg

SEQ ID NO: 418408 - RNA, 23 nt, Bordetella pertussis
aacggccuucggcggcgcgcugg

SEQ ID NO: 418409 - RNA, 20 nt, Bordetella pertussis
aacggcgugcugcggcugau

SEQ ID NO: 418410 - RNA, 13 nt, Bordetella pertussis
aacgggggcaggc

SEQ ID NO: 418411 - RNA, 18 nt, Bordetella pertussis
aacggugcgagaucucga

SEQ ID NO: 418412 - RNA, 15 nt, Bordetella pertussis
aacgugcgccaggca

SEQ ID NO: 418413 - RNA, 20 nt, Bordetella pertussis
aacucgaggcggcgcaggau

SEQ ID NO: 418414 - RNA, 13 nt, Bordetella pertussis
aacucgcgcucgg

SEQ ID NO: 418415 - RNA, 16 nt, Bordetella pertussis
aacucggccagcagcu

SEQ ID NO: 418416 - RNA, 17 nt, Bordetella pertussis
aacucggccagcagcuu

SEQ ID NO: 418417 - RNA, 18 nt, Bordetella pertussis
aacugccugcagcgcgcg

SEQ ID NO: 418418 - RNA, 16 nt, Bordetella pertussis
aacugcgagugggugu

SEQ ID NO: 418419 - RNA, 19 nt, Bordetella pertussis
aacugggcgccggccagga

SEQ ID NO: 418420 - RNA, 22 nt, Bordetella pertussis
aacugggcgccggccaggauga

SEQ ID NO: 418421 - RNA, 18 nt, Bordetella pertussis
aacugucaauagguugua

SEQ ID NO: 418422 - RNA, 17 nt, Bordetella pertussis
aacuucaccgucgacuu

SEQ ID NO: 418423 - RNA, 16 nt, Bordetella pertussis
aagaagcccggcugcu

SEQ ID NO: 418424 - RNA, 23 nt, Bordetella pertussis
aagccagcggcgcggcgcgcugg

SEQ ID NO: 418425 - RNA, 22 nt, Bordetella pertussis
aagccaucgacaagcgcuacga

SEQ ID NO: 418426 - RNA, 18 nt, Bordetella pertussis
aagcccaccgggccggcc

SEQ ID NO: 418427 - RNA, 20 nt, Bordetella pertussis
aagcccaguucgguguugag

SEQ ID NO: 418428 - RNA, 12 nt, Bordetella pertussis
aagcccauggcg

SEQ ID NO: 418429 - RNA, 21 nt, Bordetella pertussis
aagcccgagcggcgccagucg

SEQ ID NO: 418430 - RNA, 14 nt, Bordetella pertussis
aagcccggcagggu

SEQ ID NO: 418431 - RNA, 22 nt, Bordetella pertussis
aagccgaugucgaacagcugca

SEQ ID NO: 418432 - RNA, 15 nt, Bordetella pertussis
aagccgcagcggcag

SEQ ID NO: 418433 - RNA, 15 nt, Bordetella pertussis
aagccgccgcccucg

SEQ ID NO: 418434 - RNA, 21 nt, Bordetella pertussis
aagccgccggcgcgcggauga

SEQ ID NO: 418435 - RNA, 20 nt, Bordetella pertussis
aagccgggcucgcugaccua

SEQ ID NO: 418436 - RNA, 13 nt, Bordetella pertussis
aagccggggugcc

SEQ ID NO: 418437 - RNA, 16 nt, Bordetella pertussis
aagccgggcgccggcg

SEQ ID NO: 418438 - RNA, 16 nt, Bordetella pertussis
aagccguacagcgaag

SEQ ID NO: 418439 - RNA, 13 nt, Bordetella pertussis
aagccugcgcgcg

SEQ ID NO: 418440 - RNA, 22 nt, Bordetella pertussis
aagccuugcgcggccagcaccg

SEQ ID NO: 418441 - RNA, 14 nt, Bordetella pertussis
aagcgaacagggcg

SEQ ID NO: 418442 - RNA, 17 nt, Bordetella pertussis
aagcgcaagcccaggcg

SEQ ID NO: 418443 - RNA, 15 nt, Bordetella pertussis
aagcgcagcaccagg

SEQ ID NO: 418444 - RNA, 11 nt, Bordetella pertussis
aagcgcccugg

SEQ ID NO: 418445 - RNA, 18 nt, Bordetella pertussis
aagcgccgccacaggcug

SEQ ID NO: 418446 - RNA, 13 nt, Bordetella pertussis
aagcgccggcccg

SEQ ID NO: 418447 - RNA, 16 nt, Bordetella pertussis
aagcgcgccagcagcg

SEQ ID NO: 418448 - RNA, 20 nt, Bordetella pertussis
aagcgcgcguccugcgccag

SEQ ID NO: 418449 - RNA, 22 nt, Bordetella pertussis
aagcgcgucgagcaggccggcg

SEQ ID NO: 418450 - RNA, 17 nt, Bordetella pertussis
aagcgcgucgauggagu

SEQ ID NO: 418451 - RNA, 16 nt, Bordetella pertussis
aagcgcguggccggcg

SEQ ID NO: 418452 - RNA, 21 nt, Bordetella pertussis
aagcgcgugucccagccggcg

SEQ ID NO: 418453 - RNA, 18 nt, Bordetella pertussis
aagcggcugcccuugcug

SEQ ID NO: 418454 - RNA, 17 nt, Bordetella pertussis
aagcuggcgccggucug

SEQ ID NO: 418455 - RNA, 23 nt, Bordetella pertussis
aaggaaaucgcggcgcugugcaa

SEQ ID NO: 418456 - RNA, 13 nt, Bordetella pertussis
aaggcggccagca

SEQ ID NO: 418457 - RNA, 20 nt, Bordetella pertussis
aaggcggccgcgcccgcaac

SEQ ID NO: 418458 - RNA, 22 nt, Bordetella pertussis
aaggcgguguagaccaccagca

SEQ ID NO: 418459 - RNA, 13 nt, Bordetella pertussis
aagggcagcagca

SEQ ID NO: 418460 - RNA, 14 nt, Bordetella pertussis
aagggccgacuaug

SEQ ID NO: 418461 - RNA, 19 nt, Bordetella pertussis
aagggcggccaugccguca

SEQ ID NO: 418462 - RNA, 20 nt, Bordetella pertussis
aagggcgucuucgccgacca

SEQ ID NO: 418463 - RNA, 21 nt, Bordetella pertussis
aagggcuggccggccaacagc

SEQ ID NO: 418464 - RNA, 13 nt, Bordetella pertussis
aaggggccagccu

SEQ ID NO: 418465 - RNA, 18 nt, Bordetella pertussis
aaggggccagccuggcgc

SEQ ID NO: 418466 - RNA, 22 nt, Bordetella pertussis
aaggggcgcauagcgaaagccg

SEQ ID NO: 418467 - RNA, 12 nt, Bordetella pertussis
aaggggcucccc

SEQ ID NO: 418468 - RNA, 19 nt, Bordetella pertussis
aaggggcuguaccuggcga

SEQ ID NO: 418469 - RNA, 13 nt, Bordetella pertussis
aagggguggcugu

SEQ ID NO: 418470 - RNA, 23 nt, Bordetella pertussis
aaggucggcacgacgcugaugcc

SEQ ID NO: 418471 - RNA, 17 nt, Bordetella pertussis
aaguccuucagccgcug

SEQ ID NO: 418472 - RNA, 19 nt, Bordetella pertussis
aaguguggcgcaccgcgcu

SEQ ID NO: 418473 - RNA, 13 nt, Bordetella pertussis
aaguucaucaucg

SEQ ID NO: 418474 - RNA, 14 nt, Bordetella pertussis
aaguugcucauggc

SEQ ID NO: 418475 - RNA, 23 nt, Bordetella pertussis
aauaccccucauuggcgcgcuug

SEQ ID NO: 418476 - RNA, 22 nt, Bordetella pertussis
aauagccaugcggacgccagcc

SEQ ID NO: 418477 - RNA, 23 nt, Bordetella pertussis
aauagcccgcggccaccaggcug

SEQ ID NO: 418478 - RNA, 21 nt, Bordetella pertussis
aauagcccgugcgggccugca

SEQ ID NO: 418479 - RNA, 11 nt, Bordetella pertussis
aaucccggcga

SEQ ID NO: 418480 - RNA, 15 nt, Bordetella pertussis
aauccgccgccagca

SEQ ID NO: 418481 - RNA, 22 nt, Bordetella pertussis
aaucgcguucacguagaaauac

SEQ ID NO: 418482 - RNA, 14 nt, Bordetella pertussis
aaugcccgcccuug

SEQ ID NO: 418483 - RNA, 13 nt, Bordetella pertussis
aaugcggcggcgc

SEQ ID NO: 418484 - RNA, 17 nt, Bordetella pertussis
aaugcggcggcgcuggc

SEQ ID NO: 418485 - RNA, 20 nt, Bordetella pertussis
aaugcggguguugucaugcg

SEQ ID NO: 418486 - RNA, 15 nt, Bordetella pertussis
aaugcguggccggcg

SEQ ID NO: 418487 - RNA, 17 nt, Bordetella pertussis
aauugcuugccuguccc

SEQ ID NO: 418488 - RNA, 21 nt, Bordetella pertussis
aauugggcugguaggggaugc

SEQ ID NO: 418489 - RNA, 15 nt, Bordetella pertussis
acacuggccagcaag

SEQ ID NO: 418490 - RNA, 15 nt, Bordetella pertussis
acagcaccagcaugc

SEQ ID NO: 418491 - RNA, 20 nt, Bordetella pertussis
acagcacgcccgccagcagc

SEQ ID NO: 418492 - RNA, 21 nt, Bordetella pertussis
acagcacgcccgccagcagcu

SEQ ID NO: 418493 - RNA, 13 nt, Bordetella pertussis
acagcacgugguc

SEQ ID NO: 418494 - RNA, 21 nt, Bordetella pertussis
acagcacguggucgugcagga

SEQ ID NO: 418495 - RNA, 22 nt, Bordetella pertussis
acagccaaguccgguauccugg

SEQ ID NO: 418496 - RNA, 17 nt, Bordetella pertussis
acagccagggcagggcg

SEQ ID NO: 418497 - RNA, 18 nt, Bordetella pertussis
acagccauugcccacagc

SEQ ID NO: 418498 - RNA, 19 nt, Bordetella pertussis
acagccauugcccacagca

SEQ ID NO: 418499 - RNA, 14 nt, Bordetella pertussis
acagccccagcagc

SEQ ID NO: 418500 - RNA, 11 nt, Bordetella pertussis
acagcccggcc

SEQ ID NO: 418501 - RNA, 15 nt, Bordetella pertussis
acagcccggccccca

SEQ ID NO: 418502 - RNA, 15 nt, Bordetella pertussis
acagccgcagccguc

SEQ ID NO: 418503 - RNA, 17 nt, Bordetella pertussis
acagccgccccagcagc

SEQ ID NO: 418504 - RNA, 18 nt, Bordetella pertussis
acagccuggucagguugc

SEQ ID NO: 418505 - RNA, 14 nt, Bordetella pertussis
acagcgaaggggcg

SEQ ID NO: 418506 - RNA, 19 nt, Bordetella pertussis
acagcgccagcccgcugcc

SEQ ID NO: 418507 - RNA, 11 nt, Bordetella pertussis
acagcgcgccc

SEQ ID NO: 418508 - RNA, 19 nt, Bordetella pertussis
acagcgcgggcgcacaaaa

SEQ ID NO: 418509 - RNA, 22 nt, Bordetella pertussis
acagcggcacgccggcggccca

SEQ ID NO: 418510 - RNA, 13 nt, Bordetella pertussis
acagcgucacggc

SEQ ID NO: 418511 - RNA, 16 nt, Bordetella pertussis
acagcguccagccgcc

SEQ ID NO: 418512 - RNA, 18 nt, Bordetella pertussis
acagcgugacggcggcgc

SEQ ID NO: 418513 - RNA, 22 nt, Bordetella pertussis
acagcugcgggaggcuuugggg

SEQ ID NO: 418514 - RNA, 16 nt, Bordetella pertussis
acagcuggaagcgcgc

SEQ ID NO: 418515 - RNA, 18 nt, Bordetella pertussis
acagcuggaagcgcgcca

SEQ ID NO: 418516 - RNA, 18 nt, Bordetella pertussis
acagcuugcccacgcgcu

SEQ ID NO: 418517 - RNA, 13 nt, Bordetella pertussis
acagcuugcgcug

SEQ ID NO: 418518 - RNA, 18 nt, Bordetella pertussis
acaggaacaggccggccu

SEQ ID NO: 418519 - RNA, 22 nt, Bordetella pertussis
acaggaucgaaggcagcgcggc

SEQ ID NO: 418520 - RNA, 11 nt, Bordetella pertussis
acaggcacccu

SEQ ID NO: 418521 - RNA, 16 nt, Bordetella pertussis
acaggcacccugcccc

SEQ ID NO: 418522 - RNA, 21 nt, Bordetella pertussis
acaggcccaguacggccugca

SEQ ID NO: 418523 - RNA, 12 nt, Bordetella pertussis
acaggcgcgcca

SEQ ID NO: 418524 - RNA, 12 nt, Bordetella pertussis
acaggcgcgccc

SEQ ID NO: 418525 - RNA, 21 nt, Bordetella pertussis
acaggcgcgcccgcguacagc

SEQ ID NO: 418526 - RNA, 14 nt, Bordetella pertussis
acaggcugccgucg

SEQ ID NO: 418527 - RNA, 21 nt, Bordetella pertussis
acaggcugccgucggccagcu

SEQ ID NO: 418528 - RNA, 17 nt, Bordetella pertussis
acaggcugcgcaggcgc

SEQ ID NO: 418529 - RNA, 20 nt, Bordetella pertussis
acagggcgucgcgaugcgcc

SEQ ID NO: 418530 - RNA, 14 nt, Bordetella pertussis
acagggggacuggc

SEQ ID NO: 418531 - RNA, 19 nt, Bordetella pertussis
acagggggacuggcacccg

SEQ ID NO: 418532 - RNA, 18 nt, Bordetella pertussis
acaggucgccgaagggca

SEQ ID NO: 418533 - RNA, 20 nt, Bordetella pertussis
acaggucggcgcccacgccg

SEQ ID NO: 418534 - RNA, 19 nt, Bordetella pertussis
acaggucguuguggcaggc

SEQ ID NO: 418535 - RNA, 12 nt, Bordetella pertussis
acaggugcuggg

SEQ ID NO: 418536 - RNA, 24 nt, Bordetella pertussis
acagugucuaucauggccuuggca

SEQ ID NO: 418537 - RNA, 14 nt, Bordetella pertussis
acaguugcaggcca

SEQ ID NO: 418538 - RNA, 16 nt, Bordetella pertussis
acaucgccggcggcgu

SEQ ID NO: 418539 - RNA, 17 nt, Bordetella pertussis
acaucuguccugauuca

SEQ ID NO: 418540 - RNA, 19 nt, Bordetella pertussis
acaugaugcccagcgccag

SEQ ID NO: 418541 - RNA, 13 nt, Bordetella pertussis
acaugcagccgcc

SEQ ID NO: 418542 - RNA, 18 nt, Bordetella pertussis
acauggccagguacaggc

SEQ ID NO: 418543 - RNA, 17 nt, Bordetella pertussis
acaugggcaagccgauc

SEQ ID NO: 418544 - RNA, 16 nt, Bordetella pertussis
acauggugaccggggc

SEQ ID NO: 418545 - RNA, 15 nt, Bordetella pertussis
accaacgcgaucuca

SEQ ID NO: 418546 - RNA, 12 nt, Bordetella pertussis
accaagggcgcc

SEQ ID NO: 418547 - RNA, 23 nt, Bordetella pertussis
accacccgcacgccggccugcgc

SEQ ID NO: 418548 - RNA, 17 nt, Bordetella pertussis
accaccgauccgaugau

SEQ ID NO: 418549 - RNA, 13 nt, Bordetella pertussis
accaccgggaugc

SEQ ID NO: 418550 - RNA, 15 nt, Bordetella pertussis
accacgagcugcagc

SEQ ID NO: 418551 - RNA, 15 nt, Bordetella pertussis
accacggccagcagc

SEQ ID NO: 418552 - RNA, 14 nt, Bordetella pertussis
accacggcgcgccc

SEQ ID NO: 418553 - RNA, 18 nt, Bordetella pertussis
accacugcaaggcccgcc

SEQ ID NO: 418554 - RNA, 22 nt, Bordetella pertussis
accagacgguaauccaguugag

SEQ ID NO: 418555 - RNA, 23 nt, Bordetella pertussis
accagacgguaauccaguugaga

SEQ ID NO: 418556 - RNA, 20 nt, Bordetella pertussis
accagaucaggucgaugccg

SEQ ID NO: 418557 - RNA, 13 nt, Bordetella pertussis
accagcaggaugg

SEQ ID NO: 418558 - RNA, 15 nt, Bordetella pertussis
accagcaggauggau

SEQ ID NO: 418559 - RNA, 17 nt, Bordetella pertussis
accagcaggcccaccag

SEQ ID NO: 418560 - RNA, 21 nt, Bordetella pertussis
accagcaggcggccgaccagc

SEQ ID NO: 418561 - RNA, 14 nt, Bordetella pertussis
accagcgaggcggc

SEQ ID NO: 418562 - RNA, 18 nt, Bordetella pertussis
accagcgcaccaccagca

SEQ ID NO: 418563 - RNA, 19 nt, Bordetella pertussis
accagcgcacggucgaaga

SEQ ID NO: 418564 - RNA, 21 nt, Bordetella pertussis
accagcgcauugccgccgccc

SEQ ID NO: 418565 - RNA, 14 nt, Bordetella pertussis
accagcgccacgcc

SEQ ID NO: 418566 - RNA, 20 nt, Bordetella pertussis
accagcgcgaacgccugcca

SEQ ID NO: 418567 - RNA, 19 nt, Bordetella pertussis
accagcgcgccgaucacca

SEQ ID NO: 418568 - RNA, 18 nt, Bordetella pertussis
accaggccgaacuucagc

SEQ ID NO: 418569 - RNA, 22 nt, Bordetella pertussis
accaggccgccggccagcgcca

SEQ ID NO: 418570 - RNA, 16 nt, Bordetella pertussis
accaggccggccaggg

SEQ ID NO: 418571 - RNA, 19 nt, Bordetella pertussis
accaggccggccagggcca

SEQ ID NO: 418572 - RNA, 19 nt, Bordetella pertussis
accaggccugcgggugcgc

SEQ ID NO: 418573 - RNA, 17 nt, Bordetella pertussis
accaggcgggcaucgcc

SEQ ID NO: 418574 - RNA, 23 nt, Bordetella pertussis
accaggcuccggcuugccgaagg

SEQ ID NO: 418575 - RNA, 16 nt, Bordetella pertussis
accaggcugcgcgccg

SEQ ID NO: 418576 - RNA, 22 nt, Bordetella pertussis
accaggcuggagucgggcugcu

SEQ ID NO: 418577 - RNA, 22 nt, Bordetella pertussis
accagggaccaauacgccgcca

SEQ ID NO: 418578 - RNA, 13 nt, Bordetella pertussis
accagggccgcca

SEQ ID NO: 418579 - RNA, 20 nt, Bordetella pertussis
accagggcgcgcagcaggcc

SEQ ID NO: 418580 - RNA, 21 nt, Bordetella pertussis
accaggggcggcgcggcgcug

SEQ ID NO: 418581 - RNA, 20 nt, Bordetella pertussis
accaggguggcgggcgccug

SEQ ID NO: 418582 - RNA, 19 nt, Bordetella pertussis
accagguacgucgagaagc

SEQ ID NO: 418583 - RNA, 18 nt, Bordetella pertussis
accagguagggcagcagg

SEQ ID NO: 418584 - RNA, 17 nt, Bordetella pertussis
accagguccuggcggcc

SEQ ID NO: 418585 - RNA, 17 nt, Bordetella pertussis
accaggucgcggugcgc

SEQ ID NO: 418586 - RNA, 20 nt, Bordetella pertussis
accagguuggcgauggcguc

SEQ ID NO: 418587 - RNA, 20 nt, Bordetella pertussis
accagguuuuccacagccag

SEQ ID NO: 418588 - RNA, 23 nt, Bordetella pertussis
accagguuuuccacagccaggcc

SEQ ID NO: 418589 - RNA, 21 nt, Bordetella pertussis
accagugcaggggguggcggc

SEQ ID NO: 418590 - RNA, 18 nt, Bordetella pertussis
accaguucggccagcagc

SEQ ID NO: 418591 - RNA, 15 nt, Bordetella pertussis
accaguuggcccuuc

SEQ ID NO: 418592 - RNA, 14 nt, Bordetella pertussis
accaucagccagcc

SEQ ID NO: 418593 - RNA, 21 nt, Bordetella pertussis
accauugcagggugucggcca

SEQ ID NO: 418594 - RNA, 16 nt, Bordetella pertussis
acccagaucgccuggg

SEQ ID NO: 418595 - RNA, 16 nt, Bordetella pertussis
acccagcaccgagcug

SEQ ID NO: 418596 - RNA, 13 nt, Bordetella pertussis
accccgagggcgc

SEQ ID NO: 418597 - RNA, 14 nt, Bordetella pertussis
accccgcccugccc

SEQ ID NO: 418598 - RNA, 14 nt, Bordetella pertussis
accccgucggcuca

SEQ ID NO: 418599 - RNA, 20 nt, Bordetella pertussis
accccguggucgccagcacg

SEQ ID NO: 418600 - RNA, 16 nt, Bordetella pertussis
accccguugcagccca

SEQ ID NO: 418601 - RNA, 19 nt, Bordetella pertussis
accccucauuggcgcgcuu

SEQ ID NO: 418602 - RNA, 11 nt, Bordetella pertussis
accccuccggc

SEQ ID NO: 418603 - RNA, 19 nt, Bordetella pertussis
accgcacgauggcgcgcga

SEQ ID NO: 418604 - RNA, 20 nt, Bordetella pertussis
accgccaagcagaccuacca

SEQ ID NO: 418605 - RNA, 16 nt, Bordetella pertussis
accgccauggcggccg

SEQ ID NO: 418606 - RNA, 24 nt, Bordetella pertussis
accgcccaggcgcagcccacucag

SEQ ID NO: 418607 - RNA, 22 nt, Bordetella pertussis
accgcccccgccgccaugccau

SEQ ID NO: 418608 - RNA, 19 nt, Bordetella pertussis
accgccggcggcgugcccu

SEQ ID NO: 418609 - RNA, 16 nt, Bordetella pertussis
accgccgggacaggca

SEQ ID NO: 418610 - RNA, 23 nt, Bordetella pertussis
accgccucgaugcccucgcgcac

SEQ ID NO: 418611 - RNA, 13 nt, Bordetella pertussis
accgccugcugca

SEQ ID NO: 418612 - RNA, 16 nt, Bordetella pertussis
accgccugcugcgccu

SEQ ID NO: 418613 - RNA, 22 nt, Bordetella pertussis
accgccuugccuugcgcggcca

SEQ ID NO: 418614 - RNA, 16 nt, Bordetella pertussis
accgcgaaccaggccu

SEQ ID NO: 418615 - RNA, 19 nt, Bordetella pertussis
accgcgaaccaggccugcg

SEQ ID NO: 418616 - RNA, 20 nt, Bordetella pertussis
accgcgaaccggugcuggug

SEQ ID NO: 418617 - RNA, 19 nt, Bordetella pertussis
accgcgccgaguuuccgca

SEQ ID NO: 418618 - RNA, 20 nt, Bordetella pertussis
accgcgcgcacgaccaccag

SEQ ID NO: 418619 - RNA, 11 nt, Bordetella pertussis
accgcgcgccg

SEQ ID NO: 418620 - RNA, 16 nt, Bordetella pertussis
accgcuuccgccaccg

SEQ ID NO: 418621 - RNA, 17 nt, Bordetella pertussis
accggcaagcgcucgcc

SEQ ID NO: 418622 - RNA, 13 nt, Bordetella pertussis
accggcaggccgc

SEQ ID NO: 418623 - RNA, 12 nt, Bordetella pertussis
accggccgccgc

SEQ ID NO: 418624 - RNA, 15 nt, Bordetella pertussis
accggcgccggcucc

SEQ ID NO: 418625 - RNA, 13 nt, Bordetella pertussis
accggcgccuggc

SEQ ID NO: 418626 - RNA, 14 nt, Bordetella pertussis
accggcggcaccau

SEQ ID NO: 418627 - RNA, 20 nt, Bordetella pertussis
accggcggcacggccggccu

SEQ ID NO: 418628 - RNA, 19 nt, Bordetella pertussis
accggcggcgcucaucauc

SEQ ID NO: 418629 - RNA, 18 nt, Bordetella pertussis
accggcguauggcccgcc

SEQ ID NO: 418630 - RNA, 19 nt, Bordetella pertussis
accggcguauggcccgcca

SEQ ID NO: 418631 - RNA, 20 nt, Bordetella pertussis
accggcguauggcccgccac

SEQ ID NO: 418632 - RNA, 17 nt, Bordetella pertussis
accggcguccaugaaaa

SEQ ID NO: 418633 - RNA, 22 nt, Bordetella pertussis
accggcgugcgcuggcugggcc

SEQ ID NO: 418634 - RNA, 23 nt, Bordetella pertussis
accggcgugcgcuggcugggccu

SEQ ID NO: 418635 - RNA, 17 nt, Bordetella pertussis
accggcuuggggcgcgc

SEQ ID NO: 418636 - RNA, 12 nt, Bordetella pertussis
accgggacaggc

SEQ ID NO: 418637 - RNA, 16 nt, Bordetella pertussis
accgggccggccugcg

SEQ ID NO: 418638 - RNA, 14 nt, Bordetella pertussis
accggggcagggcg

SEQ ID NO: 418639 - RNA, 22 nt, Bordetella pertussis
accggguuuccagcccguggac

SEQ ID NO: 418640 - RNA, 19 nt, Bordetella pertussis
accggguugcccggcaggc

SEQ ID NO: 418641 - RNA, 12 nt, Bordetella pertussis
accggugcccuc

SEQ ID NO: 418642 - RNA, 14 nt, Bordetella pertussis
accggugcccucga

SEQ ID NO: 418643 - RNA, 15 nt, Bordetella pertussis
accggugcuggugcu

SEQ ID NO: 418644 - RNA, 18 nt, Bordetella pertussis
accgguuggccagcucca

SEQ ID NO: 418645 - RNA, 18 nt, Bordetella pertussis
accgucgaccggcccgca

SEQ ID NO: 418646 - RNA, 13 nt, Bordetella pertussis
accgucgaugacc

SEQ ID NO: 418647 - RNA, 16 nt, Bordetella pertussis
accgucguccucggca

SEQ ID NO: 418648 - RNA, 22 nt, Bordetella pertussis
accgugauauagaccagcagcu

SEQ ID NO: 418649 - RNA, 14 nt, Bordetella pertussis
accgugaugcgcgc

SEQ ID NO: 418650 - RNA, 21 nt, Bordetella pertussis
accgugaugcgcgccgcucuu

SEQ ID NO: 418651 - RNA, 16 nt, Bordetella pertussis
accgugccgccgagga

SEQ ID NO: 418652 - RNA, 24 nt, Bordetella pertussis
accguucuuccgcacgccgaccug

SEQ ID NO: 418653 - RNA, 19 nt, Bordetella pertussis
accucagccugcuggugcu

SEQ ID NO: 418654 - RNA, 13 nt, Bordetella pertussis
accuccaggccca

SEQ ID NO: 418655 - RNA, 21 nt, Bordetella pertussis
accuccugguccgugaagccg

SEQ ID NO: 418656 - RNA, 13 nt, Bordetella pertussis
accucgacgcagc

SEQ ID NO: 418657 - RNA, 17 nt, Bordetella pertussis
accucgagcaccuugac

SEQ ID NO: 418658 - RNA, 14 nt, Bordetella pertussis
accucgaucaccac

SEQ ID NO: 418659 - RNA, 13 nt, Bordetella pertussis
accucgcgccggu

SEQ ID NO: 418660 - RNA, 22 nt, Bordetella pertussis
accucgcguagugguaugaccg

SEQ ID NO: 418661 - RNA, 13 nt, Bordetella pertussis
accucgcuugccc

SEQ ID NO: 418662 - RNA, 21 nt, Bordetella pertussis
accucgcuugcccgugccuug

SEQ ID NO: 418663 - RNA, 15 nt, Bordetella pertussis
accucggccggggcg

SEQ ID NO: 418664 - RNA, 17 nt, Bordetella pertussis
accucggcgcccagcug

SEQ ID NO: 418665 - RNA, 18 nt, Bordetella pertussis
accucguaaguggcggcg

SEQ ID NO: 418666 - RNA, 17 nt, Bordetella pertussis
accucuucagcccggcg

SEQ ID NO: 418667 - RNA, 17 nt, Bordetella pertussis
accugaagguggcguuc

SEQ ID NO: 418668 - RNA, 22 nt, Bordetella pertussis
accugaccucgcgguugcgucu

SEQ ID NO: 418669 - RNA, 12 nt, Bordetella pertussis
accugacccugc

SEQ ID NO: 418670 - RNA, 14 nt, Bordetella pertussis
accugacccugcgc

SEQ ID NO: 418671 - RNA, 14 nt, Bordetella pertussis
accugagccaggcg

SEQ ID NO: 418672 - RNA, 22 nt, Bordetella pertussis
accugagccaggcgcccggcgu

SEQ ID NO: 418673 - RNA, 17 nt, Bordetella pertussis
accugaucgccucgguc

SEQ ID NO: 418674 - RNA, 18 nt, Bordetella pertussis
accugaucgcgcagcgcc

SEQ ID NO: 418675 - RNA, 18 nt, Bordetella pertussis
accugcaaccccaccggc

SEQ ID NO: 418676 - RNA, 15 nt, Bordetella pertussis
accugcaccgaagca

SEQ ID NO: 418677 - RNA, 16 nt, Bordetella pertussis
accugcaggccgccgg

SEQ ID NO: 418678 - RNA, 13 nt, Bordetella pertussis
accugccacugca

SEQ ID NO: 418679 - RNA, 22 nt, Bordetella pertussis
accugcgcaugcgccuguccca

SEQ ID NO: 418680 - RNA, 17 nt, Bordetella pertussis
accugcgcgccggcaug

SEQ ID NO: 418681 - RNA, 22 nt, Bordetella pertussis
accugcgggcgcagcgccgcuu

SEQ ID NO: 418682 - RNA, 16 nt, Bordetella pertussis
accugcguggccucuu

SEQ ID NO: 418683 - RNA, 17 nt, Bordetella pertussis
accugcucgagcggcgg

SEQ ID NO: 418684 - RNA, 23 nt, Bordetella pertussis
accugcucgucgccaugcggcug

SEQ ID NO: 418685 - RNA, 13 nt, Bordetella pertussis
accugcugcggca

SEQ ID NO: 418686 - RNA, 20 nt, Bordetella pertussis
accugcugcuugaccuuggc

SEQ ID NO: 418687 - RNA, 14 nt, Bordetella pertussis
accugcuggccgcc

SEQ ID NO: 418688 - RNA, 22 nt, Bordetella pertussis
accugcuugagcaccacguccu

SEQ ID NO: 418689 - RNA, 15 nt, Bordetella pertussis
accuggacgagggcc

SEQ ID NO: 418690 - RNA, 21 nt, Bordetella pertussis
accuggaucacgugccagccg

SEQ ID NO: 418691 - RNA, 13 nt, Bordetella pertussis
accugggccagca

SEQ ID NO: 418692 - RNA, 18 nt, Bordetella pertussis
accugggccgccugcugg

SEQ ID NO: 418693 - RNA, 13 nt, Bordetella pertussis
accugggucggaa

SEQ ID NO: 418694 - RNA, 15 nt, Bordetella pertussis
accuggucggccuuc

SEQ ID NO: 418695 - RNA, 13 nt, Bordetella pertussis
accuggugcacca

SEQ ID NO: 418696 - RNA, 17 nt, Bordetella pertussis
accuguaccagaugaga

SEQ ID NO: 418697 - RNA, 16 nt, Bordetella pertussis
accuguucggcggcgc

SEQ ID NO: 418698 - RNA, 20 nt, Bordetella pertussis
accuucaacaucgcccuguc

SEQ ID NO: 418699 - RNA, 15 nt, Bordetella pertussis
accuucagcccggcg

SEQ ID NO: 418700 - RNA, 20 nt, Bordetella pertussis
accuuccugcuggaccugcu

SEQ ID NO: 418701 - RNA, 18 nt, Bordetella pertussis
accuucugccgccaggca

SEQ ID NO: 418702 - RNA, 23 nt, Bordetella pertussis
accuugacgcgcaggccauugcu

SEQ ID NO: 418703 - RNA, 15 nt, Bordetella pertussis
accuugcccagcagc

SEQ ID NO: 418704 - RNA, 17 nt, Bordetella pertussis
accuugcccagcagcuc

SEQ ID NO: 418705 - RNA, 22 nt, Bordetella pertussis
accuugcccagcagcuccucgg

SEQ ID NO: 418706 - RNA, 20 nt, Bordetella pertussis
accuugccgauccagcgccu

SEQ ID NO: 418707 - RNA, 18 nt, Bordetella pertussis
accuugcgaggcccggcc

SEQ ID NO: 418708 - RNA, 18 nt, Bordetella pertussis
accuugcggccgcgcacc

SEQ ID NO: 418709 - RNA, 19 nt, Bordetella pertussis
accuugcuggaccgcgccu

SEQ ID NO: 418710 - RNA, 22 nt, Bordetella pertussis
accuuggcccggcgggaacagg

SEQ ID NO: 418711 - RNA, 18 nt, Bordetella pertussis
accuuggcgcccagcuug

SEQ ID NO: 418712 - RNA, 12 nt, Bordetella pertussis
accuuggcggcu

SEQ ID NO: 418713 - RNA, 14 nt, Bordetella pertussis
acgaaaaccaggcu

SEQ ID NO: 418714 - RNA, 18 nt, Bordetella pertussis
acgaaaaccaggcugccc

SEQ ID NO: 418715 - RNA, 13 nt, Bordetella pertussis
acgaacaacacga

SEQ ID NO: 418716 - RNA, 23 nt, Bordetella pertussis
acgaacccgcccgaaccggcauc

SEQ ID NO: 418717 - RNA, 22 nt, Bordetella pertussis
acgaagaacaccaucaaggcca

SEQ ID NO: 418718 - RNA, 13 nt, Bordetella pertussis
acgaagaacugcu

SEQ ID NO: 418719 - RNA, 11 nt, Bordetella pertussis
acgaagcaggu

SEQ ID NO: 418720 - RNA, 23 nt, Bordetella pertussis
acgaagcaggugaugcgcgcggc

SEQ ID NO: 418721 - RNA, 23 nt, Bordetella pertussis
acgacacccggucggcccagguc

SEQ ID NO: 418722 - RNA, 12 nt, Bordetella pertussis
acgaccggcucg

SEQ ID NO: 418723 - RNA, 19 nt, Bordetella pertussis
acgaccugaauccguaagc

SEQ ID NO: 418724 - RNA, 20 nt, Bordetella pertussis
acgaccugcaaccccaccgg

SEQ ID NO: 418725 - RNA, 15 nt, Bordetella pertussis
acgaccuugcuggac

SEQ ID NO: 418726 - RNA, 24 nt, Bordetella pertussis
acgaccuugcuggaccgcgccugg

SEQ ID NO: 418727 - RNA, 16 nt, Bordetella pertussis
acgaccuuggcggccg

SEQ ID NO: 418728 - RNA, 15 nt, Bordetella pertussis
acgacgaacaacacg

SEQ ID NO: 418729 - RNA, 14 nt, Bordetella pertussis
acgacgcaggcgcc

SEQ ID NO: 418730 - RNA, 23 nt, Bordetella pertussis
acgacgcguuguucgggccggcu

SEQ ID NO: 418731 - RNA, 14 nt, Bordetella pertussis
acgacgguacaccu

SEQ ID NO: 418732 - RNA, 13 nt, Bordetella pertussis
acgacgucuugcu

SEQ ID NO: 418733 - RNA, 20 nt, Bordetella pertussis
acgacguuguucaggaaggc

SEQ ID NO: 418734 - RNA, 13 nt, Bordetella pertussis
acgagacaggcgc

SEQ ID NO: 418735 - RNA, 16 nt, Bordetella pertussis
acgagacaggcgcgcc

SEQ ID NO: 418736 - RNA, 17 nt, Bordetella pertussis
acgagacaggcgcgcca

SEQ ID NO: 418737 - RNA, 19 nt, Bordetella pertussis
acgagaugccgaugauggc

SEQ ID NO: 418738 - RNA, 18 nt, Bordetella pertussis
acgagauguccauggccu

SEQ ID NO: 418739 - RNA, 21 nt, Bordetella pertussis
acgagcaagcccacaccauca

SEQ ID NO: 418740 - RNA, 22 nt, Bordetella pertussis
acgagcgcagcaagcugcugcu

SEQ ID NO: 418741 - RNA, 23 nt, Bordetella pertussis
acgaggcgcggucguagcggaug

SEQ ID NO: 418742 - RNA, 16 nt, Bordetella pertussis
acgagggccggcgcca

SEQ ID NO: 418743 - RNA, 18 nt, Bordetella pertussis
acgaggugccuguccccc

SEQ ID NO: 418744 - RNA, 14 nt, Bordetella pertussis
acgagugcaggccc

SEQ ID NO: 418745 - RNA, 15 nt, Bordetella pertussis
acgaguugcucggag

SEQ ID NO: 418746 - RNA, 15 nt, Bordetella pertussis
acgauauccaggcgc

SEQ ID NO: 418747 - RNA, 13 nt, Bordetella pertussis
acgaucaggcggc

SEQ ID NO: 418748 - RNA, 15 nt, Bordetella pertussis
acgaucaggcggcgc

SEQ ID NO: 418749 - RNA, 15 nt, Bordetella pertussis
acgaucauccaggcc

SEQ ID NO: 418750 - RNA, 18 nt, Bordetella pertussis
acgaugccgcccacgcca

SEQ ID NO: 418751 - RNA, 15 nt, Bordetella pertussis
acgauggccggggcg

SEQ ID NO: 418752 - RNA, 12 nt, Bordetella pertussis
acgauggggcca

SEQ ID NO: 418753 - RNA, 16 nt, Bordetella pertussis
acgauggggccauggc

SEQ ID NO: 418754 - RNA, 21 nt, Bordetella pertussis
acgaugucgccgccgcgcacc

SEQ ID NO: 418755 - RNA, 21 nt, Bordetella pertussis
acgauuuccgcuaccaggcgc

SEQ ID NO: 418756 - RNA, 22 nt, Bordetella pertussis
acgauuuccgcuaccaggcgcg

SEQ ID NO: 418757 - RNA, 17 nt, Bordetella pertussis
acgcaaccggucggccg

SEQ ID NO: 418758 - RNA, 13 nt, Bordetella pertussis
acgcaagcccggc

SEQ ID NO: 418759 - RNA, 22 nt, Bordetella pertussis
acgcugcugauccucgccagcg

SEQ ID NO: 418760 - RNA, 20 nt, Bordetella pertussis
acgcuggccgcgcuggcggc

SEQ ID NO: 418761 - RNA, 20 nt, Bordetella pertussis
acgcuggcuucgucgccggc

SEQ ID NO: 418762 - RNA, 21 nt, Bordetella pertussis
acgcuggcuucgucgccggcg

SEQ ID NO: 418763 - RNA, 14 nt, Bordetella pertussis
acgcugggccagac

SEQ ID NO: 418764 - RNA, 15 nt, Bordetella pertussis
acgcuguaacaacac

SEQ ID NO: 418765 - RNA, 17 nt, Bordetella pertussis
acgcuguaacaacacgu

SEQ ID NO: 418766 - RNA, 16 nt, Bordetella pertussis
acgcuguuggucaggu

SEQ ID NO: 418767 - RNA, 16 nt, Bordetella pertussis
acggaaacgcccagcc

SEQ ID NO: 418768 - RNA, 19 nt, Bordetella pertussis
acggaaacgcccagcccug

SEQ ID NO: 418769 - RNA, 22 nt, Bordetella pertussis
acggaacgugccgucgggcgcc

SEQ ID NO: 418770 - RNA, 16 nt, Bordetella pertussis
acggaaguccugcauc

SEQ ID NO: 418771 - RNA, 15 nt, Bordetella pertussis
acggacagcccgcgc

SEQ ID NO: 418772 - RNA, 14 nt, Bordetella pertussis
acggaucagccgcu

SEQ ID NO: 418773 - RNA, 15 nt, Bordetella pertussis
acggaucagccgcuu

SEQ ID NO: 418774 - RNA, 22 nt, Bordetella pertussis
acggauggucgugcggcacgca

SEQ ID NO: 418775 - RNA, 13 nt, Bordetella pertussis
acggcaagaucgc

SEQ ID NO: 418776 - RNA, 20 nt, Bordetella pertussis
acggccaccagggcccggac

SEQ ID NO: 418777 - RNA, 14 nt, Bordetella pertussis
acggccaggacggc

SEQ ID NO: 418778 - RNA, 18 nt, Bordetella pertussis
acggccaggggcagcucg

SEQ ID NO: 418779 - RNA, 13 nt, Bordetella pertussis
acggcccgccagg

SEQ ID NO: 418780 - RNA, 14 nt, Bordetella pertussis
acggcccuggucua

SEQ ID NO: 418781 - RNA, 18 nt, Bordetella pertussis
acggccgccaccugggcc

SEQ ID NO: 418782 - RNA, 15 nt, Bordetella pertussis
acggccggccaggcg

SEQ ID NO: 418783 - RNA, 17 nt, Bordetella pertussis
acggccggccaggcgcc

SEQ ID NO: 418784 - RNA, 21 nt, Bordetella pertussis
acggccggccaggcgccgcuc

SEQ ID NO: 418785 - RNA, 23 nt, Bordetella pertussis
acggccggggcccgcgggcgccc

SEQ ID NO: 418786 - RNA, 13 nt, Bordetella pertussis
acggccggguccc

SEQ ID NO: 418787 - RNA, 18 nt, Bordetella pertussis
acggccgggucccuggcc

SEQ ID NO: 418788 - RNA, 18 nt, Bordetella pertussis
acggccucccgccgcccg

SEQ ID NO: 418789 - RNA, 18 nt, Bordetella pertussis
acggccuccgcgccgacc

SEQ ID NO: 418790 - RNA, 13 nt, Bordetella pertussis
acggccugcccgg

SEQ ID NO: 418791 - RNA, 19 nt, Bordetella pertussis
acggccugcgcgccgacca

SEQ ID NO: 418792 - RNA, 18 nt, Bordetella pertussis
acggcgacuuccagcaga

SEQ ID NO: 418793 - RNA, 17 nt, Bordetella pertussis
acggcgaggaggugcgc

SEQ ID NO: 418794 - RNA, 22 nt, Bordetella pertussis
acggcgaggaggugcgccgcuc

SEQ ID NO: 418795 - RNA, 17 nt, Bordetella pertussis
acggcgagucugaaagg

SEQ ID NO: 418796 - RNA, 16 nt, Bordetella pertussis
acggcgaucauggcgu

SEQ ID NO: 418797 - RNA, 21 nt, Bordetella pertussis
acggcgcucuugguggugccu

SEQ ID NO: 418798 - RNA, 16 nt, Bordetella pertussis
acggcgcuggcgagca

SEQ ID NO: 418799 - RNA, 12 nt, Bordetella pertussis
acggcggaaauu

SEQ ID NO: 418800 - RNA, 13 nt, Bordetella pertussis
acggcggcaggcc

SEQ ID NO: 418801 - RNA, 15 nt, Bordetella pertussis
acggcggcaggccgc

SEQ ID NO: 418802 - RNA, 18 nt, Bordetella pertussis
acggcggcaggccgcgcc

SEQ ID NO: 418803 - RNA, 18 nt, Bordetella pertussis
acggcggcuucggccguc

SEQ ID NO: 418804 - RNA, 16 nt, Bordetella pertussis
acggcgggccggcucg

SEQ ID NO: 418805 - RNA, 22 nt, Bordetella pertussis
acggcgggccggcucggcggca

SEQ ID NO: 418806 - RNA, 14 nt, Bordetella pertussis
acggcgggcgcccc

SEQ ID NO: 418807 - RNA, 17 nt, Bordetella pertussis
acggcggcgcggcgcca

SEQ ID NO: 418808 - RNA, 23 nt, Bordetella pertussis
acgggcgccagcagcgggcuggg

SEQ ID NO: 418809 - RNA, 14 nt, Bordetella pertussis
acgggcgccugccg

SEQ ID NO: 418810 - RNA, 15 nt, Bordetella pertussis
acgggcgccugccgc

SEQ ID NO: 418811 - RNA, 15 nt, Bordetella pertussis
acgggcgccuguccc

SEQ ID NO: 418812 - RNA, 20 nt, Bordetella pertussis
acgggcggcgucgccgcgca

SEQ ID NO: 418813 - RNA, 15 nt, Bordetella pertussis
acgggcggcugccag

SEQ ID NO: 418814 - RNA, 20 nt, Bordetella pertussis
acgggcucgcugaccggcgu

SEQ ID NO: 418815 - RNA, 17 nt, Bordetella pertussis
acggggaacaggcgcgc

SEQ ID NO: 418816 - RNA, 16 nt, Bordetella pertussis
acggggacaggcacgc

SEQ ID NO: 418817 - RNA, 18 nt, Bordetella pertussis
acggggugccuguccccg

SEQ ID NO: 418818 - RNA, 19 nt, Bordetella pertussis
acgggguggccggcgcgcg

SEQ ID NO: 418819 - RNA, 17 nt, Bordetella pertussis
acggguaugcgcagcga

SEQ ID NO: 418820 - RNA, 18 nt, Bordetella pertussis
acgggucaggcugcggcg

SEQ ID NO: 418821 - RNA, 16 nt, Bordetella pertussis
acggguggguggacag

SEQ ID NO: 418822 - RNA, 19 nt, Bordetella pertussis
acgguaagcaccagguugc

SEQ ID NO: 418823 - RNA, 20 nt, Bordetella pertussis
acggucagcaaccccagcag

SEQ ID NO: 418824 - RNA, 22 nt, Bordetella pertussis
acggucagcaaccccagcagcg

SEQ ID NO: 418825 - RNA, 18 nt, Bordetella pertussis
acggucaggggcaggcgc

SEQ ID NO: 418826 - RNA, 15 nt, Bordetella pertussis
acggucgccggcaug

SEQ ID NO: 418827 - RNA, 19 nt, Bordetella pertussis
acggugccgccgaucugcu

SEQ ID NO: 418828 - RNA, 15 nt, Bordetella pertussis
acggugccggccagc

SEQ ID NO: 418829 - RNA, 19 nt, Bordetella pertussis
acggugccggccagccugc

SEQ ID NO: 418830 - RNA, 20 nt, Bordetella pertussis
acgguggcgaaggccgccgc

SEQ ID NO: 418831 - RNA, 16 nt, Bordetella pertussis
acggugggcagcagca

SEQ ID NO: 418832 - RNA, 17 nt, Bordetella pertussis
acggugggcagcagcac

SEQ ID NO: 418833 - RNA, 22 nt, Bordetella pertussis
acgguggcguaguagcccaggc

SEQ ID NO: 418834 - RNA, 15 nt, Bordetella pertussis
acgguguugaccacc

SEQ ID NO: 418835 - RNA, 15 nt, Bordetella pertussis
acguccagcgccacc

SEQ ID NO: 418836 - RNA, 18 nt, Bordetella pertussis
acguccuggggcgcgguc

SEQ ID NO: 418837 - RNA, 14 nt, Bordetella pertussis
acgucgaacagcuu

SEQ ID NO: 418838 - RNA, 22 nt, Bordetella pertussis
acgucgacguugcgcgacaggc

SEQ ID NO: 418839 - RNA, 23 nt, Bordetella pertussis
acgucgacguugcgcgacaggcc

SEQ ID NO: 418840 - RNA, 16 nt, Bordetella pertussis
acgucgcgaccgccgc

SEQ ID NO: 418841 - RNA, 22 nt, Bordetella pertussis
acgucgcgcaauacgccgccgg

SEQ ID NO: 418842 - RNA, 13 nt, Bordetella pertussis
acgucggacaggg

SEQ ID NO: 418843 - RNA, 16 nt, Bordetella pertussis
acgucggcggccgccu

SEQ ID NO: 418844 - RNA, 15 nt, Bordetella pertussis
acgucguagcgcugc

SEQ ID NO: 418845 - RNA, 17 nt, Bordetella pertussis
acgugcgcacgcguucg

SEQ ID NO: 418846 - RNA, 12 nt, Bordetella pertussis
acgugcgcgcca

SEQ ID NO: 418847 - RNA, 13 nt, Bordetella pertussis
acgugcugcugca

SEQ ID NO: 418848 - RNA, 14 nt, Bordetella pertussis
acgugcugcugcac

SEQ ID NO: 418849 - RNA, 15 nt, Bordetella pertussis
acguggacaggcacc

SEQ ID NO: 418850 - RNA, 14 nt, Bordetella pertussis
acguuguccaggcc

SEQ ID NO: 418851 - RNA, 14 nt, Bordetella pertussis
acguuguucaggaa

SEQ ID NO: 418852 - RNA, 18 nt, Bordetella pertussis
acuacggcggacuggccg

SEQ ID NO: 418853 - RNA, 12 nt, Bordetella pertussis
acuccgcggcgu

SEQ ID NO: 418854 - RNA, 14 nt, Bordetella pertussis
acuccggccgggcc

SEQ ID NO: 418855 - RNA, 19 nt, Bordetella pertussis
acuccugcagcacgcuggc

SEQ ID NO: 418856 - RNA, 20 nt, Bordetella pertussis
acucgaccgccgggacaggc

SEQ ID NO: 418857 - RNA, 18 nt, Bordetella pertussis
acucgaggcggcgcagga

SEQ ID NO: 418858 - RNA, 17 nt, Bordetella pertussis
acucgaugcccagcacc

SEQ ID NO: 418859 - RNA, 13 nt, Bordetella pertussis
acucgauggccuc

SEQ ID NO: 418860 - RNA, 20 nt, Bordetella pertussis
acucggaagacauggcgcgc

SEQ ID NO: 418861 - RNA, 14 nt, Bordetella pertussis
acucggccaccugg

SEQ ID NO: 418862 - RNA, 16 nt, Bordetella pertussis
acucuaguucuauaua

SEQ ID NO: 418863 - RNA, 20 nt, Bordetella pertussis
acucugccgugggacaggca

SEQ ID NO: 418864 - RNA, 16 nt, Bordetella pertussis
acucuuuuggagaugu

SEQ ID NO: 418865 - RNA, 20 nt, Bordetella pertussis
acugcacgcgguccacgccg

SEQ ID NO: 418866 - RNA, 15 nt, Bordetella pertussis
acugcaccugcucca

SEQ ID NO: 418867 - RNA, 15 nt, Bordetella pertussis
acugccauccucguc

SEQ ID NO: 418868 - RNA, 23 nt, Bordetella pertussis
acugccccauggcaugcaccgcg

SEQ ID NO: 418869 - RNA, 13 nt, Bordetella pertussis
acugccugcagcg

SEQ ID NO: 418870 - RNA, 22 nt, Bordetella pertussis
acugcgcaugggcgcaggccgc

SEQ ID NO: 418871 - RNA, 15 nt, Bordetella pertussis
acugcggcgccuggg

SEQ ID NO: 418872 - RNA, 23 nt, Bordetella pertussis
acugcucgaccgcuucggucagc

SEQ ID NO: 418873 - RNA, 14 nt, Bordetella pertussis
acugcuugcgcgug

SEQ ID NO: 418874 - RNA, 20 nt, Bordetella pertussis
acuggaucuuggccuguucg

SEQ ID NO: 418875 - RNA, 17 nt, Bordetella pertussis
acuggauguacgucagc

SEQ ID NO: 418876 - RNA, 16 nt, Bordetella pertussis
acuggcaccugcaaga

SEQ ID NO: 418877 - RNA, 20 nt, Bordetella pertussis
acuggcacccgcaagauuuc

SEQ ID NO: 418878 - RNA, 24 nt, Bordetella pertussis
acuggccgauggucagcaugucga

SEQ ID NO: 418879 - RNA, 22 nt, Bordetella pertussis
acuggcgcgcgcaagccgccgc

SEQ ID NO: 418880 - RNA, 14 nt, Bordetella pertussis
acuggcuaaaagga

SEQ ID NO: 418881 - RNA, 19 nt, Bordetella pertussis
acuggcuaaaaggaaauau

SEQ ID NO: 418882 - RNA, 15 nt, Bordetella pertussis
acuggcuggucaggc

SEQ ID NO: 418883 - RNA, 18 nt, Bordetella pertussis
acugggcgccggccagga

SEQ ID NO: 418884 - RNA, 20 nt, Bordetella pertussis
acuggggcgcucgaaaaagc

SEQ ID NO: 418885 - RNA, 14 nt, Bordetella pertussis
acugggggacuggc

SEQ ID NO: 418886 - RNA, 15 nt, Bordetella pertussis
acugggggacuggca

SEQ ID NO: 418887 - RNA, 12 nt, Bordetella pertussis
acugggugcugg

SEQ ID NO: 418888 - RNA, 19 nt, Bordetella pertussis
acuggguuuuuccggcucu

SEQ ID NO: 418889 - RNA, 22 nt, Bordetella pertussis
acugucggcguuccuggcgcug

SEQ ID NO: 418890 - RNA, 21 nt, Bordetella pertussis
acuuccggggagccugccccg

SEQ ID NO: 418891 - RNA, 20 nt, Bordetella pertussis
acuuuucgucgucguucugc

SEQ ID NO: 418892 - RNA, 15 nt, Bordetella pertussis
agaaaccccagggga

SEQ ID NO: 418893 - RNA, 23 nt, Bordetella pertussis
agaacagcagauggcccuugccc

SEQ ID NO: 418894 - RNA, 12 nt, Bordetella pertussis
agaacagcagcg

SEQ ID NO: 418895 - RNA, 18 nt, Bordetella pertussis
agaacgcguaggucaggc

SEQ ID NO: 418896 - RNA, 17 nt, Bordetella pertussis
agaacuucacgccgagg

SEQ ID NO: 418897 - RNA, 15 nt, Bordetella pertussis
agaagaacagcagau

SEQ ID NO: 418898 - RNA, 14 nt, Bordetella pertussis
agaagaagccgggc

SEQ ID NO: 418899 - RNA, 15 nt, Bordetella pertussis
agaagaagccgggcu

SEQ ID NO: 418900 - RNA, 15 nt, Bordetella pertussis
agaaguaggcggcca

SEQ ID NO: 418901 - RNA, 18 nt, Bordetella pertussis
agaaguaggcggccaggc

SEQ ID NO: 418902 - RNA, 18 nt, Bordetella pertussis
agaauguauuggcccagu

SEQ ID NO: 418903 - RNA, 16 nt, Bordetella pertussis
agaccaccagcaggau

SEQ ID NO: 418904 - RNA, 20 nt, Bordetella pertussis
agaccugcgggccgcacagc

SEQ ID NO: 418905 - RNA, 17 nt, Bordetella pertussis
agacgaccgaaaagccc

SEQ ID NO: 418906 - RNA, 16 nt, Bordetella pertussis
agacggccagcgcgcg

SEQ ID NO: 418907 - RNA, 13 nt, Bordetella pertussis
agacggcggcugg

SEQ ID NO: 418908 - RNA, 22 nt, Bordetella pertussis
agacgguaucuguccccgcggg

SEQ ID NO: 418909 - RNA, 14 nt, Bordetella pertussis
agagccuggagcuc

SEQ ID NO: 418910 - RNA, 16 nt, Bordetella pertussis
agagccugggcgcgcg

SEQ ID NO: 418911 - RNA, 22 nt, Bordetella pertussis
agagccugggcgcgcgcccagg

SEQ ID NO: 418912 - RNA, 23 nt, Bordetella pertussis
agagccugucccgacggggacag

SEQ ID NO: 418913 - RNA, 15 nt, Bordetella pertussis
agagcgccacgccag

SEQ ID NO: 418914 - RNA, 12 nt, Bordetella pertussis
agagcugcggcg

SEQ ID NO: 418915 - RNA, 16 nt, Bordetella pertussis
agagggucuggcggcc

SEQ ID NO: 418916 - RNA, 21 nt, Bordetella pertussis
agauaccggcauggcagcaga

SEQ ID NO: 418917 - RNA, 15 nt, Bordetella pertussis
agauaccguccuuga

SEQ ID NO: 418918 - RNA, 16 nt, Bordetella pertussis
agauagcccagcaccu

SEQ ID NO: 418919 - RNA, 20 nt, Bordetella pertussis
agauagucgcggaugcgcgc

SEQ ID NO: 418920 - RNA, 18 nt, Bordetella pertussis
agaucaacaaggcgacgg

SEQ ID NO: 418921 - RNA, 20 nt, Bordetella pertussis
agaucaggcggcugcccacc

SEQ ID NO: 418922 - RNA, 21 nt, Bordetella pertussis
agaucaugaauaugcgcccga

SEQ ID NO: 418923 - RNA, 19 nt, Bordetella pertussis
agauccacgcccgcgccga

SEQ ID NO: 418924 - RNA, 20 nt, Bordetella pertussis
agauccgguaugccugccag

SEQ ID NO: 418925 - RNA, 19 nt, Bordetella pertussis
agaucgauccagaagauau

SEQ ID NO: 418926 - RNA, 17 nt, Bordetella pertussis
agaucgauaccgucgcg

SEQ ID NO: 418927 - RNA, 15 nt, Bordetella pertussis
agaucgccuggggca

SEQ ID NO: 418928 - RNA, 19 nt, Bordetella pertussis
agaucggcccggcgccggu

SEQ ID NO: 418929 - RNA, 16 nt, Bordetella pertussis
agaugaucuacgcgcg

SEQ ID NO: 418930 - RNA, 22 nt, Bordetella pertussis
agaugccgaugauggccauggc

SEQ ID NO: 418931 - RNA, 19 nt, Bordetella pertussis
agaugcgacuggcggcugc

SEQ ID NO: 418932 - RNA, 12 nt, Bordetella pertussis
agaugcgcagca

SEQ ID NO: 418933 - RNA, 15 nt, Bordetella pertussis
agaugcgcagcaggc

SEQ ID NO: 418934 - RNA, 17 nt, Bordetella pertussis
agaugcgcgccaggcgc

SEQ ID NO: 418935 - RNA, 20 nt, Bordetella pertussis
agaugcgcgccguacagccg

SEQ ID NO: 418936 - RNA, 19 nt, Bordetella pertussis
agaugcgcggggccaggcg

SEQ ID NO: 418937 - RNA, 15 nt, Bordetella pertussis
agauggccagcagcg

SEQ ID NO: 418938 - RNA, 13 nt, Bordetella pertussis
agauggcccaggg

SEQ ID NO: 418939 - RNA, 14 nt, Bordetella pertussis
agauggccuuuucc

SEQ ID NO: 418940 - RNA, 20 nt, Bordetella pertussis
agauggccuuuuccaggcgu

SEQ ID NO: 418941 - RNA, 12 nt, Bordetella pertussis
agauggcggcga

SEQ ID NO: 418942 - RNA, 16 nt, Bordetella pertussis
agauggguacagcgcg

SEQ ID NO: 418943 - RNA, 18 nt, Bordetella pertussis
agauggguacagcgcgcc

SEQ ID NO: 418944 - RNA, 22 nt, Bordetella pertussis
agaugucaguccucaugcggga

SEQ ID NO: 418945 - RNA, 20 nt, Bordetella pertussis
agauguggucggcgccgagg

SEQ ID NO: 418946 - RNA, 13 nt, Bordetella pertussis
agauuaagacaga

SEQ ID NO: 418947 - RNA, 15 nt, Bordetella pertussis
agauugaacugcugg

SEQ ID NO: 418948 - RNA, 18 nt, Bordetella pertussis
agcgcgaugccaucgcug

SEQ ID NO: 418949 - RNA, 19 nt, Bordetella pertussis
agcgcgaugucgcccaugc

SEQ ID NO: 418950 - RNA, 21 nt, Bordetella pertussis
agcgcgaugucgcccaugcug

SEQ ID NO: 418951 - RNA, 20 nt, Bordetella pertussis
agcgcgauucccuggcgcgc

SEQ ID NO: 418952 - RNA, 19 nt, Bordetella pertussis
agcgcgcaacuccagcaua

SEQ ID NO: 418953 - RNA, 20 nt, Bordetella pertussis
agcgcgcaggaucagcuuga

SEQ ID NO: 418954 - RNA, 12 nt, Bordetella pertussis
agcgcgccagcg

SEQ ID NO: 418955 - RNA, 15 nt, Bordetella pertussis
agcgcgccagcgcgc

SEQ ID NO: 418956 - RNA, 16 nt, Bordetella pertussis
agcgcgcccgaugccu

SEQ ID NO: 418957 - RNA, 20 nt, Bordetella pertussis
agcgcgcccgcuuccuuggg

SEQ ID NO: 418958 - RNA, 17 nt, Bordetella pertussis
agcgcgccgaucaccac

SEQ ID NO: 418959 - RNA, 15 nt, Bordetella pertussis
agcgcgccgccagcg

SEQ ID NO: 418960 - RNA, 22 nt, Bordetella pertussis
agcgcgccgccagcgcgcgcga

SEQ ID NO: 418961 - RNA, 18 nt, Bordetella pertussis
agcgcgccgcgccgggcg

SEQ ID NO: 418962 - RNA, 21 nt, Bordetella pertussis
agcgcgccgcgcgcggcggcc

SEQ ID NO: 418963 - RNA, 22 nt, Bordetella pertussis
agcgcgccgcgcgcggcggccu

SEQ ID NO: 418964 - RNA, 16 nt, Bordetella pertussis
agcgcgccggccaggg

SEQ ID NO: 418965 - RNA, 13 nt, Bordetella pertussis
agcgcgccgggcg

SEQ ID NO: 418966 - RNA, 13 nt, Bordetella pertussis
agcgcgccugccc

SEQ ID NO: 418967 - RNA, 22 nt, Bordetella pertussis
agcgcgccugcccaggccagcg

SEQ ID NO: 418968 - RNA, 22 nt, Bordetella pertussis
agcgcgcgauagauggccaggu

SEQ ID NO: 418969 - RNA, 21 nt, Bordetella pertussis
agcgcgcgggcgauggccacg

SEQ ID NO: 418970 - RNA, 17 nt, Bordetella pertussis
agcgcgcggugccgccu

SEQ ID NO: 418971 - RNA, 14 nt, Bordetella pertussis
agcgcgcucuugga

SEQ ID NO: 418972 - RNA, 18 nt, Bordetella pertussis
agcgcggcaugcgcaugc

SEQ ID NO: 418973 - RNA, 20 nt, Bordetella pertussis
agcgcggcaugcgcaugcug

SEQ ID NO: 418974 - RNA, 21 nt, Bordetella pertussis
agcgcggcaugcgcaugcugg

SEQ ID NO: 418975 - RNA, 13 nt, Bordetella pertussis
agcgcggccagca

SEQ ID NO: 418976 - RNA, 13 nt, Bordetella pertussis
agcgcggccagcg

SEQ ID NO: 418977 - RNA, 14 nt, Bordetella pertussis
agcgcggccaggcg

SEQ ID NO: 418978 - RNA, 17 nt, Bordetella pertussis
agcgcggccaggcgcgu

SEQ ID NO: 418979 - RNA, 13 nt, Bordetella pertussis
agcgcggccaggu

SEQ ID NO: 418980 - RNA, 15 nt, Bordetella pertussis
agcgcggccaggucg

SEQ ID NO: 418981 - RNA, 13 nt, Bordetella pertussis
agcgcggccggca

SEQ ID NO: 418982 - RNA, 21 nt, Bordetella pertussis
agcgcggcgauacgcgccgcc

SEQ ID NO: 418983 - RNA, 23 nt, Bordetella pertussis
agcgcggccucgccggccuggcg

SEQ ID NO: 418984 - RNA, 22 nt, Bordetella pertussis
agcgcggcgccggccuccagca

SEQ ID NO: 418985 - RNA, 14 nt, Bordetella pertussis
agcgcggcgcgcga

SEQ ID NO: 418986 - RNA, 22 nt, Bordetella pertussis
agcgcggcgcgcgccagggcgc

SEQ ID NO: 418987 - RNA, 19 nt, Bordetella pertussis
agcgcggcgcggccagcag

SEQ ID NO: 418988 - RNA, 20 nt, Bordetella pertussis
agcgcggcgcggccagcagc

SEQ ID NO: 418989 - RNA, 17 nt, Bordetella pertussis
agcgcggcggacugcgc

SEQ ID NO: 418990 - RNA, 15 nt, Bordetella pertussis
agcgcggcggcgacc

SEQ ID NO: 418991 - RNA, 13 nt, Bordetella pertussis
agcgcggcggcgu

SEQ ID NO: 418992 - RNA, 14 nt, Bordetella pertussis
agcgcggcgggugc

SEQ ID NO: 418993 - RNA, 15 nt, Bordetella pertussis
agcgcgggccgccgc

SEQ ID NO: 418994 - RNA, 15 nt, Bordetella pertussis
agcgcucggccacgc

SEQ ID NO: 418995 - RNA, 21 nt, Bordetella pertussis
agcgcucgucgggguggaugu

SEQ ID NO: 418996 - RNA, 23 nt, Bordetella pertussis
agcgcugcagccauucggccacu

SEQ ID NO: 418997 - RNA, 18 nt, Bordetella pertussis
agcgcugcaugccccaac

SEQ ID NO: 418998 - RNA, 12 nt, Bordetella pertussis
agcgcugcgccg

SEQ ID NO: 418999 - RNA, 12 nt, Bordetella pertussis
agcgcuggaugg

SEQ ID NO: 419000 - RNA, 17 nt, Bordetella pertussis
agcgcugggcgccagca

SEQ ID NO: 419001 - RNA, 18 nt, Bordetella pertussis
agcgcugggcgccagcag

SEQ ID NO: 419002 - RNA, 21 nt, Bordetella pertussis
agcgcuguccaggccggggcc

SEQ ID NO: 419003 - RNA, 19 nt, Bordetella pertussis
agcggaaacgcgcgcgccc

SEQ ID NO: 419004 - RNA, 21 nt, Bordetella pertussis
agcggaaugaugguggggcug

SEQ ID NO: 419005 - RNA, 16 nt, Bordetella pertussis
agcggacgggccaggc

SEQ ID NO: 419006 - RNA, 17 nt, Bordetella pertussis
agcggacgggccaggcc

SEQ ID NO: 419007 - RNA, 18 nt, Bordetella pertussis
agcggccagcaagcgcgc

SEQ ID NO: 419008 - RNA, 19 nt, Bordetella pertussis
agcggccagcaagcgcgcc

SEQ ID NO: 419009 - RNA, 16 nt, Bordetella pertussis
agcggccagccugccg

SEQ ID NO: 419010 - RNA, 21 nt, Bordetella pertussis
agcggcccgggugggcggcau

SEQ ID NO: 419011 - RNA, 20 nt, Bordetella pertussis
agcggccggccugcgggcug

SEQ ID NO: 419012 - RNA, 18 nt, Bordetella pertussis
agcggccggcgcgcgcga

SEQ ID NO: 419013 - RNA, 13 nt, Bordetella pertussis
agcggccuggccc

SEQ ID NO: 419014 - RNA, 17 nt, Bordetella pertussis
agcggcgagcgcggcga

SEQ ID NO: 419015 - RNA, 18 nt, Bordetella pertussis
agcggcgcagccggccgg

SEQ ID NO: 419016 - RNA, 20 nt, Bordetella pertussis
agcggcgccaugcgcaccac

SEQ ID NO: 419017 - RNA, 21 nt, Bordetella pertussis
agcggcgccgcuuccggcaug

SEQ ID NO: 419018 - RNA, 21 nt, Bordetella pertussis
agcggcgccggaucggccggc

SEQ ID NO: 419019 - RNA, 23 nt, Bordetella pertussis
agcggcgcgcccaccagggugcc

SEQ ID NO: 419020 - RNA, 17 nt, Bordetella pertussis
agcggcgugaugcccag

SEQ ID NO: 419021 - RNA, 19 nt, Bordetella pertussis
agcggcgugaugcccaggc

SEQ ID NO: 419022 - RNA, 22 nt, Bordetella pertussis
agcggcgugcgcgugcaugugu

SEQ ID NO: 419023 - RNA, 19 nt, Bordetella pertussis
agcggcguggcggccaggc

SEQ ID NO: 419024 - RNA, 20 nt, Bordetella pertussis
agcggcguggcggccaggcc

SEQ ID NO: 419025 - RNA, 17 nt, Bordetella pertussis
agcggcguggggccggc

SEQ ID NO: 419026 - RNA, 18 nt, Bordetella pertussis
agcggcgugugcccagca

SEQ ID NO: 419027 - RNA, 17 nt, Bordetella pertussis
agcggcguucugcagcg

SEQ ID NO: 419028 - RNA, 21 nt, Bordetella pertussis
agcggcuccccuggucagggc

SEQ ID NO: 419029 - RNA, 18 nt, Bordetella pertussis
agcggcuucaugccggcg

SEQ ID NO: 419030 - RNA, 22 nt, Bordetella pertussis
agcgggaauucugaacaagggc

SEQ ID NO: 419031 - RNA, 22 nt, Bordetella pertussis
agcgggaauugggcgagcccag

SEQ ID NO: 419032 - RNA, 23 nt, Bordetella pertussis
agcgggauggucgcggccgaggc

SEQ ID NO: 419033 - RNA, 21 nt, Bordetella pertussis
agcgggccagcgcggccaggu

SEQ ID NO: 419034 - RNA, 21 nt, Bordetella pertussis
agcgggcccgucgcgccaggc

SEQ ID NO: 419035 - RNA, 22 nt, Bordetella pertussis
agcgggcccgucgcgccaggcc

SEQ ID NO: 419036 - RNA, 16 nt, Bordetella pertussis
agcgggccgcagcaug

SEQ ID NO: 419037 - RNA, 14 nt, Bordetella pertussis
agcgggccggcacc

SEQ ID NO: 419038 - RNA, 15 nt, Bordetella pertussis
agcgggcuggccagc

SEQ ID NO: 419039 - RNA, 17 nt, Bordetella pertussis
agcgggcuggggcaggc

SEQ ID NO: 419040 - RNA, 20 nt, Bordetella pertussis
agcgggcgcgcccggcgcgc

SEQ ID NO: 419041 - RNA, 11 nt, Bordetella pertussis
agcggggacag

SEQ ID NO: 419042 - RNA, 14 nt, Bordetella pertussis
agcggggacaggca

SEQ ID NO: 419043 - RNA, 14 nt, Bordetella pertussis
agcggggacaggcg

SEQ ID NO: 419044 - RNA, 14 nt, Bordetella pertussis
agcgguagccggcg

SEQ ID NO: 419045 - RNA, 15 nt, Bordetella pertussis
agcgguagccggcgu

SEQ ID NO: 419046 - RNA, 15 nt, Bordetella pertussis
agcgguccagcugcg

SEQ ID NO: 419047 - RNA, 22 nt, Bordetella pertussis
agcgucggcguaaggccgccgg

SEQ ID NO: 419048 - RNA, 19 nt, Bordetella pertussis
agcgucggccugcacgcuc

SEQ ID NO: 419049 - RNA, 16 nt, Bordetella pertussis
agcgucucgggcuggg

SEQ ID NO: 419050 - RNA, 15 nt, Bordetella pertussis
agcgucugcugguac

SEQ ID NO: 419051 - RNA, 18 nt, Bordetella pertussis
agcgucugcugguacagc

SEQ ID NO: 419052 - RNA, 13 nt, Bordetella pertussis
agcgugcgccccg

SEQ ID NO: 419053 - RNA, 23 nt, Bordetella pertussis
agcguggccgaggugcccaucag

SEQ ID NO: 419054 - RNA, 12 nt, Bordetella pertussis
agcguggcggcg

SEQ ID NO: 419055 - RNA, 22 nt, Bordetella pertussis
agcguggggacgcgggccacgc

SEQ ID NO: 419056 - RNA, 16 nt, Bordetella pertussis
agcguguagagcaggc

SEQ ID NO: 419057 - RNA, 13 nt, Bordetella pertussis
agcgugugcagga

SEQ ID NO: 419058 - RNA, 12 nt, Bordetella pertussis
agcucagcagcg

SEQ ID NO: 419059 - RNA, 15 nt, Bordetella pertussis
agcucauggcacagc

SEQ ID NO: 419060 - RNA, 19 nt, Bordetella pertussis
agcucuaugucgccggcca

SEQ ID NO: 419061 - RNA, 15 nt, Bordetella pertussis
agcugcagcccggcc

SEQ ID NO: 419062 - RNA, 14 nt, Bordetella pertussis
agcugcaguaugca

SEQ ID NO: 419063 - RNA, 18 nt, Bordetella pertussis
agcugcaguaugcaaccg

SEQ ID NO: 419064 - RNA, 12 nt, Bordetella pertussis
agcugccgccuu

SEQ ID NO: 419065 - RNA, 13 nt, Bordetella pertussis
agcugccggcauu

SEQ ID NO: 419066 - RNA, 21 nt, Bordetella pertussis
agcugccggcauugcccacca

SEQ ID NO: 419067 - RNA, 15 nt, Bordetella pertussis
agcugcgcagcgacu

SEQ ID NO: 419068 - RNA, 18 nt, Bordetella pertussis
agcugcgcccccucuucu

SEQ ID NO: 419069 - RNA, 12 nt, Bordetella pertussis
agcugcgccgca

SEQ ID NO: 419070 - RNA, 13 nt, Bordetella pertussis
agcugcgcgagga

SEQ ID NO: 419071 - RNA, 21 nt, Bordetella pertussis
agcugcuugcccaggccggcg

SEQ ID NO: 419072 - RNA, 19 nt, Bordetella pertussis
agcuggaccccuugcggcc

SEQ ID NO: 419073 - RNA, 22 nt, Bordetella pertussis
agcuggacuauggccuggaugu

SEQ ID NO: 419074 - RNA, 22 nt, Bordetella pertussis
agcuggaucuggugaaacagca

SEQ ID NO: 419075 - RNA, 22 nt, Bordetella pertussis
agcuggcguucgucgccuccca

SEQ ID NO: 419076 - RNA, 15 nt, Bordetella pertussis
agcuggcuggccagc

SEQ ID NO: 419077 - RNA, 13 nt, Bordetella pertussis
agcugggcggcgu

SEQ ID NO: 419078 - RNA, 18 nt, Bordetella pertussis
agcugguccaccaccuuc

SEQ ID NO: 419079 - RNA, 13 nt, Bordetella pertussis
agcuguugcagcg

SEQ ID NO: 419080 - RNA, 17 nt, Bordetella pertussis
agcuucagccugggccu

SEQ ID NO: 419081 - RNA, 21 nt, Bordetella pertussis
agcuucaucaccuucccgcuu

SEQ ID NO: 419082 - RNA, 22 nt, Bordetella pertussis
agcuucgcccccgauccccugc

SEQ ID NO: 419083 - RNA, 17 nt, Bordetella pertussis
agcuucuggaucaccgc

SEQ ID NO: 419084 - RNA, 22 nt, Bordetella pertussis
agcuucuucuuugcccuggcca

SEQ ID NO: 419085 - RNA, 17 nt, Bordetella pertussis
agcuugaccgccuccag

SEQ ID NO: 419086 - RNA, 17 nt, Bordetella pertussis
agcuugacguccagcca

SEQ ID NO: 419087 - RNA, 16 nt, Bordetella pertussis
agcuugaugccgccga

SEQ ID NO: 419088 - RNA, 17 nt, Bordetella pertussis
agcuugaugggcgaggc

SEQ ID NO: 419089 - RNA, 13 nt, Bordetella pertussis
agcuugcccacgc

SEQ ID NO: 419090 - RNA, 12 nt, Bordetella pertussis
agcuugcgcgcc

SEQ ID NO: 419091 - RNA, 21 nt, Bordetella pertussis
agcuugcgcgcccccacgccg

SEQ ID NO: 419092 - RNA, 23 nt, Bordetella pertussis
agcuugcgcgcccccacgccgcu

SEQ ID NO: 419093 - RNA, 17 nt, Bordetella pertussis
agcuugcgcgccuuggc

SEQ ID NO: 419094 - RNA, 13 nt, Bordetella pertussis
agcuuggccaggc

SEQ ID NO: 419095 - RNA, 10 nt, Bordetella pertussis
agcuuggccu

SEQ ID NO: 419096 - RNA, 20 nt, Bordetella pertussis
agcuugggcuugauggccag

SEQ ID NO: 419097 - RNA, 18 nt, Bordetella pertussis
aggaaaaccuccuccgcg

SEQ ID NO: 419098 - RNA, 16 nt, Bordetella pertussis
aggaaaccgaccugau

SEQ ID NO: 419099 - RNA, 15 nt, Bordetella pertussis
aggaaaucaggcgca

SEQ ID NO: 419100 - RNA, 19 nt, Bordetella pertussis
aggaacagccugcccucgg

SEQ ID NO: 419101 - RNA, 15 nt, Bordetella pertussis
aggaacgccagcagc

SEQ ID NO: 419102 - RNA, 22 nt, Bordetella pertussis
aggaacuggacggcgcugggga

SEQ ID NO: 419103 - RNA, 22 nt, Bordetella pertussis
aggaagacuuccgugccauaca

SEQ ID NO: 419104 - RNA, 19 nt, Bordetella pertussis
aggaagagcuggcgcugcu

SEQ ID NO: 419105 - RNA, 19 nt, Bordetella pertussis
aggaaguccugguuggccu

SEQ ID NO: 419106 - RNA, 17 nt, Bordetella pertussis
aggaauccuggugccag

SEQ ID NO: 419107 - RNA, 17 nt, Bordetella pertussis
aggacaccaugauggcc

SEQ ID NO: 419108 - RNA, 12 nt, Bordetella pertussis
aggacacgcagc

SEQ ID NO: 419109 - RNA, 15 nt, Bordetella pertussis
aggacacgcagcuga

SEQ ID NO: 419110 - RNA, 18 nt, Bordetella pertussis
aggacagccccagcagca

SEQ ID NO: 419111 - RNA, 13 nt, Bordetella pertussis
aggacaggggccu

SEQ ID NO: 419112 - RNA, 22 nt, Bordetella pertussis
aggaccaggaugaugcagcaca

SEQ ID NO: 419113 - RNA, 13 nt, Bordetella pertussis
aggaccccgaagc

SEQ ID NO: 419114 - RNA, 13 nt, Bordetella pertussis
aggaccugcuggc

SEQ ID NO: 419115 - RNA, 22 nt, Bordetella pertussis
aggaccuguacuggcuggucuu

SEQ ID NO: 419116 - RNA, 19 nt, Bordetella pertussis
aggaccuguggcgcacccu

SEQ ID NO: 419117 - RNA, 13 nt, Bordetella pertussis
aggacgacaggca

SEQ ID NO: 419118 - RNA, 15 nt, Bordetella pertussis
aggacgagcggguga

SEQ ID NO: 419119 - RNA, 16 nt, Bordetella pertussis
aggacgccaccagugc

SEQ ID NO: 419120 - RNA, 20 nt, Bordetella pertussis
aggacgcguccucggccagc

SEQ ID NO: 419121 - RNA, 20 nt, Bordetella pertussis
aggacggggaacaggcgcgc

SEQ ID NO: 419122 - RNA, 16 nt, Bordetella pertussis
aggacguuuugcggga

SEQ ID NO: 419123 - RNA, 15 nt, Bordetella pertussis
aggagacacgcuagg

SEQ ID NO: 419124 - RNA, 17 nt, Bordetella pertussis
aggagcaacuggggcgc

SEQ ID NO: 419125 - RNA, 15 nt, Bordetella pertussis
aggagccuguccccg

SEQ ID NO: 419126 - RNA, 21 nt, Bordetella pertussis
aggagccuguccccgcgggga

SEQ ID NO: 419127 - RNA, 17 nt, Bordetella pertussis
aggagcugcacaagguc

SEQ ID NO: 419128 - RNA, 18 nt, Bordetella pertussis
aggauacgugcugcagga

SEQ ID NO: 419129 - RNA, 13 nt, Bordetella pertussis
aggauaucggcca

SEQ ID NO: 419130 - RNA, 23 nt, Bordetella pertussis
aggaucaggaagacuuccgugcc

SEQ ID NO: 419131 - RNA, 17 nt, Bordetella pertussis
aggaucgaaggcagcgc

SEQ ID NO: 419132 - RNA, 15 nt, Bordetella pertussis
aggaucgcggccagc

SEQ ID NO: 419133 - RNA, 13 nt, Bordetella pertussis
aggaugaacaucg

SEQ ID NO: 419134 - RNA, 16 nt, Bordetella pertussis
aggaugagcgccugca

SEQ ID NO: 419135 - RNA, 11 nt, Bordetella pertussis
aggaugaugag

SEQ ID NO: 419136 - RNA, 19 nt, Bordetella pertussis
aggaugcccuuggcggcga

SEQ ID NO: 419137 - RNA, 20 nt, Bordetella pertussis
aggaugcgcaccggccaggg

SEQ ID NO: 419138 - RNA, 18 nt, Bordetella pertussis
aggaugcgcuggccggcc

SEQ ID NO: 419139 - RNA, 13 nt, Bordetella pertussis
aggauggacuggc

SEQ ID NO: 419140 - RNA, 14 nt, Bordetella pertussis
aggauggagagggc

SEQ ID NO: 419141 - RNA, 13 nt, Bordetella pertussis
aggauggcgaggu

SEQ ID NO: 419142 - RNA, 16 nt, Bordetella pertussis
aggaugggcgcggcgc

SEQ ID NO: 419143 - RNA, 14 nt, Bordetella pertussis
aggaugugcagcgc

SEQ ID NO: 419144 - RNA, 20 nt, Bordetella pertussis
aggauuccugcgaggacagg

SEQ ID NO: 419145 - RNA, 21 nt, Bordetella pertussis
aggauuccugcgaggacaggg

SEQ ID NO: 419146 - RNA, 23 nt, Bordetella pertussis
aggauuccugcgaggacaggggc

SEQ ID NO: 419147 - RNA, 16 nt, Bordetella pertussis
aggauuucaccuaccu

SEQ ID NO: 419148 - RNA, 14 nt, Bordetella pertussis
aggcaaagcgcagc

SEQ ID NO: 419149 - RNA, 18 nt, Bordetella pertussis
aggcaagaaucgacucgg

SEQ ID NO: 419150 - RNA, 17 nt, Bordetella pertussis
aggcaaucagccccagg

SEQ ID NO: 419151 - RNA, 19 nt, Bordetella pertussis
aggcaaucgaugaucacgc

SEQ ID NO: 419152 - RNA, 21 nt, Bordetella pertussis
aggcaaucgaugaucacgcgc

SEQ ID NO: 419153 - RNA, 23 nt, Bordetella pertussis
aggcacccgcacgggcagacgcc

SEQ ID NO: 419154 - RNA, 22 nt, Bordetella pertussis
aggcaccccggcgccgcguuca

SEQ ID NO: 419155 - RNA, 17 nt, Bordetella pertussis
aggcaccgagcacagca

SEQ ID NO: 419156 - RNA, 17 nt, Bordetella pertussis
aggcaccgccgcacagc

SEQ ID NO: 419157 - RNA, 21 nt, Bordetella pertussis
aggcaccugcgaccgagccac

SEQ ID NO: 419158 - RNA, 21 nt, Bordetella pertussis
aggcaccugcggugucccucg

SEQ ID NO: 419159 - RNA, 14 nt, Bordetella pertussis
aggcacgccggggu

SEQ ID NO: 419160 - RNA, 22 nt, Bordetella pertussis
aggcacuccggauaccgccgcc

SEQ ID NO: 419161 - RNA, 17 nt, Bordetella pertussis
aggcagccggccccgca

SEQ ID NO: 419162 - RNA, 20 nt, Bordetella pertussis
aggcagcgcggccggcacca

SEQ ID NO: 419163 - RNA, 17 nt, Bordetella pertussis
aggcagcugcgcgucga

SEQ ID NO: 419164 - RNA, 20 nt, Bordetella pertussis
aggcaggggcuccaggaaca

SEQ ID NO: 419165 - RNA, 23 nt, Bordetella pertussis
aggcagugguggugcagcggcag

SEQ ID NO: 419166 - RNA, 18 nt, Bordetella pertussis
aggcaguuggcggcgcag

SEQ ID NO: 419167 - RNA, 22 nt, Bordetella pertussis
aggcaguuggcggcgcagccgc

SEQ ID NO: 419168 - RNA, 22 nt, Bordetella pertussis
aggcaugcgccagcgccugggc

SEQ ID NO: 419169 - RNA, 23 nt, Bordetella pertussis
aggccaccccguugcagcccagc

SEQ ID NO: 419170 - RNA, 18 nt, Bordetella pertussis
aggccacccgaagguggc

SEQ ID NO: 419171 - RNA, 19 nt, Bordetella pertussis
aggccacgaauuccucgcc

SEQ ID NO: 419172 - RNA, 19 nt, Bordetella pertussis
aggccacgaugauggaggc

SEQ ID NO: 419173 - RNA, 13 nt, Bordetella pertussis
aggccagcacgcc

SEQ ID NO: 419174 - RNA, 14 nt, Bordetella pertussis
aggccagcccgcgc

SEQ ID NO: 419175 - RNA, 15 nt, Bordetella pertussis
aggccaggcucagca

SEQ ID NO: 419176 - RNA, 12 nt, Bordetella pertussis
aggccaggcuga

SEQ ID NO: 419177 - RNA, 22 nt, Bordetella pertussis
aggccagguugggugcgccgcc

SEQ ID NO: 419178 - RNA, 23 nt, Bordetella pertussis
aggccaguuccgugcgcgcccga

SEQ ID NO: 419179 - RNA, 22 nt, Bordetella pertussis
aggccaucgccgccgccgggcu

SEQ ID NO: 419180 - RNA, 14 nt, Bordetella pertussis
aggcccagccagcc

SEQ ID NO: 419181 - RNA, 16 nt, Bordetella pertussis
aggcccagccagcccu

SEQ ID NO: 419182 - RNA, 16 nt, Bordetella pertussis
aggcccagcgccagca

SEQ ID NO: 419183 - RNA, 19 nt, Bordetella pertussis
aggcccagcgccagcagca

SEQ ID NO: 419184 - RNA, 23 nt, Bordetella pertussis
aggcccagcgcgccauacugcca

SEQ ID NO: 419185 - RNA, 20 nt, Bordetella pertussis
aggcccagcuugaacaggca

SEQ ID NO: 419186 - RNA, 22 nt, Bordetella pertussis
aggcccagcuugaacaggcagu

SEQ ID NO: 419187 - RNA, 19 nt, Bordetella pertussis
aggcccaggcaaugcgcag

SEQ ID NO: 419188 - RNA, 20 nt, Bordetella pertussis
aggcccaggcgacccagcac

SEQ ID NO: 419189 - RNA, 22 nt, Bordetella pertussis
aggcccagggcgaugcgguacc

SEQ ID NO: 419190 - RNA, 18 nt, Bordetella pertussis
aggcccaugaaggcggcc

SEQ ID NO: 419191 - RNA, 10 nt, Bordetella pertussis
aggcccaugc

SEQ ID NO: 419192 - RNA, 17 nt, Bordetella pertussis
aggcccaugccgcggac

SEQ ID NO: 419193 - RNA, 23 nt, Bordetella pertussis
aggccccgccgggccgcgcccac

SEQ ID NO: 419194 - RNA, 16 nt, Bordetella pertussis
aggcccgacaggaucg

SEQ ID NO: 419195 - RNA, 17 nt, Bordetella pertussis
aggcccgauggcgggga

SEQ ID NO: 419196 - RNA, 19 nt, Bordetella pertussis
aggcccgauggcggggaug

SEQ ID NO: 419197 - RNA, 22 nt, Bordetella pertussis
aggcccgacuuggugggcaccu

SEQ ID NO: 419198 - RNA, 15 nt, Bordetella pertussis
aggcccgcccggggu

SEQ ID NO: 419199 - RNA, 17 nt, Bordetella pertussis
aggcccgcccgggguug

SEQ ID NO: 419200 - RNA, 14 nt, Bordetella pertussis
aggcccgggcgccu

SEQ ID NO: 419201 - RNA, 15 nt, Bordetella pertussis
aggcccuggcggcgc

SEQ ID NO: 419202 - RNA, 15 nt, Bordetella pertussis
aggccgaccaugugg

SEQ ID NO: 419203 - RNA, 22 nt, Bordetella pertussis
aggccgaccauguggcagaugg

SEQ ID NO: 419204 - RNA, 15 nt, Bordetella pertussis
aggccgaggccaggu

SEQ ID NO: 419205 - RNA, 17 nt, Bordetella pertussis
aggccgauagcguucga

SEQ ID NO: 419206 - RNA, 16 nt, Bordetella pertussis
aggccgaugaauugcg

SEQ ID NO: 419207 - RNA, 18 nt, Bordetella pertussis
aggccgaucagcgacagc

SEQ ID NO: 419208 - RNA, 19 nt, Bordetella pertussis
aggccgauguagcccaugg

SEQ ID NO: 419209 - RNA, 17 nt, Bordetella pertussis
aggccgauuucggccgc

SEQ ID NO: 419210 - RNA, 14 nt, Bordetella pertussis
aggccgcccagccg

SEQ ID NO: 419211 - RNA, 10 nt, Bordetella pertussis
aggccgccgc

SEQ ID NO: 419212 - RNA, 16 nt, Bordetella pertussis
aggccgccggccacca

SEQ ID NO: 419213 - RNA, 22 nt, Bordetella pertussis
aggccgccggggaggccucgac

SEQ ID NO: 419214 - RNA, 10 nt, Bordetella pertussis
aggccgccgu

SEQ ID NO: 419215 - RNA, 15 nt, Bordetella pertussis
aggccgcgaacgcgc

SEQ ID NO: 419216 - RNA, 15 nt, Bordetella pertussis
aggccgcgcagggca

SEQ ID NO: 419217 - RNA, 19 nt, Bordetella pertussis
aggccgcgccacaggcgcu

SEQ ID NO: 419218 - RNA, 18 nt, Bordetella pertussis
aggccgcgcgcauccagg

SEQ ID NO: 419219 - RNA, 19 nt, Bordetella pertussis
aggccgcgcgugcggggcg

SEQ ID NO: 419220 - RNA, 18 nt, Bordetella pertussis
aggccgcgcugccagcca

SEQ ID NO: 419221 - RNA, 16 nt, Bordetella pertussis
aggccgcggccaggcc

SEQ ID NO: 419222 - RNA, 19 nt, Bordetella pertussis
aggccgcggccaggcccau

SEQ ID NO: 419223 - RNA, 13 nt, Bordetella pertussis
aggccgcugggca

SEQ ID NO: 419224 - RNA, 18 nt, Bordetella pertussis
aggccgcugggcacaucc

SEQ ID NO: 419225 - RNA, 13 nt, Bordetella pertussis
aggccggccaggg

SEQ ID NO: 419226 - RNA, 14 nt, Bordetella pertussis
aggccggcgaugga

SEQ ID NO: 419227 - RNA, 13 nt, Bordetella pertussis
aggccggcggcga

SEQ ID NO: 419228 - RNA, 20 nt, Bordetella pertussis
aggccggcucgccgcauacc

SEQ ID NO: 419229 - RNA, 16 nt, Bordetella pertussis
aggccgguggaccagg

SEQ ID NO: 419230 - RNA, 18 nt, Bordetella pertussis
aggccguaaccggccagu

SEQ ID NO: 419231 - RNA, 15 nt, Bordetella pertussis
aggccguggcccagc

SEQ ID NO: 419232 - RNA, 15 nt, Bordetella pertussis
aggccucggccaccu

SEQ ID NO: 419233 - RNA, 16 nt, Bordetella pertussis
aggccucggccaccug

SEQ ID NO: 419234 - RNA, 22 nt, Bordetella pertussis
aggccucgugcugcugcaggcg

SEQ ID NO: 419235 - RNA, 18 nt, Bordetella pertussis
aggccugcggcgccagcg

SEQ ID NO: 419236 - RNA, 14 nt, Bordetella pertussis
aggccugcugugcg

SEQ ID NO: 419237 - RNA, 21 nt, Bordetella pertussis
aggccuugccgccgccgcgcg

SEQ ID NO: 419238 - RNA, 17 nt, Bordetella pertussis
aggccuuggccugggcc

SEQ ID NO: 419239 - RNA, 18 nt, Bordetella pertussis
aggcgaaccuggcggggu

SEQ ID NO: 419240 - RNA, 13 nt, Bordetella pertussis
aggcgaauccgca

SEQ ID NO: 419241 - RNA, 15 nt, Bordetella pertussis
aggcgaccggcaccu

SEQ ID NO: 419242 - RNA, 19 nt, Bordetella pertussis
aggcgaccggcaccugggc

SEQ ID NO: 419243 - RNA, 13 nt, Bordetella pertussis
aggcgaggcuggc

SEQ ID NO: 419244 - RNA, 22 nt, Bordetella pertussis
aggcgaggcuggcgcccacgca

SEQ ID NO: 419245 - RNA, 13 nt, Bordetella pertussis
aggcgaugcccag

SEQ ID NO: 419246 - RNA, 23 nt, Bordetella pertussis
aggcgaugggcaccugcuugagc

SEQ ID NO: 419247 - RNA, 17 nt, Bordetella pertussis
aggcgcaccagcgcgcc

SEQ ID NO: 419248 - RNA, 18 nt, Bordetella pertussis
aggcgcagcaggccagga

SEQ ID NO: 419249 - RNA, 19 nt, Bordetella pertussis
aggcgcaguccagcgugga

SEQ ID NO: 419250 - RNA, 12 nt, Bordetella pertussis
aggcgccacagg

SEQ ID NO: 419251 - RNA, 23 nt, Bordetella pertussis
aggcgccaguccccaugcgggga

SEQ ID NO: 419252 - RNA, 13 nt, Bordetella pertussis
aggcgccgcaaca

SEQ ID NO: 419253 - RNA, 15 nt, Bordetella pertussis
aggcgccgcaacagg

SEQ ID NO: 419254 - RNA, 15 nt, Bordetella pertussis
aggcgccgcagaugg

SEQ ID NO: 419255 - RNA, 19 nt, Bordetella pertussis
aggcgcccgagagcugcgu

SEQ ID NO: 419256 - RNA, 15 nt, Bordetella pertussis
aggcgcccgccacca

SEQ ID NO: 419257 - RNA, 16 nt, Bordetella pertussis
aggcgccgccgcccgg

SEQ ID NO: 419258 - RNA, 22 nt, Bordetella pertussis
aggcgccgcguccggcgcccgc

SEQ ID NO: 419259 - RNA, 15 nt, Bordetella pertussis
aggcgccggccaggc

SEQ ID NO: 419260 - RNA, 15 nt, Bordetella pertussis
aggcgccggcuggca

SEQ ID NO: 419261 - RNA, 21 nt, Bordetella pertussis
aggcgccgguccagcgcccga

SEQ ID NO: 419262 - RNA, 22 nt, Bordetella pertussis
aggcgccuacaguuccaccugc

SEQ ID NO: 419263 - RNA, 21 nt, Bordetella pertussis
aggcgccugcucacgccccgc

SEQ ID NO: 419264 - RNA, 23 nt, Bordetella pertussis
aggcgccugagccgauacaggcg

SEQ ID NO: 419265 - RNA, 18 nt, Bordetella pertussis
aggcgcgagcgccgggcg

SEQ ID NO: 419266 - RNA, 20 nt, Bordetella pertussis
aggcgcgagguggcgcucgc

SEQ ID NO: 419267 - RNA, 16 nt, Bordetella pertussis
aggcgcgcaagguggc

SEQ ID NO: 419268 - RNA, 14 nt, Bordetella pertussis
aggcgcgcccgcgu

SEQ ID NO: 419269 - RNA, 22 nt, Bordetella pertussis
aggcgcgccgggccggcgggca

SEQ ID NO: 419270 - RNA, 16 nt, Bordetella pertussis
aggcgcgguccaccuc

SEQ ID NO: 419271 - RNA, 14 nt, Bordetella pertussis
aggcgcgugagguc

SEQ ID NO: 419272 - RNA, 18 nt, Bordetella pertussis
aggcgcguggccacggcg

SEQ ID NO: 419273 - RNA, 21 nt, Bordetella pertussis
aggcgcuccauggcgccggcg

SEQ ID NO: 419274 - RNA, 23 nt, Bordetella pertussis
aggcgcucgcccucgcgccacca

SEQ ID NO: 419275 - RNA, 19 nt, Bordetella pertussis
aggcgcucgcgcgccagca

SEQ ID NO: 419276 - RNA, 21 nt, Bordetella pertussis
aggcgcucggcguugcuggca

SEQ ID NO: 419277 - RNA, 22 nt, Bordetella pertussis
aggcgcugguaaagggcgcgga

SEQ ID NO: 419278 - RNA, 16 nt, Bordetella pertussis
aggcgcuugcgcucgg

SEQ ID NO: 419279 - RNA, 18 nt, Bordetella pertussis
aggcgcuugcgcagggcg

SEQ ID NO: 419280 - RNA, 15 nt, Bordetella pertussis
aggcggccagcaugc

SEQ ID NO: 419281 - RNA, 13 nt, Bordetella pertussis
aggcggcccggcc

SEQ ID NO: 419282 - RNA, 16 nt, Bordetella pertussis
aggcggcccggccgcc

SEQ ID NO: 419283 - RNA, 18 nt, Bordetella pertussis
aggcggcccggccgccgc

SEQ ID NO: 419284 - RNA, 21 nt, Bordetella pertussis
aggcggcccaggcguccaggc

SEQ ID NO: 419285 - RNA, 16 nt, Bordetella pertussis
aggcggccgaccagca

SEQ ID NO: 419286 - RNA, 12 nt, Bordetella pertussis
aggcggccggca

SEQ ID NO: 419287 - RNA, 15 nt, Bordetella pertussis
aggcggccggcaggc

SEQ ID NO: 419288 - RNA, 22 nt, Bordetella pertussis
aggcggcgcaggaugcgcuggc

SEQ ID NO: 419289 - RNA, 13 nt, Bordetella pertussis
aggcggcgcucga

SEQ ID NO: 419290 - RNA, 12 nt, Bordetella pertussis
aggcggcggccu

SEQ ID NO: 419291 - RNA, 19 nt, Bordetella pertussis
aggcggcggugccagcgca

SEQ ID NO: 419292 - RNA, 21 nt, Bordetella pertussis
aggcggcguaguucagccaca

SEQ ID NO: 419293 - RNA, 18 nt, Bordetella pertussis
aggcggcugcccaccuug

SEQ ID NO: 419294 - RNA, 19 nt, Bordetella pertussis
aggcgggacuggcgagcac

SEQ ID NO: 419295 - RNA, 19 nt, Bordetella pertussis
aggcgggcagcauggcgcc

SEQ ID NO: 419296 - RNA, 16 nt, Bordetella pertussis
aggcgggcagcggcga

SEQ ID NO: 419297 - RNA, 13 nt, Bordetella pertussis
aggcgggccaggc

SEQ ID NO: 419298 - RNA, 14 nt, Bordetella pertussis
aggcgggccaggcc

SEQ ID NO: 419299 - RNA, 17 nt, Bordetella pertussis
aggcgguacaggccggc

SEQ ID NO: 419300 - RNA, 22 nt, Bordetella pertussis
aggcgguguagaccaccagcag

SEQ ID NO: 419301 - RNA, 17 nt, Bordetella pertussis
aggcguagaccaccugc

SEQ ID NO: 419302 - RNA, 14 nt, Bordetella pertussis
aggcguacgaggac

SEQ ID NO: 419303 - RNA, 13 nt, Bordetella pertussis
aggcguccaggcu

SEQ ID NO: 419304 - RNA, 13 nt, Bordetella pertussis
aggcgugaggccc

SEQ ID NO: 419305 - RNA, 19 nt, Bordetella pertussis
aggcgugccgcgcaggucg

SEQ ID NO: 419306 - RNA, 17 nt, Bordetella pertussis
aggcgugcugcaccugc

SEQ ID NO: 419307 - RNA, 12 nt, Bordetella pertussis
aggcgugcguga

SEQ ID NO: 419308 - RNA, 15 nt, Bordetella pertussis
aggcguucggccacu

SEQ ID NO: 419309 - RNA, 22 nt, Bordetella pertussis
aggcuaucguggcuggcgagga

SEQ ID NO: 419310 - RNA, 19 nt, Bordetella pertussis
aggcucagcccggcgaggu

SEQ ID NO: 419311 - RNA, 13 nt, Bordetella pertussis
aggcucaggcggc

SEQ ID NO: 419312 - RNA, 19 nt, Bordetella pertussis
aggcucaggcggccagggc

SEQ ID NO: 419313 - RNA, 22 nt, Bordetella pertussis
aggcuccgagggacaccgcagg

SEQ ID NO: 419314 - RNA, 16 nt, Bordetella pertussis
aggcugaaugccgccg

SEQ ID NO: 419315 - RNA, 16 nt, Bordetella pertussis
aggcugacgcccggcu

SEQ ID NO: 419316 - RNA, 15 nt, Bordetella pertussis
aggcugaucacccac

SEQ ID NO: 419317 - RNA, 13 nt, Bordetella pertussis
aggcugccgccgg

SEQ ID NO: 419318 - RNA, 15 nt, Bordetella pertussis
aggcugccgccggcg

SEQ ID NO: 419319 - RNA, 19 nt, Bordetella pertussis
aggcugccgccggcgauga

SEQ ID NO: 419320 - RNA, 22 nt, Bordetella pertussis
aggcugccgucgucguccaggc

SEQ ID NO: 419321 - RNA, 18 nt, Bordetella pertussis
aggcugcgcgcgccagcg

SEQ ID NO: 419322 - RNA, 21 nt, Bordetella pertussis
aggcugcgcgcgccagcgccu

SEQ ID NO: 419323 - RNA, 22 nt, Bordetella pertussis
aggcugcugugccugccaagcg

SEQ ID NO: 419324 - RNA, 15 nt, Bordetella pertussis
aggcuggccugcagg

SEQ ID NO: 419325 - RNA, 22 nt, Bordetella pertussis
aggcugggagagccggccacgc

SEQ ID NO: 419326 - RNA, 18 nt, Bordetella pertussis
aggcuguccccgcaugga

SEQ ID NO: 419327 - RNA, 15 nt, Bordetella pertussis
aggcuucgcccgcca

SEQ ID NO: 419328 - RNA, 16 nt, Bordetella pertussis
aggcuugcagcaacgc

SEQ ID NO: 419329 - RNA, 23 nt, Bordetella pertussis
aggcuugcagcuugcgcgccccc

SEQ ID NO: 419330 - RNA, 17 nt, Bordetella pertussis
aggcuuucgcacagccg

SEQ ID NO: 419331 - RNA, 22 nt, Bordetella pertussis
aggcuuucgcacagccggggcg

SEQ ID NO: 419332 - RNA, 14 nt, Bordetella pertussis
agggacaggcaccg

SEQ ID NO: 419333 - RNA, 22 nt, Bordetella pertussis
agggaccaccccgagauaggcg

SEQ ID NO: 419334 - RNA, 13 nt, Bordetella pertussis
agggagccguucu

SEQ ID NO: 419335 - RNA, 18 nt, Bordetella pertussis
agggcacaucggccaccc

SEQ ID NO: 419336 - RNA, 15 nt, Bordetella pertussis
agggccacgcccagg

SEQ ID NO: 419337 - RNA, 16 nt, Bordetella pertussis
agggccagcgccagca

SEQ ID NO: 419338 - RNA, 11 nt, Bordetella pertussis
agggccaggcc

SEQ ID NO: 419339 - RNA, 15 nt, Bordetella pertussis
agggccauggcaggg

SEQ ID NO: 419340 - RNA, 15 nt, Bordetella pertussis
agggcccagcugcag

SEQ ID NO: 419341 - RNA, 14 nt, Bordetella pertussis
agggccccagcauc

SEQ ID NO: 419342 - RNA, 11 nt, Bordetella pertussis
agggccgcagc

SEQ ID NO: 419343 - RNA, 15 nt, Bordetella pertussis
agggccgccagcacc

SEQ ID NO: 419344 - RNA, 18 nt, Bordetella pertussis
agggccgccagggcggcu

SEQ ID NO: 419345 - RNA, 21 nt, Bordetella pertussis
agggccgcgagcaugcgcagc

SEQ ID NO: 419346 - RNA, 13 nt, Bordetella pertussis
agggccgcggcga

SEQ ID NO: 419347 - RNA, 21 nt, Bordetella pertussis
agggccgcggcgagcucggca

SEQ ID NO: 419348 - RNA, 14 nt, Bordetella pertussis
agggccggaacagc

SEQ ID NO: 419349 - RNA, 15 nt, Bordetella pertussis
agggccggacuggcg

SEQ ID NO: 419350 - RNA, 16 nt, Bordetella pertussis
agggccggcgccagca

SEQ ID NO: 419351 - RNA, 23 nt, Bordetella pertussis
agggccggcgccagcauccggug

SEQ ID NO: 419352 - RNA, 15 nt, Bordetella pertussis
agggccucgcgggcc

SEQ ID NO: 419353 - RNA, 16 nt, Bordetella pertussis
agggccuggcacaucg

SEQ ID NO: 419354 - RNA, 12 nt, Bordetella pertussis
agggccuggcgu

SEQ ID NO: 419355 - RNA, 14 nt, Bordetella pertussis
agggccuggucagc

SEQ ID NO: 419356 - RNA, 18 nt, Bordetella pertussis
agggccuggucagcgccg

SEQ ID NO: 419357 - RNA, 16 nt, Bordetella pertussis
agggcgaacggggugg

SEQ ID NO: 419358 - RNA, 12 nt, Bordetella pertussis
agggcgacggcg

SEQ ID NO: 419359 - RNA, 15 nt, Bordetella pertussis
agggcgacugcagca

SEQ ID NO: 419360 - RNA, 22 nt, Bordetella pertussis
agggcgaucaugcaguacaggc

SEQ ID NO: 419361 - RNA, 19 nt, Bordetella pertussis
agggcgaucuugccggccu

SEQ ID NO: 419362 - RNA, 16 nt, Bordetella pertussis
agggcgaugccgcaga

SEQ ID NO: 419363 - RNA, 19 nt, Bordetella pertussis
agggcgccgcgccggggcg

SEQ ID NO: 419364 - RNA, 16 nt, Bordetella pertussis
agggcgccgggcggau

SEQ ID NO: 419365 - RNA, 15 nt, Bordetella pertussis
agggcgcgccagcac

SEQ ID NO: 419366 - RNA, 16 nt, Bordetella pertussis
agggcgcgccagcacg

SEQ ID NO: 419367 - RNA, 18 nt, Bordetella pertussis
agggcgcggauguggggg

SEQ ID NO: 419368 - RNA, 19 nt, Bordetella pertussis
agggcgcggaugugggggu

SEQ ID NO: 419369 - RNA, 13 nt, Bordetella pertussis
agggcgcggccag

SEQ ID NO: 419370 - RNA, 17 nt, Bordetella pertussis
agggcggaaaacagcac

SEQ ID NO: 419371 - RNA, 22 nt, Bordetella pertussis
agggcggaaaacagcaccagca

SEQ ID NO: 419372 - RNA, 21 nt, Bordetella pertussis
agggcggccucgacggccgcc

SEQ ID NO: 419373 - RNA, 14 nt, Bordetella pertussis
agggcggccaggcc

SEQ ID NO: 419374 - RNA, 15 nt, Bordetella pertussis
agggcggccaugccg

SEQ ID NO: 419375 - RNA, 18 nt, Bordetella pertussis
agggcggggugccugcau

SEQ ID NO: 419376 - RNA, 14 nt, Bordetella pertussis
agggcgucggccgc

SEQ ID NO: 419377 - RNA, 21 nt, Bordetella pertussis
agggcgucugcucgccguucu

SEQ ID NO: 419378 - RNA, 13 nt, Bordetella pertussis
agggcgugcggga

SEQ ID NO: 419379 - RNA, 17 nt, Bordetella pertussis
agggcgugcgggacggc

SEQ ID NO: 419380 - RNA, 14 nt, Bordetella pertussis
agggcgucuucgcc

SEQ ID NO: 419381 - RNA, 18 nt, Bordetella pertussis
agggcguuuuccagcauc

SEQ ID NO: 419382 - RNA, 22 nt, Bordetella pertussis
agggcucgaccgccgccacgcg

SEQ ID NO: 419383 - RNA, 18 nt, Bordetella pertussis
agggcucguagucggugg

SEQ ID NO: 419384 - RNA, 19 nt, Bordetella pertussis
agggcugaucuugaugcgg

SEQ ID NO: 419385 - RNA, 17 nt, Bordetella pertussis
agggcugcgaugcgggc

SEQ ID NO: 419386 - RNA, 21 nt, Bordetella pertussis
agggcugcgugcgggacaggc

SEQ ID NO: 419387 - RNA, 22 nt, Bordetella pertussis
agggcugcgugcgggacaggca

SEQ ID NO: 419388 - RNA, 23 nt, Bordetella pertussis
agggcugcgugcgggacaggcau

SEQ ID NO: 419389 - RNA, 12 nt, Bordetella pertussis
aggggacggcgc

SEQ ID NO: 419390 - RNA, 15 nt, Bordetella pertussis
aggggaugacgggcg

SEQ ID NO: 419391 - RNA, 18 nt, Bordetella pertussis
aggggcaggugccccacg

SEQ ID NO: 419392 - RNA, 17 nt, Bordetella pertussis
aggggccagccuggccu

SEQ ID NO: 419393 - RNA, 22 nt, Bordetella pertussis
aggggccggcuuuggacaggcg

SEQ ID NO: 419394 - RNA, 20 nt, Bordetella pertussis
aggggcggcgcggcgcuggc

SEQ ID NO: 419395 - RNA, 18 nt, Bordetella pertussis
aggggcucggccaggugc

SEQ ID NO: 419396 - RNA, 19 nt, Bordetella pertussis
aggggcucggccaggugcg

SEQ ID NO: 419397 - RNA, 16 nt, Bordetella pertussis
aggggcuguaccuggc

SEQ ID NO: 419398 - RNA, 13 nt, Bordetella pertussis
agggggacuggca

SEQ ID NO: 419399 - RNA, 23 nt, Bordetella pertussis
agggggcgccccaacgcggccag

SEQ ID NO: 419400 - RNA, 20 nt, Bordetella pertussis
agggggcuuuuugccuuggg

SEQ ID NO: 419401 - RNA, 22 nt, Bordetella pertussis
agggggcuuuuuugccuugggg

SEQ ID NO: 419402 - RNA, 17 nt, Bordetella pertussis
agggucaaggcgcggcc

SEQ ID NO: 419403 - RNA, 22 nt, Bordetella pertussis
agggucaggggcaggugcccca

SEQ ID NO: 419404 - RNA, 17 nt, Bordetella pertussis
agggucgagaccagcag

SEQ ID NO: 419405 - RNA, 21 nt, Bordetella pertussis
agggucuggccggugaugcgg

SEQ ID NO: 419406 - RNA, 16 nt, Bordetella pertussis
agggugacgggcuggg

SEQ ID NO: 419407 - RNA, 17 nt, Bordetella pertussis
agggugagugcccaugg

SEQ ID NO: 419408 - RNA, 13 nt, Bordetella pertussis
agggugcaccagg

SEQ ID NO: 419409 - RNA, 14 nt, Bordetella pertussis
agggugccuguccc

SEQ ID NO: 419410 - RNA, 22 nt, Bordetella pertussis
agggugccuguccccgcgggga

SEQ ID NO: 419411 - RNA, 22 nt, Bordetella pertussis
agggugccugucccugccggga

SEQ ID NO: 419412 - RNA, 21 nt, Bordetella pertussis
agggugcggggugccuguccc

SEQ ID NO: 419413 - RNA, 23 nt, Bordetella pertussis
agggugcggggugccuguccccg

SEQ ID NO: 419414 - RNA, 21 nt, Bordetella pertussis
aggguggagaauucggcgcgu

SEQ ID NO: 419415 - RNA, 17 nt, Bordetella pertussis
aggguggcgccggccac

SEQ ID NO: 419416 - RNA, 18 nt, Bordetella pertussis
agggugucggccagggcg

SEQ ID NO: 419417 - RNA, 21 nt, Bordetella pertussis
aggguucggugccuguccccg

SEQ ID NO: 419418 - RNA, 20 nt, Bordetella pertussis
aggguuggcgcgccguggcu

SEQ ID NO: 419419 - RNA, 18 nt, Bordetella pertussis
agguacccgcgccggcgg

SEQ ID NO: 419420 - RNA, 16 nt, Bordetella pertussis
agguagaccacgcaaa

SEQ ID NO: 419421 - RNA, 22 nt, Bordetella pertussis
agguagaucagccgcugcagca

SEQ ID NO: 419422 - RNA, 17 nt, Bordetella pertussis
agguaggcgggacuggc

SEQ ID NO: 419423 - RNA, 22 nt, Bordetella pertussis
agguaguagccgaauccggcca

SEQ ID NO: 419424 - RNA, 18 nt, Bordetella pertussis
agguaucggccagcacgu

SEQ ID NO: 419425 - RNA, 21 nt, Bordetella pertussis
agguaucguucgcgcgcgcgg

SEQ ID NO: 419426 - RNA, 20 nt, Bordetella pertussis
agguauucgcgcgauugcau

SEQ ID NO: 419427 - RNA, 14 nt, Bordetella pertussis
agguauugcucggc

SEQ ID NO: 419428 - RNA, 17 nt, Bordetella pertussis
agguauugcggggcggc

SEQ ID NO: 419429 - RNA, 16 nt, Bordetella pertussis
aggucagcgccuugcc

SEQ ID NO: 419430 - RNA, 16 nt, Bordetella pertussis
aggucaggcccacgcc

SEQ ID NO: 419431 - RNA, 16 nt, Bordetella pertussis
aggucaucgccaggcg

SEQ ID NO: 419432 - RNA, 17 nt, Bordetella pertussis
agguccaguacaccagg

SEQ ID NO: 419433 - RNA, 12 nt, Bordetella pertussis
agguccuggaga

SEQ ID NO: 419434 - RNA, 15 nt, Bordetella pertussis
aggucgccagcaggc

SEQ ID NO: 419435 - RNA, 19 nt, Bordetella pertussis
aggucggacgcgccgggcg

SEQ ID NO: 419436 - RNA, 12 nt, Bordetella pertussis
aggucggccacc

SEQ ID NO: 419437 - RNA, 16 nt, Bordetella pertussis
aggucggcgcggggca

SEQ ID NO: 419438 - RNA, 21 nt, Bordetella pertussis
aggucgggauaguccagcacc

SEQ ID NO: 419439 - RNA, 15 nt, Bordetella pertussis
aggugcacgugggca

SEQ ID NO: 419440 - RNA, 18 nt, Bordetella pertussis
aggugcagaaaccccagg

SEQ ID NO: 419441 - RNA, 19 nt, Bordetella pertussis
aggugcaggguuggcgcgc

SEQ ID NO: 419442 - RNA, 15 nt, Bordetella pertussis
aggugccccacgccg

SEQ ID NO: 419443 - RNA, 19 nt, Bordetella pertussis
aggugcccgcgaagcagcc

SEQ ID NO: 419444 - RNA, 13 nt, Bordetella pertussis
aggugccuguccc

SEQ ID NO: 419445 - RNA, 16 nt, Bordetella pertussis
aggugccuguccccac

SEQ ID NO: 419446 - RNA, 17 nt, Bordetella pertussis
aggugccuguccccacg

SEQ ID NO: 419447 - RNA, 15 nt, Bordetella pertussis
aggugccuguccccc

SEQ ID NO: 419448 - RNA, 22 nt, Bordetella pertussis
aggugccuguccccguggggac

SEQ ID NO: 419449 - RNA, 12 nt, Bordetella pertussis
aggugccgccgg

SEQ ID NO: 419450 - RNA, 18 nt, Bordetella pertussis
aggugcgcagcaggugga

SEQ ID NO: 419451 - RNA, 17 nt, Bordetella pertussis
aggugcgcagccgggcu

SEQ ID NO: 419452 - RNA, 18 nt, Bordetella pertussis
aggugcgcagccgggcug

SEQ ID NO: 419453 - RNA, 15 nt, Bordetella pertussis
aggugcggccgcagc

SEQ ID NO: 419454 - RNA, 22 nt, Bordetella pertussis
agguggcccgcaccgggcggcc

SEQ ID NO: 419455 - RNA, 16 nt, Bordetella pertussis
agguggcggacaggcc

SEQ ID NO: 419456 - RNA, 13 nt, Bordetella pertussis
aggugggccaggu

SEQ ID NO: 419457 - RNA, 14 nt, Bordetella pertussis
aggugggccaggua

SEQ ID NO: 419458 - RNA, 23 nt, Bordetella pertussis
aggugggcgaaccgcggcgcagg

SEQ ID NO: 419459 - RNA, 13 nt, Bordetella pertussis
agguugcaggcca

SEQ ID NO: 419460 - RNA, 15 nt, Bordetella pertussis
agguugcccgcccga

SEQ ID NO: 419461 - RNA, 22 nt, Bordetella pertussis
agguugcgccggcucagccccc

SEQ ID NO: 419462 - RNA, 15 nt, Bordetella pertussis
agguugcggccgcca

SEQ ID NO: 419463 - RNA, 23 nt, Bordetella pertussis
agguugcgguaguucagcagcgc

SEQ ID NO: 419464 - RNA, 20 nt, Bordetella pertussis
agguuuuccacagccaggcc

SEQ ID NO: 419465 - RNA, 23 nt, Bordetella pertussis
aguacaccggcgugcagagcacc

SEQ ID NO: 419466 - RNA, 14 nt, Bordetella pertussis
aguacacggccagc

SEQ ID NO: 419467 - RNA, 17 nt, Bordetella pertussis
aguacacggccagcacg

SEQ ID NO: 419468 - RNA, 19 nt, Bordetella pertussis
agucgccggcuuccagcag

SEQ ID NO: 419469 - RNA, 21 nt, Bordetella pertussis
agucgccggcuuccagcagca

SEQ ID NO: 419470 - RNA, 16 nt, Bordetella pertussis
agugcaggccgcgcag

SEQ ID NO: 419471 - RNA, 23 nt, Bordetella pertussis
agugcgaggacgaccuugcugga

SEQ ID NO: 419472 - RNA, 22 nt, Bordetella pertussis
aguggcucaugguuucgagcau

SEQ ID NO: 419473 - RNA, 22 nt, Bordetella pertussis
agugguaugaccggcgcggccu

SEQ ID NO: 419474 - RNA, 24 nt, Bordetella pertussis
agugguggugcagcggcagcaugg

SEQ ID NO: 419475 - RNA, 13 nt, Bordetella pertussis
aguucggccgcca

SEQ ID NO: 419476 - RNA, 17 nt, Bordetella pertussis
aguucggccgccaggua

SEQ ID NO: 419477 - RNA, 21 nt, Bordetella pertussis
aguucggccggcggcccaucg

SEQ ID NO: 419478 - RNA, 18 nt, Bordetella pertussis
aguucggcgggaucugca

SEQ ID NO: 419479 - RNA, 19 nt, Bordetella pertussis
aguucggcgcggccuugca

SEQ ID NO: 419480 - RNA, 19 nt, Bordetella pertussis
aguucgucgucgccaccgc

SEQ ID NO: 419481 - RNA, 11 nt, Bordetella pertussis
aguugcagcau

SEQ ID NO: 419482 - RNA, 13 nt, Bordetella pertussis
aguuggcagagug

SEQ ID NO: 419483 - RNA, 16 nt, Bordetella pertussis
aguuggcccuucuuca

SEQ ID NO: 419484 - RNA, 19 nt, Bordetella pertussis
auacgugcugcaggaaguc

SEQ ID NO: 419485 - RNA, 19 nt, Bordetella pertussis
auacucgaugcccagcacc

SEQ ID NO: 419486 - RNA, 20 nt, Bordetella pertussis
auagaugcgcggggccaggc

SEQ ID NO: 419487 - RNA, 23 nt, Bordetella pertussis
auagcccggcgcgauggucacca

SEQ ID NO: 419488 - RNA, 17 nt, Bordetella pertussis
auagcggaugaugggca

SEQ ID NO: 419489 - RNA, 17 nt, Bordetella pertussis
auaggcgcgcaccagcc

SEQ ID NO: 419490 - RNA, 14 nt, Bordetella pertussis
auaggcggccaggc

SEQ ID NO: 419491 - RNA, 21 nt, Bordetella pertussis
auagguuguauucguccaggu

SEQ ID NO: 419492 - RNA, 12 nt, Bordetella pertussis
auauccacgcca

SEQ ID NO: 419493 - RNA, 15 nt, Bordetella pertussis
auaucgacggcgccu

SEQ ID NO: 419494 - RNA, 18 nt, Bordetella pertussis
aucaagcggcccgcgccc

SEQ ID NO: 419495 - RNA, 13 nt, Bordetella pertussis
aucaaggcccgga

SEQ ID NO: 419496 - RNA, 21 nt, Bordetella pertussis
aucaaugacauggccacggcc

SEQ ID NO: 419497 - RNA, 20 nt, Bordetella pertussis
aucacaucgcuaugcagcug

SEQ ID NO: 419498 - RNA, 17 nt, Bordetella pertussis
aucaccaccggcaaggc

SEQ ID NO: 419499 - RNA, 11 nt, Bordetella pertussis
aucaccgccau

SEQ ID NO: 419500 - RNA, 13 nt, Bordetella pertussis
aucaccugcaggc

SEQ ID NO: 419501 - RNA, 12 nt, Bordetella pertussis
aucaccugggca

SEQ ID NO: 419502 - RNA, 17 nt, Bordetella pertussis
aucacgaacagcgccag

SEQ ID NO: 419503 - RNA, 18 nt, Bordetella pertussis
aucacgaacagcgccagg

SEQ ID NO: 419504 - RNA, 18 nt, Bordetella pertussis
aucacgcuggccgcgccc

SEQ ID NO: 419505 - RNA, 20 nt, Bordetella pertussis
aucacgggcgccagcagcgg

SEQ ID NO: 419506 - RNA, 23 nt, Bordetella pertussis
aucacgugguccacgaagcaggu

SEQ ID NO: 419507 - RNA, 14 nt, Bordetella pertussis
aucagaaaggcagc

SEQ ID NO: 419508 - RNA, 17 nt, Bordetella pertussis
aucagauggcgcagcgg

SEQ ID NO: 419509 - RNA, 21 nt, Bordetella pertussis
aucagcaagggccccagcauc

SEQ ID NO: 419510 - RNA, 17 nt, Bordetella pertussis
aucagcaggcccaccag

SEQ ID NO: 419511 - RNA, 10 nt, Bordetella pertussis
aucagccacc

SEQ ID NO: 419512 - RNA, 18 nt, Bordetella pertussis
aucagcgacagcaggguc

SEQ ID NO: 419513 - RNA, 15 nt, Bordetella pertussis
aucagcgccugcagg

SEQ ID NO: 419514 - RNA, 14 nt, Bordetella pertussis
aucagcgcgggcca

SEQ ID NO: 419515 - RNA, 16 nt, Bordetella pertussis
aucagcucgaccacgg

SEQ ID NO: 419516 - RNA, 17 nt, Bordetella pertussis
aucagcucgaccacggc

SEQ ID NO: 419517 - RNA, 23 nt, Bordetella pertussis
auccuuuuuguuuuggcgcacgc

SEQ ID NO: 419518 - RNA, 13 nt, Bordetella pertussis
aucgagcaccgcc

SEQ ID NO: 419519 - RNA, 20 nt, Bordetella pertussis
aucgagcauugccgcggcaa

SEQ ID NO: 419520 - RNA, 16 nt, Bordetella pertussis
aucgaggaaggcccgc

SEQ ID NO: 419521 - RNA, 17 nt, Bordetella pertussis
aucgaggcaaucagccc

SEQ ID NO: 419522 - RNA, 16 nt, Bordetella pertussis
aucgagguggcgggcg

SEQ ID NO: 419523 - RNA, 17 nt, Bordetella pertussis
aucgauaugggcggccu

SEQ ID NO: 419524 - RNA, 16 nt, Bordetella pertussis
aucgcagcagaaugua

SEQ ID NO: 419525 - RNA, 18 nt, Bordetella pertussis
aucgcccaccaugagcac

SEQ ID NO: 419526 - RNA, 20 nt, Bordetella pertussis
aucgcccauugcggcgggcg

SEQ ID NO: 419527 - RNA, 19 nt, Bordetella pertussis
aucgcccauuuccuguucg

SEQ ID NO: 419528 - RNA, 23 nt, Bordetella pertussis
aucgcccugaaaaccaaggaguc

SEQ ID NO: 419529 - RNA, 16 nt, Bordetella pertussis
aucgcgagugcuucca

SEQ ID NO: 419530 - RNA, 16 nt, Bordetella pertussis
aucgcgcaagggccag

SEQ ID NO: 419531 - RNA, 18 nt, Bordetella pertussis
aucgcgcagcgccuggcc

SEQ ID NO: 419532 - RNA, 13 nt, Bordetella pertussis
aucgcgccaggcg

SEQ ID NO: 419533 - RNA, 18 nt, Bordetella pertussis
aucgcgccuucggcgcgc

SEQ ID NO: 419534 - RNA, 13 nt, Bordetella pertussis
aucgcgcuggacc

SEQ ID NO: 419535 - RNA, 15 nt, Bordetella pertussis
aucgcgcuggcgcgc

SEQ ID NO: 419536 - RNA, 16 nt, Bordetella pertussis
aucgcggccagcggca

SEQ ID NO: 419537 - RNA, 19 nt, Bordetella pertussis
aucgcggcgcggcgcaggc

SEQ ID NO: 419538 - RNA, 21 nt, Bordetella pertussis
aucgcggcgcggcgcaggccu

SEQ ID NO: 419539 - RNA, 18 nt, Bordetella pertussis
aucgcggcggguggccuc

SEQ ID NO: 419540 - RNA, 13 nt, Bordetella pertussis
aucgcgucggcca

SEQ ID NO: 419541 - RNA, 21 nt, Bordetella pertussis
aucgcguucguggaugacucg

SEQ ID NO: 419542 - RNA, 17 nt, Bordetella pertussis
aucggagguaugcacga

SEQ ID NO: 419543 - RNA, 23 nt, Bordetella pertussis
aucggccacgcugcccugcugcu

SEQ ID NO: 419544 - RNA, 17 nt, Bordetella pertussis
aucggccaggccggccu

SEQ ID NO: 419545 - RNA, 15 nt, Bordetella pertussis
aucggccaggcgccu

SEQ ID NO: 419546 - RNA, 18 nt, Bordetella pertussis
aucggcccguuccacagg

SEQ ID NO: 419547 - RNA, 15 nt, Bordetella pertussis
aucggccggccgggc

SEQ ID NO: 419548 - RNA, 17 nt, Bordetella pertussis
aucgggagccucuggaa

SEQ ID NO: 419549 - RNA, 23 nt, Bordetella pertussis
aucgggagccucuggaagacgga

SEQ ID NO: 419550 - RNA, 21 nt, Bordetella pertussis
aucgggauccgugcggcgcgc

SEQ ID NO: 419551 - RNA, 14 nt, Bordetella pertussis
aucggggggcaggc

SEQ ID NO: 419552 - RNA, 20 nt, Bordetella pertussis
aucggugcggccgguggcga

SEQ ID NO: 419553 - RNA, 18 nt, Bordetella pertussis
aucgucgaacuuguucuu

SEQ ID NO: 419554 - RNA, 14 nt, Bordetella pertussis
aucgucgcgcuggg

SEQ ID NO: 419555 - RNA, 17 nt, Bordetella pertussis
aucgucgcgcuggggca

SEQ ID NO: 419556 - RNA, 18 nt, Bordetella pertussis
aucgucggacaacgccag

SEQ ID NO: 419557 - RNA, 20 nt, Bordetella pertussis
aucgucggcaaccgucgcca

SEQ ID NO: 419558 - RNA, 14 nt, Bordetella pertussis
aucguggccgcgca

SEQ ID NO: 419559 - RNA, 14 nt, Bordetella pertussis
aucguucccuaccc

SEQ ID NO: 419560 - RNA, 14 nt, Bordetella pertussis
aucuacagcgccug

SEQ ID NO: 419561 - RNA, 18 nt, Bordetella pertussis
aucuacgcgcgcgccggc

SEQ ID NO: 419562 - RNA, 14 nt, Bordetella pertussis
aucuacgugcugga

SEQ ID NO: 419563 - RNA, 16 nt, Bordetella pertussis
aucucagccaucauca

SEQ ID NO: 419564 - RNA, 16 nt, Bordetella pertussis
aucuccacgaaggcga

SEQ ID NO: 419565 - RNA, 11 nt, Bordetella pertussis
aucuccaggau

SEQ ID NO: 419566 - RNA, 14 nt, Bordetella pertussis
aucucccggcgccc

SEQ ID NO: 419567 - RNA, 18 nt, Bordetella pertussis
aucuccgggagccugucc

SEQ ID NO: 419568 - RNA, 16 nt, Bordetella pertussis
aucucgcccugcucgc

SEQ ID NO: 419569 - RNA, 16 nt, Bordetella pertussis
aucucggcaucggcca

SEQ ID NO: 419570 - RNA, 22 nt, Bordetella pertussis
aucucggcaucggccacgcugc

SEQ ID NO: 419571 - RNA, 15 nt, Bordetella pertussis
aucucggccagcagc

SEQ ID NO: 419572 - RNA, 13 nt, Bordetella pertussis
aucucgucgguca

SEQ ID NO: 419573 - RNA, 19 nt, Bordetella pertussis
aucugcggaaacagauuga

SEQ ID NO: 419574 - RNA, 20 nt, Bordetella pertussis
aucuggccgauggccucgcu

SEQ ID NO: 419575 - RNA, 13 nt, Bordetella pertussis
aucuggccugucu

SEQ ID NO: 419576 - RNA, 18 nt, Bordetella pertussis
aucuggcgcauggccggc

SEQ ID NO: 419577 - RNA, 19 nt, Bordetella pertussis
aucuggcgcgcgaccaggc

SEQ ID NO: 419578 - RNA, 19 nt, Bordetella pertussis
aucugggcgucgaaggcgg

SEQ ID NO: 419579 - RNA, 15 nt, Bordetella pertussis
aucuugaugccgccc

SEQ ID NO: 419580 - RNA, 15 nt, Bordetella pertussis
augaaacugcaaaau

SEQ ID NO: 419581 - RNA, 16 nt, Bordetella pertussis
augaagaccacgugga

SEQ ID NO: 419582 - RNA, 17 nt, Bordetella pertussis
augaagaccacguggau

SEQ ID NO: 419583 - RNA, 15 nt, Bordetella pertussis
augaagaugccgaac

SEQ ID NO: 419584 - RNA, 16 nt, Bordetella pertussis
augaagcugcccagca

SEQ ID NO: 419585 - RNA, 17 nt, Bordetella pertussis
augaagcugcccagcaa

SEQ ID NO: 419586 - RNA, 14 nt, Bordetella pertussis
augaagcgcagcag

SEQ ID NO: 419587 - RNA, 16 nt, Bordetella pertussis
augaaggcggccagca

SEQ ID NO: 419588 - RNA, 19 nt, Bordetella pertussis
augaaggcggccagcaugc

SEQ ID NO: 419589 - RNA, 12 nt, Bordetella pertussis
augaagggcugg

SEQ ID NO: 419590 - RNA, 17 nt, Bordetella pertussis
augaagggcuggccggc

SEQ ID NO: 419591 - RNA, 16 nt, Bordetella pertussis
augaaggugcgcagca

SEQ ID NO: 419592 - RNA, 23 nt, Bordetella pertussis
augaaggugcgcagcagguggau

SEQ ID NO: 419593 - RNA, 21 nt, Bordetella pertussis
augaaucgcaugcgguuucuc

SEQ ID NO: 419594 - RNA, 20 nt, Bordetella pertussis
augaauuccagccaggccuc

SEQ ID NO: 419595 - RNA, 19 nt, Bordetella pertussis
augaccagccagccgccgc

SEQ ID NO: 419596 - RNA, 19 nt, Bordetella pertussis
augaugagcgcgccgccgu

SEQ ID NO: 419597 - RNA, 22 nt, Bordetella pertussis
augauggccggccugccggcgc

SEQ ID NO: 419598 - RNA, 14 nt, Bordetella pertussis
augauggugcugcc

SEQ ID NO: 419599 - RNA, 14 nt, Bordetella pertussis
augcaagacaggcc

SEQ ID NO: 419600 - RNA, 19 nt, Bordetella pertussis
augcagccgcaccagcgca

SEQ ID NO: 419601 - RNA, 24 nt, Bordetella pertussis
augcagguccugguaucccucgcc

SEQ ID NO: 419602 - RNA, 15 nt, Bordetella pertussis
augcaggucggggcg

SEQ ID NO: 419603 - RNA, 17 nt, Bordetella pertussis
augcaggucggggcgcu

SEQ ID NO: 419604 - RNA, 12 nt, Bordetella pertussis
augccaaggauc

SEQ ID NO: 419605 - RNA, 19 nt, Bordetella pertussis
augccagcggcgcagccgg

SEQ ID NO: 419606 - RNA, 17 nt, Bordetella pertussis
augcccagcgccgccga

SEQ ID NO: 419607 - RNA, 16 nt, Bordetella pertussis
augcccaggaugcccu

SEQ ID NO: 419608 - RNA, 19 nt, Bordetella pertussis
augcccaugcgcugcgccu

SEQ ID NO: 419609 - RNA, 13 nt, Bordetella pertussis
augcccgaccgca

SEQ ID NO: 419610 - RNA, 15 nt, Bordetella pertussis
augcccuccucggcc

SEQ ID NO: 419611 - RNA, 23 nt, Bordetella pertussis
augcccucuucggcggccagccg

SEQ ID NO: 419612 - RNA, 19 nt, Bordetella pertussis
augccgaacagccagggca

SEQ ID NO: 419613 - RNA, 14 nt, Bordetella pertussis
augccgaccaggcc

SEQ ID NO: 419614 - RNA, 19 nt, Bordetella pertussis
augccgaccgaagaggagc

SEQ ID NO: 419615 - RNA, 17 nt, Bordetella pertussis
augccgauggcgguggu

SEQ ID NO: 419616 - RNA, 19 nt, Bordetella pertussis
augccgauguggcgguucc

SEQ ID NO: 419617 - RNA, 16 nt, Bordetella pertussis
augccgauugugcaug

SEQ ID NO: 419618 - RNA, 19 nt, Bordetella pertussis
augccgcagauggccagca

SEQ ID NO: 419619 - RNA, 14 nt, Bordetella pertussis
augccgcagcacca

SEQ ID NO: 419620 - RNA, 21 nt, Bordetella pertussis
augccgcccacgaucaccacg

SEQ ID NO: 419621 - RNA, 13 nt, Bordetella pertussis
augccgcccagca

SEQ ID NO: 419622 - RNA, 15 nt, Bordetella pertussis
augccgccaucaucc

SEQ ID NO: 419623 - RNA, 12 nt, Bordetella pertussis
augccgcccgca

SEQ ID NO: 419624 - RNA, 23 nt, Bordetella pertussis
augccgcccgcaugcagguccug

SEQ ID NO: 419625 - RNA, 18 nt, Bordetella pertussis
augccgccuucgagcugg

SEQ ID NO: 419626 - RNA, 18 nt, Bordetella pertussis
augccgcgcaccugggcg

SEQ ID NO: 419627 - RNA, 16 nt, Bordetella pertussis
augccgcugaccagca

SEQ ID NO: 419628 - RNA, 14 nt, Bordetella pertussis
augccggaaaucac

SEQ ID NO: 419629 - RNA, 15 nt, Bordetella pertussis
augccggccagcagc

SEQ ID NO: 419630 - RNA, 19 nt, Bordetella pertussis
augccggccaugcucagca

SEQ ID NO: 419631 - RNA, 15 nt, Bordetella pertussis
augccggccucggcc

SEQ ID NO: 419632 - RNA, 17 nt, Bordetella pertussis
augccggccucggccau

SEQ ID NO: 419633 - RNA, 15 nt, Bordetella pertussis
augccggcggcgccu

SEQ ID NO: 419634 - RNA, 23 nt, Bordetella pertussis
augccggcguucuggucagccgu

SEQ ID NO: 419635 - RNA, 18 nt, Bordetella pertussis
augccggcguugaaggcg

SEQ ID NO: 419636 - RNA, 19 nt, Bordetella pertussis
augccgggcaagcagaugg

SEQ ID NO: 419637 - RNA, 19 nt, Bordetella pertussis
augccguacacguugggga

SEQ ID NO: 419638 - RNA, 19 nt, Bordetella pertussis
augccguccugcugcggca

SEQ ID NO: 419639 - RNA, 15 nt, Bordetella pertussis
augccguccuggccg

SEQ ID NO: 419640 - RNA, 21 nt, Bordetella pertussis
augccucgaagcggcucaggc

SEQ ID NO: 419641 - RNA, 15 nt, Bordetella pertussis
augccuucgacggcg

SEQ ID NO: 419642 - RNA, 17 nt, Bordetella pertussis
augccuugcgcgacagc

SEQ ID NO: 419643 - RNA, 20 nt, Bordetella pertussis
augcgaugcugcagggccug

SEQ ID NO: 419644 - RNA, 12 nt, Bordetella pertussis
augcgcaccagg

SEQ ID NO: 419645 - RNA, 18 nt, Bordetella pertussis
augcgcaccaugcgcagc

SEQ ID NO: 419646 - RNA, 19 nt, Bordetella pertussis
augcgcacgggcgagggcu

SEQ ID NO: 419647 - RNA, 20 nt, Bordetella pertussis
augcgcacgggcgagggcug

SEQ ID NO: 419648 - RNA, 11 nt, Bordetella pertussis
augcgcagcag

SEQ ID NO: 419649 - RNA, 14 nt, Bordetella pertussis
augcgcagcaggcg

SEQ ID NO: 419650 - RNA, 23 nt, Bordetella pertussis
augcgcaucgcgaccgccaagca

SEQ ID NO: 419651 - RNA, 16 nt, Bordetella pertussis
auggcacggcacgccu

SEQ ID NO: 419652 - RNA, 21 nt, Bordetella pertussis
auggcagcagaucggcggccu

SEQ ID NO: 419653 - RNA, 19 nt, Bordetella pertussis
auggcaggguccgucggau

SEQ ID NO: 419654 - RNA, 23 nt, Bordetella pertussis
auggccagcacauacgccgccga

SEQ ID NO: 419655 - RNA, 22 nt, Bordetella pertussis
auggccagcagcgccgccagca

SEQ ID NO: 419656 - RNA, 13 nt, Bordetella pertussis
auggcccagggca

SEQ ID NO: 419657 - RNA, 23 nt, Bordetella pertussis
auggcgcuguuggccggcgcgcc

SEQ ID NO: 419658 - RNA, 21 nt, Bordetella pertussis
auggcggcaacgugcaggcca

SEQ ID NO: 419659 - RNA, 13 nt, Bordetella pertussis
auggcggccaggc

SEQ ID NO: 419660 - RNA, 14 nt, Bordetella pertussis
auggcggccaggcg

SEQ ID NO: 419661 - RNA, 17 nt, Bordetella pertussis
auggcucgggcagcagc

SEQ ID NO: 419662 - RNA, 12 nt, Bordetella pertussis
augggccaggcg

SEQ ID NO: 419663 - RNA, 16 nt, Bordetella pertussis
augggcccgggcaggc

SEQ ID NO: 419664 - RNA, 14 nt, Bordetella pertussis
augggccugcccau

SEQ ID NO: 419665 - RNA, 18 nt, Bordetella pertussis
augggcugucgcaacagc

SEQ ID NO: 419666 - RNA, 18 nt, Bordetella pertussis
auggucgaccagcagccg

SEQ ID NO: 419667 - RNA, 15 nt, Bordetella pertussis
auggucgcgaccacc

SEQ ID NO: 419668 - RNA, 19 nt, Bordetella pertussis
auggucggcauggccagga

SEQ ID NO: 419669 - RNA, 18 nt, Bordetella pertussis
auggucggcauggccauc

SEQ ID NO: 419670 - RNA, 17 nt, Bordetella pertussis
auggucgcggccgaggc

SEQ ID NO: 419671 - RNA, 22 nt, Bordetella pertussis
auggucgugcggcacgcacagc

SEQ ID NO: 419672 - RNA, 17 nt, Bordetella pertussis
auggucucccccucggc

SEQ ID NO: 419673 - RNA, 16 nt, Bordetella pertussis
augguguacagccgcc

SEQ ID NO: 419674 - RNA, 13 nt, Bordetella pertussis
augguguucaggu

SEQ ID NO: 419675 - RNA, 13 nt, Bordetella pertussis
auguaggccaggu

SEQ ID NO: 419676 - RNA, 16 nt, Bordetella pertussis
auguaguagccgccgc

SEQ ID NO: 419677 - RNA, 20 nt, Bordetella pertussis
auguaguucacccagguauc

SEQ ID NO: 419678 - RNA, 18 nt, Bordetella pertussis
auguccacggucgccggc

SEQ ID NO: 419679 - RNA, 22 nt, Bordetella pertussis
auguccagcgagcgaaagccgu

SEQ ID NO: 419680 - RNA, 17 nt, Bordetella pertussis
auguccauggccugcag

SEQ ID NO: 419681 - RNA, 14 nt, Bordetella pertussis
augucccuggccau

SEQ ID NO: 419682 - RNA, 12 nt, Bordetella pertussis
auguccugcagg

SEQ ID NO: 419683 - RNA, 13 nt, Bordetella pertussis
auguccugcaggc

SEQ ID NO: 419684 - RNA, 15 nt, Bordetella pertussis
auguccugcaggccc

SEQ ID NO: 419685 - RNA, 17 nt, Bordetella pertussis
augucgaacagcugcag

SEQ ID NO: 419686 - RNA, 15 nt, Bordetella pertussis
auguggcgacgccca

SEQ ID NO: 419687 - RNA, 18 nt, Bordetella pertussis
auguggggacaggcaccc

SEQ ID NO: 419688 - RNA, 13 nt, Bordetella pertussis
auguggggguugu

SEQ ID NO: 419689 - RNA, 15 nt, Bordetella pertussis
auguggucggcgccg

SEQ ID NO: 419690 - RNA, 21 nt, Bordetella pertussis
auguggucggcgccgaggcgg

SEQ ID NO: 419691 - RNA, 19 nt, Bordetella pertussis
auguucaggccggcccgcc

SEQ ID NO: 419692 - RNA, 22 nt, Bordetella pertussis
auguugcuuggcgucagcgugc

SEQ ID NO: 419693 - RNA, 19 nt, Bordetella pertussis
auguuguguacuccuaucu

SEQ ID NO: 419694 - RNA, 14 nt, Bordetella pertussis
auuagggcccagcu

SEQ ID NO: 419695 - RNA, 17 nt, Bordetella pertussis
auuagggcccagcugca

SEQ ID NO: 419696 - RNA, 20 nt, Bordetella pertussis
auuaugccgcccgcaaggac

SEQ ID NO: 419697 - RNA, 18 nt, Bordetella pertussis
auuaugcguggccgccgg

SEQ ID NO: 419698 - RNA, 18 nt, Bordetella pertussis
auugacggcgcucuuggu

SEQ ID NO: 419699 - RNA, 12 nt, Bordetella pertussis
auugccccagca

SEQ ID NO: 419700 - RNA, 13 nt, Bordetella pertussis
auugccccagcac

SEQ ID NO: 419701 - RNA, 14 nt, Bordetella pertussis
auugccccagcacg

SEQ ID NO: 419702 - RNA, 16 nt, Bordetella pertussis
auugcccuucggggca

SEQ ID NO: 419703 - RNA, 22 nt, Bordetella pertussis
auugccgcgcggcgcguucagc

SEQ ID NO: 419704 - RNA, 16 nt, Bordetella pertussis
auugccggagcagcag

SEQ ID NO: 419705 - RNA, 18 nt, Bordetella pertussis
auugccggagcagcagcg

SEQ ID NO: 419706 - RNA, 22 nt, Bordetella pertussis
auugccgucggccgcgcccauu

SEQ ID NO: 419707 - RNA, 13 nt, Bordetella pertussis
auugcuucuggua

SEQ ID NO: 419708 - RNA, 22 nt, Bordetella pertussis
auugcuucugguaguuggccag

SEQ ID NO: 419709 - RNA, 18 nt, Bordetella pertussis
auugcuugacgccgccga

SEQ ID NO: 419710 - RNA, 22 nt, Bordetella pertussis
auuggagcucgcucagaagcug

SEQ ID NO: 419711 - RNA, 22 nt, Bordetella pertussis
auuggcuguaucuggccugucu

SEQ ID NO: 419712 - RNA, 19 nt, Bordetella pertussis
auugggcugguaggggaug

SEQ ID NO: 419713 - RNA, 14 nt, Bordetella pertussis
auuucucggccagc

SEQ ID NO: 419714 - RNA, 17 nt, Bordetella pertussis
auuucucggccugggcg

SEQ ID NO: 419715 - RNA, 19 nt, Bordetella pertussis
auuucuucgccuggccggc

SEQ ID NO: 419716 - RNA, 21 nt, Bordetella pertussis
auuugaacagccgccccagca

SEQ ID NO: 419717 - RNA, 19 nt, Bordetella pertussis
auuuggcaaggcccgccgc

SEQ ID NO: 419718 - RNA, 20 nt, Bordetella pertussis
auuuggcggccuggccgcgc

SEQ ID NO: 419719 - RNA, 12 nt, Bordetella pertussis
auuuucaccauc

SEQ ID NO: 419720 - RNA, 13 nt, Bordetella pertussis
caaaaaaagaggc

SEQ ID NO: 419721 - RNA, 19 nt, Bordetella pertussis
caaaaaaagaggccacccg

SEQ ID NO: 419722 - RNA, 19 nt, Bordetella pertussis
caaaaacggucugccgcug

SEQ ID NO: 419723 - RNA, 13 nt, Bordetella pertussis
caaaacgcgcccc

SEQ ID NO: 419724 - RNA, 14 nt, Bordetella pertussis
caaaagcaacaacc

SEQ ID NO: 419725 - RNA, 20 nt, Bordetella pertussis
caaaagcguuccagcagauc

SEQ ID NO: 419726 - RNA, 21 nt, Bordetella pertussis
caaagaaauugggcguggcgg

SEQ ID NO: 419727 - RNA, 14 nt, Bordetella pertussis
caaagccugacggc

SEQ ID NO: 419728 - RNA, 22 nt, Bordetella pertussis
caaaguagugcccccacgcugc

SEQ ID NO: 419729 - RNA, 15 nt, Bordetella pertussis
caaauucugcaaaag

SEQ ID NO: 419730 - RNA, 14 nt, Bordetella pertussis
caacacgcuggacg

SEQ ID NO: 419731 - RNA, 16 nt, Bordetella pertussis
caacacguacgaccgc

SEQ ID NO: 419732 - RNA, 17 nt, Bordetella pertussis
caacagacccgggccgc

SEQ ID NO: 419733 - RNA, 14 nt, Bordetella pertussis
caacagcucgcgcc

SEQ ID NO: 419734 - RNA, 15 nt, Bordetella pertussis
caacagcucgcgcca

SEQ ID NO: 419735 - RNA, 22 nt, Bordetella pertussis
caacaugccggacaagccccuc

SEQ ID NO: 419736 - RNA, 20 nt, Bordetella pertussis
caaccacgagcugcagcccg

SEQ ID NO: 419737 - RNA, 21 nt, Bordetella pertussis
caaccaggaaaaccggcgccu

SEQ ID NO: 419738 - RNA, 23 nt, Bordetella pertussis
caaccaggaaaaccggcgccugg

SEQ ID NO: 419739 - RNA, 21 nt, Bordetella pertussis
caaccaggggcggcgcggcgc

SEQ ID NO: 419740 - RNA, 22 nt, Bordetella pertussis
caaccaggggcggcgcggcgcu

SEQ ID NO: 419741 - RNA, 15 nt, Bordetella pertussis
caacccacccccagc

SEQ ID NO: 419742 - RNA, 21 nt, Bordetella pertussis
caacccacggcguggcgcgcc

SEQ ID NO: 419743 - RNA, 14 nt, Bordetella pertussis
caaccccagcagcg

SEQ ID NO: 419744 - RNA, 20 nt, Bordetella pertussis
caacccgcccacgcggcgcu

SEQ ID NO: 419745 - RNA, 17 nt, Bordetella pertussis
caacccugccuccaggc

SEQ ID NO: 419746 - RNA, 13 nt, Bordetella pertussis
caaccggaacacc

SEQ ID NO: 419747 - RNA, 21 nt, Bordetella pertussis
caaccggcccgaagguuuccu

SEQ ID NO: 419748 - RNA, 20 nt, Bordetella pertussis
caaccgucggugaugcucug

SEQ ID NO: 419749 - RNA, 16 nt, Bordetella pertussis
caacgccaagcugcug

SEQ ID NO: 419750 - RNA, 18 nt, Bordetella pertussis
caacggcgugcugcggcu

SEQ ID NO: 419751 - RNA, 23 nt, Bordetella pertussis
caagcagacccgcgcccagcugu

SEQ ID NO: 419752 - RNA, 14 nt, Bordetella pertussis
caagcagcgccggc

SEQ ID NO: 419753 - RNA, 18 nt, Bordetella pertussis
caagccagcggcgcggcg

SEQ ID NO: 419754 - RNA, 15 nt, Bordetella pertussis
caagccccaggcagg

SEQ ID NO: 419755 - RNA, 21 nt, Bordetella pertussis
caagcccggcacggagggugc

SEQ ID NO: 419756 - RNA, 16 nt, Bordetella pertussis
caagcccgucaguccg

SEQ ID NO: 419757 - RNA, 20 nt, Bordetella pertussis
caagcggcugcccuugcugu

SEQ ID NO: 419758 - RNA, 14 nt, Bordetella pertussis
caaggaaguggccg

SEQ ID NO: 419759 - RNA, 16 nt, Bordetella pertussis
caaggaccaugcgcug

SEQ ID NO: 419760 - RNA, 18 nt, Bordetella pertussis
caaggaccaugcgcuggg

SEQ ID NO: 419761 - RNA, 20 nt, Bordetella pertussis
caaggacgcguccucggcca

SEQ ID NO: 419762 - RNA, 17 nt, Bordetella pertussis
caaggaggauaagccgu

SEQ ID NO: 419763 - RNA, 20 nt, Bordetella pertussis
caaggccgaauugccgccgc

SEQ ID NO: 419764 - RNA, 16 nt, Bordetella pertussis
caaggccgacuggaug

SEQ ID NO: 419765 - RNA, 11 nt, Bordetella pertussis
caaggccugcc

SEQ ID NO: 419766 - RNA, 21 nt, Bordetella pertussis
caagggccccccggcgcggcc

SEQ ID NO: 419767 - RNA, 17 nt, Bordetella pertussis
caagggcgccgggcgga

SEQ ID NO: 419768 - RNA, 18 nt, Bordetella pertussis
caagggguggcugucccc

SEQ ID NO: 419769 - RNA, 16 nt, Bordetella pertussis
caagguacccgcgccg

SEQ ID NO: 419770 - RNA, 18 nt, Bordetella pertussis
caagguacccgcgccggc

SEQ ID NO: 419771 - RNA, 17 nt, Bordetella pertussis
caaggugccuguccccg

SEQ ID NO: 419772 - RNA, 19 nt, Bordetella pertussis
caauagcgguggcgggcca

SEQ ID NO: 419773 - RNA, 23 nt, Bordetella pertussis
caaucauucgcgaagucauaaaa

SEQ ID NO: 419774 - RNA, 19 nt, Bordetella pertussis
caaucccggcgacaccgcg

SEQ ID NO: 419775 - RNA, 22 nt, Bordetella pertussis
caaucccggcgacaccgcggcc

SEQ ID NO: 419776 - RNA, 18 nt, Bordetella pertussis
caaucgacgaacaaggcc

SEQ ID NO: 419777 - RNA, 18 nt, Bordetella pertussis
caaucgggguggcgccgu

SEQ ID NO: 419778 - RNA, 23 nt, Bordetella pertussis
caaucgggcagcacgcgcaccag

SEQ ID NO: 419779 - RNA, 16 nt, Bordetella pertussis
caaucugaucaucuuc

SEQ ID NO: 419780 - RNA, 17 nt, Bordetella pertussis
caaucuugccaggcccg

SEQ ID NO: 419781 - RNA, 17 nt, Bordetella pertussis
caaugacgacgccggcu

SEQ ID NO: 419782 - RNA, 19 nt, Bordetella pertussis
caaugccauuggugcgcac

SEQ ID NO: 419783 - RNA, 12 nt, Bordetella pertussis
caaugccccacg

SEQ ID NO: 419784 - RNA, 15 nt, Bordetella pertussis
caaugcgcgcgcggu

SEQ ID NO: 419785 - RNA, 12 nt, Bordetella pertussis
caauggccgcgg

SEQ ID NO: 419786 - RNA, 15 nt, Bordetella pertussis
caaugguccagcagg

SEQ ID NO: 419787 - RNA, 22 nt, Bordetella pertussis
caauguccggggcgcuugccac

SEQ ID NO: 419788 - RNA, 22 nt, Bordetella pertussis
cacugaugcuggucagccuggg

SEQ ID NO: 419789 - RNA, 19 nt, Bordetella pertussis
cacugcaccugcuccagcg

SEQ ID NO: 419790 - RNA, 13 nt, Bordetella pertussis
cacugccaggcgc

SEQ ID NO: 419791 - RNA, 15 nt, Bordetella pertussis
cacugccaggcgccc

SEQ ID NO: 419792 - RNA, 19 nt, Bordetella pertussis
cacugccaguaggcgcccc

SEQ ID NO: 419793 - RNA, 13 nt, Bordetella pertussis
cacuggcccuggc

SEQ ID NO: 419794 - RNA, 14 nt, Bordetella pertussis
cacuggccuucuuc

SEQ ID NO: 419795 - RNA, 19 nt, Bordetella pertussis
cacuggccuugugcgccgu

SEQ ID NO: 419796 - RNA, 13 nt, Bordetella pertussis
cacuggcgcggcg

SEQ ID NO: 419797 - RNA, 10 nt, Bordetella pertussis
cacuggggga

SEQ ID NO: 419798 - RNA, 16 nt, Bordetella pertussis
cacugggggacuggca

SEQ ID NO: 419799 - RNA, 16 nt, Bordetella pertussis
cacuggguggccagcg

SEQ ID NO: 419800 - RNA, 22 nt, Bordetella pertussis
cacuggguuuuuccggcucuuc

SEQ ID NO: 419801 - RNA, 21 nt, Bordetella pertussis
cacugucggcguuccuggcgc

SEQ ID NO: 419802 - RNA, 14 nt, Bordetella pertussis
cacuuccagcgccu

SEQ ID NO: 419803 - RNA, 16 nt, Bordetella pertussis
cacuuccucggcgcgc

SEQ ID NO: 419804 - RNA, 14 nt, Bordetella pertussis
cacuucgaaaauga

SEQ ID NO: 419805 - RNA, 14 nt, Bordetella pertussis
cacuucgaaacccu

SEQ ID NO: 419806 - RNA, 14 nt, Bordetella pertussis
cacuucuucgagca

SEQ ID NO: 419807 - RNA, 15 nt, Bordetella pertussis
cacuucuucgagcaa

SEQ ID NO: 419808 - RNA, 14 nt, Bordetella pertussis
cacuugccggccgc

SEQ ID NO: 419809 - RNA, 18 nt, Bordetella pertussis
cacuugcgaacggccgcc

SEQ ID NO: 419810 - RNA, 19 nt, Bordetella pertussis
cacuugcgaacggccgccc

SEQ ID NO: 419811 - RNA, 13 nt, Bordetella pertussis
cacuuggccggcg

SEQ ID NO: 419812 - RNA, 17 nt, Bordetella pertussis
cacuuucgcgcgcgccu

SEQ ID NO: 419813 - RNA, 22 nt, Bordetella pertussis
cagaacccggccggcgccggca

SEQ ID NO: 419814 - RNA, 16 nt, Bordetella pertussis
cagaacgacgaucugg

SEQ ID NO: 419815 - RNA, 21 nt, Bordetella pertussis
cagaacgcguaggucaggccc

SEQ ID NO: 419816 - RNA, 17 nt, Bordetella pertussis
cagaacggaaacgccca

SEQ ID NO: 419817 - RNA, 14 nt, Bordetella pertussis
cagaacggcgcggg

SEQ ID NO: 419818 - RNA, 23 nt, Bordetella pertussis
cagaagauauugggggucagcgc

SEQ ID NO: 419819 - RNA, 16 nt, Bordetella pertussis
cagaaguggucgcgca

SEQ ID NO: 419820 - RNA, 15 nt, Bordetella pertussis
cagaccaucuugucc

SEQ ID NO: 419821 - RNA, 21 nt, Bordetella pertussis
cagacccgggccgcuggcccg

SEQ ID NO: 419822 - RNA, 16 nt, Bordetella pertussis
cagaccguagcgcagg

SEQ ID NO: 419823 - RNA, 17 nt, Bordetella pertussis
cagaccugcgcgccggc

SEQ ID NO: 419824 - RNA, 18 nt, Bordetella pertussis
cagaccugcgcgccggca

SEQ ID NO: 419825 - RNA, 14 nt, Bordetella pertussis
cagacgacgcagcg

SEQ ID NO: 419826 - RNA, 22 nt, Bordetella pertussis
cagacgaugcccaggcccgcca

SEQ ID NO: 419827 - RNA, 13 nt, Bordetella pertussis
cagacgcagacca

SEQ ID NO: 419828 - RNA, 21 nt, Bordetella pertussis
cagacgcgagaccaugacguc

SEQ ID NO: 419829 - RNA, 23 nt, Bordetella pertussis
cagacgcgcuuuuccccgcccag

SEQ ID NO: 419830 - RNA, 15 nt, Bordetella pertussis
cagacggcggcugga

SEQ ID NO: 419831 - RNA, 16 nt, Bordetella pertussis
cagacgggcuggaaga

SEQ ID NO: 419832 - RNA, 18 nt, Bordetella pertussis
cagacggucgacaccgug

SEQ ID NO: 419833 - RNA, 18 nt, Bordetella pertussis
cagagcuggggcgucccg

SEQ ID NO: 419834 - RNA, 24 nt, Bordetella pertussis
cagagggaaaacagcgcgggcgca

SEQ ID NO: 419835 - RNA, 15 nt, Bordetella pertussis
cagagggagcgacac

SEQ ID NO: 419836 - RNA, 17 nt, Bordetella pertussis
cagagggcgacggcggc

SEQ ID NO: 419837 - RNA, 13 nt, Bordetella pertussis
cagauaaaggccg

SEQ ID NO: 419838 - RNA, 22 nt, Bordetella pertussis
cagauaaaggccgcaacccacc

SEQ ID NO: 419839 - RNA, 23 nt, Bordetella pertussis
cagauaaaggccgcaacccaccc

SEQ ID NO: 419840 - RNA, 13 nt, Bordetella pertussis
cagauaaggcggg

SEQ ID NO: 419841 - RNA, 14 nt, Bordetella pertussis
cagauagcccaggc

SEQ ID NO: 419842 - RNA, 16 nt, Bordetella pertussis
cagaucaucggcgcca

SEQ ID NO: 419843 - RNA, 13 nt, Bordetella pertussis
cagauccacgccc

SEQ ID NO: 419844 - RNA, 16 nt, Bordetella pertussis
cagauccagcgcggcc

SEQ ID NO: 419845 - RNA, 16 nt, Bordetella pertussis
cagauccgguaugccu

SEQ ID NO: 419846 - RNA, 13 nt, Bordetella pertussis
cagaucgccgccg

SEQ ID NO: 419847 - RNA, 14 nt, Bordetella pertussis
cagaucgccgccgc

SEQ ID NO: 419848 - RNA, 18 nt, Bordetella pertussis
cagaucgccgccgcccgc

SEQ ID NO: 419849 - RNA, 16 nt, Bordetella pertussis
cagaucggcgcuggcc

SEQ ID NO: 419850 - RNA, 20 nt, Bordetella pertussis
cagaucucgcguccggugcg

SEQ ID NO: 419851 - RNA, 22 nt, Bordetella pertussis
cagaugaucuacgcgcgcgccg

SEQ ID NO: 419852 - RNA, 20 nt, Bordetella pertussis
cagaugcaccggccagucgc

SEQ ID NO: 419853 - RNA, 21 nt, Bordetella pertussis
cagaugcgcgccaggcgcgca

SEQ ID NO: 419854 - RNA, 13 nt, Bordetella pertussis
cagauggccagca

SEQ ID NO: 419855 - RNA, 15 nt, Bordetella pertussis
cagauggccagcagc

SEQ ID NO: 419856 - RNA, 21 nt, Bordetella pertussis
cagauggccagcagcgccgcc

SEQ ID NO: 419857 - RNA, 19 nt, Bordetella pertussis
cagauggcuuucuaucauc

SEQ ID NO: 419858 - RNA, 14 nt, Bordetella pertussis
cagauguccgugcu

SEQ ID NO: 419859 - RNA, 18 nt, Bordetella pertussis
cagauguccgugcuggcc

SEQ ID NO: 419860 - RNA, 21 nt, Bordetella pertussis
cagauugccuuccuugaccac

SEQ ID NO: 419861 - RNA, 23 nt, Bordetella pertussis
cagauuuccggaccggugcccuc

SEQ ID NO: 419862 - RNA, 18 nt, Bordetella pertussis
cagcaaaugggccgcagc

SEQ ID NO: 419863 - RNA, 14 nt, Bordetella pertussis
cagcaaccccagca

SEQ ID NO: 419864 - RNA, 15 nt, Bordetella pertussis
cagcaaccccagcag

SEQ ID NO: 419865 - RNA, 19 nt, Bordetella pertussis
cagcaaccccagcagcgcc

SEQ ID NO: 419866 - RNA, 13 nt, Bordetella pertussis
cagcaacccgccc

SEQ ID NO: 419867 - RNA, 15 nt, Bordetella pertussis
cagcaacccgcccgg

SEQ ID NO: 419868 - RNA, 16 nt, Bordetella pertussis
cagcaacgccacgcgc

SEQ ID NO: 419869 - RNA, 14 nt, Bordetella pertussis
cagcaacgcggcgu

SEQ ID NO: 419870 - RNA, 23 nt, Bordetella pertussis
cagcaacggugagccggccaccu

SEQ ID NO: 419871 - RNA, 18 nt, Bordetella pertussis
cagcaagaaucggggcgu

SEQ ID NO: 419872 - RNA, 22 nt, Bordetella pertussis
cagcaagaaucggggcguagcu

SEQ ID NO: 419873 - RNA, 21 nt, Bordetella pertussis
cagcaagcccaccgggccggc

SEQ ID NO: 419874 - RNA, 13 nt, Bordetella pertussis
cagcaagcgcgcc

SEQ ID NO: 419875 - RNA, 16 nt, Bordetella pertussis
cagcaagcgcgccaug

SEQ ID NO: 419876 - RNA, 18 nt, Bordetella pertussis
cagcaagcgcgccaugaa

SEQ ID NO: 419877 - RNA, 16 nt, Bordetella pertussis
cagcaagcugcugcug

SEQ ID NO: 419878 - RNA, 17 nt, Bordetella pertussis
cagcaaggacaaggcgc

SEQ ID NO: 419879 - RNA, 14 nt, Bordetella pertussis
cagcaaggcgcgcc

SEQ ID NO: 419880 - RNA, 17 nt, Bordetella pertussis
cagcaaggcggcaaacc

SEQ ID NO: 419881 - RNA, 15 nt, Bordetella pertussis
cagcaaggcgucggc

SEQ ID NO: 419882 - RNA, 23 nt, Bordetella pertussis
cagcaagggcagauugaugccca

SEQ ID NO: 419883 - RNA, 22 nt, Bordetella pertussis
cagcaagucagcccgcgucgcu

SEQ ID NO: 419884 - RNA, 21 nt, Bordetella pertussis
cagcaagggguccguggcggc

SEQ ID NO: 419885 - RNA, 15 nt, Bordetella pertussis
cagcaauugccccag

SEQ ID NO: 419886 - RNA, 19 nt, Bordetella pertussis
cagcaauugccccagcacg

SEQ ID NO: 419887 - RNA, 23 nt, Bordetella pertussis
cagcacacggucagcaaccccag

SEQ ID NO: 419888 - RNA, 22 nt, Bordetella pertussis
cagcacauacgccgccgaggcg

SEQ ID NO: 419889 - RNA, 22 nt, Bordetella pertussis
cagcacauagggcgagaucauc

SEQ ID NO: 419890 - RNA, 20 nt, Bordetella pertussis
cagcacauccgacagauggc

SEQ ID NO: 419891 - RNA, 13 nt, Bordetella pertussis
cagcacaucgccc

SEQ ID NO: 419892 - RNA, 17 nt, Bordetella pertussis
cagcacauggcgcgccg

SEQ ID NO: 419893 - RNA, 12 nt, Bordetella pertussis
cagcaccacggg

SEQ ID NO: 419894 - RNA, 14 nt, Bordetella pertussis
cagcaccacgggcu

SEQ ID NO: 419895 - RNA, 22 nt, Bordetella pertussis
cagcaccacgggcucgcugacc

SEQ ID NO: 419896 - RNA, 13 nt, Bordetella pertussis
cagcaccagcaug

SEQ ID NO: 419897 - RNA, 20 nt, Bordetella pertussis
cagcaccagcgccugccgau

SEQ ID NO: 419898 - RNA, 14 nt, Bordetella pertussis
cagcaccagcgccu

SEQ ID NO: 419899 - RNA, 13 nt, Bordetella pertussis
cagcaccaggccg

SEQ ID NO: 419900 - RNA, 22 nt, Bordetella pertussis
cagcaccaggccgccggccagc

SEQ ID NO: 419901 - RNA, 12 nt, Bordetella pertussis
cagcaccaggcu

SEQ ID NO: 419902 - RNA, 21 nt, Bordetella pertussis
cagcaccaggcuuugcgcgcc

SEQ ID NO: 419903 - RNA, 21 nt, Bordetella pertussis
cagcaccgacaggccgaugcu

SEQ ID NO: 419904 - RNA, 15 nt, Bordetella pertussis
cagcaccgagcugcc

SEQ ID NO: 419905 - RNA, 13 nt, Bordetella pertussis
cagcaccgaugcg

SEQ ID NO: 419906 - RNA, 13 nt, Bordetella pertussis
cagcaccgccacc

SEQ ID NO: 419907 - RNA, 14 nt, Bordetella pertussis
cagcaccgccagcg

SEQ ID NO: 419908 - RNA, 16 nt, Bordetella pertussis
cagcaccgcgaccaug

SEQ ID NO: 419909 - RNA, 18 nt, Bordetella pertussis
cagcaccgcgaccaugcg

SEQ ID NO: 419910 - RNA, 14 nt, Bordetella pertussis
cagcaccgcgcgca

SEQ ID NO: 419911 - RNA, 15 nt, Bordetella pertussis
cagcaccgcgcgcac

SEQ ID NO: 419912 - RNA, 20 nt, Bordetella pertussis
cagcaccggcacgacggccu

SEQ ID NO: 419913 - RNA, 13 nt, Bordetella pertussis
cagcaccggcccg

SEQ ID NO: 419914 - RNA, 12 nt, Bordetella pertussis
cagcaccggcgu

SEQ ID NO: 419915 - RNA, 15 nt, Bordetella pertussis
cagcaccggcugcca

SEQ ID NO: 419916 - RNA, 16 nt, Bordetella pertussis
cagcaccggggcaggg

SEQ ID NO: 419917 - RNA, 15 nt, Bordetella pertussis
cagcaccgugccggc

SEQ ID NO: 419918 - RNA, 17 nt, Bordetella pertussis
cagcaccucgacgcagc

SEQ ID NO: 419919 - RNA, 17 nt, Bordetella pertussis
cagcaccucggcgccca

SEQ ID NO: 419920 - RNA, 19 nt, Bordetella pertussis
cagcaccucggcgcccagc

SEQ ID NO: 419921 - RNA, 21 nt, Bordetella pertussis
cagcaccucggcgcccagcug

SEQ ID NO: 419922 - RNA, 19 nt, Bordetella pertussis
cagcaccucggggcgcggc

SEQ ID NO: 419923 - RNA, 14 nt, Bordetella pertussis
cagcaccugcaggc

SEQ ID NO: 419924 - RNA, 13 nt, Bordetella pertussis
cagcaccugcagg

SEQ ID NO: 419925 - RNA, 18 nt, Bordetella pertussis
cagcaccuugaccugguc

SEQ ID NO: 419926 - RNA, 18 nt, Bordetella pertussis
cagcaccuuggcauugaa

SEQ ID NO: 419927 - RNA, 21 nt, Bordetella pertussis
cagcaccuucugccgccaggc

SEQ ID NO: 419928 - RNA, 23 nt, Bordetella pertussis
cagcacgagauguccauggccug

SEQ ID NO: 419929 - RNA, 17 nt, Bordetella pertussis
cagcacgaagggcagca

SEQ ID NO: 419930 - RNA, 16 nt, Bordetella pertussis
cagcacgauggcgccc

SEQ ID NO: 419931 - RNA, 16 nt, Bordetella pertussis
cagcacgauggggcca

SEQ ID NO: 419932 - RNA, 17 nt, Bordetella pertussis
cagcacgauggggccau

SEQ ID NO: 419933 - RNA, 24 nt, Bordetella pertussis
cagcacgauggggccauggcacag

SEQ ID NO: 419934 - RNA, 15 nt, Bordetella pertussis
cagcacgcagauguu

SEQ ID NO: 419935 - RNA, 21 nt, Bordetella pertussis
cagcacgaucgcggcgcuggc

SEQ ID NO: 419936 - RNA, 15 nt, Bordetella pertussis
cagcacgaugagcau

SEQ ID NO: 419937 - RNA, 18 nt, Bordetella pertussis
cagcacgcccagauggcc

SEQ ID NO: 419938 - RNA, 11 nt, Bordetella pertussis
cagcacgcccg

SEQ ID NO: 419939 - RNA, 22 nt, Bordetella pertussis
cagcacgccgaucgcgcacagc

SEQ ID NO: 419940 - RNA, 17 nt, Bordetella pertussis
cagcacgccgcgccagg

SEQ ID NO: 419941 - RNA, 17 nt, Bordetella pertussis
cagcacgccggcgggca

SEQ ID NO: 419942 - RNA, 17 nt, Bordetella pertussis
cagcacgcgcaccaggc

SEQ ID NO: 419943 - RNA, 14 nt, Bordetella pertussis
cagcacgcgcagcu

SEQ ID NO: 419944 - RNA, 17 nt, Bordetella pertussis
cagcacgcgcagcuugc

SEQ ID NO: 419945 - RNA, 14 nt, Bordetella pertussis
cagcacgcgcgcca

SEQ ID NO: 419946 - RNA, 22 nt, Bordetella pertussis
cagcacgcgcgccagcugggcg

SEQ ID NO: 419947 - RNA, 13 nt, Bordetella pertussis
cagcacggccacg

SEQ ID NO: 419948 - RNA, 21 nt, Bordetella pertussis
cagcacggcaugucccgaggc

SEQ ID NO: 419949 - RNA, 15 nt, Bordetella pertussis
cagcacggcgcacac

SEQ ID NO: 419950 - RNA, 19 nt, Bordetella pertussis
cagcacggcgcacaccauc

SEQ ID NO: 419951 - RNA, 18 nt, Bordetella pertussis
cagcacggcuugcgcgcc

SEQ ID NO: 419952 - RNA, 20 nt, Bordetella pertussis
cagcacgggaugcuccagcu

SEQ ID NO: 419953 - RNA, 18 nt, Bordetella pertussis
cagcacgucauccugggc

SEQ ID NO: 419954 - RNA, 19 nt, Bordetella pertussis
cagcacgucauccugggcg

SEQ ID NO: 419955 - RNA, 17 nt, Bordetella pertussis
cagcacguagaaagugg

SEQ ID NO: 419956 - RNA, 22 nt, Bordetella pertussis
cagcacguggucgugcaggacc

SEQ ID NO: 419957 - RNA, 22 nt, Bordetella pertussis
cagcacuugccggccgcccagg

SEQ ID NO: 419958 - RNA, 23 nt, Bordetella pertussis
cagcacuugccggccgcccaggc

SEQ ID NO: 419959 - RNA, 17 nt, Bordetella pertussis
cagcagaaugccgccca

SEQ ID NO: 419960 - RNA, 20 nt, Bordetella pertussis
cagcagaaugccgcccacga

SEQ ID NO: 419961 - RNA, 20 nt, Bordetella pertussis
cagcagacccuggcgcgcgu

SEQ ID NO: 419962 - RNA, 16 nt, Bordetella pertussis
cagcagaucgcggcgg

SEQ ID NO: 419963 - RNA, 18 nt, Bordetella pertussis
cagcagaucggcggccug

SEQ ID NO: 419964 - RNA, 19 nt, Bordetella pertussis
cagcagauugccgcgcggc

SEQ ID NO: 419965 - RNA, 13 nt, Bordetella pertussis
cagcagcacgcag

SEQ ID NO: 419966 - RNA, 13 nt, Bordetella pertussis
cagcagcacgccc

SEQ ID NO: 419967 - RNA, 17 nt, Bordetella pertussis
cagcagcacgcccagua

SEQ ID NO: 419968 - RNA, 18 nt, Bordetella pertussis
cagcagcacggccacgau

SEQ ID NO: 419969 - RNA, 13 nt, Bordetella pertussis
cagcagcagcgcc

SEQ ID NO: 419970 - RNA, 16 nt, Bordetella pertussis
cagcagcagcgagccc

SEQ ID NO: 419971 - RNA, 22 nt, Bordetella pertussis
cagcagcaggccguaaccggcc

SEQ ID NO: 419972 - RNA, 18 nt, Bordetella pertussis
cagcagcaugccuucgac

SEQ ID NO: 419973 - RNA, 14 nt, Bordetella pertussis
cagcagcaugcggc

SEQ ID NO: 419974 - RNA, 16 nt, Bordetella pertussis
cagcagcauggcgggc

SEQ ID NO: 419975 - RNA, 23 nt, Bordetella pertussis
cagcagcauuucgaugcgcacca

SEQ ID NO: 419976 - RNA, 22 nt, Bordetella pertussis
cagcagcgcaucgcgcgcgccg

SEQ ID NO: 419977 - RNA, 14 nt, Bordetella pertussis
cagcagcgccaccg

SEQ ID NO: 419978 - RNA, 15 nt, Bordetella pertussis
cagcagcgccaggau

SEQ ID NO: 419979 - RNA, 14 nt, Bordetella pertussis
cagcagcgccaggg

SEQ ID NO: 419980 - RNA, 14 nt, Bordetella pertussis
cagcagcgccgcca

SEQ ID NO: 419981 - RNA, 15 nt, Bordetella pertussis
cagcagcgccgccag

SEQ ID NO: 419982 - RNA, 13 nt, Bordetella pertussis
cagcagcgccggc

SEQ ID NO: 419983 - RNA, 22 nt, Bordetella pertussis
cagcagcgccggcaggcgcgcc

SEQ ID NO: 419984 - RNA, 23 nt, Bordetella pertussis
cagcagcgccggcaggcgcgcca

SEQ ID NO: 419985 - RNA, 14 nt, Bordetella pertussis
cagcagcgccggga

SEQ ID NO: 419986 - RNA, 20 nt, Bordetella pertussis
cagcagcgccggggggcgca

SEQ ID NO: 419987 - RNA, 19 nt, Bordetella pertussis
cagcagcgccuugcggcgc

SEQ ID NO: 419988 - RNA, 12 nt, Bordetella pertussis
cagcagcgcgcc

SEQ ID NO: 419989 - RNA, 13 nt, Bordetella pertussis
cagcagcgcgccg

SEQ ID NO: 419990 - RNA, 15 nt, Bordetella pertussis
cagcagcgcgccgcc

SEQ ID NO: 419991 - RNA, 13 nt, Bordetella pertussis
cagcagcgcggcg

SEQ ID NO: 419992 - RNA, 19 nt, Bordetella pertussis
cagcagcgcggucaugccg

SEQ ID NO: 419993 - RNA, 19 nt, Bordetella pertussis
cagcagcgcgugcagccag

SEQ ID NO: 419994 - RNA, 13 nt, Bordetella pertussis
cagcagcggcagc

SEQ ID NO: 419995 - RNA, 14 nt, Bordetella pertussis
cagcagcggcaggu

SEQ ID NO: 419996 - RNA, 13 nt, Bordetella pertussis
cagcagcggcucg

SEQ ID NO: 419997 - RNA, 17 nt, Bordetella pertussis
cagcagcggcucgagcg

SEQ ID NO: 419998 - RNA, 17 nt, Bordetella pertussis
cagcagcgggcuggggc

SEQ ID NO: 419999 - RNA, 19 nt, Bordetella pertussis
cagcagcgggcuggggcag

SEQ ID NO: 420000 - RNA, 20 nt, Bordetella pertussis
cagcagcggguugcgcgcca

SEQ ID NO: 420001 - RNA, 24 nt, Bordetella pertussis
cagcagcgugaugccgucgagcgc

SEQ ID NO: 420002 - RNA, 23 nt, Bordetella pertussis
cagcagcguggccgccaccagcg

SEQ ID NO: 420003 - RNA, 12 nt, Bordetella pertussis
cagcagcucguu

SEQ ID NO: 420004 - RNA, 22 nt, Bordetella pertussis
cagcagcucguugaccugcugg

SEQ ID NO: 420005 - RNA, 16 nt, Bordetella pertussis
cagcagcuugagcgaa

SEQ ID NO: 420006 - RNA, 24 nt, Bordetella pertussis
cagcagcuuggugaagcccucguc

SEQ ID NO: 420007 - RNA, 15 nt, Bordetella pertussis
cagcaggagcccgcu

SEQ ID NO: 420008 - RNA, 18 nt, Bordetella pertussis
cagcaggagcccgcugcc

SEQ ID NO: 420009 - RNA, 23 nt, Bordetella pertussis
cagcaggauggaucccuggucga

SEQ ID NO: 420010 - RNA, 13 nt, Bordetella pertussis
cagcaggccagga

SEQ ID NO: 420011 - RNA, 19 nt, Bordetella pertussis
cagcaggcccaccagggcc

SEQ ID NO: 420012 - RNA, 16 nt, Bordetella pertussis
cagcaggcccaugccg

SEQ ID NO: 420013 - RNA, 19 nt, Bordetella pertussis
cagcaggcccuccggcgcc

SEQ ID NO: 420014 - RNA, 20 nt, Bordetella pertussis
cagcaggcccuccggcgcca

SEQ ID NO: 420015 - RNA, 23 nt, Bordetella pertussis
cagcaggcccuccggcgccagca

SEQ ID NO: 420016 - RNA, 17 nt, Bordetella pertussis
cagcaggcccugggcga

SEQ ID NO: 420017 - RNA, 20 nt, Bordetella pertussis
cagcaggcccugggcgaggu

SEQ ID NO: 420018 - RNA, 15 nt, Bordetella pertussis
cagcaggccgcgcgu

SEQ ID NO: 420019 - RNA, 14 nt, Bordetella pertussis
cagcaggccggcgg

SEQ ID NO: 420020 - RNA, 14 nt, Bordetella pertussis
cagcaggcgcacca

SEQ ID NO: 420021 - RNA, 16 nt, Bordetella pertussis
cagcaggcgcucggcu

SEQ ID NO: 420022 - RNA, 15 nt, Bordetella pertussis
cagcaggcgcgcggc

SEQ ID NO: 420023 - RNA, 16 nt, Bordetella pertussis
cagcaggcgcgcggcc

SEQ ID NO: 420024 - RNA, 17 nt, Bordetella pertussis
cagcaggcgcgcggccu

SEQ ID NO: 420025 - RNA, 14 nt, Bordetella pertussis
cagcaggcucagcg

SEQ ID NO: 420026 - RNA, 20 nt, Bordetella pertussis
cagcaggcucagcgggcugc

SEQ ID NO: 420027 - RNA, 21 nt, Bordetella pertussis
cagcaggcucagcgggcugcu

SEQ ID NO: 420028 - RNA, 18 nt, Bordetella pertussis
cagcagggacuugggcag

SEQ ID NO: 420029 - RNA, 22 nt, Bordetella pertussis
cagcagggacuugggcaggccu

SEQ ID NO: 420030 - RNA, 16 nt, Bordetella pertussis
cagcagggccacgccc

SEQ ID NO: 420031 - RNA, 19 nt, Bordetella pertussis
cagcagggccacgcccagg

SEQ ID NO: 420032 - RNA, 16 nt, Bordetella pertussis
cagcagggccaggccc

SEQ ID NO: 420033 - RNA, 20 nt, Bordetella pertussis
cagcagggccaggcccacgg

SEQ ID NO: 420034 - RNA, 16 nt, Bordetella pertussis
cagcagggucagcggc

SEQ ID NO: 420035 - RNA, 22 nt, Bordetella pertussis
cagcagggucaugaugucggcc

SEQ ID NO: 420036 - RNA, 23 nt, Bordetella pertussis
cagcagggucgagaccagcagcg

SEQ ID NO: 420037 - RNA, 14 nt, Bordetella pertussis
cagcagggucggcc

SEQ ID NO: 420038 - RNA, 23 nt, Bordetella pertussis
cagcagguccugcacgcgggcca

SEQ ID NO: 420039 - RNA, 14 nt, Bordetella pertussis
cagcaggucgcgca

SEQ ID NO: 420040 - RNA, 20 nt, Bordetella pertussis
cagcaguguuucggccugcu

SEQ ID NO: 420041 - RNA, 16 nt, Bordetella pertussis
cagcaguucggucagc

SEQ ID NO: 420042 - RNA, 21 nt, Bordetella pertussis
cagcaguucggucagcgcggc

SEQ ID NO: 420043 - RNA, 16 nt, Bordetella pertussis
cagcaguugcagcaug

SEQ ID NO: 420044 - RNA, 21 nt, Bordetella pertussis
cagcaguuucugcaccggcgc

SEQ ID NO: 420045 - RNA, 23 nt, Bordetella pertussis
cagcauacccugcgcgccgccgg

SEQ ID NO: 420046 - RNA, 16 nt, Bordetella pertussis
cagcaucaccagcucg

SEQ ID NO: 420047 - RNA, 16 nt, Bordetella pertussis
cagcaucagcggcagc

SEQ ID NO: 420048 - RNA, 14 nt, Bordetella pertussis
cagcauccagccga

SEQ ID NO: 420049 - RNA, 14 nt, Bordetella pertussis
cagcauccgcgcca

SEQ ID NO: 420050 - RNA, 16 nt, Bordetella pertussis
cagcaucggcacccag

SEQ ID NO: 420051 - RNA, 18 nt, Bordetella pertussis
cagcaucguaucgggcgu

SEQ ID NO: 420052 - RNA, 15 nt, Bordetella pertussis
cagcaucugccccag

SEQ ID NO: 420053 - RNA, 18 nt, Bordetella pertussis
cagcaucuugcgccgcug

SEQ ID NO: 420054 - RNA, 20 nt, Bordetella pertussis
cagcaucuugcgccgcugcg

SEQ ID NO: 420055 - RNA, 20 nt, Bordetella pertussis
cagcaucuuggccgccacgc

SEQ ID NO: 420056 - RNA, 20 nt, Bordetella pertussis
cagcaugaccgacaggcggc

SEQ ID NO: 420057 - RNA, 17 nt, Bordetella pertussis
cagcaugaucaugccgc

SEQ ID NO: 420058 - RNA, 16 nt, Bordetella pertussis
cagcaugcgcgcgacu

SEQ ID NO: 420059 - RNA, 14 nt, Bordetella pertussis
cagcaugcgcgucu

SEQ ID NO: 420060 - RNA, 22 nt, Bordetella pertussis
cagcaugcgcgucuccagcgcc

SEQ ID NO: 420061 - RNA, 23 nt, Bordetella pertussis
cagcaugcgcgucuccagcgccg

SEQ ID NO: 420062 - RNA, 15 nt, Bordetella pertussis
cagcauggagcuggg

SEQ ID NO: 420063 - RNA, 20 nt, Bordetella pertussis
cagcauggagcuggggccgc

SEQ ID NO: 420064 - RNA, 15 nt, Bordetella pertussis
cagcauggccaccag

SEQ ID NO: 420065 - RNA, 16 nt, Bordetella pertussis
cagcauggccguggcg

SEQ ID NO: 420066 - RNA, 17 nt, Bordetella pertussis
cagcauggccguggcgu

SEQ ID NO: 420067 - RNA, 19 nt, Bordetella pertussis
cagcauggccguggcgugc

SEQ ID NO: 420068 - RNA, 15 nt, Bordetella pertussis
cagcauggcggcgcc

SEQ ID NO: 420069 - RNA, 20 nt, Bordetella pertussis
cagcauggucggcauggcca

SEQ ID NO: 420070 - RNA, 23 nt, Bordetella pertussis
cagcauggucggcauggccagga

SEQ ID NO: 420071 - RNA, 13 nt, Bordetella pertussis
cagcauggcgcca

SEQ ID NO: 420072 - RNA, 16 nt, Bordetella pertussis
cagcauguccgccaug

SEQ ID NO: 420073 - RNA, 12 nt, Bordetella pertussis
cagcaugugcuc

SEQ ID NO: 420074 - RNA, 18 nt, Bordetella pertussis
cagcauuucggcgccgcc

SEQ ID NO: 420075 - RNA, 18 nt, Bordetella pertussis
cagcauuucucgggcgca

SEQ ID NO: 420076 - RNA, 19 nt, Bordetella pertussis
cagccacaggcccaugccg

SEQ ID NO: 420077 - RNA, 19 nt, Bordetella pertussis
cagccaccaugucccuggc

SEQ ID NO: 420078 - RNA, 20 nt, Bordetella pertussis
cagccaccccgucaucgccg

SEQ ID NO: 420079 - RNA, 20 nt, Bordetella pertussis
cagccaccgguugcagcgcg

SEQ ID NO: 420080 - RNA, 19 nt, Bordetella pertussis
cagccacgccggcgcgccg

SEQ ID NO: 420081 - RNA, 13 nt, Bordetella pertussis
cagccacgccugg

SEQ ID NO: 420082 - RNA, 20 nt, Bordetella pertussis
cagccacgccuggccgcgcu

SEQ ID NO: 420083 - RNA, 22 nt, Bordetella pertussis
cagccacuggaacagcuugggc

SEQ ID NO: 420084 - RNA, 15 nt, Bordetella pertussis
cagccagauuccccc

SEQ ID NO: 420085 - RNA, 19 nt, Bordetella pertussis
cagccagccgccgcgcggc

SEQ ID NO: 420086 - RNA, 14 nt, Bordetella pertussis
cagccagcgccgca

SEQ ID NO: 420087 - RNA, 18 nt, Bordetella pertussis
cagccagcgccgcagcgu

SEQ ID NO: 420088 - RNA, 17 nt, Bordetella pertussis
cagccaggccagcgcca

SEQ ID NO: 420089 - RNA, 18 nt, Bordetella pertussis
cagccaggccagcgccag

SEQ ID NO: 420090 - RNA, 19 nt, Bordetella pertussis
cagccaggccagcgccaga

SEQ ID NO: 420091 - RNA, 18 nt, Bordetella pertussis
cagccaggcgccagcggc

SEQ ID NO: 420092 - RNA, 14 nt, Bordetella pertussis
cagccaggcgcgca

SEQ ID NO: 420093 - RNA, 13 nt, Bordetella pertussis
cagccagggcagg

SEQ ID NO: 420094 - RNA, 14 nt, Bordetella pertussis
cagccagggcaggg

SEQ ID NO: 420095 - RNA, 18 nt, Bordetella pertussis
cagccaguugggccaggg

SEQ ID NO: 420096 - RNA, 20 nt, Bordetella pertussis
cagccaguugggccagggcc

SEQ ID NO: 420097 - RNA, 15 nt, Bordetella pertussis
cagccauggaagcgg

SEQ ID NO: 420098 - RNA, 17 nt, Bordetella pertussis
cagccauggaagcggca

SEQ ID NO: 420099 - RNA, 21 nt, Bordetella pertussis
cagccauucgauggcggcgcu

SEQ ID NO: 420100 - RNA, 18 nt, Bordetella pertussis
cagccauugcccacagca

SEQ ID NO: 420101 - RNA, 15 nt, Bordetella pertussis
cagcccaccagcgcc

SEQ ID NO: 420102 - RNA, 22 nt, Bordetella pertussis
cagcccagcgcgauucccuggc

SEQ ID NO: 420103 - RNA, 23 nt, Bordetella pertussis
cagcccagcgcgauucccuggcg

SEQ ID NO: 420104 - RNA, 16 nt, Bordetella pertussis
cagcccaggcgggcgu

SEQ ID NO: 420105 - RNA, 15 nt, Bordetella pertussis
cagcccaguugcugg

SEQ ID NO: 420106 - RNA, 16 nt, Bordetella pertussis
cagccccacgccgacc

SEQ ID NO: 420107 - RNA, 18 nt, Bordetella pertussis
cagccccacgccgaccuc

SEQ ID NO: 420108 - RNA, 16 nt, Bordetella pertussis
cagccccagcagcacg

SEQ ID NO: 420109 - RNA, 12 nt, Bordetella pertussis
cagccccaccuu

SEQ ID NO: 420110 - RNA, 23 nt, Bordetella pertussis
cagccccaccuugcccagcagcu

SEQ ID NO: 420111 - RNA, 16 nt, Bordetella pertussis
cagccccagcgccagc

SEQ ID NO: 420112 - RNA, 18 nt, Bordetella pertussis
cagccccagcgccagcgu

SEQ ID NO: 420113 - RNA, 22 nt, Bordetella pertussis
cagcccccugcggggucugcag

SEQ ID NO: 420114 - RNA, 16 nt, Bordetella pertussis
cagccccggcgcgccg

SEQ ID NO: 420115 - RNA, 18 nt, Bordetella pertussis
cagccccggcgcgccggc

SEQ ID NO: 420116 - RNA, 23 nt, Bordetella pertussis
cagccccgcggccgcggucagcc

SEQ ID NO: 420117 - RNA, 18 nt, Bordetella pertussis
cagcccgaugcgccaggc

SEQ ID NO: 420118 - RNA, 15 nt, Bordetella pertussis
cagcccgcaccgccc

SEQ ID NO: 420119 - RNA, 17 nt, Bordetella pertussis
cagcccgcaccgcccgc

SEQ ID NO: 420120 - RNA, 23 nt, Bordetella pertussis
cagcccgccgauccacucggcca

SEQ ID NO: 420121 - RNA, 16 nt, Bordetella pertussis
cagcccgcgcacgccc

SEQ ID NO: 420122 - RNA, 19 nt, Bordetella pertussis
cagcccgccuggcgccgcg

SEQ ID NO: 420123 - RNA, 16 nt, Bordetella pertussis
cagcccgcgcgccugc

SEQ ID NO: 420124 - RNA, 14 nt, Bordetella pertussis
cagcccgcgcgcgu

SEQ ID NO: 420125 - RNA, 22 nt, Bordetella pertussis
cagcccgcguucaggcgcggcu

SEQ ID NO: 420126 - RNA, 19 nt, Bordetella pertussis
cagcccggaucgcacccgu

SEQ ID NO: 420127 - RNA, 20 nt, Bordetella pertussis
cagcccggccagagccugga

SEQ ID NO: 420128 - RNA, 16 nt, Bordetella pertussis
cagcccggcccccagc

SEQ ID NO: 420129 - RNA, 16 nt, Bordetella pertussis
cagcccggccgccagc

SEQ ID NO: 420130 - RNA, 15 nt, Bordetella pertussis
cagcccggcgcgaca

SEQ ID NO: 420131 - RNA, 14 nt, Bordetella pertussis
cagcccggcgcgcc

SEQ ID NO: 420132 - RNA, 15 nt, Bordetella pertussis
cagcccggcgcgcca

SEQ ID NO: 420133 - RNA, 17 nt, Bordetella pertussis
cagcccggcgugcccag

SEQ ID NO: 420134 - RNA, 22 nt, Bordetella pertussis
cagcccgggaaacucgcgcagc

SEQ ID NO: 420135 - RNA, 20 nt, Bordetella pertussis
cagcccgggcaugcgaaagc

SEQ ID NO: 420136 - RNA, 16 nt, Bordetella pertussis
cagcccuggcccagcg

SEQ ID NO: 420137 - RNA, 13 nt, Bordetella pertussis
cagccgagccugg

SEQ ID NO: 420138 - RNA, 23 nt, Bordetella pertussis
cagccgcaugccggcgaugaugg

SEQ ID NO: 420139 - RNA, 18 nt, Bordetella pertussis
cagccgccauaccgaucu

SEQ ID NO: 420140 - RNA, 19 nt, Bordetella pertussis
cagccgccauaggcgcgca

SEQ ID NO: 420141 - RNA, 14 nt, Bordetella pertussis
cagccgcccgccgg

SEQ ID NO: 420142 - RNA, 15 nt, Bordetella pertussis
cagccgcccgccggg

SEQ ID NO: 420143 - RNA, 12 nt, Bordetella pertussis
cagccgccuggc

SEQ ID NO: 420144 - RNA, 18 nt, Bordetella pertussis
cagccgccuggcgcggcg

SEQ ID NO: 420145 - RNA, 19 nt, Bordetella pertussis
cagccgccuggcgcggcgc

SEQ ID NO: 420146 - RNA, 17 nt, Bordetella pertussis
cagccgcgccagcgccu

SEQ ID NO: 420147 - RNA, 16 nt, Bordetella pertussis
cagccgcgccagggcg

SEQ ID NO: 420148 - RNA, 16 nt, Bordetella pertussis
cagccgcgccugcagc

SEQ ID NO: 420149 - RNA, 17 nt, Bordetella pertussis
cagccgcuccagccacc

SEQ ID NO: 420150 - RNA, 18 nt, Bordetella pertussis
cagccgcucgcgcgacca

SEQ ID NO: 420151 - RNA, 20 nt, Bordetella pertussis
cagccgcucggccacgcgcu

SEQ ID NO: 420152 - RNA, 21 nt, Bordetella pertussis
cagccgcucguaguguuccug

SEQ ID NO: 420153 - RNA, 16 nt, Bordetella pertussis
cagccgcugcagcacg

SEQ ID NO: 420154 - RNA, 21 nt, Bordetella pertussis
cagccgcugcagcacgcacca

SEQ ID NO: 420155 - RNA, 14 nt, Bordetella pertussis
cagccgcugcagcg

SEQ ID NO: 420156 - RNA, 19 nt, Bordetella pertussis
cagccgcuggcgcgccgcc

SEQ ID NO: 420157 - RNA, 21 nt, Bordetella pertussis
cagccgcuggcgcgccgccuc

SEQ ID NO: 420158 - RNA, 16 nt, Bordetella pertussis
cagccggacccgcgcc

SEQ ID NO: 420159 - RNA, 19 nt, Bordetella pertussis
cagccggacccgcgccgca

SEQ ID NO: 420160 - RNA, 13 nt, Bordetella pertussis
cagccggcccagc

SEQ ID NO: 420161 - RNA, 15 nt, Bordetella pertussis
cagccggcccagcau

SEQ ID NO: 420162 - RNA, 13 nt, Bordetella pertussis
cagccggcccccu

SEQ ID NO: 420163 - RNA, 14 nt, Bordetella pertussis
cagccggcggcaug

SEQ ID NO: 420164 - RNA, 14 nt, Bordetella pertussis
cagccggcgcgcca

SEQ ID NO: 420165 - RNA, 23 nt, Bordetella pertussis
cagccgggcgaucgcgucggcca

SEQ ID NO: 420166 - RNA, 14 nt, Bordetella pertussis
cagccgggcggcca

SEQ ID NO: 420167 - RNA, 22 nt, Bordetella pertussis
cagccgggucggcugaugcccu

SEQ ID NO: 420168 - RNA, 16 nt, Bordetella pertussis
cagccgucgcgcugca

SEQ ID NO: 420169 - RNA, 19 nt, Bordetella pertussis
cagccguucaucagcgcgc

SEQ ID NO: 420170 - RNA, 17 nt, Bordetella pertussis
cagccguugcgccagcg

SEQ ID NO: 420171 - RNA, 19 nt, Bordetella pertussis
cagccguuggcgcccagcg

SEQ ID NO: 420172 - RNA, 20 nt, Bordetella pertussis
cagccguuggcgcccagcgc

SEQ ID NO: 420173 - RNA, 21 nt, Bordetella pertussis
cagccguuggcgcccagcgcc

SEQ ID NO: 420174 - RNA, 21 nt, Bordetella pertussis
cagccugcccgggcagcaccg

SEQ ID NO: 420175 - RNA, 13 nt, Bordetella pertussis
cagccugcccucg

SEQ ID NO: 420176 - RNA, 18 nt, Bordetella pertussis
cagccugccggcgcgccc

SEQ ID NO: 420177 - RNA, 16 nt, Bordetella pertussis
cagccugcuggugcug

SEQ ID NO: 420178 - RNA, 17 nt, Bordetella pertussis
cagccugcuggugcugg

SEQ ID NO: 420179 - RNA, 15 nt, Bordetella pertussis
cagccuggcaaugcg

SEQ ID NO: 420180 - RNA, 15 nt, Bordetella pertussis
cagccuggcgccaac

SEQ ID NO: 420181 - RNA, 18 nt, Bordetella pertussis
cagccugggccuguacug

SEQ ID NO: 420182 - RNA, 17 nt, Bordetella pertussis
cagccugggcgccuggc

SEQ ID NO: 420183 - RNA, 19 nt, Bordetella pertussis
cagccugggcgccuggcug

SEQ ID NO: 420184 - RNA, 14 nt, Bordetella pertussis
cagccuugcuccgg

SEQ ID NO: 420185 - RNA, 16 nt, Bordetella pertussis
cagccuugcuccggcg

SEQ ID NO: 420186 - RNA, 17 nt, Bordetella pertussis
cagccuugcuccggcgu

SEQ ID NO: 420187 - RNA, 22 nt, Bordetella pertussis
cagcgaaagcacggcgaugcug

SEQ ID NO: 420188 - RNA, 19 nt, Bordetella pertussis
cagcgaacggauggucgug

SEQ ID NO: 420189 - RNA, 14 nt, Bordetella pertussis
cagcgacaggacgu

SEQ ID NO: 420190 - RNA, 17 nt, Bordetella pertussis
cagcgacaucgugcugu

SEQ ID NO: 420191 - RNA, 15 nt, Bordetella pertussis
cagcgaccgcggcgg

SEQ ID NO: 420192 - RNA, 20 nt, Bordetella pertussis
cagcgacgagggcgccauga

SEQ ID NO: 420193 - RNA, 17 nt, Bordetella pertussis
cagcgacggccccagcg

SEQ ID NO: 420194 - RNA, 15 nt, Bordetella pertussis
cagcgacuugucgcg

SEQ ID NO: 420195 - RNA, 14 nt, Bordetella pertussis
cagcgagaccgugg

SEQ ID NO: 420196 - RNA, 18 nt, Bordetella pertussis
cagcgagaucagcaccgc

SEQ ID NO: 420197 - RNA, 16 nt, Bordetella pertussis
cagcgagcccgccauc

SEQ ID NO: 420198 - RNA, 14 nt, Bordetella pertussis
cagcgagccggcca

SEQ ID NO: 420199 - RNA, 23 nt, Bordetella pertussis
cagcgagccggccagcgccacca

SEQ ID NO: 420200 - RNA, 15 nt, Bordetella pertussis
cagcgagcggggcug

SEQ ID NO: 420201 - RNA, 21 nt, Bordetella pertussis
cagcgaggccucgugcugcug

SEQ ID NO: 420202 - RNA, 20 nt, Bordetella pertussis
cagcgaggcgcagcgcagcu

SEQ ID NO: 420203 - RNA, 21 nt, Bordetella pertussis
cagcgaggcggcaagcggcgu

SEQ ID NO: 420204 - RNA, 14 nt, Bordetella pertussis
cagcgaggccgcuu

SEQ ID NO: 420205 - RNA, 14 nt, Bordetella pertussis
cagcgagugaugga

SEQ ID NO: 420206 - RNA, 18 nt, Bordetella pertussis
cagcgauuucuucugcgc

SEQ ID NO: 420207 - RNA, 16 nt, Bordetella pertussis
cagcgcaaacgggggc

SEQ ID NO: 420208 - RNA, 19 nt, Bordetella pertussis
cagcgcaaggguuguggcc

SEQ ID NO: 420209 - RNA, 22 nt, Bordetella pertussis
cagcgcaccaccaccaugugcu

SEQ ID NO: 420210 - RNA, 14 nt, Bordetella pertussis
cagcgcaccgucgc

SEQ ID NO: 420211 - RNA, 16 nt, Bordetella pertussis
cagcgcacgcagcgcu

SEQ ID NO: 420212 - RNA, 21 nt, Bordetella pertussis
cagcgcacugagaaaggccgc

SEQ ID NO: 420213 - RNA, 18 nt, Bordetella pertussis
cagcgcacugaucgccgc

SEQ ID NO: 420214 - RNA, 17 nt, Bordetella pertussis
cagcgcagcgccacgcu

SEQ ID NO: 420215 - RNA, 22 nt, Bordetella pertussis
cagcgcaggauuuccucgccgu

SEQ ID NO: 420216 - RNA, 13 nt, Bordetella pertussis
cagcgcaggcuga

SEQ ID NO: 420217 - RNA, 18 nt, Bordetella pertussis
cagcgcaggaugggcagc

SEQ ID NO: 420218 - RNA, 20 nt, Bordetella pertussis
cagcgcauaggacgccacca

SEQ ID NO: 420219 - RNA, 15 nt, Bordetella pertussis
cagcgcaucgcgcgc

SEQ ID NO: 420220 - RNA, 16 nt, Bordetella pertussis
cagcgcaucgcgcgcg

SEQ ID NO: 420221 - RNA, 22 nt, Bordetella pertussis
cagcgcaugccgucgagcgcga

SEQ ID NO: 420222 - RNA, 19 nt, Bordetella pertussis
cagcgcauugcgguccagg

SEQ ID NO: 420223 - RNA, 12 nt, Bordetella pertussis
cagcgccaccag

SEQ ID NO: 420224 - RNA, 20 nt, Bordetella pertussis
cagcgccaccagcagcgcca

SEQ ID NO: 420225 - RNA, 17 nt, Bordetella pertussis
cagcgccacgcccuggc

SEQ ID NO: 420226 - RNA, 15 nt, Bordetella pertussis
cagcgccacgccggc

SEQ ID NO: 420227 - RNA, 15 nt, Bordetella pertussis
cagcgccacgcgagc

SEQ ID NO: 420228 - RNA, 13 nt, Bordetella pertussis
cagcgccacgcug

SEQ ID NO: 420229 - RNA, 16 nt, Bordetella pertussis
cagcgccagcaccggc

SEQ ID NO: 420230 - RNA, 13 nt, Bordetella pertussis
cagcgccagcacg

SEQ ID NO: 420231 - RNA, 13 nt, Bordetella pertussis
cagcgccagcagc

SEQ ID NO: 420232 - RNA, 21 nt, Bordetella pertussis
cagcgccagcagggucagcgg

SEQ ID NO: 420233 - RNA, 15 nt, Bordetella pertussis
cagcgccagcccgcu

SEQ ID NO: 420234 - RNA, 16 nt, Bordetella pertussis
cagcgccagcccgcug

SEQ ID NO: 420235 - RNA, 14 nt, Bordetella pertussis
cagcgccagccgcu

SEQ ID NO: 420236 - RNA, 19 nt, Bordetella pertussis
cagcgccaggccgcgcagg

SEQ ID NO: 420237 - RNA, 17 nt, Bordetella pertussis
cagcgccagggccaggc

SEQ ID NO: 420238 - RNA, 18 nt, Bordetella pertussis
cagcgccagggccgccgc

SEQ ID NO: 420239 - RNA, 18 nt, Bordetella pertussis
cagcgccaguccgcgcuc

SEQ ID NO: 420240 - RNA, 17 nt, Bordetella pertussis
cagcgccauuccgaugu

SEQ ID NO: 420241 - RNA, 19 nt, Bordetella pertussis
cagcgcccaaucgggcagc

SEQ ID NO: 420242 - RNA, 12 nt, Bordetella pertussis
cagcgcccaggu

SEQ ID NO: 420243 - RNA, 12 nt, Bordetella pertussis
cagcgcccccag

SEQ ID NO: 420244 - RNA, 14 nt, Bordetella pertussis
cagcgcccccagca

SEQ ID NO: 420245 - RNA, 14 nt, Bordetella pertussis
cagcgccccggcgu

SEQ ID NO: 420246 - RNA, 14 nt, Bordetella pertussis
cagcgcccgcgcca

SEQ ID NO: 420247 - RNA, 20 nt, Bordetella pertussis
cagcgccgccaccucggcgu

SEQ ID NO: 420248 - RNA, 16 nt, Bordetella pertussis
cagcgccgccagccgc

SEQ ID NO: 420249 - RNA, 18 nt, Bordetella pertussis
cagcgccgccagccgcug

SEQ ID NO: 420250 - RNA, 22 nt, Bordetella pertussis
cagcgccgccuucaccggcccc

SEQ ID NO: 420251 - RNA, 15 nt, Bordetella pertussis
cagcgccgcgaugcg

SEQ ID NO: 420252 - RNA, 14 nt, Bordetella pertussis
cagcgccgcgcgcg

SEQ ID NO: 420253 - RNA, 17 nt, Bordetella pertussis
cagcgccgcuuccaccg

SEQ ID NO: 420254 - RNA, 16 nt, Bordetella pertussis
cagcgccggcacgcug

SEQ ID NO: 420255 - RNA, 19 nt, Bordetella pertussis
cagcgccggcagccccagc

SEQ ID NO: 420256 - RNA, 14 nt, Bordetella pertussis
cagcgccggcagcg

SEQ ID NO: 420257 - RNA, 16 nt, Bordetella pertussis
cagcgccggcgcauga

SEQ ID NO: 420258 - RNA, 17 nt, Bordetella pertussis
cagcgccggcgcgucca

SEQ ID NO: 420259 - RNA, 23 nt, Bordetella pertussis
cagcgccggcaugaagcgcagca

SEQ ID NO: 420260 - RNA, 20 nt, Bordetella pertussis
cagcgccgguucgacgcuga

SEQ ID NO: 420261 - RNA, 23 nt, Bordetella pertussis
cagcgccugcaaguccagcgugg

SEQ ID NO: 420262 - RNA, 16 nt, Bordetella pertussis
cagcgccugcgcggcc

SEQ ID NO: 420263 - RNA, 22 nt, Bordetella pertussis
cagcgccuggccgagcgcggca

SEQ ID NO: 420264 - RNA, 15 nt, Bordetella pertussis
cagcgccuggcggcu

SEQ ID NO: 420265 - RNA, 21 nt, Bordetella pertussis
cagcgccuggcgggccugggc

SEQ ID NO: 420266 - RNA, 22 nt, Bordetella pertussis
cagcgccuggcgggccugggcg

SEQ ID NO: 420267 - RNA, 14 nt, Bordetella pertussis
cagcgccuugccuu

SEQ ID NO: 420268 - RNA, 17 nt, Bordetella pertussis
cagcgccuugcggcgcu

SEQ ID NO: 420269 - RNA, 15 nt, Bordetella pertussis
cagcgcgaccggcgc

SEQ ID NO: 420270 - RNA, 14 nt, Bordetella pertussis
cagcgcgacggccu

SEQ ID NO: 420271 - RNA, 18 nt, Bordetella pertussis
cagcgcgacggccucguc

SEQ ID NO: 420272 - RNA, 16 nt, Bordetella pertussis
cagcgcgauucccugg

SEQ ID NO: 420273 - RNA, 14 nt, Bordetella pertussis
cagcgcgcaggaca

SEQ ID NO: 420274 - RNA, 15 nt, Bordetella pertussis
cagcgcgcaggacaa

SEQ ID NO: 420275 - RNA, 16 nt, Bordetella pertussis
cagcgcgccagcgcgc

SEQ ID NO: 420276 - RNA, 18 nt, Bordetella pertussis
cagcgcgccagcgcgcga

SEQ ID NO: 420277 - RNA, 13 nt, Bordetella pertussis
cagcgcgcccgau

SEQ ID NO: 420278 - RNA, 16 nt, Bordetella pertussis
cagcgcgccgccagcg

SEQ ID NO: 420279 - RNA, 14 nt, Bordetella pertussis
cagcgcgccgccca

SEQ ID NO: 420280 - RNA, 17 nt, Bordetella pertussis
cagcgcgccgcccacca

SEQ ID NO: 420281 - RNA, 21 nt, Bordetella pertussis
cagcgcgccgcccaccaccag

SEQ ID NO: 420282 - RNA, 23 nt, Bordetella pertussis
cagcgcgccgcccaccaccagcg

SEQ ID NO: 420283 - RNA, 14 nt, Bordetella pertussis
cagcgcgccgcgcc

SEQ ID NO: 420284 - RNA, 20 nt, Bordetella pertussis
cagcgcgccgcgcgcggcgg

SEQ ID NO: 420285 - RNA, 17 nt, Bordetella pertussis
cagcgcgccggccaggg

SEQ ID NO: 420286 - RNA, 18 nt, Bordetella pertussis
cagcgcgccggccagggc

SEQ ID NO: 420287 - RNA, 15 nt, Bordetella pertussis
cagcgcgccgggggc

SEQ ID NO: 420288 - RNA, 21 nt, Bordetella pertussis
cagcgcgcgauagauggccag

SEQ ID NO: 420289 - RNA, 13 nt, Bordetella pertussis
cagcgcgcgcagc

SEQ ID NO: 420290 - RNA, 14 nt, Bordetella pertussis
cagcgcgcgcgccg

SEQ ID NO: 420291 - RNA, 15 nt, Bordetella pertussis
cagcgcgcgcgccga

SEQ ID NO: 420292 - RNA, 14 nt, Bordetella pertussis
cagcgcgcgcgcgc

SEQ ID NO: 420293 - RNA, 14 nt, Bordetella pertussis
cagcgcgcgcguga

SEQ ID NO: 420294 - RNA, 22 nt, Bordetella pertussis
cagcgcgcggccggccgcgccc

SEQ ID NO: 420295 - RNA, 12 nt, Bordetella pertussis
cagcgcgcggcc

SEQ ID NO: 420296 - RNA, 17 nt, Bordetella pertussis
cagcgcgcggggcaggc

SEQ ID NO: 420297 - RNA, 17 nt, Bordetella pertussis
cagcgcggcaucggcca

SEQ ID NO: 420298 - RNA, 17 nt, Bordetella pertussis
cagcgcggcaugccgcu

SEQ ID NO: 420299 - RNA, 20 nt, Bordetella pertussis
cagcgcggccgucaccgccg

SEQ ID NO: 420300 - RNA, 17 nt, Bordetella pertussis
cagcgcggcgcacaggg

SEQ ID NO: 420301 - RNA, 19 nt, Bordetella pertussis
cagcgcggcgccggccucc

SEQ ID NO: 420302 - RNA, 23 nt, Bordetella pertussis
cagcgcggcgccggccuccagca

SEQ ID NO: 420303 - RNA, 16 nt, Bordetella pertussis
cagcgcggcgcggcca

SEQ ID NO: 420304 - RNA, 23 nt, Bordetella pertussis
cagcgcggcggccaugcccaggc

SEQ ID NO: 420305 - RNA, 21 nt, Bordetella pertussis
cagcgcggcggcgaccggcgc

SEQ ID NO: 420306 - RNA, 23 nt, Bordetella pertussis
cagcgcggcgggcggcgcggcca

SEQ ID NO: 420307 - RNA, 21 nt, Bordetella pertussis
cagcgcggcguugaccugguc

SEQ ID NO: 420308 - RNA, 17 nt, Bordetella pertussis
cagcgcgucgccgccau

SEQ ID NO: 420309 - RNA, 22 nt, Bordetella pertussis
cagcgcgucggccagcgccgcg

SEQ ID NO: 420310 - RNA, 21 nt, Bordetella pertussis
cagcgcgucggccaggcgcca

SEQ ID NO: 420311 - RNA, 14 nt, Bordetella pertussis
cagcgcgugggcca

SEQ ID NO: 420312 - RNA, 21 nt, Bordetella pertussis
cagcgcgugggccagcaacug

SEQ ID NO: 420313 - RNA, 15 nt, Bordetella pertussis
cagcgcugcaugccc

SEQ ID NO: 420314 - RNA, 16 nt, Bordetella pertussis
cagcgcugguggccag

SEQ ID NO: 420315 - RNA, 15 nt, Bordetella pertussis
cagcgcuguccaggc

SEQ ID NO: 420316 - RNA, 16 nt, Bordetella pertussis
cagcgcuucgugcagc

SEQ ID NO: 420317 - RNA, 24 nt, Bordetella pertussis
cagcgcuucgugcagcgcgugggc

SEQ ID NO: 420318 - RNA, 16 nt, Bordetella pertussis
cagcgcuugcacgcca

SEQ ID NO: 420319 - RNA, 19 nt, Bordetella pertussis
cagcgcuucgggcagcucg

SEQ ID NO: 420320 - RNA, 15 nt, Bordetella pertussis
cagcggagccgcgca

SEQ ID NO: 420321 - RNA, 20 nt, Bordetella pertussis
cagcggaucgccgggcaggc

SEQ ID NO: 420322 - RNA, 16 nt, Bordetella pertussis
cagcggaugccgcccg

SEQ ID NO: 420323 - RNA, 22 nt, Bordetella pertussis
cagcggauugaccagcgcggcc

SEQ ID NO: 420324 - RNA, 13 nt, Bordetella pertussis
cagcggcagcacg

SEQ ID NO: 420325 - RNA, 15 nt, Bordetella pertussis
cagcggcagcacgau

SEQ ID NO: 420326 - RNA, 19 nt, Bordetella pertussis
cagcggcagcauggcgcgc

SEQ ID NO: 420327 - RNA, 17 nt, Bordetella pertussis
cagcggcagcgcgcagg

SEQ ID NO: 420328 - RNA, 19 nt, Bordetella pertussis
cagcggcaggacggggaac

SEQ ID NO: 420329 - RNA, 21 nt, Bordetella pertussis
cagcggcaggacggggaacag

SEQ ID NO: 420330 - RNA, 14 nt, Bordetella pertussis
cagcggcaggcugg

SEQ ID NO: 420331 - RNA, 21 nt, Bordetella pertussis
cagcggcaggcuggccggcgu

SEQ ID NO: 420332 - RNA, 21 nt, Bordetella pertussis
cagcggcaggggcucgcgccc

SEQ ID NO: 420333 - RNA, 13 nt, Bordetella pertussis
cagcggcauugcc

SEQ ID NO: 420334 - RNA, 13 nt, Bordetella pertussis
cagcggccgcgcg

SEQ ID NO: 420335 - RNA, 13 nt, Bordetella pertussis
cagcggccggccc

SEQ ID NO: 420336 - RNA, 18 nt, Bordetella pertussis
cagcggccggcccgugcg

SEQ ID NO: 420337 - RNA, 22 nt, Bordetella pertussis
cagcggccgcugccgcgcgccg

SEQ ID NO: 420338 - RNA, 16 nt, Bordetella pertussis
cagcggccgucgccuu

SEQ ID NO: 420339 - RNA, 17 nt, Bordetella pertussis
cagcggcgacggcgccu

SEQ ID NO: 420340 - RNA, 20 nt, Bordetella pertussis
cagcggcgacggcgccuggc

SEQ ID NO: 420341 - RNA, 17 nt, Bordetella pertussis
cagcggcgacugcccca

SEQ ID NO: 420342 - RNA, 19 nt, Bordetella pertussis
cagcggcgacugccccagc

SEQ ID NO: 420343 - RNA, 17 nt, Bordetella pertussis
cagcggcgagcgcggcg

SEQ ID NO: 420344 - RNA, 15 nt, Bordetella pertussis
cagcggcgcagccgg

SEQ ID NO: 420345 - RNA, 20 nt, Bordetella pertussis
cagcggcgccaugcgcacca

SEQ ID NO: 420346 - RNA, 23 nt, Bordetella pertussis
cagcggcgccaugcgcaccaccg

SEQ ID NO: 420347 - RNA, 17 nt, Bordetella pertussis
cagcggcgcgacgcgcu

SEQ ID NO: 420348 - RNA, 13 nt, Bordetella pertussis
cagcggcgcgccc

SEQ ID NO: 420349 - RNA, 13 nt, Bordetella pertussis
cagcggcgcggcg

SEQ ID NO: 420350 - RNA, 14 nt, Bordetella pertussis
cagcggcgcggcgc

SEQ ID NO: 420351 - RNA, 23 nt, Bordetella pertussis
cagcggcgcuuaccgcgccggcu

SEQ ID NO: 420352 - RNA, 22 nt, Bordetella pertussis
cagcggcgugaugcccaggccc

SEQ ID NO: 420353 - RNA, 17 nt, Bordetella pertussis
cagcggcgugcggccca

SEQ ID NO: 420354 - RNA, 17 nt, Bordetella pertussis
cagcggcguggcggcca

SEQ ID NO: 420355 - RNA, 19 nt, Bordetella pertussis
cagcggcucgagcggcagc

SEQ ID NO: 420356 - RNA, 16 nt, Bordetella pertussis
cagcggcuggcggugc

SEQ ID NO: 420357 - RNA, 14 nt, Bordetella pertussis
cagcuacggcuggc

SEQ ID NO: 420358 - RNA, 20 nt, Bordetella pertussis
cagcuccacgcacaccgccc

SEQ ID NO: 420359 - RNA, 13 nt, Bordetella pertussis
cagcuccagccgc

SEQ ID NO: 420360 - RNA, 17 nt, Bordetella pertussis
cagcuccagccgcaggc

SEQ ID NO: 420361 - RNA, 14 nt, Bordetella pertussis
cagcuccagcgcgc

SEQ ID NO: 420362 - RNA, 21 nt, Bordetella pertussis
cagcuccagcgcgccgaagcg

SEQ ID NO: 420363 - RNA, 16 nt, Bordetella pertussis
cagcuccggcggcagc

SEQ ID NO: 420364 - RNA, 18 nt, Bordetella pertussis
cagcucgccggcgauggc

SEQ ID NO: 420365 - RNA, 18 nt, Bordetella pertussis
cagcucgcgccagggccc

SEQ ID NO: 420366 - RNA, 22 nt, Bordetella pertussis
cagcucgcgccagggccccucc

SEQ ID NO: 420367 - RNA, 13 nt, Bordetella pertussis
cagcucgcgcgcu

SEQ ID NO: 420368 - RNA, 22 nt, Bordetella pertussis
cagcucgcgcgcuucgagccgg

SEQ ID NO: 420369 - RNA, 17 nt, Bordetella pertussis
cagcucgcgcagcaggc

SEQ ID NO: 420370 - RNA, 14 nt, Bordetella pertussis
cagcucgcggucgu

SEQ ID NO: 420371 - RNA, 19 nt, Bordetella pertussis
cagcucggcgaagccgcag

SEQ ID NO: 420372 - RNA, 18 nt, Bordetella pertussis
cagcucggcgaccaggcc

SEQ ID NO: 420373 - RNA, 23 nt, Bordetella pertussis
cagcucggcgaccaggcccaugg

SEQ ID NO: 420374 - RNA, 17 nt, Bordetella pertussis
cagcucggcggccgccu

SEQ ID NO: 420375 - RNA, 19 nt, Bordetella pertussis
cagcucggcggccgccugc

SEQ ID NO: 420376 - RNA, 16 nt, Bordetella pertussis
cagcucgguggucaac

SEQ ID NO: 420377 - RNA, 22 nt, Bordetella pertussis
cagcucgguggucaacggcaag

SEQ ID NO: 420378 - RNA, 15 nt, Bordetella pertussis
cagcugcuugcccag

SEQ ID NO: 420379 - RNA, 17 nt, Bordetella pertussis
cagcuggaacgcgccgc

SEQ ID NO: 420380 - RNA, 18 nt, Bordetella pertussis
cagcuggaacgcgccgcu

SEQ ID NO: 420381 - RNA, 13 nt, Bordetella pertussis
cagcuggaagcgc

SEQ ID NO: 420382 - RNA, 22 nt, Bordetella pertussis
cagcuggaagcgcgccaggcgc

SEQ ID NO: 420383 - RNA, 17 nt, Bordetella pertussis
cagcuggauggccugcu

SEQ ID NO: 420384 - RNA, 22 nt, Bordetella pertussis
cagcuggcccuggcagacguac

SEQ ID NO: 420385 - RNA, 18 nt, Bordetella pertussis
cagcuggcgcaccaggcu

SEQ ID NO: 420386 - RNA, 16 nt, Bordetella pertussis
cagcuguucagacugc

SEQ ID NO: 420387 - RNA, 19 nt, Bordetella pertussis
cagcuucagccugggccug

SEQ ID NO: 420388 - RNA, 21 nt, Bordetella pertussis
cagcuucaucaccuucccgcu

SEQ ID NO: 420389 - RNA, 21 nt, Bordetella pertussis
cagcuucuggaucaccgccgg

SEQ ID NO: 420390 - RNA, 15 nt, Bordetella pertussis
cagcuuccagguaca

SEQ ID NO: 420391 - RNA, 20 nt, Bordetella pertussis
cagcuugaccgccagcaucc

SEQ ID NO: 420392 - RNA, 22 nt, Bordetella pertussis
cagcuugacguccagccagggu

SEQ ID NO: 420393 - RNA, 16 nt, Bordetella pertussis
cagcuugagcaggcgc

SEQ ID NO: 420394 - RNA, 18 nt, Bordetella pertussis
cagcuugaccuugagcac

SEQ ID NO: 420395 - RNA, 14 nt, Bordetella pertussis
cagcuugaugggcg

SEQ ID NO: 420396 - RNA, 17 nt, Bordetella pertussis
cagcuugcccgcgcgca

SEQ ID NO: 420397 - RNA, 17 nt, Bordetella pertussis
caggaacgccagcagca

SEQ ID NO: 420398 - RNA, 19 nt, Bordetella pertussis
caggaacgccagcagcacc

SEQ ID NO: 420399 - RNA, 18 nt, Bordetella pertussis
caggaacucagcgcacug

SEQ ID NO: 420400 - RNA, 15 nt, Bordetella pertussis
caggaagaacgagaa

SEQ ID NO: 420401 - RNA, 19 nt, Bordetella pertussis
caggaagacuuccgugcca

SEQ ID NO: 420402 - RNA, 15 nt, Bordetella pertussis
caggaagagcuggcg

SEQ ID NO: 420403 - RNA, 15 nt, Bordetella pertussis
caggaagaucggccc

SEQ ID NO: 420404 - RNA, 15 nt, Bordetella pertussis
caggaagccggcccg

SEQ ID NO: 420405 - RNA, 14 nt, Bordetella pertussis
caggaagcgcacca

SEQ ID NO: 420406 - RNA, 14 nt, Bordetella pertussis
caggaagcgcgccg

SEQ ID NO: 420407 - RNA, 15 nt, Bordetella pertussis
caggaagcgcuggcc

SEQ ID NO: 420408 - RNA, 23 nt, Bordetella pertussis
caggaagcgcuggcccgucaugg

SEQ ID NO: 420409 - RNA, 14 nt, Bordetella pertussis
caggaagcggcgca

SEQ ID NO: 420410 - RNA, 17 nt, Bordetella pertussis
caggaagcggcgcacca

SEQ ID NO: 420411 - RNA, 14 nt, Bordetella pertussis
caggaagcgggccu

SEQ ID NO: 420412 - RNA, 14 nt, Bordetella pertussis
caggaaggcccggu

SEQ ID NO: 420413 - RNA, 14 nt, Bordetella pertussis
caggaaguucaggg

SEQ ID NO: 420414 - RNA, 13 nt, Bordetella pertussis
caggacaaggcgc

SEQ ID NO: 420415 - RNA, 14 nt, Bordetella pertussis
caggaccaggauga

SEQ ID NO: 420416 - RNA, 22 nt, Bordetella pertussis
caggaccaggaugaugcagcac

SEQ ID NO: 420417 - RNA, 21 nt, Bordetella pertussis
caggaccgcgccgccgcgccc

SEQ ID NO: 420418 - RNA, 18 nt, Bordetella pertussis
caggaccuguacuggcug

SEQ ID NO: 420419 - RNA, 20 nt, Bordetella pertussis
caggaccuguacuggcuggu

SEQ ID NO: 420420 - RNA, 16 nt, Bordetella pertussis
caggacguccaggccu

SEQ ID NO: 420421 - RNA, 22 nt, Bordetella pertussis
caggacuucgucgaucauggcg

SEQ ID NO: 420422 - RNA, 20 nt, Bordetella pertussis
caggagcaacuggggcgcuc

SEQ ID NO: 420423 - RNA, 20 nt, Bordetella pertussis
caggaguucccagcgcgcga

SEQ ID NO: 420424 - RNA, 14 nt, Bordetella pertussis
caggaucgcggcca

SEQ ID NO: 420425 - RNA, 16 nt, Bordetella pertussis
caggaucgcggccagc

SEQ ID NO: 420426 - RNA, 19 nt, Bordetella pertussis
caggaucgucgucaugaug

SEQ ID NO: 420427 - RNA, 18 nt, Bordetella pertussis
caggcacuggcgcggcgc

SEQ ID NO: 420428 - RNA, 20 nt, Bordetella pertussis
caggcagacgaugcccaggc

SEQ ID NO: 420429 - RNA, 15 nt, Bordetella pertussis
caggcagccggcccc

SEQ ID NO: 420430 - RNA, 17 nt, Bordetella pertussis
caggcagccggccccgc

SEQ ID NO: 420431 - RNA, 19 nt, Bordetella pertussis
caggcagcggccgcgcggg

SEQ ID NO: 420432 - RNA, 15 nt, Bordetella pertussis
caggcaggcgcgccg

SEQ ID NO: 420433 - RNA, 17 nt, Bordetella pertussis
caggcaggcgcgccggg

SEQ ID NO: 420434 - RNA, 20 nt, Bordetella pertussis
caggcagugguggugcagcg

SEQ ID NO: 420435 - RNA, 22 nt, Bordetella pertussis
caggcagugguggugcagcggc

SEQ ID NO: 420436 - RNA, 17 nt, Bordetella pertussis
caggcaguuggcggcgc

SEQ ID NO: 420437 - RNA, 23 nt, Bordetella pertussis
caggccgaacugggacaggccca

SEQ ID NO: 420438 - RNA, 20 nt, Bordetella pertussis
caggccgaggcugcgcgcgc

SEQ ID NO: 420439 - RNA, 18 nt, Bordetella pertussis
caggccgauauugcggua

SEQ ID NO: 420440 - RNA, 17 nt, Bordetella pertussis
caggccgaucagcacca

SEQ ID NO: 420441 - RNA, 20 nt, Bordetella pertussis
caggccgauggcguccagca

SEQ ID NO: 420442 - RNA, 16 nt, Bordetella pertussis
caggccgauguagccc

SEQ ID NO: 420443 - RNA, 16 nt, Bordetella pertussis
caggccgccagggccg

SEQ ID NO: 420444 - RNA, 13 nt, Bordetella pertussis
caggccgcccagc

SEQ ID NO: 420445 - RNA, 16 nt, Bordetella pertussis
caggccgcccagccgc

SEQ ID NO: 420446 - RNA, 14 nt, Bordetella pertussis
caggccgcccagcg

SEQ ID NO: 420447 - RNA, 21 nt, Bordetella pertussis
caggccgccccaacggccuuc

SEQ ID NO: 420448 - RNA, 13 nt, Bordetella pertussis
caggccgccgccg

SEQ ID NO: 420449 - RNA, 21 nt, Bordetella pertussis
caggccgccguacgaguggcc

SEQ ID NO: 420450 - RNA, 14 nt, Bordetella pertussis
caggccgcgcagca

SEQ ID NO: 420451 - RNA, 16 nt, Bordetella pertussis
caggccgcgcagggca

SEQ ID NO: 420452 - RNA, 13 nt, Bordetella pertussis
caggccgcgcagc

SEQ ID NO: 420453 - RNA, 14 nt, Bordetella pertussis
caggccgcgccggc

SEQ ID NO: 420454 - RNA, 16 nt, Bordetella pertussis
caggccgcgccggcuc

SEQ ID NO: 420455 - RNA, 14 nt, Bordetella pertussis
caggccgcgcugcc

SEQ ID NO: 420456 - RNA, 16 nt, Bordetella pertussis
caggccgcggccaggc

SEQ ID NO: 420457 - RNA, 15 nt, Bordetella pertussis
caggccgcggcgccc

SEQ ID NO: 420458 - RNA, 17 nt, Bordetella pertussis
caggccgcgguggucca

SEQ ID NO: 420459 - RNA, 19 nt, Bordetella pertussis
caggccgcuucgaugcugg

SEQ ID NO: 420460 - RNA, 24 nt, Bordetella pertussis
caggccgcuuucgaccagcgacag

SEQ ID NO: 420461 - RNA, 19 nt, Bordetella pertussis
caggccggccagcaagggg

SEQ ID NO: 420462 - RNA, 18 nt, Bordetella pertussis
caggccggccuuggccau

SEQ ID NO: 420463 - RNA, 15 nt, Bordetella pertussis
caggccggcgccagc

SEQ ID NO: 420464 - RNA, 14 nt, Bordetella pertussis
caggccggcgcgca

SEQ ID NO: 420465 - RNA, 16 nt, Bordetella pertussis
caggccggcgcgcauc

SEQ ID NO: 420466 - RNA, 19 nt, Bordetella pertussis
caggccggcgcgccggccc

SEQ ID NO: 420467 - RNA, 14 nt, Bordetella pertussis
caggccggcggcca

SEQ ID NO: 420468 - RNA, 13 nt, Bordetella pertussis
caggccgggcagc

SEQ ID NO: 420469 - RNA, 17 nt, Bordetella pertussis
caggccgggcagcgaga

SEQ ID NO: 420470 - RNA, 20 nt, Bordetella pertussis
caggccgggcagcgagaugg

SEQ ID NO: 420471 - RNA, 18 nt, Bordetella pertussis
caggccggggccgcccag

SEQ ID NO: 420472 - RNA, 23 nt, Bordetella pertussis
caggccggggccgcccagcaccu

SEQ ID NO: 420473 - RNA, 22 nt, Bordetella pertussis
caggccgggucguucgaacugg

SEQ ID NO: 420474 - RNA, 14 nt, Bordetella pertussis
caggccggucagga

SEQ ID NO: 420475 - RNA, 14 nt, Bordetella pertussis
caggccggugcgca

SEQ ID NO: 420476 - RNA, 23 nt, Bordetella pertussis
caggccggugggcgagaggggcu

SEQ ID NO: 420477 - RNA, 16 nt, Bordetella pertussis
caggccgucgagccgg

SEQ ID NO: 420478 - RNA, 16 nt, Bordetella pertussis
caggccguggcccagc

SEQ ID NO: 420479 - RNA, 14 nt, Bordetella pertussis
caggccguggcgca

SEQ ID NO: 420480 - RNA, 20 nt, Bordetella pertussis
caggccguuccaguccagcg

SEQ ID NO: 420481 - RNA, 22 nt, Bordetella pertussis
caggccguuggccgcgcgguac

SEQ ID NO: 420482 - RNA, 23 nt, Bordetella pertussis
caggccguuguccuggcgcgcca

SEQ ID NO: 420483 - RNA, 15 nt, Bordetella pertussis
caggcgcaggcgcga

SEQ ID NO: 420484 - RNA, 16 nt, Bordetella pertussis
caggcgcaggcgcgag

SEQ ID NO: 420485 - RNA, 16 nt, Bordetella pertussis
caggcgcaucgacagc

SEQ ID NO: 420486 - RNA, 14 nt, Bordetella pertussis
caggcgccaguccc

SEQ ID NO: 420487 - RNA, 17 nt, Bordetella pertussis
caggcgcccgccaccag

SEQ ID NO: 420488 - RNA, 12 nt, Bordetella pertussis
caggcgcccgug

SEQ ID NO: 420489 - RNA, 19 nt, Bordetella pertussis
caggcgccgauccagggcc

SEQ ID NO: 420490 - RNA, 22 nt, Bordetella pertussis
caggcgccgauccagggccgca

SEQ ID NO: 420491 - RNA, 17 nt, Bordetella pertussis
caggcgccgcagauggc

SEQ ID NO: 420492 - RNA, 15 nt, Bordetella pertussis
caggcgccgccgccc

SEQ ID NO: 420493 - RNA, 16 nt, Bordetella pertussis
caggcgccgccgcccg

SEQ ID NO: 420494 - RNA, 18 nt, Bordetella pertussis
caggcgccgccgcccggc

SEQ ID NO: 420495 - RNA, 14 nt, Bordetella pertussis
caggcgccggcugg

SEQ ID NO: 420496 - RNA, 16 nt, Bordetella pertussis
caggcgccugccccgc

SEQ ID NO: 420497 - RNA, 16 nt, Bordetella pertussis
caggcgccuucggcgc

SEQ ID NO: 420498 - RNA, 17 nt, Bordetella pertussis
caggcgcgagcgccggg

SEQ ID NO: 420499 - RNA, 20 nt, Bordetella pertussis
caggcgcgcaucgcgcggca

SEQ ID NO: 420500 - RNA, 15 nt, Bordetella pertussis
caggcgcgccagccc

SEQ ID NO: 420501 - RNA, 21 nt, Bordetella pertussis
caggcgcgccagcccgccgcu

SEQ ID NO: 420502 - RNA, 16 nt, Bordetella pertussis
caggcgcgccagccgc

SEQ ID NO: 420503 - RNA, 18 nt, Bordetella pertussis
caggcgcgccagccgcgc

SEQ ID NO: 420504 - RNA, 13 nt, Bordetella pertussis
caggcgcgccgcg

SEQ ID NO: 420505 - RNA, 11 nt, Bordetella pertussis
caggcgcggcg

SEQ ID NO: 420506 - RNA, 16 nt, Bordetella pertussis
caggcgcgcuggcgcu

SEQ ID NO: 420507 - RNA, 16 nt, Bordetella pertussis
caggcgcggcuggaug

SEQ ID NO: 420508 - RNA, 19 nt, Bordetella pertussis
caggcgcgugaggucgcgc

SEQ ID NO: 420509 - RNA, 14 nt, Bordetella pertussis
caggcgcgugcgca

SEQ ID NO: 420510 - RNA, 17 nt, Bordetella pertussis
caggcgcgugggcaggu

SEQ ID NO: 420511 - RNA, 23 nt, Bordetella pertussis
caggcgcucaagggccugucaca

SEQ ID NO: 420512 - RNA, 15 nt, Bordetella pertussis
caggcgcuccauggc

SEQ ID NO: 420513 - RNA, 14 nt, Bordetella pertussis
caggcgcuccagca

SEQ ID NO: 420514 - RNA, 14 nt, Bordetella pertussis
caggcggcgacgau

SEQ ID NO: 420515 - RNA, 18 nt, Bordetella pertussis
caggcggcggcgcggcgc

SEQ ID NO: 420516 - RNA, 20 nt, Bordetella pertussis
caggcggcggcgcggcgcca

SEQ ID NO: 420517 - RNA, 15 nt, Bordetella pertussis
caggcggcggugcca

SEQ ID NO: 420518 - RNA, 17 nt, Bordetella pertussis
caggcgggcaucgccca

SEQ ID NO: 420519 - RNA, 14 nt, Bordetella pertussis
caggcgggccaggc

SEQ ID NO: 420520 - RNA, 16 nt, Bordetella pertussis
caggcgguacaggccg

SEQ ID NO: 420521 - RNA, 22 nt, Bordetella pertussis
caggcgucugcuacaccgugcu

SEQ ID NO: 420522 - RNA, 23 nt, Bordetella pertussis
caggcgucugcuacaccgugcug

SEQ ID NO: 420523 - RNA, 20 nt, Bordetella pertussis
caggcgugaacgccccggcc

SEQ ID NO: 420524 - RNA, 12 nt, Bordetella pertussis
caggcgugcgca

SEQ ID NO: 420525 - RNA, 19 nt, Bordetella pertussis
caggcgugcgcgggcgcca

SEQ ID NO: 420526 - RNA, 15 nt, Bordetella pertussis
caggcguucgcacca

SEQ ID NO: 420527 - RNA, 20 nt, Bordetella pertussis
caggcguucgcaccaguccc

SEQ ID NO: 420528 - RNA, 21 nt, Bordetella pertussis
caggcuaugcaggcuuugcug

SEQ ID NO: 420529 - RNA, 16 nt, Bordetella pertussis
caggcucagcaggguc

SEQ ID NO: 420530 - RNA, 12 nt, Bordetella pertussis
caggcucagccc

SEQ ID NO: 420531 - RNA, 14 nt, Bordetella pertussis
caggcuccacagcc

SEQ ID NO: 420532 - RNA, 23 nt, Bordetella pertussis
caggcuccaguggugcucccagg

SEQ ID NO: 420533 - RNA, 17 nt, Bordetella pertussis
caggcucccgcuggcgg

SEQ ID NO: 420534 - RNA, 18 nt, Bordetella pertussis
caggcuccgagggacacc

SEQ ID NO: 420535 - RNA, 11 nt, Bordetella pertussis
cagggacaggc

SEQ ID NO: 420536 - RNA, 13 nt, Bordetella pertussis
cagggacgggcca

SEQ ID NO: 420537 - RNA, 17 nt, Bordetella pertussis
cagggacuugggcaggc

SEQ ID NO: 420538 - RNA, 18 nt, Bordetella pertussis
cagggagccguucuggca

SEQ ID NO: 420539 - RNA, 17 nt, Bordetella pertussis
cagggcagcggccagau

SEQ ID NO: 420540 - RNA, 14 nt, Bordetella pertussis
cagggcaugggccc

SEQ ID NO: 420541 - RNA, 24 nt, Bordetella pertussis
cagggccacgcccacgcgccgcca

SEQ ID NO: 420542 - RNA, 17 nt, Bordetella pertussis
cagggccacgcccaggc

SEQ ID NO: 420543 - RNA, 22 nt, Bordetella pertussis
cagggccacgcccaggccgugg

SEQ ID NO: 420544 - RNA, 13 nt, Bordetella pertussis
cagggccaggccc

SEQ ID NO: 420545 - RNA, 22 nt, Bordetella pertussis
cagggccaggcccacggcgcca

SEQ ID NO: 420546 - RNA, 19 nt, Bordetella pertussis
cagggccauguggcgcagc

SEQ ID NO: 420547 - RNA, 17 nt, Bordetella pertussis
cagggcccgcaucggcg

SEQ ID NO: 420548 - RNA, 13 nt, Bordetella pertussis
cagggccgccaug

SEQ ID NO: 420549 - RNA, 15 nt, Bordetella pertussis
cagggccgcgccggg

SEQ ID NO: 420550 - RNA, 17 nt, Bordetella pertussis
cagggccgccgcgccca

SEQ ID NO: 420551 - RNA, 14 nt, Bordetella pertussis
cagggccuccucgg

SEQ ID NO: 420552 - RNA, 21 nt, Bordetella pertussis
cagggccuccugcagcagguc

SEQ ID NO: 420553 - RNA, 16 nt, Bordetella pertussis
cagggccugcgggccg

SEQ ID NO: 420554 - RNA, 18 nt, Bordetella pertussis
cagggccugcgggccggg

SEQ ID NO: 420555 - RNA, 22 nt, Bordetella pertussis
cagggccuggaagcuggccagc

SEQ ID NO: 420556 - RNA, 17 nt, Bordetella pertussis
cagggccuggcagaugc

SEQ ID NO: 420557 - RNA, 18 nt, Bordetella pertussis
cagggccuggcagaugcg

SEQ ID NO: 420558 - RNA, 23 nt, Bordetella pertussis
cagggccuggcagaugcgcgcca

SEQ ID NO: 420559 - RNA, 19 nt, Bordetella pertussis
cagggcgaucagcaccgcg

SEQ ID NO: 420560 - RNA, 23 nt, Bordetella pertussis
cagggcgcccgccgacgaaaugc

SEQ ID NO: 420561 - RNA, 14 nt, Bordetella pertussis
cagggcgccgcgcg

SEQ ID NO: 420562 - RNA, 15 nt, Bordetella pertussis
cagggcgccugcaga

SEQ ID NO: 420563 - RNA, 15 nt, Bordetella pertussis
cagggcgcgacgcca

SEQ ID NO: 420564 - RNA, 17 nt, Bordetella pertussis
cagggcgcgcagcaggc

SEQ ID NO: 420565 - RNA, 12 nt, Bordetella pertussis
cagggcgcgccg

SEQ ID NO: 420566 - RNA, 14 nt, Bordetella pertussis
cagggcggccaggc

SEQ ID NO: 420567 - RNA, 18 nt, Bordetella pertussis
cagggcggccggcacgcc

SEQ ID NO: 420568 - RNA, 19 nt, Bordetella pertussis
cagggcggccggcacgccg

SEQ ID NO: 420569 - RNA, 21 nt, Bordetella pertussis
cagggcgggcggugcggccuc

SEQ ID NO: 420570 - RNA, 20 nt, Bordetella pertussis
cagggcgggggacgcccgcc

SEQ ID NO: 420571 - RNA, 16 nt, Bordetella pertussis
cagggcgucgcggcgu

SEQ ID NO: 420572 - RNA, 18 nt, Bordetella pertussis
cagggcgucggccgcgcc

SEQ ID NO: 420573 - RNA, 13 nt, Bordetella pertussis
cagggcgucugcu

SEQ ID NO: 420574 - RNA, 23 nt, Bordetella pertussis
cagggcgugcgggacggccaggg

SEQ ID NO: 420575 - RNA, 22 nt, Bordetella pertussis
cagggcugcgaugcgggccugg

SEQ ID NO: 420576 - RNA, 16 nt, Bordetella pertussis
cagggcuuccaguucg

SEQ ID NO: 420577 - RNA, 14 nt, Bordetella pertussis
caggggacggcgca

SEQ ID NO: 420578 - RNA, 19 nt, Bordetella pertussis
caggggacggcgcacccgc

SEQ ID NO: 420579 - RNA, 18 nt, Bordetella pertussis
caggggaugacgggcgag

SEQ ID NO: 420580 - RNA, 17 nt, Bordetella pertussis
caggggauugccgcgcg

SEQ ID NO: 420581 - RNA, 20 nt, Bordetella pertussis
caggggccgcacgcgcggca

SEQ ID NO: 420582 - RNA, 16 nt, Bordetella pertussis
caggggccggcgcgcc

SEQ ID NO: 420583 - RNA, 18 nt, Bordetella pertussis
caggggccggcgcgccgc

SEQ ID NO: 420584 - RNA, 16 nt, Bordetella pertussis
caggggcggcgcggcg

SEQ ID NO: 420585 - RNA, 23 nt, Bordetella pertussis
caggggcucuucgacagcgcgca

SEQ ID NO: 420586 - RNA, 14 nt, Bordetella pertussis
cagggggacuggca

SEQ ID NO: 420587 - RNA, 13 nt, Bordetella pertussis
cagggggucaggg

SEQ ID NO: 420588 - RNA, 18 nt, Bordetella pertussis
cagggggucgaucauggc

SEQ ID NO: 420589 - RNA, 23 nt, Bordetella pertussis
caggguacggcgaugccggcgcu

SEQ ID NO: 420590 - RNA, 16 nt, Bordetella pertussis
caggguauugaccccc

SEQ ID NO: 420591 - RNA, 20 nt, Bordetella pertussis
cagggucaaggcgcggccgu

SEQ ID NO: 420592 - RNA, 15 nt, Bordetella pertussis
cagggucagcccgcc

SEQ ID NO: 420593 - RNA, 23 nt, Bordetella pertussis
cagggucaugaugucggccaggg

SEQ ID NO: 420594 - RNA, 20 nt, Bordetella pertussis
caggguccagguggcccgca

SEQ ID NO: 420595 - RNA, 13 nt, Bordetella pertussis
cagggucugcagg

SEQ ID NO: 420596 - RNA, 23 nt, Bordetella pertussis
cagggucugcuggucgcgggcca

SEQ ID NO: 420597 - RNA, 15 nt, Bordetella pertussis
cagggugacgggcug

SEQ ID NO: 420598 - RNA, 14 nt, Bordetella pertussis
cagggugccgcccu

SEQ ID NO: 420599 - RNA, 14 nt, Bordetella pertussis
cagggugccugucc

SEQ ID NO: 420600 - RNA, 17 nt, Bordetella pertussis
cagggugccuguccccg

SEQ ID NO: 420601 - RNA, 17 nt, Bordetella pertussis
caggguggcgccggcca

SEQ ID NO: 420602 - RNA, 17 nt, Bordetella pertussis
cagggugggcacgcgcu

SEQ ID NO: 420603 - RNA, 24 nt, Bordetella pertussis
caggguguccuggucggcgcggca

SEQ ID NO: 420604 - RNA, 22 nt, Bordetella pertussis
cagggugucggccagggcggcg

SEQ ID NO: 420605 - RNA, 20 nt, Bordetella pertussis
caggguuugcuggcgcagca

SEQ ID NO: 420606 - RNA, 20 nt, Bordetella pertussis
caggguuuuauacggcgcga

SEQ ID NO: 420607 - RNA, 18 nt, Bordetella pertussis
caggugcgccagcacggc

SEQ ID NO: 420608 - RNA, 19 nt, Bordetella pertussis
caggugcgcggcgcgccgu

SEQ ID NO: 420609 - RNA, 14 nt, Bordetella pertussis
caggugcgggccgc

SEQ ID NO: 420610 - RNA, 23 nt, Bordetella pertussis
cagguggacagcgccagcccgcu

SEQ ID NO: 420611 - RNA, 17 nt, Bordetella pertussis
cagguggcggacaggcc

SEQ ID NO: 420612 - RNA, 14 nt, Bordetella pertussis
caggugggccaggu

SEQ ID NO: 420613 - RNA, 19 nt, Bordetella pertussis
caggugggccgagcccgcg

SEQ ID NO: 420614 - RNA, 14 nt, Bordetella pertussis
caggugggcgcgcu

SEQ ID NO: 420615 - RNA, 16 nt, Bordetella pertussis
caggugggcgcgcuca

SEQ ID NO: 420616 - RNA, 22 nt, Bordetella pertussis
cagguggggcagcaggccggcg

SEQ ID NO: 420617 - RNA, 16 nt, Bordetella pertussis
caggugugccagccgc

SEQ ID NO: 420618 - RNA, 14 nt, Bordetella pertussis
cagguugcgccggc

SEQ ID NO: 420619 - RNA, 19 nt, Bordetella pertussis
cagguugcgccggcucagc

SEQ ID NO: 420620 - RNA, 14 nt, Bordetella pertussis
caguacaccggcgu

SEQ ID NO: 420621 - RNA, 20 nt, Bordetella pertussis
caguacgucggacagggccc

SEQ ID NO: 420622 - RNA, 20 nt, Bordetella pertussis
caguccucguugcccgcggu

SEQ ID NO: 420623 - RNA, 17 nt, Bordetella pertussis
cagucgaugauccacag

SEQ ID NO: 420624 - RNA, 20 nt, Bordetella pertussis
cagucgccgcgcccgcgggu

SEQ ID NO: 420625 - RNA, 14 nt, Bordetella pertussis
cagucgggacggcg

SEQ ID NO: 420626 - RNA, 21 nt, Bordetella pertussis
cagucgggacggcgcgggcac

SEQ ID NO: 420627 - RNA, 16 nt, Bordetella pertussis
cagucgggcagcgccc

SEQ ID NO: 420628 - RNA, 12 nt, Bordetella pertussis
cagucuggaugg

SEQ ID NO: 420629 - RNA, 22 nt, Bordetella pertussis
cagucuugucauccgucucggc

SEQ ID NO: 420630 - RNA, 22 nt, Bordetella pertussis
cagugaaacgcgacgcgccgga

SEQ ID NO: 420631 - RNA, 16 nt, Bordetella pertussis
caguucuuccauccug

SEQ ID NO: 420632 - RNA, 14 nt, Bordetella pertussis
caguugcaggccau

SEQ ID NO: 420633 - RNA, 16 nt, Bordetella pertussis
caguugcgcaccgcuu

SEQ ID NO: 420634 - RNA, 17 nt, Bordetella pertussis
caguugcuggcccagga

SEQ ID NO: 420635 - RNA, 17 nt, Bordetella pertussis
caguuggcggcgcagcc

SEQ ID NO: 420636 - RNA, 14 nt, Bordetella pertussis
caguugggcgcgcc

SEQ ID NO: 420637 - RNA, 19 nt, Bordetella pertussis
caguugggcgcgcccagcc

SEQ ID NO: 420638 - RNA, 20 nt, Bordetella pertussis
caguugggcgcgcccagccc

SEQ ID NO: 420639 - RNA, 22 nt, Bordetella pertussis
caguugggcgcgcccagccccg

SEQ ID NO: 420640 - RNA, 15 nt, Bordetella pertussis
cauaaucggcccguu

SEQ ID NO: 420641 - RNA, 19 nt, Bordetella pertussis
cauaccuuggcgcccagcu

SEQ ID NO: 420642 - RNA, 19 nt, Bordetella pertussis
cauacgacgcggcaugcga

SEQ ID NO: 420643 - RNA, 21 nt, Bordetella pertussis
cauaucggugccccauuuuuu

SEQ ID NO: 420644 - RNA, 15 nt, Bordetella pertussis
cauauucacagccau

SEQ ID NO: 420645 - RNA, 15 nt, Bordetella pertussis
caucaacgggccgcu

SEQ ID NO: 420646 - RNA, 12 nt, Bordetella pertussis
caucaacguggc

SEQ ID NO: 420647 - RNA, 14 nt, Bordetella pertussis
caucaagagcaccg

SEQ ID NO: 420648 - RNA, 23 nt, Bordetella pertussis
caucaccauggccgacagcgucg

SEQ ID NO: 420649 - RNA, 13 nt, Bordetella pertussis
caucacgggcgcc

SEQ ID NO: 420650 - RNA, 14 nt, Bordetella pertussis
caucacgggcgcca

SEQ ID NO: 420651 - RNA, 21 nt, Bordetella pertussis
caucagcccuacccugaucaa

SEQ ID NO: 420652 - RNA, 18 nt, Bordetella pertussis
caucaggucgaccugcuu

SEQ ID NO: 420653 - RNA, 23 nt, Bordetella pertussis
caucagguucucgauguggcgcu

SEQ ID NO: 420654 - RNA, 22 nt, Bordetella pertussis
caucagguuguccagcgcgccc

SEQ ID NO: 420655 - RNA, 20 nt, Bordetella pertussis
caucaucaacuucaucguca

SEQ ID NO: 420656 - RNA, 15 nt, Bordetella pertussis
caucauccccagcgc

SEQ ID NO: 420657 - RNA, 22 nt, Bordetella pertussis
caucauccccagcgccgccaug

SEQ ID NO: 420658 - RNA, 17 nt, Bordetella pertussis
caucaucgucggcgcca

SEQ ID NO: 420659 - RNA, 18 nt, Bordetella pertussis
cauccucgcccagcggcg

SEQ ID NO: 420660 - RNA, 19 nt, Bordetella pertussis
caucgaauuugaacagccg

SEQ ID NO: 420661 - RNA, 21 nt, Bordetella pertussis
caucgagaaaccagccgccgc

SEQ ID NO: 420662 - RNA, 14 nt, Bordetella pertussis
caucgagcuccugc

SEQ ID NO: 420663 - RNA, 15 nt, Bordetella pertussis
caucgagcuccugca

SEQ ID NO: 420664 - RNA, 20 nt, Bordetella pertussis
caucgaggcaaucagcccca

SEQ ID NO: 420665 - RNA, 15 nt, Bordetella pertussis
caucgagcgccuggg

SEQ ID NO: 420666 - RNA, 15 nt, Bordetella pertussis
caucgccaggaccag

SEQ ID NO: 420667 - RNA, 20 nt, Bordetella pertussis
caucgccaggaccaggauga

SEQ ID NO: 420668 - RNA, 14 nt, Bordetella pertussis
caucgcccgugcuu

SEQ ID NO: 420669 - RNA, 21 nt, Bordetella pertussis
caucgcgaugcgcagcagcag

SEQ ID NO: 420670 - RNA, 15 nt, Bordetella pertussis
caucgcgcauggcga

SEQ ID NO: 420671 - RNA, 20 nt, Bordetella pertussis
caucgcgccuucggcgcgca

SEQ ID NO: 420672 - RNA, 24 nt, Bordetella pertussis
caucgcgccuucggcgcgcacgcu

SEQ ID NO: 420673 - RNA, 13 nt, Bordetella pertussis
caucgcgcuggcg

SEQ ID NO: 420674 - RNA, 19 nt, Bordetella pertussis
caucgcggcagcccggcac

SEQ ID NO: 420675 - RNA, 18 nt, Bordetella pertussis
caucgcuaugcagcugcg

SEQ ID NO: 420676 - RNA, 21 nt, Bordetella pertussis
caucgcuaugcagcugcgcca

SEQ ID NO: 420677 - RNA, 23 nt, Bordetella pertussis
caucggcgccaguagcgccggcu

SEQ ID NO: 420678 - RNA, 11 nt, Bordetella pertussis
caucggcgccg

SEQ ID NO: 420679 - RNA, 13 nt, Bordetella pertussis
caucggcgccgcg

SEQ ID NO: 420680 - RNA, 14 nt, Bordetella pertussis
caucggcgcgcgcu

SEQ ID NO: 420681 - RNA, 19 nt, Bordetella pertussis
caucgggcagggcuuccag

SEQ ID NO: 420682 - RNA, 19 nt, Bordetella pertussis
caucgggccggcggcagcc

SEQ ID NO: 420683 - RNA, 22 nt, Bordetella pertussis
caucgggugcggcgccugcguc

SEQ ID NO: 420684 - RNA, 17 nt, Bordetella pertussis
caucuacgugcuggacc

SEQ ID NO: 420685 - RNA, 22 nt, Bordetella pertussis
caucuacgugcuggacccgcug

SEQ ID NO: 420686 - RNA, 17 nt, Bordetella pertussis
caucucccgcaggccca

SEQ ID NO: 420687 - RNA, 20 nt, Bordetella pertussis
caucucgaagcgcucguccu

SEQ ID NO: 420688 - RNA, 15 nt, Bordetella pertussis
caucuggcgcauggc

SEQ ID NO: 420689 - RNA, 20 nt, Bordetella pertussis
caucuggcgcauggccggcg

SEQ ID NO: 420690 - RNA, 16 nt, Bordetella pertussis
caucuguccugauuca

SEQ ID NO: 420691 - RNA, 18 nt, Bordetella pertussis
caucuugccggccuguuc

SEQ ID NO: 420692 - RNA, 15 nt, Bordetella pertussis
caucuugcgccgcug

SEQ ID NO: 420693 - RNA, 21 nt, Bordetella pertussis
caugaaacggcaagagccugg

SEQ ID NO: 420694 - RNA, 14 nt, Bordetella pertussis
caugcaacacgacc

SEQ ID NO: 420695 - RNA, 19 nt, Bordetella pertussis
caugcaacacgaccagcag

SEQ ID NO: 420696 - RNA, 16 nt, Bordetella pertussis
caugcacgggccaugg

SEQ ID NO: 420697 - RNA, 17 nt, Bordetella pertussis
caugcccaugccgccau

SEQ ID NO: 420698 - RNA, 22 nt, Bordetella pertussis
caugccccauccagcggacggg

SEQ ID NO: 420699 - RNA, 20 nt, Bordetella pertussis
caugcccgaccgcaugggcg

SEQ ID NO: 420700 - RNA, 19 nt, Bordetella pertussis
caugcccgccggcacccgg

SEQ ID NO: 420701 - RNA, 20 nt, Bordetella pertussis
caugcccgccggcacccggc

SEQ ID NO: 420702 - RNA, 18 nt, Bordetella pertussis
caugcccggccaccagcg

SEQ ID NO: 420703 - RNA, 16 nt, Bordetella pertussis
caugcccuccucggcc

SEQ ID NO: 420704 - RNA, 18 nt, Bordetella pertussis
caugccguccacgcccag

SEQ ID NO: 420705 - RNA, 20 nt, Bordetella pertussis
caugccguccacgcccagcg

SEQ ID NO: 420706 - RNA, 21 nt, Bordetella pertussis
caugccguccacgcccagcgc

SEQ ID NO: 420707 - RNA, 17 nt, Bordetella pertussis
caugccguccugcugcg

SEQ ID NO: 420708 - RNA, 20 nt, Bordetella pertussis
caugccgucgcgcaccaccu

SEQ ID NO: 420709 - RNA, 19 nt, Bordetella pertussis
caugcgaaagccggccucc

SEQ ID NO: 420710 - RNA, 17 nt, Bordetella pertussis
caugcgauagcgggccu

SEQ ID NO: 420711 - RNA, 23 nt, Bordetella pertussis
caugcgauagcgggccugcagca

SEQ ID NO: 420712 - RNA, 15 nt, Bordetella pertussis
caugcgcaugcugga

SEQ ID NO: 420713 - RNA, 18 nt, Bordetella pertussis
caugcgccagcgccuggg

SEQ ID NO: 420714 - RNA, 18 nt, Bordetella pertussis
caugcgccguccucaggc

SEQ ID NO: 420715 - RNA, 18 nt, Bordetella pertussis
caugcgccugucccaggc

SEQ ID NO: 420716 - RNA, 22 nt, Bordetella pertussis
caugcgccugucccaggcgcuc

SEQ ID NO: 420717 - RNA, 13 nt, Bordetella pertussis
caugcgcgcggcc

SEQ ID NO: 420718 - RNA, 20 nt, Bordetella pertussis
caugcgcggcgggacggcca

SEQ ID NO: 420719 - RNA, 15 nt, Bordetella pertussis
caugcgcgguugggc

SEQ ID NO: 420720 - RNA, 14 nt, Bordetella pertussis
caugcgcugggcau

SEQ ID NO: 420721 - RNA, 18 nt, Bordetella pertussis
caugcgcuuggaccccgu

SEQ ID NO: 420722 - RNA, 19 nt, Bordetella pertussis
caugcggccgucgccgccc

SEQ ID NO: 420723 - RNA, 15 nt, Bordetella pertussis
caugcggcggcgggc

SEQ ID NO: 420724 - RNA, 14 nt, Bordetella pertussis
caugcggcguccug

SEQ ID NO: 420725 - RNA, 12 nt, Bordetella pertussis
caugcggcuggc

SEQ ID NO: 420726 - RNA, 14 nt, Bordetella pertussis
caugcgggacaggc

SEQ ID NO: 420727 - RNA, 18 nt, Bordetella pertussis
caugcgggacaggcgcca

SEQ ID NO: 420728 - RNA, 15 nt, Bordetella pertussis
caugcggggacaggc

SEQ ID NO: 420729 - RNA, 20 nt, Bordetella pertussis
caugcggggacaggcacucc

SEQ ID NO: 420730 - RNA, 15 nt, Bordetella pertussis
caugcgggucaggcc

SEQ ID NO: 420731 - RNA, 18 nt, Bordetella pertussis
caugcgggucaggccgcc

SEQ ID NO: 420732 - RNA, 16 nt, Bordetella pertussis
caugcggugcgccgcg

SEQ ID NO: 420733 - RNA, 20 nt, Bordetella pertussis
caugcgucgaacggccgggc

SEQ ID NO: 420734 - RNA, 17 nt, Bordetella pertussis
caugcguucggccagcc

SEQ ID NO: 420735 - RNA, 19 nt, Bordetella pertussis
cauggaaccgguuggccag

SEQ ID NO: 420736 - RNA, 21 nt, Bordetella pertussis
cauggacgagggccggcgcca

SEQ ID NO: 420737 - RNA, 23 nt, Bordetella pertussis
cauggacgaguugcucggagccc

SEQ ID NO: 420738 - RNA, 14 nt, Bordetella pertussis
cauggagcuggggc

SEQ ID NO: 420739 - RNA, 15 nt, Bordetella pertussis
cauggagcuggggcc

SEQ ID NO: 420740 - RNA, 12 nt, Bordetella pertussis
cauggaggcgca

SEQ ID NO: 420741 - RNA, 20 nt, Bordetella pertussis
cauggaggcgcagcgcggca

SEQ ID NO: 420742 - RNA, 14 nt, Bordetella pertussis
cauggaggggcgca

SEQ ID NO: 420743 - RNA, 21 nt, Bordetella pertussis
cauggcagcagaucggcggcc

SEQ ID NO: 420744 - RNA, 23 nt, Bordetella pertussis
cauggcagcucgcuaacaagggu

SEQ ID NO: 420745 - RNA, 19 nt, Bordetella pertussis
caugggccccaagagggcu

SEQ ID NO: 420746 - RNA, 23 nt, Bordetella pertussis
caugggcgaagccacggcccgcc

SEQ ID NO: 420747 - RNA, 17 nt, Bordetella pertussis
caugggcgcaggccgcc

SEQ ID NO: 420748 - RNA, 13 nt, Bordetella pertussis
caugggcgcgccc

SEQ ID NO: 420749 - RNA, 17 nt, Bordetella pertussis
caugggcgugccgcgcu

SEQ ID NO: 420750 - RNA, 18 nt, Bordetella pertussis
cauggggacuggcacccg

SEQ ID NO: 420751 - RNA, 20 nt, Bordetella pertussis
cauggucaugcccuccucgg

SEQ ID NO: 420752 - RNA, 17 nt, Bordetella pertussis
cauggucgaccagcagc

SEQ ID NO: 420753 - RNA, 18 nt, Bordetella pertussis
cauggucgaccagcagcc

SEQ ID NO: 420754 - RNA, 15 nt, Bordetella pertussis
cauggucgaugaagu

SEQ ID NO: 420755 - RNA, 16 nt, Bordetella pertussis
cauggucgcgaccacc

SEQ ID NO: 420756 - RNA, 20 nt, Bordetella pertussis
cauggucgcgaugcgucagg

SEQ ID NO: 420757 - RNA, 19 nt, Bordetella pertussis
cauggugccgcgcaggccc

SEQ ID NO: 420758 - RNA, 20 nt, Bordetella pertussis
caugguggcgcaggcaaagc

SEQ ID NO: 420759 - RNA, 19 nt, Bordetella pertussis
cauggugugccuguccccg

SEQ ID NO: 420760 - RNA, 13 nt, Bordetella pertussis
caugugccaccgc

SEQ ID NO: 420761 - RNA, 17 nt, Bordetella pertussis
caugugccaccgcccag

SEQ ID NO: 420762 - RNA, 19 nt, Bordetella pertussis
caugugccaccgcccaggc

SEQ ID NO: 420763 - RNA, 15 nt, Bordetella pertussis
caugugcgccgcgcc

SEQ ID NO: 420764 - RNA, 16 nt, Bordetella pertussis
caugugcguuuuuucg

SEQ ID NO: 420765 - RNA, 17 nt, Bordetella pertussis
caugugcugcggcagcc

SEQ ID NO: 420766 - RNA, 15 nt, Bordetella pertussis
cauuacccauggcac

SEQ ID NO: 420767 - RNA, 22 nt, Bordetella pertussis
cauugaacaccccggucagcag

SEQ ID NO: 420768 - RNA, 14 nt, Bordetella pertussis
cauugaccugcuug

SEQ ID NO: 420769 - RNA, 22 nt, Bordetella pertussis
cauugaucgaucagccagccgg

SEQ ID NO: 420770 - RNA, 16 nt, Bordetella pertussis
cauugccucgcggcag

SEQ ID NO: 420771 - RNA, 15 nt, Bordetella pertussis
cauugcgccagccgu

SEQ ID NO: 420772 - RNA, 12 nt, Bordetella pertussis
cauugcgcggcc

SEQ ID NO: 420773 - RNA, 14 nt, Bordetella pertussis
cauugcgcggccag

SEQ ID NO: 420774 - RNA, 13 nt, Bordetella pertussis
ccacccgccgccg

SEQ ID NO: 420775 - RNA, 19 nt, Bordetella pertussis
ccaccgcaucgcgcagcgu

SEQ ID NO: 420776 - RNA, 19 nt, Bordetella pertussis
ccaccgcccaggcgcagcc

SEQ ID NO: 420777 - RNA, 19 nt, Bordetella pertussis
ccaccgcggugccgcgcgc

SEQ ID NO: 420778 - RNA, 22 nt, Bordetella pertussis
ccaccggcaugccguccacgcc

SEQ ID NO: 420779 - RNA, 20 nt, Bordetella pertussis
ccaccggcgcgcgcaugccc

SEQ ID NO: 420780 - RNA, 16 nt, Bordetella pertussis
ccaccgggccggccug

SEQ ID NO: 420781 - RNA, 17 nt, Bordetella pertussis
ccaccgggccggccugc

SEQ ID NO: 420782 - RNA, 16 nt, Bordetella pertussis
ccaccgguugcagcgc

SEQ ID NO: 420783 - RNA, 18 nt, Bordetella pertussis
ccaccucgucguccagcg

SEQ ID NO: 420784 - RNA, 19 nt, Bordetella pertussis
ccaccucuucagcccggcg

SEQ ID NO: 420785 - RNA, 16 nt, Bordetella pertussis
ccaccugcaccgccgc

SEQ ID NO: 420786 - RNA, 13 nt, Bordetella pertussis
ccaccuggcagcc

SEQ ID NO: 420787 - RNA, 16 nt, Bordetella pertussis
ccaccuggccacaagc

SEQ ID NO: 420788 - RNA, 17 nt, Bordetella pertussis
ccaccuggcgcccggcg

SEQ ID NO: 420789 - RNA, 14 nt, Bordetella pertussis
ccaccugggccgcc

SEQ ID NO: 420790 - RNA, 21 nt, Bordetella pertussis
ccacgaagcgcagcaccgcgc

SEQ ID NO: 420791 - RNA, 13 nt, Bordetella pertussis
ccacgaccaccag

SEQ ID NO: 420792 - RNA, 15 nt, Bordetella pertussis
ccacgaccaccagcg

SEQ ID NO: 420793 - RNA, 14 nt, Bordetella pertussis
ccacgaccggcucg

SEQ ID NO: 420794 - RNA, 16 nt, Bordetella pertussis
ccacgaugucggcgca

SEQ ID NO: 420795 - RNA, 22 nt, Bordetella pertussis
ccacgaugucguccagcuccag

SEQ ID NO: 420796 - RNA, 15 nt, Bordetella pertussis
ccacgcacaccgccc

SEQ ID NO: 420797 - RNA, 15 nt, Bordetella pertussis
ccacgcccuggcugg

SEQ ID NO: 420798 - RNA, 14 nt, Bordetella pertussis
ccacgccgaagugg

SEQ ID NO: 420799 - RNA, 17 nt, Bordetella pertussis
ccacgccgaugcacagg

SEQ ID NO: 420800 - RNA, 18 nt, Bordetella pertussis
ccacgccgaugccgcgca

SEQ ID NO: 420801 - RNA, 15 nt, Bordetella pertussis
ccacgccgccuggcc

SEQ ID NO: 420802 - RNA, 11 nt, Bordetella pertussis
ccacgccgcug

SEQ ID NO: 420803 - RNA, 13 nt, Bordetella pertussis
ccacgccggccgc

SEQ ID NO: 420804 - RNA, 22 nt, Bordetella pertussis
ccacgccggcgcgccggccgcg

SEQ ID NO: 420805 - RNA, 14 nt, Bordetella pertussis
ccacgccuuccggc

SEQ ID NO: 420806 - RNA, 19 nt, Bordetella pertussis
ccacgcgaugcgggucugg

SEQ ID NO: 420807 - RNA, 16 nt, Bordetella pertussis
ccacgcgcaacgccgc

SEQ ID NO: 420808 - RNA, 11 nt, Bordetella pertussis
ccacgcgcaca

SEQ ID NO: 420809 - RNA, 23 nt, Bordetella pertussis
ccacgcgcacauuggaguagugg

SEQ ID NO: 420810 - RNA, 14 nt, Bordetella pertussis
ccacgcgccgccag

SEQ ID NO: 420811 - RNA, 13 nt, Bordetella pertussis
ccacgcgccgccc

SEQ ID NO: 420812 - RNA, 14 nt, Bordetella pertussis
ccacgcgccgcccg

SEQ ID NO: 420813 - RNA, 23 nt, Bordetella pertussis
ccacgcgccgugcagacggcggc

SEQ ID NO: 420814 - RNA, 14 nt, Bordetella pertussis
ccacgcgcggcggc

SEQ ID NO: 420815 - RNA, 15 nt, Bordetella pertussis
ccacgcgcuccugcu

SEQ ID NO: 420816 - RNA, 17 nt, Bordetella pertussis
ccacgcgcuguugcugg

SEQ ID NO: 420817 - RNA, 17 nt, Bordetella pertussis
ccacgcggccguggcgg

SEQ ID NO: 420818 - RNA, 17 nt, Bordetella pertussis
ccacgcgggccggccgu

SEQ ID NO: 420819 - RNA, 15 nt, Bordetella pertussis
ccacgcggguggugc

SEQ ID NO: 420820 - RNA, 18 nt, Bordetella pertussis
ccacgcgguccagccccu

SEQ ID NO: 420821 - RNA, 22 nt, Bordetella pertussis
ccacgucauaggcuucgcccgc

SEQ ID NO: 420822 - RNA, 18 nt, Bordetella pertussis
ccacucacgcaaggccga

SEQ ID NO: 420823 - RNA, 21 nt, Bordetella pertussis
ccacucagggcggggugccug

SEQ ID NO: 420824 - RNA, 14 nt, Bordetella pertussis
ccacugccaguagg

SEQ ID NO: 420825 - RNA, 17 nt, Bordetella pertussis
ccacuggaucgccgauc

SEQ ID NO: 420826 - RNA, 18 nt, Bordetella pertussis
ccacuggccuucuucacg

SEQ ID NO: 420827 - RNA, 24 nt, Bordetella pertussis
ccacuuccuugccauccagccagg

SEQ ID NO: 420828 - RNA, 17 nt, Bordetella pertussis
ccacuuccuggugggcg

SEQ ID NO: 420829 - RNA, 18 nt, Bordetella pertussis
ccacuugcggguccagca

SEQ ID NO: 420830 - RNA, 20 nt, Bordetella pertussis
ccacuugcggguccagcagg

SEQ ID NO: 420831 - RNA, 23 nt, Bordetella pertussis
ccacuuggcgaucucguccugca

SEQ ID NO: 420832 - RNA, 21 nt, Bordetella pertussis
ccagagucugccuggcgaaca

SEQ ID NO: 420833 - RNA, 16 nt, Bordetella pertussis
ccagaugcgccgcacg

SEQ ID NO: 420834 - RNA, 17 nt, Bordetella pertussis
ccagcaaaugggccgca

SEQ ID NO: 420835 - RNA, 16 nt, Bordetella pertussis
ccagcacauacgccgc

SEQ ID NO: 420836 - RNA, 23 nt, Bordetella pertussis
ccagcacaucgacgucggccucg

SEQ ID NO: 420837 - RNA, 15 nt, Bordetella pertussis
ccagcaccagcgccu

SEQ ID NO: 420838 - RNA, 18 nt, Bordetella pertussis
ccagcaccggcacgcgcc

SEQ ID NO: 420839 - RNA, 14 nt, Bordetella pertussis
ccagcaccggcccg

SEQ ID NO: 420840 - RNA, 13 nt, Bordetella pertussis
ccagcaccggccg

SEQ ID NO: 420841 - RNA, 22 nt, Bordetella pertussis
ccagcaccggccgccgcaugcc

SEQ ID NO: 420842 - RNA, 15 nt, Bordetella pertussis
ccagcaccugcaggc

SEQ ID NO: 420843 - RNA, 16 nt, Bordetella pertussis
ccagcaccugcaggcc

SEQ ID NO: 420844 - RNA, 13 nt, Bordetella pertussis
ccagcaccugcuu

SEQ ID NO: 420845 - RNA, 20 nt, Bordetella pertussis
ccagcacgaagggcagcagc

SEQ ID NO: 420846 - RNA, 15 nt, Bordetella pertussis
ccagcacgagauguc

SEQ ID NO: 420847 - RNA, 19 nt, Bordetella pertussis
ccagcacgauggucagcgg

SEQ ID NO: 420848 - RNA, 20 nt, Bordetella pertussis
ccagcacgauggucagcggc

SEQ ID NO: 420849 - RNA, 20 nt, Bordetella pertussis
ccagcacgcgcgccagcugg

SEQ ID NO: 420850 - RNA, 14 nt, Bordetella pertussis
ccagcacgcggcgc

SEQ ID NO: 420851 - RNA, 15 nt, Bordetella pertussis
ccagcacgccggcgg

SEQ ID NO: 420852 - RNA, 15 nt, Bordetella pertussis
ccagcagaucgcggc

SEQ ID NO: 420853 - RNA, 17 nt, Bordetella pertussis
ccagcagcaccgugccg

SEQ ID NO: 420854 - RNA, 12 nt, Bordetella pertussis
ccagcagcagcg

SEQ ID NO: 420855 - RNA, 23 nt, Bordetella pertussis
ccagcagcagcgagcccgccauc

SEQ ID NO: 420856 - RNA, 13 nt, Bordetella pertussis
ccagcagcagcgc

SEQ ID NO: 420857 - RNA, 19 nt, Bordetella pertussis
ccagcagcagcgccgcgcc

SEQ ID NO: 420858 - RNA, 14 nt, Bordetella pertussis
ccagcagcaggccg

SEQ ID NO: 420859 - RNA, 14 nt, Bordetella pertussis
ccagcagcggcagc

SEQ ID NO: 420860 - RNA, 23 nt, Bordetella pertussis
ccagcagcggcagcagcagcgcg

SEQ ID NO: 420861 - RNA, 13 nt, Bordetella pertussis
ccagcagcggcag

SEQ ID NO: 420862 - RNA, 21 nt, Bordetella pertussis
ccagcagcggguugcgcgcca

SEQ ID NO: 420863 - RNA, 20 nt, Bordetella pertussis
ccagcagcgugaugccgucg

SEQ ID NO: 420864 - RNA, 13 nt, Bordetella pertussis
ccagcagcuccuc

SEQ ID NO: 420865 - RNA, 20 nt, Bordetella pertussis
ccagcagcucggccaccgcc

SEQ ID NO: 420866 - RNA, 22 nt, Bordetella pertussis
ccagcagcuggcgcagcacgcc

SEQ ID NO: 420867 - RNA, 14 nt, Bordetella pertussis
ccagcaggagcccg

SEQ ID NO: 420868 - RNA, 17 nt, Bordetella pertussis
ccagcaggauggauccc

SEQ ID NO: 420869 - RNA, 21 nt, Bordetella pertussis
ccagcaggcccugggccagca

SEQ ID NO: 420870 - RNA, 17 nt, Bordetella pertussis
ccagcaggcccugggcg

SEQ ID NO: 420871 - RNA, 21 nt, Bordetella pertussis
ccagcaggcgaaacgccagcc

SEQ ID NO: 420872 - RNA, 17 nt, Bordetella pertussis
ccagcagggcggcgucg

SEQ ID NO: 420873 - RNA, 14 nt, Bordetella pertussis
ccagcaggucgcgc

SEQ ID NO: 420874 - RNA, 19 nt, Bordetella pertussis
ccagcaguucgggguccag

SEQ ID NO: 420875 - RNA, 20 nt, Bordetella pertussis
ccagccauggaagcggcaga

SEQ ID NO: 420876 - RNA, 21 nt, Bordetella pertussis
ccagccauguucgaccaggaa

SEQ ID NO: 420877 - RNA, 12 nt, Bordetella pertussis
ccagcccagccc

SEQ ID NO: 420878 - RNA, 15 nt, Bordetella pertussis
ccagccccaccuugc

SEQ ID NO: 420879 - RNA, 14 nt, Bordetella pertussis
ccagcccggccgcc

SEQ ID NO: 420880 - RNA, 14 nt, Bordetella pertussis
ccagcccggcuucg

SEQ ID NO: 420881 - RNA, 13 nt, Bordetella pertussis
ccagcccuggccc

SEQ ID NO: 420882 - RNA, 14 nt, Bordetella pertussis
ccagcccuggccca

SEQ ID NO: 420883 - RNA, 18 nt, Bordetella pertussis
ccagccgaucagccggcc

SEQ ID NO: 420884 - RNA, 13 nt, Bordetella pertussis
ccagccgcaggcu

SEQ ID NO: 420885 - RNA, 15 nt, Bordetella pertussis
ccagccgcccguggc

SEQ ID NO: 420886 - RNA, 13 nt, Bordetella pertussis
ccagccgccgcca

SEQ ID NO: 420887 - RNA, 14 nt, Bordetella pertussis
ccagccgccgcgcg

SEQ ID NO: 420888 - RNA, 16 nt, Bordetella pertussis
ccagccgcgccugcag

SEQ ID NO: 420889 - RNA, 21 nt, Bordetella pertussis
ccagccgcucgcgcgaccacu

SEQ ID NO: 420890 - RNA, 15 nt, Bordetella pertussis
ccagccgcucggcca

SEQ ID NO: 420891 - RNA, 17 nt, Bordetella pertussis
ccagccgcucggccacg

SEQ ID NO: 420892 - RNA, 20 nt, Bordetella pertussis
ccagccgcucggccacgcgc

SEQ ID NO: 420893 - RNA, 22 nt, Bordetella pertussis
ccagccgcuggcgaucaggccg

SEQ ID NO: 420894 - RNA, 12 nt, Bordetella pertussis
ccagccggccca

SEQ ID NO: 420895 - RNA, 13 nt, Bordetella pertussis
ccagccggcccag

SEQ ID NO: 420896 - RNA, 14 nt, Bordetella pertussis
ccagccggcccagc

SEQ ID NO: 420897 - RNA, 21 nt, Bordetella pertussis
ccagccggcccagcacgccgc

SEQ ID NO: 420898 - RNA, 12 nt, Bordetella pertussis
ccagccggcccg

SEQ ID NO: 420899 - RNA, 16 nt, Bordetella pertussis
ccagccggcggcaugc

SEQ ID NO: 420900 - RNA, 23 nt, Bordetella pertussis
ccagccggcggcaugcgccagcc

SEQ ID NO: 420901 - RNA, 16 nt, Bordetella pertussis
ccagccggcggccagc

SEQ ID NO: 420902 - RNA, 19 nt, Bordetella pertussis
ccagccggcggccagcuug

SEQ ID NO: 420903 - RNA, 17 nt, Bordetella pertussis
ccagccgggcggccacg

SEQ ID NO: 420904 - RNA, 20 nt, Bordetella pertussis
ccagccggguggucgcgccc

SEQ ID NO: 420905 - RNA, 16 nt, Bordetella pertussis
ccagccguuggcgccc

SEQ ID NO: 420906 - RNA, 15 nt, Bordetella pertussis
ccagccugcccgggc

SEQ ID NO: 420907 - RNA, 18 nt, Bordetella pertussis
ccagccugcccgggcagc

SEQ ID NO: 420908 - RNA, 14 nt, Bordetella pertussis
ccagccugccgcgg

SEQ ID NO: 420909 - RNA, 20 nt, Bordetella pertussis
ccagccugccgcggccgccc

SEQ ID NO: 420910 - RNA, 16 nt, Bordetella pertussis
ccagccuggccuugcg

SEQ ID NO: 420911 - RNA, 12 nt, Bordetella pertussis
ccagccugugcg

SEQ ID NO: 420912 - RNA, 20 nt, Bordetella pertussis
ccagcgacgacuugaucagg

SEQ ID NO: 420913 - RNA, 20 nt, Bordetella pertussis
ccagcgacuccggccgggcc

SEQ ID NO: 420914 - RNA, 14 nt, Bordetella pertussis
ccagcgagccggcc

SEQ ID NO: 420915 - RNA, 17 nt, Bordetella pertussis
ccagcgagccggccagc

SEQ ID NO: 420916 - RNA, 15 nt, Bordetella pertussis
ccagcgagcugguga

SEQ ID NO: 420917 - RNA, 13 nt, Bordetella pertussis
ccagcgaggccgc

SEQ ID NO: 420918 - RNA, 18 nt, Bordetella pertussis
ccagcgagucgaccaguu

SEQ ID NO: 420919 - RNA, 16 nt, Bordetella pertussis
ccagcgauacccgcuu

SEQ ID NO: 420920 - RNA, 15 nt, Bordetella pertussis
ccagcgcaaggguug

SEQ ID NO: 420921 - RNA, 19 nt, Bordetella pertussis
ccagcgcacguugagaucc

SEQ ID NO: 420922 - RNA, 14 nt, Bordetella pertussis
ccagcgcauugccg

SEQ ID NO: 420923 - RNA, 21 nt, Bordetella pertussis
ccagcgcauugccgccgcccu

SEQ ID NO: 420924 - RNA, 20 nt, Bordetella pertussis
ccagcgcauuggugagcacg

SEQ ID NO: 420925 - RNA, 17 nt, Bordetella pertussis
ccagcgccaccagcagc

SEQ ID NO: 420926 - RNA, 18 nt, Bordetella pertussis
ccagcgccaccagcagcg

SEQ ID NO: 420927 - RNA, 17 nt, Bordetella pertussis
ccagcgccacgccggcc

SEQ ID NO: 420928 - RNA, 20 nt, Bordetella pertussis
ccagcgccacgccggccagc

SEQ ID NO: 420929 - RNA, 22 nt, Bordetella pertussis
ccagcgccagcaccggcacgcg

SEQ ID NO: 420930 - RNA, 15 nt, Bordetella pertussis
ccagcgccagcagca

SEQ ID NO: 420931 - RNA, 14 nt, Bordetella pertussis
ccagcgccagcagg

SEQ ID NO: 420932 - RNA, 15 nt, Bordetella pertussis
ccagcgccagcgugg

SEQ ID NO: 420933 - RNA, 15 nt, Bordetella pertussis
ccagcgccagggccg

SEQ ID NO: 420934 - RNA, 17 nt, Bordetella pertussis
ccagcgccagggccgcc

SEQ ID NO: 420935 - RNA, 19 nt, Bordetella pertussis
ccagcgccagggccgccgc

SEQ ID NO: 420936 - RNA, 14 nt, Bordetella pertussis
ccagcgccaggccg

SEQ ID NO: 420937 - RNA, 15 nt, Bordetella pertussis
ccagcgccaucaaga

SEQ ID NO: 420938 - RNA, 14 nt, Bordetella pertussis
ccagcgcccgcgga

SEQ ID NO: 420939 - RNA, 20 nt, Bordetella pertussis
ccagcgccgacggcauggcc

SEQ ID NO: 420940 - RNA, 13 nt, Bordetella pertussis
ccagcgccgccag

SEQ ID NO: 420941 - RNA, 13 nt, Bordetella pertussis
ccagcgccgccau

SEQ ID NO: 420942 - RNA, 23 nt, Bordetella pertussis
ccagcgccgccgacggcauggcg

SEQ ID NO: 420943 - RNA, 12 nt, Bordetella pertussis
ccagcgccgccu

SEQ ID NO: 420944 - RNA, 15 nt, Bordetella pertussis
ccagcgccggcagcc

SEQ ID NO: 420945 - RNA, 18 nt, Bordetella pertussis
ccagcgccggcagcccca

SEQ ID NO: 420946 - RNA, 18 nt, Bordetella pertussis
ccagcgccgucagcagcg

SEQ ID NO: 420947 - RNA, 19 nt, Bordetella pertussis
ccagcgccgucaucugcgg

SEQ ID NO: 420948 - RNA, 17 nt, Bordetella pertussis
ccagcgccucgucgcgc

SEQ ID NO: 420949 - RNA, 17 nt, Bordetella pertussis
ccagcgccugcgcggcc

SEQ ID NO: 420950 - RNA, 23 nt, Bordetella pertussis
ccagcgccuggcgggccugggcg

SEQ ID NO: 420951 - RNA, 21 nt, Bordetella pertussis
ccagcgccuggaccuggacga

SEQ ID NO: 420952 - RNA, 14 nt, Bordetella pertussis
ccagcgccugggcg

SEQ ID NO: 420953 - RNA, 22 nt, Bordetella pertussis
ccagcgcgccgcccaccaccag

SEQ ID NO: 420954 - RNA, 14 nt, Bordetella pertussis
ccagcgcgccgcgc

SEQ ID NO: 420955 - RNA, 15 nt, Bordetella pertussis
ccagcgcgccgcgcg

SEQ ID NO: 420956 - RNA, 11 nt, Bordetella pertussis
ccagcgcgccu

SEQ ID NO: 420957 - RNA, 20 nt, Bordetella pertussis
ccagcgcgccugcccaggcc

SEQ ID NO: 420958 - RNA, 17 nt, Bordetella pertussis
ccagcgcgcggccggcc

SEQ ID NO: 420959 - RNA, 22 nt, Bordetella pertussis
ccagcgcgcggccggccgcgcc

SEQ ID NO: 420960 - RNA, 16 nt, Bordetella pertussis
ccagcgcgcggccucg

SEQ ID NO: 420961 - RNA, 14 nt, Bordetella pertussis
ccagcgcgcggcgc

SEQ ID NO: 420962 - RNA, 21 nt, Bordetella pertussis
ccagcgcgcggcgcagcgcac

SEQ ID NO: 420963 - RNA, 16 nt, Bordetella pertussis
ccagcgcgcgccggcc

SEQ ID NO: 420964 - RNA, 10 nt, Bordetella pertussis
ccagcgcggc

SEQ ID NO: 420965 - RNA, 16 nt, Bordetella pertussis
ccagcgcggcaugccg

SEQ ID NO: 420966 - RNA, 17 nt, Bordetella pertussis
ccagcgcggccacggcc

SEQ ID NO: 420967 - RNA, 14 nt, Bordetella pertussis
ccagcgcggccagc

SEQ ID NO: 420968 - RNA, 15 nt, Bordetella pertussis
ccagcgcggccagca

SEQ ID NO: 420969 - RNA, 15 nt, Bordetella pertussis
ccagcgcggccaggu

SEQ ID NO: 420970 - RNA, 19 nt, Bordetella pertussis
ccagcgcggcggccaugcc

SEQ ID NO: 420971 - RNA, 23 nt, Bordetella pertussis
ccagcgcggcgggcggcgcggcc

SEQ ID NO: 420972 - RNA, 17 nt, Bordetella pertussis
ccagcgcggcggcagcg

SEQ ID NO: 420973 - RNA, 16 nt, Bordetella pertussis
ccagcgcgucgagcag

SEQ ID NO: 420974 - RNA, 18 nt, Bordetella pertussis
ccagcgcgucgagcagcg

SEQ ID NO: 420975 - RNA, 14 nt, Bordetella pertussis
ccagcgcgucggcc

SEQ ID NO: 420976 - RNA, 21 nt, Bordetella pertussis
ccagcgcgucggccagcgccg

SEQ ID NO: 420977 - RNA, 18 nt, Bordetella pertussis
ccagcgcgucggccaggc

SEQ ID NO: 420978 - RNA, 20 nt, Bordetella pertussis
ccagcgcgucggccaggcgc

SEQ ID NO: 420979 - RNA, 20 nt, Bordetella pertussis
ccagcgcgucguccagcgug

SEQ ID NO: 420980 - RNA, 21 nt, Bordetella pertussis
ccagcgcgucguccagcgugg

SEQ ID NO: 420981 - RNA, 17 nt, Bordetella pertussis
ccagcgcgucggccagc

SEQ ID NO: 420982 - RNA, 19 nt, Bordetella pertussis
ccagcgcucgggcucgcgc

SEQ ID NO: 420983 - RNA, 16 nt, Bordetella pertussis
ccagcgcuucgugcag

SEQ ID NO: 420984 - RNA, 15 nt, Bordetella pertussis
ccagcgcuucgggca

SEQ ID NO: 420985 - RNA, 18 nt, Bordetella pertussis
ccagcggacgggccaggc

SEQ ID NO: 420986 - RNA, 23 nt, Bordetella pertussis
ccagcggcaaaguagugccccca

SEQ ID NO: 420987 - RNA, 22 nt, Bordetella pertussis
ccagcggcguggcggccaggcc

SEQ ID NO: 420988 - RNA, 15 nt, Bordetella pertussis
ccagcggcugcuuga

SEQ ID NO: 420989 - RNA, 14 nt, Bordetella pertussis
ccagcggcuggcca

SEQ ID NO: 420990 - RNA, 19 nt, Bordetella pertussis
ccagcggcuggccacuggc

SEQ ID NO: 420991 - RNA, 13 nt, Bordetella pertussis
ccagcggggacag

SEQ ID NO: 420992 - RNA, 17 nt, Bordetella pertussis
ccagcggggacaggcac

SEQ ID NO: 420993 - RNA, 21 nt, Bordetella pertussis
ccagcggggccgugacgugcu

SEQ ID NO: 420994 - RNA, 15 nt, Bordetella pertussis
ccagcguccaggcgg

SEQ ID NO: 420995 - RNA, 23 nt, Bordetella pertussis
ccagcgucggcguaaggccgccg

SEQ ID NO: 420996 - RNA, 20 nt, Bordetella pertussis
ccagcucgcgcagcaggccg

SEQ ID NO: 420997 - RNA, 14 nt, Bordetella pertussis
ccagcucgcggccc

SEQ ID NO: 420998 - RNA, 15 nt, Bordetella pertussis
ccagcucgcggcccu

SEQ ID NO: 420999 - RNA, 17 nt, Bordetella pertussis
ccagcucggcggccgcc

SEQ ID NO: 421000 - RNA, 14 nt, Bordetella pertussis
ccagcucggcggcg

SEQ ID NO: 421001 - RNA, 23 nt, Bordetella pertussis
ccagcugcaugcgcacggacagc

SEQ ID NO: 421002 - RNA, 14 nt, Bordetella pertussis
ccagcugcgcgcga

SEQ ID NO: 421003 - RNA, 15 nt, Bordetella pertussis
ccagcuggaccgccu

SEQ ID NO: 421004 - RNA, 20 nt, Bordetella pertussis
ccaggaagaucggcccggcg

SEQ ID NO: 421005 - RNA, 13 nt, Bordetella pertussis
ccaggaagcagcc

SEQ ID NO: 421006 - RNA, 18 nt, Bordetella pertussis
ccaggaagcgggccugcc

SEQ ID NO: 421007 - RNA, 19 nt, Bordetella pertussis
ccaggaagcgcgccgcgcg

SEQ ID NO: 421008 - RNA, 15 nt, Bordetella pertussis
ccaggaagcgcgccu

SEQ ID NO: 421009 - RNA, 18 nt, Bordetella pertussis
ccaggaccuguacuggcu

SEQ ID NO: 421010 - RNA, 23 nt, Bordetella pertussis
ccaggacgacaggcaugcagcau

SEQ ID NO: 421011 - RNA, 14 nt, Bordetella pertussis
ccaggaugagcgcc

SEQ ID NO: 421012 - RNA, 16 nt, Bordetella pertussis
ccaggaugagcgccug

SEQ ID NO: 421013 - RNA, 14 nt, Bordetella pertussis
ccaggaugaugagg

SEQ ID NO: 421014 - RNA, 18 nt, Bordetella pertussis
ccaggaugcgcaccggcc

SEQ ID NO: 421015 - RNA, 22 nt, Bordetella pertussis
ccaggaugcgcaccggccaggg

SEQ ID NO: 421016 - RNA, 22 nt, Bordetella pertussis
ccaggaugcgcgacaccgugcg

SEQ ID NO: 421017 - RNA, 18 nt, Bordetella pertussis
ccaggauggcgccagccc

SEQ ID NO: 421018 - RNA, 22 nt, Bordetella pertussis
ccaggauggcgccagcccgccc

SEQ ID NO: 421019 - RNA, 16 nt, Bordetella pertussis
ccaggcaaaggcccag

SEQ ID NO: 421020 - RNA, 18 nt, Bordetella pertussis
ccaggcaaaggcccaggc

SEQ ID NO: 421021 - RNA, 19 nt, Bordetella pertussis
ccaggcauucccgcccagc

SEQ ID NO: 421022 - RNA, 15 nt, Bordetella pertussis
ccaggccaccgcggc

SEQ ID NO: 421023 - RNA, 19 nt, Bordetella pertussis
ccaggccaccgcggugccg

SEQ ID NO: 421024 - RNA, 12 nt, Bordetella pertussis
ccaggccagcgc

SEQ ID NO: 421025 - RNA, 15 nt, Bordetella pertussis
ccaggccagcgccgc

SEQ ID NO: 421026 - RNA, 16 nt, Bordetella pertussis
ccaggccagcgccgcg

SEQ ID NO: 421027 - RNA, 17 nt, Bordetella pertussis
ccaggccagcugcgccc

SEQ ID NO: 421028 - RNA, 20 nt, Bordetella pertussis
ccaggccagcagcucggcca

SEQ ID NO: 421029 - RNA, 14 nt, Bordetella pertussis
ccaggccauggcgc

SEQ ID NO: 421030 - RNA, 15 nt, Bordetella pertussis
ccaggcccaccgcau

SEQ ID NO: 421031 - RNA, 12 nt, Bordetella pertussis
ccaggcccaggc

SEQ ID NO: 421032 - RNA, 16 nt, Bordetella pertussis
ccaggcccaugccgcc

SEQ ID NO: 421033 - RNA, 19 nt, Bordetella pertussis
ccaggccccgccgggccgc

SEQ ID NO: 421034 - RNA, 19 nt, Bordetella pertussis
ccaggcccgccacggcgcc

SEQ ID NO: 421035 - RNA, 12 nt, Bordetella pertussis
ccaggcccggca

SEQ ID NO: 421036 - RNA, 15 nt, Bordetella pertussis
ccaggcccggccgca

SEQ ID NO: 421037 - RNA, 20 nt, Bordetella pertussis
ccaggcccgugcuccagaac

SEQ ID NO: 421038 - RNA, 20 nt, Bordetella pertussis
ccaggcccucgcggccgucg

SEQ ID NO: 421039 - RNA, 18 nt, Bordetella pertussis
ccaggccgaagccaccgu

SEQ ID NO: 421040 - RNA, 20 nt, Bordetella pertussis
ccaggccgaagccaccgucu

SEQ ID NO: 421041 - RNA, 15 nt, Bordetella pertussis
ccaggccgaccaugu

SEQ ID NO: 421042 - RNA, 19 nt, Bordetella pertussis
ccaggccgaucagcgacag

SEQ ID NO: 421043 - RNA, 16 nt, Bordetella pertussis
ccaggccgauggcguc

SEQ ID NO: 421044 - RNA, 14 nt, Bordetella pertussis
ccaggccgcccagc

SEQ ID NO: 421045 - RNA, 14 nt, Bordetella pertussis
ccaggccgccgccg

SEQ ID NO: 421046 - RNA, 13 nt, Bordetella pertussis
ccaggccgccggc

SEQ ID NO: 421047 - RNA, 17 nt, Bordetella pertussis
ccaggccgccggcggcg

SEQ ID NO: 421048 - RNA, 14 nt, Bordetella pertussis
ccaggccggccugc

SEQ ID NO: 421049 - RNA, 16 nt, Bordetella pertussis
ccaggccggccugcag

SEQ ID NO: 421050 - RNA, 18 nt, Bordetella pertussis
ccaggccggccugcaggc

SEQ ID NO: 421051 - RNA, 18 nt, Bordetella pertussis
ccaggccggcccagucca

SEQ ID NO: 421052 - RNA, 23 nt, Bordetella pertussis
ccaggccggcccaguccagggug

SEQ ID NO: 421053 - RNA, 14 nt, Bordetella pertussis
ccaggccggccuug

SEQ ID NO: 421054 - RNA, 17 nt, Bordetella pertussis
ccaggccggcgccagcc

SEQ ID NO: 421055 - RNA, 16 nt, Bordetella pertussis
ccaggccggggccgcc

SEQ ID NO: 421056 - RNA, 14 nt, Bordetella pertussis
ccaggcgcucgcgc

SEQ ID NO: 421057 - RNA, 19 nt, Bordetella pertussis
ccaggcgcucggcguugcu

SEQ ID NO: 421058 - RNA, 16 nt, Bordetella pertussis
ccaggcgcugaccugc

SEQ ID NO: 421059 - RNA, 20 nt, Bordetella pertussis
ccaggcggccaucgccgcca

SEQ ID NO: 421060 - RNA, 22 nt, Bordetella pertussis
ccaggcggcgcucgaaggcgcc

SEQ ID NO: 421061 - RNA, 17 nt, Bordetella pertussis
ccaggcggcggugccag

SEQ ID NO: 421062 - RNA, 22 nt, Bordetella pertussis
ccaggcggcguaguucagccac

SEQ ID NO: 421063 - RNA, 23 nt, Bordetella pertussis
ccaggcgggcaucgcccaccaug

SEQ ID NO: 421064 - RNA, 20 nt, Bordetella pertussis
ccaggcggcaggcgccgccg

SEQ ID NO: 421065 - RNA, 21 nt, Bordetella pertussis
ccaggcggcaggcgccgccgc

SEQ ID NO: 421066 - RNA, 20 nt, Bordetella pertussis
ccaggcgggguggcacagcc

SEQ ID NO: 421067 - RNA, 23 nt, Bordetella pertussis
ccaggcggucauagacggcgucg

SEQ ID NO: 421068 - RNA, 20 nt, Bordetella pertussis
ccaggcggugcguccaggac

SEQ ID NO: 421069 - RNA, 23 nt, Bordetella pertussis
ccaggcgguggccucguccacgu

SEQ ID NO: 421070 - RNA, 16 nt, Bordetella pertussis
ccaggcgucggcggcc

SEQ ID NO: 421071 - RNA, 20 nt, Bordetella pertussis
ccaggcucugggcggagucg

SEQ ID NO: 421072 - RNA, 17 nt, Bordetella pertussis
ccaggcugaaugccgcc

SEQ ID NO: 421073 - RNA, 18 nt, Bordetella pertussis
ccaggcugaaugccgccg

SEQ ID NO: 421074 - RNA, 16 nt, Bordetella pertussis
ccaggcugcccuggcc

SEQ ID NO: 421075 - RNA, 19 nt, Bordetella pertussis
ccaggcugcccuggcccag

SEQ ID NO: 421076 - RNA, 21 nt, Bordetella pertussis
ccaggcugcgcgccggcgccu

SEQ ID NO: 421077 - RNA, 19 nt, Bordetella pertussis
ccaggcugucccagauggc

SEQ ID NO: 421078 - RNA, 12 nt, Bordetella pertussis
ccaggggcggcg

SEQ ID NO: 421079 - RNA, 18 nt, Bordetella pertussis
ccaggggcggcgcggcgc

SEQ ID NO: 421080 - RNA, 19 nt, Bordetella pertussis
ccaggggcggcgcggcgcu

SEQ ID NO: 421081 - RNA, 19 nt, Bordetella pertussis
ccagggggucagggccgcc

SEQ ID NO: 421082 - RNA, 17 nt, Bordetella pertussis
ccagggucaggggcagg

SEQ ID NO: 421083 - RNA, 14 nt, Bordetella pertussis
ccagggucugcugg

SEQ ID NO: 421084 - RNA, 15 nt, Bordetella pertussis
ccagggucugcuggu

SEQ ID NO: 421085 - RNA, 16 nt, Bordetella pertussis
ccagggugaccuggcg

SEQ ID NO: 421086 - RNA, 16 nt, Bordetella pertussis
ccagggugccccgccg

SEQ ID NO: 421087 - RNA, 14 nt, Bordetella pertussis
ccagggugccgccu

SEQ ID NO: 421088 - RNA, 22 nt, Bordetella pertussis
ccagguaggcggcgcgcccgcc

SEQ ID NO: 421089 - RNA, 23 nt, Bordetella pertussis
ccagguagucgucgaaggcgcgc

SEQ ID NO: 421090 - RNA, 17 nt, Bordetella pertussis
ccagguaucggccagca

SEQ ID NO: 421091 - RNA, 19 nt, Bordetella pertussis
ccaggucaucgccaggcgc

SEQ ID NO: 421092 - RNA, 19 nt, Bordetella pertussis
ccagguccgaaccgaccgc

SEQ ID NO: 421093 - RNA, 20 nt, Bordetella pertussis
ccagguccgaaccgaccgcc

SEQ ID NO: 421094 - RNA, 19 nt, Bordetella pertussis
ccagguccuggcggccgcc

SEQ ID NO: 421095 - RNA, 22 nt, Bordetella pertussis
ccaggucgcggugcgccacgau

SEQ ID NO: 421096 - RNA, 14 nt, Bordetella pertussis
ccaggucggccagc

SEQ ID NO: 421097 - RNA, 19 nt, Bordetella pertussis
ccaggucggccagccggcc

SEQ ID NO: 421098 - RNA, 22 nt, Bordetella pertussis
ccaggucggccagccggccgau

SEQ ID NO: 421099 - RNA, 18 nt, Bordetella pertussis
ccaggucggccaccgccg

SEQ ID NO: 421100 - RNA, 19 nt, Bordetella pertussis
ccaggucguacagcgccug

SEQ ID NO: 421101 - RNA, 23 nt, Bordetella pertussis
ccaggucguacagcgccugcgcg

SEQ ID NO: 421102 - RNA, 17 nt, Bordetella pertussis
ccaguagcgugugcagg

SEQ ID NO: 421103 - RNA, 16 nt, Bordetella pertussis
ccaguccagcgcgccg

SEQ ID NO: 421104 - RNA, 16 nt, Bordetella pertussis
ccagucccaggaucac

SEQ ID NO: 421105 - RNA, 20 nt, Bordetella pertussis
ccaguccccauguggggaca

SEQ ID NO: 421106 - RNA, 13 nt, Bordetella pertussis
ccaguccccugcg

SEQ ID NO: 421107 - RNA, 19 nt, Bordetella pertussis
ccaguccccugcggggaca

SEQ ID NO: 421108 - RNA, 24 nt, Bordetella pertussis
ccaguccccugcggggacaggcac

SEQ ID NO: 421109 - RNA, 20 nt, Bordetella pertussis
ccaguccgcgcucgcccagc

SEQ ID NO: 421110 - RNA, 22 nt, Bordetella pertussis
ccaguccgcgcucgcccagccg

SEQ ID NO: 421111 - RNA, 14 nt, Bordetella pertussis
ccagucgccgcgcc

SEQ ID NO: 421112 - RNA, 18 nt, Bordetella pertussis
ccagucguccagcacgcg

SEQ ID NO: 421113 - RNA, 20 nt, Bordetella pertussis
ccagucguccagcacgcggc

SEQ ID NO: 421114 - RNA, 21 nt, Bordetella pertussis
ccagucuggauggcguaugga

SEQ ID NO: 421115 - RNA, 12 nt, Bordetella pertussis
ccagugccugga

SEQ ID NO: 421116 - RNA, 14 nt, Bordetella pertussis
ccagugcgccggcg

SEQ ID NO: 421117 - RNA, 17 nt, Bordetella pertussis
ccagugcgccggcggcg

SEQ ID NO: 421118 - RNA, 15 nt, Bordetella pertussis
ccaguucgcggcgca

SEQ ID NO: 421119 - RNA, 16 nt, Bordetella pertussis
ccaguucgcuuuccag

SEQ ID NO: 421120 - RNA, 14 nt, Bordetella pertussis
ccaguucggccagc

SEQ ID NO: 421121 - RNA, 20 nt, Bordetella pertussis
ccaguugacgaugcccaggu

SEQ ID NO: 421122 - RNA, 16 nt, Bordetella pertussis
ccaguugccgccgccg

SEQ ID NO: 421123 - RNA, 14 nt, Bordetella pertussis
ccaguugcgcgccg

SEQ ID NO: 421124 - RNA, 21 nt, Bordetella pertussis
ccaguugcggggcgcccagcg

SEQ ID NO: 421125 - RNA, 18 nt, Bordetella pertussis
ccaguuggcccuucuuca

SEQ ID NO: 421126 - RNA, 15 nt, Bordetella pertussis
ccaguugggccaggg

SEQ ID NO: 421127 - RNA, 23 nt, Bordetella pertussis
ccauacagcaaggacaaggcgcg

SEQ ID NO: 421128 - RNA, 16 nt, Bordetella pertussis
ccauaccagcccggcg

SEQ ID NO: 421129 - RNA, 20 nt, Bordetella pertussis
ccauaucccugcggcagcga

SEQ ID NO: 421130 - RNA, 22 nt, Bordetella pertussis
ccauaucccugcggcagcgacu

SEQ ID NO: 421131 - RNA, 21 nt, Bordetella pertussis
ccaucaagaaggucgacgagg

SEQ ID NO: 421132 - RNA, 21 nt, Bordetella pertussis
ccaucagcagcaccuucugcc

SEQ ID NO: 421133 - RNA, 16 nt, Bordetella pertussis
ccaucagccagccgcu

SEQ ID NO: 421134 - RNA, 21 nt, Bordetella pertussis
ccaucagcucgaccacggcgg

SEQ ID NO: 421135 - RNA, 21 nt, Bordetella pertussis
ccaucaggugaaacagcagcg

SEQ ID NO: 421136 - RNA, 22 nt, Bordetella pertussis
ccaucaggugcaggguuggcgc

SEQ ID NO: 421137 - RNA, 19 nt, Bordetella pertussis
ccaucagguuguccagcgc

SEQ ID NO: 421138 - RNA, 23 nt, Bordetella pertussis
ccaucagguuguccagcgcgccc

SEQ ID NO: 421139 - RNA, 17 nt, Bordetella pertussis
ccaucaucagcauggcg

SEQ ID NO: 421140 - RNA, 19 nt, Bordetella pertussis
ccaucaucaucgucggcgc

SEQ ID NO: 421141 - RNA, 14 nt, Bordetella pertussis
ccaucauggccagg

SEQ ID NO: 421142 - RNA, 15 nt, Bordetella pertussis
ccaucauggccaggg

SEQ ID NO: 421143 - RNA, 16 nt, Bordetella pertussis
ccaucgccgagccgcu

SEQ ID NO: 421144 - RNA, 22 nt, Bordetella pertussis
ccaucggcgccaagcggcaggc

SEQ ID NO: 421145 - RNA, 15 nt, Bordetella pertussis
ccaucggcgcgcgcu

SEQ ID NO: 421146 - RNA, 23 nt, Bordetella pertussis
ccaucggcgcgcgcugcacggcc

SEQ ID NO: 421147 - RNA, 13 nt, Bordetella pertussis
ccaucgggcugcg

SEQ ID NO: 421148 - RNA, 17 nt, Bordetella pertussis
ccaucggggggcaggcu

SEQ ID NO: 421149 - RNA, 20 nt, Bordetella pertussis
ccaucuugccggccuguucu

SEQ ID NO: 421150 - RNA, 23 nt, Bordetella pertussis
ccauugcagggugucggccaggg

SEQ ID NO: 421151 - RNA, 16 nt, Bordetella pertussis
ccauugcccacagcac

SEQ ID NO: 421152 - RNA, 17 nt, Bordetella pertussis
ccauuucgauggccagg

SEQ ID NO: 421153 - RNA, 18 nt, Bordetella pertussis
ccauuuguugggccaccu

SEQ ID NO: 421154 - RNA, 16 nt, Bordetella pertussis
cccaaccagggccgcc

SEQ ID NO: 421155 - RNA, 15 nt, Bordetella pertussis
cccaaccgggacagg

SEQ ID NO: 421156 - RNA, 13 nt, Bordetella pertussis
cccacaccaucaa

SEQ ID NO: 421157 - RNA, 14 nt, Bordetella pertussis
cccacagcagcgcg

SEQ ID NO: 421158 - RNA, 19 nt, Bordetella pertussis
cccacagcagcgcgccgcc

SEQ ID NO: 421159 - RNA, 14 nt, Bordetella pertussis
cccacagcgccccc

SEQ ID NO: 421160 - RNA, 15 nt, Bordetella pertussis
cccacagcgccccca

SEQ ID NO: 421161 - RNA, 16 nt, Bordetella pertussis
cccaccaccagcgcgg

SEQ ID NO: 421162 - RNA, 21 nt, Bordetella pertussis
cccaccaccagcgcggccagc

SEQ ID NO: 421163 - RNA, 14 nt, Bordetella pertussis
cccaccaccagcgg

SEQ ID NO: 421164 - RNA, 12 nt, Bordetella pertussis
cccaccacgccg

SEQ ID NO: 421165 - RNA, 15 nt, Bordetella pertussis
cccaccagccgcccg

SEQ ID NO: 421166 - RNA, 17 nt, Bordetella pertussis
cccaccagccgggcggc

SEQ ID NO: 421167 - RNA, 23 nt, Bordetella pertussis
cccaccagccgggcggccacggc

SEQ ID NO: 421168 - RNA, 13 nt, Bordetella pertussis
cccaccagcgcca

SEQ ID NO: 421169 - RNA, 12 nt, Bordetella pertussis
cccaccgccagg

SEQ ID NO: 421170 - RNA, 13 nt, Bordetella pertussis
cccaccgccagga

SEQ ID NO: 421171 - RNA, 18 nt, Bordetella pertussis
cccaccgccgcccgccag

SEQ ID NO: 421172 - RNA, 19 nt, Bordetella pertussis
cccaccgccguggccggca

SEQ ID NO: 421173 - RNA, 21 nt, Bordetella pertussis
cccaccgcgaaccaggccugc

SEQ ID NO: 421174 - RNA, 14 nt, Bordetella pertussis
cccaccgggccggc

SEQ ID NO: 421175 - RNA, 15 nt, Bordetella pertussis
cccaccgggccggcc

SEQ ID NO: 421176 - RNA, 22 nt, Bordetella pertussis
cccaccugcagccagaucucgc

SEQ ID NO: 421177 - RNA, 20 nt, Bordetella pertussis
cccacgccgaugccgcgcac

SEQ ID NO: 421178 - RNA, 12 nt, Bordetella pertussis
cccacgccgccg

SEQ ID NO: 421179 - RNA, 12 nt, Bordetella pertussis
cccacgccgccu

SEQ ID NO: 421180 - RNA, 20 nt, Bordetella pertussis
cccacgccuuccggccccau

SEQ ID NO: 421181 - RNA, 21 nt, Bordetella pertussis
cccacgcucuggagccaccag

SEQ ID NO: 421182 - RNA, 17 nt, Bordetella pertussis
cccacggcgagucugaa

SEQ ID NO: 421183 - RNA, 22 nt, Bordetella pertussis
cccacggcgccaaagcacagga

SEQ ID NO: 421184 - RNA, 14 nt, Bordetella pertussis
cccacggggacagg

SEQ ID NO: 421185 - RNA, 15 nt, Bordetella pertussis
cccacggggacaggc

SEQ ID NO: 421186 - RNA, 19 nt, Bordetella pertussis
cccacggggacaggcaccu

SEQ ID NO: 421187 - RNA, 17 nt, Bordetella pertussis
cccacguggacaggcac

SEQ ID NO: 421188 - RNA, 21 nt, Bordetella pertussis
cccacucacgcaaggccgacu

SEQ ID NO: 421189 - RNA, 15 nt, Bordetella pertussis
cccagcaccacggca

SEQ ID NO: 421190 - RNA, 14 nt, Bordetella pertussis
cccagcaccaggcc

SEQ ID NO: 421191 - RNA, 20 nt, Bordetella pertussis
cccagcaccgagcugccgcc

SEQ ID NO: 421192 - RNA, 12 nt, Bordetella pertussis
cccagcaccgcc

SEQ ID NO: 421193 - RNA, 16 nt, Bordetella pertussis
cccagcaccgccaccg

SEQ ID NO: 421194 - RNA, 16 nt, Bordetella pertussis
cccagcaccgccgcca

SEQ ID NO: 421195 - RNA, 18 nt, Bordetella pertussis
cccagcaccucgacgcag

SEQ ID NO: 421196 - RNA, 21 nt, Bordetella pertussis
cccagcaccucgacgcagccu

SEQ ID NO: 421197 - RNA, 15 nt, Bordetella pertussis
cccagcaccugcagg

SEQ ID NO: 421198 - RNA, 19 nt, Bordetella pertussis
cccagcaccugcaggccgc

SEQ ID NO: 421199 - RNA, 12 nt, Bordetella pertussis
cccagcacgcgc

SEQ ID NO: 421200 - RNA, 20 nt, Bordetella pertussis
cccagcacgcgcgccagcug

SEQ ID NO: 421201 - RNA, 14 nt, Bordetella pertussis
cccagcagcacgcc

SEQ ID NO: 421202 - RNA, 13 nt, Bordetella pertussis
cccagcagcagcg

SEQ ID NO: 421203 - RNA, 21 nt, Bordetella pertussis
cccagcagcagcgagcccgcc

SEQ ID NO: 421204 - RNA, 21 nt, Bordetella pertussis
cccagcagcauggcgggcgag

SEQ ID NO: 421205 - RNA, 21 nt, Bordetella pertussis
cccagcagcgccaccguggcc

SEQ ID NO: 421206 - RNA, 22 nt, Bordetella pertussis
cccagcagcuccucggccugcc

SEQ ID NO: 421207 - RNA, 23 nt, Bordetella pertussis
cccagcaggcuuucgcacagccg

SEQ ID NO: 421208 - RNA, 13 nt, Bordetella pertussis
cccagcccggcuu

SEQ ID NO: 421209 - RNA, 13 nt, Bordetella pertussis
cccagcccugccc

SEQ ID NO: 421210 - RNA, 13 nt, Bordetella pertussis
cccagccgcgcca

SEQ ID NO: 421211 - RNA, 22 nt, Bordetella pertussis
cccagccgcucggccacgcgcu

SEQ ID NO: 421212 - RNA, 19 nt, Bordetella pertussis
cccagccggacccgcgccg

SEQ ID NO: 421213 - RNA, 14 nt, Bordetella pertussis
cccagccggcggca

SEQ ID NO: 421214 - RNA, 17 nt, Bordetella pertussis
cccagccggcggcaugc

SEQ ID NO: 421215 - RNA, 16 nt, Bordetella pertussis
cccagccgucgcgcug

SEQ ID NO: 421216 - RNA, 16 nt, Bordetella pertussis
cccagccugccggcgg

SEQ ID NO: 421217 - RNA, 19 nt, Bordetella pertussis
cccagcgacgagggcgcca

SEQ ID NO: 421218 - RNA, 14 nt, Bordetella pertussis
cccagcgagcugcg

SEQ ID NO: 421219 - RNA, 13 nt, Bordetella pertussis
cccagcgagcugg

SEQ ID NO: 421220 - RNA, 22 nt, Bordetella pertussis
cccagcgagccggccagcgcca

SEQ ID NO: 421221 - RNA, 15 nt, Bordetella pertussis
cccagcgcacgcagc

SEQ ID NO: 421222 - RNA, 18 nt, Bordetella pertussis
cccagcgcauaggacgcc

SEQ ID NO: 421223 - RNA, 15 nt, Bordetella pertussis
cccagcgccagcgug

SEQ ID NO: 421224 - RNA, 16 nt, Bordetella pertussis
cccagcgccagcgugg

SEQ ID NO: 421225 - RNA, 16 nt, Bordetella pertussis
cccagcgcccaggcga

SEQ ID NO: 421226 - RNA, 17 nt, Bordetella pertussis
cccagcgcccaggcgau

SEQ ID NO: 421227 - RNA, 22 nt, Bordetella pertussis
cccagcgccaucaagagcaccg

SEQ ID NO: 421228 - RNA, 14 nt, Bordetella pertussis
cccagcgccgccau

SEQ ID NO: 421229 - RNA, 14 nt, Bordetella pertussis
cccagcgccgcgag

SEQ ID NO: 421230 - RNA, 14 nt, Bordetella pertussis
cccagcgccggcac

SEQ ID NO: 421231 - RNA, 23 nt, Bordetella pertussis
cccagcgccgucagcagcgcggc

SEQ ID NO: 421232 - RNA, 14 nt, Bordetella pertussis
cccagcgccgccga

SEQ ID NO: 421233 - RNA, 15 nt, Bordetella pertussis
cccagcgcgccugcc

SEQ ID NO: 421234 - RNA, 23 nt, Bordetella pertussis
cccagcgcgccugcccaggccag

SEQ ID NO: 421235 - RNA, 22 nt, Bordetella pertussis
cccagcgcguccugcacguccu

SEQ ID NO: 421236 - RNA, 14 nt, Bordetella pertussis
cccagcgcucgucc

SEQ ID NO: 421237 - RNA, 17 nt, Bordetella pertussis
cccagcgcuugcacgcc

SEQ ID NO: 421238 - RNA, 18 nt, Bordetella pertussis
cccagcgcuugcacgcca

SEQ ID NO: 421239 - RNA, 19 nt, Bordetella pertussis
cccagcgcuugcacgccau

SEQ ID NO: 421240 - RNA, 14 nt, Bordetella pertussis
cccagcggcaggcu

SEQ ID NO: 421241 - RNA, 22 nt, Bordetella pertussis
cccagcggcgcaccgacagcaa

SEQ ID NO: 421242 - RNA, 22 nt, Bordetella pertussis
cccagcggggacaggcaccccu

SEQ ID NO: 421243 - RNA, 23 nt, Bordetella pertussis
cccagcgucagcugggcaugcac

SEQ ID NO: 421244 - RNA, 16 nt, Bordetella pertussis
cccagcguccaggcgg

SEQ ID NO: 421245 - RNA, 17 nt, Bordetella pertussis
cccagcguccaggcggc

SEQ ID NO: 421246 - RNA, 24 nt, Bordetella pertussis
cccagcguccaggcggccaucgcc

SEQ ID NO: 421247 - RNA, 12 nt, Bordetella pertussis
cccagcuccagc

SEQ ID NO: 421248 - RNA, 22 nt, Bordetella pertussis
cccaggauggcgccagcccgcc

SEQ ID NO: 421249 - RNA, 10 nt, Bordetella pertussis
cccaggcaau

SEQ ID NO: 421250 - RNA, 15 nt, Bordetella pertussis
cccaggcaggcgggc

SEQ ID NO: 421251 - RNA, 17 nt, Bordetella pertussis
cccaggccagcgccgcg

SEQ ID NO: 421252 - RNA, 13 nt, Bordetella pertussis
cccaggcccacgc

SEQ ID NO: 421253 - RNA, 15 nt, Bordetella pertussis
cccaggcccacgccg

SEQ ID NO: 421254 - RNA, 20 nt, Bordetella pertussis
cccaggcccauaugccgccg

SEQ ID NO: 421255 - RNA, 18 nt, Bordetella pertussis
cccaggccgaucagcgga

SEQ ID NO: 421256 - RNA, 17 nt, Bordetella pertussis
cccaggcccuggcuggc

SEQ ID NO: 421257 - RNA, 16 nt, Bordetella pertussis
cccaggcugggccaga

SEQ ID NO: 421258 - RNA, 16 nt, Bordetella pertussis
cccagggcagcggcca

SEQ ID NO: 421259 - RNA, 18 nt, Bordetella pertussis
cccagggcagcggccaga

SEQ ID NO: 421260 - RNA, 15 nt, Bordetella pertussis
cccagggccgcgccg

SEQ ID NO: 421261 - RNA, 21 nt, Bordetella pertussis
cccagggggucagggccgccc

SEQ ID NO: 421262 - RNA, 21 nt, Bordetella pertussis
cccagguacaucauccccagc

SEQ ID NO: 421263 - RNA, 19 nt, Bordetella pertussis
cccagguaucggccagcac

SEQ ID NO: 421264 - RNA, 16 nt, Bordetella pertussis
cccagguccagcgcca

SEQ ID NO: 421265 - RNA, 12 nt, Bordetella pertussis
cccagguccgcc

SEQ ID NO: 421266 - RNA, 21 nt, Bordetella pertussis
cccagguccgccggcacgcgc

SEQ ID NO: 421267 - RNA, 14 nt, Bordetella pertussis
cccaggucggacgc

SEQ ID NO: 421268 - RNA, 16 nt, Bordetella pertussis
cccaugccgccaugca

SEQ ID NO: 421269 - RNA, 21 nt, Bordetella pertussis
cccaugccgccaugcagcugg

SEQ ID NO: 421270 - RNA, 14 nt, Bordetella pertussis
cccaugccgcccgc

SEQ ID NO: 421271 - RNA, 16 nt, Bordetella pertussis
cccaugccgcccgcca

SEQ ID NO: 421272 - RNA, 13 nt, Bordetella pertussis
cccaugccgccgg

SEQ ID NO: 421273 - RNA, 12 nt, Bordetella pertussis
cccaugccgcgg

SEQ ID NO: 421274 - RNA, 19 nt, Bordetella pertussis
cccaugcgaucggccucgg

SEQ ID NO: 421275 - RNA, 20 nt, Bordetella pertussis
cccauggccugcaaccuggu

SEQ ID NO: 421276 - RNA, 22 nt, Bordetella pertussis
cccaugggaaucugcuugccgu

SEQ ID NO: 421277 - RNA, 19 nt, Bordetella pertussis
cccauggggugcuccugcc

SEQ ID NO: 421278 - RNA, 22 nt, Bordetella pertussis
cccauguagaacgccagggucu

SEQ ID NO: 421279 - RNA, 16 nt, Bordetella pertussis
cccauguugaacugca

SEQ ID NO: 421280 - RNA, 19 nt, Bordetella pertussis
cccauguugaacugcaggc

SEQ ID NO: 421281 - RNA, 19 nt, Bordetella pertussis
cccauguggggacaggcac

SEQ ID NO: 421282 - RNA, 18 nt, Bordetella pertussis
ccccaacgcggccagcgg

SEQ ID NO: 421283 - RNA, 21 nt, Bordetella pertussis
ccccaacggggacgggcgccc

SEQ ID NO: 421284 - RNA, 21 nt, Bordetella pertussis
ccccacagggggacuggcacc

SEQ ID NO: 421285 - RNA, 17 nt, Bordetella pertussis
ccccacgcugcgcccgc

SEQ ID NO: 421286 - RNA, 17 nt, Bordetella pertussis
ccccacguggacaggca

SEQ ID NO: 421287 - RNA, 19 nt, Bordetella pertussis
ccccacguggacaggcacc

SEQ ID NO: 421288 - RNA, 17 nt, Bordetella pertussis
ccccacugggggacugg

SEQ ID NO: 421289 - RNA, 20 nt, Bordetella pertussis
ccccacugggggacuggcac

SEQ ID NO: 421290 - RNA, 21 nt, Bordetella pertussis
ccccacugggggacuggcacc

SEQ ID NO: 421291 - RNA, 11 nt, Bordetella pertussis
ccccagcagca

SEQ ID NO: 421292 - RNA, 13 nt, Bordetella pertussis
ccccagcagcagc

SEQ ID NO: 421293 - RNA, 19 nt, Bordetella pertussis
ccccagcagcauggcgggc

SEQ ID NO: 421294 - RNA, 11 nt, Bordetella pertussis
ccccagcagcg

SEQ ID NO: 421295 - RNA, 19 nt, Bordetella pertussis
ccccagcacgaagggcagc

SEQ ID NO: 421296 - RNA, 18 nt, Bordetella pertussis
cccccacgcugcgcccgc

SEQ ID NO: 421297 - RNA, 15 nt, Bordetella pertussis
cccccacgccgccgu

SEQ ID NO: 421298 - RNA, 11 nt, Bordetella pertussis
cccccagcagc

SEQ ID NO: 421299 - RNA, 12 nt, Bordetella pertussis
cccccagcagcg

SEQ ID NO: 421300 - RNA, 17 nt, Bordetella pertussis
cccccagcccauagaug

SEQ ID NO: 421301 - RNA, 13 nt, Bordetella pertussis
cccccagggcgcg

SEQ ID NO: 421302 - RNA, 16 nt, Bordetella pertussis
cccccaugcggggaca

SEQ ID NO: 421303 - RNA, 15 nt, Bordetella pertussis
ccccccaugccggaa

SEQ ID NO: 421304 - RNA, 13 nt, Bordetella pertussis
cccccccccccuc

SEQ ID NO: 421305 - RNA, 18 nt, Bordetella pertussis
cccccgaccgagccacac

SEQ ID NO: 421306 - RNA, 14 nt, Bordetella pertussis
cccccgccguggcg

SEQ ID NO: 421307 - RNA, 15 nt, Bordetella pertussis
ccccgaggccaccuu

SEQ ID NO: 421308 - RNA, 15 nt, Bordetella pertussis
ccccgagggcgcggc

SEQ ID NO: 421309 - RNA, 20 nt, Bordetella pertussis
ccccgagggcgcggcgccgc

SEQ ID NO: 421310 - RNA, 21 nt, Bordetella pertussis
ccccgagggcgcggcgccgcu

SEQ ID NO: 421311 - RNA, 21 nt, Bordetella pertussis
ccccgagggggcuuuuugccu

SEQ ID NO: 421312 - RNA, 19 nt, Bordetella pertussis
ccccgauacaaggugccug

SEQ ID NO: 421313 - RNA, 21 nt, Bordetella pertussis
ccccgaucgggagccucugga

SEQ ID NO: 421314 - RNA, 22 nt, Bordetella pertussis
ccccgaucgggagccucuggaa

SEQ ID NO: 421315 - RNA, 21 nt, Bordetella pertussis
ccccgauccccugcccgccug

SEQ ID NO: 421316 - RNA, 21 nt, Bordetella pertussis
ccccgcacggggacuggcacc

SEQ ID NO: 421317 - RNA, 17 nt, Bordetella pertussis
ccccgcagggacaggcu

SEQ ID NO: 421318 - RNA, 18 nt, Bordetella pertussis
ccccgcaugggggcuggc

SEQ ID NO: 421319 - RNA, 17 nt, Bordetella pertussis
ccccgccgggacaggca

SEQ ID NO: 421320 - RNA, 22 nt, Bordetella pertussis
ccccgcggaggugucgccgccc

SEQ ID NO: 421321 - RNA, 17 nt, Bordetella pertussis
ccccgcggggacuggcu

SEQ ID NO: 421322 - RNA, 22 nt, Bordetella pertussis
ccccgcggggacuggcucccac

SEQ ID NO: 421323 - RNA, 14 nt, Bordetella pertussis
ccccgcgguggggc

SEQ ID NO: 421324 - RNA, 17 nt, Bordetella pertussis
ccccgcgugccuguccc

SEQ ID NO: 421325 - RNA, 19 nt, Bordetella pertussis
ccccgcugaccuggugugc

SEQ ID NO: 421326 - RNA, 16 nt, Bordetella pertussis
ccccuugcggccgccg

SEQ ID NO: 421327 - RNA, 11 nt, Bordetella pertussis
cccgaaaccca

SEQ ID NO: 421328 - RNA, 16 nt, Bordetella pertussis
cccgaaacucaccgcc

SEQ ID NO: 421329 - RNA, 20 nt, Bordetella pertussis
cccgaaacucaccgccgccc

SEQ ID NO: 421330 - RNA, 21 nt, Bordetella pertussis
cccgaaccggcaucccugcuu

SEQ ID NO: 421331 - RNA, 22 nt, Bordetella pertussis
cccgaacggcccauccaucugg

SEQ ID NO: 421332 - RNA, 21 nt, Bordetella pertussis
cccgaagauuuccucgcgcac

SEQ ID NO: 421333 - RNA, 20 nt, Bordetella pertussis
cccgaagcgcagcaccaggu

SEQ ID NO: 421334 - RNA, 21 nt, Bordetella pertussis
cccgaagcgcagcaccagguc

SEQ ID NO: 421335 - RNA, 16 nt, Bordetella pertussis
cccgaaggcgcggccg

SEQ ID NO: 421336 - RNA, 22 nt, Bordetella pertussis
cccgaaggggacuggcucccgc

SEQ ID NO: 421337 - RNA, 23 nt, Bordetella pertussis
cccgaccgagccacaccguuccc

SEQ ID NO: 421338 - RNA, 13 nt, Bordetella pertussis
cccgaccugcugg

SEQ ID NO: 421339 - RNA, 15 nt, Bordetella pertussis
cccgacggcgcgccc

SEQ ID NO: 421340 - RNA, 15 nt, Bordetella pertussis
cccgacggggacagg

SEQ ID NO: 421341 - RNA, 23 nt, Bordetella pertussis
cccgagaagggcuugaccagggc

SEQ ID NO: 421342 - RNA, 12 nt, Bordetella pertussis
cccgagaccgcc

SEQ ID NO: 421343 - RNA, 19 nt, Bordetella pertussis
cccgagcgcgacagcacca

SEQ ID NO: 421344 - RNA, 22 nt, Bordetella pertussis
cccgagcgcgacagcaccaacu

SEQ ID NO: 421345 - RNA, 14 nt, Bordetella pertussis
cccgagcggcgcca

SEQ ID NO: 421346 - RNA, 14 nt, Bordetella pertussis
cccgaggcggcgcg

SEQ ID NO: 421347 - RNA, 17 nt, Bordetella pertussis
cccgagggcgcggcgcc

SEQ ID NO: 421348 - RNA, 22 nt, Bordetella pertussis
cccgauacaaggugccuguccc

SEQ ID NO: 421349 - RNA, 19 nt, Bordetella pertussis
cccgauacgacacgccgcg

SEQ ID NO: 421350 - RNA, 21 nt, Bordetella pertussis
cccgauaugcagccgcaccag

SEQ ID NO: 421351 - RNA, 15 nt, Bordetella pertussis
cccgauccccugccc

SEQ ID NO: 421352 - RNA, 21 nt, Bordetella pertussis
cccgaugauggauucgcgccg

SEQ ID NO: 421353 - RNA, 15 nt, Bordetella pertussis
cccgaugcuccgggu

SEQ ID NO: 421354 - RNA, 23 nt, Bordetella pertussis
cccgaugcucgccggcgccgccc

SEQ ID NO: 421355 - RNA, 13 nt, Bordetella pertussis
cccgauggcgggg

SEQ ID NO: 421356 - RNA, 14 nt, Bordetella pertussis
cccgauuucggagc

SEQ ID NO: 421357 - RNA, 16 nt, Bordetella pertussis
cccgcaaaaccgggcc

SEQ ID NO: 421358 - RNA, 21 nt, Bordetella pertussis
cccgcaaaccugaugccuguc

SEQ ID NO: 421359 - RNA, 16 nt, Bordetella pertussis
cccgcaacgccgcccg

SEQ ID NO: 421360 - RNA, 17 nt, Bordetella pertussis
cccgcaacgccgcccgu

SEQ ID NO: 421361 - RNA, 20 nt, Bordetella pertussis
cccgcaaggggccggcgccg

SEQ ID NO: 421362 - RNA, 22 nt, Bordetella pertussis
cccgcacauacaaggcgcggca

SEQ ID NO: 421363 - RNA, 14 nt, Bordetella pertussis
cccgcaccgaccag

SEQ ID NO: 421364 - RNA, 22 nt, Bordetella pertussis
cccgcaccgaccagcgcgcgcc

SEQ ID NO: 421365 - RNA, 14 nt, Bordetella pertussis
cccgcacgcagccc

SEQ ID NO: 421366 - RNA, 16 nt, Bordetella pertussis
cccgcacggggacugg

SEQ ID NO: 421367 - RNA, 13 nt, Bordetella pertussis
cccgcaggcccac

SEQ ID NO: 421368 - RNA, 21 nt, Bordetella pertussis
cccgcaggcggcggccuccag

SEQ ID NO: 421369 - RNA, 20 nt, Bordetella pertussis
cccgcagggacaggcacccc

SEQ ID NO: 421370 - RNA, 17 nt, Bordetella pertussis
cccgcagguggggcagc

SEQ ID NO: 421371 - RNA, 13 nt, Bordetella pertussis
cccgcauccuuca

SEQ ID NO: 421372 - RNA, 15 nt, Bordetella pertussis
cccgcaucgcgcgcc

SEQ ID NO: 421373 - RNA, 16 nt, Bordetella pertussis
cccgcaucgcgcgccg

SEQ ID NO: 421374 - RNA, 22 nt, Bordetella pertussis
cccgcaucggcguaccaggcag

SEQ ID NO: 421375 - RNA, 13 nt, Bordetella pertussis
cccgcaugcgcag

SEQ ID NO: 421376 - RNA, 22 nt, Bordetella pertussis
cccgcauggagaccggcgccug

SEQ ID NO: 421377 - RNA, 17 nt, Bordetella pertussis
cccgcaugguggcgcag

SEQ ID NO: 421378 - RNA, 22 nt, Bordetella pertussis
cccgccaccaggaacgccagca

SEQ ID NO: 421379 - RNA, 22 nt, Bordetella pertussis
cccgccacagauuggccaccag

SEQ ID NO: 421380 - RNA, 13 nt, Bordetella pertussis
cccgccacgcggg

SEQ ID NO: 421381 - RNA, 15 nt, Bordetella pertussis
cccgccacggcgccc

SEQ ID NO: 421382 - RNA, 17 nt, Bordetella pertussis
cccgccacgucgccggc

SEQ ID NO: 421383 - RNA, 15 nt, Bordetella pertussis
cccgccagcaaggcg

SEQ ID NO: 421384 - RNA, 23 nt, Bordetella pertussis
cccgccagcaaggcggcaaaccc

SEQ ID NO: 421385 - RNA, 15 nt, Bordetella pertussis
cccgccaggccaggu

SEQ ID NO: 421386 - RNA, 12 nt, Bordetella pertussis
cccgccaggcga

SEQ ID NO: 421387 - RNA, 13 nt, Bordetella pertussis
cccgccaggcgaa

SEQ ID NO: 421388 - RNA, 19 nt, Bordetella pertussis
cccgccauccuggccgccg

SEQ ID NO: 421389 - RNA, 20 nt, Bordetella pertussis
cccgccauccuggccgccgc

SEQ ID NO: 421390 - RNA, 16 nt, Bordetella pertussis
cccgccaucgccagga

SEQ ID NO: 421391 - RNA, 15 nt, Bordetella pertussis
cccgccaucgcgcau

SEQ ID NO: 421392 - RNA, 14 nt, Bordetella pertussis
cccgccaugcgcag

SEQ ID NO: 421393 - RNA, 19 nt, Bordetella pertussis
cccgccauugcacgcgcag

SEQ ID NO: 421394 - RNA, 15 nt, Bordetella pertussis
cccgcccacgcggcg

SEQ ID NO: 421395 - RNA, 17 nt, Bordetella pertussis
cccgcccagcgagucga

SEQ ID NO: 421396 - RNA, 12 nt, Bordetella pertussis
cccgcccagcau

SEQ ID NO: 421397 - RNA, 13 nt, Bordetella pertussis
cccgcccgcgccc

SEQ ID NO: 421398 - RNA, 14 nt, Bordetella pertussis
cccgcccgcgccca

SEQ ID NO: 421399 - RNA, 18 nt, Bordetella pertussis
cccgcccgcugaccggcc

SEQ ID NO: 421400 - RNA, 12 nt, Bordetella pertussis
cccgcccggguu

SEQ ID NO: 421401 - RNA, 20 nt, Bordetella pertussis
cccgcccggguuggcgucca

SEQ ID NO: 421402 - RNA, 17 nt, Bordetella pertussis
cccgcccugacgccugc

SEQ ID NO: 421403 - RNA, 22 nt, Bordetella pertussis
cccgcccugacgccugcgccgg

SEQ ID NO: 421404 - RNA, 13 nt, Bordetella pertussis
cccgcccucuucc

SEQ ID NO: 421405 - RNA, 15 nt, Bordetella pertussis
cccgcccuuggucac

SEQ ID NO: 421406 - RNA, 15 nt, Bordetella pertussis
cccgccgcaccagcc

SEQ ID NO: 421407 - RNA, 16 nt, Bordetella pertussis
cccgccgcaccagccu

SEQ ID NO: 421408 - RNA, 14 nt, Bordetella pertussis
cccgccgccgccca

SEQ ID NO: 421409 - RNA, 14 nt, Bordetella pertussis
cccgccgcggcagg

SEQ ID NO: 421410 - RNA, 20 nt, Bordetella pertussis
cccgccgcgaucagcgcggc

SEQ ID NO: 421411 - RNA, 20 nt, Bordetella pertussis
cccgccgggacacacgcucu

SEQ ID NO: 421412 - RNA, 12 nt, Bordetella pertussis
cccgccgggccg

SEQ ID NO: 421413 - RNA, 18 nt, Bordetella pertussis
cccgccgggccgcgccca

SEQ ID NO: 421414 - RNA, 17 nt, Bordetella pertussis
cccgccguaccgggcgg

SEQ ID NO: 421415 - RNA, 16 nt, Bordetella pertussis
cccgccucaggccgga

SEQ ID NO: 421416 - RNA, 23 nt, Bordetella pertussis
cccgccugcgccagccgcgccug

SEQ ID NO: 421417 - RNA, 22 nt, Bordetella pertussis
cccgcgacccagaacccggccg

SEQ ID NO: 421418 - RNA, 18 nt, Bordetella pertussis
cccgcgaggggcccuugu

SEQ ID NO: 421419 - RNA, 21 nt, Bordetella pertussis
cccgcgagcggccagccugcc

SEQ ID NO: 421420 - RNA, 14 nt, Bordetella pertussis
cccgcgcacgcccg

SEQ ID NO: 421421 - RNA, 13 nt, Bordetella pertussis
cccgcgcaugcaa

SEQ ID NO: 421422 - RNA, 13 nt, Bordetella pertussis
cccgcgccaccac

SEQ ID NO: 421423 - RNA, 17 nt, Bordetella pertussis
cccgcgccaccaccguc

SEQ ID NO: 421424 - RNA, 15 nt, Bordetella pertussis
cccgcgccagcgcca

SEQ ID NO: 421425 - RNA, 19 nt, Bordetella pertussis
cccgcgccagcgccacgcc

SEQ ID NO: 421426 - RNA, 12 nt, Bordetella pertussis
cccgcgcccagc

SEQ ID NO: 421427 - RNA, 15 nt, Bordetella pertussis
cccgcgcccagcugu

SEQ ID NO: 421428 - RNA, 16 nt, Bordetella pertussis
cccgcgccgcaggccg

SEQ ID NO: 421429 - RNA, 14 nt, Bordetella pertussis
cccgcgccgcgcag

SEQ ID NO: 421430 - RNA, 13 nt, Bordetella pertussis
cccgcgccggcgg

SEQ ID NO: 421431 - RNA, 22 nt, Bordetella pertussis
cccgcgcgagcgcaagcaccgc

SEQ ID NO: 421432 - RNA, 16 nt, Bordetella pertussis
cccgcgcgagcucacc

SEQ ID NO: 421433 - RNA, 13 nt, Bordetella pertussis
cccgcgcggccag

SEQ ID NO: 421434 - RNA, 18 nt, Bordetella pertussis
cccgcgcggccagcgccg

SEQ ID NO: 421435 - RNA, 14 nt, Bordetella pertussis
cccgcgcugcgccc

SEQ ID NO: 421436 - RNA, 22 nt, Bordetella pertussis
cccgcgcuguugcuccaggccg

SEQ ID NO: 421437 - RNA, 14 nt, Bordetella pertussis
cccgcggccaccag

SEQ ID NO: 421438 - RNA, 16 nt, Bordetella pertussis
cccgcggccagccacg

SEQ ID NO: 421439 - RNA, 18 nt, Bordetella pertussis
cccgcggccagccacgcc

SEQ ID NO: 421440 - RNA, 21 nt, Bordetella pertussis
cccgcggccagggugccccgc

SEQ ID NO: 421441 - RNA, 14 nt, Bordetella pertussis
cccgcggccgcguc

SEQ ID NO: 421442 - RNA, 13 nt, Bordetella pertussis
cccgcggcgccag

SEQ ID NO: 421443 - RNA, 13 nt, Bordetella pertussis
cccgcggcgccca

SEQ ID NO: 421444 - RNA, 13 nt, Bordetella pertussis
cccgcggcgcccc

SEQ ID NO: 421445 - RNA, 14 nt, Bordetella pertussis
cccgcggcgccccg

SEQ ID NO: 421446 - RNA, 14 nt, Bordetella pertussis
cccgcggggacagg

SEQ ID NO: 421447 - RNA, 21 nt, Bordetella pertussis
cccgcggggacaggcaccgcc

SEQ ID NO: 421448 - RNA, 23 nt, Bordetella pertussis
cccgcggggacaggcaccgccgc

SEQ ID NO: 421449 - RNA, 20 nt, Bordetella pertussis
cccgcggggacaggcucccg

SEQ ID NO: 421450 - RNA, 12 nt, Bordetella pertussis
cccgcgggcgcc

SEQ ID NO: 421451 - RNA, 17 nt, Bordetella pertussis
cccgcgucagacgcgcu

SEQ ID NO: 421452 - RNA, 20 nt, Bordetella pertussis
cccgcgucggacgcgcgccg

SEQ ID NO: 421453 - RNA, 18 nt, Bordetella pertussis
cccgcgugccuguccccg

SEQ ID NO: 421454 - RNA, 18 nt, Bordetella pertussis
cccgcuaccccggcagcg

SEQ ID NO: 421455 - RNA, 21 nt, Bordetella pertussis
cccgcuacgcgggcuugcugc

SEQ ID NO: 421456 - RNA, 23 nt, Bordetella pertussis
cccgcuacgcgggcuugcugccc

SEQ ID NO: 421457 - RNA, 13 nt, Bordetella pertussis
cccgcuccaggcg

SEQ ID NO: 421458 - RNA, 20 nt, Bordetella pertussis
cccgcucgaccuugucgccc

SEQ ID NO: 421459 - RNA, 15 nt, Bordetella pertussis
cccgcucggccacgc

SEQ ID NO: 421460 - RNA, 17 nt, Bordetella pertussis
cccgcucggccacgcgc

SEQ ID NO: 421461 - RNA, 16 nt, Bordetella pertussis
cccgcugaaggaccuc

SEQ ID NO: 421462 - RNA, 22 nt, Bordetella pertussis
cccgcugaaggaccucgcgccg

SEQ ID NO: 421463 - RNA, 22 nt, Bordetella pertussis
cccgcugccgagacggccgccg

SEQ ID NO: 421464 - RNA, 17 nt, Bordetella pertussis
cccgcuggccgucgccg

SEQ ID NO: 421465 - RNA, 21 nt, Bordetella pertussis
cccgcuggccgucgccgcccu

SEQ ID NO: 421466 - RNA, 14 nt, Bordetella pertussis
cccgcuggcggcac

SEQ ID NO: 421467 - RNA, 14 nt, Bordetella pertussis
cccgcugggacagg

SEQ ID NO: 421468 - RNA, 14 nt, Bordetella pertussis
cccgcuucgggccg

SEQ ID NO: 421469 - RNA, 17 nt, Bordetella pertussis
cccgcuucgggccggau

SEQ ID NO: 421470 - RNA, 18 nt, Bordetella pertussis
cccgcuugggccgcgccu

SEQ ID NO: 421471 - RNA, 20 nt, Bordetella pertussis
cccggaauaccgccagcucg

SEQ ID NO: 421472 - RNA, 17 nt, Bordetella pertussis
cccggacgcggccggca

SEQ ID NO: 421473 - RNA, 16 nt, Bordetella pertussis
cccggaucgacaggaa

SEQ ID NO: 421474 - RNA, 23 nt, Bordetella pertussis
cccggaugccaccucgcuugccc

SEQ ID NO: 421475 - RNA, 17 nt, Bordetella pertussis
cccggcaaucccggcga

SEQ ID NO: 421476 - RNA, 11 nt, Bordetella pertussis
cccggccagag

SEQ ID NO: 421477 - RNA, 13 nt, Bordetella pertussis
cccggccaggcgc

SEQ ID NO: 421478 - RNA, 14 nt, Bordetella pertussis
cccggcccaggccg

SEQ ID NO: 421479 - RNA, 11 nt, Bordetella pertussis
cccggccccag

SEQ ID NO: 421480 - RNA, 15 nt, Bordetella pertussis
cccggccccaggccg

SEQ ID NO: 421481 - RNA, 15 nt, Bordetella pertussis
cccggcccggcgggc

SEQ ID NO: 421482 - RNA, 17 nt, Bordetella pertussis
cccggccgaucgcgccg

SEQ ID NO: 421483 - RNA, 13 nt, Bordetella pertussis
cccggccgccgcc

SEQ ID NO: 421484 - RNA, 17 nt, Bordetella pertussis
cccggccgccucaccgc

SEQ ID NO: 421485 - RNA, 22 nt, Bordetella pertussis
cccggccggcacggccggccag

SEQ ID NO: 421486 - RNA, 15 nt, Bordetella pertussis
cccggccggcccugc

SEQ ID NO: 421487 - RNA, 12 nt, Bordetella pertussis
cccggccucccg

SEQ ID NO: 421488 - RNA, 22 nt, Bordetella pertussis
cccggccucgcugcgggcggcc

SEQ ID NO: 421489 - RNA, 21 nt, Bordetella pertussis
cccggccugcgugucaggcgg

SEQ ID NO: 421490 - RNA, 13 nt, Bordetella pertussis
cccggcgaagccg

SEQ ID NO: 421491 - RNA, 19 nt, Bordetella pertussis
cccggcgaagccggcacgc

SEQ ID NO: 421492 - RNA, 23 nt, Bordetella pertussis
cccggcgaagccggcacgccugc

SEQ ID NO: 421493 - RNA, 15 nt, Bordetella pertussis
cccggcgaggccgcc

SEQ ID NO: 421494 - RNA, 16 nt, Bordetella pertussis
cccggcgaggccgccc

SEQ ID NO: 421495 - RNA, 17 nt, Bordetella pertussis
cccggcgaggccgcccg

SEQ ID NO: 421496 - RNA, 18 nt, Bordetella pertussis
cccggcgaggccgcccgc

SEQ ID NO: 421497 - RNA, 22 nt, Bordetella pertussis
cccggcgaggccgcccgccccg

SEQ ID NO: 421498 - RNA, 23 nt, Bordetella pertussis
cccggcgagguugcaggccaggc

SEQ ID NO: 421499 - RNA, 19 nt, Bordetella pertussis
cccggcgaucaugccgccg

SEQ ID NO: 421500 - RNA, 14 nt, Bordetella pertussis
cccggcgcaugcug

SEQ ID NO: 421501 - RNA, 18 nt, Bordetella pertussis
cccggcgcgccuucggca

SEQ ID NO: 421502 - RNA, 19 nt, Bordetella pertussis
cccggcgcgccuucggcag

SEQ ID NO: 421503 - RNA, 23 nt, Bordetella pertussis
cccggcgcgccuucggcaggcgc

SEQ ID NO: 421504 - RNA, 19 nt, Bordetella pertussis
cccggcgcgccggccgcca

SEQ ID NO: 421505 - RNA, 18 nt, Bordetella pertussis
cccggcgcggccgggggu

SEQ ID NO: 421506 - RNA, 15 nt, Bordetella pertussis
cccggcgcggcgcgc

SEQ ID NO: 421507 - RNA, 17 nt, Bordetella pertussis
cccggcgcuggccgcca

SEQ ID NO: 421508 - RNA, 18 nt, Bordetella pertussis
cccggcgcuggccgccau

SEQ ID NO: 421509 - RNA, 17 nt, Bordetella pertussis
cccggcgcucagcgcgc

SEQ ID NO: 421510 - RNA, 20 nt, Bordetella pertussis
cccggcggaucacccagcgg

SEQ ID NO: 421511 - RNA, 23 nt, Bordetella pertussis
cccggcggaucacccagcggcug

SEQ ID NO: 421512 - RNA, 18 nt, Bordetella pertussis
cccggcggccaggccggc

SEQ ID NO: 421513 - RNA, 17 nt, Bordetella pertussis
cccggcggcgcgccgcc

SEQ ID NO: 421514 - RNA, 18 nt, Bordetella pertussis
cccggcggcgcgccgccg

SEQ ID NO: 421515 - RNA, 23 nt, Bordetella pertussis
cccggcggcgcgccgccgggccu

SEQ ID NO: 421516 - RNA, 14 nt, Bordetella pertussis
cccggcggcgcgcu

SEQ ID NO: 421517 - RNA, 19 nt, Bordetella pertussis
cccggcggcgcggcgagca

SEQ ID NO: 421518 - RNA, 14 nt, Bordetella pertussis
cccggcggcgcgcc

SEQ ID NO: 421519 - RNA, 13 nt, Bordetella pertussis
cccggcggggaca

SEQ ID NO: 421520 - RNA, 15 nt, Bordetella pertussis
cccggcggggacagg

SEQ ID NO: 421521 - RNA, 15 nt, Bordetella pertussis
cccggcuccaggccg

SEQ ID NO: 421522 - RNA, 16 nt, Bordetella pertussis
cccggcucccgcgcca

SEQ ID NO: 421523 - RNA, 16 nt, Bordetella pertussis
cccggcugcgcggccg

SEQ ID NO: 421524 - RNA, 22 nt, Bordetella pertussis
cccggcuucgaucaugcccgcc

SEQ ID NO: 421525 - RNA, 23 nt, Bordetella pertussis
cccggcuucgaucaugcccgcca

SEQ ID NO: 421526 - RNA, 15 nt, Bordetella pertussis
cccgggcaggcucag

SEQ ID NO: 421527 - RNA, 17 nt, Bordetella pertussis
cccgggcaggcucagcc

SEQ ID NO: 421528 - RNA, 23 nt, Bordetella pertussis
cccgggcaugcgaaagccggccu

SEQ ID NO: 421529 - RNA, 16 nt, Bordetella pertussis
cccgggccgcuggccc

SEQ ID NO: 421530 - RNA, 17 nt, Bordetella pertussis
cccgggccggcuacagc

SEQ ID NO: 421531 - RNA, 13 nt, Bordetella pertussis
cccgggcgcaagc

SEQ ID NO: 421532 - RNA, 19 nt, Bordetella pertussis
cccgggcgcaagcgcgccg

SEQ ID NO: 421533 - RNA, 17 nt, Bordetella pertussis
cccgggcgccugcgcca

SEQ ID NO: 421534 - RNA, 18 nt, Bordetella pertussis
cccgggcgugaccagcug

SEQ ID NO: 421535 - RNA, 23 nt, Bordetella pertussis
cccgggcgugaccagcugcacca

SEQ ID NO: 421536 - RNA, 19 nt, Bordetella pertussis
cccgggcugauccgcaccg

SEQ ID NO: 421537 - RNA, 21 nt, Bordetella pertussis
cccggggcaggaagccggccc

SEQ ID NO: 421538 - RNA, 19 nt, Bordetella pertussis
cccgggcuggccgccugcu

SEQ ID NO: 421539 - RNA, 22 nt, Bordetella pertussis
cccgggcuggccgccugcugcg

SEQ ID NO: 421540 - RNA, 20 nt, Bordetella pertussis
cccgggggcgccuguccccg

SEQ ID NO: 421541 - RNA, 19 nt, Bordetella pertussis
cccggguacguggccccag

SEQ ID NO: 421542 - RNA, 12 nt, Bordetella pertussis
cccgggugcagg

SEQ ID NO: 421543 - RNA, 16 nt, Bordetella pertussis
cccgggugccuguccc

SEQ ID NO: 421544 - RNA, 21 nt, Bordetella pertussis
cccgggugccuguccccgccg

SEQ ID NO: 421545 - RNA, 23 nt, Bordetella pertussis
cccgggugccuguccccgccggg

SEQ ID NO: 421546 - RNA, 20 nt, Bordetella pertussis
cccggguuggcguccaggcg

SEQ ID NO: 421547 - RNA, 14 nt, Bordetella pertussis
cccgguauccgcgc

SEQ ID NO: 421548 - RNA, 18 nt, Bordetella pertussis
cccggucagcagggcgcc

SEQ ID NO: 421549 - RNA, 22 nt, Bordetella pertussis
cccggucagcagggcgccgacg

SEQ ID NO: 421550 - RNA, 12 nt, Bordetella pertussis
cccggucagcag

SEQ ID NO: 421551 - RNA, 17 nt, Bordetella pertussis
cccggugcagccgccgc

SEQ ID NO: 421552 - RNA, 17 nt, Bordetella pertussis
cccggugccaguccccc

SEQ ID NO: 421553 - RNA, 22 nt, Bordetella pertussis
cccggugccagucccccgcggg

SEQ ID NO: 421554 - RNA, 15 nt, Bordetella pertussis
cccgguucgccgucg

SEQ ID NO: 421555 - RNA, 19 nt, Bordetella pertussis
cccgguuggggucgcgcug

SEQ ID NO: 421556 - RNA, 18 nt, Bordetella pertussis
cccguacgucaaggccug

SEQ ID NO: 421557 - RNA, 17 nt, Bordetella pertussis
cccguacuugcuccggu

SEQ ID NO: 421558 - RNA, 15 nt, Bordetella pertussis
cccguaggcggccca

SEQ ID NO: 421559 - RNA, 20 nt, Bordetella pertussis
cccgucagcggcgcgcccac

SEQ ID NO: 421560 - RNA, 20 nt, Bordetella pertussis
cccgucaucgggugcggcgc

SEQ ID NO: 421561 - RNA, 20 nt, Bordetella pertussis
cccgucaugcgccgcagcac

SEQ ID NO: 421562 - RNA, 15 nt, Bordetella pertussis
cccgucauggcggca

SEQ ID NO: 421563 - RNA, 19 nt, Bordetella pertussis
cccgucaugggcggggcca

SEQ ID NO: 421564 - RNA, 21 nt, Bordetella pertussis
cccgucaugaggccccugucc

SEQ ID NO: 421565 - RNA, 12 nt, Bordetella pertussis
cccgucccuggu

SEQ ID NO: 421566 - RNA, 15 nt, Bordetella pertussis
cccgucccuggucca

SEQ ID NO: 421567 - RNA, 23 nt, Bordetella pertussis
cccgugcggggaccggcacccgc

SEQ ID NO: 421568 - RNA, 22 nt, Bordetella pertussis
cccgugcgggugccuguccccg

SEQ ID NO: 421569 - RNA, 22 nt, Bordetella pertussis
cccgugcgugcgccuguccccg

SEQ ID NO: 421570 - RNA, 21 nt, Bordetella pertussis
cccgugcuccagaacgcgccg

SEQ ID NO: 421571 - RNA, 19 nt, Bordetella pertussis
cccgugcgcgguucaggcu

SEQ ID NO: 421572 - RNA, 20 nt, Bordetella pertussis
cccguggggacgagcuccug

SEQ ID NO: 421573 - RNA, 17 nt, Bordetella pertussis
cccguggucgccagcac

SEQ ID NO: 421574 - RNA, 13 nt, Bordetella pertussis
cccgugucggcaa

SEQ ID NO: 421575 - RNA, 13 nt, Bordetella pertussis
cccguuccccauc

SEQ ID NO: 421576 - RNA, 19 nt, Bordetella pertussis
cccguucggggacaggcac

SEQ ID NO: 421577 - RNA, 14 nt, Bordetella pertussis
cccguugcagccca

SEQ ID NO: 421578 - RNA, 15 nt, Bordetella pertussis
cccguugucgccgcg

SEQ ID NO: 421579 - RNA, 16 nt, Bordetella pertussis
cccuacgaguaccgcc

SEQ ID NO: 421580 - RNA, 20 nt, Bordetella pertussis
cccuacgaguaccgccgccu

SEQ ID NO: 421581 - RNA, 18 nt, Bordetella pertussis
cccucagcccgcaccgcc

SEQ ID NO: 421582 - RNA, 21 nt, Bordetella pertussis
cccucagcccgcaccgcccgc

SEQ ID NO: 421583 - RNA, 16 nt, Bordetella pertussis
cccucccacgaccugc

SEQ ID NO: 421584 - RNA, 12 nt, Bordetella pertussis
cccuccggcgcc

SEQ ID NO: 421585 - RNA, 22 nt, Bordetella pertussis
cccuccggugccuggcuccccg

SEQ ID NO: 421586 - RNA, 13 nt, Bordetella pertussis
cccuccuacgcca

SEQ ID NO: 421587 - RNA, 22 nt, Bordetella pertussis
cccuccucgcuuuaccagcugu

SEQ ID NO: 421588 - RNA, 23 nt, Bordetella pertussis
cccucgcacggccgucaacagca

SEQ ID NO: 421589 - RNA, 13 nt, Bordetella pertussis
cccucgcccccga

SEQ ID NO: 421590 - RNA, 16 nt, Bordetella pertussis
cccucgcggccgucgg

SEQ ID NO: 421591 - RNA, 16 nt, Bordetella pertussis
cccucgcugcgcguca

SEQ ID NO: 421592 - RNA, 20 nt, Bordetella pertussis
cccuuggcuucggucacacu

SEQ ID NO: 421593 - RNA, 16 nt, Bordetella pertussis
cccuuguagggaaucg

SEQ ID NO: 421594 - RNA, 15 nt, Bordetella pertussis
cccuuguggccgccg

SEQ ID NO: 421595 - RNA, 15 nt, Bordetella pertussis
ccgaaacucaccgcc

SEQ ID NO: 421596 - RNA, 19 nt, Bordetella pertussis
ccgaaacucaccgccgccc

SEQ ID NO: 421597 - RNA, 13 nt, Bordetella pertussis
ccgaacgccgccg

SEQ ID NO: 421598 - RNA, 17 nt, Bordetella pertussis
ccgaacgccgccgcagc

SEQ ID NO: 421599 - RNA, 18 nt, Bordetella pertussis
ccgaacgcgacagcgcug

SEQ ID NO: 421600 - RNA, 13 nt, Bordetella pertussis
ccgaacggggccg

SEQ ID NO: 421601 - RNA, 19 nt, Bordetella pertussis
ccgaacucgcgcucggcca

SEQ ID NO: 421602 - RNA, 22 nt, Bordetella pertussis
ccgaacugccggcgcgggcgca

SEQ ID NO: 421603 - RNA, 15 nt, Bordetella pertussis
ccgaagcgcaggccu

SEQ ID NO: 421604 - RNA, 17 nt, Bordetella pertussis
ccgaagcgucggccugc

SEQ ID NO: 421605 - RNA, 16 nt, Bordetella pertussis
ccgaaggcgugaggcc

SEQ ID NO: 421606 - RNA, 15 nt, Bordetella pertussis
ccgaaggcgcggccg

SEQ ID NO: 421607 - RNA, 23 nt, Bordetella pertussis
ccgaagggcaccgugaugucgcc

SEQ ID NO: 421608 - RNA, 18 nt, Bordetella pertussis
ccgaaggucuuggcgugc

SEQ ID NO: 421609 - RNA, 19 nt, Bordetella pertussis
ccgaaggucuuggcgugca

SEQ ID NO: 421610 - RNA, 12 nt, Bordetella pertussis
ccgaaggguugc

SEQ ID NO: 421611 - RNA, 17 nt, Bordetella pertussis
ccgaaugcccgcccuug

SEQ ID NO: 421612 - RNA, 16 nt, Bordetella pertussis
ccgacaacggcgugcu

SEQ ID NO: 421613 - RNA, 18 nt, Bordetella pertussis
ccgacaccaaggggcgga

SEQ ID NO: 421614 - RNA, 12 nt, Bordetella pertussis
ccgacagcgccc

SEQ ID NO: 421615 - RNA, 17 nt, Bordetella pertussis
ccgacaggcggcuguag

SEQ ID NO: 421616 - RNA, 16 nt, Bordetella pertussis
ccgacagguaggcgcc

SEQ ID NO: 421617 - RNA, 11 nt, Bordetella pertussis
ccgacaugccg

SEQ ID NO: 421618 - RNA, 16 nt, Bordetella pertussis
ccgacaugccgcccca

SEQ ID NO: 421619 - RNA, 12 nt, Bordetella pertussis
ccgaccacccgc

SEQ ID NO: 421620 - RNA, 18 nt, Bordetella pertussis
ccgaccacccgcgccagg

SEQ ID NO: 421621 - RNA, 18 nt, Bordetella pertussis
ccgaccaccugcaccgcc

SEQ ID NO: 421622 - RNA, 13 nt, Bordetella pertussis
ccgaccagcacga

SEQ ID NO: 421623 - RNA, 18 nt, Bordetella pertussis
ccgaccaggcccgccacg

SEQ ID NO: 421624 - RNA, 15 nt, Bordetella pertussis
ccgaccaggucgggc

SEQ ID NO: 421625 - RNA, 13 nt, Bordetella pertussis
ccgacccccggcc

SEQ ID NO: 421626 - RNA, 15 nt, Bordetella pertussis
ccgacccccggcccg

SEQ ID NO: 421627 - RNA, 17 nt, Bordetella pertussis
ccgacccgagcccuggc

SEQ ID NO: 421628 - RNA, 13 nt, Bordetella pertussis
ccgaccgaagagg

SEQ ID NO: 421629 - RNA, 15 nt, Bordetella pertussis
ccgaccgagccgaag

SEQ ID NO: 421630 - RNA, 14 nt, Bordetella pertussis
ccgaccgccacgaa

SEQ ID NO: 421631 - RNA, 19 nt, Bordetella pertussis
ccgaccggaccguuccaga

SEQ ID NO: 421632 - RNA, 20 nt, Bordetella pertussis
ccgaccgggccgaccaggcc

SEQ ID NO: 421633 - RNA, 14 nt, Bordetella pertussis
ccgaccggccccac

SEQ ID NO: 421634 - RNA, 24 nt, Bordetella pertussis
ccgaccggccccaccuggcggugc

SEQ ID NO: 421635 - RNA, 18 nt, Bordetella pertussis
ccgaccugcuggcgcgca

SEQ ID NO: 421636 - RNA, 15 nt, Bordetella pertussis
ccgacggcagccccg

SEQ ID NO: 421637 - RNA, 19 nt, Bordetella pertussis
ccgacggccucggccagga

SEQ ID NO: 421638 - RNA, 15 nt, Bordetella pertussis
ccgacggcgccgugc

SEQ ID NO: 421639 - RNA, 18 nt, Bordetella pertussis
ccgacggcgccgugcugg

SEQ ID NO: 421640 - RNA, 22 nt, Bordetella pertussis
ccgacggcgccgugcuggaggu

SEQ ID NO: 421641 - RNA, 13 nt, Bordetella pertussis
ccgacggcgcgcc

SEQ ID NO: 421642 - RNA, 12 nt, Bordetella pertussis
ccgacggcugga

SEQ ID NO: 421643 - RNA, 13 nt, Bordetella pertussis
ccgacgggccggu

SEQ ID NO: 421644 - RNA, 18 nt, Bordetella pertussis
ccgacgggcggcugcugg

SEQ ID NO: 421645 - RNA, 20 nt, Bordetella pertussis
ccgacgguaucucagcgcgc

SEQ ID NO: 421646 - RNA, 22 nt, Bordetella pertussis
ccgacgguaucucagcgcgccg

SEQ ID NO: 421647 - RNA, 19 nt, Bordetella pertussis
ccgacucgaaacgggcggc

SEQ ID NO: 421648 - RNA, 12 nt, Bordetella pertussis
ccgacugcugua

SEQ ID NO: 421649 - RNA, 12 nt, Bordetella pertussis
ccgagcgcgcca

SEQ ID NO: 421650 - RNA, 12 nt, Bordetella pertussis
ccgagcgcgccc

SEQ ID NO: 421651 - RNA, 14 nt, Bordetella pertussis
ccgagcgcgcccgc

SEQ ID NO: 421652 - RNA, 17 nt, Bordetella pertussis
ccgagcccgggcgugcc

SEQ ID NO: 421653 - RNA, 15 nt, Bordetella pertussis
ccgagcgcugcgcca

SEQ ID NO: 421654 - RNA, 13 nt, Bordetella pertussis
ccgagcggcgcca

SEQ ID NO: 421655 - RNA, 19 nt, Bordetella pertussis
ccgagcgggcaugggcccc

SEQ ID NO: 421656 - RNA, 21 nt, Bordetella pertussis
ccgagcgggccagcgcggcca

SEQ ID NO: 421657 - RNA, 23 nt, Bordetella pertussis
ccgagcgugccgggaugcugcuc

SEQ ID NO: 421658 - RNA, 19 nt, Bordetella pertussis
ccgaggaucuggccggcgc

SEQ ID NO: 421659 - RNA, 15 nt, Bordetella pertussis
ccgaggccaccuugg

SEQ ID NO: 421660 - RNA, 12 nt, Bordetella pertussis
ccgaggccaggu

SEQ ID NO: 421661 - RNA, 14 nt, Bordetella pertussis
ccgaggccagguug

SEQ ID NO: 421662 - RNA, 19 nt, Bordetella pertussis
ccgaggccgaguggccgcu

SEQ ID NO: 421663 - RNA, 18 nt, Bordetella pertussis
ccgaggccuugcucgccc

SEQ ID NO: 421664 - RNA, 13 nt, Bordetella pertussis
ccgaggcgcccca

SEQ ID NO: 421665 - RNA, 13 nt, Bordetella pertussis
ccgaggucggcgg

SEQ ID NO: 421666 - RNA, 19 nt, Bordetella pertussis
ccgauacgacacgccgcgc

SEQ ID NO: 421667 - RNA, 22 nt, Bordetella pertussis
ccgauacgacacgccgcgcgau

SEQ ID NO: 421668 - RNA, 14 nt, Bordetella pertussis
ccgauagccgcgcg

SEQ ID NO: 421669 - RNA, 23 nt, Bordetella pertussis
ccgauagccgugaccugcucguc

SEQ ID NO: 421670 - RNA, 22 nt, Bordetella pertussis
ccgauaucgauaccaacugccu

SEQ ID NO: 421671 - RNA, 15 nt, Bordetella pertussis
ccgauccagcgccug

SEQ ID NO: 421672 - RNA, 18 nt, Bordetella pertussis
ccgauccagggccgcagc

SEQ ID NO: 421673 - RNA, 16 nt, Bordetella pertussis
ccgauccccugcccgc

SEQ ID NO: 421674 - RNA, 15 nt, Bordetella pertussis
ccgaucgccgacagg

SEQ ID NO: 421675 - RNA, 19 nt, Bordetella pertussis
ccgaucgccgacaggauga

SEQ ID NO: 421676 - RNA, 15 nt, Bordetella pertussis
ccgaugcgcugcugg

SEQ ID NO: 421677 - RNA, 23 nt, Bordetella pertussis
ccgaugcggguacuggccgacgg

SEQ ID NO: 421678 - RNA, 18 nt, Bordetella pertussis
ccgaugcgguaggcccag

SEQ ID NO: 421679 - RNA, 17 nt, Bordetella pertussis
ccgaugcggcgcaugcu

SEQ ID NO: 421680 - RNA, 19 nt, Bordetella pertussis
ccgauggcgcgcggcuggg

SEQ ID NO: 421681 - RNA, 22 nt, Bordetella pertussis
ccgauggcgcggccgccagccc

SEQ ID NO: 421682 - RNA, 21 nt, Bordetella pertussis
ccgauggcgccaccuucgccg

SEQ ID NO: 421683 - RNA, 19 nt, Bordetella pertussis
ccgauggcguccagcagca

SEQ ID NO: 421684 - RNA, 18 nt, Bordetella pertussis
ccgcaccgacgggcugau

SEQ ID NO: 421685 - RNA, 13 nt, Bordetella pertussis
ccgcaccgaccag

SEQ ID NO: 421686 - RNA, 14 nt, Bordetella pertussis
ccgcaccgggcggc

SEQ ID NO: 421687 - RNA, 15 nt, Bordetella pertussis
ccgcaccgggcggcc

SEQ ID NO: 421688 - RNA, 17 nt, Bordetella pertussis
ccgcaccgggcggcccg

SEQ ID NO: 421689 - RNA, 19 nt, Bordetella pertussis
ccgcaccgggcggcccggc

SEQ ID NO: 421690 - RNA, 15 nt, Bordetella pertussis
ccgcaccggcgugcg

SEQ ID NO: 421691 - RNA, 17 nt, Bordetella pertussis
ccgcaccggcgugcgcu

SEQ ID NO: 421692 - RNA, 13 nt, Bordetella pertussis
ccgcaccugaaca

SEQ ID NO: 421693 - RNA, 23 nt, Bordetella pertussis
ccgcaccugaacaccggcgcgcc

SEQ ID NO: 421694 - RNA, 18 nt, Bordetella pertussis
ccgcacgaagcggcaucg

SEQ ID NO: 421695 - RNA, 23 nt, Bordetella pertussis
ccgcacgcagcccuucggagcca

SEQ ID NO: 421696 - RNA, 13 nt, Bordetella pertussis
ccgcacgcccgcc

SEQ ID NO: 421697 - RNA, 14 nt, Bordetella pertussis
ccgcacgccggccu

SEQ ID NO: 421698 - RNA, 15 nt, Bordetella pertussis
ccgcacgccggccug

SEQ ID NO: 421699 - RNA, 23 nt, Bordetella pertussis
ccgcacgccggucgccagcgauc

SEQ ID NO: 421700 - RNA, 15 nt, Bordetella pertussis
ccgcacgcggccgcg

SEQ ID NO: 421701 - RNA, 19 nt, Bordetella pertussis
ccgcagaagaacaccgugu

SEQ ID NO: 421702 - RNA, 13 nt, Bordetella pertussis
ccgcagauggcca

SEQ ID NO: 421703 - RNA, 19 nt, Bordetella pertussis
ccgcagauggccagcagcg

SEQ ID NO: 421704 - RNA, 21 nt, Bordetella pertussis
ccgcagauggccagcagcgcc

SEQ ID NO: 421705 - RNA, 19 nt, Bordetella pertussis
ccgcagccggcugcaagac

SEQ ID NO: 421706 - RNA, 15 nt, Bordetella pertussis
ccgcagcgcagcgcc

SEQ ID NO: 421707 - RNA, 16 nt, Bordetella pertussis
ccgcagcgcagcgcca

SEQ ID NO: 421708 - RNA, 19 nt, Bordetella pertussis
ccgcagcgcucgcacggca

SEQ ID NO: 421709 - RNA, 13 nt, Bordetella pertussis
ccgcagcggcagc

SEQ ID NO: 421710 - RNA, 14 nt, Bordetella pertussis
ccgcagcggcagcg

SEQ ID NO: 421711 - RNA, 23 nt, Bordetella pertussis
ccgcagcgggcccgucgcgccag

SEQ ID NO: 421712 - RNA, 15 nt, Bordetella pertussis
ccgcagcgucgcggc

SEQ ID NO: 421713 - RNA, 13 nt, Bordetella pertussis
ccgcaucccgccc

SEQ ID NO: 421714 - RNA, 14 nt, Bordetella pertussis
ccgcaucgcgcagc

SEQ ID NO: 421715 - RNA, 21 nt, Bordetella pertussis
ccgcaucgcgcgccgccgccc

SEQ ID NO: 421716 - RNA, 22 nt, Bordetella pertussis
ccgcaucgcgcgccgccgcccg

SEQ ID NO: 421717 - RNA, 23 nt, Bordetella pertussis
ccgcaucgcgcgccgccgcccgc

SEQ ID NO: 421718 - RNA, 20 nt, Bordetella pertussis
ccgcaucggcuggcgcaaga

SEQ ID NO: 421719 - RNA, 21 nt, Bordetella pertussis
ccgcauggaccgccgccgucg

SEQ ID NO: 421720 - RNA, 18 nt, Bordetella pertussis
ccgcaugggccaggcgcu

SEQ ID NO: 421721 - RNA, 20 nt, Bordetella pertussis
ccgcauugaucgaucagcca

SEQ ID NO: 421722 - RNA, 22 nt, Bordetella pertussis
ccgcauugaucgaucagccagc

SEQ ID NO: 421723 - RNA, 19 nt, Bordetella pertussis
ccgcauuuccucgaccagc

SEQ ID NO: 421724 - RNA, 19 nt, Bordetella pertussis
ccgccacagauuggccacc

SEQ ID NO: 421725 - RNA, 22 nt, Bordetella pertussis
ccgccacagauuggccaccagg

SEQ ID NO: 421726 - RNA, 13 nt, Bordetella pertussis
ccgccacaggcug

SEQ ID NO: 421727 - RNA, 15 nt, Bordetella pertussis
ccgccaccagcgcgu

SEQ ID NO: 421728 - RNA, 14 nt, Bordetella pertussis
ccgccaccagcggc

SEQ ID NO: 421729 - RNA, 15 nt, Bordetella pertussis
ccgccaccaggaacg

SEQ ID NO: 421730 - RNA, 15 nt, Bordetella pertussis
ccgccacccaggcgg

SEQ ID NO: 421731 - RNA, 16 nt, Bordetella pertussis
ccgccacccagggcuu

SEQ ID NO: 421732 - RNA, 16 nt, Bordetella pertussis
ccgccacccuggcacg

SEQ ID NO: 421733 - RNA, 13 nt, Bordetella pertussis
ccgccaccgcccc

SEQ ID NO: 421734 - RNA, 15 nt, Bordetella pertussis
ccgccaccgcgccgc

SEQ ID NO: 421735 - RNA, 14 nt, Bordetella pertussis
ccgccaccugggcc

SEQ ID NO: 421736 - RNA, 15 nt, Bordetella pertussis
ccgccaccugggccg

SEQ ID NO: 421737 - RNA, 16 nt, Bordetella pertussis
ccgccaccugggccgc

SEQ ID NO: 421738 - RNA, 20 nt, Bordetella pertussis
ccgccaccugggccgccugc

SEQ ID NO: 421739 - RNA, 15 nt, Bordetella pertussis
ccgccaccguggcgu

SEQ ID NO: 421740 - RNA, 19 nt, Bordetella pertussis
ccgccacgaaacccacggc

SEQ ID NO: 421741 - RNA, 14 nt, Bordetella pertussis
ccgccacgcccugg

SEQ ID NO: 421742 - RNA, 11 nt, Bordetella pertussis
ccgccacgccu

SEQ ID NO: 421743 - RNA, 20 nt, Bordetella pertussis
ccgccacgcgcacggccagc

SEQ ID NO: 421744 - RNA, 17 nt, Bordetella pertussis
ccgccacgcgggccggc

SEQ ID NO: 421745 - RNA, 23 nt, Bordetella pertussis
ccgccacgcgguccagccccugc

SEQ ID NO: 421746 - RNA, 21 nt, Bordetella pertussis
ccgccacgggcccgcgcagac

SEQ ID NO: 421747 - RNA, 15 nt, Bordetella pertussis
ccgccacgucgccgg

SEQ ID NO: 421748 - RNA, 20 nt, Bordetella pertussis
ccgccagcaaggcgucggcc

SEQ ID NO: 421749 - RNA, 16 nt, Bordetella pertussis
ccgccagcagcucggc

SEQ ID NO: 421750 - RNA, 22 nt, Bordetella pertussis
ccgccagcaggcccugggccag

SEQ ID NO: 421751 - RNA, 23 nt, Bordetella pertussis
ccgccagcauggcggccaggcgc

SEQ ID NO: 421752 - RNA, 12 nt, Bordetella pertussis
ccgccagcccga

SEQ ID NO: 421753 - RNA, 13 nt, Bordetella pertussis
ccgccagccggcc

SEQ ID NO: 421754 - RNA, 17 nt, Bordetella pertussis
ccgccagccggcccagc

SEQ ID NO: 421755 - RNA, 20 nt, Bordetella pertussis
ccgccagcgccuggaccugg

SEQ ID NO: 421756 - RNA, 23 nt, Bordetella pertussis
ccgccaggaaaagccgccuucgg

SEQ ID NO: 421757 - RNA, 20 nt, Bordetella pertussis
ccgccaggaagaucggcccg

SEQ ID NO: 421758 - RNA, 20 nt, Bordetella pertussis
ccgccaggaagcgggccugc

SEQ ID NO: 421759 - RNA, 21 nt, Bordetella pertussis
ccgccaggaagcgggccugcc

SEQ ID NO: 421760 - RNA, 16 nt, Bordetella pertussis
ccgccagggcggcugc

SEQ ID NO: 421761 - RNA, 16 nt, Bordetella pertussis
ccgccagggcggggcc

SEQ ID NO: 421762 - RNA, 14 nt, Bordetella pertussis
ccgccagggccaug

SEQ ID NO: 421763 - RNA, 14 nt, Bordetella pertussis
ccgccaggucggcc

SEQ ID NO: 421764 - RNA, 19 nt, Bordetella pertussis
ccgccaggucggccaccgc

SEQ ID NO: 421765 - RNA, 22 nt, Bordetella pertussis
ccgccagguucgccuggcgggg

SEQ ID NO: 421766 - RNA, 19 nt, Bordetella pertussis
ccgccauaccgaucuacga

SEQ ID NO: 421767 - RNA, 14 nt, Bordetella pertussis
ccgccaucauccug

SEQ ID NO: 421768 - RNA, 18 nt, Bordetella pertussis
ccgccaucauggcgucgg

SEQ ID NO: 421769 - RNA, 18 nt, Bordetella pertussis
ccgccauccuggccgccg

SEQ ID NO: 421770 - RNA, 21 nt, Bordetella pertussis
ccgccauccuggccgccgcgg

SEQ ID NO: 421771 - RNA, 15 nt, Bordetella pertussis
ccgcccacauggcgg

SEQ ID NO: 421772 - RNA, 19 nt, Bordetella pertussis
ccgcccacauggcggcgaa

SEQ ID NO: 421773 - RNA, 21 nt, Bordetella pertussis
ccgcccacgaucaccacgccc

SEQ ID NO: 421774 - RNA, 11 nt, Bordetella pertussis
ccgcccagcau

SEQ ID NO: 421775 - RNA, 16 nt, Bordetella pertussis
ccgcccagccaggcgc

SEQ ID NO: 421776 - RNA, 22 nt, Bordetella pertussis
ccgcccagcgacgagggcgcca

SEQ ID NO: 421777 - RNA, 17 nt, Bordetella pertussis
ccgcccgccgggccguc

SEQ ID NO: 421778 - RNA, 16 nt, Bordetella pertussis
ccgcccgcggccagcc

SEQ ID NO: 421779 - RNA, 19 nt, Bordetella pertussis
ccgcccgcggccagccacg

SEQ ID NO: 421780 - RNA, 12 nt, Bordetella pertussis
ccgcccggcagc

SEQ ID NO: 421781 - RNA, 16 nt, Bordetella pertussis
ccgcccggccggcacg

SEQ ID NO: 421782 - RNA, 22 nt, Bordetella pertussis
ccgcccggccggcacggccggc

SEQ ID NO: 421783 - RNA, 18 nt, Bordetella pertussis
ccgcccggcggcgcgccg

SEQ ID NO: 421784 - RNA, 19 nt, Bordetella pertussis
ccgccgaaccagcgcacca

SEQ ID NO: 421785 - RNA, 19 nt, Bordetella pertussis
ccgccgaacggcagcagcg

SEQ ID NO: 421786 - RNA, 21 nt, Bordetella pertussis
ccgccgaacggggccgccucg

SEQ ID NO: 421787 - RNA, 23 nt, Bordetella pertussis
ccgccgagucggcgauggcgcgc

SEQ ID NO: 421788 - RNA, 20 nt, Bordetella pertussis
ccgccgauaccacgcgcggc

SEQ ID NO: 421789 - RNA, 14 nt, Bordetella pertussis
ccgccgauggcgcc

SEQ ID NO: 421790 - RNA, 15 nt, Bordetella pertussis
ccgccgauggcgcgc

SEQ ID NO: 421791 - RNA, 12 nt, Bordetella pertussis
ccgccgcccgca

SEQ ID NO: 421792 - RNA, 13 nt, Bordetella pertussis
ccgccgcccgccc

SEQ ID NO: 421793 - RNA, 14 nt, Bordetella pertussis
ccgccgcccgcccg

SEQ ID NO: 421794 - RNA, 18 nt, Bordetella pertussis
ccgccgcccgcccgccgc

SEQ ID NO: 421795 - RNA, 14 nt, Bordetella pertussis
ccgccgcccggcaa

SEQ ID NO: 421796 - RNA, 20 nt, Bordetella pertussis
ccgccgcccggcaacccgcc

SEQ ID NO: 421797 - RNA, 18 nt, Bordetella pertussis
ccgccgcccucgcccccg

SEQ ID NO: 421798 - RNA, 14 nt, Bordetella pertussis
ccgccgcccugcca

SEQ ID NO: 421799 - RNA, 15 nt, Bordetella pertussis
ccgccgccgcccacg

SEQ ID NO: 421800 - RNA, 14 nt, Bordetella pertussis
ccgccgccggcccg

SEQ ID NO: 421801 - RNA, 16 nt, Bordetella pertussis
ccgccgccgggcgcgc

SEQ ID NO: 421802 - RNA, 22 nt, Bordetella pertussis
ccgccgccgggcgcgcgccggc

SEQ ID NO: 421803 - RNA, 17 nt, Bordetella pertussis
ccgccgccggugauaug

SEQ ID NO: 421804 - RNA, 15 nt, Bordetella pertussis
ccgccugcgccagcc

SEQ ID NO: 421805 - RNA, 20 nt, Bordetella pertussis
ccgccugcgccgaggcgggc

SEQ ID NO: 421806 - RNA, 17 nt, Bordetella pertussis
ccgccugcgggaacugc

SEQ ID NO: 421807 - RNA, 22 nt, Bordetella pertussis
ccgccuggcuuacaggcccagu

SEQ ID NO: 421808 - RNA, 16 nt, Bordetella pertussis
ccgccuggcgcggcgc

SEQ ID NO: 421809 - RNA, 22 nt, Bordetella pertussis
ccgccugguaguaaucgcgcgc

SEQ ID NO: 421810 - RNA, 14 nt, Bordetella pertussis
ccgcgaagcagccg

SEQ ID NO: 421811 - RNA, 17 nt, Bordetella pertussis
ccgcgaagcgcgccagc

SEQ ID NO: 421812 - RNA, 20 nt, Bordetella pertussis
ccgcgacccagaacccggcc

SEQ ID NO: 421813 - RNA, 13 nt, Bordetella pertussis
ccgcgaccaccag

SEQ ID NO: 421814 - RNA, 15 nt, Bordetella pertussis
ccgcgaccacggucu

SEQ ID NO: 421815 - RNA, 20 nt, Bordetella pertussis
ccgcgaccacggucuggcgc

SEQ ID NO: 421816 - RNA, 22 nt, Bordetella pertussis
ccgcgacgaccccgccgugccg

SEQ ID NO: 421817 - RNA, 21 nt, Bordetella pertussis
ccgcgaugcaugaaccgcagc

SEQ ID NO: 421818 - RNA, 24 nt, Bordetella pertussis
ccgcgcauggacugcaggcgcugc

SEQ ID NO: 421819 - RNA, 22 nt, Bordetella pertussis
ccgcgccaacccggccucagcg

SEQ ID NO: 421820 - RNA, 23 nt, Bordetella pertussis
ccgcgccacacgggcgccugccg

SEQ ID NO: 421821 - RNA, 18 nt, Bordetella pertussis
ccgcgccaagggcgugcg

SEQ ID NO: 421822 - RNA, 21 nt, Bordetella pertussis
ccgcgccaagggcgugcgcuu

SEQ ID NO: 421823 - RNA, 16 nt, Bordetella pertussis
ccgcgccagcgccggc

SEQ ID NO: 421824 - RNA, 16 nt, Bordetella pertussis
ccgcgccagcgccucc

SEQ ID NO: 421825 - RNA, 17 nt, Bordetella pertussis
ccgcgccagcgccucca

SEQ ID NO: 421826 - RNA, 13 nt, Bordetella pertussis
ccgcgccaggcgg

SEQ ID NO: 421827 - RNA, 21 nt, Bordetella pertussis
ccgcgcgaugcgcggcccggc

SEQ ID NO: 421828 - RNA, 17 nt, Bordetella pertussis
ccgcgcgcacgaccacc

SEQ ID NO: 421829 - RNA, 21 nt, Bordetella pertussis
ccgcgcgccgcuguggacgcc

SEQ ID NO: 421830 - RNA, 19 nt, Bordetella pertussis
ccgcgcgccuuacuccggc

SEQ ID NO: 421831 - RNA, 24 nt, Bordetella pertussis
ccgcgcgcgacgacagcggcgagc

SEQ ID NO: 421832 - RNA, 16 nt, Bordetella pertussis
ccgcgcgcgagcugcg

SEQ ID NO: 421833 - RNA, 12 nt, Bordetella pertussis
ccgcgcgcgcca

SEQ ID NO: 421834 - RNA, 21 nt, Bordetella pertussis
ccgcgcgcgcccgggccgucu

SEQ ID NO: 421835 - RNA, 19 nt, Bordetella pertussis
ccgcgcgcggccggcacca

SEQ ID NO: 421836 - RNA, 23 nt, Bordetella pertussis
ccgcgcgcggccggcgcgccggc

SEQ ID NO: 421837 - RNA, 14 nt, Bordetella pertussis
ccgcgcgcggcggc

SEQ ID NO: 421838 - RNA, 18 nt, Bordetella pertussis
ccgcgcgcguauggcggc

SEQ ID NO: 421839 - RNA, 23 nt, Bordetella pertussis
ccgcgcgcuggcugugcccgccc

SEQ ID NO: 421840 - RNA, 18 nt, Bordetella pertussis
ccgcgcgcuucaggcgcc

SEQ ID NO: 421841 - RNA, 22 nt, Bordetella pertussis
ccgcgcgcuucaggcgccgcag

SEQ ID NO: 421842 - RNA, 20 nt, Bordetella pertussis
ccgcgcgcuuccucgaccag

SEQ ID NO: 421843 - RNA, 19 nt, Bordetella pertussis
ccgcgcggccagcgccggc

SEQ ID NO: 421844 - RNA, 18 nt, Bordetella pertussis
ccgcgcggcgccugccug

SEQ ID NO: 421845 - RNA, 23 nt, Bordetella pertussis
ccgcgcggcgcguucagcagcag

SEQ ID NO: 421846 - RNA, 17 nt, Bordetella pertussis
ccgcgcgggcggcccgc

SEQ ID NO: 421847 - RNA, 23 nt, Bordetella pertussis
ccgcgcgguacgcaccgccgccg

SEQ ID NO: 421848 - RNA, 20 nt, Bordetella pertussis
ccgcgcgguauugcgccacc

SEQ ID NO: 421849 - RNA, 23 nt, Bordetella pertussis
ccgcgcggucgccaucggccggc

SEQ ID NO: 421850 - RNA, 17 nt, Bordetella pertussis
ccgcgcgguggccgccg

SEQ ID NO: 421851 - RNA, 16 nt, Bordetella pertussis
ccgcgcguaucggcgc

SEQ ID NO: 421852 - RNA, 20 nt, Bordetella pertussis
ccgcgcucagcaccaggccg

SEQ ID NO: 421853 - RNA, 21 nt, Bordetella pertussis
ccgcgcucagcaccaggccgc

SEQ ID NO: 421854 - RNA, 22 nt, Bordetella pertussis
ccgcgcucagcaccaggccgcc

SEQ ID NO: 421855 - RNA, 21 nt, Bordetella pertussis
ccgcgcucaggccgcugggca

SEQ ID NO: 421856 - RNA, 19 nt, Bordetella pertussis
ccgcgcuccagggcgucgg

SEQ ID NO: 421857 - RNA, 22 nt, Bordetella pertussis
ccgcgcuccagggcgucggcga

SEQ ID NO: 421858 - RNA, 19 nt, Bordetella pertussis
ccgcgcucgcccagccgcc

SEQ ID NO: 421859 - RNA, 15 nt, Bordetella pertussis
ccgcgcucgcgccag

SEQ ID NO: 421860 - RNA, 22 nt, Bordetella pertussis
ccgcgcugccgcugcaggcccu

SEQ ID NO: 421861 - RNA, 20 nt, Bordetella pertussis
ccgcgcugcugcaggccggc

SEQ ID NO: 421862 - RNA, 21 nt, Bordetella pertussis
ccgcgcugcugccgucggcgu

SEQ ID NO: 421863 - RNA, 16 nt, Bordetella pertussis
ccgcgcuggcgcagca

SEQ ID NO: 421864 - RNA, 21 nt, Bordetella pertussis
ccgcgcuggcgcagcaggcgc

SEQ ID NO: 421865 - RNA, 23 nt, Bordetella pertussis
ccgcgcuggcgcagcaggcgcgc

SEQ ID NO: 421866 - RNA, 20 nt, Bordetella pertussis
ccgcgcuggcgcuggccgcc

SEQ ID NO: 421867 - RNA, 21 nt, Bordetella pertussis
ccgcgcuggcgcuggccgccc

SEQ ID NO: 421868 - RNA, 15 nt, Bordetella pertussis
ccgcgcuggcggcgc

SEQ ID NO: 421869 - RNA, 22 nt, Bordetella pertussis
ccgcgcuggcggcgcaggccgc

SEQ ID NO: 421870 - RNA, 20 nt, Bordetella pertussis
ccgcgcugggcgcugcugcu

SEQ ID NO: 421871 - RNA, 17 nt, Bordetella pertussis
ccgcgcuggugcuggcc

SEQ ID NO: 421872 - RNA, 16 nt, Bordetella pertussis
ccgcggaaagcuggcg

SEQ ID NO: 421873 - RNA, 19 nt, Bordetella pertussis
ccgcggaagucgggcacca

SEQ ID NO: 421874 - RNA, 22 nt, Bordetella pertussis
ccgcggauugccguccuggcga

SEQ ID NO: 421875 - RNA, 19 nt, Bordetella pertussis
ccgcggcaaauggggcggc

SEQ ID NO: 421876 - RNA, 17 nt, Bordetella pertussis
ccgcggcaggccccggc

SEQ ID NO: 421877 - RNA, 13 nt, Bordetella pertussis
ccgcggccgcccc

SEQ ID NO: 421878 - RNA, 21 nt, Bordetella pertussis
ccgcggccgcccccagcgcgc

SEQ ID NO: 421879 - RNA, 15 nt, Bordetella pertussis
ccgcggcccgcccgc

SEQ ID NO: 421880 - RNA, 12 nt, Bordetella pertussis
ccgcggccggca

SEQ ID NO: 421881 - RNA, 13 nt, Bordetella pertussis
ccgcggccggcac

SEQ ID NO: 421882 - RNA, 16 nt, Bordetella pertussis
ccgcggccggcggcgc

SEQ ID NO: 421883 - RNA, 18 nt, Bordetella pertussis
ccgcggccuucaccccgc

SEQ ID NO: 421884 - RNA, 19 nt, Bordetella pertussis
ccgcggcgaugccggccag

SEQ ID NO: 421885 - RNA, 21 nt, Bordetella pertussis
ccgcggcgaugccggccagca

SEQ ID NO: 421886 - RNA, 23 nt, Bordetella pertussis
ccgcggcgcagguccaccgccac

SEQ ID NO: 421887 - RNA, 18 nt, Bordetella pertussis
ccgcggcgcccagcuggc

SEQ ID NO: 421888 - RNA, 16 nt, Bordetella pertussis
ccgcgguccgggccau

SEQ ID NO: 421889 - RNA, 19 nt, Bordetella pertussis
ccgcggucgagacgauggc

SEQ ID NO: 421890 - RNA, 13 nt, Bordetella pertussis
ccgcggucgcaga

SEQ ID NO: 421891 - RNA, 14 nt, Bordetella pertussis
ccgcgguggcgggc

SEQ ID NO: 421892 - RNA, 19 nt, Bordetella pertussis
ccgcgguggcgggcgugcg

SEQ ID NO: 421893 - RNA, 15 nt, Bordetella pertussis
ccgcggugcugggcu

SEQ ID NO: 421894 - RNA, 19 nt, Bordetella pertussis
ccgcggugguccagauugc

SEQ ID NO: 421895 - RNA, 14 nt, Bordetella pertussis
ccgcgucggccuca

SEQ ID NO: 421896 - RNA, 23 nt, Bordetella pertussis
ccgcgucggcgccgaucagcagg

SEQ ID NO: 421897 - RNA, 14 nt, Bordetella pertussis
ccgcgucgcuggcc

SEQ ID NO: 421898 - RNA, 15 nt, Bordetella pertussis
ccgcgucuucggcgc

SEQ ID NO: 421899 - RNA, 16 nt, Bordetella pertussis
ccgcgucuuggcgggc

SEQ ID NO: 421900 - RNA, 20 nt, Bordetella pertussis
ccgcgugacggccgccacgc

SEQ ID NO: 421901 - RNA, 16 nt, Bordetella pertussis
ccgcgugcgccgggcu

SEQ ID NO: 421902 - RNA, 19 nt, Bordetella pertussis
ccgcgugcguuucggaccc

SEQ ID NO: 421903 - RNA, 14 nt, Bordetella pertussis
ccgcgugguggcgc

SEQ ID NO: 421904 - RNA, 22 nt, Bordetella pertussis
ccgcgugguggcgcagaugggc

SEQ ID NO: 421905 - RNA, 15 nt, Bordetella pertussis
ccgcuaccaggcgcg

SEQ ID NO: 421906 - RNA, 16 nt, Bordetella pertussis
ccgcuaccccggcagc

SEQ ID NO: 421907 - RNA, 13 nt, Bordetella pertussis
ccgcuacgcgggc

SEQ ID NO: 421908 - RNA, 21 nt, Bordetella pertussis
ccgcuacgggcgcugcacgca

SEQ ID NO: 421909 - RNA, 21 nt, Bordetella pertussis
ccgcuaggccuugccgccgcc

SEQ ID NO: 421910 - RNA, 19 nt, Bordetella pertussis
ccgcucaugccggcaagca

SEQ ID NO: 421911 - RNA, 16 nt, Bordetella pertussis
ccgcuccagccaccac

SEQ ID NO: 421912 - RNA, 17 nt, Bordetella pertussis
ccgcuccagccaccacu

SEQ ID NO: 421913 - RNA, 23 nt, Bordetella pertussis
ccgcuccauguaaaaacccggcc

SEQ ID NO: 421914 - RNA, 16 nt, Bordetella pertussis
ccgcucgacgucgccc

SEQ ID NO: 421915 - RNA, 16 nt, Bordetella pertussis
ccgcucgaggccaggc

SEQ ID NO: 421916 - RNA, 13 nt, Bordetella pertussis
ccgcucggccagc

SEQ ID NO: 421917 - RNA, 16 nt, Bordetella pertussis
ccgcucggccagcagu

SEQ ID NO: 421918 - RNA, 15 nt, Bordetella pertussis
ccgcugaccggccug

SEQ ID NO: 421919 - RNA, 15 nt, Bordetella pertussis
ccgcugcgaaaaagc

SEQ ID NO: 421920 - RNA, 16 nt, Bordetella pertussis
ccgcugcgcagcagcg

SEQ ID NO: 421921 - RNA, 14 nt, Bordetella pertussis
ccgcugcgcgcggc

SEQ ID NO: 421922 - RNA, 22 nt, Bordetella pertussis
ccgcugcgcuggccgcgaugca

SEQ ID NO: 421923 - RNA, 15 nt, Bordetella pertussis
ccgcugcguccacca

SEQ ID NO: 421924 - RNA, 22 nt, Bordetella pertussis
ccgcugcguccaccaccaggcc

SEQ ID NO: 421925 - RNA, 16 nt, Bordetella pertussis
ccgcugcuaugccgug

SEQ ID NO: 421926 - RNA, 13 nt, Bordetella pertussis
ccgcugggacagg

SEQ ID NO: 421927 - RNA, 15 nt, Bordetella pertussis
ccgcugggacaggca

SEQ ID NO: 421928 - RNA, 17 nt, Bordetella pertussis
ccgcugggacaggcaca

SEQ ID NO: 421929 - RNA, 18 nt, Bordetella pertussis
ccgcugggacaggcacac

SEQ ID NO: 421930 - RNA, 17 nt, Bordetella pertussis
ccgcugggacaggcacu

SEQ ID NO: 421931 - RNA, 21 nt, Bordetella pertussis
ccgcugggcacauccagcgcc

SEQ ID NO: 421932 - RNA, 16 nt, Bordetella pertussis
ccgcuggucaccgccc

SEQ ID NO: 421933 - RNA, 13 nt, Bordetella pertussis
ccgcuggugcuga

SEQ ID NO: 421934 - RNA, 16 nt, Bordetella pertussis
ccgcuggugcugagac

SEQ ID NO: 421935 - RNA, 23 nt, Bordetella pertussis
ccgcuguagaaguaguucggcgc

SEQ ID NO: 421936 - RNA, 23 nt, Bordetella pertussis
ccgcugucgcaggcgcugcagca

SEQ ID NO: 421937 - RNA, 15 nt, Bordetella pertussis
ccgcuucggacagca

SEQ ID NO: 421938 - RNA, 16 nt, Bordetella pertussis
ccgcuucggcggccgc

SEQ ID NO: 421939 - RNA, 22 nt, Bordetella pertussis
ccgcuugaaguaaucgcccggc

SEQ ID NO: 421940 - RNA, 19 nt, Bordetella pertussis
ccgcuugcguucaugccgg

SEQ ID NO: 421941 - RNA, 17 nt, Bordetella pertussis
ccggaccggugcccucg

SEQ ID NO: 421942 - RNA, 20 nt, Bordetella pertussis
ccggacgcaaccggucggcc

SEQ ID NO: 421943 - RNA, 14 nt, Bordetella pertussis
ccggagcagcagcg

SEQ ID NO: 421944 - RNA, 20 nt, Bordetella pertussis
ccggagcagucgcgcagcca

SEQ ID NO: 421945 - RNA, 23 nt, Bordetella pertussis
ccggagcugccgaaucggccccu

SEQ ID NO: 421946 - RNA, 13 nt, Bordetella pertussis
ccggaggccgccc

SEQ ID NO: 421947 - RNA, 13 nt, Bordetella pertussis
ccggaggcgccgc

SEQ ID NO: 421948 - RNA, 15 nt, Bordetella pertussis
ccggaggcgccgcgg

SEQ ID NO: 421949 - RNA, 13 nt, Bordetella pertussis
ccggaggcgcgca

SEQ ID NO: 421950 - RNA, 16 nt, Bordetella pertussis
ccggaggggacagagu

SEQ ID NO: 421951 - RNA, 17 nt, Bordetella pertussis
ccggauauggccggcgc

SEQ ID NO: 421952 - RNA, 20 nt, Bordetella pertussis
ccggauauggccggcgcgcu

SEQ ID NO: 421953 - RNA, 19 nt, Bordetella pertussis
ccggaucauccgggcccgg

SEQ ID NO: 421954 - RNA, 15 nt, Bordetella pertussis
ccggaucccaggccg

SEQ ID NO: 421955 - RNA, 18 nt, Bordetella pertussis
ccggaucccaggccggcu

SEQ ID NO: 421956 - RNA, 20 nt, Bordetella pertussis
ccggaucauugggucugcgc

SEQ ID NO: 421957 - RNA, 20 nt, Bordetella pertussis
ccggaucggccggcagcgcg

SEQ ID NO: 421958 - RNA, 17 nt, Bordetella pertussis
ccggaugcgcguggcgc

SEQ ID NO: 421959 - RNA, 12 nt, Bordetella pertussis
ccggauggcgcg

SEQ ID NO: 421960 - RNA, 21 nt, Bordetella pertussis
ccggauugcuugacgccgccg

SEQ ID NO: 421961 - RNA, 16 nt, Bordetella pertussis
ccggauuggcgcugca

SEQ ID NO: 421962 - RNA, 16 nt, Bordetella pertussis
ccggcaaacccggcaa

SEQ ID NO: 421963 - RNA, 20 nt, Bordetella pertussis
ccggcaccagcgccacgccc

SEQ ID NO: 421964 - RNA, 18 nt, Bordetella pertussis
ccggcagggcggccaggc

SEQ ID NO: 421965 - RNA, 20 nt, Bordetella pertussis
ccggcagggcggccaggccg

SEQ ID NO: 421966 - RNA, 20 nt, Bordetella pertussis
ccggcagggucucggccacg

SEQ ID NO: 421967 - RNA, 23 nt, Bordetella pertussis
ccggcagggucucggccacgguc

SEQ ID NO: 421968 - RNA, 19 nt, Bordetella pertussis
ccggcagggugacgggcug

SEQ ID NO: 421969 - RNA, 19 nt, Bordetella pertussis
ccggcaugaccgcggacgc

SEQ ID NO: 421970 - RNA, 18 nt, Bordetella pertussis
ccggccacgcgcugcagc

SEQ ID NO: 421971 - RNA, 23 nt, Bordetella pertussis
ccggccacguguggcaggccagc

SEQ ID NO: 421972 - RNA, 13 nt, Bordetella pertussis
ccggccagcagcg

SEQ ID NO: 421973 - RNA, 11 nt, Bordetella pertussis
ccggccagcca

SEQ ID NO: 421974 - RNA, 17 nt, Bordetella pertussis
ccggccagccauugccg

SEQ ID NO: 421975 - RNA, 11 nt, Bordetella pertussis
ccggccagcgc

SEQ ID NO: 421976 - RNA, 17 nt, Bordetella pertussis
ccggccagcgccaccac

SEQ ID NO: 421977 - RNA, 17 nt, Bordetella pertussis
ccggccagcgccugggc

SEQ ID NO: 421978 - RNA, 21 nt, Bordetella pertussis
ccggccagcgcgccggccagg

SEQ ID NO: 421979 - RNA, 18 nt, Bordetella pertussis
ccggccagcgcggcaucg

SEQ ID NO: 421980 - RNA, 18 nt, Bordetella pertussis
ccggccauggcccuugcc

SEQ ID NO: 421981 - RNA, 14 nt, Bordetella pertussis
ccggcccaaggccc

SEQ ID NO: 421982 - RNA, 16 nt, Bordetella pertussis
ccggcccaaggccccg

SEQ ID NO: 421983 - RNA, 13 nt, Bordetella pertussis
ccggcccaggcgc

SEQ ID NO: 421984 - RNA, 16 nt, Bordetella pertussis
ccggcccaggcgcgcu

SEQ ID NO: 421985 - RNA, 11 nt, Bordetella pertussis
ccggcccagga

SEQ ID NO: 421986 - RNA, 21 nt, Bordetella pertussis
ccggcccaggauggcgccagc

SEQ ID NO: 421987 - RNA, 22 nt, Bordetella pertussis
ccggcccguuggcaggccagca

SEQ ID NO: 421988 - RNA, 17 nt, Bordetella pertussis
ccggcccugccgcccug

SEQ ID NO: 421989 - RNA, 14 nt, Bordetella pertussis
ccggccgacccgcg

SEQ ID NO: 421990 - RNA, 20 nt, Bordetella pertussis
ccggccgauagccgcggcgc

SEQ ID NO: 421991 - RNA, 20 nt, Bordetella pertussis
ccggccgaugacaucgccgc

SEQ ID NO: 421992 - RNA, 18 nt, Bordetella pertussis
ccggccgcacgcggccgc

SEQ ID NO: 421993 - RNA, 17 nt, Bordetella pertussis
ccggccgccagcauggc

SEQ ID NO: 421994 - RNA, 16 nt, Bordetella pertussis
ccggccgcccaggcgc

SEQ ID NO: 421995 - RNA, 18 nt, Bordetella pertussis
ccggccgccucaccgcgc

SEQ ID NO: 421996 - RNA, 18 nt, Bordetella pertussis
ccggccgccuccaggcgg

SEQ ID NO: 421997 - RNA, 14 nt, Bordetella pertussis
ccggccgcgccagc

SEQ ID NO: 421998 - RNA, 19 nt, Bordetella pertussis
ccggccgcgcggccgucag

SEQ ID NO: 421999 - RNA, 15 nt, Bordetella pertussis
ccggccgcggggcug

SEQ ID NO: 422000 - RNA, 21 nt, Bordetella pertussis
ccggccggcaaggggccagcc

SEQ ID NO: 422001 - RNA, 15 nt, Bordetella pertussis
ccggccggcccugcg

SEQ ID NO: 422002 - RNA, 14 nt, Bordetella pertussis
ccggccggccagua

SEQ ID NO: 422003 - RNA, 15 nt, Bordetella pertussis
ccggccgggcgcggc

SEQ ID NO: 422004 - RNA, 12 nt, Bordetella pertussis
ccggccgugccg

SEQ ID NO: 422005 - RNA, 18 nt, Bordetella pertussis
ccggccguuucaggccug

SEQ ID NO: 422006 - RNA, 19 nt, Bordetella pertussis
ccggccguuucaggccugc

SEQ ID NO: 422007 - RNA, 17 nt, Bordetella pertussis
ccggccucagcggccgc

SEQ ID NO: 422008 - RNA, 18 nt, Bordetella pertussis
ccggccucagcggccgcu

SEQ ID NO: 422009 - RNA, 21 nt, Bordetella pertussis
ccggccuccagcaucgccgcc

SEQ ID NO: 422010 - RNA, 16 nt, Bordetella pertussis
ccggccucccggacca

SEQ ID NO: 422011 - RNA, 15 nt, Bordetella pertussis
ccggccucgcggcgc

SEQ ID NO: 422012 - RNA, 21 nt, Bordetella pertussis
ccggccugcaaugcggccagg

SEQ ID NO: 422013 - RNA, 20 nt, Bordetella pertussis
ccggccugcaggcucuugac

SEQ ID NO: 422014 - RNA, 15 nt, Bordetella pertussis
ccggccugccggcgc

SEQ ID NO: 422015 - RNA, 15 nt, Bordetella pertussis
ccggccugcgccagc

SEQ ID NO: 422016 - RNA, 20 nt, Bordetella pertussis
ccggccugcgccagcuccag

SEQ ID NO: 422017 - RNA, 19 nt, Bordetella pertussis
ccggccugcgucgccaccu

SEQ ID NO: 422018 - RNA, 14 nt, Bordetella pertussis
ccggccugcucgcc

SEQ ID NO: 422019 - RNA, 13 nt, Bordetella pertussis
ccggccuggggac

SEQ ID NO: 422020 - RNA, 15 nt, Bordetella pertussis
ccggccuggcgcgca

SEQ ID NO: 422021 - RNA, 20 nt, Bordetella pertussis
ccggccuugcugaaccugcu

SEQ ID NO: 422022 - RNA, 13 nt, Bordetella pertussis
ccggccuuggccu

SEQ ID NO: 422023 - RNA, 18 nt, Bordetella pertussis
ccggcgacauagaucucc

SEQ ID NO: 422024 - RNA, 16 nt, Bordetella pertussis
ccggcgacaccgcggc

SEQ ID NO: 422025 - RNA, 13 nt, Bordetella pertussis
ccggcgacgccgc

SEQ ID NO: 422026 - RNA, 15 nt, Bordetella pertussis
ccggcgacuuccgcu

SEQ ID NO: 422027 - RNA, 19 nt, Bordetella pertussis
ccggcgagaacgcggccgc

SEQ ID NO: 422028 - RNA, 15 nt, Bordetella pertussis
ccggcgagcauggcg

SEQ ID NO: 422029 - RNA, 16 nt, Bordetella pertussis
ccggcgagccgauggc

SEQ ID NO: 422030 - RNA, 14 nt, Bordetella pertussis
ccggcgaggccgcc

SEQ ID NO: 422031 - RNA, 16 nt, Bordetella pertussis
ccggcgaggccgcccg

SEQ ID NO: 422032 - RNA, 19 nt, Bordetella pertussis
ccggcgaugaucgccucgg

SEQ ID NO: 422033 - RNA, 20 nt, Bordetella pertussis
ccggcgaugauggggucgcc

SEQ ID NO: 422034 - RNA, 18 nt, Bordetella pertussis
ccggcgauauggccaggg

SEQ ID NO: 422035 - RNA, 17 nt, Bordetella pertussis
ccggcgauugcgccagc

SEQ ID NO: 422036 - RNA, 13 nt, Bordetella pertussis
ccggcgcacgccc

SEQ ID NO: 422037 - RNA, 15 nt, Bordetella pertussis
ccggcgcacgccccg

SEQ ID NO: 422038 - RNA, 18 nt, Bordetella pertussis
ccggcgcacgccccgacg

SEQ ID NO: 422039 - RNA, 17 nt, Bordetella pertussis
ccggcgcaugagccggc

SEQ ID NO: 422040 - RNA, 19 nt, Bordetella pertussis
ccggcgcaugauggccggc

SEQ ID NO: 422041 - RNA, 14 nt, Bordetella pertussis
ccggcgccaccccg

SEQ ID NO: 422042 - RNA, 17 nt, Bordetella pertussis
ccggcgccagccgcucc

SEQ ID NO: 422043 - RNA, 18 nt, Bordetella pertussis
ccggcgcccccagcagcg

SEQ ID NO: 422044 - RNA, 14 nt, Bordetella pertussis
ccggcgcccgccgc

SEQ ID NO: 422045 - RNA, 17 nt, Bordetella pertussis
ccggcgcccgccgccgg

SEQ ID NO: 422046 - RNA, 13 nt, Bordetella pertussis
ccggcgcccggca

SEQ ID NO: 422047 - RNA, 14 nt, Bordetella pertussis
ccggcgccgccccu

SEQ ID NO: 422048 - RNA, 13 nt, Bordetella pertussis
ccggcgccgccgg

SEQ ID NO: 422049 - RNA, 23 nt, Bordetella pertussis
ccggcgccgccucaggccggcgc

SEQ ID NO: 422050 - RNA, 13 nt, Bordetella pertussis
ccggcgccgcgcg

SEQ ID NO: 422051 - RNA, 19 nt, Bordetella pertussis
ccggcgccgggcagcccgc

SEQ ID NO: 422052 - RNA, 14 nt, Bordetella pertussis
ccggcgccuggccg

SEQ ID NO: 422053 - RNA, 20 nt, Bordetella pertussis
ccggcgcgauggucaccacc

SEQ ID NO: 422054 - RNA, 20 nt, Bordetella pertussis
ccggcgcgcauccgguggug

SEQ ID NO: 422055 - RNA, 14 nt, Bordetella pertussis
ccggcgcgccgccc

SEQ ID NO: 422056 - RNA, 15 nt, Bordetella pertussis
ccggcgcgccgcccg

SEQ ID NO: 422057 - RNA, 15 nt, Bordetella pertussis
ccggcgcgccggccc

SEQ ID NO: 422058 - RNA, 19 nt, Bordetella pertussis
ccggcgcgccggcccaagg

SEQ ID NO: 422059 - RNA, 17 nt, Bordetella pertussis
ccggcgcgccggccgcc

SEQ ID NO: 422060 - RNA, 17 nt, Bordetella pertussis
ccggcgcgccucggcgc

SEQ ID NO: 422061 - RNA, 21 nt, Bordetella pertussis
ccggcgcgccuuacgcggcgc

SEQ ID NO: 422062 - RNA, 22 nt, Bordetella pertussis
ccggcgcgcgaucucgggcagg

SEQ ID NO: 422063 - RNA, 18 nt, Bordetella pertussis
ccggcgcgcgcgaccacg

SEQ ID NO: 422064 - RNA, 22 nt, Bordetella pertussis
ccggcgcgcgcgcgccgcacgc

SEQ ID NO: 422065 - RNA, 20 nt, Bordetella pertussis
ccggcgcgcucgcugccggc

SEQ ID NO: 422066 - RNA, 15 nt, Bordetella pertussis
ccggcgcggcagccu

SEQ ID NO: 422067 - RNA, 13 nt, Bordetella pertussis
ccggcgcggcugc

SEQ ID NO: 422068 - RNA, 19 nt, Bordetella pertussis
ccggcgcggcugcugggca

SEQ ID NO: 422069 - RNA, 20 nt, Bordetella pertussis
ccggcgcggcugcugggcau

SEQ ID NO: 422070 - RNA, 15 nt, Bordetella pertussis
ccggcgcggcgcgcg

SEQ ID NO: 422071 - RNA, 20 nt, Bordetella pertussis
ccggcgcguccacgccgugg

SEQ ID NO: 422072 - RNA, 19 nt, Bordetella pertussis
ccggcgcgucgccggcgau

SEQ ID NO: 422073 - RNA, 14 nt, Bordetella pertussis
ccggcgcgucgcgc

SEQ ID NO: 422074 - RNA, 21 nt, Bordetella pertussis
ccggcgcgucgcgcggcggca

SEQ ID NO: 422075 - RNA, 24 nt, Bordetella pertussis
ccggcgcguuccaugcgauccagg

SEQ ID NO: 422076 - RNA, 15 nt, Bordetella pertussis
ccggcgcucgccccg

SEQ ID NO: 422077 - RNA, 22 nt, Bordetella pertussis
ccggcgcucgccccggcgcgca

SEQ ID NO: 422078 - RNA, 21 nt, Bordetella pertussis
ccggcgcugcgcagcagggcg

SEQ ID NO: 422079 - RNA, 18 nt, Bordetella pertussis
ccggcgcugcugucgcgc

SEQ ID NO: 422080 - RNA, 15 nt, Bordetella pertussis
ccggcgcuggccgcc

SEQ ID NO: 422081 - RNA, 14 nt, Bordetella pertussis
ccggcgcuggcgca

SEQ ID NO: 422082 - RNA, 20 nt, Bordetella pertussis
ccggcgcuggcgcauggcug

SEQ ID NO: 422083 - RNA, 15 nt, Bordetella pertussis
ccgggaugccguagg

SEQ ID NO: 422084 - RNA, 18 nt, Bordetella pertussis
ccgggcaaucggcgugca

SEQ ID NO: 422085 - RNA, 21 nt, Bordetella pertussis
ccgggcaccagguccuggcgg

SEQ ID NO: 422086 - RNA, 22 nt, Bordetella pertussis
ccgggcaccagguccuggcggc

SEQ ID NO: 422087 - RNA, 15 nt, Bordetella pertussis
ccgggcagcaccgcu

SEQ ID NO: 422088 - RNA, 18 nt, Bordetella pertussis
ccgggcagcaccgcugcu

SEQ ID NO: 422089 - RNA, 14 nt, Bordetella pertussis
ccgggcagcccgcg

SEQ ID NO: 422090 - RNA, 17 nt, Bordetella pertussis
ccgggcagcgggccgca

SEQ ID NO: 422091 - RNA, 13 nt, Bordetella pertussis
ccgggcaggccgc

SEQ ID NO: 422092 - RNA, 16 nt, Bordetella pertussis
ccgggcaggccgcgcu

SEQ ID NO: 422093 - RNA, 17 nt, Bordetella pertussis
ccgggcaguucgggcac

SEQ ID NO: 422094 - RNA, 22 nt, Bordetella pertussis
ccgggccgcgaccacggucugg

SEQ ID NO: 422095 - RNA, 16 nt, Bordetella pertussis
ccgggccgcgccgccu

SEQ ID NO: 422096 - RNA, 12 nt, Bordetella pertussis
ccgggccgcgcg

SEQ ID NO: 422097 - RNA, 14 nt, Bordetella pertussis
ccgggccggcgggc

SEQ ID NO: 422098 - RNA, 12 nt, Bordetella pertussis
ccgggccgucgc

SEQ ID NO: 422099 - RNA, 12 nt, Bordetella pertussis
ccgggccgucgu

SEQ ID NO: 422100 - RNA, 16 nt, Bordetella pertussis
ccgggccgucgugcgc

SEQ ID NO: 422101 - RNA, 14 nt, Bordetella pertussis
ccgggccuggugcc

SEQ ID NO: 422102 - RNA, 19 nt, Bordetella pertussis
ccgggcgagauggcgugca

SEQ ID NO: 422103 - RNA, 15 nt, Bordetella pertussis
ccgggcgagccgaac

SEQ ID NO: 422104 - RNA, 20 nt, Bordetella pertussis
ccgggcgaucgcgucggcca

SEQ ID NO: 422105 - RNA, 16 nt, Bordetella pertussis
ccgggcgcaagcgcgc

SEQ ID NO: 422106 - RNA, 15 nt, Bordetella pertussis
ccgggcgccaggcug

SEQ ID NO: 422107 - RNA, 14 nt, Bordetella pertussis
ccgggcgccugcgc

SEQ ID NO: 422108 - RNA, 15 nt, Bordetella pertussis
ccgggcgcgcugccc

SEQ ID NO: 422109 - RNA, 18 nt, Bordetella pertussis
ccgggcgcggccaggcgc

SEQ ID NO: 422110 - RNA, 21 nt, Bordetella pertussis
ccgggcgcggccaggcgcuca

SEQ ID NO: 422111 - RNA, 15 nt, Bordetella pertussis
ccgggcgcggcccgg

SEQ ID NO: 422112 - RNA, 22 nt, Bordetella pertussis
ccgggcgcggccgccgcccgcc

SEQ ID NO: 422113 - RNA, 14 nt, Bordetella pertussis
ccgggcgcggcgcc

SEQ ID NO: 422114 - RNA, 15 nt, Bordetella pertussis
ccgggcgcggcgccc

SEQ ID NO: 422115 - RNA, 18 nt, Bordetella pertussis
ccgggcgcggcgcccgcc

SEQ ID NO: 422116 - RNA, 21 nt, Bordetella pertussis
ccgggcgcgccggcgggcgcu

SEQ ID NO: 422117 - RNA, 21 nt, Bordetella pertussis
ccgggcgcugcgccggcggca

SEQ ID NO: 422118 - RNA, 13 nt, Bordetella pertussis
ccggggucagcgc

SEQ ID NO: 422119 - RNA, 22 nt, Bordetella pertussis
ccggggucagcgccggcacgcu

SEQ ID NO: 422120 - RNA, 22 nt, Bordetella pertussis
ccggggucuugccgcgcagcgu

SEQ ID NO: 422121 - RNA, 15 nt, Bordetella pertussis
ccgggucccuggccc

SEQ ID NO: 422122 - RNA, 22 nt, Bordetella pertussis
ccggguccggccgcgcaaggcg

SEQ ID NO: 422123 - RNA, 12 nt, Bordetella pertussis
ccgggucgccgg

SEQ ID NO: 422124 - RNA, 15 nt, Bordetella pertussis
ccgggucgccggugg

SEQ ID NO: 422125 - RNA, 22 nt, Bordetella pertussis
ccgggucgcgcagcagggccug

SEQ ID NO: 422126 - RNA, 14 nt, Bordetella pertussis
ccgggucgcggcac

SEQ ID NO: 422127 - RNA, 13 nt, Bordetella pertussis
ccgggucgggcgu

SEQ ID NO: 422128 - RNA, 19 nt, Bordetella pertussis
ccgggucgucgggcggcgc

SEQ ID NO: 422129 - RNA, 20 nt, Bordetella pertussis
ccgggugaaguugucgucgg

SEQ ID NO: 422130 - RNA, 18 nt, Bordetella pertussis
ccgggugaucaguccgac

SEQ ID NO: 422131 - RNA, 15 nt, Bordetella pertussis
ccggguggccgcggu

SEQ ID NO: 422132 - RNA, 16 nt, Bordetella pertussis
ccggguggcgccaugu

SEQ ID NO: 422133 - RNA, 14 nt, Bordetella pertussis
ccgggugggcggca

SEQ ID NO: 422134 - RNA, 18 nt, Bordetella pertussis
ccggguggguucgggcgu

SEQ ID NO: 422135 - RNA, 19 nt, Bordetella pertussis
ccgggugguccaugcgaau

SEQ ID NO: 422136 - RNA, 12 nt, Bordetella pertussis
ccgguacgccug

SEQ ID NO: 422137 - RNA, 17 nt, Bordetella pertussis
ccggucagcccaggcgg

SEQ ID NO: 422138 - RNA, 23 nt, Bordetella pertussis
ccgguccagaugauggucggugc

SEQ ID NO: 422139 - RNA, 16 nt, Bordetella pertussis
ccggucggccggcagc

SEQ ID NO: 422140 - RNA, 21 nt, Bordetella pertussis
ccggucuacgccaugagcgcu

SEQ ID NO: 422141 - RNA, 14 nt, Bordetella pertussis
ccggucugccacac

SEQ ID NO: 422142 - RNA, 18 nt, Bordetella pertussis
ccggugcgauagcgccgc

SEQ ID NO: 422143 - RNA, 19 nt, Bordetella pertussis
ccggugcgauagcgccgcg

SEQ ID NO: 422144 - RNA, 20 nt, Bordetella pertussis
ccggugcgcgcagggcggcc

SEQ ID NO: 422145 - RNA, 21 nt, Bordetella pertussis
ccggugcgcgugggcacccgg

SEQ ID NO: 422146 - RNA, 23 nt, Bordetella pertussis
ccggugcgcgugggcacccggcc

SEQ ID NO: 422147 - RNA, 14 nt, Bordetella pertussis
ccggugcgcggcgc

SEQ ID NO: 422148 - RNA, 18 nt, Bordetella pertussis
ccggugcgcggcgccccc

SEQ ID NO: 422149 - RNA, 13 nt, Bordetella pertussis
ccggugcucggcc

SEQ ID NO: 422150 - RNA, 14 nt, Bordetella pertussis
ccgguggugcuggg

SEQ ID NO: 422151 - RNA, 16 nt, Bordetella pertussis
ccgguggugcugggcg

SEQ ID NO: 422152 - RNA, 22 nt, Bordetella pertussis
ccgguggugcugggcggcgggc

SEQ ID NO: 422153 - RNA, 20 nt, Bordetella pertussis
ccggugucgccguggcgggu

SEQ ID NO: 422154 - RNA, 14 nt, Bordetella pertussis
ccgguucgcccacc

SEQ ID NO: 422155 - RNA, 15 nt, Bordetella pertussis
ccgguucgcccacca

SEQ ID NO: 422156 - RNA, 14 nt, Bordetella pertussis
ccgguucgccgucg

SEQ ID NO: 422157 - RNA, 20 nt, Bordetella pertussis
ccgguucgugccgggcagca

SEQ ID NO: 422158 - RNA, 17 nt, Bordetella pertussis
ccgguugcagcgcgcca

SEQ ID NO: 422159 - RNA, 19 nt, Bordetella pertussis
ccgguugcagcgcgccagg

SEQ ID NO: 422160 - RNA, 19 nt, Bordetella pertussis
ccgguugacgaucucgccc

SEQ ID NO: 422161 - RNA, 12 nt, Bordetella pertussis
ccgguuggccag

SEQ ID NO: 422162 - RNA, 14 nt, Bordetella pertussis
ccgguuggccagcu

SEQ ID NO: 422163 - RNA, 23 nt, Bordetella pertussis
ccgguuggcgccuuccggcagcg

SEQ ID NO: 422164 - RNA, 16 nt, Bordetella pertussis
ccguaaucggcgucgg

SEQ ID NO: 422165 - RNA, 21 nt, Bordetella pertussis
ccguauggccguuggccagcg

SEQ ID NO: 422166 - RNA, 15 nt, Bordetella pertussis
ccgucaacgcccagg

SEQ ID NO: 422167 - RNA, 16 nt, Bordetella pertussis
ccgucaccgacgccag

SEQ ID NO: 422168 - RNA, 18 nt, Bordetella pertussis
ccgucacgcgcaaggcgg

SEQ ID NO: 422169 - RNA, 21 nt, Bordetella pertussis
ccgucacgcgcaaggcgggcu

SEQ ID NO: 422170 - RNA, 19 nt, Bordetella pertussis
ccgucaucgggugcggcgc

SEQ ID NO: 422171 - RNA, 19 nt, Bordetella pertussis
ccguccacgcccagcgccg

SEQ ID NO: 422172 - RNA, 16 nt, Bordetella pertussis
ccguccacgccgcgcg

SEQ ID NO: 422173 - RNA, 14 nt, Bordetella pertussis
ccguccacggccug

SEQ ID NO: 422174 - RNA, 15 nt, Bordetella pertussis
ccguccacggccugc

SEQ ID NO: 422175 - RNA, 16 nt, Bordetella pertussis
ccguccaggaagcagc

SEQ ID NO: 422176 - RNA, 22 nt, Bordetella pertussis
ccguccaggaagcagcccagca

SEQ ID NO: 422177 - RNA, 16 nt, Bordetella pertussis
ccguccagcgcggcgc

SEQ ID NO: 422178 - RNA, 19 nt, Bordetella pertussis
ccgucccgacccccggccc

SEQ ID NO: 422179 - RNA, 15 nt, Bordetella pertussis
ccguccgccaggacg

SEQ ID NO: 422180 - RNA, 20 nt, Bordetella pertussis
ccguccggccgugccgcccg

SEQ ID NO: 422181 - RNA, 14 nt, Bordetella pertussis
ccguccucaggccc

SEQ ID NO: 422182 - RNA, 15 nt, Bordetella pertussis
ccguccucaggcccg

SEQ ID NO: 422183 - RNA, 19 nt, Bordetella pertussis
ccguccucgcgggccuggc

SEQ ID NO: 422184 - RNA, 13 nt, Bordetella pertussis
ccguccugcugcg

SEQ ID NO: 422185 - RNA, 17 nt, Bordetella pertussis
ccguccuugagcgccag

SEQ ID NO: 422186 - RNA, 23 nt, Bordetella pertussis
ccguccuugagcgccagcucggc

SEQ ID NO: 422187 - RNA, 14 nt, Bordetella pertussis
ccgucgccagcgcg

SEQ ID NO: 422188 - RNA, 15 nt, Bordetella pertussis
ccgucgccagcgcgu

SEQ ID NO: 422189 - RNA, 18 nt, Bordetella pertussis
ccgucgccaaagcgcagc

SEQ ID NO: 422190 - RNA, 12 nt, Bordetella pertussis
ccgucgccgccc

SEQ ID NO: 422191 - RNA, 13 nt, Bordetella pertussis
ccgucgcgccagg

SEQ ID NO: 422192 - RNA, 16 nt, Bordetella pertussis
ccgugagugcagcgcu

SEQ ID NO: 422193 - RNA, 14 nt, Bordetella pertussis
ccgugaugggcgca

SEQ ID NO: 422194 - RNA, 22 nt, Bordetella pertussis
ccgugcaucggcacgggucagg

SEQ ID NO: 422195 - RNA, 16 nt, Bordetella pertussis
ccguggccaagggcgc

SEQ ID NO: 422196 - RNA, 14 nt, Bordetella pertussis
ccguggccaagugg

SEQ ID NO: 422197 - RNA, 13 nt, Bordetella pertussis
ccguggcgcacca

SEQ ID NO: 422198 - RNA, 18 nt, Bordetella pertussis
ccguggcgcaccagguug

SEQ ID NO: 422199 - RNA, 20 nt, Bordetella pertussis
ccguggcgugcaggccggcg

SEQ ID NO: 422200 - RNA, 21 nt, Bordetella pertussis
ccguggcguugacggcccagc

SEQ ID NO: 422201 - RNA, 18 nt, Bordetella pertussis
ccguggggacaggcaccu

SEQ ID NO: 422202 - RNA, 19 nt, Bordetella pertussis
ccguggggacgagcuccug

SEQ ID NO: 422203 - RNA, 21 nt, Bordetella pertussis
ccguggggacgagcuccugga

SEQ ID NO: 422204 - RNA, 22 nt, Bordetella pertussis
ccguggggacgagcuccuggag

SEQ ID NO: 422205 - RNA, 19 nt, Bordetella pertussis
ccguuaggccuugcgugac

SEQ ID NO: 422206 - RNA, 19 nt, Bordetella pertussis
ccguuaugguucggccucg

SEQ ID NO: 422207 - RNA, 19 nt, Bordetella pertussis
ccguucuggcugcgcgccu

SEQ ID NO: 422208 - RNA, 18 nt, Bordetella pertussis
ccguucuucgaucgccug

SEQ ID NO: 422209 - RNA, 13 nt, Bordetella pertussis
ccguuggccagcg

SEQ ID NO: 422210 - RNA, 17 nt, Bordetella pertussis
ccguuguccuggcgcgc

SEQ ID NO: 422211 - RNA, 15 nt, Bordetella pertussis
ccguugucgccgcgg

SEQ ID NO: 422212 - RNA, 22 nt, Bordetella pertussis
ccguuuuuuucguugcauugca

SEQ ID NO: 422213 - RNA, 15 nt, Bordetella pertussis
ccuacuucggcagcu

SEQ ID NO: 422214 - RNA, 16 nt, Bordetella pertussis
ccuagcgccgcgccag

SEQ ID NO: 422215 - RNA, 22 nt, Bordetella pertussis
ccuaggcugcagccaguugggc

SEQ ID NO: 422216 - RNA, 15 nt, Bordetella pertussis
ccuaucaccugggca

SEQ ID NO: 422217 - RNA, 17 nt, Bordetella pertussis
ccuauguaggcgccgcg

SEQ ID NO: 422218 - RNA, 18 nt, Bordetella pertussis
ccuauugcgacgccgccg

SEQ ID NO: 422219 - RNA, 16 nt, Bordetella pertussis
ccucacgcuuccccga

SEQ ID NO: 422220 - RNA, 17 nt, Bordetella pertussis
ccucacgcuuccccgaa

SEQ ID NO: 422221 - RNA, 23 nt, Bordetella pertussis
ccucacuccauagcgccgcucga

SEQ ID NO: 422222 - RNA, 14 nt, Bordetella pertussis
ccucagcggccgcu

SEQ ID NO: 422223 - RNA, 17 nt, Bordetella pertussis
ccucagcggccgcugcc

SEQ ID NO: 422224 - RNA, 17 nt, Bordetella pertussis
ccucaggcccgcggcgc

SEQ ID NO: 422225 - RNA, 16 nt, Bordetella pertussis
ccucaggccggcgccu

SEQ ID NO: 422226 - RNA, 19 nt, Bordetella pertussis
ccucaguccagcuggcccu

SEQ ID NO: 422227 - RNA, 14 nt, Bordetella pertussis
ccucgaugucaucg

SEQ ID NO: 422228 - RNA, 22 nt, Bordetella pertussis
ccucgaugucaucgcccucuuc

SEQ ID NO: 422229 - RNA, 16 nt, Bordetella pertussis
ccucgauuuccgaggc

SEQ ID NO: 422230 - RNA, 16 nt, Bordetella pertussis
ccucgccagcggcagc

SEQ ID NO: 422231 - RNA, 22 nt, Bordetella pertussis
ccucgcccagcgagccggccag

SEQ ID NO: 422232 - RNA, 23 nt, Bordetella pertussis
ccucgcccagcgagccggccagc

SEQ ID NO: 422233 - RNA, 23 nt, Bordetella pertussis
ccucgcccagcggcgccgaccag

SEQ ID NO: 422234 - RNA, 14 nt, Bordetella pertussis
ccucgcccaggccg

SEQ ID NO: 422235 - RNA, 22 nt, Bordetella pertussis
ccucgcccccgaaggccgcgcc

SEQ ID NO: 422236 - RNA, 19 nt, Bordetella pertussis
ccucgccgcccagccggcc

SEQ ID NO: 422237 - RNA, 14 nt, Bordetella pertussis
ccucgccgcgccag

SEQ ID NO: 422238 - RNA, 16 nt, Bordetella pertussis
ccucgccgcgccagcu

SEQ ID NO: 422239 - RNA, 16 nt, Bordetella pertussis
ccucgccggcccugcc

SEQ ID NO: 422240 - RNA, 16 nt, Bordetella pertussis
ccucgcgacggccucc

SEQ ID NO: 422241 - RNA, 18 nt, Bordetella pertussis
ccucgcgacggccucccg

SEQ ID NO: 422242 - RNA, 19 nt, Bordetella pertussis
ccucgcgacggccucccgc

SEQ ID NO: 422243 - RNA, 15 nt, Bordetella pertussis
ccucgcugccagggu

SEQ ID NO: 422244 - RNA, 15 nt, Bordetella pertussis
ccucgcugcgggcgg

SEQ ID NO: 422245 - RNA, 17 nt, Bordetella pertussis
ccucgcuuuaccagcug

SEQ ID NO: 422246 - RNA, 20 nt, Bordetella pertussis
ccucggacgccuggcgcggc

SEQ ID NO: 422247 - RNA, 20 nt, Bordetella pertussis
ccucggaggauacggccagc

SEQ ID NO: 422248 - RNA, 23 nt, Bordetella pertussis
ccucggccacgucggcggccgcc

SEQ ID NO: 422249 - RNA, 14 nt, Bordetella pertussis
ccucggccagcugg

SEQ ID NO: 422250 - RNA, 19 nt, Bordetella pertussis
ccucggccagcugggaggc

SEQ ID NO: 422251 - RNA, 12 nt, Bordetella pertussis
ccucggccagga

SEQ ID NO: 422252 - RNA, 21 nt, Bordetella pertussis
ccucggccaggaaagccggcg

SEQ ID NO: 422253 - RNA, 19 nt, Bordetella pertussis
ccucggccauguagauggc

SEQ ID NO: 422254 - RNA, 20 nt, Bordetella pertussis
ccucggccauguagauggcc

SEQ ID NO: 422255 - RNA, 13 nt, Bordetella pertussis
ccucggccggcag

SEQ ID NO: 422256 - RNA, 11 nt, Bordetella pertussis
ccucggccugc

SEQ ID NO: 422257 - RNA, 19 nt, Bordetella pertussis
ccucggccugccggcgcgc

SEQ ID NO: 422258 - RNA, 22 nt, Bordetella pertussis
ccucggccuggccccaggcgcc

SEQ ID NO: 422259 - RNA, 19 nt, Bordetella pertussis
ccucggcgaagugcccgcu

SEQ ID NO: 422260 - RNA, 18 nt, Bordetella pertussis
ccucguccucgucggcga

SEQ ID NO: 422261 - RNA, 14 nt, Bordetella pertussis
ccucguccugcagg

SEQ ID NO: 422262 - RNA, 17 nt, Bordetella pertussis
ccucguccugcaggcgg

SEQ ID NO: 422263 - RNA, 12 nt, Bordetella pertussis
ccucuacuggcu

SEQ ID NO: 422264 - RNA, 14 nt, Bordetella pertussis
ccugaccggcggcg

SEQ ID NO: 422265 - RNA, 21 nt, Bordetella pertussis
ccugaccggcuauaccgggcu

SEQ ID NO: 422266 - RNA, 23 nt, Bordetella pertussis
ccugacgaccaaccugaccgccu

SEQ ID NO: 422267 - RNA, 17 nt, Bordetella pertussis
ccugacgcucauccagg

SEQ ID NO: 422268 - RNA, 19 nt, Bordetella pertussis
ccugacggcuacacccugc

SEQ ID NO: 422269 - RNA, 17 nt, Bordetella pertussis
ccugaucgaggagcugc

SEQ ID NO: 422270 - RNA, 14 nt, Bordetella pertussis
ccugaucgccucgg

SEQ ID NO: 422271 - RNA, 15 nt, Bordetella pertussis
ccugaucggggccaa

SEQ ID NO: 422272 - RNA, 13 nt, Bordetella pertussis
ccugaugccuguc

SEQ ID NO: 422273 - RNA, 14 nt, Bordetella pertussis
ccugauucccaggc

SEQ ID NO: 422274 - RNA, 14 nt, Bordetella pertussis
ccugcagcgccgcc

SEQ ID NO: 422275 - RNA, 15 nt, Bordetella pertussis
ccugcagcgccgccu

SEQ ID NO: 422276 - RNA, 16 nt, Bordetella pertussis
ccugcaggaaggccgc

SEQ ID NO: 422277 - RNA, 18 nt, Bordetella pertussis
ccugcaggaaggccgccg

SEQ ID NO: 422278 - RNA, 22 nt, Bordetella pertussis
ccugcaggcccaccggcaugcc

SEQ ID NO: 422279 - RNA, 13 nt, Bordetella pertussis
ccugcaggcccgg

SEQ ID NO: 422280 - RNA, 16 nt, Bordetella pertussis
ccugcaggcccggcgc

SEQ ID NO: 422281 - RNA, 15 nt, Bordetella pertussis
ccugcaggccgccgg

SEQ ID NO: 422282 - RNA, 20 nt, Bordetella pertussis
ccugccaauagcgguggcgg

SEQ ID NO: 422283 - RNA, 15 nt, Bordetella pertussis
ccugccacuccuggu

SEQ ID NO: 422284 - RNA, 17 nt, Bordetella pertussis
ccugccagcccaccagc

SEQ ID NO: 422285 - RNA, 18 nt, Bordetella pertussis
ccugccaguugccgccgc

SEQ ID NO: 422286 - RNA, 20 nt, Bordetella pertussis
ccugccaguugccgccgccg

SEQ ID NO: 422287 - RNA, 21 nt, Bordetella pertussis
ccugccaguugccgccgccgg

SEQ ID NO: 422288 - RNA, 14 nt, Bordetella pertussis
ccugccauccggcc

SEQ ID NO: 422289 - RNA, 15 nt, Bordetella pertussis
ccugcccaccgccgc

SEQ ID NO: 422290 - RNA, 15 nt, Bordetella pertussis
ccugcccaggccagc

SEQ ID NO: 422291 - RNA, 19 nt, Bordetella pertussis
ccugcccauucccgcccug

SEQ ID NO: 422292 - RNA, 19 nt, Bordetella pertussis
ccugccccaucccauccgc

SEQ ID NO: 422293 - RNA, 18 nt, Bordetella pertussis
ccugcucacgccccgccc

SEQ ID NO: 422294 - RNA, 16 nt, Bordetella pertussis
ccugcucgaccugcuc

SEQ ID NO: 422295 - RNA, 16 nt, Bordetella pertussis
ccugcucgcaggccug

SEQ ID NO: 422296 - RNA, 16 nt, Bordetella pertussis
ccugcugcgccgucug

SEQ ID NO: 422297 - RNA, 17 nt, Bordetella pertussis
ccugcugcgccuggccg

SEQ ID NO: 422298 - RNA, 14 nt, Bordetella pertussis
ccugcugcugcagc

SEQ ID NO: 422299 - RNA, 15 nt, Bordetella pertussis
ccugcugcugcagcc

SEQ ID NO: 422300 - RNA, 13 nt, Bordetella pertussis
ccugcuggccgcc

SEQ ID NO: 422301 - RNA, 14 nt, Bordetella pertussis
ccugcuggccgccg

SEQ ID NO: 422302 - RNA, 17 nt, Bordetella pertussis
ccugcuggcgcgcacca

SEQ ID NO: 422303 - RNA, 16 nt, Bordetella pertussis
ccugcuggcgcgucgg

SEQ ID NO: 422304 - RNA, 16 nt, Bordetella pertussis
ccugcugggccgcgcu

SEQ ID NO: 422305 - RNA, 14 nt, Bordetella pertussis
ccugcuggucggcc

SEQ ID NO: 422306 - RNA, 14 nt, Bordetella pertussis
ccugcugucgcugg

SEQ ID NO: 422307 - RNA, 22 nt, Bordetella pertussis
ccugcugucgcugggaugggua

SEQ ID NO: 422308 - RNA, 21 nt, Bordetella pertussis
ccugcuguucaccuucaacau

SEQ ID NO: 422309 - RNA, 15 nt, Bordetella pertussis
ccugcuuggcgcgca

SEQ ID NO: 422310 - RNA, 21 nt, Bordetella pertussis
ccugcuuggcgcgcagcagcg

SEQ ID NO: 422311 - RNA, 19 nt, Bordetella pertussis
ccuggaagcuggccagcgg

SEQ ID NO: 422312 - RNA, 20 nt, Bordetella pertussis
ccuggacagugcccugaccc

SEQ ID NO: 422313 - RNA, 22 nt, Bordetella pertussis
ccuggccauuccuuccgggccc

SEQ ID NO: 422314 - RNA, 24 nt, Bordetella pertussis
ccuggcccacaucgucgcgcuggg

SEQ ID NO: 422315 - RNA, 18 nt, Bordetella pertussis
ccuggcccagcgcauaga

SEQ ID NO: 422316 - RNA, 18 nt, Bordetella pertussis
ccuggccgauuucgcgcg

SEQ ID NO: 422317 - RNA, 21 nt, Bordetella pertussis
ccuggccgauuucgcgcgcca

SEQ ID NO: 422318 - RNA, 18 nt, Bordetella pertussis
ccuggccgccgcgggcgc

SEQ ID NO: 422319 - RNA, 19 nt, Bordetella pertussis
ccuggccgccgcgggcgcc

SEQ ID NO: 422320 - RNA, 12 nt, Bordetella pertussis
ccuggccgcgcg

SEQ ID NO: 422321 - RNA, 15 nt, Bordetella pertussis
ccuggccgcgcgccu

SEQ ID NO: 422322 - RNA, 12 nt, Bordetella pertussis
ccuggccgcgcu

SEQ ID NO: 422323 - RNA, 11 nt, Bordetella pertussis
ccuggccggcg

SEQ ID NO: 422324 - RNA, 22 nt, Bordetella pertussis
ccuggccgggacaaucgaagau

SEQ ID NO: 422325 - RNA, 14 nt, Bordetella pertussis
ccuggccggcgccg

SEQ ID NO: 422326 - RNA, 17 nt, Bordetella pertussis
ccuggccuucgaccugc

SEQ ID NO: 422327 - RNA, 17 nt, Bordetella pertussis
ccuggccuucgcugccc

SEQ ID NO: 422328 - RNA, 14 nt, Bordetella pertussis
ccuggcgcaggccg

SEQ ID NO: 422329 - RNA, 16 nt, Bordetella pertussis
ccuggcgcaggccggc

SEQ ID NO: 422330 - RNA, 17 nt, Bordetella pertussis
ccuggcgcgcgaacggg

SEQ ID NO: 422331 - RNA, 24 nt, Bordetella pertussis
ccuggcgcggcgccugcgcgcgcu

SEQ ID NO: 422332 - RNA, 18 nt, Bordetella pertussis
ccuggcgcuccucgcgcg

SEQ ID NO: 422333 - RNA, 21 nt, Bordetella pertussis
ccuggcucugaucgcgcugga

SEQ ID NO: 422334 - RNA, 15 nt, Bordetella pertussis
ccuggcuuacaggcc

SEQ ID NO: 422335 - RNA, 21 nt, Bordetella pertussis
ccuggcuuacaggcccaguac

SEQ ID NO: 422336 - RNA, 20 nt, Bordetella pertussis
ccuggcuucccgguccaggc

SEQ ID NO: 422337 - RNA, 16 nt, Bordetella pertussis
ccugggaggggccggc

SEQ ID NO: 422338 - RNA, 17 nt, Bordetella pertussis
ccugggaggggccggcu

SEQ ID NO: 422339 - RNA, 12 nt, Bordetella pertussis
ccugggcacgcc

SEQ ID NO: 422340 - RNA, 21 nt, Bordetella pertussis
ccuggucagguugcgccggcu

SEQ ID NO: 422341 - RNA, 19 nt, Bordetella pertussis
ccuggucaugacgggcggc

SEQ ID NO: 422342 - RNA, 17 nt, Bordetella pertussis
ccugguccauggcgggg

SEQ ID NO: 422343 - RNA, 14 nt, Bordetella pertussis
ccugguccgccgcg

SEQ ID NO: 422344 - RNA, 20 nt, Bordetella pertussis
ccugguccugcgugauggcg

SEQ ID NO: 422345 - RNA, 16 nt, Bordetella pertussis
ccuggucgaacguggc

SEQ ID NO: 422346 - RNA, 19 nt, Bordetella pertussis
ccuggucgaacguggcggc

SEQ ID NO: 422347 - RNA, 16 nt, Bordetella pertussis
ccuggucgaccaggcc

SEQ ID NO: 422348 - RNA, 16 nt, Bordetella pertussis
ccuggucgacccacuu

SEQ ID NO: 422349 - RNA, 19 nt, Bordetella pertussis
ccuggucgaucagccccug

SEQ ID NO: 422350 - RNA, 21 nt, Bordetella pertussis
ccuggucgaucagccccugcc

SEQ ID NO: 422351 - RNA, 16 nt, Bordetella pertussis
ccuggucgcgcgccug

SEQ ID NO: 422352 - RNA, 23 nt, Bordetella pertussis
ccuggucggggucggccaccacc

SEQ ID NO: 422353 - RNA, 22 nt, Bordetella pertussis
ccuggucgucggccacgcccug

SEQ ID NO: 422354 - RNA, 13 nt, Bordetella pertussis
ccuggugcccgac

SEQ ID NO: 422355 - RNA, 17 nt, Bordetella pertussis
ccuggugcccgacgccg

SEQ ID NO: 422356 - RNA, 16 nt, Bordetella pertussis
ccugguggcgcuggcc

SEQ ID NO: 422357 - RNA, 17 nt, Bordetella pertussis
ccugguggcgcuggccc

SEQ ID NO: 422358 - RNA, 15 nt, Bordetella pertussis
ccuggugugccuguc

SEQ ID NO: 422359 - RNA, 17 nt, Bordetella pertussis
ccuggugugccuguccc

SEQ ID NO: 422360 - RNA, 14 nt, Bordetella pertussis
ccugguguucggca

SEQ ID NO: 422361 - RNA, 19 nt, Bordetella pertussis
ccugguugaccgagcccgg

SEQ ID NO: 422362 - RNA, 19 nt, Bordetella pertussis
ccugguugccgaaggguug

SEQ ID NO: 422363 - RNA, 14 nt, Bordetella pertussis
ccugguuggccgcc

SEQ ID NO: 422364 - RNA, 23 nt, Bordetella pertussis
ccugguuggccucgcgcucgcgc

SEQ ID NO: 422365 - RNA, 24 nt, Bordetella pertussis
ccugguuggccucgcgcucgcgcu

SEQ ID NO: 422366 - RNA, 14 nt, Bordetella pertussis
ccugugccagcugg

SEQ ID NO: 422367 - RNA, 18 nt, Bordetella pertussis
ccuguucccgccgggcca

SEQ ID NO: 422368 - RNA, 20 nt, Bordetella pertussis
ccuguucggccacggcugga

SEQ ID NO: 422369 - RNA, 23 nt, Bordetella pertussis
ccuguugcaggaucugguucuug

SEQ ID NO: 422370 - RNA, 15 nt, Bordetella pertussis
ccuguuuuggcgcac

SEQ ID NO: 422371 - RNA, 18 nt, Bordetella pertussis
ccuuacgcgguccgcagc

SEQ ID NO: 422372 - RNA, 16 nt, Bordetella pertussis
ccuucagcgggccggc

SEQ ID NO: 422373 - RNA, 15 nt, Bordetella pertussis
ccuucagguuccagg

SEQ ID NO: 422374 - RNA, 23 nt, Bordetella pertussis
ccuucauggcgucguccagcuug

SEQ ID NO: 422375 - RNA, 15 nt, Bordetella pertussis
ccuucauuuccuggu

SEQ ID NO: 422376 - RNA, 15 nt, Bordetella pertussis
cgauacgacacgccg

SEQ ID NO: 422377 - RNA, 21 nt, Bordetella pertussis
cgauacgucgcagcacgccca

SEQ ID NO: 422378 - RNA, 22 nt, Bordetella pertussis
cgauacugcgcaugggcgcagg

SEQ ID NO: 422379 - RNA, 18 nt, Bordetella pertussis
cgauauccaucggcgcgc

SEQ ID NO: 422380 - RNA, 19 nt, Bordetella pertussis
cgauaucccgggcuccggu

SEQ ID NO: 422381 - RNA, 23 nt, Bordetella pertussis
cgauauccuugcgcucgcccagc

SEQ ID NO: 422382 - RNA, 16 nt, Bordetella pertussis
cgaucagcgcccaggu

SEQ ID NO: 422383 - RNA, 14 nt, Bordetella pertussis
cgaucaggccgccc

SEQ ID NO: 422384 - RNA, 15 nt, Bordetella pertussis
cgaucaggcggugcc

SEQ ID NO: 422385 - RNA, 15 nt, Bordetella pertussis
cgaucaucaggauga

SEQ ID NO: 422386 - RNA, 23 nt, Bordetella pertussis
cgaucauccaggccgugagcgcc

SEQ ID NO: 422387 - RNA, 15 nt, Bordetella pertussis
cgaucauggccagcc

SEQ ID NO: 422388 - RNA, 12 nt, Bordetella pertussis
cgauccagcagc

SEQ ID NO: 422389 - RNA, 13 nt, Bordetella pertussis
cgauccagcagcg

SEQ ID NO: 422390 - RNA, 13 nt, Bordetella pertussis
cgauccagcgccu

SEQ ID NO: 422391 - RNA, 22 nt, Bordetella pertussis
cgauccagggccgccagcaccu

SEQ ID NO: 422392 - RNA, 22 nt, Bordetella pertussis
cgaucccgacgauccgcgggua

SEQ ID NO: 422393 - RNA, 17 nt, Bordetella pertussis
cgaucccuugugcgcgc

SEQ ID NO: 422394 - RNA, 19 nt, Bordetella pertussis
cgauccgcgacgcccuggc

SEQ ID NO: 422395 - RNA, 15 nt, Bordetella pertussis
cgauccgcgccaggc

SEQ ID NO: 422396 - RNA, 16 nt, Bordetella pertussis
cgauccgcgggcgggc

SEQ ID NO: 422397 - RNA, 20 nt, Bordetella pertussis
cgauccggcgaccgacggca

SEQ ID NO: 422398 - RNA, 14 nt, Bordetella pertussis
cgaucgaacgcggc

SEQ ID NO: 422399 - RNA, 16 nt, Bordetella pertussis
cgaucgaacgcggcca

SEQ ID NO: 422400 - RNA, 12 nt, Bordetella pertussis
cgaucgacggcc

SEQ ID NO: 422401 - RNA, 14 nt, Bordetella pertussis
cgaucgccagcagg

SEQ ID NO: 422402 - RNA, 19 nt, Bordetella pertussis
cgaucgccuggggcgggcg

SEQ ID NO: 422403 - RNA, 14 nt, Bordetella pertussis
cgaucgcgauggcc

SEQ ID NO: 422404 - RNA, 14 nt, Bordetella pertussis
cgaucggcgccgcg

SEQ ID NO: 422405 - RNA, 15 nt, Bordetella pertussis
cgaucggcgucugga

SEQ ID NO: 422406 - RNA, 18 nt, Bordetella pertussis
cgaucggcuugccgcgcg

SEQ ID NO: 422407 - RNA, 13 nt, Bordetella pertussis
cgaucgucagcag

SEQ ID NO: 422408 - RNA, 18 nt, Bordetella pertussis
cgaucuacgacgccugga

SEQ ID NO: 422409 - RNA, 20 nt, Bordetella pertussis
cgaucucagccaucaucauc

SEQ ID NO: 422410 - RNA, 21 nt, Bordetella pertussis
cgaucucacgggcgaagcgga

SEQ ID NO: 422411 - RNA, 18 nt, Bordetella pertussis
cgaucuccgggagccugu

SEQ ID NO: 422412 - RNA, 16 nt, Bordetella pertussis
cgaucucgcccugcuc

SEQ ID NO: 422413 - RNA, 14 nt, Bordetella pertussis
cgaucucgggcagg

SEQ ID NO: 422414 - RNA, 14 nt, Bordetella pertussis
cgaucugcgcggcg

SEQ ID NO: 422415 - RNA, 17 nt, Bordetella pertussis
cgaucuggcgcgcgacc

SEQ ID NO: 422416 - RNA, 23 nt, Bordetella pertussis
cgaucuggcgcgcgaccaggcug

SEQ ID NO: 422417 - RNA, 12 nt, Bordetella pertussis
cgaucuggcuca

SEQ ID NO: 422418 - RNA, 16 nt, Bordetella pertussis
cgaucugguuggccac

SEQ ID NO: 422419 - RNA, 16 nt, Bordetella pertussis
cgaucuucagcaccag

SEQ ID NO: 422420 - RNA, 19 nt, Bordetella pertussis
cgaucuucagcaccagcuc

SEQ ID NO: 422421 - RNA, 15 nt, Bordetella pertussis
cgaugaagacgccgu

SEQ ID NO: 422422 - RNA, 14 nt, Bordetella pertussis
cgaugaccagcagc

SEQ ID NO: 422423 - RNA, 19 nt, Bordetella pertussis
cgaugaccagccagccgcc

SEQ ID NO: 422424 - RNA, 19 nt, Bordetella pertussis
cgaugaccaucacgagcag

SEQ ID NO: 422425 - RNA, 18 nt, Bordetella pertussis
cgaugaccggccaggcgc

SEQ ID NO: 422426 - RNA, 21 nt, Bordetella pertussis
cgaugaccucgcgcugcagca

SEQ ID NO: 422427 - RNA, 21 nt, Bordetella pertussis
cgaugacggcuucgaccacgc

SEQ ID NO: 422428 - RNA, 14 nt, Bordetella pertussis
cgaugaucaugaug

SEQ ID NO: 422429 - RNA, 17 nt, Bordetella pertussis
cgaugaugagcgcgccg

SEQ ID NO: 422430 - RNA, 15 nt, Bordetella pertussis
cgaugaugcccagga

SEQ ID NO: 422431 - RNA, 16 nt, Bordetella pertussis
cgaugaugcccaggau

SEQ ID NO: 422432 - RNA, 23 nt, Bordetella pertussis
cgaugauggugaacgccaccagg

SEQ ID NO: 422433 - RNA, 21 nt, Bordetella pertussis
cgaugcaauagcgcccgccuu

SEQ ID NO: 422434 - RNA, 15 nt, Bordetella pertussis
cgaugcccaccagcc

SEQ ID NO: 422435 - RNA, 17 nt, Bordetella pertussis
cgaugcccaccagccgc

SEQ ID NO: 422436 - RNA, 18 nt, Bordetella pertussis
cgaugcccaccagccgcc

SEQ ID NO: 422437 - RNA, 18 nt, Bordetella pertussis
cgaugcgcgcgcgggcca

SEQ ID NO: 422438 - RNA, 23 nt, Bordetella pertussis
cgaugcgcgcgcgggccagcaga

SEQ ID NO: 422439 - RNA, 17 nt, Bordetella pertussis
cgaugcgccgcaccagc

SEQ ID NO: 422440 - RNA, 19 nt, Bordetella pertussis
cgaugcgcugcuggaggcc

SEQ ID NO: 422441 - RNA, 18 nt, Bordetella pertussis
cgaugcgguaggcccagc

SEQ ID NO: 422442 - RNA, 23 nt, Bordetella pertussis
cgaugcggucggccgcgccgccg

SEQ ID NO: 422443 - RNA, 15 nt, Bordetella pertussis
cgaugcucacgccca

SEQ ID NO: 422444 - RNA, 16 nt, Bordetella pertussis
cgauggcacggcacgc

SEQ ID NO: 422445 - RNA, 23 nt, Bordetella pertussis
cgauggcauggggcaggcgcagc

SEQ ID NO: 422446 - RNA, 14 nt, Bordetella pertussis
cgauggcccgcagg

SEQ ID NO: 422447 - RNA, 17 nt, Bordetella pertussis
cgauggccgggagcggc

SEQ ID NO: 422448 - RNA, 19 nt, Bordetella pertussis
cgauggcgcgcggcugggg

SEQ ID NO: 422449 - RNA, 22 nt, Bordetella pertussis
cgauggcgcgcggcuggggcug

SEQ ID NO: 422450 - RNA, 12 nt, Bordetella pertussis
cgauggcggcca

SEQ ID NO: 422451 - RNA, 16 nt, Bordetella pertussis
cgauggugccggccgu

SEQ ID NO: 422452 - RNA, 15 nt, Bordetella pertussis
cgauggugccgggcu

SEQ ID NO: 422453 - RNA, 16 nt, Bordetella pertussis
cgauguagagggucug

SEQ ID NO: 422454 - RNA, 13 nt, Bordetella pertussis
cgauguagccgac

SEQ ID NO: 422455 - RNA, 20 nt, Bordetella pertussis
cgauguaguagccgccgcug

SEQ ID NO: 422456 - RNA, 17 nt, Bordetella pertussis
cgauguccacgaaggcg

SEQ ID NO: 422457 - RNA, 18 nt, Bordetella pertussis
cgcaaaccgacgcggcca

SEQ ID NO: 422458 - RNA, 19 nt, Bordetella pertussis
cgcaaaccugaugccuguc

SEQ ID NO: 422459 - RNA, 18 nt, Bordetella pertussis
cgcaaacguggugucggc

SEQ ID NO: 422460 - RNA, 19 nt, Bordetella pertussis
cgcaacgcgcgcgcgcaca

SEQ ID NO: 422461 - RNA, 16 nt, Bordetella pertussis
cgcaacucggccaccu

SEQ ID NO: 422462 - RNA, 21 nt, Bordetella pertussis
cgcaaggccugcucgggcgcc

SEQ ID NO: 422463 - RNA, 23 nt, Bordetella pertussis
cgcaagggccccccggcgcggcc

SEQ ID NO: 422464 - RNA, 23 nt, Bordetella pertussis
cgcaaggguuguggccguggcgg

SEQ ID NO: 422465 - RNA, 18 nt, Bordetella pertussis
cgcaaguguggcgcaccg

SEQ ID NO: 422466 - RNA, 20 nt, Bordetella pertussis
cgcaaguguggcgcaccgcg

SEQ ID NO: 422467 - RNA, 19 nt, Bordetella pertussis
cgcaagugcuggcccgcca

SEQ ID NO: 422468 - RNA, 19 nt, Bordetella pertussis
cgcaauaccuucagcccgg

SEQ ID NO: 422469 - RNA, 16 nt, Bordetella pertussis
cgcaauaggccgcgau

SEQ ID NO: 422470 - RNA, 20 nt, Bordetella pertussis
cgcacagcauggccaccagg

SEQ ID NO: 422471 - RNA, 22 nt, Bordetella pertussis
cgcacaguacuuguugcgugcc

SEQ ID NO: 422472 - RNA, 14 nt, Bordetella pertussis
cgcaccagcccgcc

SEQ ID NO: 422473 - RNA, 15 nt, Bordetella pertussis
cgcaccagcccgccc

SEQ ID NO: 422474 - RNA, 22 nt, Bordetella pertussis
cgcaccagccugaugcgcagac

SEQ ID NO: 422475 - RNA, 20 nt, Bordetella pertussis
cgcaccagcgaguuguccug

SEQ ID NO: 422476 - RNA, 13 nt, Bordetella pertussis
cgcaccagcgcgc

SEQ ID NO: 422477 - RNA, 16 nt, Bordetella pertussis
cgcaccaggccgcggc

SEQ ID NO: 422478 - RNA, 20 nt, Bordetella pertussis
cgcaccaggccgcggcgccc

SEQ ID NO: 422479 - RNA, 14 nt, Bordetella pertussis
cgcaccaggccugc

SEQ ID NO: 422480 - RNA, 16 nt, Bordetella pertussis
cgcaccagcuuggccu

SEQ ID NO: 422481 - RNA, 21 nt, Bordetella pertussis
cgcaccaggcuggggccgagc

SEQ ID NO: 422482 - RNA, 24 nt, Bordetella pertussis
cgcaccagucccgcaccgaccagc

SEQ ID NO: 422483 - RNA, 15 nt, Bordetella pertussis
cgcaccaugcgcagc

SEQ ID NO: 422484 - RNA, 14 nt, Bordetella pertussis
cgcacccgccugga

SEQ ID NO: 422485 - RNA, 19 nt, Bordetella pertussis
cgcacccgguauccgcgca

SEQ ID NO: 422486 - RNA, 14 nt, Bordetella pertussis
cgcaccugcugcgg

SEQ ID NO: 422487 - RNA, 18 nt, Bordetella pertussis
cgcaccugggaggggccg

SEQ ID NO: 422488 - RNA, 13 nt, Bordetella pertussis
cgcaccugggcgu

SEQ ID NO: 422489 - RNA, 15 nt, Bordetella pertussis
cgcaccuugccugca

SEQ ID NO: 422490 - RNA, 18 nt, Bordetella pertussis
cgcaccuugucgcgcagc

SEQ ID NO: 422491 - RNA, 21 nt, Bordetella pertussis
cgcaccuugucgcgcagcgcc

SEQ ID NO: 422492 - RNA, 15 nt, Bordetella pertussis
cgcacgccgggcgcg

SEQ ID NO: 422493 - RNA, 14 nt, Bordetella pertussis
cgcacgcgcggcag

SEQ ID NO: 422494 - RNA, 19 nt, Bordetella pertussis
cgcacgcgcggcagcgccg

SEQ ID NO: 422495 - RNA, 21 nt, Bordetella pertussis
cgcacgcucuacacggccgcc

SEQ ID NO: 422496 - RNA, 19 nt, Bordetella pertussis
cgcacgcucugcaccuugg

SEQ ID NO: 422497 - RNA, 13 nt, Bordetella pertussis
cgcacgcugggcg

SEQ ID NO: 422498 - RNA, 19 nt, Bordetella pertussis
cgcacgcugggcuacgacc

SEQ ID NO: 422499 - RNA, 14 nt, Bordetella pertussis
cgcacggacagccc

SEQ ID NO: 422500 - RNA, 17 nt, Bordetella pertussis
cgcacggacagcccgcg

SEQ ID NO: 422501 - RNA, 23 nt, Bordetella pertussis
cgcacugagaaaggccgccacga

SEQ ID NO: 422502 - RNA, 19 nt, Bordetella pertussis
cgcacugagcuucgccccc

SEQ ID NO: 422503 - RNA, 16 nt, Bordetella pertussis
cgcacugaucgccgcc

SEQ ID NO: 422504 - RNA, 20 nt, Bordetella pertussis
cgcacuggguggccagcgcc

SEQ ID NO: 422505 - RNA, 18 nt, Bordetella pertussis
cgcagcagauugccgcgc

SEQ ID NO: 422506 - RNA, 23 nt, Bordetella pertussis
cgcagcagcgcgguggccagcga

SEQ ID NO: 422507 - RNA, 15 nt, Bordetella pertussis
cgcagcaggccagga

SEQ ID NO: 422508 - RNA, 13 nt, Bordetella pertussis
cgcagcaggccgc

SEQ ID NO: 422509 - RNA, 18 nt, Bordetella pertussis
cgcagcaggcgcgcggcc

SEQ ID NO: 422510 - RNA, 14 nt, Bordetella pertussis
cgcagcaggcgcgu

SEQ ID NO: 422511 - RNA, 13 nt, Bordetella pertussis
cgcagcaggcgcu

SEQ ID NO: 422512 - RNA, 18 nt, Bordetella pertussis
cgcagcaggcgcucggcc

SEQ ID NO: 422513 - RNA, 14 nt, Bordetella pertussis
cgcagcaggccgcg

SEQ ID NO: 422514 - RNA, 21 nt, Bordetella pertussis
cgcagcaguucggucagcgcg

SEQ ID NO: 422515 - RNA, 15 nt, Bordetella pertussis
cgcagcauggcgcca

SEQ ID NO: 422516 - RNA, 20 nt, Bordetella pertussis
cgcagcauggcgccagcugg

SEQ ID NO: 422517 - RNA, 21 nt, Bordetella pertussis
cgcagcauuucggcgccgccg

SEQ ID NO: 422518 - RNA, 13 nt, Bordetella pertussis
cgcagccacagcg

SEQ ID NO: 422519 - RNA, 15 nt, Bordetella pertussis
cgcagcccgcgcgcc

SEQ ID NO: 422520 - RNA, 16 nt, Bordetella pertussis
cgcagcccgcgcgccu

SEQ ID NO: 422521 - RNA, 15 nt, Bordetella pertussis
cgcagccgacaggcg

SEQ ID NO: 422522 - RNA, 17 nt, Bordetella pertussis
cgcagccgccagcgccu

SEQ ID NO: 422523 - RNA, 22 nt, Bordetella pertussis
cgcagccgccauaggcgcgcac

SEQ ID NO: 422524 - RNA, 13 nt, Bordetella pertussis
cgcagccgcccgg

SEQ ID NO: 422525 - RNA, 15 nt, Bordetella pertussis
cgcagccgcgcgccu

SEQ ID NO: 422526 - RNA, 14 nt, Bordetella pertussis
cgcagccggcugca

SEQ ID NO: 422527 - RNA, 21 nt, Bordetella pertussis
cgcagccgggcugccggcagc

SEQ ID NO: 422528 - RNA, 17 nt, Bordetella pertussis
cgcagccgucgcgcugc

SEQ ID NO: 422529 - RNA, 19 nt, Bordetella pertussis
cgcagcgaacggcccacgc

SEQ ID NO: 422530 - RNA, 19 nt, Bordetella pertussis
cgcagcgaggccucgugcu

SEQ ID NO: 422531 - RNA, 21 nt, Bordetella pertussis
cgcagcgaguagacgcagccg

SEQ ID NO: 422532 - RNA, 22 nt, Bordetella pertussis
cgcagcgcaccgacggcagccc

SEQ ID NO: 422533 - RNA, 15 nt, Bordetella pertussis
cgcagcgccaccggc

SEQ ID NO: 422534 - RNA, 14 nt, Bordetella pertussis
cgcagcgccacgcu

SEQ ID NO: 422535 - RNA, 15 nt, Bordetella pertussis
cgcagcgccgcgauu

SEQ ID NO: 422536 - RNA, 16 nt, Bordetella pertussis
cgcagcgcggcacgcu

SEQ ID NO: 422537 - RNA, 16 nt, Bordetella pertussis
cgcagcgcgucggcgc

SEQ ID NO: 422538 - RNA, 21 nt, Bordetella pertussis
cgcagcgcgugugguuggcgc

SEQ ID NO: 422539 - RNA, 17 nt, Bordetella pertussis
cgcagcggaugccgccc

SEQ ID NO: 422540 - RNA, 16 nt, Bordetella pertussis
cgcagcggcagcgcac

SEQ ID NO: 422541 - RNA, 18 nt, Bordetella pertussis
cgcagcggcaggcccugc

SEQ ID NO: 422542 - RNA, 15 nt, Bordetella pertussis
cgcagcggccaugga

SEQ ID NO: 422543 - RNA, 15 nt, Bordetella pertussis
cgcagcggcgcgcgc

SEQ ID NO: 422544 - RNA, 16 nt, Bordetella pertussis
cgcagcggcgcgcgca

SEQ ID NO: 422545 - RNA, 13 nt, Bordetella pertussis
cgcagcggcggcg

SEQ ID NO: 422546 - RNA, 21 nt, Bordetella pertussis
cgcagcgggcccgucgcgcca

SEQ ID NO: 422547 - RNA, 17 nt, Bordetella pertussis
cgcagcggggacaggcg

SEQ ID NO: 422548 - RNA, 23 nt, Bordetella pertussis
cgcagcuucuaucugccgcgcau

SEQ ID NO: 422549 - RNA, 24 nt, Bordetella pertussis
cgcagcuucuucuuugcccuggcc

SEQ ID NO: 422550 - RNA, 13 nt, Bordetella pertussis
cgcagcuugcccg

SEQ ID NO: 422551 - RNA, 19 nt, Bordetella pertussis
cgcaggacaaggcgcgcgc

SEQ ID NO: 422552 - RNA, 13 nt, Bordetella pertussis
cgcaggacggcgc

SEQ ID NO: 422553 - RNA, 15 nt, Bordetella pertussis
cgcaggacggcgccg

SEQ ID NO: 422554 - RNA, 13 nt, Bordetella pertussis
cgcaggagucgga

SEQ ID NO: 422555 - RNA, 13 nt, Bordetella pertussis
cgcaggaugcgcu

SEQ ID NO: 422556 - RNA, 15 nt, Bordetella pertussis
cgcaggcgcugcagc

SEQ ID NO: 422557 - RNA, 20 nt, Bordetella pertussis
cgcaggcggcggccuccagc

SEQ ID NO: 422558 - RNA, 15 nt, Bordetella pertussis
cgcaggcgggccucg

SEQ ID NO: 422559 - RNA, 17 nt, Bordetella pertussis
cgcaggcgggcgccgcg

SEQ ID NO: 422560 - RNA, 12 nt, Bordetella pertussis
cgcaggcgugcg

SEQ ID NO: 422561 - RNA, 17 nt, Bordetella pertussis
cgcaggcgugcgcgggc

SEQ ID NO: 422562 - RNA, 19 nt, Bordetella pertussis
cgcaggcgugcgcgggcgc

SEQ ID NO: 422563 - RNA, 15 nt, Bordetella pertussis
cgcagggacaggcuc

SEQ ID NO: 422564 - RNA, 19 nt, Bordetella pertussis
cgcaggugccuguccccac

SEQ ID NO: 422565 - RNA, 20 nt, Bordetella pertussis
cgcagguggggcagcaggcc

SEQ ID NO: 422566 - RNA, 21 nt, Bordetella pertussis
cgcaguaucuggugcgcgucc

SEQ ID NO: 422567 - RNA, 23 nt, Bordetella pertussis
cgcaguccaaggaaagcccggcc

SEQ ID NO: 422568 - RNA, 17 nt, Bordetella pertussis
cgcagucgagcaccgcg

SEQ ID NO: 422569 - RNA, 18 nt, Bordetella pertussis
cgcauacaacuucagcca

SEQ ID NO: 422570 - RNA, 20 nt, Bordetella pertussis
cgcauacaacuucagccagc

SEQ ID NO: 422571 - RNA, 15 nt, Bordetella pertussis
cgcauaccggccgcg

SEQ ID NO: 422572 - RNA, 15 nt, Bordetella pertussis
cgccacacgggcgcc

SEQ ID NO: 422573 - RNA, 17 nt, Bordetella pertussis
cgccacacgggcgccug

SEQ ID NO: 422574 - RNA, 18 nt, Bordetella pertussis
cgccacacgggcgccugc

SEQ ID NO: 422575 - RNA, 22 nt, Bordetella pertussis
cgccacagcaugaccucggccu

SEQ ID NO: 422576 - RNA, 13 nt, Bordetella pertussis
cgccacagcgcca

SEQ ID NO: 422577 - RNA, 14 nt, Bordetella pertussis
cgccacagcgccgc

SEQ ID NO: 422578 - RNA, 21 nt, Bordetella pertussis
cgccacaggcugacgcccggc

SEQ ID NO: 422579 - RNA, 13 nt, Bordetella pertussis
cgccacagggccu

SEQ ID NO: 422580 - RNA, 14 nt, Bordetella pertussis
cgccacagggccug

SEQ ID NO: 422581 - RNA, 15 nt, Bordetella pertussis
cgccacagggccuga

SEQ ID NO: 422582 - RNA, 15 nt, Bordetella pertussis
cgccaccacgcgcac

SEQ ID NO: 422583 - RNA, 14 nt, Bordetella pertussis
cgccaccagcagcg

SEQ ID NO: 422584 - RNA, 14 nt, Bordetella pertussis
cgccaccaggccga

SEQ ID NO: 422585 - RNA, 18 nt, Bordetella pertussis
cgccaccagggcgcccgc

SEQ ID NO: 422586 - RNA, 13 nt, Bordetella pertussis
cgccaccagugcg

SEQ ID NO: 422587 - RNA, 18 nt, Bordetella pertussis
cgccaccagugcgccggc

SEQ ID NO: 422588 - RNA, 13 nt, Bordetella pertussis
cgccaccaggccg

SEQ ID NO: 422589 - RNA, 14 nt, Bordetella pertussis
cgccacccagggcu

SEQ ID NO: 422590 - RNA, 22 nt, Bordetella pertussis
cgccaccguggccacggccgcg

SEQ ID NO: 422591 - RNA, 19 nt, Bordetella pertussis
cgccaccugggccgccugc

SEQ ID NO: 422592 - RNA, 19 nt, Bordetella pertussis
cgccaccuucgccgcgcac

SEQ ID NO: 422593 - RNA, 18 nt, Bordetella pertussis
cgccacgaagugcgcccc

SEQ ID NO: 422594 - RNA, 20 nt, Bordetella pertussis
cgccacgauguagccgaccc

SEQ ID NO: 422595 - RNA, 13 nt, Bordetella pertussis
cgccacggcgccc

SEQ ID NO: 422596 - RNA, 20 nt, Bordetella pertussis
cgccacggcuucgcccagcg

SEQ ID NO: 422597 - RNA, 19 nt, Bordetella pertussis
cgccacgggcgucaccggc

SEQ ID NO: 422598 - RNA, 17 nt, Bordetella pertussis
cgccacggucgcgagcu

SEQ ID NO: 422599 - RNA, 18 nt, Bordetella pertussis
cgccacggucgcgagcug

SEQ ID NO: 422600 - RNA, 19 nt, Bordetella pertussis
cgccacggucugcacgccg

SEQ ID NO: 422601 - RNA, 23 nt, Bordetella pertussis
cgccacguccagcacggccgcgg

SEQ ID NO: 422602 - RNA, 17 nt, Bordetella pertussis
cgccacgucgccggcgu

SEQ ID NO: 422603 - RNA, 21 nt, Bordetella pertussis
cgccacguugaagcgcagcca

SEQ ID NO: 422604 - RNA, 13 nt, Bordetella pertussis
cgccagcaccggc

SEQ ID NO: 422605 - RNA, 16 nt, Bordetella pertussis
cgccagcaccugcuug

SEQ ID NO: 422606 - RNA, 15 nt, Bordetella pertussis
cgccagcacgcgcag

SEQ ID NO: 422607 - RNA, 20 nt, Bordetella pertussis
cgccagcacgcgcagcuugc

SEQ ID NO: 422608 - RNA, 13 nt, Bordetella pertussis
cgccagcagcgcc

SEQ ID NO: 422609 - RNA, 14 nt, Bordetella pertussis
cgccagcaggcgcu

SEQ ID NO: 422610 - RNA, 20 nt, Bordetella pertussis
cgccagcauggcggccaggc

SEQ ID NO: 422611 - RNA, 17 nt, Bordetella pertussis
cgccagcaugcgcgcgg

SEQ ID NO: 422612 - RNA, 15 nt, Bordetella pertussis
cgccagcccgacggc

SEQ ID NO: 422613 - RNA, 14 nt, Bordetella pertussis
cgccagcccgcccg

SEQ ID NO: 422614 - RNA, 14 nt, Bordetella pertussis
cgccagcccgccgc

SEQ ID NO: 422615 - RNA, 15 nt, Bordetella pertussis
cgccagcccgccggc

SEQ ID NO: 422616 - RNA, 17 nt, Bordetella pertussis
cgccagcccgccggcgc

SEQ ID NO: 422617 - RNA, 20 nt, Bordetella pertussis
cgccagccgcgccugcagca

SEQ ID NO: 422618 - RNA, 14 nt, Bordetella pertussis
cgccagccgcgcga

SEQ ID NO: 422619 - RNA, 17 nt, Bordetella pertussis
cgccagccgcuccagga

SEQ ID NO: 422620 - RNA, 13 nt, Bordetella pertussis
cgccagccgcugg

SEQ ID NO: 422621 - RNA, 20 nt, Bordetella pertussis
cgccagccgcuggcgcgccg

SEQ ID NO: 422622 - RNA, 18 nt, Bordetella pertussis
cgccagccggcccagcac

SEQ ID NO: 422623 - RNA, 14 nt, Bordetella pertussis
cgccagccggcccg

SEQ ID NO: 422624 - RNA, 15 nt, Bordetella pertussis
cgccagccguugcgc

SEQ ID NO: 422625 - RNA, 18 nt, Bordetella pertussis
cgccagcgccacgcgagc

SEQ ID NO: 422626 - RNA, 14 nt, Bordetella pertussis
cgccagcgccgcgu

SEQ ID NO: 422627 - RNA, 15 nt, Bordetella pertussis
cgccagcgccggcgc

SEQ ID NO: 422628 - RNA, 16 nt, Bordetella pertussis
cgccagcgccggcgcg

SEQ ID NO: 422629 - RNA, 15 nt, Bordetella pertussis
cgccagcgccuccau

SEQ ID NO: 422630 - RNA, 13 nt, Bordetella pertussis
cgccagcgccugg

SEQ ID NO: 422631 - RNA, 14 nt, Bordetella pertussis
cgccagcgccugga

SEQ ID NO: 422632 - RNA, 21 nt, Bordetella pertussis
cgccagcgcgaaaacccgcgg

SEQ ID NO: 422633 - RNA, 13 nt, Bordetella pertussis
cgccagcgcgcca

SEQ ID NO: 422634 - RNA, 13 nt, Bordetella pertussis
cgccagcgcgccg

SEQ ID NO: 422635 - RNA, 12 nt, Bordetella pertussis
cgccagcgcggc

SEQ ID NO: 422636 - RNA, 16 nt, Bordetella pertussis
cgccagcgcggccagc

SEQ ID NO: 422637 - RNA, 18 nt, Bordetella pertussis
cgccagcgcuguccaggc

SEQ ID NO: 422638 - RNA, 15 nt, Bordetella pertussis
cgccagcggccgucg

SEQ ID NO: 422639 - RNA, 14 nt, Bordetella pertussis
cgccagcggcuggc

SEQ ID NO: 422640 - RNA, 15 nt, Bordetella pertussis
cgccagcucgcgcag

SEQ ID NO: 422641 - RNA, 19 nt, Bordetella pertussis
cgccagcucggccaaggca

SEQ ID NO: 422642 - RNA, 14 nt, Bordetella pertussis
cgccagcugggcga

SEQ ID NO: 422643 - RNA, 17 nt, Bordetella pertussis
cgccagcuugcgcgccu

SEQ ID NO: 422644 - RNA, 18 nt, Bordetella pertussis
cgccaggaagcgcgccgc

SEQ ID NO: 422645 - RNA, 19 nt, Bordetella pertussis
cgccaggaagcgggccugc

SEQ ID NO: 422646 - RNA, 21 nt, Bordetella pertussis
cgccaggacgggaaagcggcg

SEQ ID NO: 422647 - RNA, 14 nt, Bordetella pertussis
cgccaggcauugaa

SEQ ID NO: 422648 - RNA, 13 nt, Bordetella pertussis
cgccaggccaggu

SEQ ID NO: 422649 - RNA, 15 nt, Bordetella pertussis
cgccaggccggcggc

SEQ ID NO: 422650 - RNA, 14 nt, Bordetella pertussis
cgccaggcgcgcau

SEQ ID NO: 422651 - RNA, 20 nt, Bordetella pertussis
cgccaggcgcgcaucgcgcg

SEQ ID NO: 422652 - RNA, 23 nt, Bordetella pertussis
cgccaggcgcgcaucgcgcggca

SEQ ID NO: 422653 - RNA, 24 nt, Bordetella pertussis
cgccaggcgcucggcguugcuggc

SEQ ID NO: 422654 - RNA, 14 nt, Bordetella pertussis
cgccaggcgcugcg

SEQ ID NO: 422655 - RNA, 22 nt, Bordetella pertussis
cgccaggcgguacaggccggcg

SEQ ID NO: 422656 - RNA, 22 nt, Bordetella pertussis
cgccaggcggucauagacggcg

SEQ ID NO: 422657 - RNA, 14 nt, Bordetella pertussis
cgccagggccaggc

SEQ ID NO: 422658 - RNA, 16 nt, Bordetella pertussis
cgccagggccaggccg

SEQ ID NO: 422659 - RNA, 17 nt, Bordetella pertussis
cgccagggccaggccgc

SEQ ID NO: 422660 - RNA, 19 nt, Bordetella pertussis
cgccagggccgccgcgccc

SEQ ID NO: 422661 - RNA, 14 nt, Bordetella pertussis
cgccagggcggggc

SEQ ID NO: 422662 - RNA, 16 nt, Bordetella pertussis
cgccagguaggccggc

SEQ ID NO: 422663 - RNA, 15 nt, Bordetella pertussis
cgccaggucgcgcac

SEQ ID NO: 422664 - RNA, 14 nt, Bordetella pertussis
cgccaggucggcca

SEQ ID NO: 422665 - RNA, 17 nt, Bordetella pertussis
cgccaggucggccaccg

SEQ ID NO: 422666 - RNA, 17 nt, Bordetella pertussis
cgccaguccagcgcgcc

SEQ ID NO: 422667 - RNA, 18 nt, Bordetella pertussis
cgccaguccagcgcgccg

SEQ ID NO: 422668 - RNA, 19 nt, Bordetella pertussis
cgccaguccgcgcucgccc

SEQ ID NO: 422669 - RNA, 14 nt, Bordetella pertussis
cgccagucgcgcag

SEQ ID NO: 422670 - RNA, 16 nt, Bordetella pertussis
cgccagucgcgcagca

SEQ ID NO: 422671 - RNA, 19 nt, Bordetella pertussis
cgccaguugcggggcgccc

SEQ ID NO: 422672 - RNA, 20 nt, Bordetella pertussis
cgccaguugcggggcgccca

SEQ ID NO: 422673 - RNA, 13 nt, Bordetella pertussis
cgccaguuguagg

SEQ ID NO: 422674 - RNA, 22 nt, Bordetella pertussis
cgccauaggcgcgcaccagccc

SEQ ID NO: 422675 - RNA, 22 nt, Bordetella pertussis
cgccauaugcgcgaaguggcca

SEQ ID NO: 422676 - RNA, 19 nt, Bordetella pertussis
cgccaucaucgcgauccuc

SEQ ID NO: 422677 - RNA, 20 nt, Bordetella pertussis
cgccaucauggcgucggcca

SEQ ID NO: 422678 - RNA, 23 nt, Bordetella pertussis
cgccaucauggcgucggccacgu

SEQ ID NO: 422679 - RNA, 18 nt, Bordetella pertussis
cgccauccuggccgccgc

SEQ ID NO: 422680 - RNA, 20 nt, Bordetella pertussis
cgccauccuggccgccgcgg

SEQ ID NO: 422681 - RNA, 14 nt, Bordetella pertussis
cgccaucgccagga

SEQ ID NO: 422682 - RNA, 21 nt, Bordetella pertussis
cgccaucgucguagcgccagc

SEQ ID NO: 422683 - RNA, 22 nt, Bordetella pertussis
cgccaucuaccugucgggcggc

SEQ ID NO: 422684 - RNA, 16 nt, Bordetella pertussis
cgccaucucgcgcgcu

SEQ ID NO: 422685 - RNA, 16 nt, Bordetella pertussis
cgccaugaacucgcgc

SEQ ID NO: 422686 - RNA, 21 nt, Bordetella pertussis
cgccaugagcgcuugacggcc

SEQ ID NO: 422687 - RNA, 20 nt, Bordetella pertussis
cgccaugcagcuggauggcc

SEQ ID NO: 422688 - RNA, 14 nt, Bordetella pertussis
cgccaugccggccc

SEQ ID NO: 422689 - RNA, 20 nt, Bordetella pertussis
cgccaugcgauacagcuugg

SEQ ID NO: 422690 - RNA, 17 nt, Bordetella pertussis
cgccaugcgcccggcca

SEQ ID NO: 422691 - RNA, 13 nt, Bordetella pertussis
cgccaugcggcgc

SEQ ID NO: 422692 - RNA, 21 nt, Bordetella pertussis
cgccaugcuggccgccgcgcu

SEQ ID NO: 422693 - RNA, 19 nt, Bordetella pertussis
cgccauggccggccgccgg

SEQ ID NO: 422694 - RNA, 13 nt, Bordetella pertussis
cgccauggcggcc

SEQ ID NO: 422695 - RNA, 15 nt, Bordetella pertussis
cgccauggcggccgc

SEQ ID NO: 422696 - RNA, 16 nt, Bordetella pertussis
cgccauggcggccgcc

SEQ ID NO: 422697 - RNA, 13 nt, Bordetella pertussis
cgcccaacccggc

SEQ ID NO: 422698 - RNA, 15 nt, Bordetella pertussis
cgcccaacccggcga

SEQ ID NO: 422699 - RNA, 23 nt, Bordetella pertussis
cgcccacaggaacaggccggccu

SEQ ID NO: 422700 - RNA, 19 nt, Bordetella pertussis
cgcccacauagcggccggc

SEQ ID NO: 422701 - RNA, 13 nt, Bordetella pertussis
cgcccaccagggu

SEQ ID NO: 422702 - RNA, 17 nt, Bordetella pertussis
cgcccaccacgccgccc

SEQ ID NO: 422703 - RNA, 15 nt, Bordetella pertussis
cgcccacgccgccug

SEQ ID NO: 422704 - RNA, 15 nt, Bordetella pertussis
cgcccacgcgccgcc

SEQ ID NO: 422705 - RNA, 18 nt, Bordetella pertussis
cgcccacgcgccgccagg

SEQ ID NO: 422706 - RNA, 14 nt, Bordetella pertussis
cgcccacgcggcgc

SEQ ID NO: 422707 - RNA, 15 nt, Bordetella pertussis
cgcccacgcggcgcu

SEQ ID NO: 422708 - RNA, 18 nt, Bordetella pertussis
cgcccacggccgcaugcg

SEQ ID NO: 422709 - RNA, 22 nt, Bordetella pertussis
cgcccacuuccucggcgcgcgc

SEQ ID NO: 422710 - RNA, 18 nt, Bordetella pertussis
cgcccagaaugcggcgga

SEQ ID NO: 422711 - RNA, 11 nt, Bordetella pertussis
cgcccagcaga

SEQ ID NO: 422712 - RNA, 20 nt, Bordetella pertussis
cgcccagcagauaccggcau

SEQ ID NO: 422713 - RNA, 23 nt, Bordetella pertussis
cgcccagcagauaccggcauggc

SEQ ID NO: 422714 - RNA, 14 nt, Bordetella pertussis
cgcccagcagcgcc

SEQ ID NO: 422715 - RNA, 15 nt, Bordetella pertussis
cgcccagcagcgcca

SEQ ID NO: 422716 - RNA, 16 nt, Bordetella pertussis
cgcccagcauccgcgc

SEQ ID NO: 422717 - RNA, 12 nt, Bordetella pertussis
cgcccagccccg

SEQ ID NO: 422718 - RNA, 13 nt, Bordetella pertussis
cgcccagcccugc

SEQ ID NO: 422719 - RNA, 17 nt, Bordetella pertussis
cgcccagcccugcccgc

SEQ ID NO: 422720 - RNA, 13 nt, Bordetella pertussis
cgcccagccgcgc

SEQ ID NO: 422721 - RNA, 13 nt, Bordetella pertussis
cgcccagccugcc

SEQ ID NO: 422722 - RNA, 14 nt, Bordetella pertussis
cgcccagccugccg

SEQ ID NO: 422723 - RNA, 19 nt, Bordetella pertussis
cgcccagccugccggcggc

SEQ ID NO: 422724 - RNA, 20 nt, Bordetella pertussis
cgcccagccugccggcggcc

SEQ ID NO: 422725 - RNA, 19 nt, Bordetella pertussis
cgcccagccaggcgccagc

SEQ ID NO: 422726 - RNA, 20 nt, Bordetella pertussis
cgcccagcgagccggccagc

SEQ ID NO: 422727 - RNA, 12 nt, Bordetella pertussis
cgcccagcgcca

SEQ ID NO: 422728 - RNA, 16 nt, Bordetella pertussis
cgcccagcgccggcac

SEQ ID NO: 422729 - RNA, 19 nt, Bordetella pertussis
cgcccagcgccggcacgcu

SEQ ID NO: 422730 - RNA, 14 nt, Bordetella pertussis
cgcccagcgcgucg

SEQ ID NO: 422731 - RNA, 20 nt, Bordetella pertussis
cgcccagcgcgucggccagc

SEQ ID NO: 422732 - RNA, 21 nt, Bordetella pertussis
cgcccagcgcuugcacgccau

SEQ ID NO: 422733 - RNA, 13 nt, Bordetella pertussis
cgcccagcggcgc

SEQ ID NO: 422734 - RNA, 12 nt, Bordetella pertussis
cgcccagcucca

SEQ ID NO: 422735 - RNA, 16 nt, Bordetella pertussis
cgcccagcuggcgccc

SEQ ID NO: 422736 - RNA, 17 nt, Bordetella pertussis
cgcccagcuggcgcccc

SEQ ID NO: 422737 - RNA, 15 nt, Bordetella pertussis
cgcccagcuugagau

SEQ ID NO: 422738 - RNA, 17 nt, Bordetella pertussis
cgcccaggccagccagg

SEQ ID NO: 422739 - RNA, 16 nt, Bordetella pertussis
cgcccaggcccaccgc

SEQ ID NO: 422740 - RNA, 19 nt, Bordetella pertussis
cgcccaggcgaugcccagc

SEQ ID NO: 422741 - RNA, 20 nt, Bordetella pertussis
cgcccaggggccggcgcgcc

SEQ ID NO: 422742 - RNA, 21 nt, Bordetella pertussis
cgcccagguccgaaccgaccg

SEQ ID NO: 422743 - RNA, 20 nt, Bordetella pertussis
cgcccagguccugcgccagc

SEQ ID NO: 422744 - RNA, 19 nt, Bordetella pertussis
cgcccagggugguggccuc

SEQ ID NO: 422745 - RNA, 15 nt, Bordetella pertussis
cgcccagguugcggc

SEQ ID NO: 422746 - RNA, 19 nt, Bordetella pertussis
cgcccagguugcggccgcc

SEQ ID NO: 422747 - RNA, 21 nt, Bordetella pertussis
cgcccagguugcggccgccac

SEQ ID NO: 422748 - RNA, 20 nt, Bordetella pertussis
cgcccaguuccacgcggccg

SEQ ID NO: 422749 - RNA, 23 nt, Bordetella pertussis
cgcccaugcgggcguagaaagcc

SEQ ID NO: 422750 - RNA, 22 nt, Bordetella pertussis
cgcccaugcugaauugcgggcc

SEQ ID NO: 422751 - RNA, 22 nt, Bordetella pertussis
cgcccauguagaacgccagggu

SEQ ID NO: 422752 - RNA, 16 nt, Bordetella pertussis
cgcccauggcgcgcag

SEQ ID NO: 422753 - RNA, 16 nt, Bordetella pertussis
cgcccauugcggcggg

SEQ ID NO: 422754 - RNA, 16 nt, Bordetella pertussis
cgccccaacgcggcca

SEQ ID NO: 422755 - RNA, 12 nt, Bordetella pertussis
cgccccagcagc

SEQ ID NO: 422756 - RNA, 17 nt, Bordetella pertussis
cgccccauugggacgcc

SEQ ID NO: 422757 - RNA, 20 nt, Bordetella pertussis
cgccccauugggacgccagc

SEQ ID NO: 422758 - RNA, 15 nt, Bordetella pertussis
cgcccccacgccgcu

SEQ ID NO: 422759 - RNA, 13 nt, Bordetella pertussis
cgccccccgaggc

SEQ ID NO: 422760 - RNA, 16 nt, Bordetella pertussis
cgcccccgcggcgccc

SEQ ID NO: 422761 - RNA, 12 nt, Bordetella pertussis
cgcccccgccgc

SEQ ID NO: 422762 - RNA, 15 nt, Bordetella pertussis
cgccccgacgcgcuu

SEQ ID NO: 422763 - RNA, 16 nt, Bordetella pertussis
cgccccggcgcggcgc

SEQ ID NO: 422764 - RNA, 18 nt, Bordetella pertussis
cgccccggcgcggcgcgc

SEQ ID NO: 422765 - RNA, 18 nt, Bordetella pertussis
cgccccgucaucgggugc

SEQ ID NO: 422766 - RNA, 11 nt, Bordetella pertussis
cgccccuagcg

SEQ ID NO: 422767 - RNA, 16 nt, Bordetella pertussis
cgccccuagcgccgcg

SEQ ID NO: 422768 - RNA, 22 nt, Bordetella pertussis
cgccccuucagcuuccagguac

SEQ ID NO: 422769 - RNA, 15 nt, Bordetella pertussis
cgcccgaaccggcau

SEQ ID NO: 422770 - RNA, 14 nt, Bordetella pertussis
cgcccgaccugcug

SEQ ID NO: 422771 - RNA, 22 nt, Bordetella pertussis
cgcccgacgaggagccggcggg

SEQ ID NO: 422772 - RNA, 17 nt, Bordetella pertussis
cgcccgacggcgcgccc

SEQ ID NO: 422773 - RNA, 22 nt, Bordetella pertussis
cgcccgacggcgcgcccgccgc

SEQ ID NO: 422774 - RNA, 23 nt, Bordetella pertussis
cgcccgacgguaucucagcgcgc

SEQ ID NO: 422775 - RNA, 23 nt, Bordetella pertussis
cgcccgagagcugcgucuugagc

SEQ ID NO: 422776 - RNA, 17 nt, Bordetella pertussis
cgcccgagcuggccggc

SEQ ID NO: 422777 - RNA, 16 nt, Bordetella pertussis
cgcccgaucggccggc

SEQ ID NO: 422778 - RNA, 17 nt, Bordetella pertussis
cgcccgaucggccggcc

SEQ ID NO: 422779 - RNA, 19 nt, Bordetella pertussis
cgcccgaucggccggccgg

SEQ ID NO: 422780 - RNA, 16 nt, Bordetella pertussis
cgcccgaugcucgccg

SEQ ID NO: 422781 - RNA, 22 nt, Bordetella pertussis
cgcccgcaacgggccggccgcc

SEQ ID NO: 422782 - RNA, 21 nt, Bordetella pertussis
cgcccgcacgaugccgaccga

SEQ ID NO: 422783 - RNA, 13 nt, Bordetella pertussis
cgcccgccccggc

SEQ ID NO: 422784 - RNA, 11 nt, Bordetella pertussis
cgcccgcccgc

SEQ ID NO: 422785 - RNA, 16 nt, Bordetella pertussis
cgcccgcccgccgccu

SEQ ID NO: 422786 - RNA, 15 nt, Bordetella pertussis
cgcccgccugcagca

SEQ ID NO: 422787 - RNA, 22 nt, Bordetella pertussis
cgcccgccugcgccagccgcgc

SEQ ID NO: 422788 - RNA, 20 nt, Bordetella pertussis
cgcccgccuucggcggcggg

SEQ ID NO: 422789 - RNA, 12 nt, Bordetella pertussis
cgcccgcgccga

SEQ ID NO: 422790 - RNA, 18 nt, Bordetella pertussis
cgcccgcgcgcgagcugc

SEQ ID NO: 422791 - RNA, 23 nt, Bordetella pertussis
cgcccgcgcgguauugcgccacc

SEQ ID NO: 422792 - RNA, 12 nt, Bordetella pertussis
cgcccgcggcgc

SEQ ID NO: 422793 - RNA, 14 nt, Bordetella pertussis
cgcccgcggcgccc

SEQ ID NO: 422794 - RNA, 17 nt, Bordetella pertussis
cgcccgcggcgcccagc

SEQ ID NO: 422795 - RNA, 13 nt, Bordetella pertussis
cgcccgcguacag

SEQ ID NO: 422796 - RNA, 17 nt, Bordetella pertussis
cgcccgcuacgcgggcu

SEQ ID NO: 422797 - RNA, 19 nt, Bordetella pertussis
cgcccgcuccaccagcacc

SEQ ID NO: 422798 - RNA, 15 nt, Bordetella pertussis
cgcccgcugaccggc

SEQ ID NO: 422799 - RNA, 18 nt, Bordetella pertussis
cgcccgcugaccggccug

SEQ ID NO: 422800 - RNA, 20 nt, Bordetella pertussis
cgcccgcugaccggccuggu

SEQ ID NO: 422801 - RNA, 12 nt, Bordetella pertussis
cgcccgcugacc

SEQ ID NO: 422802 - RNA, 20 nt, Bordetella pertussis
cgcccgcuucuuccuugcga

SEQ ID NO: 422803 - RNA, 21 nt, Bordetella pertussis
cgcccgcuugcggccggcgcu

SEQ ID NO: 422804 - RNA, 13 nt, Bordetella pertussis
cgcccggccgccu

SEQ ID NO: 422805 - RNA, 14 nt, Bordetella pertussis
cgcccggccgccuc

SEQ ID NO: 422806 - RNA, 15 nt, Bordetella pertussis
cgcccggccgccuca

SEQ ID NO: 422807 - RNA, 13 nt, Bordetella pertussis
cgcccggccggcc

SEQ ID NO: 422808 - RNA, 14 nt, Bordetella pertussis
cgcccggccggccc

SEQ ID NO: 422809 - RNA, 22 nt, Bordetella pertussis
cgcccggccggcccgcgcgccu

SEQ ID NO: 422810 - RNA, 14 nt, Bordetella pertussis
cgcccggccggccu

SEQ ID NO: 422811 - RNA, 14 nt, Bordetella pertussis
cgcccggcgccgcg

SEQ ID NO: 422812 - RNA, 14 nt, Bordetella pertussis
cgcccggcgcgccu

SEQ ID NO: 422813 - RNA, 13 nt, Bordetella pertussis
cgcccggcggcgc

SEQ ID NO: 422814 - RNA, 19 nt, Bordetella pertussis
cgcccggcggcgcgccgcc

SEQ ID NO: 422815 - RNA, 16 nt, Bordetella pertussis
cgcccggcggcgcgcu

SEQ ID NO: 422816 - RNA, 18 nt, Bordetella pertussis
cgcccggcggcgcggcga

SEQ ID NO: 422817 - RNA, 20 nt, Bordetella pertussis
cgcccggcgugacgcugacc

SEQ ID NO: 422818 - RNA, 13 nt, Bordetella pertussis
cgcccgggccguc

SEQ ID NO: 422819 - RNA, 13 nt, Bordetella pertussis
cgcccgggcgccg

SEQ ID NO: 422820 - RNA, 15 nt, Bordetella pertussis
cgcccgggcgccggc

SEQ ID NO: 422821 - RNA, 21 nt, Bordetella pertussis
cgcccggggugugccgaugcu

SEQ ID NO: 422822 - RNA, 22 nt, Bordetella pertussis
cgcccggugcgcgcagggcggc

SEQ ID NO: 422823 - RNA, 20 nt, Bordetella pertussis
cgcccggugcguaccagccc

SEQ ID NO: 422824 - RNA, 15 nt, Bordetella pertussis
cgcccggugccugcc

SEQ ID NO: 422825 - RNA, 20 nt, Bordetella pertussis
cgcccgucccgacccccggc

SEQ ID NO: 422826 - RNA, 16 nt, Bordetella pertussis
cgcccguccgggcggc

SEQ ID NO: 422827 - RNA, 17 nt, Bordetella pertussis
cgcccguccgggcggcg

SEQ ID NO: 422828 - RNA, 17 nt, Bordetella pertussis
cgcccgucucgcgcgcc

SEQ ID NO: 422829 - RNA, 18 nt, Bordetella pertussis
cgcccgucucgcgcgcca

SEQ ID NO: 422830 - RNA, 21 nt, Bordetella pertussis
cgcccgucucgcgcgccaggu

SEQ ID NO: 422831 - RNA, 23 nt, Bordetella pertussis
cgcccgugcagaagcugaccacc

SEQ ID NO: 422832 - RNA, 14 nt, Bordetella pertussis
cgcccgugccgcag

SEQ ID NO: 422833 - RNA, 13 nt, Bordetella pertussis
cgcccgugcgcgg

SEQ ID NO: 422834 - RNA, 20 nt, Bordetella pertussis
cgcccgugcuuuugaacucc

SEQ ID NO: 422835 - RNA, 18 nt, Bordetella pertussis
cgcccguugcggcgccuc

SEQ ID NO: 422836 - RNA, 20 nt, Bordetella pertussis
cgcccucguugacgccgacg

SEQ ID NO: 422837 - RNA, 13 nt, Bordetella pertussis
cgcccucgccccc

SEQ ID NO: 422838 - RNA, 22 nt, Bordetella pertussis
cgcccugaacuauggcgcgcgc

SEQ ID NO: 422839 - RNA, 17 nt, Bordetella pertussis
cgcccugacgccugcgc

SEQ ID NO: 422840 - RNA, 16 nt, Bordetella pertussis
cgcccugcacgcgcgc

SEQ ID NO: 422841 - RNA, 17 nt, Bordetella pertussis
cgcccugcacgcgcgcg

SEQ ID NO: 422842 - RNA, 20 nt, Bordetella pertussis
cgcccugcagggcaugggcc

SEQ ID NO: 422843 - RNA, 22 nt, Bordetella pertussis
cgcccugcagggcaugggcccg

SEQ ID NO: 422844 - RNA, 13 nt, Bordetella pertussis
cgcccugcccggc

SEQ ID NO: 422845 - RNA, 16 nt, Bordetella pertussis
cgcccugcccggcgag

SEQ ID NO: 422846 - RNA, 23 nt, Bordetella pertussis
cgcccugcgcguacguggcgcgg

SEQ ID NO: 422847 - RNA, 19 nt, Bordetella pertussis
cgcccuggauggcggccgc

SEQ ID NO: 422848 - RNA, 20 nt, Bordetella pertussis
cgcccuggauggcggccgcc

SEQ ID NO: 422849 - RNA, 23 nt, Bordetella pertussis
cgcccuggauggcggccgccagc

SEQ ID NO: 422850 - RNA, 20 nt, Bordetella pertussis
cgcccuggcagcuggcgcgg

SEQ ID NO: 422851 - RNA, 22 nt, Bordetella pertussis
cgcccuggcagcuggcgcgggc

SEQ ID NO: 422852 - RNA, 12 nt, Bordetella pertussis
cgcccuggccuu

SEQ ID NO: 422853 - RNA, 13 nt, Bordetella pertussis
cgcccuggcgcag

SEQ ID NO: 422854 - RNA, 16 nt, Bordetella pertussis
cgcccuggcgcaggcc

SEQ ID NO: 422855 - RNA, 20 nt, Bordetella pertussis
cgcccuggcguggcgcgcgc

SEQ ID NO: 422856 - RNA, 18 nt, Bordetella pertussis
cgcccuggcuggcggccc

SEQ ID NO: 422857 - RNA, 19 nt, Bordetella pertussis
cgcccuggcgcgaggcggc

SEQ ID NO: 422858 - RNA, 16 nt, Bordetella pertussis
cgcccuggcgcggcgg

SEQ ID NO: 422859 - RNA, 15 nt, Bordetella pertussis
cgcccuucagguagc

SEQ ID NO: 422860 - RNA, 18 nt, Bordetella pertussis
cgcccuugaugccgucgg

SEQ ID NO: 422861 - RNA, 19 nt, Bordetella pertussis
cgcccuugauggccucggc

SEQ ID NO: 422862 - RNA, 22 nt, Bordetella pertussis
cgcccuugauggccucggcggc

SEQ ID NO: 422863 - RNA, 18 nt, Bordetella pertussis
cgcccuugccagggccug

SEQ ID NO: 422864 - RNA, 21 nt, Bordetella pertussis
cgcccuugagcacggcgcggc

SEQ ID NO: 422865 - RNA, 23 nt, Bordetella pertussis
cgcccuugccguuguccgccugc

SEQ ID NO: 422866 - RNA, 21 nt, Bordetella pertussis
cgcccuugggcaucaggggcu

SEQ ID NO: 422867 - RNA, 19 nt, Bordetella pertussis
cgcccuuggucaccgagag

SEQ ID NO: 422868 - RNA, 17 nt, Bordetella pertussis
cgccgaaauuggcgacg

SEQ ID NO: 422869 - RNA, 21 nt, Bordetella pertussis
cgccgaacaagguccaggccc

SEQ ID NO: 422870 - RNA, 23 nt, Bordetella pertussis
cgccgaacaccagcucggcggcg

SEQ ID NO: 422871 - RNA, 14 nt, Bordetella pertussis
cgccgaaccagcgc

SEQ ID NO: 422872 - RNA, 15 nt, Bordetella pertussis
cgccgaagcaaugca

SEQ ID NO: 422873 - RNA, 15 nt, Bordetella pertussis
cgccgaacugccggc

SEQ ID NO: 422874 - RNA, 18 nt, Bordetella pertussis
cgccgaagcgcaggccuu

SEQ ID NO: 422875 - RNA, 21 nt, Bordetella pertussis
cgccgaagucggcgcgcgcuu

SEQ ID NO: 422876 - RNA, 13 nt, Bordetella pertussis
cgccgaauacgcu

SEQ ID NO: 422877 - RNA, 20 nt, Bordetella pertussis
cgccgaauacgcucaggguu

SEQ ID NO: 422878 - RNA, 17 nt, Bordetella pertussis
cgccgaauugcuggagc

SEQ ID NO: 422879 - RNA, 19 nt, Bordetella pertussis
cgccgacccgggcgggcgu

SEQ ID NO: 422880 - RNA, 14 nt, Bordetella pertussis
cgccgaccgggccg

SEQ ID NO: 422881 - RNA, 16 nt, Bordetella pertussis
cgccgaccuggcgccc

SEQ ID NO: 422882 - RNA, 23 nt, Bordetella pertussis
cgccgacgaugccgcccacgcca

SEQ ID NO: 422883 - RNA, 21 nt, Bordetella pertussis
cgccgacggcauggccggcag

SEQ ID NO: 422884 - RNA, 14 nt, Bordetella pertussis
cgccgacggcgccc

SEQ ID NO: 422885 - RNA, 20 nt, Bordetella pertussis
cgccgacggcggcgcggcgc

SEQ ID NO: 422886 - RNA, 14 nt, Bordetella pertussis
cgccgacgggccgg

SEQ ID NO: 422887 - RNA, 21 nt, Bordetella pertussis
cgccgacguagucgcgccagc

SEQ ID NO: 422888 - RNA, 20 nt, Bordetella pertussis
cgccgacugggugcgccuga

SEQ ID NO: 422889 - RNA, 22 nt, Bordetella pertussis
cgccgagaaauccagcgcgccc

SEQ ID NO: 422890 - RNA, 21 nt, Bordetella pertussis
cgccgacuucagacagacgcu

SEQ ID NO: 422891 - RNA, 15 nt, Bordetella pertussis
cgccgagcggggccg

SEQ ID NO: 422892 - RNA, 20 nt, Bordetella pertussis
cgccgaggaucuggccggcg

SEQ ID NO: 422893 - RNA, 18 nt, Bordetella pertussis
cgccgaggcggugggcag

SEQ ID NO: 422894 - RNA, 16 nt, Bordetella pertussis
cgccgaggugaucugg

SEQ ID NO: 422895 - RNA, 19 nt, Bordetella pertussis
cgccgauaccacgcgcggc

SEQ ID NO: 422896 - RNA, 22 nt, Bordetella pertussis
cgccgauccacucggccagcgc

SEQ ID NO: 422897 - RNA, 15 nt, Bordetella pertussis
cgccgauccagccca

SEQ ID NO: 422898 - RNA, 14 nt, Bordetella pertussis
cgccgaucgagcag

SEQ ID NO: 422899 - RNA, 22 nt, Bordetella pertussis
cgccgaucgagcaggccgccgg

SEQ ID NO: 422900 - RNA, 20 nt, Bordetella pertussis
cgccgaucgcgcacagcaug

SEQ ID NO: 422901 - RNA, 15 nt, Bordetella pertussis
cgccgauccggcgca

SEQ ID NO: 422902 - RNA, 15 nt, Bordetella pertussis
cgccgaucugcuucc

SEQ ID NO: 422903 - RNA, 17 nt, Bordetella pertussis
cgccgaugaccagcagc

SEQ ID NO: 422904 - RNA, 17 nt, Bordetella pertussis
cgccgaugaccagggcg

SEQ ID NO: 422905 - RNA, 15 nt, Bordetella pertussis
cgccgaugcacaggu

SEQ ID NO: 422906 - RNA, 21 nt, Bordetella pertussis
cgccgaugccgcgcaccuggg

SEQ ID NO: 422907 - RNA, 22 nt, Bordetella pertussis
cgccgaugcggguacuggccga

SEQ ID NO: 422908 - RNA, 15 nt, Bordetella pertussis
cgccgauggcgccgc

SEQ ID NO: 422909 - RNA, 16 nt, Bordetella pertussis
cgccgauggcgccgcu

SEQ ID NO: 422910 - RNA, 17 nt, Bordetella pertussis
cgccgauggcgcgcggc

SEQ ID NO: 422911 - RNA, 15 nt, Bordetella pertussis
cgccgauggcgcggc

SEQ ID NO: 422912 - RNA, 18 nt, Bordetella pertussis
cgccgcaacgccgccggc

SEQ ID NO: 422913 - RNA, 16 nt, Bordetella pertussis
cgccgcaacgccgggc

SEQ ID NO: 422914 - RNA, 16 nt, Bordetella pertussis
cgccgcaccagccuga

SEQ ID NO: 422915 - RNA, 13 nt, Bordetella pertussis
cgccgcaccagcg

SEQ ID NO: 422916 - RNA, 15 nt, Bordetella pertussis
cgccgcacgggcgcc

SEQ ID NO: 422917 - RNA, 14 nt, Bordetella pertussis
cgccgcagccgcca

SEQ ID NO: 422918 - RNA, 19 nt, Bordetella pertussis
cgccgcagcgucgcggcgu

SEQ ID NO: 422919 - RNA, 19 nt, Bordetella pertussis
cgccgcaguuccaggcauu

SEQ ID NO: 422920 - RNA, 23 nt, Bordetella pertussis
cgccgcauaccuuggcgcccagc

SEQ ID NO: 422921 - RNA, 18 nt, Bordetella pertussis
cgccgcaugggcgcgccc

SEQ ID NO: 422922 - RNA, 15 nt, Bordetella pertussis
cgccgccacaggcug

SEQ ID NO: 422923 - RNA, 16 nt, Bordetella pertussis
cgccgccacaggcuga

SEQ ID NO: 422924 - RNA, 22 nt, Bordetella pertussis
cgccgccaccagggcgcccgcc

SEQ ID NO: 422925 - RNA, 15 nt, Bordetella pertussis
cgccgccacgcgcac

SEQ ID NO: 422926 - RNA, 18 nt, Bordetella pertussis
cgccgccacgcgcacggc

SEQ ID NO: 422927 - RNA, 14 nt, Bordetella pertussis
cgccgccagccgcu

SEQ ID NO: 422928 - RNA, 14 nt, Bordetella pertussis
cgccgccagccugc

SEQ ID NO: 422929 - RNA, 16 nt, Bordetella pertussis
cgccgccagcgcgccg

SEQ ID NO: 422930 - RNA, 18 nt, Bordetella pertussis
cgccgccagcgcgccgcc

SEQ ID NO: 422931 - RNA, 13 nt, Bordetella pertussis
cgccgccaggccg

SEQ ID NO: 422932 - RNA, 19 nt, Bordetella pertussis
cgccgccauggugccgcgc

SEQ ID NO: 422933 - RNA, 16 nt, Bordetella pertussis
cgccgcccacgccgcu

SEQ ID NO: 422934 - RNA, 14 nt, Bordetella pertussis
cgccgcccagccgg

SEQ ID NO: 422935 - RNA, 13 nt, Bordetella pertussis
cgccgcccagcgc

SEQ ID NO: 422936 - RNA, 19 nt, Bordetella pertussis
cgccgcccagcgcgugggc

SEQ ID NO: 422937 - RNA, 14 nt, Bordetella pertussis
cgccgcccgacagc

SEQ ID NO: 422938 - RNA, 14 nt, Bordetella pertussis
cgccgcccgccuca

SEQ ID NO: 422939 - RNA, 15 nt, Bordetella pertussis
cgccgcccgcggcca

SEQ ID NO: 422940 - RNA, 12 nt, Bordetella pertussis
cgccgcccgcuu

SEQ ID NO: 422941 - RNA, 14 nt, Bordetella pertussis
cgccgcccggccgg

SEQ ID NO: 422942 - RNA, 19 nt, Bordetella pertussis
cgccgcccuggccgcgccg

SEQ ID NO: 422943 - RNA, 22 nt, Bordetella pertussis
cgccgccgaacggggccgccuc

SEQ ID NO: 422944 - RNA, 11 nt, Bordetella pertussis
cgccgccgaag

SEQ ID NO: 422945 - RNA, 18 nt, Bordetella pertussis
cgccgccgaagccgccgc

SEQ ID NO: 422946 - RNA, 17 nt, Bordetella pertussis
cgccgccgauggcgcca

SEQ ID NO: 422947 - RNA, 21 nt, Bordetella pertussis
cgccgccgauggcgcgcggcu

SEQ ID NO: 422948 - RNA, 19 nt, Bordetella pertussis
cgccgccgcagccgccagc

SEQ ID NO: 422949 - RNA, 15 nt, Bordetella pertussis
cgccgccgcccgccc

SEQ ID NO: 422950 - RNA, 13 nt, Bordetella pertussis
cgccgccgcccgg

SEQ ID NO: 422951 - RNA, 14 nt, Bordetella pertussis
cgccgccgcgcccu

SEQ ID NO: 422952 - RNA, 23 nt, Bordetella pertussis
cgccgccgcgccgcuggcgucca

SEQ ID NO: 422953 - RNA, 12 nt, Bordetella pertussis
cgccgccgcgcu

SEQ ID NO: 422954 - RNA, 22 nt, Bordetella pertussis
cgccgccgcguggcggcgcagc

SEQ ID NO: 422955 - RNA, 13 nt, Bordetella pertussis
cgccgccggcaag

SEQ ID NO: 422956 - RNA, 12 nt, Bordetella pertussis
cgccgccggcca

SEQ ID NO: 422957 - RNA, 12 nt, Bordetella pertussis
cgccgccggccc

SEQ ID NO: 422958 - RNA, 13 nt, Bordetella pertussis
cgccgccggcccg

SEQ ID NO: 422959 - RNA, 16 nt, Bordetella pertussis
cgccgccggcccgcca

SEQ ID NO: 422960 - RNA, 15 nt, Bordetella pertussis
cgccgccggcggccu

SEQ ID NO: 422961 - RNA, 16 nt, Bordetella pertussis
cgccgccggcggccug

SEQ ID NO: 422962 - RNA, 22 nt, Bordetella pertussis
cgccgccggcggccuggaccug

SEQ ID NO: 422963 - RNA, 13 nt, Bordetella pertussis
cgccgccgggccu

SEQ ID NO: 422964 - RNA, 21 nt, Bordetella pertussis
cgccgccgggccugcccgcau

SEQ ID NO: 422965 - RNA, 12 nt, Bordetella pertussis
cgccgccgggcg

SEQ ID NO: 422966 - RNA, 17 nt, Bordetella pertussis
cgccgccgggcgcgcgc

SEQ ID NO: 422967 - RNA, 19 nt, Bordetella pertussis
cgccgccgggcgcgcgccg

SEQ ID NO: 422968 - RNA, 14 nt, Bordetella pertussis
cgccgccgggcugg

SEQ ID NO: 422969 - RNA, 19 nt, Bordetella pertussis
cgccgccggucaccgccgc

SEQ ID NO: 422970 - RNA, 15 nt, Bordetella pertussis
cgccgccgugcgcgg

SEQ ID NO: 422971 - RNA, 23 nt, Bordetella pertussis
cgccgccgugcgcgggcgcggca

SEQ ID NO: 422972 - RNA, 20 nt, Bordetella pertussis
cgccgccguuuucgcccgcc

SEQ ID NO: 422973 - RNA, 21 nt, Bordetella pertussis
cgccgccguuuucgcccgccc

SEQ ID NO: 422974 - RNA, 18 nt, Bordetella pertussis
cgccgccuaccagguggg

SEQ ID NO: 422975 - RNA, 22 nt, Bordetella pertussis
cgccgccucgauugaccagcac

SEQ ID NO: 422976 - RNA, 23 nt, Bordetella pertussis
cgccgccugcgcaauucuuccuc

SEQ ID NO: 422977 - RNA, 23 nt, Bordetella pertussis
cgccgcgacaaauagccgaccgc

SEQ ID NO: 422978 - RNA, 14 nt, Bordetella pertussis
cgccgcgaccacca

SEQ ID NO: 422979 - RNA, 21 nt, Bordetella pertussis
cgccgcgaccaccagcaccau

SEQ ID NO: 422980 - RNA, 16 nt, Bordetella pertussis
cgccgcgaccgggccg

SEQ ID NO: 422981 - RNA, 15 nt, Bordetella pertussis
cgccgcgagcgccga

SEQ ID NO: 422982 - RNA, 20 nt, Bordetella pertussis
cgccgcgauggcgccggcca

SEQ ID NO: 422983 - RNA, 13 nt, Bordetella pertussis
cgccgcgcacagc

SEQ ID NO: 422984 - RNA, 23 nt, Bordetella pertussis
cgccgcgcacgauggggcagcca

SEQ ID NO: 422985 - RNA, 20 nt, Bordetella pertussis
cgccgcgcagaaaccgccac

SEQ ID NO: 422986 - RNA, 15 nt, Bordetella pertussis
cgccgcgcagcagca

SEQ ID NO: 422987 - RNA, 21 nt, Bordetella pertussis
cgccgcgcaucgaucaggcug

SEQ ID NO: 422988 - RNA, 16 nt, Bordetella pertussis
cgccgcgcccagcagc

SEQ ID NO: 422989 - RNA, 12 nt, Bordetella pertussis
cgccgcgcccca

SEQ ID NO: 422990 - RNA, 14 nt, Bordetella pertussis
cgccgcgccccauc

SEQ ID NO: 422991 - RNA, 15 nt, Bordetella pertussis
cgccgcgccagcugc

SEQ ID NO: 422992 - RNA, 16 nt, Bordetella pertussis
cgccgcgccaggcauu

SEQ ID NO: 422993 - RNA, 15 nt, Bordetella pertussis
cgccgcgcccgcggg

SEQ ID NO: 422994 - RNA, 14 nt, Bordetella pertussis
cgccgcgcccgcuu

SEQ ID NO: 422995 - RNA, 14 nt, Bordetella pertussis
cgccgcgccgccgc

SEQ ID NO: 422996 - RNA, 20 nt, Bordetella pertussis
cgccgcgcgcacggcgcccu

SEQ ID NO: 422997 - RNA, 15 nt, Bordetella pertussis
cgccgcgcgcggccc

SEQ ID NO: 422998 - RNA, 16 nt, Bordetella pertussis
cgccgcgcgcggcccc

SEQ ID NO: 422999 - RNA, 17 nt, Bordetella pertussis
cgccgcgcgccgcgccu

SEQ ID NO: 423000 - RNA, 14 nt, Bordetella pertussis
cgccgcgcgcggca

SEQ ID NO: 423001 - RNA, 13 nt, Bordetella pertussis
cgccgcgcggcga

SEQ ID NO: 423002 - RNA, 17 nt, Bordetella pertussis
cgccgcgcucgcgccag

SEQ ID NO: 423003 - RNA, 19 nt, Bordetella pertussis
cgccgcgcucgcgccaggc

SEQ ID NO: 423004 - RNA, 13 nt, Bordetella pertussis
cgccgcgcucggc

SEQ ID NO: 423005 - RNA, 22 nt, Bordetella pertussis
cgccgcgcugauccuggcucug

SEQ ID NO: 423006 - RNA, 18 nt, Bordetella pertussis
cgccgcggcaagccgcgg

SEQ ID NO: 423007 - RNA, 15 nt, Bordetella pertussis
cgccgcggcaggccc

SEQ ID NO: 423008 - RNA, 22 nt, Bordetella pertussis
cgccgcggcaggccccggcccg

SEQ ID NO: 423009 - RNA, 22 nt, Bordetella pertussis
cgccgcggccagcgccgcgccg

SEQ ID NO: 423010 - RNA, 19 nt, Bordetella pertussis
cgccgcggccggcggcgcc

SEQ ID NO: 423011 - RNA, 12 nt, Bordetella pertussis
cgccgcggcgcu

SEQ ID NO: 423012 - RNA, 12 nt, Bordetella pertussis
cgccgcggcggg

SEQ ID NO: 423013 - RNA, 17 nt, Bordetella pertussis
cgccgcggcuugccgcg

SEQ ID NO: 423014 - RNA, 15 nt, Bordetella pertussis
cgccgcgggcaaagc

SEQ ID NO: 423015 - RNA, 12 nt, Bordetella pertussis
cgccgcgggccu

SEQ ID NO: 423016 - RNA, 13 nt, Bordetella pertussis
cgccgcgggccug

SEQ ID NO: 423017 - RNA, 19 nt, Bordetella pertussis
cgccgcgggcgccgcgcac

SEQ ID NO: 423018 - RNA, 15 nt, Bordetella pertussis
cgccgcguccgcccg

SEQ ID NO: 423019 - RNA, 16 nt, Bordetella pertussis
cgccgcguccgcccgc

SEQ ID NO: 423020 - RNA, 17 nt, Bordetella pertussis
cgccgcguccggcgccc

SEQ ID NO: 423021 - RNA, 18 nt, Bordetella pertussis
cgccgcguccucggccug

SEQ ID NO: 423022 - RNA, 22 nt, Bordetella pertussis
cgccgcguccucggccuggccc

SEQ ID NO: 423023 - RNA, 16 nt, Bordetella pertussis
cgccgcgucggcgccg

SEQ ID NO: 423024 - RNA, 17 nt, Bordetella pertussis
cgccgcguggcggcgca

SEQ ID NO: 423025 - RNA, 22 nt, Bordetella pertussis
cgccgcguggcggcgcagcgcc

SEQ ID NO: 423026 - RNA, 21 nt, Bordetella pertussis
cgccgcguugcagccacaggc

SEQ ID NO: 423027 - RNA, 16 nt, Bordetella pertussis
cgccgcucgucccccu

SEQ ID NO: 423028 - RNA, 13 nt, Bordetella pertussis
cgccgcugccggc

SEQ ID NO: 423029 - RNA, 14 nt, Bordetella pertussis
cgccgcugccggcc

SEQ ID NO: 423030 - RNA, 15 nt, Bordetella pertussis
cgccgcugcgcagca

SEQ ID NO: 423031 - RNA, 13 nt, Bordetella pertussis
cgccgcugcagcg

SEQ ID NO: 423032 - RNA, 18 nt, Bordetella pertussis
cgccgcuggcggccgcgg

SEQ ID NO: 423033 - RNA, 20 nt, Bordetella pertussis
cgccgcuggcggccgcgggc

SEQ ID NO: 423034 - RNA, 22 nt, Bordetella pertussis
cgccgcuggcggccgcgggcgu

SEQ ID NO: 423035 - RNA, 18 nt, Bordetella pertussis
cgccgcuggcgucgcgcu

SEQ ID NO: 423036 - RNA, 20 nt, Bordetella pertussis
cgccgcuguugcccaccagc

SEQ ID NO: 423037 - RNA, 15 nt, Bordetella pertussis
cgccgcuuccggcau

SEQ ID NO: 423038 - RNA, 20 nt, Bordetella pertussis
cgccgcuuucucccgccgcu

SEQ ID NO: 423039 - RNA, 21 nt, Bordetella pertussis
cgccgcuuucucccgccgcuu

SEQ ID NO: 423040 - RNA, 22 nt, Bordetella pertussis
cgccggacacguacaaccgcgc

SEQ ID NO: 423041 - RNA, 23 nt, Bordetella pertussis
cgccggacgcaaaaacgcccggc

SEQ ID NO: 423042 - RNA, 18 nt, Bordetella pertussis
cgccggaggcgcgcagcu

SEQ ID NO: 423043 - RNA, 20 nt, Bordetella pertussis
cgccggcaagggucccagcu

SEQ ID NO: 423044 - RNA, 16 nt, Bordetella pertussis
cgccggcacgcgcggu

SEQ ID NO: 423045 - RNA, 14 nt, Bordetella pertussis
cgccggcagggcca

SEQ ID NO: 423046 - RNA, 13 nt, Bordetella pertussis
cgccggcagggcg

SEQ ID NO: 423047 - RNA, 16 nt, Bordetella pertussis
cgccggcagggcggcc

SEQ ID NO: 423048 - RNA, 18 nt, Bordetella pertussis
cgccggcauggccaaugc

SEQ ID NO: 423049 - RNA, 13 nt, Bordetella pertussis
cgccggccaccgc

SEQ ID NO: 423050 - RNA, 17 nt, Bordetella pertussis
cgccggccagcgcgccg

SEQ ID NO: 423051 - RNA, 15 nt, Bordetella pertussis
cgccggccagccugu

SEQ ID NO: 423052 - RNA, 12 nt, Bordetella pertussis
cgccggccagcg

SEQ ID NO: 423053 - RNA, 12 nt, Bordetella pertussis
cgccggccagga

SEQ ID NO: 423054 - RNA, 15 nt, Bordetella pertussis
cgccggccaggcccu

SEQ ID NO: 423055 - RNA, 14 nt, Bordetella pertussis
cgccggccagggcc

SEQ ID NO: 423056 - RNA, 21 nt, Bordetella pertussis
cgccggccaggucggcggcca

SEQ ID NO: 423057 - RNA, 17 nt, Bordetella pertussis
cgccggccaucacgccg

SEQ ID NO: 423058 - RNA, 18 nt, Bordetella pertussis
cgccggcccaggcgcgcu

SEQ ID NO: 423059 - RNA, 23 nt, Bordetella pertussis
cgccggcccgccacgcgggccgg

SEQ ID NO: 423060 - RNA, 15 nt, Bordetella pertussis
cgccggcccgccucg

SEQ ID NO: 423061 - RNA, 16 nt, Bordetella pertussis
cgccggcccgccucga

SEQ ID NO: 423062 - RNA, 16 nt, Bordetella pertussis
cgccggccgacggcgc

SEQ ID NO: 423063 - RNA, 17 nt, Bordetella pertussis
cgccggccgacggcgcu

SEQ ID NO: 423064 - RNA, 13 nt, Bordetella pertussis
cgccggccgccug

SEQ ID NO: 423065 - RNA, 14 nt, Bordetella pertussis
cgccggccgcgccc

SEQ ID NO: 423066 - RNA, 23 nt, Bordetella pertussis
cgccggccggggucuugccgcgc

SEQ ID NO: 423067 - RNA, 16 nt, Bordetella pertussis
cgccggccugacgcgc

SEQ ID NO: 423068 - RNA, 11 nt, Bordetella pertussis
cgccggccugc

SEQ ID NO: 423069 - RNA, 17 nt, Bordetella pertussis
cgccggccugcgccagc

SEQ ID NO: 423070 - RNA, 18 nt, Bordetella pertussis
cgccggccugcgccagcu

SEQ ID NO: 423071 - RNA, 20 nt, Bordetella pertussis
cgccggccugcgccagcucc

SEQ ID NO: 423072 - RNA, 21 nt, Bordetella pertussis
cgccggccugcgccgggcgcg

SEQ ID NO: 423073 - RNA, 23 nt, Bordetella pertussis
cgccggccuggcgcgacgccugc

SEQ ID NO: 423074 - RNA, 12 nt, Bordetella pertussis
cgccggccuugc

SEQ ID NO: 423075 - RNA, 18 nt, Bordetella pertussis
cgccggcgaaugccggcc

SEQ ID NO: 423076 - RNA, 20 nt, Bordetella pertussis
cgccggcgaaugccggccga

SEQ ID NO: 423077 - RNA, 21 nt, Bordetella pertussis
cgccggcgaaugccggccgau

SEQ ID NO: 423078 - RNA, 13 nt, Bordetella pertussis
cgccggccugcug

SEQ ID NO: 423079 - RNA, 22 nt, Bordetella pertussis
cgccggcgcaugagccggcaga

SEQ ID NO: 423080 - RNA, 13 nt, Bordetella pertussis
cgccggcgccccc

SEQ ID NO: 423081 - RNA, 18 nt, Bordetella pertussis
cgccggcgcccccagcag

SEQ ID NO: 423082 - RNA, 14 nt, Bordetella pertussis
cgccggcgccgccc

SEQ ID NO: 423083 - RNA, 15 nt, Bordetella pertussis
cgccggcgccggcga

SEQ ID NO: 423084 - RNA, 12 nt, Bordetella pertussis
cgccggcgccgu

SEQ ID NO: 423085 - RNA, 13 nt, Bordetella pertussis
cgccggcgcgccg

SEQ ID NO: 423086 - RNA, 15 nt, Bordetella pertussis
cgccggcgcgccgcc

SEQ ID NO: 423087 - RNA, 16 nt, Bordetella pertussis
cgccggcgcgccgccc

SEQ ID NO: 423088 - RNA, 19 nt, Bordetella pertussis
cgccggcgcgccgcccgcu

SEQ ID NO: 423089 - RNA, 20 nt, Bordetella pertussis
cgccggcgcgcgcgcgccgc

SEQ ID NO: 423090 - RNA, 14 nt, Bordetella pertussis
cgccggcgcgcgcu

SEQ ID NO: 423091 - RNA, 13 nt, Bordetella pertussis
cgccggcgcggcu

SEQ ID NO: 423092 - RNA, 18 nt, Bordetella pertussis
cgccggcgcuacagggug

SEQ ID NO: 423093 - RNA, 17 nt, Bordetella pertussis
cgccggcgcucgcgcac

SEQ ID NO: 423094 - RNA, 21 nt, Bordetella pertussis
cgccggcgcugcugucgcgcg

SEQ ID NO: 423095 - RNA, 15 nt, Bordetella pertussis
cgccggcggcaaggu

SEQ ID NO: 423096 - RNA, 17 nt, Bordetella pertussis
cgccggcggcaccgcgc

SEQ ID NO: 423097 - RNA, 19 nt, Bordetella pertussis
cgccggcggcaccgcgcag

SEQ ID NO: 423098 - RNA, 22 nt, Bordetella pertussis
cgccggcggcccauucgcgcac

SEQ ID NO: 423099 - RNA, 13 nt, Bordetella pertussis
cgccggcggccug

SEQ ID NO: 423100 - RNA, 15 nt, Bordetella pertussis
cgccggcggccugga

SEQ ID NO: 423101 - RNA, 21 nt, Bordetella pertussis
cgccggcggcgaugcgggcca

SEQ ID NO: 423102 - RNA, 13 nt, Bordetella pertussis
cgccggcggcgca

SEQ ID NO: 423103 - RNA, 18 nt, Bordetella pertussis
cgccggcggcgccggccu

SEQ ID NO: 423104 - RNA, 13 nt, Bordetella pertussis
cgccggcggcgcg

SEQ ID NO: 423105 - RNA, 15 nt, Bordetella pertussis
cgccggcggcgugcg

SEQ ID NO: 423106 - RNA, 14 nt, Bordetella pertussis
cgccggcgggcgcu

SEQ ID NO: 423107 - RNA, 17 nt, Bordetella pertussis
cgccggcgggcgcugcc

SEQ ID NO: 423108 - RNA, 17 nt, Bordetella pertussis
cgccggcggucacgccg

SEQ ID NO: 423109 - RNA, 17 nt, Bordetella pertussis
cgccggcgucacgcggc

SEQ ID NO: 423110 - RNA, 16 nt, Bordetella pertussis
cgccggcgucgcucag

SEQ ID NO: 423111 - RNA, 15 nt, Bordetella pertussis
cgccggcuaccgcgc

SEQ ID NO: 423112 - RNA, 17 nt, Bordetella pertussis
cgccggcucagcccccc

SEQ ID NO: 423113 - RNA, 16 nt, Bordetella pertussis
cgccggcucccgcgcu

SEQ ID NO: 423114 - RNA, 17 nt, Bordetella pertussis
cgccggcucccgcgcug

SEQ ID NO: 423115 - RNA, 21 nt, Bordetella pertussis
cgccggcugaauuggcgccca

SEQ ID NO: 423116 - RNA, 23 nt, Bordetella pertussis
cgccggcuucgucauggucgacc

SEQ ID NO: 423117 - RNA, 17 nt, Bordetella pertussis
cgccggcuugcgccagc

SEQ ID NO: 423118 - RNA, 22 nt, Bordetella pertussis
cgccggcuuucagcgccgagcg

SEQ ID NO: 423119 - RNA, 13 nt, Bordetella pertussis
cgccgggacaggc

SEQ ID NO: 423120 - RNA, 17 nt, Bordetella pertussis
cgccgggacaggcaccc

SEQ ID NO: 423121 - RNA, 16 nt, Bordetella pertussis
cgccgggcagcccgcg

SEQ ID NO: 423122 - RNA, 17 nt, Bordetella pertussis
cgccgggcagcccgcgc

SEQ ID NO: 423123 - RNA, 20 nt, Bordetella pertussis
cgccgggcauugccggagca

SEQ ID NO: 423124 - RNA, 21 nt, Bordetella pertussis
cgccgggccaaggugccuguc

SEQ ID NO: 423125 - RNA, 15 nt, Bordetella pertussis
cgccgggccgcgccc

SEQ ID NO: 423126 - RNA, 16 nt, Bordetella pertussis
cgccgggcgccgcgcc

SEQ ID NO: 423127 - RNA, 15 nt, Bordetella pertussis
cgccgggcgcggccg

SEQ ID NO: 423128 - RNA, 16 nt, Bordetella pertussis
cgccgggcgcggccgc

SEQ ID NO: 423129 - RNA, 19 nt, Bordetella pertussis
cgccgggcgcggccgccgc

SEQ ID NO: 423130 - RNA, 13 nt, Bordetella pertussis
cgccgggccggcg

SEQ ID NO: 423131 - RNA, 15 nt, Bordetella pertussis
cgccgggccugcccg

SEQ ID NO: 423132 - RNA, 20 nt, Bordetella pertussis
cgccgggcggcgcgggcggc

SEQ ID NO: 423133 - RNA, 18 nt, Bordetella pertussis
cgccggggcggcucggcc

SEQ ID NO: 423134 - RNA, 20 nt, Bordetella pertussis
cgccggggcggcucggcccu

SEQ ID NO: 423135 - RNA, 17 nt, Bordetella pertussis
cgccggggcgcaccggc

SEQ ID NO: 423136 - RNA, 15 nt, Bordetella pertussis
cgccggggcgccggu

SEQ ID NO: 423137 - RNA, 17 nt, Bordetella pertussis
cgccggggcguggccgc

SEQ ID NO: 423138 - RNA, 18 nt, Bordetella pertussis
cgccgggggcguugcggu

SEQ ID NO: 423139 - RNA, 20 nt, Bordetella pertussis
cgccggggucagcgccggca

SEQ ID NO: 423140 - RNA, 24 nt, Bordetella pertussis
cgccggggucagcgccggcacgcu

SEQ ID NO: 423141 - RNA, 15 nt, Bordetella pertussis
cgccggggugggagc

SEQ ID NO: 423142 - RNA, 15 nt, Bordetella pertussis
cgccggguccggccg

SEQ ID NO: 423143 - RNA, 17 nt, Bordetella pertussis
cgccggguugcggcgga

SEQ ID NO: 423144 - RNA, 19 nt, Bordetella pertussis
cgccggucaccgccgccgc

SEQ ID NO: 423145 - RNA, 15 nt, Bordetella pertussis
cgccggucacugccg

SEQ ID NO: 423146 - RNA, 14 nt, Bordetella pertussis
cgccgguccagcgc

SEQ ID NO: 423147 - RNA, 13 nt, Bordetella pertussis
cgccggucgccag

SEQ ID NO: 423148 - RNA, 16 nt, Bordetella pertussis
cgccggucgccgcggg

SEQ ID NO: 423149 - RNA, 22 nt, Bordetella pertussis
cgccggucgccgcgggcaaagc

SEQ ID NO: 423150 - RNA, 15 nt, Bordetella pertussis
cgccggucggccgcu

SEQ ID NO: 423151 - RNA, 21 nt, Bordetella pertussis
cgccggucggccgcuccgcca

SEQ ID NO: 423152 - RNA, 23 nt, Bordetella pertussis
cgccggucugggcgcggaacagc

SEQ ID NO: 423153 - RNA, 18 nt, Bordetella pertussis
cgccggugaccgccagca

SEQ ID NO: 423154 - RNA, 23 nt, Bordetella pertussis
cgccggugauaugcgccaggccc

SEQ ID NO: 423155 - RNA, 16 nt, Bordetella pertussis
cgccggugcaccaggc

SEQ ID NO: 423156 - RNA, 16 nt, Bordetella pertussis
cgccggugcgcggcgc

SEQ ID NO: 423157 - RNA, 19 nt, Bordetella pertussis
cgccggugcgcggcgcccc

SEQ ID NO: 423158 - RNA, 14 nt, Bordetella pertussis
cgccgguggccagc

SEQ ID NO: 423159 - RNA, 17 nt, Bordetella pertussis
cgccggugucggggccg

SEQ ID NO: 423160 - RNA, 23 nt, Bordetella pertussis
cgccggugucggggccgggccgg

SEQ ID NO: 423161 - RNA, 20 nt, Bordetella pertussis
cgccguacagccgcggcaga

SEQ ID NO: 423162 - RNA, 14 nt, Bordetella pertussis
cgccguaccgggcg

SEQ ID NO: 423163 - RNA, 16 nt, Bordetella pertussis
cgccguaccgggcggu

SEQ ID NO: 423164 - RNA, 23 nt, Bordetella pertussis
cgccguagccgcugcgcgcggcc

SEQ ID NO: 423165 - RNA, 18 nt, Bordetella pertussis
cgccguccagcgcggcau

SEQ ID NO: 423166 - RNA, 18 nt, Bordetella pertussis
cgccguccgagcccgacg

SEQ ID NO: 423167 - RNA, 20 nt, Bordetella pertussis
cgccguccgugagugcagcg

SEQ ID NO: 423168 - RNA, 18 nt, Bordetella pertussis
cgccgucgaacuccugca

SEQ ID NO: 423169 - RNA, 18 nt, Bordetella pertussis
cgccgucgaagccggcgc

SEQ ID NO: 423170 - RNA, 18 nt, Bordetella pertussis
cgccgucgcggaccuccu

SEQ ID NO: 423171 - RNA, 15 nt, Bordetella pertussis
cgccgucgcuggggc

SEQ ID NO: 423172 - RNA, 13 nt, Bordetella pertussis
cgccgucgggggc

SEQ ID NO: 423173 - RNA, 18 nt, Bordetella pertussis
cgccgugaaugcgccugg

SEQ ID NO: 423174 - RNA, 16 nt, Bordetella pertussis
cgccgugaugccgccc

SEQ ID NO: 423175 - RNA, 14 nt, Bordetella pertussis
cgccgugcagggcc

SEQ ID NO: 423176 - RNA, 14 nt, Bordetella pertussis
cgccgugcgcgggc

SEQ ID NO: 423177 - RNA, 14 nt, Bordetella pertussis
cgccgugcugaucg

SEQ ID NO: 423178 - RNA, 14 nt, Bordetella pertussis
cgccgugcuggagg

SEQ ID NO: 423179 - RNA, 21 nt, Bordetella pertussis
cgccguggcuggucacgucca

SEQ ID NO: 423180 - RNA, 21 nt, Bordetella pertussis
cgccguggugcugaccggcuu

SEQ ID NO: 423181 - RNA, 17 nt, Bordetella pertussis
cgccguguuguccugga

SEQ ID NO: 423182 - RNA, 17 nt, Bordetella pertussis
cgccguucgucgcgcag

SEQ ID NO: 423183 - RNA, 15 nt, Bordetella pertussis
cgccguucucaggcc

SEQ ID NO: 423184 - RNA, 21 nt, Bordetella pertussis
cgccguucuggcugcgcgccu

SEQ ID NO: 423185 - RNA, 22 nt, Bordetella pertussis
cgccuaccaggugggcgcgcuc

SEQ ID NO: 423186 - RNA, 13 nt, Bordetella pertussis
cgccuaccggcgc

SEQ ID NO: 423187 - RNA, 18 nt, Bordetella pertussis
cgccuauugcgacgccgc

SEQ ID NO: 423188 - RNA, 15 nt, Bordetella pertussis
cgccucaccgcgccg

SEQ ID NO: 423189 - RNA, 15 nt, Bordetella pertussis
cgccucaggccggaa

SEQ ID NO: 423190 - RNA, 18 nt, Bordetella pertussis
cgccucaggccggcgccu

SEQ ID NO: 423191 - RNA, 19 nt, Bordetella pertussis
cgccucaggccggcgccug

SEQ ID NO: 423192 - RNA, 14 nt, Bordetella pertussis
cgccuccagcgcgg

SEQ ID NO: 423193 - RNA, 22 nt, Bordetella pertussis
cgccuccagcgcggcgggcggc

SEQ ID NO: 423194 - RNA, 19 nt, Bordetella pertussis
cgccuccaggaugagcgcc

SEQ ID NO: 423195 - RNA, 22 nt, Bordetella pertussis
cgccuccaggaugagcgccugc

SEQ ID NO: 423196 - RNA, 20 nt, Bordetella pertussis
cgccucccauugcgcggcca

SEQ ID NO: 423197 - RNA, 21 nt, Bordetella pertussis
cgccucgaagaccucggcgcu

SEQ ID NO: 423198 - RNA, 14 nt, Bordetella pertussis
cgccucgaccggcg

SEQ ID NO: 423199 - RNA, 16 nt, Bordetella pertussis
cgccucgacgcccggg

SEQ ID NO: 423200 - RNA, 21 nt, Bordetella pertussis
cgccucgaugucaucgcccuc

SEQ ID NO: 423201 - RNA, 20 nt, Bordetella pertussis
cgccucgauugaccagcacc

SEQ ID NO: 423202 - RNA, 12 nt, Bordetella pertussis
cgccucgccggc

SEQ ID NO: 423203 - RNA, 17 nt, Bordetella pertussis
cgccucgccggcccugc

SEQ ID NO: 423204 - RNA, 15 nt, Bordetella pertussis
cgccucgcgacggcc

SEQ ID NO: 423205 - RNA, 21 nt, Bordetella pertussis
cgccucgcgacggccucccgc

SEQ ID NO: 423206 - RNA, 20 nt, Bordetella pertussis
cgccucgcgcucgagcgcgg

SEQ ID NO: 423207 - RNA, 23 nt, Bordetella pertussis
cgccucggcggccagcgcgcccu

SEQ ID NO: 423208 - RNA, 17 nt, Bordetella pertussis
cgccucggcuugcgcgg

SEQ ID NO: 423209 - RNA, 17 nt, Bordetella pertussis
cgccucgggcacggcca

SEQ ID NO: 423210 - RNA, 19 nt, Bordetella pertussis
cgccucgggcacggccagc

SEQ ID NO: 423211 - RNA, 22 nt, Bordetella pertussis
cgccugcaccgccgcgcggugc

SEQ ID NO: 423212 - RNA, 15 nt, Bordetella pertussis
cgccugcacgaccug

SEQ ID NO: 423213 - RNA, 16 nt, Bordetella pertussis
cgccugcagcagcgcc

SEQ ID NO: 423214 - RNA, 17 nt, Bordetella pertussis
cgccugcagcgccgccu

SEQ ID NO: 423215 - RNA, 18 nt, Bordetella pertussis
cgccugcagcgccgccug

SEQ ID NO: 423216 - RNA, 13 nt, Bordetella pertussis
cgccugcaggucu

SEQ ID NO: 423217 - RNA, 16 nt, Bordetella pertussis
cgccugcauccggccc

SEQ ID NO: 423218 - RNA, 17 nt, Bordetella pertussis
cgccugcauccggccca

SEQ ID NO: 423219 - RNA, 20 nt, Bordetella pertussis
cgccugccagaacagccgcg

SEQ ID NO: 423220 - RNA, 17 nt, Bordetella pertussis
cgccugcccaggccagc

SEQ ID NO: 423221 - RNA, 16 nt, Bordetella pertussis
cgccugccccgccggg

SEQ ID NO: 423222 - RNA, 16 nt, Bordetella pertussis
cgccugccccgccugc

SEQ ID NO: 423223 - RNA, 16 nt, Bordetella pertussis
cgccugcccgcacggg

SEQ ID NO: 423224 - RNA, 18 nt, Bordetella pertussis
cgccugccgcaucccgcc

SEQ ID NO: 423225 - RNA, 17 nt, Bordetella pertussis
cgccugccgcgcccggc

SEQ ID NO: 423226 - RNA, 12 nt, Bordetella pertussis
cgccugccgcgu

SEQ ID NO: 423227 - RNA, 21 nt, Bordetella pertussis
cgccugccgcgugcccgcguc

SEQ ID NO: 423228 - RNA, 13 nt, Bordetella pertussis
cgccugccggccu

SEQ ID NO: 423229 - RNA, 15 nt, Bordetella pertussis
cgccugccggccugg

SEQ ID NO: 423230 - RNA, 13 nt, Bordetella pertussis
cgccugcgccagc

SEQ ID NO: 423231 - RNA, 16 nt, Bordetella pertussis
cgccugcgccagccgc

SEQ ID NO: 423232 - RNA, 17 nt, Bordetella pertussis
cgccugcgccauguggc

SEQ ID NO: 423233 - RNA, 23 nt, Bordetella pertussis
cgccugcgccggguccggccgcg

SEQ ID NO: 423234 - RNA, 16 nt, Bordetella pertussis
cgccugcgcgccgccu

SEQ ID NO: 423235 - RNA, 19 nt, Bordetella pertussis
cgccugcgcgccgccucga

SEQ ID NO: 423236 - RNA, 14 nt, Bordetella pertussis
cgccugcgcggccu

SEQ ID NO: 423237 - RNA, 20 nt, Bordetella pertussis
cgccugcggcaggccgcagc

SEQ ID NO: 423238 - RNA, 17 nt, Bordetella pertussis
cgccugcggcgcggccg

SEQ ID NO: 423239 - RNA, 18 nt, Bordetella pertussis
cgccugcggcgcggccga

SEQ ID NO: 423240 - RNA, 18 nt, Bordetella pertussis
cgccugcggggccgcuuc

SEQ ID NO: 423241 - RNA, 17 nt, Bordetella pertussis
cgccugcgucguugccc

SEQ ID NO: 423242 - RNA, 19 nt, Bordetella pertussis
cgccugcgucguugccccg

SEQ ID NO: 423243 - RNA, 22 nt, Bordetella pertussis
cgccugcgucguugccccgauc

SEQ ID NO: 423244 - RNA, 19 nt, Bordetella pertussis
cgccugcguggcgggccgc

SEQ ID NO: 423245 - RNA, 14 nt, Bordetella pertussis
cgccugcucacgcc

SEQ ID NO: 423246 - RNA, 18 nt, Bordetella pertussis
cgccugcucacgccccgc

SEQ ID NO: 423247 - RNA, 16 nt, Bordetella pertussis
cgccugcugcgccguc

SEQ ID NO: 423248 - RNA, 22 nt, Bordetella pertussis
cgccugcugcgccgucugugcg

SEQ ID NO: 423249 - RNA, 19 nt, Bordetella pertussis
cgccugcugggccgcgcuc

SEQ ID NO: 423250 - RNA, 17 nt, Bordetella pertussis
cgccuggacggcgagga

SEQ ID NO: 423251 - RNA, 17 nt, Bordetella pertussis
cgccuggcccgaacggc

SEQ ID NO: 423252 - RNA, 19 nt, Bordetella pertussis
cgccuggccgagcgcggca

SEQ ID NO: 423253 - RNA, 20 nt, Bordetella pertussis
cgccuggccgagcgcggcau

SEQ ID NO: 423254 - RNA, 16 nt, Bordetella pertussis
cgccuggccgcccagc

SEQ ID NO: 423255 - RNA, 13 nt, Bordetella pertussis
cgccuggccggcu

SEQ ID NO: 423256 - RNA, 22 nt, Bordetella pertussis
cgccuggccuucgcugcccugg

SEQ ID NO: 423257 - RNA, 17 nt, Bordetella pertussis
cgccuggcgccgcgccc

SEQ ID NO: 423258 - RNA, 15 nt, Bordetella pertussis
cgccuggcgcggcgc

SEQ ID NO: 423259 - RNA, 14 nt, Bordetella pertussis
cgccuggcgggccu

SEQ ID NO: 423260 - RNA, 23 nt, Bordetella pertussis
cgccuggcguucaaucgcgcuuc

SEQ ID NO: 423261 - RNA, 18 nt, Bordetella pertussis
cgccuggcuuacaggccc

SEQ ID NO: 423262 - RNA, 13 nt, Bordetella pertussis
cgccugggccuuc

SEQ ID NO: 423263 - RNA, 15 nt, Bordetella pertussis
cgccugggccuucuu

SEQ ID NO: 423264 - RNA, 15 nt, Bordetella pertussis
cgccugggcggcgca

SEQ ID NO: 423265 - RNA, 18 nt, Bordetella pertussis
cgccuggggggucaacca

SEQ ID NO: 423266 - RNA, 20 nt, Bordetella pertussis
cgccugguaguaaucgcgcg

SEQ ID NO: 423267 - RNA, 20 nt, Bordetella pertussis
cgccuggucgacgccggcga

SEQ ID NO: 423268 - RNA, 17 nt, Bordetella pertussis
cgccuggucgcgcgccu

SEQ ID NO: 423269 - RNA, 19 nt, Bordetella pertussis
cgccuguuuuggcgcacgc

SEQ ID NO: 423270 - RNA, 14 nt, Bordetella pertussis
cgccuuccggcagc

SEQ ID NO: 423271 - RNA, 14 nt, Bordetella pertussis
cgccuuccggcccc

SEQ ID NO: 423272 - RNA, 14 nt, Bordetella pertussis
cgccuucgagcacc

SEQ ID NO: 423273 - RNA, 16 nt, Bordetella pertussis
cgccuucuacccgcuc

SEQ ID NO: 423274 - RNA, 16 nt, Bordetella pertussis
cgccuucuuucgcgag

SEQ ID NO: 423275 - RNA, 16 nt, Bordetella pertussis
cgccuugccgccgcgc

SEQ ID NO: 423276 - RNA, 20 nt, Bordetella pertussis
cgccuuucccgcgccgagcg

SEQ ID NO: 423277 - RNA, 23 nt, Bordetella pertussis
cgcgaaagcggcgugugcccagc

SEQ ID NO: 423278 - RNA, 17 nt, Bordetella pertussis
cgcgaaccaggccaccg

SEQ ID NO: 423279 - RNA, 18 nt, Bordetella pertussis
cgcgaaccaggccaccgc

SEQ ID NO: 423280 - RNA, 17 nt, Bordetella pertussis
cgcgaaccggugcuggu

SEQ ID NO: 423281 - RNA, 16 nt, Bordetella pertussis
cgcgaacgccugccag

SEQ ID NO: 423282 - RNA, 22 nt, Bordetella pertussis
cgcgaacgcgcgccggccagcg

SEQ ID NO: 423283 - RNA, 23 nt, Bordetella pertussis
cgcgaacgcgcgccggccagcgg

SEQ ID NO: 423284 - RNA, 14 nt, Bordetella pertussis
cgcgaacgcggcca

SEQ ID NO: 423285 - RNA, 13 nt, Bordetella pertussis
cgcgaacggcagg

SEQ ID NO: 423286 - RNA, 15 nt, Bordetella pertussis
cgcgaagcagccggc

SEQ ID NO: 423287 - RNA, 18 nt, Bordetella pertussis
cgcgaagcgcgccagcag

SEQ ID NO: 423288 - RNA, 22 nt, Bordetella pertussis
cgcgaagcggaaacgcgcgcgc

SEQ ID NO: 423289 - RNA, 14 nt, Bordetella pertussis
cgcgaaggccgccc

SEQ ID NO: 423290 - RNA, 15 nt, Bordetella pertussis
cgcgaaggccgcccc

SEQ ID NO: 423291 - RNA, 16 nt, Bordetella pertussis
cgcgaaggccgccccc

SEQ ID NO: 423292 - RNA, 16 nt, Bordetella pertussis
cgcgaaguggccacca

SEQ ID NO: 423293 - RNA, 20 nt, Bordetella pertussis
cgcgaauuuuucuuccaguu

SEQ ID NO: 423294 - RNA, 23 nt, Bordetella pertussis
cgcgaauuuuucuuccaguucgc

SEQ ID NO: 423295 - RNA, 14 nt, Bordetella pertussis
cgcgacaccgugcg

SEQ ID NO: 423296 - RNA, 13 nt, Bordetella pertussis
cgcgacagcacca

SEQ ID NO: 423297 - RNA, 16 nt, Bordetella pertussis
cgcgacagccgcgcca

SEQ ID NO: 423298 - RNA, 20 nt, Bordetella pertussis
cgcgacagccgcgccagcgc

SEQ ID NO: 423299 - RNA, 17 nt, Bordetella pertussis
cgcgacaguucgccccc

SEQ ID NO: 423300 - RNA, 20 nt, Bordetella pertussis
cgcgacaguucgccccccga

SEQ ID NO: 423301 - RNA, 13 nt, Bordetella pertussis
cgcgaccaccagc

SEQ ID NO: 423302 - RNA, 15 nt, Bordetella pertussis
cgcgaccaccgugau

SEQ ID NO: 423303 - RNA, 23 nt, Bordetella pertussis
cgcgaccagcuucugcgccugcu

SEQ ID NO: 423304 - RNA, 13 nt, Bordetella pertussis
cgcgaccgccgcc

SEQ ID NO: 423305 - RNA, 19 nt, Bordetella pertussis
cgcgaccgccgcgggauuc

SEQ ID NO: 423306 - RNA, 14 nt, Bordetella pertussis
cgcgaccgccucca

SEQ ID NO: 423307 - RNA, 15 nt, Bordetella pertussis
cgcgaccgccuccag

SEQ ID NO: 423308 - RNA, 14 nt, Bordetella pertussis
cgcgaccgcgcggc

SEQ ID NO: 423309 - RNA, 14 nt, Bordetella pertussis
cgcgaccgggccga

SEQ ID NO: 423310 - RNA, 21 nt, Bordetella pertussis
cgcgaccugcgcgaccgccgc

SEQ ID NO: 423311 - RNA, 23 nt, Bordetella pertussis
cgcgaccugcgcgaccgccgcgg

SEQ ID NO: 423312 - RNA, 17 nt, Bordetella pertussis
cgcgaccugcgggcgca

SEQ ID NO: 423313 - RNA, 19 nt, Bordetella pertussis
cgcgaccugcgggcgcagc

SEQ ID NO: 423314 - RNA, 23 nt, Bordetella pertussis
cgcgaccugcgggcgcagcgccg

SEQ ID NO: 423315 - RNA, 22 nt, Bordetella pertussis
cgcgaccuccggcaacagcagg

SEQ ID NO: 423316 - RNA, 18 nt, Bordetella pertussis
cgcgacgccagcgcgcca

SEQ ID NO: 423317 - RNA, 21 nt, Bordetella pertussis
cgcgacgcgcccucaguccag

SEQ ID NO: 423318 - RNA, 14 nt, Bordetella pertussis
cgcgacgcgccugc

SEQ ID NO: 423319 - RNA, 19 nt, Bordetella pertussis
cgcgacgcuguuggucagg

SEQ ID NO: 423320 - RNA, 13 nt, Bordetella pertussis
cgcgacggcggcc

SEQ ID NO: 423321 - RNA, 14 nt, Bordetella pertussis
cgcgacgguccugc

SEQ ID NO: 423322 - RNA, 20 nt, Bordetella pertussis
cgcgacgguccugcgcgccg

SEQ ID NO: 423323 - RNA, 19 nt, Bordetella pertussis
cgcgacgugucggccacca

SEQ ID NO: 423324 - RNA, 20 nt, Bordetella pertussis
cgcgacgugucggccaccac

SEQ ID NO: 423325 - RNA, 22 nt, Bordetella pertussis
cgcgacuggcccaggcgggcca

SEQ ID NO: 423326 - RNA, 22 nt, Bordetella pertussis
cgcgacuucgccgaucgagcag

SEQ ID NO: 423327 - RNA, 14 nt, Bordetella pertussis
cgcgagaaccaggc

SEQ ID NO: 423328 - RNA, 16 nt, Bordetella pertussis
cgcgagaauggcgcga

SEQ ID NO: 423329 - RNA, 15 nt, Bordetella pertussis
cgcgagcaugcgcag

SEQ ID NO: 423330 - RNA, 12 nt, Bordetella pertussis
cgcgagccgccc

SEQ ID NO: 423331 - RNA, 15 nt, Bordetella pertussis
cgcgagcgaugcccu

SEQ ID NO: 423332 - RNA, 23 nt, Bordetella pertussis
cgcgagcgccgggcgccgcgccc

SEQ ID NO: 423333 - RNA, 18 nt, Bordetella pertussis
cgcgagcggccagccugc

SEQ ID NO: 423334 - RNA, 16 nt, Bordetella pertussis
cgcgagcugcgcgacc

SEQ ID NO: 423335 - RNA, 17 nt, Bordetella pertussis
cgcgaggcggcgacgca

SEQ ID NO: 423336 - RNA, 18 nt, Bordetella pertussis
cgcgaggugccggacgcc

SEQ ID NO: 423337 - RNA, 20 nt, Bordetella pertussis
cgcgaggugccggacgccga

SEQ ID NO: 423338 - RNA, 22 nt, Bordetella pertussis
cgcgagguggcgcucgcgccca

SEQ ID NO: 423339 - RNA, 22 nt, Bordetella pertussis
cgcgauauccuugcgcucgccc

SEQ ID NO: 423340 - RNA, 12 nt, Bordetella pertussis
cgcgauccuggg

SEQ ID NO: 423341 - RNA, 14 nt, Bordetella pertussis
cgcgaucgccagca

SEQ ID NO: 423342 - RNA, 19 nt, Bordetella pertussis
cgcgaucucagccaucauc

SEQ ID NO: 423343 - RNA, 17 nt, Bordetella pertussis
cgcgaucucgggcaggu

SEQ ID NO: 423344 - RNA, 12 nt, Bordetella pertussis
cgcgaugcauga

SEQ ID NO: 423345 - RNA, 18 nt, Bordetella pertussis
cgcgaugcccgcgcacca

SEQ ID NO: 423346 - RNA, 19 nt, Bordetella pertussis
cgcgaugcccgcgcaccag

SEQ ID NO: 423347 - RNA, 15 nt, Bordetella pertussis
cgcgaugcgcagcag

SEQ ID NO: 423348 - RNA, 16 nt, Bordetella pertussis
cgcgauguccagcucc

SEQ ID NO: 423349 - RNA, 20 nt, Bordetella pertussis
cgcgauguccagcuccagcg

SEQ ID NO: 423350 - RNA, 17 nt, Bordetella pertussis
cgcgauggucaccaccc

SEQ ID NO: 423351 - RNA, 19 nt, Bordetella pertussis
cgcgauggucaccacccgc

SEQ ID NO: 423352 - RNA, 20 nt, Bordetella pertussis
cgcgaugucgcgcgcgcuca

SEQ ID NO: 423353 - RNA, 13 nt, Bordetella pertussis
cgcgauguucgga

SEQ ID NO: 423354 - RNA, 20 nt, Bordetella pertussis
cgcgauugaguucgcgcgcc

SEQ ID NO: 423355 - RNA, 19 nt, Bordetella pertussis
cgcgauuuccuugcgccgc

SEQ ID NO: 423356 - RNA, 20 nt, Bordetella pertussis
cgcgauuuccuugcgccgcc

SEQ ID NO: 423357 - RNA, 19 nt, Bordetella pertussis
cgcgcaaaccgacgcggcc

SEQ ID NO: 423358 - RNA, 23 nt, Bordetella pertussis
cgcgcaaaccgacgcggccagcg

SEQ ID NO: 423359 - RNA, 22 nt, Bordetella pertussis
cgcgcaacacgcgcgacgccgu

SEQ ID NO: 423360 - RNA, 22 nt, Bordetella pertussis
cgcgcaacauggugaccggggc

SEQ ID NO: 423361 - RNA, 15 nt, Bordetella pertussis
cgcgcaagccgccgc

SEQ ID NO: 423362 - RNA, 17 nt, Bordetella pertussis
cgcgcaaugcgcggcgc

SEQ ID NO: 423363 - RNA, 14 nt, Bordetella pertussis
cgcgcaauugcuuc

SEQ ID NO: 423364 - RNA, 18 nt, Bordetella pertussis
cgcgcacaaacgcacgau

SEQ ID NO: 423365 - RNA, 21 nt, Bordetella pertussis
cgcgcacagcgcggcgaugcc

SEQ ID NO: 423366 - RNA, 16 nt, Bordetella pertussis
cgcgcaccagcccgcc

SEQ ID NO: 423367 - RNA, 13 nt, Bordetella pertussis
cgcgcaccaggcc

SEQ ID NO: 423368 - RNA, 14 nt, Bordetella pertussis
cgcgcaccaggccu

SEQ ID NO: 423369 - RNA, 15 nt, Bordetella pertussis
cgcgcaccaggcgcg

SEQ ID NO: 423370 - RNA, 20 nt, Bordetella pertussis
cgcgcaccaggucgcggugc

SEQ ID NO: 423371 - RNA, 17 nt, Bordetella pertussis
cgcgcacccgcaggccg

SEQ ID NO: 423372 - RNA, 13 nt, Bordetella pertussis
cgcgcaccggcuu

SEQ ID NO: 423373 - RNA, 17 nt, Bordetella pertussis
cgcgcacgaccaccagc

SEQ ID NO: 423374 - RNA, 15 nt, Bordetella pertussis
cgcgcacgacgucgc

SEQ ID NO: 423375 - RNA, 22 nt, Bordetella pertussis
cgcgcacgacgucgcgcggauc

SEQ ID NO: 423376 - RNA, 13 nt, Bordetella pertussis
cgcgcacgcgcuu

SEQ ID NO: 423377 - RNA, 16 nt, Bordetella pertussis
cgcgcacgcugggcga

SEQ ID NO: 423378 - RNA, 11 nt, Bordetella pertussis
cgcgcacggcc

SEQ ID NO: 423379 - RNA, 15 nt, Bordetella pertussis
cgcgcacguggacca

SEQ ID NO: 423380 - RNA, 17 nt, Bordetella pertussis
cgcgcagaucccaggcg

SEQ ID NO: 423381 - RNA, 17 nt, Bordetella pertussis
cgcgcagcaccgccagc

SEQ ID NO: 423382 - RNA, 14 nt, Bordetella pertussis
cgcgcagcaccggc

SEQ ID NO: 423383 - RNA, 13 nt, Bordetella pertussis
cgcgcagcacgau

SEQ ID NO: 423384 - RNA, 22 nt, Bordetella pertussis
cgcgcagcacgauggggccaug

SEQ ID NO: 423385 - RNA, 14 nt, Bordetella pertussis
cgcgcagcacgccc

SEQ ID NO: 423386 - RNA, 23 nt, Bordetella pertussis
cgcgcagcacgcugcgcggcggc

SEQ ID NO: 423387 - RNA, 20 nt, Bordetella pertussis
cgcgcagcaggguggccacg

SEQ ID NO: 423388 - RNA, 21 nt, Bordetella pertussis
cgcgcagccacagcgcguggc

SEQ ID NO: 423389 - RNA, 15 nt, Bordetella pertussis
cgcgcagcccggcgu

SEQ ID NO: 423390 - RNA, 20 nt, Bordetella pertussis
cgcgcagcgccugcaggcgg

SEQ ID NO: 423391 - RNA, 22 nt, Bordetella pertussis
cgcgcagcggcaggcccugccg

SEQ ID NO: 423392 - RNA, 21 nt, Bordetella pertussis
cgcgcagcucccccacgccgc

SEQ ID NO: 423393 - RNA, 18 nt, Bordetella pertussis
cgcgcaggacaaggcgcg

SEQ ID NO: 423394 - RNA, 22 nt, Bordetella pertussis
cgcgcaggacaaggcgcgcgcc

SEQ ID NO: 423395 - RNA, 15 nt, Bordetella pertussis
cgcgcaggcgggccu

SEQ ID NO: 423396 - RNA, 22 nt, Bordetella pertussis
cgcgcaggcgugcgcgggcgcc

SEQ ID NO: 423397 - RNA, 18 nt, Bordetella pertussis
cgcgcagggcggccggca

SEQ ID NO: 423398 - RNA, 22 nt, Bordetella pertussis
cgcgcagggcggccggcacgcc

SEQ ID NO: 423399 - RNA, 13 nt, Bordetella pertussis
cgcgcaucggccg

SEQ ID NO: 423400 - RNA, 15 nt, Bordetella pertussis
cgcgcaucgggaucc

SEQ ID NO: 423401 - RNA, 16 nt, Bordetella pertussis
cgcgcaugccagcuug

SEQ ID NO: 423402 - RNA, 16 nt, Bordetella pertussis
cgcgcaugcgccuuac

SEQ ID NO: 423403 - RNA, 21 nt, Bordetella pertussis
cgcgcauggacugcaggcgcu

SEQ ID NO: 423404 - RNA, 11 nt, Bordetella pertussis
cgcgcauggcg

SEQ ID NO: 423405 - RNA, 18 nt, Bordetella pertussis
cgcgcauucgucgcugcc

SEQ ID NO: 423406 - RNA, 21 nt, Bordetella pertussis
cgcgcauuucgaacaaggcgg

SEQ ID NO: 423407 - RNA, 19 nt, Bordetella pertussis
cgcgcauuucgaccugcgc

SEQ ID NO: 423408 - RNA, 17 nt, Bordetella pertussis
cgcgccacacgggcgcc

SEQ ID NO: 423409 - RNA, 15 nt, Bordetella pertussis
cgcgccacaggcgcu

SEQ ID NO: 423410 - RNA, 21 nt, Bordetella pertussis
cgcgccacauccugcacggcg

SEQ ID NO: 423411 - RNA, 21 nt, Bordetella pertussis
cgcgccacggcuucgcccagc

SEQ ID NO: 423412 - RNA, 14 nt, Bordetella pertussis
cgcgccagccgcgc

SEQ ID NO: 423413 - RNA, 18 nt, Bordetella pertussis
cgcgccagccgcugcagc

SEQ ID NO: 423414 - RNA, 16 nt, Bordetella pertussis
cgcgccagcgccacgc

SEQ ID NO: 423415 - RNA, 14 nt, Bordetella pertussis
cgcgccagcgccuc

SEQ ID NO: 423416 - RNA, 16 nt, Bordetella pertussis
cgcgccagcgcgcgau

SEQ ID NO: 423417 - RNA, 18 nt, Bordetella pertussis
cgcgccagcgcggccagc

SEQ ID NO: 423418 - RNA, 20 nt, Bordetella pertussis
cgcgccagcugaccucgccc

SEQ ID NO: 423419 - RNA, 13 nt, Bordetella pertussis
cgcgccagcugcg

SEQ ID NO: 423420 - RNA, 20 nt, Bordetella pertussis
cgcgccaggauggccacgac

SEQ ID NO: 423421 - RNA, 21 nt, Bordetella pertussis
cgcgccaggauggccacgacc

SEQ ID NO: 423422 - RNA, 16 nt, Bordetella pertussis
cgcgccaggcccaggg

SEQ ID NO: 423423 - RNA, 20 nt, Bordetella pertussis
cgcgccaggccccgccgggc

SEQ ID NO: 423424 - RNA, 17 nt, Bordetella pertussis
cgcgccaggcgccgggc

SEQ ID NO: 423425 - RNA, 17 nt, Bordetella pertussis
cgcgccaggcgcgcauc

SEQ ID NO: 423426 - RNA, 13 nt, Bordetella pertussis
cgcgccaggcgcu

SEQ ID NO: 423427 - RNA, 23 nt, Bordetella pertussis
cgcgccaggcgguacaggccggc

SEQ ID NO: 423428 - RNA, 12 nt, Bordetella pertussis
cgcgccaggcgu

SEQ ID NO: 423429 - RNA, 17 nt, Bordetella pertussis
cgcgccaggucgcgcac

SEQ ID NO: 423430 - RNA, 18 nt, Bordetella pertussis
cgcgccagggcgcggauc

SEQ ID NO: 423431 - RNA, 20 nt, Bordetella pertussis
cgcgccaguugcgcaccgcu

SEQ ID NO: 423432 - RNA, 16 nt, Bordetella pertussis
cgcgccaguucaaggc

SEQ ID NO: 423433 - RNA, 22 nt, Bordetella pertussis
cgcgccaucgacgggcggcugc

SEQ ID NO: 423434 - RNA, 22 nt, Bordetella pertussis
cgcgccaugaaagcgaacaggg

SEQ ID NO: 423435 - RNA, 19 nt, Bordetella pertussis
cgcgccaugaacucgcgcu

SEQ ID NO: 423436 - RNA, 18 nt, Bordetella pertussis
cgcgccaugagccacaau

SEQ ID NO: 423437 - RNA, 20 nt, Bordetella pertussis
cgcgccauggucucccccuc

SEQ ID NO: 423438 - RNA, 12 nt, Bordetella pertussis
cgcgccaugucg

SEQ ID NO: 423439 - RNA, 22 nt, Bordetella pertussis
cgcgccauugccacggcgggcc

SEQ ID NO: 423440 - RNA, 22 nt, Bordetella pertussis
cgcgcccaauccgaucagcacg

SEQ ID NO: 423441 - RNA, 14 nt, Bordetella pertussis
cgcgcccagcagcg

SEQ ID NO: 423442 - RNA, 12 nt, Bordetella pertussis
cgcgcccagccc

SEQ ID NO: 423443 - RNA, 21 nt, Bordetella pertussis
cgcgcccagccccgcggccgc

SEQ ID NO: 423444 - RNA, 16 nt, Bordetella pertussis
cgcgcccagcggcagg

SEQ ID NO: 423445 - RNA, 18 nt, Bordetella pertussis
cgcgcccagggugguggc

SEQ ID NO: 423446 - RNA, 15 nt, Bordetella pertussis
cgcgcccccagcgcc

SEQ ID NO: 423447 - RNA, 14 nt, Bordetella pertussis
cgcgcccgagcgcc

SEQ ID NO: 423448 - RNA, 14 nt, Bordetella pertussis
cgcgcccgaggcgc

SEQ ID NO: 423449 - RNA, 22 nt, Bordetella pertussis
cgcgcccgaggcgcgcagcacg

SEQ ID NO: 423450 - RNA, 13 nt, Bordetella pertussis
cgcgcccgagugg

SEQ ID NO: 423451 - RNA, 22 nt, Bordetella pertussis
cgcgcccgcaggcggcggccuc

SEQ ID NO: 423452 - RNA, 18 nt, Bordetella pertussis
cgcgcccggcggccaggc

SEQ ID NO: 423453 - RNA, 18 nt, Bordetella pertussis
cgcgcccugcacgcgcgc

SEQ ID NO: 423454 - RNA, 14 nt, Bordetella pertussis
cgcgccgaacgcgc

SEQ ID NO: 423455 - RNA, 17 nt, Bordetella pertussis
cgcgccgaacgcgcagc

SEQ ID NO: 423456 - RNA, 22 nt, Bordetella pertussis
cgcgcccugcuugagcgaaaug

SEQ ID NO: 423457 - RNA, 19 nt, Bordetella pertussis
cgcgccgaccacgcugggc

SEQ ID NO: 423458 - RNA, 20 nt, Bordetella pertussis
cgcgccgaccacgcugggcc

SEQ ID NO: 423459 - RNA, 18 nt, Bordetella pertussis
cgcgccgaugcgccaggc

SEQ ID NO: 423460 - RNA, 18 nt, Bordetella pertussis
cgcgccgcaauagaucau

SEQ ID NO: 423461 - RNA, 16 nt, Bordetella pertussis
cgcgccgccagcgcgc

SEQ ID NO: 423462 - RNA, 15 nt, Bordetella pertussis
cgcgccgccaggcgc

SEQ ID NO: 423463 - RNA, 16 nt, Bordetella pertussis
cgcgccgccaggcgcg

SEQ ID NO: 423464 - RNA, 19 nt, Bordetella pertussis
cgcgccgcccaccaccagc

SEQ ID NO: 423465 - RNA, 14 nt, Bordetella pertussis
cgcgccgcccccgc

SEQ ID NO: 423466 - RNA, 19 nt, Bordetella pertussis
cgcgccgcccccgcccagc

SEQ ID NO: 423467 - RNA, 15 nt, Bordetella pertussis
cgcgccgcccgcggc

SEQ ID NO: 423468 - RNA, 22 nt, Bordetella pertussis
cgcgccgcccgcggccagccac

SEQ ID NO: 423469 - RNA, 13 nt, Bordetella pertussis
cgcgccgcccggg

SEQ ID NO: 423470 - RNA, 13 nt, Bordetella pertussis
cgcgccgccgccc

SEQ ID NO: 423471 - RNA, 17 nt, Bordetella pertussis
cgcgccgccgcccuggc

SEQ ID NO: 423472 - RNA, 16 nt, Bordetella pertussis
cgcgccgccgccuggc

SEQ ID NO: 423473 - RNA, 19 nt, Bordetella pertussis
cgcgccgccucgcgcucca

SEQ ID NO: 423474 - RNA, 22 nt, Bordetella pertussis
cgcgccgccguaggacagcccc

SEQ ID NO: 423475 - RNA, 13 nt, Bordetella pertussis
cgcgccgccuggc

SEQ ID NO: 423476 - RNA, 14 nt, Bordetella pertussis
cgcgccgcgacgcu

SEQ ID NO: 423477 - RNA, 13 nt, Bordetella pertussis
cgcgccgcgcaga

SEQ ID NO: 423478 - RNA, 13 nt, Bordetella pertussis
cgcgccgcgcgca

SEQ ID NO: 423479 - RNA, 13 nt, Bordetella pertussis
cgcgccgcggcac

SEQ ID NO: 423480 - RNA, 14 nt, Bordetella pertussis
cgcgccgcggcacg

SEQ ID NO: 423481 - RNA, 23 nt, Bordetella pertussis
cgcgccgcguugcagccacaggc

SEQ ID NO: 423482 - RNA, 15 nt, Bordetella pertussis
cgcgccgcucuuggc

SEQ ID NO: 423483 - RNA, 16 nt, Bordetella pertussis
cgcgccgcucuuggcg

SEQ ID NO: 423484 - RNA, 14 nt, Bordetella pertussis
cgcgccgcugcagc

SEQ ID NO: 423485 - RNA, 15 nt, Bordetella pertussis
cgcgccgcugcagcg

SEQ ID NO: 423486 - RNA, 22 nt, Bordetella pertussis
cgcgccgcuguugcccaccagc

SEQ ID NO: 423487 - RNA, 16 nt, Bordetella pertussis
cgcgccggcccaaggc

SEQ ID NO: 423488 - RNA, 15 nt, Bordetella pertussis
cgcgccggcccaggc

SEQ ID NO: 423489 - RNA, 11 nt, Bordetella pertussis
cgcgccggccg

SEQ ID NO: 423490 - RNA, 13 nt, Bordetella pertussis
cgcgccggccgcc

SEQ ID NO: 423491 - RNA, 13 nt, Bordetella pertussis
cgcgccggcgcgc

SEQ ID NO: 423492 - RNA, 16 nt, Bordetella pertussis
cgcgccggcggccugc

SEQ ID NO: 423493 - RNA, 22 nt, Bordetella pertussis
cgcgccggcggccugcaggccg

SEQ ID NO: 423494 - RNA, 20 nt, Bordetella pertussis
cgcggaucgaaaccggcgcg

SEQ ID NO: 423495 - RNA, 23 nt, Bordetella pertussis
cgcggaucgaaaccggcgcgcgc

SEQ ID NO: 423496 - RNA, 20 nt, Bordetella pertussis
cgcggaucgugucgaacgga

SEQ ID NO: 423497 - RNA, 18 nt, Bordetella pertussis
cgcggaugaccugcgcca

SEQ ID NO: 423498 - RNA, 15 nt, Bordetella pertussis
cgcggaugcgcgccu

SEQ ID NO: 423499 - RNA, 21 nt, Bordetella pertussis
cgcggauugaugucgcgcacc

SEQ ID NO: 423500 - RNA, 22 nt, Bordetella pertussis
cgcggcaggccccggcccggcg

SEQ ID NO: 423501 - RNA, 23 nt, Bordetella pertussis
cgcggcaggccccggcccggcgg

SEQ ID NO: 423502 - RNA, 19 nt, Bordetella pertussis
cgcggcauagcccaggccg

SEQ ID NO: 423503 - RNA, 24 nt, Bordetella pertussis
cgcggcauacgccgauggcgcggc

SEQ ID NO: 423504 - RNA, 23 nt, Bordetella pertussis
cgcggcaucgagaaaccagccgc

SEQ ID NO: 423505 - RNA, 14 nt, Bordetella pertussis
cgcggcaugcgcau

SEQ ID NO: 423506 - RNA, 14 nt, Bordetella pertussis
cgcggcauggcgcc

SEQ ID NO: 423507 - RNA, 13 nt, Bordetella pertussis
cgcggccaacccc

SEQ ID NO: 423508 - RNA, 20 nt, Bordetella pertussis
cgcggcccagcgcggcggcc

SEQ ID NO: 423509 - RNA, 22 nt, Bordetella pertussis
cgcggccccggcucccgcgcca

SEQ ID NO: 423510 - RNA, 23 nt, Bordetella pertussis
cgcggcccgccacgcaggcgggc

SEQ ID NO: 423511 - RNA, 14 nt, Bordetella pertussis
cgcggcccggccgc

SEQ ID NO: 423512 - RNA, 19 nt, Bordetella pertussis
cgcggccgagcgggccagc

SEQ ID NO: 423513 - RNA, 18 nt, Bordetella pertussis
cgcggccgagcuccucga

SEQ ID NO: 423514 - RNA, 13 nt, Bordetella pertussis
cgcggccgccagc

SEQ ID NO: 423515 - RNA, 16 nt, Bordetella pertussis
cgcggccgcccccagc

SEQ ID NO: 423516 - RNA, 22 nt, Bordetella pertussis
cgcggccgcccccagcgcgccu

SEQ ID NO: 423517 - RNA, 23 nt, Bordetella pertussis
cgcggccgcccccagcgcgccug

SEQ ID NO: 423518 - RNA, 12 nt, Bordetella pertussis
cgcggccgcccc

SEQ ID NO: 423519 - RNA, 14 nt, Bordetella pertussis
cgcggccgccgccc

SEQ ID NO: 423520 - RNA, 13 nt, Bordetella pertussis
cgcggccgcgcgc

SEQ ID NO: 423521 - RNA, 14 nt, Bordetella pertussis
cgcggccgcgcgcu

SEQ ID NO: 423522 - RNA, 17 nt, Bordetella pertussis
cgcggccgcgggccgcu

SEQ ID NO: 423523 - RNA, 14 nt, Bordetella pertussis
cgcggccggccgcg

SEQ ID NO: 423524 - RNA, 13 nt, Bordetella pertussis
cgcggccggccgg

SEQ ID NO: 423525 - RNA, 15 nt, Bordetella pertussis
cgcggccggccugcu

SEQ ID NO: 423526 - RNA, 14 nt, Bordetella pertussis
cgcggccggcgcgc

SEQ ID NO: 423527 - RNA, 15 nt, Bordetella pertussis
cgcggccggcgcgcc

SEQ ID NO: 423528 - RNA, 23 nt, Bordetella pertussis
cgcggccggcgcgccggccugcg

SEQ ID NO: 423529 - RNA, 13 nt, Bordetella pertussis
cgcggccggcggc

SEQ ID NO: 423530 - RNA, 18 nt, Bordetella pertussis
cgcggccgucaccgccgc

SEQ ID NO: 423531 - RNA, 14 nt, Bordetella pertussis
cgcggccgucggcg

SEQ ID NO: 423532 - RNA, 16 nt, Bordetella pertussis
cgcggccgucggcgcu

SEQ ID NO: 423533 - RNA, 16 nt, Bordetella pertussis
cgcggccgucgugcag

SEQ ID NO: 423534 - RNA, 19 nt, Bordetella pertussis
cgcggccguguucgagcag

SEQ ID NO: 423535 - RNA, 21 nt, Bordetella pertussis
cgcggccguguucgagcaggc

SEQ ID NO: 423536 - RNA, 19 nt, Bordetella pertussis
cgcggccguuggcgauggc

SEQ ID NO: 423537 - RNA, 15 nt, Bordetella pertussis
cgcggccguggcggc

SEQ ID NO: 423538 - RNA, 19 nt, Bordetella pertussis
cgcggccguggcggccugc

SEQ ID NO: 423539 - RNA, 15 nt, Bordetella pertussis
cgcggcgagcgccgc

SEQ ID NO: 423540 - RNA, 19 nt, Bordetella pertussis
cgcggcgagcgccgccagg

SEQ ID NO: 423541 - RNA, 18 nt, Bordetella pertussis
cgcggcgauacgcgccgc

SEQ ID NO: 423542 - RNA, 21 nt, Bordetella pertussis
cgcggcgauacgcgccgccug

SEQ ID NO: 423543 - RNA, 22 nt, Bordetella pertussis
cgcggcgaugccggccagcagc

SEQ ID NO: 423544 - RNA, 22 nt, Bordetella pertussis
cgcggcgcagcaugagcugaug

SEQ ID NO: 423545 - RNA, 19 nt, Bordetella pertussis
cgcggcgcagguccaccgc

SEQ ID NO: 423546 - RNA, 12 nt, Bordetella pertussis
cgcggcgcagca

SEQ ID NO: 423547 - RNA, 13 nt, Bordetella pertussis
cgcggcgcccagc

SEQ ID NO: 423548 - RNA, 22 nt, Bordetella pertussis
cgcggcgcccagcuggcgcccc

SEQ ID NO: 423549 - RNA, 13 nt, Bordetella pertussis
cgcggcgccgccg

SEQ ID NO: 423550 - RNA, 20 nt, Bordetella pertussis
cgcggcgccgcuggccacgu

SEQ ID NO: 423551 - RNA, 14 nt, Bordetella pertussis
cgcggcgccggccu

SEQ ID NO: 423552 - RNA, 20 nt, Bordetella pertussis
cgcggcgccggccuccagca

SEQ ID NO: 423553 - RNA, 22 nt, Bordetella pertussis
cgcggcgccguccagcgcggca

SEQ ID NO: 423554 - RNA, 18 nt, Bordetella pertussis
cgcggcgccugccugccg

SEQ ID NO: 423555 - RNA, 15 nt, Bordetella pertussis
cgcggcgccuggggc

SEQ ID NO: 423556 - RNA, 14 nt, Bordetella pertussis
cgcggcgcgcgcca

SEQ ID NO: 423557 - RNA, 23 nt, Bordetella pertussis
cgcggcgcgcgccagggcgccgc

SEQ ID NO: 423558 - RNA, 14 nt, Bordetella pertussis
cgcggcgcgcgccg

SEQ ID NO: 423559 - RNA, 15 nt, Bordetella pertussis
cgcggcgcgcgccug

SEQ ID NO: 423560 - RNA, 15 nt, Bordetella pertussis
cgcggcgcgcgcgcg

SEQ ID NO: 423561 - RNA, 18 nt, Bordetella pertussis
cgcggcgcgcgcgcgcag

SEQ ID NO: 423562 - RNA, 12 nt, Bordetella pertussis
cgcggcgcgccg

SEQ ID NO: 423563 - RNA, 22 nt, Bordetella pertussis
cgcggcgcgccguccgggccgg

SEQ ID NO: 423564 - RNA, 15 nt, Bordetella pertussis
cgcggcgcggcaggu

SEQ ID NO: 423565 - RNA, 14 nt, Bordetella pertussis
cgcggcgcggcgca

SEQ ID NO: 423566 - RNA, 16 nt, Bordetella pertussis
cgcggcgcgucgcgcg

SEQ ID NO: 423567 - RNA, 22 nt, Bordetella pertussis
cgcggcgcguucucagccgccc

SEQ ID NO: 423568 - RNA, 20 nt, Bordetella pertussis
cgcggcgcugcuggccggcc

SEQ ID NO: 423569 - RNA, 17 nt, Bordetella pertussis
cgcggcgcuggcgccgc

SEQ ID NO: 423570 - RNA, 24 nt, Bordetella pertussis
cgcggcuccagcucagcagcgcca

SEQ ID NO: 423571 - RNA, 13 nt, Bordetella pertussis
cgcggcucgccgg

SEQ ID NO: 423572 - RNA, 22 nt, Bordetella pertussis
cgcggcucgccggccgcgccca

SEQ ID NO: 423573 - RNA, 12 nt, Bordetella pertussis
cgcggcuggcug

SEQ ID NO: 423574 - RNA, 22 nt, Bordetella pertussis
cgcggcugguggugccgcgcac

SEQ ID NO: 423575 - RNA, 23 nt, Bordetella pertussis
cgcggcugguggugccgcgcacg

SEQ ID NO: 423576 - RNA, 22 nt, Bordetella pertussis
cgcgggcagggcgggggacgcc

SEQ ID NO: 423577 - RNA, 12 nt, Bordetella pertussis
cgcgggccagcu

SEQ ID NO: 423578 - RNA, 17 nt, Bordetella pertussis
cgcgggccaggccggcc

SEQ ID NO: 423579 - RNA, 19 nt, Bordetella pertussis
cgcgggccaggccggccca

SEQ ID NO: 423580 - RNA, 17 nt, Bordetella pertussis
cgcgggcccgcucggcc

SEQ ID NO: 423581 - RNA, 20 nt, Bordetella pertussis
cgcgggcccgcucggccagc

SEQ ID NO: 423582 - RNA, 22 nt, Bordetella pertussis
cgcgggcccuggcguucgcgcg

SEQ ID NO: 423583 - RNA, 13 nt, Bordetella pertussis
cgcgggccgccgc

SEQ ID NO: 423584 - RNA, 18 nt, Bordetella pertussis
cgcgggccgccgcacagc

SEQ ID NO: 423585 - RNA, 22 nt, Bordetella pertussis
cgcgggccuacuugccggcgcu

SEQ ID NO: 423586 - RNA, 20 nt, Bordetella pertussis
cgcgggccuuggccagcagc

SEQ ID NO: 423587 - RNA, 12 nt, Bordetella pertussis
cgcggggccggu

SEQ ID NO: 423588 - RNA, 24 nt, Bordetella pertussis
cgcgggggauagacccuccucgcu

SEQ ID NO: 423589 - RNA, 14 nt, Bordetella pertussis
cgcggguccuugcc

SEQ ID NO: 423590 - RNA, 13 nt, Bordetella pertussis
cgcgggugcgggc

SEQ ID NO: 423591 - RNA, 18 nt, Bordetella pertussis
cgcgggugucgcuccccc

SEQ ID NO: 423592 - RNA, 15 nt, Bordetella pertussis
cgcgguaaugacgca

SEQ ID NO: 423593 - RNA, 23 nt, Bordetella pertussis
cgcgguaaugacgcagccgcccg

SEQ ID NO: 423594 - RNA, 14 nt, Bordetella pertussis
cgcgguagcgcccc

SEQ ID NO: 423595 - RNA, 15 nt, Bordetella pertussis
cgcgguagcgccccu

SEQ ID NO: 423596 - RNA, 17 nt, Bordetella pertussis
cgcgguaggacggcagc

SEQ ID NO: 423597 - RNA, 18 nt, Bordetella pertussis
cgcgguaggacggcagca

SEQ ID NO: 423598 - RNA, 21 nt, Bordetella pertussis
cgcgguauugcgccaccccgc

SEQ ID NO: 423599 - RNA, 15 nt, Bordetella pertussis
cgcgguauccagguc

SEQ ID NO: 423600 - RNA, 16 nt, Bordetella pertussis
cgcgguauggccgccc

SEQ ID NO: 423601 - RNA, 17 nt, Bordetella pertussis
cgcggucagccagagcg

SEQ ID NO: 423602 - RNA, 15 nt, Bordetella pertussis
cgcgguccacgcggg

SEQ ID NO: 423603 - RNA, 18 nt, Bordetella pertussis
cgcgguccagcaccaggg

SEQ ID NO: 423604 - RNA, 21 nt, Bordetella pertussis
cgcgguccagcaccagggcgc

SEQ ID NO: 423605 - RNA, 14 nt, Bordetella pertussis
cgcgguccagcacg

SEQ ID NO: 423606 - RNA, 14 nt, Bordetella pertussis
cgcgguccagcccc

SEQ ID NO: 423607 - RNA, 20 nt, Bordetella pertussis
cgcgguccagccccugcccg

SEQ ID NO: 423608 - RNA, 12 nt, Bordetella pertussis
cgcgguccgcag

SEQ ID NO: 423609 - RNA, 20 nt, Bordetella pertussis
cgcggucgcauuggccgccg

SEQ ID NO: 423610 - RNA, 19 nt, Bordetella pertussis
cgcggucgggaucauccug

SEQ ID NO: 423611 - RNA, 20 nt, Bordetella pertussis
cgcggugcaagcggccggcc

SEQ ID NO: 423612 - RNA, 21 nt, Bordetella pertussis
cgcggugcaagcggccggccu

SEQ ID NO: 423613 - RNA, 19 nt, Bordetella pertussis
cgcgguucgcauagcgccg

SEQ ID NO: 423614 - RNA, 20 nt, Bordetella pertussis
cgcgguugguuugcggcgcg

SEQ ID NO: 423615 - RNA, 18 nt, Bordetella pertussis
cgcgucaggccgggcagc

SEQ ID NO: 423616 - RNA, 21 nt, Bordetella pertussis
cgcgucauacacggcgcgggc

SEQ ID NO: 423617 - RNA, 21 nt, Bordetella pertussis
cgcguccaagcagacccgcgc

SEQ ID NO: 423618 - RNA, 14 nt, Bordetella pertussis
cgcguccagcgcgc

SEQ ID NO: 423619 - RNA, 16 nt, Bordetella pertussis
cgcguccaggcccagc

SEQ ID NO: 423620 - RNA, 23 nt, Bordetella pertussis
cgcguccaggcccagcgcguccu

SEQ ID NO: 423621 - RNA, 17 nt, Bordetella pertussis
cgcguccaggcccuggc

SEQ ID NO: 423622 - RNA, 22 nt, Bordetella pertussis
cgcguccaucuggaccgcgcgc

SEQ ID NO: 423623 - RNA, 22 nt, Bordetella pertussis
cgcguccgcccgcuccaccagc

SEQ ID NO: 423624 - RNA, 24 nt, Bordetella pertussis
cgcguccgcucaugccggcaagca

SEQ ID NO: 423625 - RNA, 14 nt, Bordetella pertussis
cgcguccucggcca

SEQ ID NO: 423626 - RNA, 13 nt, Bordetella pertussis
cgcguccugccag

SEQ ID NO: 423627 - RNA, 18 nt, Bordetella pertussis
cgcgucgacggugcgcgc

SEQ ID NO: 423628 - RNA, 14 nt, Bordetella pertussis
cgcgucgagcgcga

SEQ ID NO: 423629 - RNA, 18 nt, Bordetella pertussis
cgcgucgaucagcgcggg

SEQ ID NO: 423630 - RNA, 17 nt, Bordetella pertussis
cgcgucgauccggcagc

SEQ ID NO: 423631 - RNA, 21 nt, Bordetella pertussis
cgcgucgccgcuggccagccg

SEQ ID NO: 423632 - RNA, 17 nt, Bordetella pertussis
cgcgucgcgcgccaggc

SEQ ID NO: 423633 - RNA, 20 nt, Bordetella pertussis
cgcgucgcguagcgcggccg

SEQ ID NO: 423634 - RNA, 15 nt, Bordetella pertussis
cgcgucggccaaggc

SEQ ID NO: 423635 - RNA, 14 nt, Bordetella pertussis
cgcgucggacgcgc

SEQ ID NO: 423636 - RNA, 17 nt, Bordetella pertussis
cgcgucggacgcgcgcc

SEQ ID NO: 423637 - RNA, 20 nt, Bordetella pertussis
cgcgugacgauauccaggcg

SEQ ID NO: 423638 - RNA, 20 nt, Bordetella pertussis
cgcgugcagccagcggccga

SEQ ID NO: 423639 - RNA, 15 nt, Bordetella pertussis
cgcgugcaggccgcg

SEQ ID NO: 423640 - RNA, 20 nt, Bordetella pertussis
cgcgugcagguaggacggcg

SEQ ID NO: 423641 - RNA, 14 nt, Bordetella pertussis
cgcgugccagcagg

SEQ ID NO: 423642 - RNA, 13 nt, Bordetella pertussis
cgcgugccgcgca

SEQ ID NO: 423643 - RNA, 13 nt, Bordetella pertussis
cgcgugcgcggcc

SEQ ID NO: 423644 - RNA, 14 nt, Bordetella pertussis
cgcgugcgcggccg

SEQ ID NO: 423645 - RNA, 16 nt, Bordetella pertussis
cgcgugcgcggccgcg

SEQ ID NO: 423646 - RNA, 15 nt, Bordetella pertussis
cgcgugcgcgcgcca

SEQ ID NO: 423647 - RNA, 15 nt, Bordetella pertussis
cgcuaccccggcagc

SEQ ID NO: 423648 - RNA, 18 nt, Bordetella pertussis
cgcuaccgcuucccuggc

SEQ ID NO: 423649 - RNA, 21 nt, Bordetella pertussis
cgcuacgacgagaucgcgccu

SEQ ID NO: 423650 - RNA, 14 nt, Bordetella pertussis
cgcuacgccgccga

SEQ ID NO: 423651 - RNA, 19 nt, Bordetella pertussis
cgcuacgggcgcugcacgc

SEQ ID NO: 423652 - RNA, 19 nt, Bordetella pertussis
cgcuaugcgggcuugcugc

SEQ ID NO: 423653 - RNA, 20 nt, Bordetella pertussis
cgcucagcgcggcgcggcca

SEQ ID NO: 423654 - RNA, 13 nt, Bordetella pertussis
cgcucagccuugu

SEQ ID NO: 423655 - RNA, 17 nt, Bordetella pertussis
cgcucaggaaccagcgg

SEQ ID NO: 423656 - RNA, 18 nt, Bordetella pertussis
cgcucagggggcgcccca

SEQ ID NO: 423657 - RNA, 16 nt, Bordetella pertussis
cgcucggcuuccugcc

SEQ ID NO: 423658 - RNA, 22 nt, Bordetella pertussis
cgcucggucauguccagcgcca

SEQ ID NO: 423659 - RNA, 19 nt, Bordetella pertussis
cgcucgucaugaucccgcg

SEQ ID NO: 423660 - RNA, 22 nt, Bordetella pertussis
cgcucgucaugaucccgcgccu

SEQ ID NO: 423661 - RNA, 21 nt, Bordetella pertussis
cgcucuccgaacaggcggucu

SEQ ID NO: 423662 - RNA, 15 nt, Bordetella pertussis
cgcucugcgcggcau

SEQ ID NO: 423663 - RNA, 15 nt, Bordetella pertussis
cgcugaagcgccgcc

SEQ ID NO: 423664 - RNA, 21 nt, Bordetella pertussis
cgcugaaggaccucgcgccgg

SEQ ID NO: 423665 - RNA, 22 nt, Bordetella pertussis
cgcugaaggaccucgcgccggu

SEQ ID NO: 423666 - RNA, 21 nt, Bordetella pertussis
cgcugaauccggggugccugu

SEQ ID NO: 423667 - RNA, 13 nt, Bordetella pertussis
cgcugaccagcac

SEQ ID NO: 423668 - RNA, 20 nt, Bordetella pertussis
cgcugaccgagggcgcgucc

SEQ ID NO: 423669 - RNA, 15 nt, Bordetella pertussis
cgcugaccggccugg

SEQ ID NO: 423670 - RNA, 13 nt, Bordetella pertussis
cgcugaccggcgg

SEQ ID NO: 423671 - RNA, 19 nt, Bordetella pertussis
cgcugaccggcggcacggc

SEQ ID NO: 423672 - RNA, 15 nt, Bordetella pertussis
cgcugauccuggcuc

SEQ ID NO: 423673 - RNA, 18 nt, Bordetella pertussis
cgcugaugcgcggcgggc

SEQ ID NO: 423674 - RNA, 17 nt, Bordetella pertussis
cgcugauggccgccagc

SEQ ID NO: 423675 - RNA, 19 nt, Bordetella pertussis
cgcugauggccgccagcgg

SEQ ID NO: 423676 - RNA, 23 nt, Bordetella pertussis
cgcugccagggugcaccaggugg

SEQ ID NO: 423677 - RNA, 20 nt, Bordetella pertussis
cgcugcccaccuuccugcug

SEQ ID NO: 423678 - RNA, 19 nt, Bordetella pertussis
cgcugcccagccacaccag

SEQ ID NO: 423679 - RNA, 22 nt, Bordetella pertussis
cgcugcccagcgucagcugggc

SEQ ID NO: 423680 - RNA, 21 nt, Bordetella pertussis
cgcugccgagacggccgccga

SEQ ID NO: 423681 - RNA, 12 nt, Bordetella pertussis
cgcugcgcacgc

SEQ ID NO: 423682 - RNA, 17 nt, Bordetella pertussis
cgcugcgcagcagggcg

SEQ ID NO: 423683 - RNA, 13 nt, Bordetella pertussis
cgcugcgcauggc

SEQ ID NO: 423684 - RNA, 16 nt, Bordetella pertussis
cgcugcgccgaggccu

SEQ ID NO: 423685 - RNA, 20 nt, Bordetella pertussis
cgcugcgccggcggcaccgc

SEQ ID NO: 423686 - RNA, 18 nt, Bordetella pertussis
cgcugcgccuuggcgcgc

SEQ ID NO: 423687 - RNA, 19 nt, Bordetella pertussis
cgcugcgcgaacgcggcca

SEQ ID NO: 423688 - RNA, 13 nt, Bordetella pertussis
cgcugcgcgcggc

SEQ ID NO: 423689 - RNA, 14 nt, Bordetella pertussis
cgcugcgcgcggcc

SEQ ID NO: 423690 - RNA, 15 nt, Bordetella pertussis
cgcugcgggcggccu

SEQ ID NO: 423691 - RNA, 18 nt, Bordetella pertussis
cgcugcgggcggccuggg

SEQ ID NO: 423692 - RNA, 15 nt, Bordetella pertussis
cgcugcguccaccac

SEQ ID NO: 423693 - RNA, 18 nt, Bordetella pertussis
cgcugcguccaccaccag

SEQ ID NO: 423694 - RNA, 22 nt, Bordetella pertussis
cgcugcguccaccaccaggccg

SEQ ID NO: 423695 - RNA, 13 nt, Bordetella pertussis
cgcugcucuuggc

SEQ ID NO: 423696 - RNA, 19 nt, Bordetella pertussis
cgcugcugauccucgccag

SEQ ID NO: 423697 - RNA, 20 nt, Bordetella pertussis
cgcugcugauccucgccagc

SEQ ID NO: 423698 - RNA, 13 nt, Bordetella pertussis
cgcugcugcaggc

SEQ ID NO: 423699 - RNA, 18 nt, Bordetella pertussis
cgcugcugcaggccggcg

SEQ ID NO: 423700 - RNA, 14 nt, Bordetella pertussis
cgcugcugcuggcu

SEQ ID NO: 423701 - RNA, 19 nt, Bordetella pertussis
cgcugcuggaggccggcgu

SEQ ID NO: 423702 - RNA, 14 nt, Bordetella pertussis
cgcugcuggccaag

SEQ ID NO: 423703 - RNA, 13 nt, Bordetella pertussis
cgcugcuggccgc

SEQ ID NO: 423704 - RNA, 15 nt, Bordetella pertussis
cgcugcuggccggcc

SEQ ID NO: 423705 - RNA, 16 nt, Bordetella pertussis
cgcugcuggccggcca

SEQ ID NO: 423706 - RNA, 18 nt, Bordetella pertussis
cgcugcuggccggccagc

SEQ ID NO: 423707 - RNA, 18 nt, Bordetella pertussis
cgcuggaagacguggccc

SEQ ID NO: 423708 - RNA, 18 nt, Bordetella pertussis
cgcuggaccgggaauggc

SEQ ID NO: 423709 - RNA, 18 nt, Bordetella pertussis
cgcuggacgcccuggcgc

SEQ ID NO: 423710 - RNA, 19 nt, Bordetella pertussis
cgcuggagauggcgccgau

SEQ ID NO: 423711 - RNA, 16 nt, Bordetella pertussis
cgcuggagcgcggcgg

SEQ ID NO: 423712 - RNA, 13 nt, Bordetella pertussis
cgcuggaggccuu

SEQ ID NO: 423713 - RNA, 13 nt, Bordetella pertussis
cgcuggccaugcc

SEQ ID NO: 423714 - RNA, 20 nt, Bordetella pertussis
cgcuggcccaguucgcgcag

SEQ ID NO: 423715 - RNA, 14 nt, Bordetella pertussis
cgcuggccgcccgc

SEQ ID NO: 423716 - RNA, 15 nt, Bordetella pertussis
cgcuggccgcccgcg

SEQ ID NO: 423717 - RNA, 14 nt, Bordetella pertussis
cgcuggccggcgug

SEQ ID NO: 423718 - RNA, 16 nt, Bordetella pertussis
cgcuggccugccgcgc

SEQ ID NO: 423719 - RNA, 18 nt, Bordetella pertussis
cgcuggccugccgcgccg

SEQ ID NO: 423720 - RNA, 23 nt, Bordetella pertussis
cgcuggccuggccgccggcggcg

SEQ ID NO: 423721 - RNA, 23 nt, Bordetella pertussis
cgcuggcgaugcccaccagccgc

SEQ ID NO: 423722 - RNA, 21 nt, Bordetella pertussis
cgcuggcgaucaggccgcccc

SEQ ID NO: 423723 - RNA, 17 nt, Bordetella pertussis
cgcuggcgcccgccugc

SEQ ID NO: 423724 - RNA, 15 nt, Bordetella pertussis
cgcuggcgcccggcc

SEQ ID NO: 423725 - RNA, 13 nt, Bordetella pertussis
cgcuggcgccggu

SEQ ID NO: 423726 - RNA, 14 nt, Bordetella pertussis
cgcuggcgcgccgc

SEQ ID NO: 423727 - RNA, 21 nt, Bordetella pertussis
cgcuggcgcgcgacggcgccg

SEQ ID NO: 423728 - RNA, 16 nt, Bordetella pertussis
cgcuggcgcgcggccg

SEQ ID NO: 423729 - RNA, 17 nt, Bordetella pertussis
cgcuggcgcgcggccgc

SEQ ID NO: 423730 - RNA, 15 nt, Bordetella pertussis
cgcuggcgcgcggcu

SEQ ID NO: 423731 - RNA, 19 nt, Bordetella pertussis
cgcuggcgcgcggcuggcu

SEQ ID NO: 423732 - RNA, 17 nt, Bordetella pertussis
cgcuggcgcucgggcgc

SEQ ID NO: 423733 - RNA, 13 nt, Bordetella pertussis
cgcuggcgcgucu

SEQ ID NO: 423734 - RNA, 13 nt, Bordetella pertussis
cgcuggcggcgca

SEQ ID NO: 423735 - RNA, 18 nt, Bordetella pertussis
cgcuggcggcgcaggccg

SEQ ID NO: 423736 - RNA, 20 nt, Bordetella pertussis
cgcuggcggcgcaggccgcg

SEQ ID NO: 423737 - RNA, 18 nt, Bordetella pertussis
cgcuggcugggccugcug

SEQ ID NO: 423738 - RNA, 18 nt, Bordetella pertussis
cgcuggcuucggcguacu

SEQ ID NO: 423739 - RNA, 18 nt, Bordetella pertussis
cgcuggcuucgucgccgg

SEQ ID NO: 423740 - RNA, 18 nt, Bordetella pertussis
cgcuggcuaucgccucga

SEQ ID NO: 423741 - RNA, 20 nt, Bordetella pertussis
cgcugggacaggcacaccgu

SEQ ID NO: 423742 - RNA, 22 nt, Bordetella pertussis
cgcugggauggguacgccggcc

SEQ ID NO: 423743 - RNA, 23 nt, Bordetella pertussis
cgcugggcaugggcggcccggcc

SEQ ID NO: 423744 - RNA, 12 nt, Bordetella pertussis
cgcugggccaga

SEQ ID NO: 423745 - RNA, 12 nt, Bordetella pertussis
cgcugggccagg

SEQ ID NO: 423746 - RNA, 13 nt, Bordetella pertussis
cgcugggccaggc

SEQ ID NO: 423747 - RNA, 23 nt, Bordetella pertussis
cgcugggcgaggcgcuggccggc

SEQ ID NO: 423748 - RNA, 17 nt, Bordetella pertussis
cgcugggcgccagcagc

SEQ ID NO: 423749 - RNA, 13 nt, Bordetella pertussis
cgcuggggcagca

SEQ ID NO: 423750 - RNA, 14 nt, Bordetella pertussis
cgcugggcgcugcu

SEQ ID NO: 423751 - RNA, 16 nt, Bordetella pertussis
cgcuggucaccgcccc

SEQ ID NO: 423752 - RNA, 17 nt, Bordetella pertussis
cgcuggucaccgccccg

SEQ ID NO: 423753 - RNA, 19 nt, Bordetella pertussis
cgcuggucaccgccccgac

SEQ ID NO: 423754 - RNA, 15 nt, Bordetella pertussis
cgcugguccgccgcc

SEQ ID NO: 423755 - RNA, 20 nt, Bordetella pertussis
cgcuggucguaucgccgcug

SEQ ID NO: 423756 - RNA, 13 nt, Bordetella pertussis
cgcuggugcugag

SEQ ID NO: 423757 - RNA, 20 nt, Bordetella pertussis
cgcugguggccaccagcccc

SEQ ID NO: 423758 - RNA, 21 nt, Bordetella pertussis
cgcuguacugguaccaggcgg

SEQ ID NO: 423759 - RNA, 23 nt, Bordetella pertussis
cgcuguagaggcgcggcucgccg

SEQ ID NO: 423760 - RNA, 21 nt, Bordetella pertussis
cgcuguccaggccggggccgc

SEQ ID NO: 423761 - RNA, 14 nt, Bordetella pertussis
cgcuguccgaugcg

SEQ ID NO: 423762 - RNA, 19 nt, Bordetella pertussis
cgcuguccgaugcgcugcu

SEQ ID NO: 423763 - RNA, 15 nt, Bordetella pertussis
cgcuguccggcgcuc

SEQ ID NO: 423764 - RNA, 18 nt, Bordetella pertussis
cgcugucgaccucgucga

SEQ ID NO: 423765 - RNA, 13 nt, Bordetella pertussis
cgcugucgcaggc

SEQ ID NO: 423766 - RNA, 12 nt, Bordetella pertussis
cgcuguggacgc

SEQ ID NO: 423767 - RNA, 17 nt, Bordetella pertussis
cgcuguggacgccgccg

SEQ ID NO: 423768 - RNA, 19 nt, Bordetella pertussis
cgcuguggacgccgccggc

SEQ ID NO: 423769 - RNA, 22 nt, Bordetella pertussis
cgcuguggacgccgccggccca

SEQ ID NO: 423770 - RNA, 15 nt, Bordetella pertussis
cgcuguggcgcgcca

SEQ ID NO: 423771 - RNA, 17 nt, Bordetella pertussis
cgcuguuccagccagua

SEQ ID NO: 423772 - RNA, 21 nt, Bordetella pertussis
cgcuguucgauacggccacgc

SEQ ID NO: 423773 - RNA, 22 nt, Bordetella pertussis
cgcuguucuucggcaaccgcgc

SEQ ID NO: 423774 - RNA, 14 nt, Bordetella pertussis
cgcuguuggccggc

SEQ ID NO: 423775 - RNA, 15 nt, Bordetella pertussis
cgcuguuggccggcg

SEQ ID NO: 423776 - RNA, 16 nt, Bordetella pertussis
cgcuguuggccgucgc

SEQ ID NO: 423777 - RNA, 19 nt, Bordetella pertussis
cgcuguuuucggccgacuc

SEQ ID NO: 423778 - RNA, 19 nt, Bordetella pertussis
cgcuuacuggaucuuggcc

SEQ ID NO: 423779 - RNA, 15 nt, Bordetella pertussis
cgcuuaucgcggcgc

SEQ ID NO: 423780 - RNA, 22 nt, Bordetella pertussis
cgcuugcccgucaugcgccgca

SEQ ID NO: 423781 - RNA, 15 nt, Bordetella pertussis
cgcuugccgaccucc

SEQ ID NO: 423782 - RNA, 18 nt, Bordetella pertussis
cgcuugcgcagggcgggc

SEQ ID NO: 423783 - RNA, 20 nt, Bordetella pertussis
cgcuuuuuucuccagcgcca

SEQ ID NO: 423784 - RNA, 22 nt, Bordetella pertussis
cggaaacacguccagcgccgcg

SEQ ID NO: 423785 - RNA, 19 nt, Bordetella pertussis
cggaaacccuucgcgcagc

SEQ ID NO: 423786 - RNA, 19 nt, Bordetella pertussis
cggaaacuggcuaaaagga

SEQ ID NO: 423787 - RNA, 22 nt, Bordetella pertussis
cggaaauccguaguccagcagc

SEQ ID NO: 423788 - RNA, 20 nt, Bordetella pertussis
cggaaaugccgcgcgcaggg

SEQ ID NO: 423789 - RNA, 22 nt, Bordetella pertussis
cggaaaugccgcgcgcagggcg

SEQ ID NO: 423790 - RNA, 13 nt, Bordetella pertussis
cggagcagcagcg

SEQ ID NO: 423791 - RNA, 17 nt, Bordetella pertussis
cggagcagucgcgcagc

SEQ ID NO: 423792 - RNA, 23 nt, Bordetella pertussis
cggagccaguccccgcagggaca

SEQ ID NO: 423793 - RNA, 24 nt, Bordetella pertussis
cggagccaguccccgcagggacag

SEQ ID NO: 423794 - RNA, 13 nt, Bordetella pertussis
cggagcgacggca

SEQ ID NO: 423795 - RNA, 19 nt, Bordetella pertussis
cggagcgacggcagaugga

SEQ ID NO: 423796 - RNA, 20 nt, Bordetella pertussis
cggaguugcccgaaggcagc

SEQ ID NO: 423797 - RNA, 17 nt, Bordetella pertussis
cggauaacaucaugggc

SEQ ID NO: 423798 - RNA, 15 nt, Bordetella pertussis
cggaucggggcaacg

SEQ ID NO: 423799 - RNA, 16 nt, Bordetella pertussis
cggaugaagggcuggc

SEQ ID NO: 423800 - RNA, 19 nt, Bordetella pertussis
cggaugaccuggugcacca

SEQ ID NO: 423801 - RNA, 20 nt, Bordetella pertussis
cggaugaccuggugcaccac

SEQ ID NO: 423802 - RNA, 18 nt, Bordetella pertussis
cggaugagcaggccgggu

SEQ ID NO: 423803 - RNA, 17 nt, Bordetella pertussis
cggaugaugcggcgcca

SEQ ID NO: 423804 - RNA, 20 nt, Bordetella pertussis
cggaugcacguagcgcagca

SEQ ID NO: 423805 - RNA, 16 nt, Bordetella pertussis
cggaugcgcaggacgg

SEQ ID NO: 423806 - RNA, 14 nt, Bordetella pertussis
cggaugcgccgccc

SEQ ID NO: 423807 - RNA, 16 nt, Bordetella pertussis
cggaugcgccgcccca

SEQ ID NO: 423808 - RNA, 17 nt, Bordetella pertussis
cggauggcauaguccuc

SEQ ID NO: 423809 - RNA, 21 nt, Bordetella pertussis
cggauggucgugcggcacgca

SEQ ID NO: 423810 - RNA, 15 nt, Bordetella pertussis
cggaugucaguuucc

SEQ ID NO: 423811 - RNA, 19 nt, Bordetella pertussis
cggauugaugucgcgcacc

SEQ ID NO: 423812 - RNA, 14 nt, Bordetella pertussis
cggauugccgccgc

SEQ ID NO: 423813 - RNA, 17 nt, Bordetella pertussis
cggauugccgccgcgca

SEQ ID NO: 423814 - RNA, 19 nt, Bordetella pertussis
cggauugccguccuggcga

SEQ ID NO: 423815 - RNA, 22 nt, Bordetella pertussis
cggcaaaaaaaaccgcgcgccg

SEQ ID NO: 423816 - RNA, 15 nt, Bordetella pertussis
cggcaaagucggggc

SEQ ID NO: 423817 - RNA, 23 nt, Bordetella pertussis
cggcaccagcgccacgcccaggc

SEQ ID NO: 423818 - RNA, 20 nt, Bordetella pertussis
cggcaccaucguugccuggg

SEQ ID NO: 423819 - RNA, 22 nt, Bordetella pertussis
cggcaccaucguugccugggug

SEQ ID NO: 423820 - RNA, 13 nt, Bordetella pertussis
cggcaccauugcc

SEQ ID NO: 423821 - RNA, 12 nt, Bordetella pertussis
cggcacccagcc

SEQ ID NO: 423822 - RNA, 19 nt, Bordetella pertussis
cggcacccgcuaccccggc

SEQ ID NO: 423823 - RNA, 22 nt, Bordetella pertussis
cggcacccgcuaccccggcagc

SEQ ID NO: 423824 - RNA, 19 nt, Bordetella pertussis
cggcaccgaggccgagugg

SEQ ID NO: 423825 - RNA, 18 nt, Bordetella pertussis
cggcaccucggccggggc

SEQ ID NO: 423826 - RNA, 14 nt, Bordetella pertussis
cggcaccucggcgc

SEQ ID NO: 423827 - RNA, 19 nt, Bordetella pertussis
cggcaccucggcgccgcgg

SEQ ID NO: 423828 - RNA, 14 nt, Bordetella pertussis
cggcaccugcugcu

SEQ ID NO: 423829 - RNA, 13 nt, Bordetella pertussis
cggcaccugggcc

SEQ ID NO: 423830 - RNA, 17 nt, Bordetella pertussis
cggcaccugggccuuca

SEQ ID NO: 423831 - RNA, 17 nt, Bordetella pertussis
cggcaccuucgcgcagc

SEQ ID NO: 423832 - RNA, 18 nt, Bordetella pertussis
cggcacgaaaagccgcgg

SEQ ID NO: 423833 - RNA, 19 nt, Bordetella pertussis
cggcacgaaaagccgcggc

SEQ ID NO: 423834 - RNA, 21 nt, Bordetella pertussis
cggcacgaaaagccgcggccg

SEQ ID NO: 423835 - RNA, 16 nt, Bordetella pertussis
cggcacgacggccucc

SEQ ID NO: 423836 - RNA, 19 nt, Bordetella pertussis
cggcacgaucggcgccugg

SEQ ID NO: 423837 - RNA, 15 nt, Bordetella pertussis
cggcacgauuucgcc

SEQ ID NO: 423838 - RNA, 21 nt, Bordetella pertussis
cggcacgcccagccgcagcag

SEQ ID NO: 423839 - RNA, 15 nt, Bordetella pertussis
cggcacgccggcggc

SEQ ID NO: 423840 - RNA, 16 nt, Bordetella pertussis
cggcacgccggcggcg

SEQ ID NO: 423841 - RNA, 20 nt, Bordetella pertussis
cggcagacgaucauccaggc

SEQ ID NO: 423842 - RNA, 23 nt, Bordetella pertussis
cggcagcgacuucuaccuggacg

SEQ ID NO: 423843 - RNA, 15 nt, Bordetella pertussis
cggcagcgcaccguc

SEQ ID NO: 423844 - RNA, 17 nt, Bordetella pertussis
cggcagcgcgcaggaca

SEQ ID NO: 423845 - RNA, 13 nt, Bordetella pertussis
cggcagcgcgcgc

SEQ ID NO: 423846 - RNA, 13 nt, Bordetella pertussis
cggcagcggcgcc

SEQ ID NO: 423847 - RNA, 23 nt, Bordetella pertussis
cggcagcggcgccaugcgcacca

SEQ ID NO: 423848 - RNA, 20 nt, Bordetella pertussis
cggcaggccgcagcgggccc

SEQ ID NO: 423849 - RNA, 14 nt, Bordetella pertussis
cggcaggccgcgcc

SEQ ID NO: 423850 - RNA, 15 nt, Bordetella pertussis
cggcaggccgcgcca

SEQ ID NO: 423851 - RNA, 21 nt, Bordetella pertussis
cggcaggccgcgccacaggcg

SEQ ID NO: 423852 - RNA, 16 nt, Bordetella pertussis
cggcaggccgcgcugc

SEQ ID NO: 423853 - RNA, 19 nt, Bordetella pertussis
cggcaggccgcgcugccag

SEQ ID NO: 423854 - RNA, 18 nt, Bordetella pertussis
cggcaggccggccagcaa

SEQ ID NO: 423855 - RNA, 14 nt, Bordetella pertussis
cggcaggccggcgc

SEQ ID NO: 423856 - RNA, 14 nt, Bordetella pertussis
cggcaggcgccgcc

SEQ ID NO: 423857 - RNA, 14 nt, Bordetella pertussis
cggcaggcggcaga

SEQ ID NO: 423858 - RNA, 19 nt, Bordetella pertussis
cggcaggcuggccggcgug

SEQ ID NO: 423859 - RNA, 12 nt, Bordetella pertussis
cggcagggccag

SEQ ID NO: 423860 - RNA, 22 nt, Bordetella pertussis
cggcagggcgucggccgcgccc

SEQ ID NO: 423861 - RNA, 17 nt, Bordetella pertussis
cggcagggucucggcca

SEQ ID NO: 423862 - RNA, 22 nt, Bordetella pertussis
cggcagggugacgggcugggcc

SEQ ID NO: 423863 - RNA, 22 nt, Bordetella pertussis
cggcaggucgauggggucgggc

SEQ ID NO: 423864 - RNA, 13 nt, Bordetella pertussis
cggcaggucgcgc

SEQ ID NO: 423865 - RNA, 14 nt, Bordetella pertussis
cggcaggucggugc

SEQ ID NO: 423866 - RNA, 14 nt, Bordetella pertussis
cggcaggugcgcca

SEQ ID NO: 423867 - RNA, 22 nt, Bordetella pertussis
cggcaggugcgccagcacggca

SEQ ID NO: 423868 - RNA, 19 nt, Bordetella pertussis
cggcagguucugcgcgucc

SEQ ID NO: 423869 - RNA, 23 nt, Bordetella pertussis
cggcauacgccgauggcgcggcc

SEQ ID NO: 423870 - RNA, 20 nt, Bordetella pertussis
cggcauagcccaggccgccg

SEQ ID NO: 423871 - RNA, 21 nt, Bordetella pertussis
cggcauagcccaggccgccgg

SEQ ID NO: 423872 - RNA, 18 nt, Bordetella pertussis
cggcauaggcggcgcagg

SEQ ID NO: 423873 - RNA, 21 nt, Bordetella pertussis
cggcaucccgacaugccgccc

SEQ ID NO: 423874 - RNA, 15 nt, Bordetella pertussis
cggcaucccugcuug

SEQ ID NO: 423875 - RNA, 14 nt, Bordetella pertussis
cggcaucgccgcgg

SEQ ID NO: 423876 - RNA, 22 nt, Bordetella pertussis
cggcaucgcgcugacagcgcuc

SEQ ID NO: 423877 - RNA, 20 nt, Bordetella pertussis
cggcaucggcgccgcgcgcu

SEQ ID NO: 423878 - RNA, 12 nt, Bordetella pertussis
cggccagcagcg

SEQ ID NO: 423879 - RNA, 23 nt, Bordetella pertussis
cggccagcagcgacggccccagc

SEQ ID NO: 423880 - RNA, 12 nt, Bordetella pertussis
cggccagcagcu

SEQ ID NO: 423881 - RNA, 17 nt, Bordetella pertussis
cggccagcaggagcccg

SEQ ID NO: 423882 - RNA, 19 nt, Bordetella pertussis
cggccagcaguguuucggc

SEQ ID NO: 423883 - RNA, 22 nt, Bordetella pertussis
cggccagcauacccugcgcgcc

SEQ ID NO: 423884 - RNA, 22 nt, Bordetella pertussis
cggccagcaucguaucgggcgu

SEQ ID NO: 423885 - RNA, 16 nt, Bordetella pertussis
cggccagcaugcuggg

SEQ ID NO: 423886 - RNA, 13 nt, Bordetella pertussis
cggccagcauuac

SEQ ID NO: 423887 - RNA, 22 nt, Bordetella pertussis
cggccagccacgccggcgcgcc

SEQ ID NO: 423888 - RNA, 16 nt, Bordetella pertussis
cggccagccccaccuu

SEQ ID NO: 423889 - RNA, 15 nt, Bordetella pertussis
cggccagccggccga

SEQ ID NO: 423890 - RNA, 23 nt, Bordetella pertussis
cggccagccggguggucgcgccc

SEQ ID NO: 423891 - RNA, 15 nt, Bordetella pertussis
cggccagccggcgcg

SEQ ID NO: 423892 - RNA, 17 nt, Bordetella pertussis
cggccagccggcgcgcc

SEQ ID NO: 423893 - RNA, 14 nt, Bordetella pertussis
cggccagcgaggcc

SEQ ID NO: 423894 - RNA, 14 nt, Bordetella pertussis
cggccagcgccagc

SEQ ID NO: 423895 - RNA, 17 nt, Bordetella pertussis
cggccagcgccagccgc

SEQ ID NO: 423896 - RNA, 13 nt, Bordetella pertussis
cggccagcgccga

SEQ ID NO: 423897 - RNA, 15 nt, Bordetella pertussis
cggccagcgccuggg

SEQ ID NO: 423898 - RNA, 16 nt, Bordetella pertussis
cggccagcgccugggc

SEQ ID NO: 423899 - RNA, 12 nt, Bordetella pertussis
cggccagcgcga

SEQ ID NO: 423900 - RNA, 23 nt, Bordetella pertussis
cggccagcgcgcaacccacggcg

SEQ ID NO: 423901 - RNA, 14 nt, Bordetella pertussis
cggccagcgcgccg

SEQ ID NO: 423902 - RNA, 14 nt, Bordetella pertussis
cggccagcgcgcgc

SEQ ID NO: 423903 - RNA, 15 nt, Bordetella pertussis
cggccagcgcgcgcc

SEQ ID NO: 423904 - RNA, 15 nt, Bordetella pertussis
cggccagcgcgcggc

SEQ ID NO: 423905 - RNA, 17 nt, Bordetella pertussis
cggccagggugccccgc

SEQ ID NO: 423906 - RNA, 14 nt, Bordetella pertussis
cggccaggucgcgc

SEQ ID NO: 423907 - RNA, 17 nt, Bordetella pertussis
cggccaggucgcgcauc

SEQ ID NO: 423908 - RNA, 21 nt, Bordetella pertussis
cggccaggucgcgcaucaccu

SEQ ID NO: 423909 - RNA, 18 nt, Bordetella pertussis
cggccaggucggcggcca

SEQ ID NO: 423910 - RNA, 15 nt, Bordetella pertussis
cggccaggugcgcca

SEQ ID NO: 423911 - RNA, 16 nt, Bordetella pertussis
cggccagucgcggugc

SEQ ID NO: 423912 - RNA, 20 nt, Bordetella pertussis
cggccauguucuucaggcuc

SEQ ID NO: 423913 - RNA, 22 nt, Bordetella pertussis
cggccauguagauggccgccuu

SEQ ID NO: 423914 - RNA, 15 nt, Bordetella pertussis
cggcccaaggccccg

SEQ ID NO: 423915 - RNA, 15 nt, Bordetella pertussis
cggcccacagcgccc

SEQ ID NO: 423916 - RNA, 15 nt, Bordetella pertussis
cggcccacggccagc

SEQ ID NO: 423917 - RNA, 14 nt, Bordetella pertussis
cggccccggccgcc

SEQ ID NO: 423918 - RNA, 17 nt, Bordetella pertussis
cggccccggccgccccc

SEQ ID NO: 423919 - RNA, 13 nt, Bordetella pertussis
cggccccggcucc

SEQ ID NO: 423920 - RNA, 14 nt, Bordetella pertussis
cggccccggcuccc

SEQ ID NO: 423921 - RNA, 21 nt, Bordetella pertussis
cggccccguugucgccgcggc

SEQ ID NO: 423922 - RNA, 17 nt, Bordetella pertussis
cggcccgccacgcgggc

SEQ ID NO: 423923 - RNA, 18 nt, Bordetella pertussis
cggcccgccaggaagcgg

SEQ ID NO: 423924 - RNA, 20 nt, Bordetella pertussis
cggcccgcccgcccugggca

SEQ ID NO: 423925 - RNA, 13 nt, Bordetella pertussis
cggcccgcggccu

SEQ ID NO: 423926 - RNA, 14 nt, Bordetella pertussis
cggcccgcgccggg

SEQ ID NO: 423927 - RNA, 15 nt, Bordetella pertussis
cggcccggccgccgc

SEQ ID NO: 423928 - RNA, 17 nt, Bordetella pertussis
cggcccggccgccgccg

SEQ ID NO: 423929 - RNA, 13 nt, Bordetella pertussis
cggcccggcgccg

SEQ ID NO: 423930 - RNA, 15 nt, Bordetella pertussis
cggcccggcgccggu

SEQ ID NO: 423931 - RNA, 18 nt, Bordetella pertussis
cggcccggcgccgguggg

SEQ ID NO: 423932 - RNA, 19 nt, Bordetella pertussis
cggcccggcgggccggcuc

SEQ ID NO: 423933 - RNA, 22 nt, Bordetella pertussis
cggcccggugcagccgccgcag

SEQ ID NO: 423934 - RNA, 13 nt, Bordetella pertussis
cggcccguagcug

SEQ ID NO: 423935 - RNA, 13 nt, Bordetella pertussis
cggcccugcagga

SEQ ID NO: 423936 - RNA, 14 nt, Bordetella pertussis
cggcccugccgccc

SEQ ID NO: 423937 - RNA, 20 nt, Bordetella pertussis
cggcccugcgucaguugaag

SEQ ID NO: 423938 - RNA, 13 nt, Bordetella pertussis
cggcccuggucuu

SEQ ID NO: 423939 - RNA, 16 nt, Bordetella pertussis
cggcccugucggccga

SEQ ID NO: 423940 - RNA, 19 nt, Bordetella pertussis
cggccgaaaccgccgcggc

SEQ ID NO: 423941 - RNA, 14 nt, Bordetella pertussis
cggccgaaccgcgc

SEQ ID NO: 423942 - RNA, 21 nt, Bordetella pertussis
cggccgaaccgcgcagccgcu

SEQ ID NO: 423943 - RNA, 22 nt, Bordetella pertussis
cggccgaagcgcaagcccaggc

SEQ ID NO: 423944 - RNA, 12 nt, Bordetella pertussis
cggccgaccacu

SEQ ID NO: 423945 - RNA, 14 nt, Bordetella pertussis
cggccgacccgcgg

SEQ ID NO: 423946 - RNA, 17 nt, Bordetella pertussis
cggccgacccgcggccc

SEQ ID NO: 423947 - RNA, 22 nt, Bordetella pertussis
cggccgacccgcggcccuugcg

SEQ ID NO: 423948 - RNA, 15 nt, Bordetella pertussis
cggccgaccggcgcg

SEQ ID NO: 423949 - RNA, 18 nt, Bordetella pertussis
cggccgaccggcgcgcgc

SEQ ID NO: 423950 - RNA, 14 nt, Bordetella pertussis
cggccgacggcgcu

SEQ ID NO: 423951 - RNA, 19 nt, Bordetella pertussis
cggccgacgggcggcugcu

SEQ ID NO: 423952 - RNA, 22 nt, Bordetella pertussis
cggccgacguggaccgcgcggu

SEQ ID NO: 423953 - RNA, 13 nt, Bordetella pertussis
cggccgagcgggc

SEQ ID NO: 423954 - RNA, 23 nt, Bordetella pertussis
cggccgagcgggccagcgcggcc

SEQ ID NO: 423955 - RNA, 15 nt, Bordetella pertussis
cggccgaggccagcg

SEQ ID NO: 423956 - RNA, 12 nt, Bordetella pertussis
cggccgauagcc

SEQ ID NO: 423957 - RNA, 19 nt, Bordetella pertussis
cggccgauagccgcggcgc

SEQ ID NO: 423958 - RNA, 20 nt, Bordetella pertussis
cggccgauagccgcggcgcc

SEQ ID NO: 423959 - RNA, 22 nt, Bordetella pertussis
cggccgauagccgcggcgccgc

SEQ ID NO: 423960 - RNA, 13 nt, Bordetella pertussis
cggccgaucgcgc

SEQ ID NO: 423961 - RNA, 16 nt, Bordetella pertussis
cggccgaucgcgccgu

SEQ ID NO: 423962 - RNA, 22 nt, Bordetella pertussis
cggccgaugacaucgccgcugc

SEQ ID NO: 423963 - RNA, 23 nt, Bordetella pertussis
cggccgaugacaucgccgcugcg

SEQ ID NO: 423964 - RNA, 22 nt, Bordetella pertussis
cggccgauggcaucgccccgga

SEQ ID NO: 423965 - RNA, 20 nt, Bordetella pertussis
cggccgauguuuuccuggga

SEQ ID NO: 423966 - RNA, 17 nt, Bordetella pertussis
cggccgcaagcuggccg

SEQ ID NO: 423967 - RNA, 20 nt, Bordetella pertussis
cggccgcacgcggccgcggg

SEQ ID NO: 423968 - RNA, 17 nt, Bordetella pertussis
cggccgcauggcggccc

SEQ ID NO: 423969 - RNA, 14 nt, Bordetella pertussis
cggccgccacgccc

SEQ ID NO: 423970 - RNA, 20 nt, Bordetella pertussis
cggccgccagccggcccagc

SEQ ID NO: 423971 - RNA, 15 nt, Bordetella pertussis
cggccgccagcgcca

SEQ ID NO: 423972 - RNA, 19 nt, Bordetella pertussis
cggccgccagcgccaugau

SEQ ID NO: 423973 - RNA, 14 nt, Bordetella pertussis
cggccgccagguag

SEQ ID NO: 423974 - RNA, 14 nt, Bordetella pertussis
cggccgcccacggc

SEQ ID NO: 423975 - RNA, 14 nt, Bordetella pertussis
cggccgcccagcag

SEQ ID NO: 423976 - RNA, 13 nt, Bordetella pertussis
cggccgcccaggc

SEQ ID NO: 423977 - RNA, 17 nt, Bordetella pertussis
cggccgcccgccugccg

SEQ ID NO: 423978 - RNA, 12 nt, Bordetella pertussis
cggccgcccggc

SEQ ID NO: 423979 - RNA, 19 nt, Bordetella pertussis
cggccgccgccagcgcgcc

SEQ ID NO: 423980 - RNA, 14 nt, Bordetella pertussis
cggccgccgcccgc

SEQ ID NO: 423981 - RNA, 21 nt, Bordetella pertussis
cggccgccgcccgccucaggc

SEQ ID NO: 423982 - RNA, 14 nt, Bordetella pertussis
cggccgccggcgag

SEQ ID NO: 423983 - RNA, 13 nt, Bordetella pertussis
cggccgcgcaccu

SEQ ID NO: 423984 - RNA, 15 nt, Bordetella pertussis
cggccgcgccgccgc

SEQ ID NO: 423985 - RNA, 17 nt, Bordetella pertussis
cggccgcgccgccgccc

SEQ ID NO: 423986 - RNA, 14 nt, Bordetella pertussis
cggccgcgcgcauc

SEQ ID NO: 423987 - RNA, 14 nt, Bordetella pertussis
cggccgcgcgcgcc

SEQ ID NO: 423988 - RNA, 15 nt, Bordetella pertussis
cggccgcgcgcgcca

SEQ ID NO: 423989 - RNA, 15 nt, Bordetella pertussis
cggccgcgggccgcu

SEQ ID NO: 423990 - RNA, 20 nt, Bordetella pertussis
cggccgcgggcggcgcgccc

SEQ ID NO: 423991 - RNA, 23 nt, Bordetella pertussis
cggccgcgggcgugcuggcacug

SEQ ID NO: 423992 - RNA, 19 nt, Bordetella pertussis
cggccgcgucggccucauc

SEQ ID NO: 423993 - RNA, 20 nt, Bordetella pertussis
cggccgcguggccgcgcugc

SEQ ID NO: 423994 - RNA, 15 nt, Bordetella pertussis
cggccgcguucagca

SEQ ID NO: 423995 - RNA, 14 nt, Bordetella pertussis
cggccgcugccgcg

SEQ ID NO: 423996 - RNA, 18 nt, Bordetella pertussis
cggccgcugccgcgcgcc

SEQ ID NO: 423997 - RNA, 22 nt, Bordetella pertussis
cggccggcaaggggccagccug

SEQ ID NO: 423998 - RNA, 15 nt, Bordetella pertussis
cggccggcaccagga

SEQ ID NO: 423999 - RNA, 12 nt, Bordetella pertussis
cggccggcagcg

SEQ ID NO: 424000 - RNA, 18 nt, Bordetella pertussis
cggccggcagcggcgcca

SEQ ID NO: 424001 - RNA, 17 nt, Bordetella pertussis
cggccggcaggccggcc

SEQ ID NO: 424002 - RNA, 19 nt, Bordetella pertussis
cggccggccaggcgccgcu

SEQ ID NO: 424003 - RNA, 13 nt, Bordetella pertussis
cggccggccagcc

SEQ ID NO: 424004 - RNA, 13 nt, Bordetella pertussis
cggccggccgggc

SEQ ID NO: 424005 - RNA, 14 nt, Bordetella pertussis
cggccggccgggcc

SEQ ID NO: 424006 - RNA, 16 nt, Bordetella pertussis
cggccggccugcgggc

SEQ ID NO: 424007 - RNA, 15 nt, Bordetella pertussis
cggccggccugcuug

SEQ ID NO: 424008 - RNA, 20 nt, Bordetella pertussis
cggccggcgcacgccggacc

SEQ ID NO: 424009 - RNA, 21 nt, Bordetella pertussis
cggccggcgcaguuccggcgg

SEQ ID NO: 424010 - RNA, 14 nt, Bordetella pertussis
cggccggcgccggc

SEQ ID NO: 424011 - RNA, 15 nt, Bordetella pertussis
cggccggcgccggca

SEQ ID NO: 424012 - RNA, 16 nt, Bordetella pertussis
cggccggcgcgccggc

SEQ ID NO: 424013 - RNA, 13 nt, Bordetella pertussis
cggccggcggccc

SEQ ID NO: 424014 - RNA, 18 nt, Bordetella pertussis
cggccggcguugcgcccu

SEQ ID NO: 424015 - RNA, 14 nt, Bordetella pertussis
cggccggcuccgcu

SEQ ID NO: 424016 - RNA, 21 nt, Bordetella pertussis
cggccggcugcaccagcgcgc

SEQ ID NO: 424017 - RNA, 16 nt, Bordetella pertussis
cggccggcugcgcgcc

SEQ ID NO: 424018 - RNA, 20 nt, Bordetella pertussis
cggccggcugcgcgccgacc

SEQ ID NO: 424019 - RNA, 13 nt, Bordetella pertussis
cggccgggccagc

SEQ ID NO: 424020 - RNA, 14 nt, Bordetella pertussis
cggccgggccgggc

SEQ ID NO: 424021 - RNA, 17 nt, Bordetella pertussis
cggccgggcgcggcgcc

SEQ ID NO: 424022 - RNA, 15 nt, Bordetella pertussis
cggccgggcucaggc

SEQ ID NO: 424023 - RNA, 13 nt, Bordetella pertussis
cggccggggcccg

SEQ ID NO: 424024 - RNA, 20 nt, Bordetella pertussis
cggccggggcccgcgggcgc

SEQ ID NO: 424025 - RNA, 18 nt, Bordetella pertussis
cggccgguaucgacgcgc

SEQ ID NO: 424026 - RNA, 20 nt, Bordetella pertussis
cggccgguaucgacgcgcgu

SEQ ID NO: 424027 - RNA, 22 nt, Bordetella pertussis
cggccggucagcccaggcgggc

SEQ ID NO: 424028 - RNA, 15 nt, Bordetella pertussis
cggccggucagggag

SEQ ID NO: 424029 - RNA, 23 nt, Bordetella pertussis
cggccggugaucuugccgaugcg

SEQ ID NO: 424030 - RNA, 22 nt, Bordetella pertussis
cggccggugcaucggccggcgg

SEQ ID NO: 424031 - RNA, 15 nt, Bordetella pertussis
cggccgucagcagca

SEQ ID NO: 424032 - RNA, 21 nt, Bordetella pertussis
cggccgucagcagcaggcugg

SEQ ID NO: 424033 - RNA, 19 nt, Bordetella pertussis
cggccgucgaccgacagca

SEQ ID NO: 424034 - RNA, 21 nt, Bordetella pertussis
cggccgucgaccgacagcaca

SEQ ID NO: 424035 - RNA, 22 nt, Bordetella pertussis
cggccgucgaccgacagcacau

SEQ ID NO: 424036 - RNA, 13 nt, Bordetella pertussis
cggccgucggcgc

SEQ ID NO: 424037 - RNA, 14 nt, Bordetella pertussis
cggccgucggcgcu

SEQ ID NO: 424038 - RNA, 14 nt, Bordetella pertussis
cggccgucugggcg

SEQ ID NO: 424039 - RNA, 15 nt, Bordetella pertussis
cggccgugcgccagc

SEQ ID NO: 424040 - RNA, 20 nt, Bordetella pertussis
cggccguggccgggcccggc

SEQ ID NO: 424041 - RNA, 17 nt, Bordetella pertussis
cggccguugcuccagcc

SEQ ID NO: 424042 - RNA, 23 nt, Bordetella pertussis
cggccguugcuccagccaggcgc

SEQ ID NO: 424043 - RNA, 16 nt, Bordetella pertussis
cggccguuugccccuc

SEQ ID NO: 424044 - RNA, 20 nt, Bordetella pertussis
cggccguuugccccucggcg

SEQ ID NO: 424045 - RNA, 18 nt, Bordetella pertussis
cggccguuggcgugcagc

SEQ ID NO: 424046 - RNA, 18 nt, Bordetella pertussis
cggccuaucaccugggca

SEQ ID NO: 424047 - RNA, 22 nt, Bordetella pertussis
cggccuaucaccugggcaaccg

SEQ ID NO: 424048 - RNA, 23 nt, Bordetella pertussis
cggccuauuuggcggccuggccg

SEQ ID NO: 424049 - RNA, 15 nt, Bordetella pertussis
cggccucaaccgcgc

SEQ ID NO: 424050 - RNA, 17 nt, Bordetella pertussis
cggccucaaccgcgcgu

SEQ ID NO: 424051 - RNA, 18 nt, Bordetella pertussis
cggccucagcggccgcug

SEQ ID NO: 424052 - RNA, 12 nt, Bordetella pertussis
cggccuccagca

SEQ ID NO: 424053 - RNA, 23 nt, Bordetella pertussis
cggccuccagcaucgccgccagc

SEQ ID NO: 424054 - RNA, 16 nt, Bordetella pertussis
cggccucccgccgccc

SEQ ID NO: 424055 - RNA, 19 nt, Bordetella pertussis
cggccucccgucgucgucc

SEQ ID NO: 424056 - RNA, 17 nt, Bordetella pertussis
cggccuccgcgccgacc

SEQ ID NO: 424057 - RNA, 17 nt, Bordetella pertussis
cggccucgacggccgcc

SEQ ID NO: 424058 - RNA, 19 nt, Bordetella pertussis
cggccucgacggccgccgg

SEQ ID NO: 424059 - RNA, 22 nt, Bordetella pertussis
cggccucgagguauucgcgcga

SEQ ID NO: 424060 - RNA, 15 nt, Bordetella pertussis
cggccucgcccaugc

SEQ ID NO: 424061 - RNA, 16 nt, Bordetella pertussis
cggccucgccggccug

SEQ ID NO: 424062 - RNA, 18 nt, Bordetella pertussis
cggccucgccggccuggc

SEQ ID NO: 424063 - RNA, 16 nt, Bordetella pertussis
cggccucgcgcagggc

SEQ ID NO: 424064 - RNA, 14 nt, Bordetella pertussis
cggccucgcggcgc

SEQ ID NO: 424065 - RNA, 15 nt, Bordetella pertussis
cggccucggccagcu

SEQ ID NO: 424066 - RNA, 17 nt, Bordetella pertussis
cggccucggcgggcggc

SEQ ID NO: 424067 - RNA, 21 nt, Bordetella pertussis
cggccucgguggucagguagc

SEQ ID NO: 424068 - RNA, 19 nt, Bordetella pertussis
cggccugaaccaggccgcc

SEQ ID NO: 424069 - RNA, 17 nt, Bordetella pertussis
cggccugacgcgcaagc

SEQ ID NO: 424070 - RNA, 23 nt, Bordetella pertussis
cggccugacgcgcaagcggcccc

SEQ ID NO: 424071 - RNA, 14 nt, Bordetella pertussis
cggccugcaaugcg

SEQ ID NO: 424072 - RNA, 12 nt, Bordetella pertussis
cggccugcaccg

SEQ ID NO: 424073 - RNA, 14 nt, Bordetella pertussis
cggccugcaccggc

SEQ ID NO: 424074 - RNA, 19 nt, Bordetella pertussis
cggccugcagaccagcacc

SEQ ID NO: 424075 - RNA, 22 nt, Bordetella pertussis
cggccugcagaccagcaccggc

SEQ ID NO: 424076 - RNA, 20 nt, Bordetella pertussis
cggccugcacggugggcagc

SEQ ID NO: 424077 - RNA, 14 nt, Bordetella pertussis
cggccugcaggccc

SEQ ID NO: 424078 - RNA, 13 nt, Bordetella pertussis
cggccugcccggg

SEQ ID NO: 424079 - RNA, 14 nt, Bordetella pertussis
cggccugcccgggc

SEQ ID NO: 424080 - RNA, 17 nt, Bordetella pertussis
cggccugcccgggcggg

SEQ ID NO: 424081 - RNA, 21 nt, Bordetella pertussis
cggccugcccguucacgcgca

SEQ ID NO: 424082 - RNA, 15 nt, Bordetella pertussis
cggccugccggcgcg

SEQ ID NO: 424083 - RNA, 14 nt, Bordetella pertussis
cggccugcgccacc

SEQ ID NO: 424084 - RNA, 14 nt, Bordetella pertussis
cggccugcgccggg

SEQ ID NO: 424085 - RNA, 19 nt, Bordetella pertussis
cggccugcgucgccaccuc

SEQ ID NO: 424086 - RNA, 19 nt, Bordetella pertussis
cggccugcucgaaaugcgc

SEQ ID NO: 424087 - RNA, 17 nt, Bordetella pertussis
cggccugcucgcaggcc

SEQ ID NO: 424088 - RNA, 18 nt, Bordetella pertussis
cggccugcucgccggcca

SEQ ID NO: 424089 - RNA, 18 nt, Bordetella pertussis
cggccugcucgugcauca

SEQ ID NO: 424090 - RNA, 21 nt, Bordetella pertussis
cggccuggaggccgagcgcga

SEQ ID NO: 424091 - RNA, 16 nt, Bordetella pertussis
cggccuggccccaggc

SEQ ID NO: 424092 - RNA, 20 nt, Bordetella pertussis
cggccuggccccaggcgccc

SEQ ID NO: 424093 - RNA, 16 nt, Bordetella pertussis
cggccuggccccgcgc

SEQ ID NO: 424094 - RNA, 18 nt, Bordetella pertussis
cggccuggccgcgcgccu

SEQ ID NO: 424095 - RNA, 22 nt, Bordetella pertussis
cggccuggccgcgcgccugcuc

SEQ ID NO: 424096 - RNA, 11 nt, Bordetella pertussis
cggccuggcgc

SEQ ID NO: 424097 - RNA, 19 nt, Bordetella pertussis
cggccuggcgcgcggccug

SEQ ID NO: 424098 - RNA, 16 nt, Bordetella pertussis
cggccuggcgcuccuc

SEQ ID NO: 424099 - RNA, 14 nt, Bordetella pertussis
cggccuggcgggcc

SEQ ID NO: 424100 - RNA, 13 nt, Bordetella pertussis
cggccuggcgcgc

SEQ ID NO: 424101 - RNA, 12 nt, Bordetella pertussis
cggccugggcca

SEQ ID NO: 424102 - RNA, 22 nt, Bordetella pertussis
cggccugggcgcgaugggccug

SEQ ID NO: 424103 - RNA, 15 nt, Bordetella pertussis
cggccugggcggcgc

SEQ ID NO: 424104 - RNA, 15 nt, Bordetella pertussis
cggccuucaccccgc

SEQ ID NO: 424105 - RNA, 16 nt, Bordetella pertussis
cggccuuccggcauca

SEQ ID NO: 424106 - RNA, 16 nt, Bordetella pertussis
cggccuucggcggcgc

SEQ ID NO: 424107 - RNA, 22 nt, Bordetella pertussis
cggccuugagcaucugcggcac

SEQ ID NO: 424108 - RNA, 16 nt, Bordetella pertussis
cggcgcgcuggacguc

SEQ ID NO: 424109 - RNA, 18 nt, Bordetella pertussis
cggcgcgcuuggucagca

SEQ ID NO: 424110 - RNA, 15 nt, Bordetella pertussis
cggcgcggccagcag

SEQ ID NO: 424111 - RNA, 17 nt, Bordetella pertussis
cggcgcggcccgccacg

SEQ ID NO: 424112 - RNA, 12 nt, Bordetella pertussis
cggcgcggcagu

SEQ ID NO: 424113 - RNA, 12 nt, Bordetella pertussis
cggcgcggccuu

SEQ ID NO: 424114 - RNA, 10 nt, Bordetella pertussis
cggcgcggcg

SEQ ID NO: 424115 - RNA, 23 nt, Bordetella pertussis
cggcgcggcgccaugccgcgccc

SEQ ID NO: 424116 - RNA, 16 nt, Bordetella pertussis
cggcgcggcgcgcgcc

SEQ ID NO: 424117 - RNA, 18 nt, Bordetella pertussis
cggcgcggcgcgcgccgu

SEQ ID NO: 424118 - RNA, 11 nt, Bordetella pertussis
cggcgcggcgg

SEQ ID NO: 424119 - RNA, 19 nt, Bordetella pertussis
cggcgcgugcuggcgcagc

SEQ ID NO: 424120 - RNA, 14 nt, Bordetella pertussis
cggcgcguucagca

SEQ ID NO: 424121 - RNA, 17 nt, Bordetella pertussis
cggcgcguucagcagca

SEQ ID NO: 424122 - RNA, 22 nt, Bordetella pertussis
cggcgcguucagcagcaggccc

SEQ ID NO: 424123 - RNA, 21 nt, Bordetella pertussis
cggcgcguucagggcgccgcg

SEQ ID NO: 424124 - RNA, 23 nt, Bordetella pertussis
cggcgcguucagggcgccgcggc

SEQ ID NO: 424125 - RNA, 18 nt, Bordetella pertussis
cggcgcguucgccgcagc

SEQ ID NO: 424126 - RNA, 17 nt, Bordetella pertussis
cggcgcucagcgcgccg

SEQ ID NO: 424127 - RNA, 15 nt, Bordetella pertussis
cggcgcucaggaacc

SEQ ID NO: 424128 - RNA, 16 nt, Bordetella pertussis
cggcgcucgccccggc

SEQ ID NO: 424129 - RNA, 22 nt, Bordetella pertussis
cggcgcucgccccggcgcgcag

SEQ ID NO: 424130 - RNA, 23 nt, Bordetella pertussis
cggcgcucgccccggcgcgcagc

SEQ ID NO: 424131 - RNA, 14 nt, Bordetella pertussis
cggcgcucgcgcac

SEQ ID NO: 424132 - RNA, 16 nt, Bordetella pertussis
cggcgcucgcgcaccg

SEQ ID NO: 424133 - RNA, 18 nt, Bordetella pertussis
cggcggaaugcggcgaca

SEQ ID NO: 424134 - RNA, 15 nt, Bordetella pertussis
cggcggaucacccag

SEQ ID NO: 424135 - RNA, 17 nt, Bordetella pertussis
cggcggcaugcgccagc

SEQ ID NO: 424136 - RNA, 15 nt, Bordetella pertussis
cggcggccacgaccg

SEQ ID NO: 424137 - RNA, 22 nt, Bordetella pertussis
cggcggccacgaccggcucgau

SEQ ID NO: 424138 - RNA, 22 nt, Bordetella pertussis
cggcggccagcagcggcagguc

SEQ ID NO: 424139 - RNA, 14 nt, Bordetella pertussis
cggcggccagccgg

SEQ ID NO: 424140 - RNA, 17 nt, Bordetella pertussis
cggcggccagccggcgc

SEQ ID NO: 424141 - RNA, 19 nt, Bordetella pertussis
cggcggccagccggcgcgc

SEQ ID NO: 424142 - RNA, 15 nt, Bordetella pertussis
cggcggccagcgcgc

SEQ ID NO: 424143 - RNA, 18 nt, Bordetella pertussis
cggcggccagcgcgcaac

SEQ ID NO: 424144 - RNA, 18 nt, Bordetella pertussis
cggcggccagcgcgcccu

SEQ ID NO: 424145 - RNA, 17 nt, Bordetella pertussis
cggcggccagcgcgccg

SEQ ID NO: 424146 - RNA, 14 nt, Bordetella pertussis
cggcggccaggccg

SEQ ID NO: 424147 - RNA, 18 nt, Bordetella pertussis
cggcggccaugacggcca

SEQ ID NO: 424148 - RNA, 20 nt, Bordetella pertussis
cggcggccaugacggccauc

SEQ ID NO: 424149 - RNA, 19 nt, Bordetella pertussis
cggcggcccacagcgcccc

SEQ ID NO: 424150 - RNA, 16 nt, Bordetella pertussis
cggcggccggggccgc

SEQ ID NO: 424151 - RNA, 18 nt, Bordetella pertussis
cggcggccggggccgccc

SEQ ID NO: 424152 - RNA, 21 nt, Bordetella pertussis
cggcggccuaugugcaggcca

SEQ ID NO: 424153 - RNA, 19 nt, Bordetella pertussis
cggcggccuccgcgcacag

SEQ ID NO: 424154 - RNA, 21 nt, Bordetella pertussis
cggcggccuccggcaggaucu

SEQ ID NO: 424155 - RNA, 14 nt, Bordetella pertussis
cggcggccugcagg

SEQ ID NO: 424156 - RNA, 21 nt, Bordetella pertussis
cggcggccuggaccugagcca

SEQ ID NO: 424157 - RNA, 15 nt, Bordetella pertussis
cggcggccugggcca

SEQ ID NO: 424158 - RNA, 20 nt, Bordetella pertussis
cggcggccuugugcgccagc

SEQ ID NO: 424159 - RNA, 18 nt, Bordetella pertussis
cggcggccuuugcgcgcu

SEQ ID NO: 424160 - RNA, 22 nt, Bordetella pertussis
cggcggcgagcgcggcgcgcgc

SEQ ID NO: 424161 - RNA, 21 nt, Bordetella pertussis
cggcggcgcccgcauggaccg

SEQ ID NO: 424162 - RNA, 15 nt, Bordetella pertussis
cggcggcgcaccaau

SEQ ID NO: 424163 - RNA, 14 nt, Bordetella pertussis
cggcggcgcgcgcg

SEQ ID NO: 424164 - RNA, 13 nt, Bordetella pertussis
cggcggcgcgcug

SEQ ID NO: 424165 - RNA, 12 nt, Bordetella pertussis
cggcggcgcgcc

SEQ ID NO: 424166 - RNA, 16 nt, Bordetella pertussis
cggcggcgcuggccug

SEQ ID NO: 424167 - RNA, 18 nt, Bordetella pertussis
cggcggcgcuggccugcc

SEQ ID NO: 424168 - RNA, 14 nt, Bordetella pertussis
cggcggcgcgccgc

SEQ ID NO: 424169 - RNA, 14 nt, Bordetella pertussis
cggcggcgucgcgc

SEQ ID NO: 424170 - RNA, 17 nt, Bordetella pertussis
cggcggcgucggcgccc

SEQ ID NO: 424171 - RNA, 18 nt, Bordetella pertussis
cggcggcguggccgugcu

SEQ ID NO: 424172 - RNA, 15 nt, Bordetella pertussis
cggcggcguggcggc

SEQ ID NO: 424173 - RNA, 16 nt, Bordetella pertussis
cggcgggaucgggcag

SEQ ID NO: 424174 - RNA, 17 nt, Bordetella pertussis
cggcgggaucgggcagc

SEQ ID NO: 424175 - RNA, 14 nt, Bordetella pertussis
cggcgggcaggcgg

SEQ ID NO: 424176 - RNA, 16 nt, Bordetella pertussis
cggcgggcaggcgggc

SEQ ID NO: 424177 - RNA, 21 nt, Bordetella pertussis
cggcgggccggcucggcggca

SEQ ID NO: 424178 - RNA, 15 nt, Bordetella pertussis
cggcgggcgcgcagg

SEQ ID NO: 424179 - RNA, 19 nt, Bordetella pertussis
cggcgggcgcugccugccg

SEQ ID NO: 424180 - RNA, 13 nt, Bordetella pertussis
cggcgggcggcgc

SEQ ID NO: 424181 - RNA, 17 nt, Bordetella pertussis
cggcgggcggcgcggcc

SEQ ID NO: 424182 - RNA, 12 nt, Bordetella pertussis
cggcgggcucag

SEQ ID NO: 424183 - RNA, 13 nt, Bordetella pertussis
cggcgggcucagc

SEQ ID NO: 424184 - RNA, 15 nt, Bordetella pertussis
cggcgggcucggcgc

SEQ ID NO: 424185 - RNA, 16 nt, Bordetella pertussis
cggcgguaccaggccg

SEQ ID NO: 424186 - RNA, 23 nt, Bordetella pertussis
cggcgguaagcguccgcgcgccg

SEQ ID NO: 424187 - RNA, 13 nt, Bordetella pertussis
cggcggucagcgc

SEQ ID NO: 424188 - RNA, 18 nt, Bordetella pertussis
cggcggucagcgcggcgc

SEQ ID NO: 424189 - RNA, 20 nt, Bordetella pertussis
cggcggucccgagcgcuccc

SEQ ID NO: 424190 - RNA, 18 nt, Bordetella pertussis
cggcggucgcgcuggccc

SEQ ID NO: 424191 - RNA, 16 nt, Bordetella pertussis
cggcgguugcccgccc

SEQ ID NO: 424192 - RNA, 17 nt, Bordetella pertussis
cggcgguugcccgcccc

SEQ ID NO: 424193 - RNA, 15 nt, Bordetella pertussis
cggcguaccaggcag

SEQ ID NO: 424194 - RNA, 23 nt, Bordetella pertussis
cggcguaccaggcagccggcccc

SEQ ID NO: 424195 - RNA, 20 nt, Bordetella pertussis
cggcguacuggcgcggcggc

SEQ ID NO: 424196 - RNA, 21 nt, Bordetella pertussis
cggcguagucguugccggcca

SEQ ID NO: 424197 - RNA, 12 nt, Bordetella pertussis
cggcgugccaug

SEQ ID NO: 424198 - RNA, 12 nt, Bordetella pertussis
cggcgugcccag

SEQ ID NO: 424199 - RNA, 14 nt, Bordetella pertussis
cggcgugcccaggg

SEQ ID NO: 424200 - RNA, 19 nt, Bordetella pertussis
cggcgugcccagggccacg

SEQ ID NO: 424201 - RNA, 21 nt, Bordetella pertussis
cggcgugcccagggccacgaa

SEQ ID NO: 424202 - RNA, 23 nt, Bordetella pertussis
cggcgugcccugcggcgcggcca

SEQ ID NO: 424203 - RNA, 16 nt, Bordetella pertussis
cggcgugcgccugcug

SEQ ID NO: 424204 - RNA, 13 nt, Bordetella pertussis
cggcgugcggccc

SEQ ID NO: 424205 - RNA, 18 nt, Bordetella pertussis
cggcgugcggcccagccg

SEQ ID NO: 424206 - RNA, 23 nt, Bordetella pertussis
cggcgugcggcccagccgcucgg

SEQ ID NO: 424207 - RNA, 21 nt, Bordetella pertussis
cggcgugcgcuggcugggccu

SEQ ID NO: 424208 - RNA, 12 nt, Bordetella pertussis
cggcguggccug

SEQ ID NO: 424209 - RNA, 15 nt, Bordetella pertussis
cggcguggcgcgcac

SEQ ID NO: 424210 - RNA, 17 nt, Bordetella pertussis
cggcguggcggccaggc

SEQ ID NO: 424211 - RNA, 14 nt, Bordetella pertussis
cggcguggcggggc

SEQ ID NO: 424212 - RNA, 17 nt, Bordetella pertussis
cggcguggggccggccg

SEQ ID NO: 424213 - RNA, 18 nt, Bordetella pertussis
cggcgugguaucgcgcca

SEQ ID NO: 424214 - RNA, 17 nt, Bordetella pertussis
cggcguguagagcugcg

SEQ ID NO: 424215 - RNA, 21 nt, Bordetella pertussis
cggcguguagagcugcggcgc

SEQ ID NO: 424216 - RNA, 20 nt, Bordetella pertussis
cggcguguccagcggcgcca

SEQ ID NO: 424217 - RNA, 15 nt, Bordetella pertussis
cggcgugugcccagc

SEQ ID NO: 424218 - RNA, 18 nt, Bordetella pertussis
cggcgugugcccagcacc

SEQ ID NO: 424219 - RNA, 20 nt, Bordetella pertussis
cggcguguucagcgcgcgcg

SEQ ID NO: 424220 - RNA, 16 nt, Bordetella pertussis
cggcguuccuggcgcu

SEQ ID NO: 424221 - RNA, 14 nt, Bordetella pertussis
cggcuacgaccuga

SEQ ID NO: 424222 - RNA, 20 nt, Bordetella pertussis
cggcuacggcaagguccagg

SEQ ID NO: 424223 - RNA, 21 nt, Bordetella pertussis
cggcuauaccgggcuggucag

SEQ ID NO: 424224 - RNA, 22 nt, Bordetella pertussis
cggcuaggcgcagcaggccagg

SEQ ID NO: 424225 - RNA, 13 nt, Bordetella pertussis
cggcucaggccag

SEQ ID NO: 424226 - RNA, 14 nt, Bordetella pertussis
cggcucagcccccc

SEQ ID NO: 424227 - RNA, 12 nt, Bordetella pertussis
cggcuccggccg

SEQ ID NO: 424228 - RNA, 14 nt, Bordetella pertussis
cggcuccggccgcu

SEQ ID NO: 424229 - RNA, 20 nt, Bordetella pertussis
cggcucgagcaagggccaga

SEQ ID NO: 424230 - RNA, 18 nt, Bordetella pertussis
cggcucgagcuccugcuc

SEQ ID NO: 424231 - RNA, 15 nt, Bordetella pertussis
cggcucgaggaacca

SEQ ID NO: 424232 - RNA, 22 nt, Bordetella pertussis
cggcucgaggaaccagccgucg

SEQ ID NO: 424233 - RNA, 19 nt, Bordetella pertussis
cggcucgaucgccgccggc

SEQ ID NO: 424234 - RNA, 21 nt, Bordetella pertussis
cggcucgaucgccgccggcac

SEQ ID NO: 424235 - RNA, 14 nt, Bordetella pertussis
cggcucgaugcaau

SEQ ID NO: 424236 - RNA, 23 nt, Bordetella pertussis
cggcucgaugcaauagcgcccgc

SEQ ID NO: 424237 - RNA, 17 nt, Bordetella pertussis
cggcucgaacaggcugg

SEQ ID NO: 424238 - RNA, 19 nt, Bordetella pertussis
cggcucgaacaggcuggca

SEQ ID NO: 424239 - RNA, 16 nt, Bordetella pertussis
cggcucgccgcauacc

SEQ ID NO: 424240 - RNA, 15 nt, Bordetella pertussis
cggcucgccgcuccg

SEQ ID NO: 424241 - RNA, 18 nt, Bordetella pertussis
cggcucgccggccgcgcc

SEQ ID NO: 424242 - RNA, 13 nt, Bordetella pertussis
cggcucgccuccc

SEQ ID NO: 424243 - RNA, 22 nt, Bordetella pertussis
cggcugcaagacgcccaggccc

SEQ ID NO: 424244 - RNA, 18 nt, Bordetella pertussis
cggcugcaccagcgcgcc

SEQ ID NO: 424245 - RNA, 21 nt, Bordetella pertussis
cggcugcaccagcgcgccgcg

SEQ ID NO: 424246 - RNA, 15 nt, Bordetella pertussis
cggcugccagggccg

SEQ ID NO: 424247 - RNA, 14 nt, Bordetella pertussis
cggcugcccaccuu

SEQ ID NO: 424248 - RNA, 16 nt, Bordetella pertussis
cggcugcccaccuugc

SEQ ID NO: 424249 - RNA, 13 nt, Bordetella pertussis
cggcugcccucgg

SEQ ID NO: 424250 - RNA, 17 nt, Bordetella pertussis
cggcugcccucggucag

SEQ ID NO: 424251 - RNA, 15 nt, Bordetella pertussis
cggcugcccuugcug

SEQ ID NO: 424252 - RNA, 16 nt, Bordetella pertussis
cggcugcccuugcugu

SEQ ID NO: 424253 - RNA, 15 nt, Bordetella pertussis
cggcuggccgaucac

SEQ ID NO: 424254 - RNA, 20 nt, Bordetella pertussis
cggcuggccgaucaccugca

SEQ ID NO: 424255 - RNA, 21 nt, Bordetella pertussis
cggcuggcgcaagacgcggca

SEQ ID NO: 424256 - RNA, 15 nt, Bordetella pertussis
cggcuggcgcggccg

SEQ ID NO: 424257 - RNA, 19 nt, Bordetella pertussis
cggcuggcugggcgcgccg

SEQ ID NO: 424258 - RNA, 20 nt, Bordetella pertussis
cggcuggcugggcgcgccgc

SEQ ID NO: 424259 - RNA, 14 nt, Bordetella pertussis
cggcugggcggccu

SEQ ID NO: 424260 - RNA, 20 nt, Bordetella pertussis
cggcugggcggccuuggccg

SEQ ID NO: 424261 - RNA, 12 nt, Bordetella pertussis
cggcuggggcug

SEQ ID NO: 424262 - RNA, 23 nt, Bordetella pertussis
cggcuggucgccgucaggaucag

SEQ ID NO: 424263 - RNA, 18 nt, Bordetella pertussis
cggcuguagucgccgcug

SEQ ID NO: 424264 - RNA, 19 nt, Bordetella pertussis
cggcuguccaccugcaccg

SEQ ID NO: 424265 - RNA, 18 nt, Bordetella pertussis
cggcuguccuggcguggc

SEQ ID NO: 424266 - RNA, 13 nt, Bordetella pertussis
cggcuucaggcgc

SEQ ID NO: 424267 - RNA, 18 nt, Bordetella pertussis
cggcuucaggcgcgcggc

SEQ ID NO: 424268 - RNA, 17 nt, Bordetella pertussis
cggcuucaugccggcgu

SEQ ID NO: 424269 - RNA, 20 nt, Bordetella pertussis
cggcuucgaccacgcggcgg

SEQ ID NO: 424270 - RNA, 14 nt, Bordetella pertussis
cggcuucgcccagc

SEQ ID NO: 424271 - RNA, 18 nt, Bordetella pertussis
cggcuucgcgcagcaagu

SEQ ID NO: 424272 - RNA, 21 nt, Bordetella pertussis
cggcuucgcgcagcaagucag

SEQ ID NO: 424273 - RNA, 16 nt, Bordetella pertussis
cggcuucggccgucag

SEQ ID NO: 424274 - RNA, 17 nt, Bordetella pertussis
cggcuucggccgucagc

SEQ ID NO: 424275 - RNA, 20 nt, Bordetella pertussis
cggcuucggccgucagcagc

SEQ ID NO: 424276 - RNA, 15 nt, Bordetella pertussis
cggcuuuggacaggc

SEQ ID NO: 424277 - RNA, 17 nt, Bordetella pertussis
cggcuuuuucucggccu

SEQ ID NO: 424278 - RNA, 22 nt, Bordetella pertussis
cgggaagcgcucgcgcaggcgu

SEQ ID NO: 424279 - RNA, 14 nt, Bordetella pertussis
cgggaaugaagcgc

SEQ ID NO: 424280 - RNA, 21 nt, Bordetella pertussis
cgggaaugauuccgcuggcga

SEQ ID NO: 424281 - RNA, 17 nt, Bordetella pertussis
cgggcacaacccgcccg

SEQ ID NO: 424282 - RNA, 19 nt, Bordetella pertussis
cgggcacaacccgcccggg

SEQ ID NO: 424283 - RNA, 20 nt, Bordetella pertussis
cgggcacaacccgcccgggg

SEQ ID NO: 424284 - RNA, 21 nt, Bordetella pertussis
cgggcacaacccgcccggggc

SEQ ID NO: 424285 - RNA, 22 nt, Bordetella pertussis
cgggaaugucccacaggcgcgc

SEQ ID NO: 424286 - RNA, 18 nt, Bordetella pertussis
cgggcaccaucucccgca

SEQ ID NO: 424287 - RNA, 23 nt, Bordetella pertussis
cgggcaccaucucccgcaggccc

SEQ ID NO: 424288 - RNA, 22 nt, Bordetella pertussis
cgggcacgagaucgccuggggc

SEQ ID NO: 424289 - RNA, 20 nt, Bordetella pertussis
cgggcacgaucaccgccgcg

SEQ ID NO: 424290 - RNA, 22 nt, Bordetella pertussis
cgggcacgaucaccgccgcggc

SEQ ID NO: 424291 - RNA, 22 nt, Bordetella pertussis
cgggcacgaugcguugcgccuc

SEQ ID NO: 424292 - RNA, 19 nt, Bordetella pertussis
cgggcacguccggaucuuc

SEQ ID NO: 424293 - RNA, 16 nt, Bordetella pertussis
cgggcagcucgcgcgc

SEQ ID NO: 424294 - RNA, 14 nt, Bordetella pertussis
cgggcaggcucagc

SEQ ID NO: 424295 - RNA, 15 nt, Bordetella pertussis
cgggcaggcucagcc

SEQ ID NO: 424296 - RNA, 15 nt, Bordetella pertussis
cgggcaggcuccaca

SEQ ID NO: 424297 - RNA, 21 nt, Bordetella pertussis
cgggcaggcuccacagccacu

SEQ ID NO: 424298 - RNA, 14 nt, Bordetella pertussis
cgggcagggugggc

SEQ ID NO: 424299 - RNA, 17 nt, Bordetella pertussis
cgggcaguucgggcacg

SEQ ID NO: 424300 - RNA, 19 nt, Bordetella pertussis
cgggccagcuccccgggcg

SEQ ID NO: 424301 - RNA, 16 nt, Bordetella pertussis
cgggccaggccggugg

SEQ ID NO: 424302 - RNA, 19 nt, Bordetella pertussis
cgggccauccguccgccag

SEQ ID NO: 424303 - RNA, 18 nt, Bordetella pertussis
cgggccauggaugcgcgc

SEQ ID NO: 424304 - RNA, 14 nt, Bordetella pertussis
cgggcccgcgcaga

SEQ ID NO: 424305 - RNA, 19 nt, Bordetella pertussis
cgggcccgacagcgccccg

SEQ ID NO: 424306 - RNA, 17 nt, Bordetella pertussis
cgggcccgucgcgccag

SEQ ID NO: 424307 - RNA, 19 nt, Bordetella pertussis
cgggcccgucgcgccaggc

SEQ ID NO: 424308 - RNA, 21 nt, Bordetella pertussis
cgggcccgucgcgccaggccg

SEQ ID NO: 424309 - RNA, 13 nt, Bordetella pertussis
cgggccgacgcgc

SEQ ID NO: 424310 - RNA, 18 nt, Bordetella pertussis
cgggccgacgcgcccggg

SEQ ID NO: 424311 - RNA, 18 nt, Bordetella pertussis
cgggccgacggccucggc

SEQ ID NO: 424312 - RNA, 23 nt, Bordetella pertussis
cgggccgacggccucggccagga

SEQ ID NO: 424313 - RNA, 14 nt, Bordetella pertussis
cgggccgaccaggc

SEQ ID NO: 424314 - RNA, 23 nt, Bordetella pertussis
cgggccgcaagcaagccccaggc

SEQ ID NO: 424315 - RNA, 13 nt, Bordetella pertussis
cgggccgcacagc

SEQ ID NO: 424316 - RNA, 14 nt, Bordetella pertussis
cgggccgcagcaug

SEQ ID NO: 424317 - RNA, 22 nt, Bordetella pertussis
cgggccgcgccccuagcgccgc

SEQ ID NO: 424318 - RNA, 21 nt, Bordetella pertussis
cgggccgcgccgcggcacggg

SEQ ID NO: 424319 - RNA, 12 nt, Bordetella pertussis
cgggccgcgcgc

SEQ ID NO: 424320 - RNA, 13 nt, Bordetella pertussis
cgggccgcgcgcg

SEQ ID NO: 424321 - RNA, 16 nt, Bordetella pertussis
cgggccgcgcgcgggc

SEQ ID NO: 424322 - RNA, 13 nt, Bordetella pertussis
cgggccggcuaca

SEQ ID NO: 424323 - RNA, 22 nt, Bordetella pertussis
cgggccggcucauucggcgcgc

SEQ ID NO: 424324 - RNA, 15 nt, Bordetella pertussis
cgggccggcucggcg

SEQ ID NO: 424325 - RNA, 14 nt, Bordetella pertussis
cgggccggcugccg

SEQ ID NO: 424326 - RNA, 15 nt, Bordetella pertussis
cgggccggcugggcg

SEQ ID NO: 424327 - RNA, 15 nt, Bordetella pertussis
cgggccgggcacgau

SEQ ID NO: 424328 - RNA, 15 nt, Bordetella pertussis
cgggccggcgcgccu

SEQ ID NO: 424329 - RNA, 12 nt, Bordetella pertussis
cgggccggcggc

SEQ ID NO: 424330 - RNA, 16 nt, Bordetella pertussis
cgggccggcgggcaug

SEQ ID NO: 424331 - RNA, 16 nt, Bordetella pertussis
cgggccggccugcguc

SEQ ID NO: 424332 - RNA, 16 nt, Bordetella pertussis
cgggccgugcgccggg

SEQ ID NO: 424333 - RNA, 17 nt, Bordetella pertussis
cgggccgugcgccgggc

SEQ ID NO: 424334 - RNA, 19 nt, Bordetella pertussis
cgggccgucgugcgccugg

SEQ ID NO: 424335 - RNA, 23 nt, Bordetella pertussis
cgggccgucgugcgccuggcggc

SEQ ID NO: 424336 - RNA, 17 nt, Bordetella pertussis
cgggccuacuucggcag

SEQ ID NO: 424337 - RNA, 18 nt, Bordetella pertussis
cgggccuacuucggcagc

SEQ ID NO: 424338 - RNA, 14 nt, Bordetella pertussis
cgggccugcagcau

SEQ ID NO: 424339 - RNA, 21 nt, Bordetella pertussis
cgggccugcaguucggccgcc

SEQ ID NO: 424340 - RNA, 13 nt, Bordetella pertussis
cgggccugcagca

SEQ ID NO: 424341 - RNA, 14 nt, Bordetella pertussis
cgggccugccgcgc

SEQ ID NO: 424342 - RNA, 14 nt, Bordetella pertussis
cgggccuggaucgg

SEQ ID NO: 424343 - RNA, 22 nt, Bordetella pertussis
cgggccuggccugcgccgccgc

SEQ ID NO: 424344 - RNA, 21 nt, Bordetella pertussis
cgggccuggcucaggccugca

SEQ ID NO: 424345 - RNA, 21 nt, Bordetella pertussis
cgggccugggcgucgagcggc

SEQ ID NO: 424346 - RNA, 17 nt, Bordetella pertussis
cgggcgaagcagucaug

SEQ ID NO: 424347 - RNA, 16 nt, Bordetella pertussis
cgggcgacggcgugcu

SEQ ID NO: 424348 - RNA, 17 nt, Bordetella pertussis
cgggcgacuccagcccg

SEQ ID NO: 424349 - RNA, 22 nt, Bordetella pertussis
cgggcgagauggcgugcacgcg

SEQ ID NO: 424350 - RNA, 15 nt, Bordetella pertussis
cgggcgaggcggggc

SEQ ID NO: 424351 - RNA, 16 nt, Bordetella pertussis
cgggcgaggcggggcu

SEQ ID NO: 424352 - RNA, 16 nt, Bordetella pertussis
cgggcgaucgcgucgg

SEQ ID NO: 424353 - RNA, 18 nt, Bordetella pertussis
cgggcgaucgcgucggcc

SEQ ID NO: 424354 - RNA, 22 nt, Bordetella pertussis
cgggcgauuugccgcagcccgc

SEQ ID NO: 424355 - RNA, 17 nt, Bordetella pertussis
cgggcgcaagcgcgccg

SEQ ID NO: 424356 - RNA, 20 nt, Bordetella pertussis
cgggcgccagcagcgggcug

SEQ ID NO: 424357 - RNA, 22 nt, Bordetella pertussis
cgggcgccagcagcgggcuggg

SEQ ID NO: 424358 - RNA, 12 nt, Bordetella pertussis
cgggcgcccagc

SEQ ID NO: 424359 - RNA, 22 nt, Bordetella pertussis
cgggcgcccgcuucucacugcc

SEQ ID NO: 424360 - RNA, 18 nt, Bordetella pertussis
cgggcgcccggccggccu

SEQ ID NO: 424361 - RNA, 13 nt, Bordetella pertussis
cgggcgccgcgca

SEQ ID NO: 424362 - RNA, 16 nt, Bordetella pertussis
cgggcgccgcgcccca

SEQ ID NO: 424363 - RNA, 15 nt, Bordetella pertussis
cgggcgccugccgca

SEQ ID NO: 424364 - RNA, 14 nt, Bordetella pertussis
cgggcgccugcgcc

SEQ ID NO: 424365 - RNA, 15 nt, Bordetella pertussis
cgggcgcgcagcgcg

SEQ ID NO: 424366 - RNA, 18 nt, Bordetella pertussis
cgggcgcgcagcgcgacc

SEQ ID NO: 424367 - RNA, 13 nt, Bordetella pertussis
cgggcgcgcaggc

SEQ ID NO: 424368 - RNA, 14 nt, Bordetella pertussis
cgggcgcgccggcg

SEQ ID NO: 424369 - RNA, 15 nt, Bordetella pertussis
cgggcgcgccgucgc

SEQ ID NO: 424370 - RNA, 15 nt, Bordetella pertussis
cgggcgcgcgccccg

SEQ ID NO: 424371 - RNA, 17 nt, Bordetella pertussis
cgggcgcgcugcccagc

SEQ ID NO: 424372 - RNA, 14 nt, Bordetella pertussis
cgggcgcggcaggc

SEQ ID NO: 424373 - RNA, 15 nt, Bordetella pertussis
cgggcgcggccaggc

SEQ ID NO: 424374 - RNA, 17 nt, Bordetella pertussis
cgggcgcggccaggcgc

SEQ ID NO: 424375 - RNA, 22 nt, Bordetella pertussis
cgggcgcggccgccgcccgccu

SEQ ID NO: 424376 - RNA, 15 nt, Bordetella pertussis
cgggcgcgcuucagu

SEQ ID NO: 424377 - RNA, 22 nt, Bordetella pertussis
cgggcgcgcuucagugcucggg

SEQ ID NO: 424378 - RNA, 21 nt, Bordetella pertussis
cgggcgcggugcgcaccaggc

SEQ ID NO: 424379 - RNA, 23 nt, Bordetella pertussis
cgggcgcggugcgcaccaggccc

SEQ ID NO: 424380 - RNA, 13 nt, Bordetella pertussis
cgggcgcugccca

SEQ ID NO: 424381 - RNA, 16 nt, Bordetella pertussis
cgggcgcugcccagga

SEQ ID NO: 424382 - RNA, 19 nt, Bordetella pertussis
cgggcgcugcgccggcggc

SEQ ID NO: 424383 - RNA, 13 nt, Bordetella pertussis
cgggcggccgacg

SEQ ID NO: 424384 - RNA, 14 nt, Bordetella pertussis
cgggcggcgccugg

SEQ ID NO: 424385 - RNA, 22 nt, Bordetella pertussis
cgggcggcgcgcccagcggcag

SEQ ID NO: 424386 - RNA, 19 nt, Bordetella pertussis
cgggcggcgcggccaaccc

SEQ ID NO: 424387 - RNA, 18 nt, Bordetella pertussis
cgggcggcgcgggcggcu

SEQ ID NO: 424388 - RNA, 22 nt, Bordetella pertussis
cgggcggcgguuucuuccagca

SEQ ID NO: 424389 - RNA, 16 nt, Bordetella pertussis
cgggcggcgucgccgc

SEQ ID NO: 424390 - RNA, 20 nt, Bordetella pertussis
cgggcgggaaguggaaccgc

SEQ ID NO: 424391 - RNA, 12 nt, Bordetella pertussis
cgggcgggcgca

SEQ ID NO: 424392 - RNA, 15 nt, Bordetella pertussis
cgggcgggucggcga

SEQ ID NO: 424393 - RNA, 16 nt, Bordetella pertussis
cgggcggugcggccuc

SEQ ID NO: 424394 - RNA, 13 nt, Bordetella pertussis
cgggcgucaccgg

SEQ ID NO: 424395 - RNA, 15 nt, Bordetella pertussis
cgggcgucugcccgc

SEQ ID NO: 424396 - RNA, 16 nt, Bordetella pertussis
cgggcgugagcgccuc

SEQ ID NO: 424397 - RNA, 23 nt, Bordetella pertussis
cgggcgugaugccgaccaggccc

SEQ ID NO: 424398 - RNA, 23 nt, Bordetella pertussis
cgggcgugcggauggucgagcgc

SEQ ID NO: 424399 - RNA, 19 nt, Bordetella pertussis
cgggcgugcuggcacuguc

SEQ ID NO: 424400 - RNA, 17 nt, Bordetella pertussis
cgggcguuugcccuucg

SEQ ID NO: 424401 - RNA, 15 nt, Bordetella pertussis
cgggcuccucgcccg

SEQ ID NO: 424402 - RNA, 18 nt, Bordetella pertussis
cgggcucgaaguacagcu

SEQ ID NO: 424403 - RNA, 19 nt, Bordetella pertussis
cgggcucgcgcgcgcgggc

SEQ ID NO: 424404 - RNA, 14 nt, Bordetella pertussis
cgggcuggucgcgc

SEQ ID NO: 424405 - RNA, 16 nt, Bordetella pertussis
cgggcuggucgcgccg

SEQ ID NO: 424406 - RNA, 20 nt, Bordetella pertussis
cgggcugucgcagucggggc

SEQ ID NO: 424407 - RNA, 17 nt, Bordetella pertussis
cgggcuguucgcgcagc

SEQ ID NO: 424408 - RNA, 15 nt, Bordetella pertussis
cgggcuugcgcaccc

SEQ ID NO: 424409 - RNA, 20 nt, Bordetella pertussis
cgggcuugcgcaccccggug

SEQ ID NO: 424410 - RNA, 13 nt, Bordetella pertussis
cgggcuugcugcc

SEQ ID NO: 424411 - RNA, 14 nt, Bordetella pertussis
cgggcuugcugccc

SEQ ID NO: 424412 - RNA, 16 nt, Bordetella pertussis
cgggcuugcugccccc

SEQ ID NO: 424413 - RNA, 19 nt, Bordetella pertussis
cgggcuugcugccccccga

SEQ ID NO: 424414 - RNA, 23 nt, Bordetella pertussis
cgggcuugcugccccccgagggg

SEQ ID NO: 424415 - RNA, 23 nt, Bordetella pertussis
cgggcuugucgcugcgcauggcg

SEQ ID NO: 424416 - RNA, 20 nt, Bordetella pertussis
cgggcuuucggucucgcgcg

SEQ ID NO: 424417 - RNA, 17 nt, Bordetella pertussis
cggggcgagcgcagccg

SEQ ID NO: 424418 - RNA, 18 nt, Bordetella pertussis
cggggcgcuugccacuau

SEQ ID NO: 424419 - RNA, 14 nt, Bordetella pertussis
cggggcggcagguc

SEQ ID NO: 424420 - RNA, 14 nt, Bordetella pertussis
cggggcggcgcagc

SEQ ID NO: 424421 - RNA, 15 nt, Bordetella pertussis
cggggcggcgccugc

SEQ ID NO: 424422 - RNA, 22 nt, Bordetella pertussis
cggggcggucaaugcggcggcg

SEQ ID NO: 424423 - RNA, 15 nt, Bordetella pertussis
cggggcguccaccgc

SEQ ID NO: 424424 - RNA, 17 nt, Bordetella pertussis
cggggcguccaccgccg

SEQ ID NO: 424425 - RNA, 18 nt, Bordetella pertussis
cggggcguccaccgccga

SEQ ID NO: 424426 - RNA, 13 nt, Bordetella pertussis
cggggguggacgc

SEQ ID NO: 424427 - RNA, 20 nt, Bordetella pertussis
cggggucagcgccggcacgc

SEQ ID NO: 424428 - RNA, 22 nt, Bordetella pertussis
cggggucagcgccggcacgcug

SEQ ID NO: 424429 - RNA, 13 nt, Bordetella pertussis
cggggucgaucgc

SEQ ID NO: 424430 - RNA, 21 nt, Bordetella pertussis
cggggucgucggcgcugcagc

SEQ ID NO: 424431 - RNA, 22 nt, Bordetella pertussis
cggggucuugccgcgcagcguc

SEQ ID NO: 424432 - RNA, 12 nt, Bordetella pertussis
cggggugcagcu

SEQ ID NO: 424433 - RNA, 20 nt, Bordetella pertussis
cggggugccguucggccagc

SEQ ID NO: 424434 - RNA, 14 nt, Bordetella pertussis
cggggugccugucc

SEQ ID NO: 424435 - RNA, 21 nt, Bordetella pertussis
cggggugccuguccccgcggg

SEQ ID NO: 424436 - RNA, 21 nt, Bordetella pertussis
cggggugccugucccugcggg

SEQ ID NO: 424437 - RNA, 16 nt, Bordetella pertussis
cgggguggccggcgcg

SEQ ID NO: 424438 - RNA, 21 nt, Bordetella pertussis
cgggguggccggcgcgcggcc

SEQ ID NO: 424439 - RNA, 14 nt, Bordetella pertussis
cgggguggucuucc

SEQ ID NO: 424440 - RNA, 19 nt, Bordetella pertussis
cggguacguggccccaggc

SEQ ID NO: 424441 - RNA, 19 nt, Bordetella pertussis
cggguaucgucgaccugga

SEQ ID NO: 424442 - RNA, 14 nt, Bordetella pertussis
cgggucaaggcggg

SEQ ID NO: 424443 - RNA, 17 nt, Bordetella pertussis
cggguccuugccgggcu

SEQ ID NO: 424444 - RNA, 13 nt, Bordetella pertussis
cgggucgagcgcc

SEQ ID NO: 424445 - RNA, 13 nt, Bordetella pertussis
cgggucgcgcagc

SEQ ID NO: 424446 - RNA, 14 nt, Bordetella pertussis
cgggucgcgcagca

SEQ ID NO: 424447 - RNA, 20 nt, Bordetella pertussis
cgggucgcgcagcagggccu

SEQ ID NO: 424448 - RNA, 15 nt, Bordetella pertussis
cgggucgcgcagcau

SEQ ID NO: 424449 - RNA, 22 nt, Bordetella pertussis
cggucaccgcgcccaggguggu

SEQ ID NO: 424450 - RNA, 15 nt, Bordetella pertussis
cggucaccgagcuga

SEQ ID NO: 424451 - RNA, 18 nt, Bordetella pertussis
cggucacguucagcgccg

SEQ ID NO: 424452 - RNA, 17 nt, Bordetella pertussis
cggucaggaugcgcgcc

SEQ ID NO: 424453 - RNA, 21 nt, Bordetella pertussis
cggucaggaugcgcgccaggc

SEQ ID NO: 424454 - RNA, 21 nt, Bordetella pertussis
cggucagcuugccgcccaggu

SEQ ID NO: 424455 - RNA, 19 nt, Bordetella pertussis
cggucagggcgaagcgcgc

SEQ ID NO: 424456 - RNA, 15 nt, Bordetella pertussis
cggucaugcccaugc

SEQ ID NO: 424457 - RNA, 21 nt, Bordetella pertussis
cggucaugcccaugccgccau

SEQ ID NO: 424458 - RNA, 16 nt, Bordetella pertussis
cgguccacagcccggc

SEQ ID NO: 424459 - RNA, 13 nt, Bordetella pertussis
cgguccagcacca

SEQ ID NO: 424460 - RNA, 21 nt, Bordetella pertussis
cgguccagcaccagggcgcgc

SEQ ID NO: 424461 - RNA, 13 nt, Bordetella pertussis
cgguccaggaagc

SEQ ID NO: 424462 - RNA, 11 nt, Bordetella pertussis
cgguccaggcc

SEQ ID NO: 424463 - RNA, 23 nt, Bordetella pertussis
cgguccaugcgaaagcggccagc

SEQ ID NO: 424464 - RNA, 15 nt, Bordetella pertussis
cggucccgagcgcuc

SEQ ID NO: 424465 - RNA, 18 nt, Bordetella pertussis
cggucccgagcgcucccg

SEQ ID NO: 424466 - RNA, 17 nt, Bordetella pertussis
cgguccgacgguagccg

SEQ ID NO: 424467 - RNA, 14 nt, Bordetella pertussis
cgguccgcagcgcu

SEQ ID NO: 424468 - RNA, 22 nt, Bordetella pertussis
cgguccgcucgaggccaggcug

SEQ ID NO: 424469 - RNA, 21 nt, Bordetella pertussis
cggucgacgaaauagccgacc

SEQ ID NO: 424470 - RNA, 22 nt, Bordetella pertussis
cggucgaugaagcccgagcggc

SEQ ID NO: 424471 - RNA, 18 nt, Bordetella pertussis
cggucgaugaccagccag

SEQ ID NO: 424472 - RNA, 18 nt, Bordetella pertussis
cggucgaugcgcacgccc

SEQ ID NO: 424473 - RNA, 19 nt, Bordetella pertussis
cggucgccucgaagaccuc

SEQ ID NO: 424474 - RNA, 21 nt, Bordetella pertussis
cggucggcccaggucaucgcc

SEQ ID NO: 424475 - RNA, 16 nt, Bordetella pertussis
cggucggccggcagcg

SEQ ID NO: 424476 - RNA, 16 nt, Bordetella pertussis
cggucggccgcgccgc

SEQ ID NO: 424477 - RNA, 15 nt, Bordetella pertussis
cggucggcgcggcgc

SEQ ID NO: 424478 - RNA, 17 nt, Bordetella pertussis
cggucggcgcggcgccg

SEQ ID NO: 424479 - RNA, 18 nt, Bordetella pertussis
cggucgucagcacgcccu

SEQ ID NO: 424480 - RNA, 21 nt, Bordetella pertussis
cggucgucagcacgcccuggc

SEQ ID NO: 424481 - RNA, 14 nt, Bordetella pertussis
cggugaccgccagc

SEQ ID NO: 424482 - RNA, 23 nt, Bordetella pertussis
cggucuccgguucggcgcggcgc

SEQ ID NO: 424483 - RNA, 16 nt, Bordetella pertussis
cggugacgcccugcca

SEQ ID NO: 424484 - RNA, 19 nt, Bordetella pertussis
cggugaucuugccgaugcg

SEQ ID NO: 424485 - RNA, 18 nt, Bordetella pertussis
cggugaugauggccaggu

SEQ ID NO: 424486 - RNA, 20 nt, Bordetella pertussis
cggugaugcggcgcgccgcg

SEQ ID NO: 424487 - RNA, 17 nt, Bordetella pertussis
cggugcaccaggccacc

SEQ ID NO: 424488 - RNA, 14 nt, Bordetella pertussis
cggugcagcccagc

SEQ ID NO: 424489 - RNA, 18 nt, Bordetella pertussis
cggugccaguccccaugc

SEQ ID NO: 424490 - RNA, 15 nt, Bordetella pertussis
cggugccaguccccc

SEQ ID NO: 424491 - RNA, 17 nt, Bordetella pertussis
cggugccagucccccug

SEQ ID NO: 424492 - RNA, 18 nt, Bordetella pertussis
cggugccagucccccugc

SEQ ID NO: 424493 - RNA, 23 nt, Bordetella pertussis
cggugccagucuccaggcucagg

SEQ ID NO: 424494 - RNA, 17 nt, Bordetella pertussis
cggugccgagcagaugc

SEQ ID NO: 424495 - RNA, 23 nt, Bordetella pertussis
cgguggauucggacgccucgccg

SEQ ID NO: 424496 - RNA, 16 nt, Bordetella pertussis
cgguggccagccaggc

SEQ ID NO: 424497 - RNA, 12 nt, Bordetella pertussis
cgguggccaugc

SEQ ID NO: 424498 - RNA, 16 nt, Bordetella pertussis
cgguggccgcgcaugc

SEQ ID NO: 424499 - RNA, 21 nt, Bordetella pertussis
cggugggauaaggcgugccgc

SEQ ID NO: 424500 - RNA, 14 nt, Bordetella pertussis
cgguggucgggcag

SEQ ID NO: 424501 - RNA, 23 nt, Bordetella pertussis
cgguggucugccaguccauccag

SEQ ID NO: 424502 - RNA, 20 nt, Bordetella pertussis
cggugucgaugggcccgggc

SEQ ID NO: 424503 - RNA, 17 nt, Bordetella pertussis
cgguuguugcccaccgc

SEQ ID NO: 424504 - RNA, 18 nt, Bordetella pertussis
cgguuugguagcaggcgc

SEQ ID NO: 424505 - RNA, 20 nt, Bordetella pertussis
cguaaacaucgcgcauggcg

SEQ ID NO: 424506 - RNA, 14 nt, Bordetella pertussis
cguagaacacgucg

SEQ ID NO: 424507 - RNA, 19 nt, Bordetella pertussis
cguagccgcugcgcgcggc

SEQ ID NO: 424508 - RNA, 20 nt, Bordetella pertussis
cguagccgcugcgcgcggcc

SEQ ID NO: 424509 - RNA, 15 nt, Bordetella pertussis
cguagccggugcgca

SEQ ID NO: 424510 - RNA, 17 nt, Bordetella pertussis
cguagccggugcgcagc

SEQ ID NO: 424511 - RNA, 17 nt, Bordetella pertussis
cguagcgauccgaugcc

SEQ ID NO: 424512 - RNA, 15 nt, Bordetella pertussis
cguagcgcagcaccg

SEQ ID NO: 424513 - RNA, 22 nt, Bordetella pertussis
cguagcgcaucgcgaugcgcag

SEQ ID NO: 424514 - RNA, 12 nt, Bordetella pertussis
cguagcgcggcc

SEQ ID NO: 424515 - RNA, 21 nt, Bordetella pertussis
cguagcguuggcggccggcca

SEQ ID NO: 424516 - RNA, 16 nt, Bordetella pertussis
cguagcugucgaccgg

SEQ ID NO: 424517 - RNA, 16 nt, Bordetella pertussis
cguaggacagccccag

SEQ ID NO: 424518 - RNA, 19 nt, Bordetella pertussis
cguaggacagccccagcag

SEQ ID NO: 424519 - RNA, 18 nt, Bordetella pertussis
cguaggcaaagcgcggcu

SEQ ID NO: 424520 - RNA, 19 nt, Bordetella pertussis
cguaggcaggggcuccagg

SEQ ID NO: 424521 - RNA, 15 nt, Bordetella pertussis
cguaggcggcccagg

SEQ ID NO: 424522 - RNA, 23 nt, Bordetella pertussis
cguaggucaggcccacgccgccg

SEQ ID NO: 424523 - RNA, 14 nt, Bordetella pertussis
cguaguacagcagc

SEQ ID NO: 424524 - RNA, 15 nt, Bordetella pertussis
cguaguacagcagca

SEQ ID NO: 424525 - RNA, 18 nt, Bordetella pertussis
cguaguccagcagcagcg

SEQ ID NO: 424526 - RNA, 18 nt, Bordetella pertussis
cguaguccgagcccgggc

SEQ ID NO: 424527 - RNA, 14 nt, Bordetella pertussis
cguagugcgcgccg

SEQ ID NO: 424528 - RNA, 15 nt, Bordetella pertussis
cguaugcggcagcag

SEQ ID NO: 424529 - RNA, 16 nt, Bordetella pertussis
cguaugcggcagcagg

SEQ ID NO: 424530 - RNA, 14 nt, Bordetella pertussis
cgucaacagcaugg

SEQ ID NO: 424531 - RNA, 18 nt, Bordetella pertussis
cgucaauccgccgccagc

SEQ ID NO: 424532 - RNA, 13 nt, Bordetella pertussis
cgucaccagcagg

SEQ ID NO: 424533 - RNA, 13 nt, Bordetella pertussis
cgucaccccgccc

SEQ ID NO: 424534 - RNA, 16 nt, Bordetella pertussis
cgucacgaaagcgccc

SEQ ID NO: 424535 - RNA, 19 nt, Bordetella pertussis
cgucacgaaagcgcccagg

SEQ ID NO: 424536 - RNA, 19 nt, Bordetella pertussis
cgucacggcaagacggcgc

SEQ ID NO: 424537 - RNA, 20 nt, Bordetella pertussis
cgucagcacgcccuggcuga

SEQ ID NO: 424538 - RNA, 11 nt, Bordetella pertussis
cgucagcagca

SEQ ID NO: 424539 - RNA, 23 nt, Bordetella pertussis
cgucagcaugcacgacuacggcg

SEQ ID NO: 424540 - RNA, 13 nt, Bordetella pertussis
cgucagcgccgcg

SEQ ID NO: 424541 - RNA, 15 nt, Bordetella pertussis
cgucagcgccgcgau

SEQ ID NO: 424542 - RNA, 12 nt, Bordetella pertussis
cgucagcgccgc

SEQ ID NO: 424543 - RNA, 15 nt, Bordetella pertussis
cgucagcgugcgccc

SEQ ID NO: 424544 - RNA, 18 nt, Bordetella pertussis
cgucagcgugcgccccgc

SEQ ID NO: 424545 - RNA, 23 nt, Bordetella pertussis
cgucagcgugcgccccgccucga

SEQ ID NO: 424546 - RNA, 20 nt, Bordetella pertussis
cgucagcucgaucaggcgcu

SEQ ID NO: 424547 - RNA, 23 nt, Bordetella pertussis
cgucagcucgaucaggcgcucca

SEQ ID NO: 424548 - RNA, 16 nt, Bordetella pertussis
cgucaggcaggcgcgc

SEQ ID NO: 424549 - RNA, 17 nt, Bordetella pertussis
cgucaggcaggcgcgcc

SEQ ID NO: 424550 - RNA, 15 nt, Bordetella pertussis
cgucagggccgcagc

SEQ ID NO: 424551 - RNA, 20 nt, Bordetella pertussis
cgucaggggcaugccggcau

SEQ ID NO: 424552 - RNA, 18 nt, Bordetella pertussis
cgucaggugcagcgagac

SEQ ID NO: 424553 - RNA, 19 nt, Bordetella pertussis
cgucaggugcagcgagacc

SEQ ID NO: 424554 - RNA, 17 nt, Bordetella pertussis
cgucaguugggcgcgcc

SEQ ID NO: 424555 - RNA, 22 nt, Bordetella pertussis
cgucaguugggcgcgcccagcc

SEQ ID NO: 424556 - RNA, 23 nt, Bordetella pertussis
cgucaguugggcgcgcccagccc

SEQ ID NO: 424557 - RNA, 16 nt, Bordetella pertussis
cgucaucaccaagggc

SEQ ID NO: 424558 - RNA, 17 nt, Bordetella pertussis
cgucaucgccgcggcgg

SEQ ID NO: 424559 - RNA, 16 nt, Bordetella pertussis
cgucaucggcgcgcag

SEQ ID NO: 424560 - RNA, 19 nt, Bordetella pertussis
cgucaugauguagcccaug

SEQ ID NO: 424561 - RNA, 13 nt, Bordetella pertussis
cgucaugcgccgc

SEQ ID NO: 424562 - RNA, 19 nt, Bordetella pertussis
cgucaugcgccgcagcacc

SEQ ID NO: 424563 - RNA, 20 nt, Bordetella pertussis
cgucaugcgcuugucgccgc

SEQ ID NO: 424564 - RNA, 16 nt, Bordetella pertussis
cgucauggucgaccag

SEQ ID NO: 424565 - RNA, 14 nt, Bordetella pertussis
cgucaugugcagaa

SEQ ID NO: 424566 - RNA, 17 nt, Bordetella pertussis
cgucauuacccauggca

SEQ ID NO: 424567 - RNA, 17 nt, Bordetella pertussis
cguccaauucgagcagg

SEQ ID NO: 424568 - RNA, 17 nt, Bordetella pertussis
cguccaccaccaggccg

SEQ ID NO: 424569 - RNA, 21 nt, Bordetella pertussis
cguccaccaccaggccggcca

SEQ ID NO: 424570 - RNA, 17 nt, Bordetella pertussis
cguccacccccgucagc

SEQ ID NO: 424571 - RNA, 15 nt, Bordetella pertussis
cguucaggcgcggcu

SEQ ID NO: 424572 - RNA, 21 nt, Bordetella pertussis
cguucaucagcgcgcgcagcc

SEQ ID NO: 424573 - RNA, 20 nt, Bordetella pertussis
cguucgaaagccagcgccug

SEQ ID NO: 424574 - RNA, 20 nt, Bordetella pertussis
cguucgaaguccgcgcgcag

SEQ ID NO: 424575 - RNA, 15 nt, Bordetella pertussis
cguucgacgggcagg

SEQ ID NO: 424576 - RNA, 20 nt, Bordetella pertussis
cguucggggacaggcaccca

SEQ ID NO: 424577 - RNA, 16 nt, Bordetella pertussis
cguucggggcgucgcu

SEQ ID NO: 424578 - RNA, 23 nt, Bordetella pertussis
cguucggggcgucgcugcuggcg

SEQ ID NO: 424579 - RNA, 17 nt, Bordetella pertussis
cguucguauugcugcug

SEQ ID NO: 424580 - RNA, 14 nt, Bordetella pertussis
cguucgucgcgcag

SEQ ID NO: 424581 - RNA, 17 nt, Bordetella pertussis
cguugaagcgcagccac

SEQ ID NO: 424582 - RNA, 20 nt, Bordetella pertussis
cguugacggcccagcucugg

SEQ ID NO: 424583 - RNA, 14 nt, Bordetella pertussis
cguugauccagcgc

SEQ ID NO: 424584 - RNA, 17 nt, Bordetella pertussis
cguugcagcccagcgcg

SEQ ID NO: 424585 - RNA, 14 nt, Bordetella pertussis
cguugccgcgcgcg

SEQ ID NO: 424586 - RNA, 17 nt, Bordetella pertussis
cguugccggccagcacg

SEQ ID NO: 424587 - RNA, 16 nt, Bordetella pertussis
cguugcgccagcggcg

SEQ ID NO: 424588 - RNA, 21 nt, Bordetella pertussis
cguugcggcccgccgacuggg

SEQ ID NO: 424589 - RNA, 22 nt, Bordetella pertussis
cguugcggcccgccgacugggc

SEQ ID NO: 424590 - RNA, 13 nt, Bordetella pertussis
cguugcggcgcca

SEQ ID NO: 424591 - RNA, 19 nt, Bordetella pertussis
cguugcuccagccaggcgc

SEQ ID NO: 424592 - RNA, 21 nt, Bordetella pertussis
cguugcuccagccaggcgcgc

SEQ ID NO: 424593 - RNA, 23 nt, Bordetella pertussis
cguugcuggcaaagcgcgcgucc

SEQ ID NO: 424594 - RNA, 14 nt, Bordetella pertussis
cguuguccaggccg

SEQ ID NO: 424595 - RNA, 16 nt, Bordetella pertussis
cguuguccuggcgcgc

SEQ ID NO: 424596 - RNA, 21 nt, Bordetella pertussis
cguugucgagcaggccgccgc

SEQ ID NO: 424597 - RNA, 15 nt, Bordetella pertussis
cguugucgcgccgcg

SEQ ID NO: 424598 - RNA, 17 nt, Bordetella pertussis
cguuguucgggccggcu

SEQ ID NO: 424599 - RNA, 14 nt, Bordetella pertussis
cguuuuggcgagca

SEQ ID NO: 424600 - RNA, 14 nt, Bordetella pertussis
cuacaccaucaacg

SEQ ID NO: 424601 - RNA, 20 nt, Bordetella pertussis
cuacaccaucaacgggccgc

SEQ ID NO: 424602 - RNA, 12 nt, Bordetella pertussis
cuacacccugcu

SEQ ID NO: 424603 - RNA, 19 nt, Bordetella pertussis
cuacacggccgccaccugg

SEQ ID NO: 424604 - RNA, 23 nt, Bordetella pertussis
cuacacggccgccaccugggccg

SEQ ID NO: 424605 - RNA, 15 nt, Bordetella pertussis
cuacacggugggcga

SEQ ID NO: 424606 - RNA, 18 nt, Bordetella pertussis
cuacuggcaacgggucgc

SEQ ID NO: 424607 - RNA, 15 nt, Bordetella pertussis
cuacuggcugaucac

SEQ ID NO: 424608 - RNA, 16 nt, Bordetella pertussis
cuacuugccggcgcuc

SEQ ID NO: 424609 - RNA, 14 nt, Bordetella pertussis
cuagggcguggcgc

SEQ ID NO: 424610 - RNA, 20 nt, Bordetella pertussis
cuaguagaacucgccagguc

SEQ ID NO: 424611 - RNA, 20 nt, Bordetella pertussis
cuaguucuauauaggacuau

SEQ ID NO: 424612 - RNA, 15 nt, Bordetella pertussis
cuaucauggccuugg

SEQ ID NO: 424613 - RNA, 17 nt, Bordetella pertussis
cuaugcagcugcgccag

SEQ ID NO: 424614 - RNA, 19 nt, Bordetella pertussis
cuaugcagcugcgccagcc

SEQ ID NO: 424615 - RNA, 22 nt, Bordetella pertussis
cuauguggcguucgcggugggc

SEQ ID NO: 424616 - RNA, 20 nt, Bordetella pertussis
cuauucggccaacggcuggc

SEQ ID NO: 424617 - RNA, 22 nt, Bordetella pertussis
cuauucgggaaugaugcgcauu

SEQ ID NO: 424618 - RNA, 13 nt, Bordetella pertussis
cuauuggcuguau

SEQ ID NO: 424619 - RNA, 21 nt, Bordetella pertussis
cucaacaguacuacaguaugg

SEQ ID NO: 424620 - RNA, 23 nt, Bordetella pertussis
cucaacgaagaacagccgcugca

SEQ ID NO: 424621 - RNA, 18 nt, Bordetella pertussis
cucacagacgaucacggu

SEQ ID NO: 424622 - RNA, 15 nt, Bordetella pertussis
cucaccgccgcccgc

SEQ ID NO: 424623 - RNA, 22 nt, Bordetella pertussis
cucaccuuuccgaucagcugcg

SEQ ID NO: 424624 - RNA, 17 nt, Bordetella pertussis
cucacgccccgcccucu

SEQ ID NO: 424625 - RNA, 20 nt, Bordetella pertussis
cucacuccauagcgccgcuc

SEQ ID NO: 424626 - RNA, 17 nt, Bordetella pertussis
cucagcgacgcgcgccg

SEQ ID NO: 424627 - RNA, 16 nt, Bordetella pertussis
cucagcgccaucaucg

SEQ ID NO: 424628 - RNA, 17 nt, Bordetella pertussis
cucagcgggcugcugga

SEQ ID NO: 424629 - RNA, 22 nt, Bordetella pertussis
cucagcguuuccagggcgcgcc

SEQ ID NO: 424630 - RNA, 23 nt, Bordetella pertussis
cucagcguuuccagggcgcgccg

SEQ ID NO: 424631 - RNA, 15 nt, Bordetella pertussis
cucaggccgccggcg

SEQ ID NO: 424632 - RNA, 16 nt, Bordetella pertussis
cucaggccgcugggca

SEQ ID NO: 424633 - RNA, 20 nt, Bordetella pertussis
cucaggccugcacgucccag

SEQ ID NO: 424634 - RNA, 18 nt, Bordetella pertussis
cucaggcggugacgcccu

SEQ ID NO: 424635 - RNA, 21 nt, Bordetella pertussis
cucaggcggugacgcccugcc

SEQ ID NO: 424636 - RNA, 22 nt, Bordetella pertussis
cucagucggccuggcgcuccuc

SEQ ID NO: 424637 - RNA, 23 nt, Bordetella pertussis
cucagucgggcagcgcccgcgcc

SEQ ID NO: 424638 - RNA, 12 nt, Bordetella pertussis
cucauccaggcg

SEQ ID NO: 424639 - RNA, 20 nt, Bordetella pertussis
cucauccccgcgugccuguc

SEQ ID NO: 424640 - RNA, 13 nt, Bordetella pertussis
cucaugcgggaca

SEQ ID NO: 424641 - RNA, 18 nt, Bordetella pertussis
cucaugcgggacaggcgc

SEQ ID NO: 424642 - RNA, 14 nt, Bordetella pertussis
cucauuggcgcgcu

SEQ ID NO: 424643 - RNA, 17 nt, Bordetella pertussis
cucauuggcgcgcuuga

SEQ ID NO: 424644 - RNA, 22 nt, Bordetella pertussis
cuccacagccacugcggcccga

SEQ ID NO: 424645 - RNA, 14 nt, Bordetella pertussis
cuccaccaccaucu

SEQ ID NO: 424646 - RNA, 17 nt, Bordetella pertussis
cuccaccagcaccggca

SEQ ID NO: 424647 - RNA, 15 nt, Bordetella pertussis
cuccacccccgggcg

SEQ ID NO: 424648 - RNA, 19 nt, Bordetella pertussis
cuccccuggucagggcugc

SEQ ID NO: 424649 - RNA, 17 nt, Bordetella pertussis
cucccguaagcaggucu

SEQ ID NO: 424650 - RNA, 19 nt, Bordetella pertussis
cucccguaagcaggucugc

SEQ ID NO: 424651 - RNA, 22 nt, Bordetella pertussis
cuccgaagggcugcgugcggga

SEQ ID NO: 424652 - RNA, 16 nt, Bordetella pertussis
cuccgacaggcgccgc

SEQ ID NO: 424653 - RNA, 17 nt, Bordetella pertussis
cuccgacaggcgccgca

SEQ ID NO: 424654 - RNA, 16 nt, Bordetella pertussis
cuccgagggacaccgc

SEQ ID NO: 424655 - RNA, 17 nt, Bordetella pertussis
cuccgauagcggcgccg

SEQ ID NO: 424656 - RNA, 19 nt, Bordetella pertussis
cuccgauagcggcgccgcu

SEQ ID NO: 424657 - RNA, 21 nt, Bordetella pertussis
cuccgcguugcgcugcccguc

SEQ ID NO: 424658 - RNA, 19 nt, Bordetella pertussis
cuccggauaccgccgccgc

SEQ ID NO: 424659 - RNA, 16 nt, Bordetella pertussis
cuccggugccuggcuc

SEQ ID NO: 424660 - RNA, 12 nt, Bordetella pertussis
cuccgguucggc

SEQ ID NO: 424661 - RNA, 20 nt, Bordetella pertussis
cuccguaaagaugcgcgccg

SEQ ID NO: 424662 - RNA, 23 nt, Bordetella pertussis
cuccugcuggcgcgucggcgcgc

SEQ ID NO: 424663 - RNA, 22 nt, Bordetella pertussis
cuccugguugaccgagcccggc

SEQ ID NO: 424664 - RNA, 12 nt, Bordetella pertussis
cuccuugaccag

SEQ ID NO: 424665 - RNA, 16 nt, Bordetella pertussis
cuccuugacgcgcgcg

SEQ ID NO: 424666 - RNA, 16 nt, Bordetella pertussis
cucgaacaggccaucg

SEQ ID NO: 424667 - RNA, 23 nt, Bordetella pertussis
cucgaacaggccaucgccgccgc

SEQ ID NO: 424668 - RNA, 20 nt, Bordetella pertussis
cucgaagaagcagccgcgcu

SEQ ID NO: 424669 - RNA, 22 nt, Bordetella pertussis
cucgaagaccucggcgcucagg

SEQ ID NO: 424670 - RNA, 20 nt, Bordetella pertussis
cucgaccaucauggccaggg

SEQ ID NO: 424671 - RNA, 23 nt, Bordetella pertussis
cucgaccaucauggccagggccg

SEQ ID NO: 424672 - RNA, 17 nt, Bordetella pertussis
cucgacccgcucggcca

SEQ ID NO: 424673 - RNA, 19 nt, Bordetella pertussis
cucgacccgcucggccacg

SEQ ID NO: 424674 - RNA, 13 nt, Bordetella pertussis
cucgaccgccgcc

SEQ ID NO: 424675 - RNA, 15 nt, Bordetella pertussis
cucgaccgccgccac

SEQ ID NO: 424676 - RNA, 18 nt, Bordetella pertussis
cucgaccgccgggacagg

SEQ ID NO: 424677 - RNA, 20 nt, Bordetella pertussis
cucgaccgccgggacaggca

SEQ ID NO: 424678 - RNA, 16 nt, Bordetella pertussis
cucgaccugggucgga

SEQ ID NO: 424679 - RNA, 19 nt, Bordetella pertussis
cucgaccugggucggaaac

SEQ ID NO: 424680 - RNA, 19 nt, Bordetella pertussis
cucgaccuugucgcccgau

SEQ ID NO: 424681 - RNA, 20 nt, Bordetella pertussis
cucgacgaacacgcgcgccg

SEQ ID NO: 424682 - RNA, 21 nt, Bordetella pertussis
cucgacgaagcccgugucggc

SEQ ID NO: 424683 - RNA, 14 nt, Bordetella pertussis
cucgacgaugcccu

SEQ ID NO: 424684 - RNA, 15 nt, Bordetella pertussis
cucgacgcccgggcg

SEQ ID NO: 424685 - RNA, 22 nt, Bordetella pertussis
cucgacgcgcauuucgaccugc

SEQ ID NO: 424686 - RNA, 19 nt, Bordetella pertussis
cucgagcgccugcagcgug

SEQ ID NO: 424687 - RNA, 13 nt, Bordetella pertussis
cucgagcggcgga

SEQ ID NO: 424688 - RNA, 20 nt, Bordetella pertussis
cucgagcuggcuggccagcg

SEQ ID NO: 424689 - RNA, 14 nt, Bordetella pertussis
cucgaggaaccagc

SEQ ID NO: 424690 - RNA, 14 nt, Bordetella pertussis
cucgaggcggcgca

SEQ ID NO: 424691 - RNA, 19 nt, Bordetella pertussis
cucgauccgggccuggcgu

SEQ ID NO: 424692 - RNA, 24 nt, Bordetella pertussis
cucgaucgccaggucggccagccg

SEQ ID NO: 424693 - RNA, 16 nt, Bordetella pertussis
cucgaugaccagcagc

SEQ ID NO: 424694 - RNA, 11 nt, Bordetella pertussis
cucgaugaugg

SEQ ID NO: 424695 - RNA, 16 nt, Bordetella pertussis
cucgaugcccagcacc

SEQ ID NO: 424696 - RNA, 16 nt, Bordetella pertussis
cucgaugcgccagucc

SEQ ID NO: 424697 - RNA, 22 nt, Bordetella pertussis
cucgaugcgccaguccagcgcg

SEQ ID NO: 424698 - RNA, 20 nt, Bordetella pertussis
cucgcaagugcuggcccgcc

SEQ ID NO: 424699 - RNA, 22 nt, Bordetella pertussis
cucgcaagugcuggcccgccag

SEQ ID NO: 424700 - RNA, 14 nt, Bordetella pertussis
cucgcacacgcgcu

SEQ ID NO: 424701 - RNA, 19 nt, Bordetella pertussis
cucgcacacgcgcugggcg

SEQ ID NO: 424702 - RNA, 23 nt, Bordetella pertussis
cucgcacaguucgugcaccagcc

SEQ ID NO: 424703 - RNA, 23 nt, Bordetella pertussis
cucgcacggcaauguccggggcg

SEQ ID NO: 424704 - RNA, 17 nt, Bordetella pertussis
cucgcacgugacgccgg

SEQ ID NO: 424705 - RNA, 16 nt, Bordetella pertussis
cucgcaggccugcugc

SEQ ID NO: 424706 - RNA, 15 nt, Bordetella pertussis
cucgccccggcgcgc

SEQ ID NO: 424707 - RNA, 14 nt, Bordetella pertussis
cucgcccgaccugc

SEQ ID NO: 424708 - RNA, 18 nt, Bordetella pertussis
cucgcccgaucggccggc

SEQ ID NO: 424709 - RNA, 19 nt, Bordetella pertussis
cucgcccgaucggccggcc

SEQ ID NO: 424710 - RNA, 17 nt, Bordetella pertussis
cucgccgaacugccggc

SEQ ID NO: 424711 - RNA, 21 nt, Bordetella pertussis
cucgccgagccgggccaugcg

SEQ ID NO: 424712 - RNA, 12 nt, Bordetella pertussis
cucgccgcgcgu

SEQ ID NO: 424713 - RNA, 16 nt, Bordetella pertussis
cucgccgugcugggcg

SEQ ID NO: 424714 - RNA, 23 nt, Bordetella pertussis
cucgccuccccaggccagcugcg

SEQ ID NO: 424715 - RNA, 14 nt, Bordetella pertussis
cucgccucggcuug

SEQ ID NO: 424716 - RNA, 18 nt, Bordetella pertussis
cucgcgaaagcacgccau

SEQ ID NO: 424717 - RNA, 13 nt, Bordetella pertussis
cucgcgcaccgca

SEQ ID NO: 424718 - RNA, 20 nt, Bordetella pertussis
cucgcgcaccgcaugggcca

SEQ ID NO: 424719 - RNA, 13 nt, Bordetella pertussis
cucgcgcaacgca

SEQ ID NO: 424720 - RNA, 19 nt, Bordetella pertussis
cucggccaccuggucgucg

SEQ ID NO: 424721 - RNA, 17 nt, Bordetella pertussis
cucggccacggucggca

SEQ ID NO: 424722 - RNA, 19 nt, Bordetella pertussis
cucggccacggucggcacg

SEQ ID NO: 424723 - RNA, 21 nt, Bordetella pertussis
cucggccacgucggcggccgc

SEQ ID NO: 424724 - RNA, 18 nt, Bordetella pertussis
cucggccagcagcgccug

SEQ ID NO: 424725 - RNA, 14 nt, Bordetella pertussis
cucggccagcagug

SEQ ID NO: 424726 - RNA, 12 nt, Bordetella pertussis
cucggccagccg

SEQ ID NO: 424727 - RNA, 12 nt, Bordetella pertussis
cucggccagcga

SEQ ID NO: 424728 - RNA, 18 nt, Bordetella pertussis
cucggccagcgaggccgc

SEQ ID NO: 424729 - RNA, 12 nt, Bordetella pertussis
cucggccagcgc

SEQ ID NO: 424730 - RNA, 19 nt, Bordetella pertussis
cucggccucggucagggug

SEQ ID NO: 424731 - RNA, 20 nt, Bordetella pertussis
cucggccucggucagggugg

SEQ ID NO: 424732 - RNA, 14 nt, Bordetella pertussis
cucggccugcggcu

SEQ ID NO: 424733 - RNA, 15 nt, Bordetella pertussis
cucggccuguucgga

SEQ ID NO: 424734 - RNA, 16 nt, Bordetella pertussis
cucggcgaagugcccg

SEQ ID NO: 424735 - RNA, 14 nt, Bordetella pertussis
cucggcgaagccgc

SEQ ID NO: 424736 - RNA, 22 nt, Bordetella pertussis
cucggcgacggucaggggcagg

SEQ ID NO: 424737 - RNA, 20 nt, Bordetella pertussis
cucggcgagcgccucgcgcu

SEQ ID NO: 424738 - RNA, 16 nt, Bordetella pertussis
cucggcggccagcgcg

SEQ ID NO: 424739 - RNA, 20 nt, Bordetella pertussis
cucggcggccagcgcgcccu

SEQ ID NO: 424740 - RNA, 15 nt, Bordetella pertussis
cucggcggccgccug

SEQ ID NO: 424741 - RNA, 20 nt, Bordetella pertussis
cucggcggccuccggcagga

SEQ ID NO: 424742 - RNA, 17 nt, Bordetella pertussis
cucggcgggcggcgcca

SEQ ID NO: 424743 - RNA, 21 nt, Bordetella pertussis
cucggcgggcggcgccagcgg

SEQ ID NO: 424744 - RNA, 19 nt, Bordetella pertussis
cucggcggucagcgcggcg

SEQ ID NO: 424745 - RNA, 22 nt, Bordetella pertussis
cucggcgguugcccgccccgug

SEQ ID NO: 424746 - RNA, 19 nt, Bordetella pertussis
cucgggcgacaggcgcgcc

SEQ ID NO: 424747 - RNA, 17 nt, Bordetella pertussis
cucgggcgacuccagcc

SEQ ID NO: 424748 - RNA, 13 nt, Bordetella pertussis
cucgggcucgacu

SEQ ID NO: 424749 - RNA, 19 nt, Bordetella pertussis
cucgggggcgggcccugug

SEQ ID NO: 424750 - RNA, 19 nt, Bordetella pertussis
cucggguuucuugcugcug

SEQ ID NO: 424751 - RNA, 18 nt, Bordetella pertussis
cucggugcagcccagcac

SEQ ID NO: 424752 - RNA, 15 nt, Bordetella pertussis
cucggugcgccgccg

SEQ ID NO: 424753 - RNA, 19 nt, Bordetella pertussis
cucggugcgcgcgcccacc

SEQ ID NO: 424754 - RNA, 15 nt, Bordetella pertussis
cucggugcgggccgg

SEQ ID NO: 424755 - RNA, 16 nt, Bordetella pertussis
cucggugcucuggccc

SEQ ID NO: 424756 - RNA, 14 nt, Bordetella pertussis
cucggugcugcugu

SEQ ID NO: 424757 - RNA, 21 nt, Bordetella pertussis
cucggugcuguuucgcgagga

SEQ ID NO: 424758 - RNA, 16 nt, Bordetella pertussis
cucgguggaggacgcc

SEQ ID NO: 424759 - RNA, 19 nt, Bordetella pertussis
cucgucggucagcucaaga

SEQ ID NO: 424760 - RNA, 18 nt, Bordetella pertussis
cucgugguaguacaaggc

SEQ ID NO: 424761 - RNA, 14 nt, Bordetella pertussis
cucguuggccagcg

SEQ ID NO: 424762 - RNA, 16 nt, Bordetella pertussis
cucuaguucuauauag

SEQ ID NO: 424763 - RNA, 14 nt, Bordetella pertussis
cucuccacuggccu

SEQ ID NO: 424764 - RNA, 19 nt, Bordetella pertussis
cucugcccgaagcggcccg

SEQ ID NO: 424765 - RNA, 22 nt, Bordetella pertussis
cucugcucugucacucaacagu

SEQ ID NO: 424766 - RNA, 15 nt, Bordetella pertussis
cucuggaucgugccc

SEQ ID NO: 424767 - RNA, 13 nt, Bordetella pertussis
cucuggcacacca

SEQ ID NO: 424768 - RNA, 16 nt, Bordetella pertussis
cucuggcacaccagcg

SEQ ID NO: 424769 - RNA, 22 nt, Bordetella pertussis
cucuggcacaccagcgccagga

SEQ ID NO: 424770 - RNA, 15 nt, Bordetella pertussis
cucuggcccgccuca

SEQ ID NO: 424771 - RNA, 15 nt, Bordetella pertussis
cucuucgccggacag

SEQ ID NO: 424772 - RNA, 16 nt, Bordetella pertussis
cucuucggcggccagc

SEQ ID NO: 424773 - RNA, 15 nt, Bordetella pertussis
cucuucgucgccggc

SEQ ID NO: 424774 - RNA, 17 nt, Bordetella pertussis
cucuugaccagcuuguc

SEQ ID NO: 424775 - RNA, 13 nt, Bordetella pertussis
cucuugaccuggg

SEQ ID NO: 424776 - RNA, 13 nt, Bordetella pertussis
cucuuuccccucc

SEQ ID NO: 424777 - RNA, 15 nt, Bordetella pertussis
cugaaaccgcaggca

SEQ ID NO: 424778 - RNA, 20 nt, Bordetella pertussis
cugaacaccggcgcgccugg

SEQ ID NO: 424779 - RNA, 15 nt, Bordetella pertussis
cugaacaggccuucg

SEQ ID NO: 424780 - RNA, 16 nt, Bordetella pertussis
cugaaccugcuggccg

SEQ ID NO: 424781 - RNA, 21 nt, Bordetella pertussis
cugaacgccgcgcugccugaa

SEQ ID NO: 424782 - RNA, 15 nt, Bordetella pertussis
cugaacuauggcgcg

SEQ ID NO: 424783 - RNA, 22 nt, Bordetella pertussis
cugaacuacgaaacucccacgc

SEQ ID NO: 424784 - RNA, 19 nt, Bordetella pertussis
cugaaggaccucgcgccgg

SEQ ID NO: 424785 - RNA, 19 nt, Bordetella pertussis
cugaaggggcuccccugcu

SEQ ID NO: 424786 - RNA, 12 nt, Bordetella pertussis
cugaauugcggg

SEQ ID NO: 424787 - RNA, 12 nt, Bordetella pertussis
cugacccuggcc

SEQ ID NO: 424788 - RNA, 13 nt, Bordetella pertussis
cugacccuggccg

SEQ ID NO: 424789 - RNA, 14 nt, Bordetella pertussis
cugacccuggccga

SEQ ID NO: 424790 - RNA, 19 nt, Bordetella pertussis
cugaccgaagcgggcgagg

SEQ ID NO: 424791 - RNA, 14 nt, Bordetella pertussis
cugaccgacggccu

SEQ ID NO: 424792 - RNA, 15 nt, Bordetella pertussis
cugaccggccugguc

SEQ ID NO: 424793 - RNA, 23 nt, Bordetella pertussis
cugaccggcggcgcucaucaucg

SEQ ID NO: 424794 - RNA, 21 nt, Bordetella pertussis
cugaccggcggcgucugguac

SEQ ID NO: 424795 - RNA, 13 nt, Bordetella pertussis
cugaccggcuucc

SEQ ID NO: 424796 - RNA, 19 nt, Bordetella pertussis
cugaccuggugugccuguc

SEQ ID NO: 424797 - RNA, 16 nt, Bordetella pertussis
cugacgaaacgcgcgu

SEQ ID NO: 424798 - RNA, 23 nt, Bordetella pertussis
cugacgaaacgcgcguccuuggc

SEQ ID NO: 424799 - RNA, 13 nt, Bordetella pertussis
cugacgaaaugcg

SEQ ID NO: 424800 - RNA, 20 nt, Bordetella pertussis
cugacggcuacacccugcuc

SEQ ID NO: 424801 - RNA, 17 nt, Bordetella pertussis
cugacgugcgccacagc

SEQ ID NO: 424802 - RNA, 20 nt, Bordetella pertussis
cugacgugcgccacagcaug

SEQ ID NO: 424803 - RNA, 18 nt, Bordetella pertussis
cugacugcggugccuguc

SEQ ID NO: 424804 - RNA, 14 nt, Bordetella pertussis
cugacugugcagcc

SEQ ID NO: 424805 - RNA, 20 nt, Bordetella pertussis
cugacuuccggggagccugc

SEQ ID NO: 424806 - RNA, 18 nt, Bordetella pertussis
cugagcacaugcccggcc

SEQ ID NO: 424807 - RNA, 15 nt, Bordetella pertussis
cugaugcaggccugc

SEQ ID NO: 424808 - RNA, 12 nt, Bordetella pertussis
cugaugcccagc

SEQ ID NO: 424809 - RNA, 22 nt, Bordetella pertussis
cugaugccugucccgcacgcag

SEQ ID NO: 424810 - RNA, 13 nt, Bordetella pertussis
cugaugcgcggcg

SEQ ID NO: 424811 - RNA, 16 nt, Bordetella pertussis
cugaugcgcggcgggc

SEQ ID NO: 424812 - RNA, 14 nt, Bordetella pertussis
cugaugcuggucag

SEQ ID NO: 424813 - RNA, 18 nt, Bordetella pertussis
cugauucccaggcccggc

SEQ ID NO: 424814 - RNA, 23 nt, Bordetella pertussis
cugcaaccuggucaagggcggcc

SEQ ID NO: 424815 - RNA, 14 nt, Bordetella pertussis
cugcacccacacuu

SEQ ID NO: 424816 - RNA, 21 nt, Bordetella pertussis
cugcacccacacuuggccggc

SEQ ID NO: 424817 - RNA, 16 nt, Bordetella pertussis
cugcacccccuuggcu

SEQ ID NO: 424818 - RNA, 14 nt, Bordetella pertussis
cugcaccggcuugu

SEQ ID NO: 424819 - RNA, 21 nt, Bordetella pertussis
cugcaccggcuugucgaccag

SEQ ID NO: 424820 - RNA, 18 nt, Bordetella pertussis
cugcaccggcgccacggc

SEQ ID NO: 424821 - RNA, 19 nt, Bordetella pertussis
cugcaccggcgccacggcu

SEQ ID NO: 424822 - RNA, 17 nt, Bordetella pertussis
cugcaccgucacgcgcu

SEQ ID NO: 424823 - RNA, 16 nt, Bordetella pertussis
cugcaccgucaggugc

SEQ ID NO: 424824 - RNA, 13 nt, Bordetella pertussis
cugcaccugccug

SEQ ID NO: 424825 - RNA, 14 nt, Bordetella pertussis
cugcaccugccugc

SEQ ID NO: 424826 - RNA, 15 nt, Bordetella pertussis
cugcaccugccugcc

SEQ ID NO: 424827 - RNA, 18 nt, Bordetella pertussis
cugcaccugccugccgcc

SEQ ID NO: 424828 - RNA, 17 nt, Bordetella pertussis
cugcaccucaggaugcc

SEQ ID NO: 424829 - RNA, 19 nt, Bordetella pertussis
cugcaccuugggcgccugc

SEQ ID NO: 424830 - RNA, 18 nt, Bordetella pertussis
cugcaccuuguacugguc

SEQ ID NO: 424831 - RNA, 23 nt, Bordetella pertussis
cugcacgaagcggaugcgccgcc

SEQ ID NO: 424832 - RNA, 15 nt, Bordetella pertussis
cugcacgauggcgcc

SEQ ID NO: 424833 - RNA, 18 nt, Bordetella pertussis
cugcacgauuccgccuac

SEQ ID NO: 424834 - RNA, 15 nt, Bordetella pertussis
cugcacgcagcgcag

SEQ ID NO: 424835 - RNA, 14 nt, Bordetella pertussis
cugcacgccgggcg

SEQ ID NO: 424836 - RNA, 18 nt, Bordetella pertussis
cugcacgccgggcgcgcu

SEQ ID NO: 424837 - RNA, 18 nt, Bordetella pertussis
cugcagcacgcaccaggc

SEQ ID NO: 424838 - RNA, 14 nt, Bordetella pertussis
cugcagcagcgccu

SEQ ID NO: 424839 - RNA, 17 nt, Bordetella pertussis
cugcagcagcgccuugc

SEQ ID NO: 424840 - RNA, 14 nt, Bordetella pertussis
cugcagcagcggca

SEQ ID NO: 424841 - RNA, 15 nt, Bordetella pertussis
cugcagcagcggcag

SEQ ID NO: 424842 - RNA, 23 nt, Bordetella pertussis
cugcagcagcggcagcucggcga

SEQ ID NO: 424843 - RNA, 21 nt, Bordetella pertussis
cugcagcagcguggccgccac

SEQ ID NO: 424844 - RNA, 16 nt, Bordetella pertussis
cugcagcaggcugggc

SEQ ID NO: 424845 - RNA, 13 nt, Bordetella pertussis
cugcagcaggcug

SEQ ID NO: 424846 - RNA, 12 nt, Bordetella pertussis
cugcagcaugaa

SEQ ID NO: 424847 - RNA, 14 nt, Bordetella pertussis
cugcagcaugaccg

SEQ ID NO: 424848 - RNA, 21 nt, Bordetella pertussis
cugcagcaugaccgacaggcg

SEQ ID NO: 424849 - RNA, 15 nt, Bordetella pertussis
cugcagccacuggaa

SEQ ID NO: 424850 - RNA, 22 nt, Bordetella pertussis
cugcagccacuggaacagcuug

SEQ ID NO: 424851 - RNA, 23 nt, Bordetella pertussis
cugcagccacuggaacagcuugg

SEQ ID NO: 424852 - RNA, 20 nt, Bordetella pertussis
cugcagccauucggccacuu

SEQ ID NO: 424853 - RNA, 22 nt, Bordetella pertussis
cugcagcccggccagagccugg

SEQ ID NO: 424854 - RNA, 13 nt, Bordetella pertussis
cugcagcgucugc

SEQ ID NO: 424855 - RNA, 17 nt, Bordetella pertussis
cugcagcgucuggcacg

SEQ ID NO: 424856 - RNA, 17 nt, Bordetella pertussis
cugcagcuugcgcgcca

SEQ ID NO: 424857 - RNA, 15 nt, Bordetella pertussis
cugcaggaaggccgc

SEQ ID NO: 424858 - RNA, 22 nt, Bordetella pertussis
cugcaggaucgcggccagcggc

SEQ ID NO: 424859 - RNA, 19 nt, Bordetella pertussis
cugcaugccauagucgcgc

SEQ ID NO: 424860 - RNA, 22 nt, Bordetella pertussis
cugccagauccgguaugccugc

SEQ ID NO: 424861 - RNA, 20 nt, Bordetella pertussis
cugccagcccaccagcgcca

SEQ ID NO: 424862 - RNA, 17 nt, Bordetella pertussis
cugccauuccagcuccg

SEQ ID NO: 424863 - RNA, 15 nt, Bordetella pertussis
cugccccgaugaugg

SEQ ID NO: 424864 - RNA, 17 nt, Bordetella pertussis
cugcccgacggcgccga

SEQ ID NO: 424865 - RNA, 18 nt, Bordetella pertussis
cugcccgacggcgccgau

SEQ ID NO: 424866 - RNA, 21 nt, Bordetella pertussis
cugcccgacggcgccgauccg

SEQ ID NO: 424867 - RNA, 18 nt, Bordetella pertussis
cugcccgagaccgcccgc

SEQ ID NO: 424868 - RNA, 19 nt, Bordetella pertussis
cugcccgagaccgcccgcu

SEQ ID NO: 424869 - RNA, 16 nt, Bordetella pertussis
cugcccgaagcgcagc

SEQ ID NO: 424870 - RNA, 18 nt, Bordetella pertussis
cugcccgcaacgccgccc

SEQ ID NO: 424871 - RNA, 14 nt, Bordetella pertussis
cugcccgucuuggc

SEQ ID NO: 424872 - RNA, 15 nt, Bordetella pertussis
cugcccgugcgggug

SEQ ID NO: 424873 - RNA, 20 nt, Bordetella pertussis
cugcccgugcgugcgccugu

SEQ ID NO: 424874 - RNA, 21 nt, Bordetella pertussis
cugcccgugcgugcgccuguc

SEQ ID NO: 424875 - RNA, 19 nt, Bordetella pertussis
cugcccguucacgcgcagc

SEQ ID NO: 424876 - RNA, 13 nt, Bordetella pertussis
cugcccucgcccg

SEQ ID NO: 424877 - RNA, 17 nt, Bordetella pertussis
cugcccucgcccgugcg

SEQ ID NO: 424878 - RNA, 16 nt, Bordetella pertussis
cugcccucgccucggc

SEQ ID NO: 424879 - RNA, 18 nt, Bordetella pertussis
cugcccucggucagcgcc

SEQ ID NO: 424880 - RNA, 21 nt, Bordetella pertussis
cugcccugcggcuugggcccg

SEQ ID NO: 424881 - RNA, 23 nt, Bordetella pertussis
cugcccugcggcuugggcccggc

SEQ ID NO: 424882 - RNA, 20 nt, Bordetella pertussis
cugcccugcgugugccuguc

SEQ ID NO: 424883 - RNA, 23 nt, Bordetella pertussis
cugcccuggacgucugagcgccg

SEQ ID NO: 424884 - RNA, 16 nt, Bordetella pertussis
cugcccuggaucagga

SEQ ID NO: 424885 - RNA, 18 nt, Bordetella pertussis
cugcccuggaucaggaug

SEQ ID NO: 424886 - RNA, 15 nt, Bordetella pertussis
cugcccuggcccagg

SEQ ID NO: 424887 - RNA, 16 nt, Bordetella pertussis
cugcccuggcccaggc

SEQ ID NO: 424888 - RNA, 18 nt, Bordetella pertussis
cugcccuggcccaggccg

SEQ ID NO: 424889 - RNA, 18 nt, Bordetella pertussis
cugccgcacuucgggcca

SEQ ID NO: 424890 - RNA, 21 nt, Bordetella pertussis
cugccgcacuucgggccaccc

SEQ ID NO: 424891 - RNA, 15 nt, Bordetella pertussis
cugccgcaucccgcc

SEQ ID NO: 424892 - RNA, 17 nt, Bordetella pertussis
cugccgcaucccgcccc

SEQ ID NO: 424893 - RNA, 15 nt, Bordetella pertussis
cugccgccaggcauu

SEQ ID NO: 424894 - RNA, 16 nt, Bordetella pertussis
cugccgcccgagcugg

SEQ ID NO: 424895 - RNA, 14 nt, Bordetella pertussis
cugccgcccuggcg

SEQ ID NO: 424896 - RNA, 17 nt, Bordetella pertussis
cugccgcgccgaccggc

SEQ ID NO: 424897 - RNA, 15 nt, Bordetella pertussis
cugccgcgcgccggc

SEQ ID NO: 424898 - RNA, 20 nt, Bordetella pertussis
cugcgaacgcccggcccagg

SEQ ID NO: 424899 - RNA, 21 nt, Bordetella pertussis
cugcgaacgcccggcccaggc

SEQ ID NO: 424900 - RNA, 22 nt, Bordetella pertussis
cugcgaacgcccggcccaggcc

SEQ ID NO: 424901 - RNA, 23 nt, Bordetella pertussis
cugcgacagcagcaugcggcccg

SEQ ID NO: 424902 - RNA, 16 nt, Bordetella pertussis
cugcgacagcagggcc

SEQ ID NO: 424903 - RNA, 17 nt, Bordetella pertussis
cugcgacagcagggcca

SEQ ID NO: 424904 - RNA, 21 nt, Bordetella pertussis
cugcgagccgccgcccuugcg

SEQ ID NO: 424905 - RNA, 18 nt, Bordetella pertussis
cugcgcacccgccuggac

SEQ ID NO: 424906 - RNA, 22 nt, Bordetella pertussis
cugcgcacccgccuggacggcg

SEQ ID NO: 424907 - RNA, 21 nt, Bordetella pertussis
cugcgcaccggccggccgggc

SEQ ID NO: 424908 - RNA, 21 nt, Bordetella pertussis
cugcgccaauuguccuggucg

SEQ ID NO: 424909 - RNA, 21 nt, Bordetella pertussis
cugcgccagccgcgccugcag

SEQ ID NO: 424910 - RNA, 14 nt, Bordetella pertussis
cugcgccagcgccu

SEQ ID NO: 424911 - RNA, 20 nt, Bordetella pertussis
cugcgccagcgccucgcgcu

SEQ ID NO: 424912 - RNA, 13 nt, Bordetella pertussis
cugcgccagcgga

SEQ ID NO: 424913 - RNA, 16 nt, Bordetella pertussis
cugcgccagcuccagc

SEQ ID NO: 424914 - RNA, 22 nt, Bordetella pertussis
cugcgccgccgcguggcggcgc

SEQ ID NO: 424915 - RNA, 12 nt, Bordetella pertussis
cugcgccgccuc

SEQ ID NO: 424916 - RNA, 15 nt, Bordetella pertussis
cugcgccggcggcac

SEQ ID NO: 424917 - RNA, 17 nt, Bordetella pertussis
cugcgccggcggcaccg

SEQ ID NO: 424918 - RNA, 19 nt, Bordetella pertussis
cugcgccggcggcaccgcg

SEQ ID NO: 424919 - RNA, 17 nt, Bordetella pertussis
cugcgccgggcgcggcc

SEQ ID NO: 424920 - RNA, 19 nt, Bordetella pertussis
cugcgccggguccggccgc

SEQ ID NO: 424921 - RNA, 22 nt, Bordetella pertussis
cugcgccgucugugcgccccgc

SEQ ID NO: 424922 - RNA, 19 nt, Bordetella pertussis
cugcgcugcauacgccgcu

SEQ ID NO: 424923 - RNA, 22 nt, Bordetella pertussis
cugcggcacgaucggcgccugg

SEQ ID NO: 424924 - RNA, 14 nt, Bordetella pertussis
cugcggcaggccgc

SEQ ID NO: 424925 - RNA, 17 nt, Bordetella pertussis
cugcggccccggcacca

SEQ ID NO: 424926 - RNA, 20 nt, Bordetella pertussis
cugcggccggugaucuugcc

SEQ ID NO: 424927 - RNA, 17 nt, Bordetella pertussis
cugcggcgccagcgccg

SEQ ID NO: 424928 - RNA, 12 nt, Bordetella pertussis
cugcggcgccug

SEQ ID NO: 424929 - RNA, 15 nt, Bordetella pertussis
cugcggcgccugggc

SEQ ID NO: 424930 - RNA, 15 nt, Bordetella pertussis
cugcggcgcggccag

SEQ ID NO: 424931 - RNA, 13 nt, Bordetella pertussis
cugcggcgcggcg

SEQ ID NO: 424932 - RNA, 14 nt, Bordetella pertussis
cugcggcgcggcgc

SEQ ID NO: 424933 - RNA, 18 nt, Bordetella pertussis
cugcggcucgaggaacca

SEQ ID NO: 424934 - RNA, 13 nt, Bordetella pertussis
cugcgucaaggca

SEQ ID NO: 424935 - RNA, 14 nt, Bordetella pertussis
cugcgucgccaccu

SEQ ID NO: 424936 - RNA, 15 nt, Bordetella pertussis
cugcgucgccaccuc

SEQ ID NO: 424937 - RNA, 18 nt, Bordetella pertussis
cugcgugaaacgcucgau

SEQ ID NO: 424938 - RNA, 19 nt, Bordetella pertussis
cugcuccacgugcggcagg

SEQ ID NO: 424939 - RNA, 20 nt, Bordetella pertussis
cugcucgacagcagcccgcu

SEQ ID NO: 424940 - RNA, 22 nt, Bordetella pertussis
cugcucgaaaugcgcguuggcc

SEQ ID NO: 424941 - RNA, 22 nt, Bordetella pertussis
cugcucgagcaugcgggccaug

SEQ ID NO: 424942 - RNA, 15 nt, Bordetella pertussis
cugcucgcaggccug

SEQ ID NO: 424943 - RNA, 14 nt, Bordetella pertussis
cugcucgccguucu

SEQ ID NO: 424944 - RNA, 17 nt, Bordetella pertussis
cugcucgcgcagcgugg

SEQ ID NO: 424945 - RNA, 21 nt, Bordetella pertussis
cugcucgcgcagcguggcggc

SEQ ID NO: 424946 - RNA, 19 nt, Bordetella pertussis
cugcucggugagcggcacg

SEQ ID NO: 424947 - RNA, 20 nt, Bordetella pertussis
cugcucggugcucuggcccg

SEQ ID NO: 424948 - RNA, 22 nt, Bordetella pertussis
cugcucgugcaucaucugggcg

SEQ ID NO: 424949 - RNA, 19 nt, Bordetella pertussis
cugcucguucugcgcgccc

SEQ ID NO: 424950 - RNA, 21 nt, Bordetella pertussis
cugcucguugcgcaagccgcc

SEQ ID NO: 424951 - RNA, 19 nt, Bordetella pertussis
cugcugacugugcagccac

SEQ ID NO: 424952 - RNA, 14 nt, Bordetella pertussis
cugcugcaaggaca

SEQ ID NO: 424953 - RNA, 23 nt, Bordetella pertussis
cugcugcagcacacgcauuugca

SEQ ID NO: 424954 - RNA, 14 nt, Bordetella pertussis
cugcugcagccacu

SEQ ID NO: 424955 - RNA, 15 nt, Bordetella pertussis
cugcugcaggcgcgg

SEQ ID NO: 424956 - RNA, 20 nt, Bordetella pertussis
cugcugcauguccugcaggu

SEQ ID NO: 424957 - RNA, 21 nt, Bordetella pertussis
cugcugcccgaagcgcagcac

SEQ ID NO: 424958 - RNA, 22 nt, Bordetella pertussis
cugcugcccgaagcgcagcacc

SEQ ID NO: 424959 - RNA, 12 nt, Bordetella pertussis
cugcugcccgcc

SEQ ID NO: 424960 - RNA, 14 nt, Bordetella pertussis
cugcugccguuucu

SEQ ID NO: 424961 - RNA, 17 nt, Bordetella pertussis
cugcugcgccuggccgc

SEQ ID NO: 424962 - RNA, 15 nt, Bordetella pertussis
cugcugcggcacgau

SEQ ID NO: 424963 - RNA, 16 nt, Bordetella pertussis
cugcugcggcacggcc

SEQ ID NO: 424964 - RNA, 17 nt, Bordetella pertussis
cugcugcggcacggcca

SEQ ID NO: 424965 - RNA, 18 nt, Bordetella pertussis
cugcugcgccuggcggac

SEQ ID NO: 424966 - RNA, 19 nt, Bordetella pertussis
cugcugcuggaccuggcca

SEQ ID NO: 424967 - RNA, 17 nt, Bordetella pertussis
cugcugcuggcugcccu

SEQ ID NO: 424968 - RNA, 18 nt, Bordetella pertussis
cugcugcuggcugcccug

SEQ ID NO: 424969 - RNA, 20 nt, Bordetella pertussis
cugcugcuggcuucggcgcu

SEQ ID NO: 424970 - RNA, 13 nt, Bordetella pertussis
cugcuggaccugg

SEQ ID NO: 424971 - RNA, 18 nt, Bordetella pertussis
cugcuggaggccggcgug

SEQ ID NO: 424972 - RNA, 19 nt, Bordetella pertussis
cugcuggccaagcgcgccg

SEQ ID NO: 424973 - RNA, 13 nt, Bordetella pertussis
cugcuggccggcc

SEQ ID NO: 424974 - RNA, 21 nt, Bordetella pertussis
cugcuggccggccccauccuc

SEQ ID NO: 424975 - RNA, 22 nt, Bordetella pertussis
cugcuggccggccccauccuca

SEQ ID NO: 424976 - RNA, 14 nt, Bordetella pertussis
cugcuggcgcgcca

SEQ ID NO: 424977 - RNA, 13 nt, Bordetella pertussis
cugcugggccggc

SEQ ID NO: 424978 - RNA, 14 nt, Bordetella pertussis
cugcugggccggcg

SEQ ID NO: 424979 - RNA, 22 nt, Bordetella pertussis
cugcugggguggagcgcggcgc

SEQ ID NO: 424980 - RNA, 23 nt, Bordetella pertussis
cugcugggguggagcgcggcgcu

SEQ ID NO: 424981 - RNA, 24 nt, Bordetella pertussis
cugcugggguggagcgcggcgcug

SEQ ID NO: 424982 - RNA, 14 nt, Bordetella pertussis
cugcuggcggcgcu

SEQ ID NO: 424983 - RNA, 20 nt, Bordetella pertussis
cugcugucgcgcgacuggcc

SEQ ID NO: 424984 - RNA, 19 nt, Bordetella pertussis
cugcugugcgccggggcgc

SEQ ID NO: 424985 - RNA, 14 nt, Bordetella pertussis
cugcuguugcgcgu

SEQ ID NO: 424986 - RNA, 17 nt, Bordetella pertussis
cugcuuauaggcuuuca

SEQ ID NO: 424987 - RNA, 19 nt, Bordetella pertussis
cugcuucauccaggcgcuc

SEQ ID NO: 424988 - RNA, 15 nt, Bordetella pertussis
cugcuucaugcgcuc

SEQ ID NO: 424989 - RNA, 16 nt, Bordetella pertussis
cuggauauggcgccgc

SEQ ID NO: 424990 - RNA, 19 nt, Bordetella pertussis
cuggaucacgugccagccg

SEQ ID NO: 424991 - RNA, 20 nt, Bordetella pertussis
cuggaucgcgcccagcgagc

SEQ ID NO: 424992 - RNA, 21 nt, Bordetella pertussis
cuggaugccaugccgggcaag

SEQ ID NO: 424993 - RNA, 16 nt, Bordetella pertussis
cuggauggccugggug

SEQ ID NO: 424994 - RNA, 17 nt, Bordetella pertussis
cuggauggcggccgcca

SEQ ID NO: 424995 - RNA, 22 nt, Bordetella pertussis
cuggauggcucgggcagcagca

SEQ ID NO: 424996 - RNA, 24 nt, Bordetella pertussis
cuggauggcucgggcagcagcagg

SEQ ID NO: 424997 - RNA, 12 nt, Bordetella pertussis
cuggauggucac

SEQ ID NO: 424998 - RNA, 18 nt, Bordetella pertussis
cuggauggucacgcccag

SEQ ID NO: 424999 - RNA, 23 nt, Bordetella pertussis
cuggaugugcgcgggcgcgggcu

SEQ ID NO: 425000 - RNA, 15 nt, Bordetella pertussis
cuggcaccugccgac

SEQ ID NO: 425001 - RNA, 14 nt, Bordetella pertussis
cuggcacgcgcuga

SEQ ID NO: 425002 - RNA, 16 nt, Bordetella pertussis
cuggcacugucggcgu

SEQ ID NO: 425003 - RNA, 13 nt, Bordetella pertussis
cuggcagccuuga

SEQ ID NO: 425004 - RNA, 14 nt, Bordetella pertussis
cuggccacuggccg

SEQ ID NO: 425005 - RNA, 18 nt, Bordetella pertussis
cuggccacuggccgcgcu

SEQ ID NO: 425006 - RNA, 20 nt, Bordetella pertussis
cuggccacguugucgcgcgu

SEQ ID NO: 425007 - RNA, 21 nt, Bordetella pertussis
cuggccagauagcccaggcgg

SEQ ID NO: 425008 - RNA, 11 nt, Bordetella pertussis
cuggccagccg

SEQ ID NO: 425009 - RNA, 15 nt, Bordetella pertussis
cuggccagccggccc

SEQ ID NO: 425010 - RNA, 21 nt, Bordetella pertussis
cuggccagccggcccagcaug

SEQ ID NO: 425011 - RNA, 18 nt, Bordetella pertussis
cuggccagcuggcggcgc

SEQ ID NO: 425012 - RNA, 17 nt, Bordetella pertussis
cuggccaucaccgccuc

SEQ ID NO: 425013 - RNA, 19 nt, Bordetella pertussis
cuggccaucaccgccuccg

SEQ ID NO: 425014 - RNA, 17 nt, Bordetella pertussis
cuggcccuggcgggccg

SEQ ID NO: 425015 - RNA, 13 nt, Bordetella pertussis
cuggcccugggcu

SEQ ID NO: 425016 - RNA, 24 nt, Bordetella pertussis
cuggcccuuggucugcaggcucug

SEQ ID NO: 425017 - RNA, 15 nt, Bordetella pertussis
cuggccgaacgccgc

SEQ ID NO: 425018 - RNA, 14 nt, Bordetella pertussis
cuggccgagcgcgg

SEQ ID NO: 425019 - RNA, 22 nt, Bordetella pertussis
cuggccgaucaccugcaggccc

SEQ ID NO: 425020 - RNA, 17 nt, Bordetella pertussis
cuggccgaugucgccgc

SEQ ID NO: 425021 - RNA, 19 nt, Bordetella pertussis
cuggccgauuucgcgcgcc

SEQ ID NO: 425022 - RNA, 19 nt, Bordetella pertussis
cuggccgauggucagcaug

SEQ ID NO: 425023 - RNA, 22 nt, Bordetella pertussis
cuggccgccauggcgcuggcag

SEQ ID NO: 425024 - RNA, 13 nt, Bordetella pertussis
cuggccgcccagc

SEQ ID NO: 425025 - RNA, 14 nt, Bordetella pertussis
cuggccgccgcgcu

SEQ ID NO: 425026 - RNA, 17 nt, Bordetella pertussis
cuggccgccgcggccuc

SEQ ID NO: 425027 - RNA, 15 nt, Bordetella pertussis
cuggccgccugcugc

SEQ ID NO: 425028 - RNA, 16 nt, Bordetella pertussis
cuggccgccugcugcg

SEQ ID NO: 425029 - RNA, 17 nt, Bordetella pertussis
cuggccgcgaugcauga

SEQ ID NO: 425030 - RNA, 23 nt, Bordetella pertussis
cuggccgcgaugcaugaaccgca

SEQ ID NO: 425031 - RNA, 11 nt, Bordetella pertussis
cuggccgcgcc

SEQ ID NO: 425032 - RNA, 18 nt, Bordetella pertussis
cuggccgcgccgcuggcg

SEQ ID NO: 425033 - RNA, 18 nt, Bordetella pertussis
cuggccgcgcgccugcuc

SEQ ID NO: 425034 - RNA, 15 nt, Bordetella pertussis
cuggccgcgcucagc

SEQ ID NO: 425035 - RNA, 20 nt, Bordetella pertussis
cuggccgcgcucagccuugu

SEQ ID NO: 425036 - RNA, 19 nt, Bordetella pertussis
cuggccggccaacagcucg

SEQ ID NO: 425037 - RNA, 21 nt, Bordetella pertussis
cuggccggccccauccucauc

SEQ ID NO: 425038 - RNA, 18 nt, Bordetella pertussis
cuggccggcgacuuccgc

SEQ ID NO: 425039 - RNA, 12 nt, Bordetella pertussis
cuggccggcgcu

SEQ ID NO: 425040 - RNA, 20 nt, Bordetella pertussis
cuggccggcguggccugccc

SEQ ID NO: 425041 - RNA, 22 nt, Bordetella pertussis
cuggccggggaagccgccggcg

SEQ ID NO: 425042 - RNA, 21 nt, Bordetella pertussis
cuggccggugaugcggcgcgc

SEQ ID NO: 425043 - RNA, 18 nt, Bordetella pertussis
cuggccgucgagccgguc

SEQ ID NO: 425044 - RNA, 23 nt, Bordetella pertussis
cuggccgucgccgcccugcugcc

SEQ ID NO: 425045 - RNA, 23 nt, Bordetella pertussis
cuggccuugcgcuuuuuucucca

SEQ ID NO: 425046 - RNA, 17 nt, Bordetella pertussis
cuggcgaagaacaccgc

SEQ ID NO: 425047 - RNA, 23 nt, Bordetella pertussis
cuggcgaagaccgugaucggcgc

SEQ ID NO: 425048 - RNA, 16 nt, Bordetella pertussis
cuggcgaccggcggca

SEQ ID NO: 425049 - RNA, 22 nt, Bordetella pertussis
cuggcgcaaggcgucgggcacg

SEQ ID NO: 425050 - RNA, 16 nt, Bordetella pertussis
cuggcgcaccaggcug

SEQ ID NO: 425051 - RNA, 18 nt, Bordetella pertussis
cuggcgcaccaggcuggg

SEQ ID NO: 425052 - RNA, 19 nt, Bordetella pertussis
cuggcgcaccaggcugggg

SEQ ID NO: 425053 - RNA, 20 nt, Bordetella pertussis
cuggcgcacguccagagucu

SEQ ID NO: 425054 - RNA, 12 nt, Bordetella pertussis
cuggcgcagcac

SEQ ID NO: 425055 - RNA, 16 nt, Bordetella pertussis
cuggcgcagcagcgcc

SEQ ID NO: 425056 - RNA, 17 nt, Bordetella pertussis
cuggcgcagcagcgccg

SEQ ID NO: 425057 - RNA, 15 nt, Bordetella pertussis
cuggcgcagcaggcg

SEQ ID NO: 425058 - RNA, 12 nt, Bordetella pertussis
cuggcgcagcau

SEQ ID NO: 425059 - RNA, 23 nt, Bordetella pertussis
cuggcgcaguaucccggccaggc

SEQ ID NO: 425060 - RNA, 16 nt, Bordetella pertussis
cuggcguggcgcgcgc

SEQ ID NO: 425061 - RNA, 13 nt, Bordetella pertussis
cuggcguugcggu

SEQ ID NO: 425062 - RNA, 21 nt, Bordetella pertussis
cuggcguugacguggcugagc

SEQ ID NO: 425063 - RNA, 16 nt, Bordetella pertussis
cuggcuaaaaggaaau

SEQ ID NO: 425064 - RNA, 16 nt, Bordetella pertussis
cuggcucagucggccu

SEQ ID NO: 425065 - RNA, 24 nt, Bordetella pertussis
cuggcucagucggccuggcgcucc

SEQ ID NO: 425066 - RNA, 18 nt, Bordetella pertussis
cuggcucccgcugacuuc

SEQ ID NO: 425067 - RNA, 15 nt, Bordetella pertussis
cuggcugcccuggcg

SEQ ID NO: 425068 - RNA, 16 nt, Bordetella pertussis
cuggcugcccuggcgc

SEQ ID NO: 425069 - RNA, 17 nt, Bordetella pertussis
cuggcugcccuggcgcu

SEQ ID NO: 425070 - RNA, 20 nt, Bordetella pertussis
cuggcuggccagccggccca

SEQ ID NO: 425071 - RNA, 15 nt, Bordetella pertussis
cuggcugggccugcu

SEQ ID NO: 425072 - RNA, 16 nt, Bordetella pertussis
cuggcugggccugcug

SEQ ID NO: 425073 - RNA, 18 nt, Bordetella pertussis
cuggcugggccugcuguc

SEQ ID NO: 425074 - RNA, 17 nt, Bordetella pertussis
cuggcugggcgcgccgc

SEQ ID NO: 425075 - RNA, 18 nt, Bordetella pertussis
cuggcugggcgcgccgcu

SEQ ID NO: 425076 - RNA, 20 nt, Bordetella pertussis
cuggcugugcccgccccauu

SEQ ID NO: 425077 - RNA, 17 nt, Bordetella pertussis
cuggcuguucgccaugu

SEQ ID NO: 425078 - RNA, 16 nt, Bordetella pertussis
cuggcuuacaggccca

SEQ ID NO: 425079 - RNA, 18 nt, Bordetella pertussis
cuggcuucggcgcugggc

SEQ ID NO: 425080 - RNA, 15 nt, Bordetella pertussis
cuggcuucguuggug

SEQ ID NO: 425081 - RNA, 22 nt, Bordetella pertussis
cuggcuucguuggugucggcgg

SEQ ID NO: 425082 - RNA, 20 nt, Bordetella pertussis
cuggcuucccgguccaggcc

SEQ ID NO: 425083 - RNA, 22 nt, Bordetella pertussis
cuggcuugcgccacgcccgucc

SEQ ID NO: 425084 - RNA, 20 nt, Bordetella pertussis
cuggcuuucgccgcgggccu

SEQ ID NO: 425085 - RNA, 16 nt, Bordetella pertussis
cugggacaggcacacc

SEQ ID NO: 425086 - RNA, 15 nt, Bordetella pertussis
cugggacaggcacuc

SEQ ID NO: 425087 - RNA, 16 nt, Bordetella pertussis
cugggagagccggcca

SEQ ID NO: 425088 - RNA, 18 nt, Bordetella pertussis
cugggagagccggccacg

SEQ ID NO: 425089 - RNA, 16 nt, Bordetella pertussis
cugggauggguacgcc

SEQ ID NO: 425090 - RNA, 23 nt, Bordetella pertussis
cugggauggguacgccggccuga

SEQ ID NO: 425091 - RNA, 17 nt, Bordetella pertussis
cugggcaaccgccacgu

SEQ ID NO: 425092 - RNA, 19 nt, Bordetella pertussis
cugggcacauccagcgcca

SEQ ID NO: 425093 - RNA, 16 nt, Bordetella pertussis
cugggcaucaacacgc

SEQ ID NO: 425094 - RNA, 16 nt, Bordetella pertussis
cugggcaugggcggcc

SEQ ID NO: 425095 - RNA, 23 nt, Bordetella pertussis
cugggccaaccacgagcugcagc

SEQ ID NO: 425096 - RNA, 19 nt, Bordetella pertussis
cugggccagaccgcgcgca

SEQ ID NO: 425097 - RNA, 17 nt, Bordetella pertussis
cugggccagcaucggca

SEQ ID NO: 425098 - RNA, 12 nt, Bordetella pertussis
cugggccagcca

SEQ ID NO: 425099 - RNA, 13 nt, Bordetella pertussis
cugggccagccag

SEQ ID NO: 425100 - RNA, 23 nt, Bordetella pertussis
cugggccaggccggccuuggcca

SEQ ID NO: 425101 - RNA, 18 nt, Bordetella pertussis
cugggccaugccguccug

SEQ ID NO: 425102 - RNA, 23 nt, Bordetella pertussis
cugggccaugccguccugcugcg

SEQ ID NO: 425103 - RNA, 18 nt, Bordetella pertussis
cugggccgaguuggcaga

SEQ ID NO: 425104 - RNA, 15 nt, Bordetella pertussis
cugggccgccugcug

SEQ ID NO: 425105 - RNA, 14 nt, Bordetella pertussis
cugggccgggugau

SEQ ID NO: 425106 - RNA, 14 nt, Bordetella pertussis
cugggcgcggaaca

SEQ ID NO: 425107 - RNA, 14 nt, Bordetella pertussis
cugggcgcugcugc

SEQ ID NO: 425108 - RNA, 13 nt, Bordetella pertussis
cugggcgcgcgcc

SEQ ID NO: 425109 - RNA, 17 nt, Bordetella pertussis
cugggcggccuuggccg

SEQ ID NO: 425110 - RNA, 15 nt, Bordetella pertussis
cugggcggcgcgcuc

SEQ ID NO: 425111 - RNA, 21 nt, Bordetella pertussis
cugggcggcggcgaugccgcu

SEQ ID NO: 425112 - RNA, 13 nt, Bordetella pertussis
cugggcggcgggc

SEQ ID NO: 425113 - RNA, 14 nt, Bordetella pertussis
cugggcggcgggca

SEQ ID NO: 425114 - RNA, 13 nt, Bordetella pertussis
cugggcgggccgu

SEQ ID NO: 425115 - RNA, 15 nt, Bordetella pertussis
cugggcgggccguug

SEQ ID NO: 425116 - RNA, 13 nt, Bordetella pertussis
cugggcggcggcg

SEQ ID NO: 425117 - RNA, 21 nt, Bordetella pertussis
cugggcgguugcgcugcuguc

SEQ ID NO: 425118 - RNA, 20 nt, Bordetella pertussis
cugggcgucguccugcagca

SEQ ID NO: 425119 - RNA, 15 nt, Bordetella pertussis
cugggcgucccaggc

SEQ ID NO: 425120 - RNA, 23 nt, Bordetella pertussis
cugggcgucgaaggcggccggca

SEQ ID NO: 425121 - RNA, 19 nt, Bordetella pertussis
cugggggacuggcacccgc

SEQ ID NO: 425122 - RNA, 21 nt, Bordetella pertussis
cugggggucggucugcgugcg

SEQ ID NO: 425123 - RNA, 15 nt, Bordetella pertussis
cugggguaggcgcgg

SEQ ID NO: 425124 - RNA, 18 nt, Bordetella pertussis
cugggguggagcgcggcg

SEQ ID NO: 425125 - RNA, 22 nt, Bordetella pertussis
cugggguuguauugcaugaccg

SEQ ID NO: 425126 - RNA, 19 nt, Bordetella pertussis
cuggugcgccgugcccggc

SEQ ID NO: 425127 - RNA, 19 nt, Bordetella pertussis
cuggugcgcguccugggcc

SEQ ID NO: 425128 - RNA, 16 nt, Bordetella pertussis
cuggugcgcuaccgcu

SEQ ID NO: 425129 - RNA, 14 nt, Bordetella pertussis
cuggugugccuguc

SEQ ID NO: 425130 - RNA, 12 nt, Bordetella pertussis
cugguucauguc

SEQ ID NO: 425131 - RNA, 15 nt, Bordetella pertussis
cugguuggccacauc

SEQ ID NO: 425132 - RNA, 23 nt, Bordetella pertussis
cugguuguccaccacccaggccc

SEQ ID NO: 425133 - RNA, 13 nt, Bordetella pertussis
cuguagaggcgcg

SEQ ID NO: 425134 - RNA, 16 nt, Bordetella pertussis
cuguagaggcgcggcu

SEQ ID NO: 425135 - RNA, 16 nt, Bordetella pertussis
cuguagcgcagccccg

SEQ ID NO: 425136 - RNA, 18 nt, Bordetella pertussis
cuguaugccguaggcgcc

SEQ ID NO: 425137 - RNA, 15 nt, Bordetella pertussis
cuguaucuggccugu

SEQ ID NO: 425138 - RNA, 22 nt, Bordetella pertussis
cugucaugguuucgucaccgaa

SEQ ID NO: 425139 - RNA, 22 nt, Bordetella pertussis
cuguccaagcgcguggccauca

SEQ ID NO: 425140 - RNA, 12 nt, Bordetella pertussis
cuguccaggccg

SEQ ID NO: 425141 - RNA, 17 nt, Bordetella pertussis
cuguccauauauauagg

SEQ ID NO: 425142 - RNA, 22 nt, Bordetella pertussis
cuguccauauauauagggccau

SEQ ID NO: 425143 - RNA, 13 nt, Bordetella pertussis
cuguccggcgcuc

SEQ ID NO: 425144 - RNA, 21 nt, Bordetella pertussis
cuguccggcgcucgccccggc

SEQ ID NO: 425145 - RNA, 15 nt, Bordetella pertussis
cuguccggcgcuggc

SEQ ID NO: 425146 - RNA, 13 nt, Bordetella pertussis
cuguccuccccgc

SEQ ID NO: 425147 - RNA, 22 nt, Bordetella pertussis
cugucgaccggaaucaccgccg

SEQ ID NO: 425148 - RNA, 24 nt, Bordetella pertussis
cugucgagguaagugggcugcggc

SEQ ID NO: 425149 - RNA, 16 nt, Bordetella pertussis
cugugcaagcgaaagu

SEQ ID NO: 425150 - RNA, 22 nt, Bordetella pertussis
cugugcagccacgccuggccgc

SEQ ID NO: 425151 - RNA, 14 nt, Bordetella pertussis
cugugccagcuggc

SEQ ID NO: 425152 - RNA, 19 nt, Bordetella pertussis
cugugccccacacgcgcgc

SEQ ID NO: 425153 - RNA, 17 nt, Bordetella pertussis
cugugcgccggggcgcc

SEQ ID NO: 425154 - RNA, 12 nt, Bordetella pertussis
cugugcgcggcg

SEQ ID NO: 425155 - RNA, 16 nt, Bordetella pertussis
cugugcgcguuccggc

SEQ ID NO: 425156 - RNA, 16 nt, Bordetella pertussis
cugugggggcgcggcg

SEQ ID NO: 425157 - RNA, 13 nt, Bordetella pertussis
cuguucaccuuca

SEQ ID NO: 425158 - RNA, 17 nt, Bordetella pertussis
cuguucagacugcugcc

SEQ ID NO: 425159 - RNA, 21 nt, Bordetella pertussis
cuguucgccgcaccaggccgc

SEQ ID NO: 425160 - RNA, 23 nt, Bordetella pertussis
cuguucgcgcagcaggccgcgcg

SEQ ID NO: 425161 - RNA, 15 nt, Bordetella pertussis
cuucaccuugccgcu

SEQ ID NO: 425162 - RNA, 18 nt, Bordetella pertussis
cuucacgaaccgcagaag

SEQ ID NO: 425163 - RNA, 18 nt, Bordetella pertussis
cuucaucgucgaggaugc

SEQ ID NO: 425164 - RNA, 12 nt, Bordetella pertussis
cuuccagcagca

SEQ ID NO: 425165 - RNA, 13 nt, Bordetella pertussis
cuuccagcagcau

SEQ ID NO: 425166 - RNA, 12 nt, Bordetella pertussis
cuuccagcgccc

SEQ ID NO: 425167 - RNA, 18 nt, Bordetella pertussis
cuuccaggaguucccagc

SEQ ID NO: 425168 - RNA, 20 nt, Bordetella pertussis
cuuccccgaaacucaccgcc

SEQ ID NO: 425169 - RNA, 21 nt, Bordetella pertussis
cuuccccgaaacucaccgccg

SEQ ID NO: 425170 - RNA, 18 nt, Bordetella pertussis
cuuccccgcgugccuguc

SEQ ID NO: 425171 - RNA, 15 nt, Bordetella pertussis
cuuccccgucggcgg

SEQ ID NO: 425172 - RNA, 12 nt, Bordetella pertussis
cuuccugcugcg

SEQ ID NO: 425173 - RNA, 14 nt, Bordetella pertussis
cuuccugcugcgcc

SEQ ID NO: 425174 - RNA, 16 nt, Bordetella pertussis
cuuccuggccaaugcc

SEQ ID NO: 425175 - RNA, 23 nt, Bordetella pertussis
cuuccugggccugcggcgucagg

SEQ ID NO: 425176 - RNA, 16 nt, Bordetella pertussis
cuuccuugcgaugcca

SEQ ID NO: 425177 - RNA, 21 nt, Bordetella pertussis
cuuccuuuauugaaaugaagg

SEQ ID NO: 425178 - RNA, 12 nt, Bordetella pertussis
cuucgagcacca

SEQ ID NO: 425179 - RNA, 17 nt, Bordetella pertussis
cuucgagcgcggcgcgc

SEQ ID NO: 425180 - RNA, 19 nt, Bordetella pertussis
cuucgaggaaagcggccug

SEQ ID NO: 425181 - RNA, 21 nt, Bordetella pertussis
cuucggcaggcgccggcuggc

SEQ ID NO: 425182 - RNA, 18 nt, Bordetella pertussis
cuucggcauguaggccuc

SEQ ID NO: 425183 - RNA, 12 nt, Bordetella pertussis
cuucggcagcuu

SEQ ID NO: 425184 - RNA, 13 nt, Bordetella pertussis
cuucggccgccag

SEQ ID NO: 425185 - RNA, 17 nt, Bordetella pertussis
cuucggccgccagccgg

SEQ ID NO: 425186 - RNA, 13 nt, Bordetella pertussis
cuucggccggcug

SEQ ID NO: 425187 - RNA, 13 nt, Bordetella pertussis
cuucggccgucag

SEQ ID NO: 425188 - RNA, 14 nt, Bordetella pertussis
cuucggccgucagc

SEQ ID NO: 425189 - RNA, 20 nt, Bordetella pertussis
cuucggcgacuucggcggcc

SEQ ID NO: 425190 - RNA, 18 nt, Bordetella pertussis
cuucggcgcgcacgcucu

SEQ ID NO: 425191 - RNA, 15 nt, Bordetella pertussis
cuucggcgcgcgccg

SEQ ID NO: 425192 - RNA, 23 nt, Bordetella pertussis
cuucggcgcggcgggcgcuggcg

SEQ ID NO: 425193 - RNA, 23 nt, Bordetella pertussis
cuucggcgcggcgggcucagccc

SEQ ID NO: 425194 - RNA, 19 nt, Bordetella pertussis
cuucggcggccagccggcg

SEQ ID NO: 425195 - RNA, 23 nt, Bordetella pertussis
cuucggcggccagccggcgcgcc

SEQ ID NO: 425196 - RNA, 16 nt, Bordetella pertussis
cuucggcggccaugcc

SEQ ID NO: 425197 - RNA, 23 nt, Bordetella pertussis
cuucggcggccgcgucgaucagc

SEQ ID NO: 425198 - RNA, 13 nt, Bordetella pertussis
cuucggcggccug

SEQ ID NO: 425199 - RNA, 18 nt, Bordetella pertussis
cuucggcggccugcuugg

SEQ ID NO: 425200 - RNA, 22 nt, Bordetella pertussis
cuucggcggccugcuuggcagc

SEQ ID NO: 425201 - RNA, 15 nt, Bordetella pertussis
cuucggcggcgcgcu

SEQ ID NO: 425202 - RNA, 21 nt, Bordetella pertussis
cuucggcguaaggcugcagcu

SEQ ID NO: 425203 - RNA, 21 nt, Bordetella pertussis
cuucggguugcaaauucugca

SEQ ID NO: 425204 - RNA, 21 nt, Bordetella pertussis
cuucgguggcccgccauugca

SEQ ID NO: 425205 - RNA, 15 nt, Bordetella pertussis
cuucguacagccugc

SEQ ID NO: 425206 - RNA, 18 nt, Bordetella pertussis
cuucguacagccugcccu

SEQ ID NO: 425207 - RNA, 12 nt, Bordetella pertussis
cuucguccugcc

SEQ ID NO: 425208 - RNA, 14 nt, Bordetella pertussis
cuucgucgccggcg

SEQ ID NO: 425209 - RNA, 21 nt, Bordetella pertussis
cuucgucgaccagcauccuca

SEQ ID NO: 425210 - RNA, 17 nt, Bordetella pertussis
cuucgucgggcagcgcg

SEQ ID NO: 425211 - RNA, 14 nt, Bordetella pertussis
cuucgugcagcgcg

SEQ ID NO: 425212 - RNA, 21 nt, Bordetella pertussis
cuucgugcagcgcgugggcca

SEQ ID NO: 425213 - RNA, 16 nt, Bordetella pertussis
cuucgugcggccgcag

SEQ ID NO: 425214 - RNA, 14 nt, Bordetella pertussis
cuucguggcgcagc

SEQ ID NO: 425215 - RNA, 15 nt, Bordetella pertussis
cuucguucagcuucu

SEQ ID NO: 425216 - RNA, 16 nt, Bordetella pertussis
cuucguugaccgcuuc

SEQ ID NO: 425217 - RNA, 19 nt, Bordetella pertussis
cuucuacccgcucaccuuu

SEQ ID NO: 425218 - RNA, 20 nt, Bordetella pertussis
cuucucacugcccgcgccgu

SEQ ID NO: 425219 - RNA, 19 nt, Bordetella pertussis
cuugaacgccuugcccggg

SEQ ID NO: 425220 - RNA, 16 nt, Bordetella pertussis
cuugaacggcgcggcc

SEQ ID NO: 425221 - RNA, 16 nt, Bordetella pertussis
cuugaacucggccagc

SEQ ID NO: 425222 - RNA, 15 nt, Bordetella pertussis
cuugaagacgcccag

SEQ ID NO: 425223 - RNA, 17 nt, Bordetella pertussis
cuugaagacgcccaggu

SEQ ID NO: 425224 - RNA, 18 nt, Bordetella pertussis
cuugaccacggccagcag

SEQ ID NO: 425225 - RNA, 13 nt, Bordetella pertussis
cuugaccagcagg

SEQ ID NO: 425226 - RNA, 16 nt, Bordetella pertussis
cuugaccagcaggccg

SEQ ID NO: 425227 - RNA, 13 nt, Bordetella pertussis
cuugaccagcuug

SEQ ID NO: 425228 - RNA, 15 nt, Bordetella pertussis
cuugaccgcaugcug

SEQ ID NO: 425229 - RNA, 21 nt, Bordetella pertussis
cuugaccgccagcauccagcc

SEQ ID NO: 425230 - RNA, 21 nt, Bordetella pertussis
cuugaccgccuccaggaugag

SEQ ID NO: 425231 - RNA, 18 nt, Bordetella pertussis
cuugaccugggccagcag

SEQ ID NO: 425232 - RNA, 18 nt, Bordetella pertussis
cuugaccuggucggccuu

SEQ ID NO: 425233 - RNA, 14 nt, Bordetella pertussis
cuugacggccaaga

SEQ ID NO: 425234 - RNA, 17 nt, Bordetella pertussis
cuugagcaccacguccu

SEQ ID NO: 425235 - RNA, 15 nt, Bordetella pertussis
cuugagcacguccag

SEQ ID NO: 425236 - RNA, 19 nt, Bordetella pertussis
cuugaucagcggcggcacg

SEQ ID NO: 425237 - RNA, 15 nt, Bordetella pertussis
cuugaucagggccac

SEQ ID NO: 425238 - RNA, 12 nt, Bordetella pertussis
cuugauccagga

SEQ ID NO: 425239 - RNA, 15 nt, Bordetella pertussis
cuugccacuauuuuc

SEQ ID NO: 425240 - RNA, 21 nt, Bordetella pertussis
cuugcccacgcgcuccugcuc

SEQ ID NO: 425241 - RNA, 19 nt, Bordetella pertussis
cuugcccaggccggcgcgc

SEQ ID NO: 425242 - RNA, 15 nt, Bordetella pertussis
cuugcccgggcuggc

SEQ ID NO: 425243 - RNA, 19 nt, Bordetella pertussis
cuugcccgggcuggccgcc

SEQ ID NO: 425244 - RNA, 22 nt, Bordetella pertussis
cuugcccgugcgugugccuguc

SEQ ID NO: 425245 - RNA, 15 nt, Bordetella pertussis
cuugccgaccuccag

SEQ ID NO: 425246 - RNA, 17 nt, Bordetella pertussis
cuugccgauccagcgcc

SEQ ID NO: 425247 - RNA, 16 nt, Bordetella pertussis
cuugccgcagcgggga

SEQ ID NO: 425248 - RNA, 23 nt, Bordetella pertussis
cuugccgcaggagucgcuccccg

SEQ ID NO: 425249 - RNA, 22 nt, Bordetella pertussis
cuugccgccgccgcgcgcggca

SEQ ID NO: 425250 - RNA, 16 nt, Bordetella pertussis
cuugccuugcgcggcc

SEQ ID NO: 425251 - RNA, 19 nt, Bordetella pertussis
cuugcgaggcccggccugc

SEQ ID NO: 425252 - RNA, 20 nt, Bordetella pertussis
cuugcgcaaguucaucaucg

SEQ ID NO: 425253 - RNA, 23 nt, Bordetella pertussis
cuugcgcaaguucaucaucgccg

SEQ ID NO: 425254 - RNA, 16 nt, Bordetella pertussis
cuugcgcagggcgggc

SEQ ID NO: 425255 - RNA, 13 nt, Bordetella pertussis
cuugcugcccccc

SEQ ID NO: 425256 - RNA, 20 nt, Bordetella pertussis
cuugcuggaccgcgccuggg

SEQ ID NO: 425257 - RNA, 21 nt, Bordetella pertussis
cuuggaguucuucuuggccag

SEQ ID NO: 425258 - RNA, 14 nt, Bordetella pertussis
cuuggcagccuugg

SEQ ID NO: 425259 - RNA, 19 nt, Bordetella pertussis
cuuggcagccuuggucagc

SEQ ID NO: 425260 - RNA, 22 nt, Bordetella pertussis
cuuggcaggcgucuugccggag

SEQ ID NO: 425261 - RNA, 18 nt, Bordetella pertussis
cuuggccaccacgcccau

SEQ ID NO: 425262 - RNA, 16 nt, Bordetella pertussis
cuuggcgauggccgcc

SEQ ID NO: 425263 - RNA, 15 nt, Bordetella pertussis
cuuggcgcgcagcag

SEQ ID NO: 425264 - RNA, 14 nt, Bordetella pertussis
cuuggcgcgccgga

SEQ ID NO: 425265 - RNA, 14 nt, Bordetella pertussis
cuuggcggccuugc

SEQ ID NO: 425266 - RNA, 21 nt, Bordetella pertussis
cuuggcggccuugcgggccgg

SEQ ID NO: 425267 - RNA, 22 nt, Bordetella pertussis
cuuggcggccuugcgggccggc

SEQ ID NO: 425268 - RNA, 17 nt, Bordetella pertussis
cuuggcgugcaggcugg

SEQ ID NO: 425269 - RNA, 18 nt, Bordetella pertussis
cuugggcaucaggggcuc

SEQ ID NO: 425270 - RNA, 13 nt, Bordetella pertussis
cuugggccgcgcc

SEQ ID NO: 425271 - RNA, 16 nt, Bordetella pertussis
cuugggcgcggcggcc

SEQ ID NO: 425272 - RNA, 19 nt, Bordetella pertussis
cuugggcgcggcggccugg

SEQ ID NO: 425273 - RNA, 20 nt, Bordetella pertussis
cuuggggcggcccagcggca

SEQ ID NO: 425274 - RNA, 15 nt, Bordetella pertussis
cuuggggcggcccgg

SEQ ID NO: 425275 - RNA, 18 nt, Bordetella pertussis
cuuggggucccacugcca

SEQ ID NO: 425276 - RNA, 21 nt, Bordetella pertussis
cuuggucagcaucagcagacc

SEQ ID NO: 425277 - RNA, 22 nt, Bordetella pertussis
cuuggucagcaucagcagaccc

SEQ ID NO: 425278 - RNA, 20 nt, Bordetella pertussis
cuuguaggcgauccaggcca

SEQ ID NO: 425279 - RNA, 16 nt, Bordetella pertussis
cuuguccuucagcacg

SEQ ID NO: 425280 - RNA, 20 nt, Bordetella pertussis
cuugucgaucgccaccagcg

SEQ ID NO: 425281 - RNA, 16 nt, Bordetella pertussis
cuugucgaugacgcgc

SEQ ID NO: 425282 - RNA, 17 nt, Bordetella pertussis
cuugucgcgcagcgccg

SEQ ID NO: 425283 - RNA, 15 nt, Bordetella pertussis
cuugucggccgcgcg

SEQ ID NO: 425284 - RNA, 15 nt, Bordetella pertussis
cuuuauugaaaugaa

SEQ ID NO: 425285 - RNA, 22 nt, Bordetella pertussis
cuuuccagcgcgaaaugcccag

SEQ ID NO: 425286 - RNA, 23 nt, Bordetella pertussis
cuuuccagcgcgaaaugcccagc

SEQ ID NO: 425287 - RNA, 20 nt, Bordetella pertussis
cuuugccugcgaugccggcg

SEQ ID NO: 425288 - RNA, 15 nt, Bordetella pertussis
cuuugcgggcgcgcu

SEQ ID NO: 425289 - RNA, 23 nt, Bordetella pertussis
cuuugcuggccauagggcgacug

SEQ ID NO: 425290 - RNA, 22 nt, Bordetella pertussis
cuuuggacaggcgugcgcagcu

SEQ ID NO: 425291 - RNA, 17 nt, Bordetella pertussis
gacaaauagccgaccgc

SEQ ID NO: 425292 - RNA, 15 nt, Bordetella pertussis
gacaacaagccgggc

SEQ ID NO: 425293 - RNA, 20 nt, Bordetella pertussis
gacaccgucaggaagcccga

SEQ ID NO: 425294 - RNA, 19 nt, Bordetella pertussis
gacaccguuuuggcaggcu

SEQ ID NO: 425295 - RNA, 20 nt, Bordetella pertussis
gacaccuacauccuggaugu

SEQ ID NO: 425296 - RNA, 19 nt, Bordetella pertussis
gacaccuggacccgcucga

SEQ ID NO: 425297 - RNA, 15 nt, Bordetella pertussis
gacacgcccagcagg

SEQ ID NO: 425298 - RNA, 16 nt, Bordetella pertussis
gacacgcccagcaggc

SEQ ID NO: 425299 - RNA, 12 nt, Bordetella pertussis
gacacgcccugg

SEQ ID NO: 425300 - RNA, 17 nt, Bordetella pertussis
gacacgcuagggcgugg

SEQ ID NO: 425301 - RNA, 18 nt, Bordetella pertussis
gacagaccguagcgcagg

SEQ ID NO: 425302 - RNA, 22 nt, Bordetella pertussis
gacagaccguagcgcaggcgcu

SEQ ID NO: 425303 - RNA, 16 nt, Bordetella pertussis
gacagauagaacgagg

SEQ ID NO: 425304 - RNA, 11 nt, Bordetella pertussis
gacagaugccg

SEQ ID NO: 425305 - RNA, 16 nt, Bordetella pertussis
gacagcaagggcagau

SEQ ID NO: 425306 - RNA, 15 nt, Bordetella pertussis
gacagcaagggcguc

SEQ ID NO: 425307 - RNA, 22 nt, Bordetella pertussis
gacagcacauggcgcgccggcc

SEQ ID NO: 425308 - RNA, 17 nt, Bordetella pertussis
gacagcaccgacaggcc

SEQ ID NO: 425309 - RNA, 17 nt, Bordetella pertussis
gacagcagcccgcuggc

SEQ ID NO: 425310 - RNA, 19 nt, Bordetella pertussis
gacagcagcccgcuggccg

SEQ ID NO: 425311 - RNA, 15 nt, Bordetella pertussis
gacagcagggccagg

SEQ ID NO: 425312 - RNA, 17 nt, Bordetella pertussis
gacagcagggccaggcc

SEQ ID NO: 425313 - RNA, 22 nt, Bordetella pertussis
gacagcaguucggccggcggcc

SEQ ID NO: 425314 - RNA, 15 nt, Bordetella pertussis
gacagccaggccagc

SEQ ID NO: 425315 - RNA, 18 nt, Bordetella pertussis
gacagccaggccagcgcc

SEQ ID NO: 425316 - RNA, 15 nt, Bordetella pertussis
gacagccccagcagc

SEQ ID NO: 425317 - RNA, 20 nt, Bordetella pertussis
gacagccgcgccagcgccuc

SEQ ID NO: 425318 - RNA, 17 nt, Bordetella pertussis
gacagccuuuccuccug

SEQ ID NO: 425319 - RNA, 18 nt, Bordetella pertussis
gacagcgacagccaggcc

SEQ ID NO: 425320 - RNA, 20 nt, Bordetella pertussis
gacagcgcgcaggaucagcu

SEQ ID NO: 425321 - RNA, 15 nt, Bordetella pertussis
gacagcggcgagcgc

SEQ ID NO: 425322 - RNA, 15 nt, Bordetella pertussis
gacagcgucgagcug

SEQ ID NO: 425323 - RNA, 16 nt, Bordetella pertussis
gacagcucggggaaau

SEQ ID NO: 425324 - RNA, 22 nt, Bordetella pertussis
gacagcuugaugggcgaggcga

SEQ ID NO: 425325 - RNA, 16 nt, Bordetella pertussis
gacagcuugcgcuggc

SEQ ID NO: 425326 - RNA, 18 nt, Bordetella pertussis
gacaggaacagcacgugg

SEQ ID NO: 425327 - RNA, 19 nt, Bordetella pertussis
gacaggaacuccggcggcg

SEQ ID NO: 425328 - RNA, 20 nt, Bordetella pertussis
gacaggaacuccggcggcgc

SEQ ID NO: 425329 - RNA, 12 nt, Bordetella pertussis
gacaggaugaag

SEQ ID NO: 425330 - RNA, 19 nt, Bordetella pertussis
gacaggaugaagaccacgu

SEQ ID NO: 425331 - RNA, 16 nt, Bordetella pertussis
gacaggcacacucugu

SEQ ID NO: 425332 - RNA, 23 nt, Bordetella pertussis
gacaggcacccccgaccgagcca

SEQ ID NO: 425333 - RNA, 22 nt, Bordetella pertussis
gacaggcaccccggcgccgcgu

SEQ ID NO: 425334 - RNA, 14 nt, Bordetella pertussis
gacaggcaccccgu

SEQ ID NO: 425335 - RNA, 18 nt, Bordetella pertussis
gacaggcaccccucccug

SEQ ID NO: 425336 - RNA, 15 nt, Bordetella pertussis
gacaggcacccgcgc

SEQ ID NO: 425337 - RNA, 14 nt, Bordetella pertussis
gacaggcacccugu

SEQ ID NO: 425338 - RNA, 20 nt, Bordetella pertussis
gacaggcaccgaacccugcc

SEQ ID NO: 425339 - RNA, 23 nt, Bordetella pertussis
gacaggcaccugcgaccgagcca

SEQ ID NO: 425340 - RNA, 19 nt, Bordetella pertussis
gacaggcaccugcgguguc

SEQ ID NO: 425341 - RNA, 18 nt, Bordetella pertussis
gacaggcacgcgccgacu

SEQ ID NO: 425342 - RNA, 23 nt, Bordetella pertussis
gacaggcacucuugccgcugcgc

SEQ ID NO: 425343 - RNA, 18 nt, Bordetella pertussis
gacaggccagugccugga

SEQ ID NO: 425344 - RNA, 18 nt, Bordetella pertussis
gacaggcccucggugcgg

SEQ ID NO: 425345 - RNA, 19 nt, Bordetella pertussis
gacaggcgccgcaacaggc

SEQ ID NO: 425346 - RNA, 23 nt, Bordetella pertussis
gacaggcgccgcaacaggcagcu

SEQ ID NO: 425347 - RNA, 14 nt, Bordetella pertussis
gacaggcgccucgc

SEQ ID NO: 425348 - RNA, 13 nt, Bordetella pertussis
gacaggcgcgcag

SEQ ID NO: 425349 - RNA, 14 nt, Bordetella pertussis
gacaggcgcgcagg

SEQ ID NO: 425350 - RNA, 15 nt, Bordetella pertussis
gacaggcgcgcaggc

SEQ ID NO: 425351 - RNA, 16 nt, Bordetella pertussis
gacaggcgcgccaucc

SEQ ID NO: 425352 - RNA, 15 nt, Bordetella pertussis
gacaggcgugcgcag

SEQ ID NO: 425353 - RNA, 17 nt, Bordetella pertussis
gacaggcgugcgcagcu

SEQ ID NO: 425354 - RNA, 20 nt, Bordetella pertussis
gacaggcggugcgcgcggcc

SEQ ID NO: 425355 - RNA, 19 nt, Bordetella pertussis
gacaggcuccgagggacac

SEQ ID NO: 425356 - RNA, 21 nt, Bordetella pertussis
gacaggguccagguggcccgc

SEQ ID NO: 425357 - RNA, 18 nt, Bordetella pertussis
gacaggucggcgcccacg

SEQ ID NO: 425358 - RNA, 12 nt, Bordetella pertussis
gacauaggagag

SEQ ID NO: 425359 - RNA, 20 nt, Bordetella pertussis
gacaucggggucgaucgcau

SEQ ID NO: 425360 - RNA, 23 nt, Bordetella pertussis
gacaugacgauggucuugccgcc

SEQ ID NO: 425361 - RNA, 19 nt, Bordetella pertussis
gacaugcucgaugccggcc

SEQ ID NO: 425362 - RNA, 15 nt, Bordetella pertussis
gacaugcuggcccag

SEQ ID NO: 425363 - RNA, 20 nt, Bordetella pertussis
gacauggccacggcccuggu

SEQ ID NO: 425364 - RNA, 14 nt, Bordetella pertussis
gacauugcccagca

SEQ ID NO: 425365 - RNA, 21 nt, Bordetella pertussis
gaccacacgaucgucagcagc

SEQ ID NO: 425366 - RNA, 13 nt, Bordetella pertussis
gaccaccagcacc

SEQ ID NO: 425367 - RNA, 14 nt, Bordetella pertussis
gaccaccagcacca

SEQ ID NO: 425368 - RNA, 17 nt, Bordetella pertussis
gaccaccagcaccaugc

SEQ ID NO: 425369 - RNA, 18 nt, Bordetella pertussis
gaccaccagcaccaugcc

SEQ ID NO: 425370 - RNA, 14 nt, Bordetella pertussis
gaccaccagcaccg

SEQ ID NO: 425371 - RNA, 13 nt, Bordetella pertussis
gaccaccagcagg

SEQ ID NO: 425372 - RNA, 14 nt, Bordetella pertussis
gaccaccagcagga

SEQ ID NO: 425373 - RNA, 14 nt, Bordetella pertussis
gaccaccagcaucg

SEQ ID NO: 425374 - RNA, 17 nt, Bordetella pertussis
gaccaccaggccgccua

SEQ ID NO: 425375 - RNA, 17 nt, Bordetella pertussis
gaccacccgcgccagga

SEQ ID NO: 425376 - RNA, 22 nt, Bordetella pertussis
gaccaccggcuugggcgugccc

SEQ ID NO: 425377 - RNA, 19 nt, Bordetella pertussis
gaccacgaccuuggcggcc

SEQ ID NO: 425378 - RNA, 23 nt, Bordetella pertussis
gaccacgaccuuggcggccgaca

SEQ ID NO: 425379 - RNA, 21 nt, Bordetella pertussis
gaccacgcccuggaucagggu

SEQ ID NO: 425380 - RNA, 16 nt, Bordetella pertussis
gaccacgccggcggcc

SEQ ID NO: 425381 - RNA, 18 nt, Bordetella pertussis
gaccacgccggcggccau

SEQ ID NO: 425382 - RNA, 19 nt, Bordetella pertussis
gaccacgcguccccgcaga

SEQ ID NO: 425383 - RNA, 20 nt, Bordetella pertussis
gaccacgcugggccagaccg

SEQ ID NO: 425384 - RNA, 13 nt, Bordetella pertussis
gaccacggccagc

SEQ ID NO: 425385 - RNA, 14 nt, Bordetella pertussis
gaccacggccagca

SEQ ID NO: 425386 - RNA, 16 nt, Bordetella pertussis
gaccagcaccagcgcc

SEQ ID NO: 425387 - RNA, 20 nt, Bordetella pertussis
gaccagcacgagauguccau

SEQ ID NO: 425388 - RNA, 18 nt, Bordetella pertussis
gaccagcacgauccagcc

SEQ ID NO: 425389 - RNA, 20 nt, Bordetella pertussis
gaccagcacgauccagccgu

SEQ ID NO: 425390 - RNA, 18 nt, Bordetella pertussis
gaccagcacgauggucag

SEQ ID NO: 425391 - RNA, 14 nt, Bordetella pertussis
gaccagcagcacgu

SEQ ID NO: 425392 - RNA, 14 nt, Bordetella pertussis
gaccagcagcgccg

SEQ ID NO: 425393 - RNA, 15 nt, Bordetella pertussis
gaccagcagcucggc

SEQ ID NO: 425394 - RNA, 16 nt, Bordetella pertussis
gaccagcagcucggcg

SEQ ID NO: 425395 - RNA, 13 nt, Bordetella pertussis
gaccagcaggccc

SEQ ID NO: 425396 - RNA, 22 nt, Bordetella pertussis
gaccagcaguugcgccaguucg

SEQ ID NO: 425397 - RNA, 10 nt, Bordetella pertussis
gaccagcagg

SEQ ID NO: 425398 - RNA, 15 nt, Bordetella pertussis
gaccagccagccgcc

SEQ ID NO: 425399 - RNA, 17 nt, Bordetella pertussis
gaccagccagccgccgc

SEQ ID NO: 425400 - RNA, 17 nt, Bordetella pertussis
gaccagcgaguugaagg

SEQ ID NO: 425401 - RNA, 14 nt, Bordetella pertussis
gaccagcgcgcggu

SEQ ID NO: 425402 - RNA, 16 nt, Bordetella pertussis
gaccagcggaucgccg

SEQ ID NO: 425403 - RNA, 20 nt, Bordetella pertussis
gaccagcgguugcgccagcu

SEQ ID NO: 425404 - RNA, 17 nt, Bordetella pertussis
gaccagcuucugcgccu

SEQ ID NO: 425405 - RNA, 20 nt, Bordetella pertussis
gaccaggaccuguacuggcu

SEQ ID NO: 425406 - RNA, 18 nt, Bordetella pertussis
gaccaggaugaugcagca

SEQ ID NO: 425407 - RNA, 19 nt, Bordetella pertussis
gaccaggaugaugcagcac

SEQ ID NO: 425408 - RNA, 22 nt, Bordetella pertussis
gaccaggaugugacggaccuug

SEQ ID NO: 425409 - RNA, 15 nt, Bordetella pertussis
gaccaggccggcggc

SEQ ID NO: 425410 - RNA, 17 nt, Bordetella pertussis
gaccaggccggcggcgg

SEQ ID NO: 425411 - RNA, 18 nt, Bordetella pertussis
gaccaggccggcggcggg

SEQ ID NO: 425412 - RNA, 19 nt, Bordetella pertussis
gaccaggccguggcccagc

SEQ ID NO: 425413 - RNA, 18 nt, Bordetella pertussis
gaccaggcgggcaucgcc

SEQ ID NO: 425414 - RNA, 14 nt, Bordetella pertussis
gaccaggcugcgcg

SEQ ID NO: 425415 - RNA, 17 nt, Bordetella pertussis
gaccaggcugcgcgccg

SEQ ID NO: 425416 - RNA, 12 nt, Bordetella pertussis
gaccaggcugga

SEQ ID NO: 425417 - RNA, 12 nt, Bordetella pertussis
gaccagggcgcc

SEQ ID NO: 425418 - RNA, 17 nt, Bordetella pertussis
gaccagggcgccgaccg

SEQ ID NO: 425419 - RNA, 19 nt, Bordetella pertussis
gaccagggcggugggcagc

SEQ ID NO: 425420 - RNA, 23 nt, Bordetella pertussis
gaccagggcggugggcagcgcgu

SEQ ID NO: 425421 - RNA, 19 nt, Bordetella pertussis
gaccagguaucgacccagg

SEQ ID NO: 425422 - RNA, 14 nt, Bordetella pertussis
gaccaggucgccgu

SEQ ID NO: 425423 - RNA, 22 nt, Bordetella pertussis
gaccaucaucaacuucaucguc

SEQ ID NO: 425424 - RNA, 14 nt, Bordetella pertussis
gaccaugccggccu

SEQ ID NO: 425425 - RNA, 14 nt, Bordetella pertussis
gaccaugcggccgu

SEQ ID NO: 425426 - RNA, 20 nt, Bordetella pertussis
gaccaugcggccgucgccgc

SEQ ID NO: 425427 - RNA, 15 nt, Bordetella pertussis
gacccagaacccggc

SEQ ID NO: 425428 - RNA, 22 nt, Bordetella pertussis
gacccagaacccggccggcgcc

SEQ ID NO: 425429 - RNA, 19 nt, Bordetella pertussis
gacccacuugagcagcgcc

SEQ ID NO: 425430 - RNA, 22 nt, Bordetella pertussis
gacccagcaccgagcugccgcc

SEQ ID NO: 425431 - RNA, 21 nt, Bordetella pertussis
gacccaguucggccgccaggu

SEQ ID NO: 425432 - RNA, 15 nt, Bordetella pertussis
gacccauaccagccc

SEQ ID NO: 425433 - RNA, 19 nt, Bordetella pertussis
gaccccuugcggccgccga

SEQ ID NO: 425434 - RNA, 18 nt, Bordetella pertussis
gacccgagcccuggcuug

SEQ ID NO: 425435 - RNA, 16 nt, Bordetella pertussis
gacccgauagccgcgc

SEQ ID NO: 425436 - RNA, 17 nt, Bordetella pertussis
gacccgcgccgcaggcc

SEQ ID NO: 425437 - RNA, 21 nt, Bordetella pertussis
gacccggaugccaccucgcuu

SEQ ID NO: 425438 - RNA, 17 nt, Bordetella pertussis
gacccgggccgcuggcc

SEQ ID NO: 425439 - RNA, 13 nt, Bordetella pertussis
gacccguggcccg

SEQ ID NO: 425440 - RNA, 14 nt, Bordetella pertussis
gacccugcccggca

SEQ ID NO: 425441 - RNA, 22 nt, Bordetella pertussis
gacccuguacaagcgcacgcug

SEQ ID NO: 425442 - RNA, 16 nt, Bordetella pertussis
gaccgaacaccaccga

SEQ ID NO: 425443 - RNA, 20 nt, Bordetella pertussis
gaccgaaccgauccagcccg

SEQ ID NO: 425444 - RNA, 16 nt, Bordetella pertussis
gaccgaagcgcgggcg

SEQ ID NO: 425445 - RNA, 12 nt, Bordetella pertussis
gaccgagccaca

SEQ ID NO: 425446 - RNA, 15 nt, Bordetella pertussis
gaccgagccggccag

SEQ ID NO: 425447 - RNA, 19 nt, Bordetella pertussis
gaccgagggcgcguccaag

SEQ ID NO: 425448 - RNA, 13 nt, Bordetella pertussis
gaccgcaugcugc

SEQ ID NO: 425449 - RNA, 13 nt, Bordetella pertussis
gaccgccagcagg

SEQ ID NO: 425450 - RNA, 12 nt, Bordetella pertussis
gaccgccagcau

SEQ ID NO: 425451 - RNA, 23 nt, Bordetella pertussis
gaccgccaugcgcauggccagcg

SEQ ID NO: 425452 - RNA, 14 nt, Bordetella pertussis
gaccgccgccuugg

SEQ ID NO: 425453 - RNA, 18 nt, Bordetella pertussis
gaccgccgcgccgguggc

SEQ ID NO: 425454 - RNA, 23 nt, Bordetella pertussis
gaccgccgcgccgguggccagca

SEQ ID NO: 425455 - RNA, 17 nt, Bordetella pertussis
gaccgccgggacaggca

SEQ ID NO: 425456 - RNA, 19 nt, Bordetella pertussis
gaccgccgggacaggcacc

SEQ ID NO: 425457 - RNA, 16 nt, Bordetella pertussis
gaccgccuccagcgcg

SEQ ID NO: 425458 - RNA, 20 nt, Bordetella pertussis
gaccgccucgacgcccgggc

SEQ ID NO: 425459 - RNA, 13 nt, Bordetella pertussis
gaccgcgaagccg

SEQ ID NO: 425460 - RNA, 14 nt, Bordetella pertussis
gaccgcgaugcugc

SEQ ID NO: 425461 - RNA, 19 nt, Bordetella pertussis
gaccgcgccugggggcugg

SEQ ID NO: 425462 - RNA, 22 nt, Bordetella pertussis
gaccgcgccugggggcuggagg

SEQ ID NO: 425463 - RNA, 14 nt, Bordetella pertussis
gaccgcggacgcca

SEQ ID NO: 425464 - RNA, 20 nt, Bordetella pertussis
gaccgcggacgccauggcgg

SEQ ID NO: 425465 - RNA, 21 nt, Bordetella pertussis
gaccgcggacgccauggcggc

SEQ ID NO: 425466 - RNA, 14 nt, Bordetella pertussis
gaccgcggccgcgc

SEQ ID NO: 425467 - RNA, 19 nt, Bordetella pertussis
gaccgcgcggcgcugcacg

SEQ ID NO: 425468 - RNA, 20 nt, Bordetella pertussis
gaccgcgcgguggccgccgc

SEQ ID NO: 425469 - RNA, 17 nt, Bordetella pertussis
gaccgcuucggucagcu

SEQ ID NO: 425470 - RNA, 18 nt, Bordetella pertussis
gaccggaauagauauggg

SEQ ID NO: 425471 - RNA, 22 nt, Bordetella pertussis
gaccggcaagcgcucgccggcg

SEQ ID NO: 425472 - RNA, 14 nt, Bordetella pertussis
gaccggcaccuggg

SEQ ID NO: 425473 - RNA, 15 nt, Bordetella pertussis
gaccggcaccugggc

SEQ ID NO: 425474 - RNA, 20 nt, Bordetella pertussis
gaccggccccaccuggcggu

SEQ ID NO: 425475 - RNA, 13 nt, Bordetella pertussis
gaccggcgcggcc

SEQ ID NO: 425476 - RNA, 15 nt, Bordetella pertussis
gaccggcgaagagcc

SEQ ID NO: 425477 - RNA, 15 nt, Bordetella pertussis
gaccggcgccggcuc

SEQ ID NO: 425478 - RNA, 17 nt, Bordetella pertussis
gaccggcguguccagcg

SEQ ID NO: 425479 - RNA, 14 nt, Bordetella pertussis
gaccggcuggcgca

SEQ ID NO: 425480 - RNA, 15 nt, Bordetella pertussis
gaccggcuggcgcac

SEQ ID NO: 425481 - RNA, 19 nt, Bordetella pertussis
gaccggguugcccggcagg

SEQ ID NO: 425482 - RNA, 14 nt, Bordetella pertussis
gaccgugccgccga

SEQ ID NO: 425483 - RNA, 17 nt, Bordetella pertussis
gaccuccaggcccaggc

SEQ ID NO: 425484 - RNA, 18 nt, Bordetella pertussis
gaccuccugguccgugaa

SEQ ID NO: 425485 - RNA, 22 nt, Bordetella pertussis
gaccuccugguccgugaagccg

SEQ ID NO: 425486 - RNA, 15 nt, Bordetella pertussis
gaccucgcccaggcc

SEQ ID NO: 425487 - RNA, 17 nt, Bordetella pertussis
gaccucgcgcugcagca

SEQ ID NO: 425488 - RNA, 14 nt, Bordetella pertussis
gaccucggcggcgu

SEQ ID NO: 425489 - RNA, 23 nt, Bordetella pertussis
gaccugaucgcgcagcgccuggc

SEQ ID NO: 425490 - RNA, 17 nt, Bordetella pertussis
gaccugcacgauggcgc

SEQ ID NO: 425491 - RNA, 22 nt, Bordetella pertussis
gaccugccgcccgagcuggccg

SEQ ID NO: 425492 - RNA, 21 nt, Bordetella pertussis
gaccugcccgagaccgcccgc

SEQ ID NO: 425493 - RNA, 14 nt, Bordetella pertussis
gaccugcgacagca

SEQ ID NO: 425494 - RNA, 15 nt, Bordetella pertussis
gaccugcgcaccggc

SEQ ID NO: 425495 - RNA, 15 nt, Bordetella pertussis
gaccugcgcgccggc

SEQ ID NO: 425496 - RNA, 23 nt, Bordetella pertussis
gaccugcgcgccggcauggucga

SEQ ID NO: 425497 - RNA, 15 nt, Bordetella pertussis
gaccugcgggccgca

SEQ ID NO: 425498 - RNA, 19 nt, Bordetella pertussis
gaccugcgggccgcacagc

SEQ ID NO: 425499 - RNA, 16 nt, Bordetella pertussis
gaccugcuugcccagc

SEQ ID NO: 425500 - RNA, 11 nt, Bordetella pertussis
gaccugggcca

SEQ ID NO: 425501 - RNA, 14 nt, Bordetella pertussis
gaccugggccagca

SEQ ID NO: 425502 - RNA, 16 nt, Bordetella pertussis
gaccugggccagcagg

SEQ ID NO: 425503 - RNA, 15 nt, Bordetella pertussis
gaccuggucggccuu

SEQ ID NO: 425504 - RNA, 17 nt, Bordetella pertussis
gaccuggugugccuguc

SEQ ID NO: 425505 - RNA, 19 nt, Bordetella pertussis
gaccuggugugccuguccc

SEQ ID NO: 425506 - RNA, 17 nt, Bordetella pertussis
gaccuguacuggcuggu

SEQ ID NO: 425507 - RNA, 16 nt, Bordetella pertussis
gaccuugccgauccag

SEQ ID NO: 425508 - RNA, 20 nt, Bordetella pertussis
gaccuugccgauccagcgcc

SEQ ID NO: 425509 - RNA, 12 nt, Bordetella pertussis
gacgaacaacac

SEQ ID NO: 425510 - RNA, 15 nt, Bordetella pertussis
gacgaacaggccgcc

SEQ ID NO: 425511 - RNA, 18 nt, Bordetella pertussis
gacgaagccuaggcugca

SEQ ID NO: 425512 - RNA, 15 nt, Bordetella pertussis
gacgaaggcgccggc

SEQ ID NO: 425513 - RNA, 19 nt, Bordetella pertussis
gacgaagucccagccggcc

SEQ ID NO: 425514 - RNA, 18 nt, Bordetella pertussis
gacgaauacgcuggcgcg

SEQ ID NO: 425515 - RNA, 20 nt, Bordetella pertussis
gacgaauuucucggccagcg

SEQ ID NO: 425516 - RNA, 22 nt, Bordetella pertussis
gacgaccaacucgaggcggcgc

SEQ ID NO: 425517 - RNA, 20 nt, Bordetella pertussis
gacgacgcgguaguuggggg

SEQ ID NO: 425518 - RNA, 22 nt, Bordetella pertussis
gacgacgcguuguucgggccgg

SEQ ID NO: 425519 - RNA, 14 nt, Bordetella pertussis
gacgacggccggcg

SEQ ID NO: 425520 - RNA, 16 nt, Bordetella pertussis
gacgacggccggcgcg

SEQ ID NO: 425521 - RNA, 15 nt, Bordetella pertussis
gacgagacaggcgcg

SEQ ID NO: 425522 - RNA, 17 nt, Bordetella pertussis
gacgagacaggcgcgcc

SEQ ID NO: 425523 - RNA, 19 nt, Bordetella pertussis
gacgagaugccgaugaugg

SEQ ID NO: 425524 - RNA, 15 nt, Bordetella pertussis
gacgagcgcaccaug

SEQ ID NO: 425525 - RNA, 20 nt, Bordetella pertussis
gacgagcgcaccauggcgcc

SEQ ID NO: 425526 - RNA, 15 nt, Bordetella pertussis
gacgaggagccggcg

SEQ ID NO: 425527 - RNA, 16 nt, Bordetella pertussis
gacgagggccgcggcg

SEQ ID NO: 425528 - RNA, 15 nt, Bordetella pertussis
gacgagggccggcgc

SEQ ID NO: 425529 - RNA, 19 nt, Bordetella pertussis
gacgagggccggcgccagc

SEQ ID NO: 425530 - RNA, 19 nt, Bordetella pertussis
gacgaguugcucggagccc

SEQ ID NO: 425531 - RNA, 23 nt, Bordetella pertussis
gacgaguugcucggagcccagug

SEQ ID NO: 425532 - RNA, 12 nt, Bordetella pertussis
gacgauccggcg

SEQ ID NO: 425533 - RNA, 16 nt, Bordetella pertussis
gacgaucauccaggcc

SEQ ID NO: 425534 - RNA, 22 nt, Bordetella pertussis
gacgaucggccugaaccaggcc

SEQ ID NO: 425535 - RNA, 17 nt, Bordetella pertussis
gacgaugcccugcgcca

SEQ ID NO: 425536 - RNA, 22 nt, Bordetella pertussis
gacgaugcccugcgccagcgcc

SEQ ID NO: 425537 - RNA, 15 nt, Bordetella pertussis
gacgaugccgcccac

SEQ ID NO: 425538 - RNA, 17 nt, Bordetella pertussis
gacgaugcgcgaagcgc

SEQ ID NO: 425539 - RNA, 14 nt, Bordetella pertussis
gacgauggccggau

SEQ ID NO: 425540 - RNA, 21 nt, Bordetella pertussis
gacgauggugcgcaggggcuc

SEQ ID NO: 425541 - RNA, 20 nt, Bordetella pertussis
gacgauguagaucuggcgcg

SEQ ID NO: 425542 - RNA, 14 nt, Bordetella pertussis
gacgaugucgccgc

SEQ ID NO: 425543 - RNA, 14 nt, Bordetella pertussis
gacgcagaccacgc

SEQ ID NO: 425544 - RNA, 22 nt, Bordetella pertussis
gacgcagaccacgccggcgguc

SEQ ID NO: 425545 - RNA, 23 nt, Bordetella pertussis
gacgcagcgcaccgacggcagcc

SEQ ID NO: 425546 - RNA, 13 nt, Bordetella pertussis
gacgcagcgugcg

SEQ ID NO: 425547 - RNA, 13 nt, Bordetella pertussis
gacgcagcuucuu

SEQ ID NO: 425548 - RNA, 17 nt, Bordetella pertussis
gacgcaggagucggagg

SEQ ID NO: 425549 - RNA, 18 nt, Bordetella pertussis
gacgcaugucagcgccug

SEQ ID NO: 425550 - RNA, 15 nt, Bordetella pertussis
gacgccauggcggcg

SEQ ID NO: 425551 - RNA, 17 nt, Bordetella pertussis
gacgccgaaggucuugg

SEQ ID NO: 425552 - RNA, 13 nt, Bordetella pertussis
gacgcccuggccu

SEQ ID NO: 425553 - RNA, 22 nt, Bordetella pertussis
gacgccgaacacaucgagggcg

SEQ ID NO: 425554 - RNA, 22 nt, Bordetella pertussis
gacgccgacgaugccggucucc

SEQ ID NO: 425555 - RNA, 19 nt, Bordetella pertussis
gacgccgccacgcuggccg

SEQ ID NO: 425556 - RNA, 14 nt, Bordetella pertussis
gacgccgccggccc

SEQ ID NO: 425557 - RNA, 15 nt, Bordetella pertussis
gacgccgcggugcug

SEQ ID NO: 425558 - RNA, 13 nt, Bordetella pertussis
gacgccggcggcg

SEQ ID NO: 425559 - RNA, 16 nt, Bordetella pertussis
gacgccggcucaggcc

SEQ ID NO: 425560 - RNA, 19 nt, Bordetella pertussis
gacgccgguguagcugccc

SEQ ID NO: 425561 - RNA, 16 nt, Bordetella pertussis
gacgccuggcgcggcc

SEQ ID NO: 425562 - RNA, 16 nt, Bordetella pertussis
gacgcgauguccagcu

SEQ ID NO: 425563 - RNA, 18 nt, Bordetella pertussis
gacgcgauguccagcucc

SEQ ID NO: 425564 - RNA, 19 nt, Bordetella pertussis
gacgcgccgaacaccagcu

SEQ ID NO: 425565 - RNA, 23 nt, Bordetella pertussis
gacgcgccgggcgaaccgguggc

SEQ ID NO: 425566 - RNA, 17 nt, Bordetella pertussis
gacgcgcgccggcgcuc

SEQ ID NO: 425567 - RNA, 14 nt, Bordetella pertussis
gacgcgcuuccagg

SEQ ID NO: 425568 - RNA, 13 nt, Bordetella pertussis
gacgcgcucgccg

SEQ ID NO: 425569 - RNA, 16 nt, Bordetella pertussis
gacgcgcucgccgucg

SEQ ID NO: 425570 - RNA, 21 nt, Bordetella pertussis
gacgcggccguggaggcggcg

SEQ ID NO: 425571 - RNA, 16 nt, Bordetella pertussis
gacgcggccagcggcg

SEQ ID NO: 425572 - RNA, 14 nt, Bordetella pertussis
gacgcggccgaccc

SEQ ID NO: 425573 - RNA, 11 nt, Bordetella pertussis
gacgcggcggc

SEQ ID NO: 425574 - RNA, 14 nt, Bordetella pertussis
gacgcggggacagg

SEQ ID NO: 425575 - RNA, 17 nt, Bordetella pertussis
gacgcggggacaggcac

SEQ ID NO: 425576 - RNA, 23 nt, Bordetella pertussis
gacgcggggauggcuuccugcgg

SEQ ID NO: 425577 - RNA, 23 nt, Bordetella pertussis
gacgcggucgcccaacccggcga

SEQ ID NO: 425578 - RNA, 16 nt, Bordetella pertussis
gacgcguucgccgucg

SEQ ID NO: 425579 - RNA, 21 nt, Bordetella pertussis
gacgcguuguucgggccggcu

SEQ ID NO: 425580 - RNA, 17 nt, Bordetella pertussis
gacgcugacccuggccg

SEQ ID NO: 425581 - RNA, 17 nt, Bordetella pertussis
gacgcuggagcgcggcg

SEQ ID NO: 425582 - RNA, 19 nt, Bordetella pertussis
gacgcuggagcgcggcggc

SEQ ID NO: 425583 - RNA, 16 nt, Bordetella pertussis
gacgcuguaacaacac

SEQ ID NO: 425584 - RNA, 14 nt, Bordetella pertussis
gacggacuggcugg

SEQ ID NO: 425585 - RNA, 20 nt, Bordetella pertussis
gacggacuggcuggucaggc

SEQ ID NO: 425586 - RNA, 14 nt, Bordetella pertussis
gacggacuggugca

SEQ ID NO: 425587 - RNA, 22 nt, Bordetella pertussis
gacggaugccgucuuggcgggc

SEQ ID NO: 425588 - RNA, 22 nt, Bordetella pertussis
gacggauucgcccagggucgga

SEQ ID NO: 425589 - RNA, 16 nt, Bordetella pertussis
gacggcagcaagcugu

SEQ ID NO: 425590 - RNA, 15 nt, Bordetella pertussis
gacggcauggcggcc

SEQ ID NO: 425591 - RNA, 14 nt, Bordetella pertussis
gacggccauccggc

SEQ ID NO: 425592 - RNA, 15 nt, Bordetella pertussis
gacggccccagcgcc

SEQ ID NO: 425593 - RNA, 23 nt, Bordetella pertussis
gacggccccagcgccgcgagcgc

SEQ ID NO: 425594 - RNA, 12 nt, Bordetella pertussis
gacggcccugca

SEQ ID NO: 425595 - RNA, 15 nt, Bordetella pertussis
gacggccggggcccg

SEQ ID NO: 425596 - RNA, 20 nt, Bordetella pertussis
gacggcgccgugcuggaggu

SEQ ID NO: 425597 - RNA, 14 nt, Bordetella pertussis
gacggcgcucggcc

SEQ ID NO: 425598 - RNA, 15 nt, Bordetella pertussis
gacggcgggcgcccc

SEQ ID NO: 425599 - RNA, 13 nt, Bordetella pertussis
gacggcuugcgca

SEQ ID NO: 425600 - RNA, 12 nt, Bordetella pertussis
gacgggcaggcc

SEQ ID NO: 425601 - RNA, 12 nt, Bordetella pertussis
gacgggccaggc

SEQ ID NO: 425602 - RNA, 13 nt, Bordetella pertussis
gacgggccaggcc

SEQ ID NO: 425603 - RNA, 16 nt, Bordetella pertussis
gacgggccaggccgau

SEQ ID NO: 425604 - RNA, 13 nt, Bordetella pertussis
gacgggcgcccgc

SEQ ID NO: 425605 - RNA, 13 nt, Bordetella pertussis
gacgggcggcggc

SEQ ID NO: 425606 - RNA, 17 nt, Bordetella pertussis
gacgggcggcggcgcgc

SEQ ID NO: 425607 - RNA, 13 nt, Bordetella pertussis
gacggggacaggc

SEQ ID NO: 425608 - RNA, 14 nt, Bordetella pertussis
gacggggacaggcu

SEQ ID NO: 425609 - RNA, 15 nt, Bordetella pertussis
gacggggacaggcuc

SEQ ID NO: 425610 - RNA, 19 nt, Bordetella pertussis
gacgggucacccgccgcac

SEQ ID NO: 425611 - RNA, 19 nt, Bordetella pertussis
gacgguaucucagcgcgcc

SEQ ID NO: 425612 - RNA, 23 nt, Bordetella pertussis
gacgguaucucagcgcgccgcgc

SEQ ID NO: 425613 - RNA, 16 nt, Bordetella pertussis
gacguagccgcugccg

SEQ ID NO: 425614 - RNA, 19 nt, Bordetella pertussis
gacguccagcccgugggcg

SEQ ID NO: 425615 - RNA, 22 nt, Bordetella pertussis
gacguccagcccgugggcggcg

SEQ ID NO: 425616 - RNA, 11 nt, Bordetella pertussis
gacguccagcg

SEQ ID NO: 425617 - RNA, 23 nt, Bordetella pertussis
gacguccagcgccaccagcagcg

SEQ ID NO: 425618 - RNA, 21 nt, Bordetella pertussis
gacguccugguggaccugccg

SEQ ID NO: 425619 - RNA, 22 nt, Bordetella pertussis
gacgucgcccuggauggcggcc

SEQ ID NO: 425620 - RNA, 15 nt, Bordetella pertussis
gacgucguaccccga

SEQ ID NO: 425621 - RNA, 16 nt, Bordetella pertussis
gacgucguaccccgag

SEQ ID NO: 425622 - RNA, 13 nt, Bordetella pertussis
gacgucuugcugc

SEQ ID NO: 425623 - RNA, 23 nt, Bordetella pertussis
gacgugggcgccuacggcggcgg

SEQ ID NO: 425624 - RNA, 18 nt, Bordetella pertussis
gacgugucggccaccacg

SEQ ID NO: 425625 - RNA, 12 nt, Bordetella pertussis
gacguugccgcg

SEQ ID NO: 425626 - RNA, 14 nt, Bordetella pertussis
gacuacgcgcuggc

SEQ ID NO: 425627 - RNA, 19 nt, Bordetella pertussis
gacuacggcggacuggccg

SEQ ID NO: 425628 - RNA, 14 nt, Bordetella pertussis
gacuauagcucucu

SEQ ID NO: 425629 - RNA, 23 nt, Bordetella pertussis
gacuauggccuggaugugcaggc

SEQ ID NO: 425630 - RNA, 20 nt, Bordetella pertussis
gacucauaggcaucgaccag

SEQ ID NO: 425631 - RNA, 17 nt, Bordetella pertussis
gacucgacgaacacgcg

SEQ ID NO: 425632 - RNA, 21 nt, Bordetella pertussis
gacucgccgugcugggcggcc

SEQ ID NO: 425633 - RNA, 14 nt, Bordetella pertussis
gacucgcggucugg

SEQ ID NO: 425634 - RNA, 19 nt, Bordetella pertussis
gacucguccauggugggca

SEQ ID NO: 425635 - RNA, 18 nt, Bordetella pertussis
gacugaacgcguccaggc

SEQ ID NO: 425636 - RNA, 11 nt, Bordetella pertussis
gacugccagau

SEQ ID NO: 425637 - RNA, 16 nt, Bordetella pertussis
gacugcggugccuguc

SEQ ID NO: 425638 - RNA, 18 nt, Bordetella pertussis
gacugcggugccuguccc

SEQ ID NO: 425639 - RNA, 19 nt, Bordetella pertussis
gacuggacgaugagcuggu

SEQ ID NO: 425640 - RNA, 24 nt, Bordetella pertussis
gacuggcacccgccaauugcuugc

SEQ ID NO: 425641 - RNA, 23 nt, Bordetella pertussis
gacuggcaccggccaagcuccag

SEQ ID NO: 425642 - RNA, 12 nt, Bordetella pertussis
gacuggccgcgc

SEQ ID NO: 425643 - RNA, 18 nt, Bordetella pertussis
gacuggccgcgccgcugg

SEQ ID NO: 425644 - RNA, 22 nt, Bordetella pertussis
gacuggccgcgccgcuggcggc

SEQ ID NO: 425645 - RNA, 13 nt, Bordetella pertussis
gacuggcucccac

SEQ ID NO: 425646 - RNA, 18 nt, Bordetella pertussis
gacuuccggggagccugc

SEQ ID NO: 425647 - RNA, 19 nt, Bordetella pertussis
gacuuccggggagccugcc

SEQ ID NO: 425648 - RNA, 12 nt, Bordetella pertussis
gacuucgcccgg

SEQ ID NO: 425649 - RNA, 15 nt, Bordetella pertussis
gacuucggcggccug

SEQ ID NO: 425650 - RNA, 15 nt, Bordetella pertussis
gacuugggcaggccu

SEQ ID NO: 425651 - RNA, 15 nt, Bordetella pertussis
gagaaaccagccgcc

SEQ ID NO: 425652 - RNA, 13 nt, Bordetella pertussis
gagaaaggccgcc

SEQ ID NO: 425653 - RNA, 16 nt, Bordetella pertussis
gagaacgagccggccg

SEQ ID NO: 425654 - RNA, 19 nt, Bordetella pertussis
gagaacgagccggccgcgc

SEQ ID NO: 425655 - RNA, 21 nt, Bordetella pertussis
gagaacgccgucgggguggcg

SEQ ID NO: 425656 - RNA, 15 nt, Bordetella pertussis
gagaacucgguggcg

SEQ ID NO: 425657 - RNA, 14 nt, Bordetella pertussis
gagaagucaucgau

SEQ ID NO: 425658 - RNA, 15 nt, Bordetella pertussis
gagaaguuggcgggc

SEQ ID NO: 425659 - RNA, 18 nt, Bordetella pertussis
gagaaucaugggcgacgc

SEQ ID NO: 425660 - RNA, 16 nt, Bordetella pertussis
gagacaucaugcagaa

SEQ ID NO: 425661 - RNA, 14 nt, Bordetella pertussis
gagacguagccgcu

SEQ ID NO: 425662 - RNA, 18 nt, Bordetella pertussis
gagagccugggcgcgcgc

SEQ ID NO: 425663 - RNA, 19 nt, Bordetella pertussis
gagagccugggcgcgcgcc

SEQ ID NO: 425664 - RNA, 14 nt, Bordetella pertussis
gagagcgccacgcc

SEQ ID NO: 425665 - RNA, 21 nt, Bordetella pertussis
gagaggaucaccgcauggaac

SEQ ID NO: 425666 - RNA, 17 nt, Bordetella pertussis
gagaguucauccacagc

SEQ ID NO: 425667 - RNA, 18 nt, Bordetella pertussis
gagaguucauccacagcc

SEQ ID NO: 425668 - RNA, 14 nt, Bordetella pertussis
gagauagcccagca

SEQ ID NO: 425669 - RNA, 15 nt, Bordetella pertussis
gagaucagcaccgcg

SEQ ID NO: 425670 - RNA, 17 nt, Bordetella pertussis
gagaucgccgagcggca

SEQ ID NO: 425671 - RNA, 23 nt, Bordetella pertussis
gagaucucgaugcguucgcccgu

SEQ ID NO: 425672 - RNA, 16 nt, Bordetella pertussis
gagaugccagcggcgc

SEQ ID NO: 425673 - RNA, 18 nt, Bordetella pertussis
gagaugccagcggcgcag

SEQ ID NO: 425674 - RNA, 18 nt, Bordetella pertussis
gagauggcgcaggcgcgc

SEQ ID NO: 425675 - RNA, 14 nt, Bordetella pertussis
gagauggguacagc

SEQ ID NO: 425676 - RNA, 15 nt, Bordetella pertussis
gagauguccauggcc

SEQ ID NO: 425677 - RNA, 22 nt, Bordetella pertussis
gagaugugcggcguggcggggc

SEQ ID NO: 425678 - RNA, 14 nt, Bordetella pertussis
gagauuguccagcg

SEQ ID NO: 425679 - RNA, 13 nt, Bordetella pertussis
gagauugugcagc

SEQ ID NO: 425680 - RNA, 20 nt, Bordetella pertussis
gagcacaugcccggccacca

SEQ ID NO: 425681 - RNA, 13 nt, Bordetella pertussis
gagcaccagcagc

SEQ ID NO: 425682 - RNA, 14 nt, Bordetella pertussis
gagcaccagcagcc

SEQ ID NO: 425683 - RNA, 20 nt, Bordetella pertussis
gagcaccgccgcguccucgg

SEQ ID NO: 425684 - RNA, 15 nt, Bordetella pertussis
gagcacggccugcuc

SEQ ID NO: 425685 - RNA, 20 nt, Bordetella pertussis
gagcacgguuucgccgugcu

SEQ ID NO: 425686 - RNA, 15 nt, Bordetella pertussis
gagcagcagcgggcu

SEQ ID NO: 425687 - RNA, 16 nt, Bordetella pertussis
gagcagcagcgggcuu

SEQ ID NO: 425688 - RNA, 14 nt, Bordetella pertussis
gagcagcgcaucga

SEQ ID NO: 425689 - RNA, 21 nt, Bordetella pertussis
gagcagcucacuuguaaugag

SEQ ID NO: 425690 - RNA, 13 nt, Bordetella pertussis
gagcaggccgccc

SEQ ID NO: 425691 - RNA, 15 nt, Bordetella pertussis
gagcaggccgccgcc

SEQ ID NO: 425692 - RNA, 17 nt, Bordetella pertussis
gagcaggccgccgccgg

SEQ ID NO: 425693 - RNA, 11 nt, Bordetella pertussis
gagcaggcgca

SEQ ID NO: 425694 - RNA, 16 nt, Bordetella pertussis
gagcaggcgcaggccg

SEQ ID NO: 425695 - RNA, 17 nt, Bordetella pertussis
gagcaggcgcaggccgc

SEQ ID NO: 425696 - RNA, 17 nt, Bordetella pertussis
gagcaggucgagguccu

SEQ ID NO: 425697 - RNA, 23 nt, Bordetella pertussis
gagcaggucgagguccugcucgg

SEQ ID NO: 425698 - RNA, 14 nt, Bordetella pertussis
gagcagugugccug

SEQ ID NO: 425699 - RNA, 20 nt, Bordetella pertussis
gagcaucauggcgcgcgccg

SEQ ID NO: 425700 - RNA, 17 nt, Bordetella pertussis
gagcaucccggcgcuca

SEQ ID NO: 425701 - RNA, 12 nt, Bordetella pertussis
gagcaugcccuu

SEQ ID NO: 425702 - RNA, 15 nt, Bordetella pertussis
gagcaugcggcgucc

SEQ ID NO: 425703 - RNA, 15 nt, Bordetella pertussis
gagcauggcgguggc

SEQ ID NO: 425704 - RNA, 17 nt, Bordetella pertussis
gagcauggcgguggcca

SEQ ID NO: 425705 - RNA, 15 nt, Bordetella pertussis
gagccaauaacagag

SEQ ID NO: 425706 - RNA, 17 nt, Bordetella pertussis
gagccacaauccauucc

SEQ ID NO: 425707 - RNA, 21 nt, Bordetella pertussis
gagccacgucgcucggccucc

SEQ ID NO: 425708 - RNA, 16 nt, Bordetella pertussis
gagccaggcgcccggc

SEQ ID NO: 425709 - RNA, 22 nt, Bordetella pertussis
gagccagguggacagcgccagc

SEQ ID NO: 425710 - RNA, 12 nt, Bordetella pertussis
gagccagucccc

SEQ ID NO: 425711 - RNA, 23 nt, Bordetella pertussis
gagccaguccccgcagggacagg

SEQ ID NO: 425712 - RNA, 23 nt, Bordetella pertussis
gagccaguccccgcggggacagg

SEQ ID NO: 425713 - RNA, 21 nt, Bordetella pertussis
gagccaugccgucuggcggca

SEQ ID NO: 425714 - RNA, 15 nt, Bordetella pertussis
gagcccgccaucgcc

SEQ ID NO: 425715 - RNA, 14 nt, Bordetella pertussis
gagcccgcgucggc

SEQ ID NO: 425716 - RNA, 16 nt, Bordetella pertussis
gagccgauacaggcgc

SEQ ID NO: 425717 - RNA, 17 nt, Bordetella pertussis
gagccgauacaggcgcu

SEQ ID NO: 425718 - RNA, 20 nt, Bordetella pertussis
gagccgauacaggcgcucgc

SEQ ID NO: 425719 - RNA, 13 nt, Bordetella pertussis
gagccgauggcau

SEQ ID NO: 425720 - RNA, 22 nt, Bordetella pertussis
gagccgauggcauggggcaggc

SEQ ID NO: 425721 - RNA, 23 nt, Bordetella pertussis
gagccgauggcauggggcaggcg

SEQ ID NO: 425722 - RNA, 13 nt, Bordetella pertussis
gagccgcagaaca

SEQ ID NO: 425723 - RNA, 15 nt, Bordetella pertussis
gagccgcagaacagc

SEQ ID NO: 425724 - RNA, 18 nt, Bordetella pertussis
gagccgcagaacagcagc

SEQ ID NO: 425725 - RNA, 22 nt, Bordetella pertussis
gagccgcagaacagcagcguga

SEQ ID NO: 425726 - RNA, 16 nt, Bordetella pertussis
gagccgcagguccagg

SEQ ID NO: 425727 - RNA, 12 nt, Bordetella pertussis
gagccgcgcaca

SEQ ID NO: 425728 - RNA, 21 nt, Bordetella pertussis
gagccggagcagucgcgcagc

SEQ ID NO: 425729 - RNA, 22 nt, Bordetella pertussis
gagccggccacgcgcugcagca

SEQ ID NO: 425730 - RNA, 14 nt, Bordetella pertussis
gagccggccagcgc

SEQ ID NO: 425731 - RNA, 15 nt, Bordetella pertussis
gagccggccagcgcc

SEQ ID NO: 425732 - RNA, 16 nt, Bordetella pertussis
gagccggccagcgcca

SEQ ID NO: 425733 - RNA, 15 nt, Bordetella pertussis
gagccgggccaugcg

SEQ ID NO: 425734 - RNA, 16 nt, Bordetella pertussis
gagccgggccaugcgg

SEQ ID NO: 425735 - RNA, 14 nt, Bordetella pertussis
gagccgggcgccga

SEQ ID NO: 425736 - RNA, 23 nt, Bordetella pertussis
gagccgguccgccucgcacaguu

SEQ ID NO: 425737 - RNA, 15 nt, Bordetella pertussis
gagccggugggcgcg

SEQ ID NO: 425738 - RNA, 19 nt, Bordetella pertussis
gagccguacucgaucgcca

SEQ ID NO: 425739 - RNA, 22 nt, Bordetella pertussis
gagccguaguaggucaugcaga

SEQ ID NO: 425740 - RNA, 23 nt, Bordetella pertussis
gagccguucuggcagugcgccug

SEQ ID NO: 425741 - RNA, 16 nt, Bordetella pertussis
gagccuguccccgcgg

SEQ ID NO: 425742 - RNA, 15 nt, Bordetella pertussis
gagccuguccccguc

SEQ ID NO: 425743 - RNA, 23 nt, Bordetella pertussis
gagccuguccccgucgggacagg

SEQ ID NO: 425744 - RNA, 19 nt, Bordetella pertussis
gagccugucccugcgggga

SEQ ID NO: 425745 - RNA, 16 nt, Bordetella pertussis
gagccuucggccggcu

SEQ ID NO: 425746 - RNA, 20 nt, Bordetella pertussis
gagcgaaauggcggccucgg

SEQ ID NO: 425747 - RNA, 13 nt, Bordetella pertussis
gagcgaugcccug

SEQ ID NO: 425748 - RNA, 18 nt, Bordetella pertussis
gagcgcagcaagcugcug

SEQ ID NO: 425749 - RNA, 21 nt, Bordetella pertussis
gagcgcagcaagcugcugcug

SEQ ID NO: 425750 - RNA, 22 nt, Bordetella pertussis
gagcgccagcucggccaaggca

SEQ ID NO: 425751 - RNA, 14 nt, Bordetella pertussis
gagcgccagggccu

SEQ ID NO: 425752 - RNA, 16 nt, Bordetella pertussis
gagcgccagggccucc

SEQ ID NO: 425753 - RNA, 20 nt, Bordetella pertussis
gagcgccgacgggccgguca

SEQ ID NO: 425754 - RNA, 14 nt, Bordetella pertussis
gagcgccgccaggc

SEQ ID NO: 425755 - RNA, 15 nt, Bordetella pertussis
gagcgccgccaggcc

SEQ ID NO: 425756 - RNA, 14 nt, Bordetella pertussis
gagcgccgcgcucc

SEQ ID NO: 425757 - RNA, 21 nt, Bordetella pertussis
gagcgccugggcggccacgua

SEQ ID NO: 425758 - RNA, 23 nt, Bordetella pertussis
gagcgcggcaugcgcaugcugga

SEQ ID NO: 425759 - RNA, 14 nt, Bordetella pertussis
gagcgcggccaggc

SEQ ID NO: 425760 - RNA, 15 nt, Bordetella pertussis
gagcgcggcgcgcga

SEQ ID NO: 425761 - RNA, 18 nt, Bordetella pertussis
gagcgcgggccgccgcac

SEQ ID NO: 425762 - RNA, 19 nt, Bordetella pertussis
gagcgcgggccgccgcaca

SEQ ID NO: 425763 - RNA, 17 nt, Bordetella pertussis
gagcgcgguggccgcuu

SEQ ID NO: 425764 - RNA, 14 nt, Bordetella pertussis
gagcggcagcagcg

SEQ ID NO: 425765 - RNA, 14 nt, Bordetella pertussis
gagcggcccgggcg

SEQ ID NO: 425766 - RNA, 12 nt, Bordetella pertussis
gagcggcggcuu

SEQ ID NO: 425767 - RNA, 18 nt, Bordetella pertussis
gagcggcgucgcguccuu

SEQ ID NO: 425768 - RNA, 17 nt, Bordetella pertussis
gagcgggcaugggcccc

SEQ ID NO: 425769 - RNA, 14 nt, Bordetella pertussis
gagcucggcauggc

SEQ ID NO: 425770 - RNA, 19 nt, Bordetella pertussis
gagcucguguagggccugg

SEQ ID NO: 425771 - RNA, 15 nt, Bordetella pertussis
gagcugagcaccagc

SEQ ID NO: 425772 - RNA, 17 nt, Bordetella pertussis
gagcugagcaccagcag

SEQ ID NO: 425773 - RNA, 15 nt, Bordetella pertussis
gagcugcacccacac

SEQ ID NO: 425774 - RNA, 16 nt, Bordetella pertussis
gagcugcacccacacu

SEQ ID NO: 425775 - RNA, 18 nt, Bordetella pertussis
gagcugcagcccggccag

SEQ ID NO: 425776 - RNA, 17 nt, Bordetella pertussis
gagcugcggcgcggcgc

SEQ ID NO: 425777 - RNA, 17 nt, Bordetella pertussis
gagcuggcgcagguccu

SEQ ID NO: 425778 - RNA, 21 nt, Bordetella pertussis
gagcuggcuggccagcggggc

SEQ ID NO: 425779 - RNA, 20 nt, Bordetella pertussis
gaggaaauggugcgguugcg

SEQ ID NO: 425780 - RNA, 17 nt, Bordetella pertussis
gaggaacuggacggcgc

SEQ ID NO: 425781 - RNA, 21 nt, Bordetella pertussis
gaggaacuggacggcgcuggg

SEQ ID NO: 425782 - RNA, 23 nt, Bordetella pertussis
gaggaacugggcgccggccagga

SEQ ID NO: 425783 - RNA, 17 nt, Bordetella pertussis
gaggaacggcaccagcc

SEQ ID NO: 425784 - RNA, 17 nt, Bordetella pertussis
gaggaagggugcggcgc

SEQ ID NO: 425785 - RNA, 18 nt, Bordetella pertussis
gaggaagggugcggcgcc

SEQ ID NO: 425786 - RNA, 20 nt, Bordetella pertussis
gaggaccccgaagcacagau

SEQ ID NO: 425787 - RNA, 15 nt, Bordetella pertussis
gaggagccggcgggc

SEQ ID NO: 425788 - RNA, 14 nt, Bordetella pertussis
gaggagguggcugg

SEQ ID NO: 425789 - RNA, 15 nt, Bordetella pertussis
gaggauacggccagc

SEQ ID NO: 425790 - RNA, 18 nt, Bordetella pertussis
gaggauacggccagcgcc

SEQ ID NO: 425791 - RNA, 16 nt, Bordetella pertussis
gaggaugcgcgcggcc

SEQ ID NO: 425792 - RNA, 14 nt, Bordetella pertussis
gaggaugugcagcg

SEQ ID NO: 425793 - RNA, 16 nt, Bordetella pertussis
gaggaugugcagcgca

SEQ ID NO: 425794 - RNA, 14 nt, Bordetella pertussis
gaggcaaucagccc

SEQ ID NO: 425795 - RNA, 22 nt, Bordetella pertussis
gaggcagaaguggucgcgcagg

SEQ ID NO: 425796 - RNA, 20 nt, Bordetella pertussis
gaggcauacaggcuguggcc

SEQ ID NO: 425797 - RNA, 14 nt, Bordetella pertussis
gaggcauuggcggc

SEQ ID NO: 425798 - RNA, 22 nt, Bordetella pertussis
gaggccacccgaagguggcccg

SEQ ID NO: 425799 - RNA, 18 nt, Bordetella pertussis
gaggccagcgugcccagc

SEQ ID NO: 425800 - RNA, 18 nt, Bordetella pertussis
gaggcccgauggcgggga

SEQ ID NO: 425801 - RNA, 21 nt, Bordetella pertussis
gaggcccgauggcggggaugg

SEQ ID NO: 425802 - RNA, 18 nt, Bordetella pertussis
gaggccgaguggccgcug

SEQ ID NO: 425803 - RNA, 15 nt, Bordetella pertussis
gaggccggcgugcug

SEQ ID NO: 425804 - RNA, 20 nt, Bordetella pertussis
gaggcgccccagagcaccga

SEQ ID NO: 425805 - RNA, 16 nt, Bordetella pertussis
gaggcgccgccgugcg

SEQ ID NO: 425806 - RNA, 18 nt, Bordetella pertussis
gaggcgccgcggaggcga

SEQ ID NO: 425807 - RNA, 17 nt, Bordetella pertussis
gaggcgcgcagcuccgu

SEQ ID NO: 425808 - RNA, 13 nt, Bordetella pertussis
gaggcgcgggcag

SEQ ID NO: 425809 - RNA, 19 nt, Bordetella pertussis
gaggcgcgggcgauguagg

SEQ ID NO: 425810 - RNA, 19 nt, Bordetella pertussis
gaggcgcuggcguccagcc

SEQ ID NO: 425811 - RNA, 20 nt, Bordetella pertussis
gaggcggccgcgggcggcgc

SEQ ID NO: 425812 - RNA, 14 nt, Bordetella pertussis
gaggcggccgggcg

SEQ ID NO: 425813 - RNA, 13 nt, Bordetella pertussis
gaggcggcgcagg

SEQ ID NO: 425814 - RNA, 14 nt, Bordetella pertussis
gaggcggcgcagga

SEQ ID NO: 425815 - RNA, 23 nt, Bordetella pertussis
gaggcggcgcaggaugcgcuggc

SEQ ID NO: 425816 - RNA, 17 nt, Bordetella pertussis
gaggcggucgaugaagc

SEQ ID NO: 425817 - RNA, 18 nt, Bordetella pertussis
gaggcgugcugcaccugc

SEQ ID NO: 425818 - RNA, 21 nt, Bordetella pertussis
gaggcugcgcgcgccagcgcc

SEQ ID NO: 425819 - RNA, 15 nt, Bordetella pertussis
gaggcuguccccgca

SEQ ID NO: 425820 - RNA, 19 nt, Bordetella pertussis
gagggacaccgcaggugcc

SEQ ID NO: 425821 - RNA, 19 nt, Bordetella pertussis
gagggccggacuggcgcgc

SEQ ID NO: 425822 - RNA, 16 nt, Bordetella pertussis
gagggcgacggcggcg

SEQ ID NO: 425823 - RNA, 17 nt, Bordetella pertussis
gagggcgacggcggcgu

SEQ ID NO: 425824 - RNA, 20 nt, Bordetella pertussis
gagggcgcgggccagcucuu

SEQ ID NO: 425825 - RNA, 20 nt, Bordetella pertussis
gagggcuccaggcugagcgu

SEQ ID NO: 425826 - RNA, 19 nt, Bordetella pertussis
gagggcugcccucgcccgu

SEQ ID NO: 425827 - RNA, 13 nt, Bordetella pertussis
gagguaugcacga

SEQ ID NO: 425828 - RNA, 20 nt, Bordetella pertussis
gagguaugcacgaccaggcc

SEQ ID NO: 425829 - RNA, 17 nt, Bordetella pertussis
gaggucggggugguugu

SEQ ID NO: 425830 - RNA, 19 nt, Bordetella pertussis
gaggucggggugguugucg

SEQ ID NO: 425831 - RNA, 17 nt, Bordetella pertussis
gaggugccggacgccga

SEQ ID NO: 425832 - RNA, 16 nt, Bordetella pertussis
gaggugccggcgguga

SEQ ID NO: 425833 - RNA, 22 nt, Bordetella pertussis
gaggugccggcggugaugacgu

SEQ ID NO: 425834 - RNA, 16 nt, Bordetella pertussis
gagguggacaagaaag

SEQ ID NO: 425835 - RNA, 21 nt, Bordetella pertussis
gagguuuccgccaugcggcgc

SEQ ID NO: 425836 - RNA, 22 nt, Bordetella pertussis
gaguagccgcucagguagacca

SEQ ID NO: 425837 - RNA, 21 nt, Bordetella pertussis
gaguagcggcgcaacccggcc

SEQ ID NO: 425838 - RNA, 21 nt, Bordetella pertussis
gaguggccguagagggucugg

SEQ ID NO: 425839 - RNA, 21 nt, Bordetella pertussis
gaguugcccgaaggcagcggc

SEQ ID NO: 425840 - RNA, 16 nt, Bordetella pertussis
gauaccgcuggccagg

SEQ ID NO: 425841 - RNA, 21 nt, Bordetella pertussis
gauaccggagcggcucgccgc

SEQ ID NO: 425842 - RNA, 20 nt, Bordetella pertussis
gauaccggcauggcagcaga

SEQ ID NO: 425843 - RNA, 14 nt, Bordetella pertussis
gauagacccuccuc

SEQ ID NO: 425844 - RNA, 18 nt, Bordetella pertussis
gauagcccagcaccugca

SEQ ID NO: 425845 - RNA, 21 nt, Bordetella pertussis
gauagcccagcaccugcaggc

SEQ ID NO: 425846 - RNA, 18 nt, Bordetella pertussis
gauagcgggccugcagca

SEQ ID NO: 425847 - RNA, 15 nt, Bordetella pertussis
gauagcggugcaggg

SEQ ID NO: 425848 - RNA, 14 nt, Bordetella pertussis
gauaggcggccagg

SEQ ID NO: 425849 - RNA, 15 nt, Bordetella pertussis
gauaggugcgcagcc

SEQ ID NO: 425850 - RNA, 19 nt, Bordetella pertussis
gauaggugcgcagccgggc

SEQ ID NO: 425851 - RNA, 20 nt, Bordetella pertussis
gauagucggaguagggcagc

SEQ ID NO: 425852 - RNA, 15 nt, Bordetella pertussis
gauauagaccagcag

SEQ ID NO: 425853 - RNA, 17 nt, Bordetella pertussis
gauauagaccagcagcu

SEQ ID NO: 425854 - RNA, 22 nt, Bordetella pertussis
gaucaaaaucgugacgcuggcc

SEQ ID NO: 425855 - RNA, 20 nt, Bordetella pertussis
gaucaagggguggcuguccc

SEQ ID NO: 425856 - RNA, 18 nt, Bordetella pertussis
gaucacauaggccggcac

SEQ ID NO: 425857 - RNA, 22 nt, Bordetella pertussis
gaucacccagcggcuggccacu

SEQ ID NO: 425858 - RNA, 19 nt, Bordetella pertussis
gaucaccgccauggcggcc

SEQ ID NO: 425859 - RNA, 22 nt, Bordetella pertussis
gaucaccgccggcggcgugccc

SEQ ID NO: 425860 - RNA, 14 nt, Bordetella pertussis
gaucaccguucuuc

SEQ ID NO: 425861 - RNA, 17 nt, Bordetella pertussis
gaucaccguuuggccug

SEQ ID NO: 425862 - RNA, 16 nt, Bordetella pertussis
gaucacgaacagcgcc

SEQ ID NO: 425863 - RNA, 19 nt, Bordetella pertussis
gaucagcaagggccccagc

SEQ ID NO: 425864 - RNA, 19 nt, Bordetella pertussis
gaucagcaccgcggcgggc

SEQ ID NO: 425865 - RNA, 16 nt, Bordetella pertussis
gaucaucuucgugcug

SEQ ID NO: 425866 - RNA, 14 nt, Bordetella pertussis
gaucauggcgccga

SEQ ID NO: 425867 - RNA, 16 nt, Bordetella pertussis
gauccagcgcggccac

SEQ ID NO: 425868 - RNA, 14 nt, Bordetella pertussis
gauccagcgcucgg

SEQ ID NO: 425869 - RNA, 17 nt, Bordetella pertussis
gauccagcuugcguccc

SEQ ID NO: 425870 - RNA, 23 nt, Bordetella pertussis
gauccagcuugcgucccaccugc

SEQ ID NO: 425871 - RNA, 17 nt, Bordetella pertussis
gauccagggccgcagca

SEQ ID NO: 425872 - RNA, 18 nt, Bordetella pertussis
gauccagggccgccagca

SEQ ID NO: 425873 - RNA, 20 nt, Bordetella pertussis
gauccagggccgccagcacc

SEQ ID NO: 425874 - RNA, 22 nt, Bordetella pertussis
gauccagucgaugauccacagu

SEQ ID NO: 425875 - RNA, 23 nt, Bordetella pertussis
gaucccgagcgggcaugggcccc

SEQ ID NO: 425876 - RNA, 23 nt, Bordetella pertussis
gaucuaggccguuuccucuggag

SEQ ID NO: 425877 - RNA, 17 nt, Bordetella pertussis
gaucucagccaucauca

SEQ ID NO: 425878 - RNA, 19 nt, Bordetella pertussis
gaucuccggauccagccgc

SEQ ID NO: 425879 - RNA, 17 nt, Bordetella pertussis
gaucuccggcgccuggc

SEQ ID NO: 425880 - RNA, 18 nt, Bordetella pertussis
gaucuccggcgccuggcc

SEQ ID NO: 425881 - RNA, 19 nt, Bordetella pertussis
gaucuccgggagccugucc

SEQ ID NO: 425882 - RNA, 14 nt, Bordetella pertussis
gaucucgcccagca

SEQ ID NO: 425883 - RNA, 15 nt, Bordetella pertussis
gaucucggccagcag

SEQ ID NO: 425884 - RNA, 17 nt, Bordetella pertussis
gaucucggccagcagcg

SEQ ID NO: 425885 - RNA, 14 nt, Bordetella pertussis
gaucucgucgaccg

SEQ ID NO: 425886 - RNA, 22 nt, Bordetella pertussis
gaucugacgggucacccgccgc

SEQ ID NO: 425887 - RNA, 21 nt, Bordetella pertussis
gaucugcauguacucggccag

SEQ ID NO: 425888 - RNA, 13 nt, Bordetella pertussis
gaucugggccucg

SEQ ID NO: 425889 - RNA, 20 nt, Bordetella pertussis
gaucugguccacggcggcgg

SEQ ID NO: 425890 - RNA, 18 nt, Bordetella pertussis
gaucuggugaaacagcau

SEQ ID NO: 425891 - RNA, 19 nt, Bordetella pertussis
gaucuguaccgccgggucg

SEQ ID NO: 425892 - RNA, 15 nt, Bordetella pertussis
gaucuucccgccaug

SEQ ID NO: 425893 - RNA, 14 nt, Bordetella pertussis
gaucuuccuugaag

SEQ ID NO: 425894 - RNA, 20 nt, Bordetella pertussis
gaugaagaugccgaaccaga

SEQ ID NO: 425895 - RNA, 18 nt, Bordetella pertussis
gaugaagcguucggccuu

SEQ ID NO: 425896 - RNA, 16 nt, Bordetella pertussis
gaugaccugggccugg

SEQ ID NO: 425897 - RNA, 20 nt, Bordetella pertussis
gaugaccuugagaugccagc

SEQ ID NO: 425898 - RNA, 17 nt, Bordetella pertussis
gaugacggggcggcgcc

SEQ ID NO: 425899 - RNA, 14 nt, Bordetella pertussis
gaugaugcggcgcc

SEQ ID NO: 425900 - RNA, 14 nt, Bordetella pertussis
gaugauggaggcca

SEQ ID NO: 425901 - RNA, 17 nt, Bordetella pertussis
gaugauggucggugccg

SEQ ID NO: 425902 - RNA, 16 nt, Bordetella pertussis
gaugaugugguagccg

SEQ ID NO: 425903 - RNA, 22 nt, Bordetella pertussis
gaugauguucauacgcgcgcuc

SEQ ID NO: 425904 - RNA, 20 nt, Bordetella pertussis
gaugcaccggccagucgcgg

SEQ ID NO: 425905 - RNA, 17 nt, Bordetella pertussis
gaugcacguagcgcagc

SEQ ID NO: 425906 - RNA, 19 nt, Bordetella pertussis
gaugcacguagcgcagcac

SEQ ID NO: 425907 - RNA, 16 nt, Bordetella pertussis
gaugccagcggcgcag

SEQ ID NO: 425908 - RNA, 20 nt, Bordetella pertussis
gaugccaguuguaguggugu

SEQ ID NO: 425909 - RNA, 13 nt, Bordetella pertussis
gaugcccagcgcc

SEQ ID NO: 425910 - RNA, 18 nt, Bordetella pertussis
gaugcccaggcccuggcu

SEQ ID NO: 425911 - RNA, 15 nt, Bordetella pertussis
gaugcccagggccgc

SEQ ID NO: 425912 - RNA, 18 nt, Bordetella pertussis
gaugcccagggccgcgcc

SEQ ID NO: 425913 - RNA, 22 nt, Bordetella pertussis
gaugccccagguccgccggcac

SEQ ID NO: 425914 - RNA, 16 nt, Bordetella pertussis
gaugccccgcccgcgu

SEQ ID NO: 425915 - RNA, 14 nt, Bordetella pertussis
gaugcccgcgggca

SEQ ID NO: 425916 - RNA, 17 nt, Bordetella pertussis
gaugccggccagcagcg

SEQ ID NO: 425917 - RNA, 22 nt, Bordetella pertussis
gaugccggcguucuggucagcc

SEQ ID NO: 425918 - RNA, 21 nt, Bordetella pertussis
gaugccgucgagcgcggccag

SEQ ID NO: 425919 - RNA, 15 nt, Bordetella pertussis
gaugccgucggccug

SEQ ID NO: 425920 - RNA, 13 nt, Bordetella pertussis
gaugccgucuugg

SEQ ID NO: 425921 - RNA, 13 nt, Bordetella pertussis
gaugccguucuug

SEQ ID NO: 425922 - RNA, 12 nt, Bordetella pertussis
gaugcgccgcac

SEQ ID NO: 425923 - RNA, 15 nt, Bordetella pertussis
gaugcgcgccaggcg

SEQ ID NO: 425924 - RNA, 21 nt, Bordetella pertussis
gaugcgcgcgcgggccagcag

SEQ ID NO: 425925 - RNA, 17 nt, Bordetella pertussis
gaugcgcucgaucaagg

SEQ ID NO: 425926 - RNA, 18 nt, Bordetella pertussis
gaugcgcugggccaggcc

SEQ ID NO: 425927 - RNA, 16 nt, Bordetella pertussis
gaugcgcuggccggcc

SEQ ID NO: 425928 - RNA, 23 nt, Bordetella pertussis
gaugcgcuugccgcccacugcca

SEQ ID NO: 425929 - RNA, 18 nt, Bordetella pertussis
gaugcggccuucgccggu

SEQ ID NO: 425930 - RNA, 13 nt, Bordetella pertussis
gaugcggcggccg

SEQ ID NO: 425931 - RNA, 14 nt, Bordetella pertussis
gauggccagcagcg

SEQ ID NO: 425932 - RNA, 16 nt, Bordetella pertussis
gauggccagcagcgcc

SEQ ID NO: 425933 - RNA, 18 nt, Bordetella pertussis
gauggccagcagcgccgc

SEQ ID NO: 425934 - RNA, 13 nt, Bordetella pertussis
gauggccagcgcg

SEQ ID NO: 425935 - RNA, 20 nt, Bordetella pertussis
gauggccagguggcggcggc

SEQ ID NO: 425936 - RNA, 16 nt, Bordetella pertussis
gauggcccagggcagc

SEQ ID NO: 425937 - RNA, 17 nt, Bordetella pertussis
gauggcccagggcagcg

SEQ ID NO: 425938 - RNA, 20 nt, Bordetella pertussis
gauggcccagggcagcggcc

SEQ ID NO: 425939 - RNA, 22 nt, Bordetella pertussis
gauggccgacaugucgugcugg

SEQ ID NO: 425940 - RNA, 21 nt, Bordetella pertussis
gauggccugcucgcccacaua

SEQ ID NO: 425941 - RNA, 22 nt, Bordetella pertussis
gauggccuuuuccaggcgugcc

SEQ ID NO: 425942 - RNA, 16 nt, Bordetella pertussis
gauggcgaaacuggcc

SEQ ID NO: 425943 - RNA, 18 nt, Bordetella pertussis
gauggcgaaacuggccga

SEQ ID NO: 425944 - RNA, 12 nt, Bordetella pertussis
gauggcgguggu

SEQ ID NO: 425945 - RNA, 14 nt, Bordetella pertussis
gauggcggugguga

SEQ ID NO: 425946 - RNA, 15 nt, Bordetella pertussis
gauggcgguggugau

SEQ ID NO: 425947 - RNA, 17 nt, Bordetella pertussis
gauggcgguggugggca

SEQ ID NO: 425948 - RNA, 20 nt, Bordetella pertussis
gauggcguaggcggccuuga

SEQ ID NO: 425949 - RNA, 16 nt, Bordetella pertussis
gauggcucgggcagca

SEQ ID NO: 425950 - RNA, 18 nt, Bordetella pertussis
gaugucggugaaggccac

SEQ ID NO: 425951 - RNA, 17 nt, Bordetella pertussis
gaugugacggaccuugu

SEQ ID NO: 425952 - RNA, 23 nt, Bordetella pertussis
gaugugcagcgcacgguccaggc

SEQ ID NO: 425953 - RNA, 14 nt, Bordetella pertussis
gauguggcgcuggc

SEQ ID NO: 425954 - RNA, 19 nt, Bordetella pertussis
gauguggcgcuggcggcug

SEQ ID NO: 425955 - RNA, 20 nt, Bordetella pertussis
gauguggcgcuggcggcugc

SEQ ID NO: 425956 - RNA, 17 nt, Bordetella pertussis
gauguugaacagcugga

SEQ ID NO: 425957 - RNA, 20 nt, Bordetella pertussis
gauguuguuggccgccagcc

SEQ ID NO: 425958 - RNA, 13 nt, Bordetella pertussis
gauucccaggccc

SEQ ID NO: 425959 - RNA, 20 nt, Bordetella pertussis
gauucccaggcccggccgca

SEQ ID NO: 425960 - RNA, 23 nt, Bordetella pertussis
gauucccuggcgcgccagcucgc

SEQ ID NO: 425961 - RNA, 13 nt, Bordetella pertussis
gauuccgcuggcg

SEQ ID NO: 425962 - RNA, 21 nt, Bordetella pertussis
gauuccugcgaggacaggggc

SEQ ID NO: 425963 - RNA, 19 nt, Bordetella pertussis
gauuccugucgcgcugcuu

SEQ ID NO: 425964 - RNA, 13 nt, Bordetella pertussis
gauuccugggugc

SEQ ID NO: 425965 - RNA, 14 nt, Bordetella pertussis
gauucgauugccug

SEQ ID NO: 425966 - RNA, 18 nt, Bordetella pertussis
gauugcagguggccagcc

SEQ ID NO: 425967 - RNA, 17 nt, Bordetella pertussis
gauugcaucuccaggau

SEQ ID NO: 425968 - RNA, 19 nt, Bordetella pertussis
gauuucggcggccaggccc

SEQ ID NO: 425969 - RNA, 17 nt, Bordetella pertussis
gcaaaaccgggcccgga

SEQ ID NO: 425970 - RNA, 22 nt, Bordetella pertussis
gcaaaacggugccuugcggcgc

SEQ ID NO: 425971 - RNA, 18 nt, Bordetella pertussis
gcaacacgaccagcaggc

SEQ ID NO: 425972 - RNA, 15 nt, Bordetella pertussis
gcaaccaggggcggc

SEQ ID NO: 425973 - RNA, 16 nt, Bordetella pertussis
gcaaccaggggcggcg

SEQ ID NO: 425974 - RNA, 21 nt, Bordetella pertussis
gcaaccaggggcggcgcggcg

SEQ ID NO: 425975 - RNA, 19 nt, Bordetella pertussis
gcaacccacccccagcagc

SEQ ID NO: 425976 - RNA, 16 nt, Bordetella pertussis
gcaacccagcagcggc

SEQ ID NO: 425977 - RNA, 22 nt, Bordetella pertussis
gcaaccccaccggcaagccuug

SEQ ID NO: 425978 - RNA, 14 nt, Bordetella pertussis
gcaaccccagcagc

SEQ ID NO: 425979 - RNA, 23 nt, Bordetella pertussis
gcaaccgccacgugcugcuggag

SEQ ID NO: 425980 - RNA, 24 nt, Bordetella pertussis
gcaaccgucggugaugcucugccc

SEQ ID NO: 425981 - RNA, 18 nt, Bordetella pertussis
gcaaccugcacgcgggcg

SEQ ID NO: 425982 - RNA, 20 nt, Bordetella pertussis
gcaaccuggucaagggcggc

SEQ ID NO: 425983 - RNA, 16 nt, Bordetella pertussis
gcaacgccacgcgcgg

SEQ ID NO: 425984 - RNA, 14 nt, Bordetella pertussis
gcaacgccagcagg

SEQ ID NO: 425985 - RNA, 15 nt, Bordetella pertussis
gcaacgccagcaggc

SEQ ID NO: 425986 - RNA, 16 nt, Bordetella pertussis
gcaacgccagcaggcg

SEQ ID NO: 425987 - RNA, 21 nt, Bordetella pertussis
gcaacgccgccggcagggcca

SEQ ID NO: 425988 - RNA, 21 nt, Bordetella pertussis
gcaacgccggccgccauggcc

SEQ ID NO: 425989 - RNA, 14 nt, Bordetella pertussis
gcaacgccgccacc

SEQ ID NO: 425990 - RNA, 20 nt, Bordetella pertussis
gcaacgcgcgcgcgcacagg

SEQ ID NO: 425991 - RNA, 17 nt, Bordetella pertussis
gcaacgggucgcgcagc

SEQ ID NO: 425992 - RNA, 15 nt, Bordetella pertussis
gcaacgugcaggcca

SEQ ID NO: 425993 - RNA, 17 nt, Bordetella pertussis
gcaacuccacgcccugc

SEQ ID NO: 425994 - RNA, 14 nt, Bordetella pertussis
gcaacuccagcaua

SEQ ID NO: 425995 - RNA, 16 nt, Bordetella pertussis
gcaagacgcccaggcc

SEQ ID NO: 425996 - RNA, 20 nt, Bordetella pertussis
gcaagcguacguaccaggcc

SEQ ID NO: 425997 - RNA, 14 nt, Bordetella pertussis
gcaagcugcugcug

SEQ ID NO: 425998 - RNA, 16 nt, Bordetella pertussis
gcaagcugcugcugga

SEQ ID NO: 425999 - RNA, 19 nt, Bordetella pertussis
gcaagcugcuggcgcgcca

SEQ ID NO: 426000 - RNA, 23 nt, Bordetella pertussis
gcaagcugcuggcgcgccaggcg

SEQ ID NO: 426001 - RNA, 21 nt, Bordetella pertussis
gcaagcuggcggcgcgcggcu

SEQ ID NO: 426002 - RNA, 19 nt, Bordetella pertussis
gcaaggaaguggccgagcg

SEQ ID NO: 426003 - RNA, 12 nt, Bordetella pertussis
gcaaggacaagg

SEQ ID NO: 426004 - RNA, 14 nt, Bordetella pertussis
gcaaggacaaggcg

SEQ ID NO: 426005 - RNA, 20 nt, Bordetella pertussis
gcaaggcaugcgccagcgcc

SEQ ID NO: 426006 - RNA, 16 nt, Bordetella pertussis
gcaaggcccgccgcgg

SEQ ID NO: 426007 - RNA, 17 nt, Bordetella pertussis
gcaaggcccgccgcggc

SEQ ID NO: 426008 - RNA, 19 nt, Bordetella pertussis
gcaaggcggcaaacccggc

SEQ ID NO: 426009 - RNA, 18 nt, Bordetella pertussis
gcaaggcggcccggccgc

SEQ ID NO: 426010 - RNA, 18 nt, Bordetella pertussis
gcaaggcgggcuggucgc

SEQ ID NO: 426011 - RNA, 17 nt, Bordetella pertussis
gcaaggcgucggccagg

SEQ ID NO: 426012 - RNA, 19 nt, Bordetella pertussis
gcaaggcgucggccaggcc

SEQ ID NO: 426013 - RNA, 14 nt, Bordetella pertussis
gcaagggccccagc

SEQ ID NO: 426014 - RNA, 18 nt, Bordetella pertussis
gcaagggccccagcaucu

SEQ ID NO: 426015 - RNA, 22 nt, Bordetella pertussis
gcaagggccccccggcgcggcc

SEQ ID NO: 426016 - RNA, 19 nt, Bordetella pertussis
gcaaguucgcugccgggau

SEQ ID NO: 426017 - RNA, 14 nt, Bordetella pertussis
gcaauaccuucagc

SEQ ID NO: 426018 - RNA, 21 nt, Bordetella pertussis
gcaauacgucgcgaccgccgc

SEQ ID NO: 426019 - RNA, 22 nt, Bordetella pertussis
gcaaucgaaaagcccgccgagu

SEQ ID NO: 426020 - RNA, 19 nt, Bordetella pertussis
gcaaucgggguggcgccgu

SEQ ID NO: 426021 - RNA, 19 nt, Bordetella pertussis
gcacaccccgggcgggcac

SEQ ID NO: 426022 - RNA, 23 nt, Bordetella pertussis
gcacagcaacucuuccccgucgg

SEQ ID NO: 426023 - RNA, 17 nt, Bordetella pertussis
gcacagcaugcgcuggu

SEQ ID NO: 426024 - RNA, 14 nt, Bordetella pertussis
gcacagccgcagcc

SEQ ID NO: 426025 - RNA, 23 nt, Bordetella pertussis
gcacagcgcggcgaugccccagu

SEQ ID NO: 426026 - RNA, 22 nt, Bordetella pertussis
gcacaggauggcgaucaggaaa

SEQ ID NO: 426027 - RNA, 15 nt, Bordetella pertussis
gcacaggaacagccu

SEQ ID NO: 426028 - RNA, 16 nt, Bordetella pertussis
gcacaggcgcucgccc

SEQ ID NO: 426029 - RNA, 13 nt, Bordetella pertussis
gcacaggcggcgc

SEQ ID NO: 426030 - RNA, 14 nt, Bordetella pertussis
gcacaggcggcgcc

SEQ ID NO: 426031 - RNA, 17 nt, Bordetella pertussis
gcacaggcggcgccggc

SEQ ID NO: 426032 - RNA, 24 nt, Bordetella pertussis
gcacauccagcgccagcaccggca

SEQ ID NO: 426033 - RNA, 13 nt, Bordetella pertussis
gcacaucgcccgu

SEQ ID NO: 426034 - RNA, 14 nt, Bordetella pertussis
gcacaucggccacc

SEQ ID NO: 426035 - RNA, 17 nt, Bordetella pertussis
gcacaugcccggccacc

SEQ ID NO: 426036 - RNA, 21 nt, Bordetella pertussis
gcacaugcccggccaccagcg

SEQ ID NO: 426037 - RNA, 15 nt, Bordetella pertussis
gcaccaauccccccc

SEQ ID NO: 426038 - RNA, 14 nt, Bordetella pertussis
gcaccacaucgccg

SEQ ID NO: 426039 - RNA, 19 nt, Bordetella pertussis
gcaccacaucgccggcggc

SEQ ID NO: 426040 - RNA, 18 nt, Bordetella pertussis
gcaccaccaccaugugcu

SEQ ID NO: 426041 - RNA, 15 nt, Bordetella pertussis
gcaccaccagcaccg

SEQ ID NO: 426042 - RNA, 11 nt, Bordetella pertussis
gcaccagcagc

SEQ ID NO: 426043 - RNA, 15 nt, Bordetella pertussis
gcaccagcagcccca

SEQ ID NO: 426044 - RNA, 14 nt, Bordetella pertussis
gcaccagcccgaug

SEQ ID NO: 426045 - RNA, 16 nt, Bordetella pertussis
gcaccagcccgcccgc

SEQ ID NO: 426046 - RNA, 16 nt, Bordetella pertussis
gcaccagcgaggcggc

SEQ ID NO: 426047 - RNA, 22 nt, Bordetella pertussis
gcaccagcgccgacggcauggc

SEQ ID NO: 426048 - RNA, 16 nt, Bordetella pertussis
gcaccagcgccugccg

SEQ ID NO: 426049 - RNA, 17 nt, Bordetella pertussis
gcaccagcgcgccgcgc

SEQ ID NO: 426050 - RNA, 14 nt, Bordetella pertussis
gcaccagggcgcgc

SEQ ID NO: 426051 - RNA, 22 nt, Bordetella pertussis
gcaccagggcgcgcagcaggcc

SEQ ID NO: 426052 - RNA, 14 nt, Bordetella pertussis
gcaccagguccugg

SEQ ID NO: 426053 - RNA, 21 nt, Bordetella pertussis
gcaccagguccuggcggccgc

SEQ ID NO: 426054 - RNA, 16 nt, Bordetella pertussis
gcaccagucccgcacc

SEQ ID NO: 426055 - RNA, 16 nt, Bordetella pertussis
gcaccagugcgccggc

SEQ ID NO: 426056 - RNA, 18 nt, Bordetella pertussis
gcaccagugcgccggcgc

SEQ ID NO: 426057 - RNA, 21 nt, Bordetella pertussis
gcaccagugcgccggcgcggc

SEQ ID NO: 426058 - RNA, 20 nt, Bordetella pertussis
gcaccaguuuucucauggcc

SEQ ID NO: 426059 - RNA, 20 nt, Bordetella pertussis
gcaccaguuucucggccacu

SEQ ID NO: 426060 - RNA, 21 nt, Bordetella pertussis
gcaccaguuucucggccacuu

SEQ ID NO: 426061 - RNA, 12 nt, Bordetella pertussis
gcaccaucgccg

SEQ ID NO: 426062 - RNA, 15 nt, Bordetella pertussis
gcaccaucgccgagc

SEQ ID NO: 426063 - RNA, 15 nt, Bordetella pertussis
gcaccaucgccgccu

SEQ ID NO: 426064 - RNA, 17 nt, Bordetella pertussis
gcaccaugugcgagagc

SEQ ID NO: 426065 - RNA, 20 nt, Bordetella pertussis
gcacccacacuuggccggcg

SEQ ID NO: 426066 - RNA, 15 nt, Bordetella pertussis
gcacccaggcgggcu

SEQ ID NO: 426067 - RNA, 16 nt, Bordetella pertussis
gcacccaggcgggcug

SEQ ID NO: 426068 - RNA, 13 nt, Bordetella pertussis
gcaccccagcacc

SEQ ID NO: 426069 - RNA, 17 nt, Bordetella pertussis
gcacccccgaccgagcc

SEQ ID NO: 426070 - RNA, 15 nt, Bordetella pertussis
gcaccccggcgccgc

SEQ ID NO: 426071 - RNA, 21 nt, Bordetella pertussis
gcaccccgucaugcgccauga

SEQ ID NO: 426072 - RNA, 20 nt, Bordetella pertussis
gcaccccgucggcucagucc

SEQ ID NO: 426073 - RNA, 21 nt, Bordetella pertussis
gcaccccgucggcucagucca

SEQ ID NO: 426074 - RNA, 20 nt, Bordetella pertussis
gcacccgaugacggggcggc

SEQ ID NO: 426075 - RNA, 12 nt, Bordetella pertussis
gcacccgcaaga

SEQ ID NO: 426076 - RNA, 22 nt, Bordetella pertussis
gcacccgcacgggcagacgcca

SEQ ID NO: 426077 - RNA, 13 nt, Bordetella pertussis
gcacccgcaggcc

SEQ ID NO: 426078 - RNA, 15 nt, Bordetella pertussis
gcacccgcaggcggc

SEQ ID NO: 426079 - RNA, 19 nt, Bordetella pertussis
gcacccgcaggcggcuggu

SEQ ID NO: 426080 - RNA, 15 nt, Bordetella pertussis
gcacccgcauggugg

SEQ ID NO: 426081 - RNA, 21 nt, Bordetella pertussis
gcacccgcaugguggcgcagg

SEQ ID NO: 426082 - RNA, 15 nt, Bordetella pertussis
gcacccgcgcgcagc

SEQ ID NO: 426083 - RNA, 13 nt, Bordetella pertussis
gcacccgcggcgc

SEQ ID NO: 426084 - RNA, 20 nt, Bordetella pertussis
gcacccgcuaccccggcagc

SEQ ID NO: 426085 - RNA, 13 nt, Bordetella pertussis
gcacccggccgcu

SEQ ID NO: 426086 - RNA, 21 nt, Bordetella pertussis
gcacccggccgcuguagaagu

SEQ ID NO: 426087 - RNA, 15 nt, Bordetella pertussis
gcacccuugccgcag

SEQ ID NO: 426088 - RNA, 14 nt, Bordetella pertussis
gcacccuugccgcg

SEQ ID NO: 426089 - RNA, 15 nt, Bordetella pertussis
gcacccuugcucagu

SEQ ID NO: 426090 - RNA, 17 nt, Bordetella pertussis
gcaccgaacccugccuc

SEQ ID NO: 426091 - RNA, 23 nt, Bordetella pertussis
gcaccgaacccugccucagacca

SEQ ID NO: 426092 - RNA, 23 nt, Bordetella pertussis
gcaccgaacgggcguggcgcagg

SEQ ID NO: 426093 - RNA, 13 nt, Bordetella pertussis
gcaccgacacgcu

SEQ ID NO: 426094 - RNA, 17 nt, Bordetella pertussis
gcaccgacacgcuggcg

SEQ ID NO: 426095 - RNA, 15 nt, Bordetella pertussis
gcaccgacagcaagg

SEQ ID NO: 426096 - RNA, 14 nt, Bordetella pertussis
gcaccgaccagcgc

SEQ ID NO: 426097 - RNA, 14 nt, Bordetella pertussis
gcaccgacugcgca

SEQ ID NO: 426098 - RNA, 16 nt, Bordetella pertussis
gcaccgagaccgggcg

SEQ ID NO: 426099 - RNA, 20 nt, Bordetella pertussis
gcaccgcgaccaugcggccg

SEQ ID NO: 426100 - RNA, 14 nt, Bordetella pertussis
gcaccgcgcagccc

SEQ ID NO: 426101 - RNA, 22 nt, Bordetella pertussis
gcaccgccugcugcgccuggcc

SEQ ID NO: 426102 - RNA, 20 nt, Bordetella pertussis
gcaccgcgucggccugccag

SEQ ID NO: 426103 - RNA, 22 nt, Bordetella pertussis
gcaccgcgucggccugccagcc

SEQ ID NO: 426104 - RNA, 16 nt, Bordetella pertussis
gcaccggaggcgccgc

SEQ ID NO: 426105 - RNA, 17 nt, Bordetella pertussis
gcaccggcagauggugc

SEQ ID NO: 426106 - RNA, 19 nt, Bordetella pertussis
gcaccggcagauggugcuc

SEQ ID NO: 426107 - RNA, 21 nt, Bordetella pertussis
gcaccggccaggggcgcuggu

SEQ ID NO: 426108 - RNA, 12 nt, Bordetella pertussis
gcaccggccagu

SEQ ID NO: 426109 - RNA, 21 nt, Bordetella pertussis
gcaccuagcauaucggugccc

SEQ ID NO: 426110 - RNA, 14 nt, Bordetella pertussis
gcaccugccgacuu

SEQ ID NO: 426111 - RNA, 13 nt, Bordetella pertussis
gcaccugccugcc

SEQ ID NO: 426112 - RNA, 16 nt, Bordetella pertussis
gcaccugccugccgcc

SEQ ID NO: 426113 - RNA, 17 nt, Bordetella pertussis
gcaccugccugccgccu

SEQ ID NO: 426114 - RNA, 18 nt, Bordetella pertussis
gcaccugccugccgccug

SEQ ID NO: 426115 - RNA, 19 nt, Bordetella pertussis
gcaccugccugccgccugc

SEQ ID NO: 426116 - RNA, 19 nt, Bordetella pertussis
gcaccugcgaccgagccac

SEQ ID NO: 426117 - RNA, 17 nt, Bordetella pertussis
gcaccugcgucugcacg

SEQ ID NO: 426118 - RNA, 14 nt, Bordetella pertussis
gcaccugcguggcc

SEQ ID NO: 426119 - RNA, 19 nt, Bordetella pertussis
gcaccugcugcggcacggc

SEQ ID NO: 426120 - RNA, 13 nt, Bordetella pertussis
gcaccugggaggg

SEQ ID NO: 426121 - RNA, 14 nt, Bordetella pertussis
gcacgaaccacagg

SEQ ID NO: 426122 - RNA, 15 nt, Bordetella pertussis
gcacgaagcggaugc

SEQ ID NO: 426123 - RNA, 19 nt, Bordetella pertussis
gcacgaagggcagcagcag

SEQ ID NO: 426124 - RNA, 19 nt, Bordetella pertussis
gcacgaaguacucgccggc

SEQ ID NO: 426125 - RNA, 20 nt, Bordetella pertussis
gcacgaaguacucgccggcg

SEQ ID NO: 426126 - RNA, 15 nt, Bordetella pertussis
gcacgaucuggcgcg

SEQ ID NO: 426127 - RNA, 17 nt, Bordetella pertussis
gcacgaucuugauccag

SEQ ID NO: 426128 - RNA, 16 nt, Bordetella pertussis
gcacgaucgcggcgcu

SEQ ID NO: 426129 - RNA, 16 nt, Bordetella pertussis
gcacgauggcgccggc

SEQ ID NO: 426130 - RNA, 17 nt, Bordetella pertussis
gcacgauggcgccggcu

SEQ ID NO: 426131 - RNA, 11 nt, Bordetella pertussis
gcacgaugccg

SEQ ID NO: 426132 - RNA, 19 nt, Bordetella pertussis
gcacgaugccgucgccgcc

SEQ ID NO: 426133 - RNA, 13 nt, Bordetella pertussis
gcacgauggggcc

SEQ ID NO: 426134 - RNA, 23 nt, Bordetella pertussis
gcacgauuccgccuacuggcgcg

SEQ ID NO: 426135 - RNA, 17 nt, Bordetella pertussis
gcacgauuucacccagg

SEQ ID NO: 426136 - RNA, 15 nt, Bordetella pertussis
gcacgcacagcaugc

SEQ ID NO: 426137 - RNA, 16 nt, Bordetella pertussis
gcacgcaccaggcgca

SEQ ID NO: 426138 - RNA, 23 nt, Bordetella pertussis
gcacgcaggauaccggagcggcu

SEQ ID NO: 426139 - RNA, 15 nt, Bordetella pertussis
gcacgccggccuugc

SEQ ID NO: 426140 - RNA, 15 nt, Bordetella pertussis
gcacgccgggcgcgc

SEQ ID NO: 426141 - RNA, 20 nt, Bordetella pertussis
gcacgccgggcgcgcugccc

SEQ ID NO: 426142 - RNA, 17 nt, Bordetella pertussis
gcacgccgggcgcggcc

SEQ ID NO: 426143 - RNA, 15 nt, Bordetella pertussis
gcacgccucgccggc

SEQ ID NO: 426144 - RNA, 21 nt, Bordetella pertussis
gcacgccuugcucgaccaggu

SEQ ID NO: 426145 - RNA, 14 nt, Bordetella pertussis
gcacgcgccaggcg

SEQ ID NO: 426146 - RNA, 15 nt, Bordetella pertussis
gcacgcgcgcgggcg

SEQ ID NO: 426147 - RNA, 15 nt, Bordetella pertussis
gcacgcgcgcgugca

SEQ ID NO: 426148 - RNA, 21 nt, Bordetella pertussis
gcacgcgcggcagcgccgggu

SEQ ID NO: 426149 - RNA, 21 nt, Bordetella pertussis
gcacgcgcgguucgccgugca

SEQ ID NO: 426150 - RNA, 12 nt, Bordetella pertussis
gcacgcgcguga

SEQ ID NO: 426151 - RNA, 15 nt, Bordetella pertussis
gcacgcggcgcagca

SEQ ID NO: 426152 - RNA, 15 nt, Bordetella pertussis
gcacuugcgaacggc

SEQ ID NO: 426153 - RNA, 13 nt, Bordetella pertussis
gcagaaaccccag

SEQ ID NO: 426154 - RNA, 23 nt, Bordetella pertussis
gcagaaggucugggccagcaggc

SEQ ID NO: 426155 - RNA, 21 nt, Bordetella pertussis
gcagaccacgccggcggucac

SEQ ID NO: 426156 - RNA, 12 nt, Bordetella pertussis
gcagacccgcgc

SEQ ID NO: 426157 - RNA, 15 nt, Bordetella pertussis
gcagaccgagcgcgc

SEQ ID NO: 426158 - RNA, 19 nt, Bordetella pertussis
gcagacgccaucuugcagg

SEQ ID NO: 426159 - RNA, 21 nt, Bordetella pertussis
gcagacgcgcucaggcgguga

SEQ ID NO: 426160 - RNA, 17 nt, Bordetella pertussis
gcagacgcuucaggccg

SEQ ID NO: 426161 - RNA, 15 nt, Bordetella pertussis
gcagacuguucagaa

SEQ ID NO: 426162 - RNA, 21 nt, Bordetella pertussis
gcagagacagauaccgccuug

SEQ ID NO: 426163 - RNA, 19 nt, Bordetella pertussis
gcagagcaccacggcgcgc

SEQ ID NO: 426164 - RNA, 21 nt, Bordetella pertussis
gcagauccucgaacaggccau

SEQ ID NO: 426165 - RNA, 20 nt, Bordetella pertussis
gcagaucggcgcuggccugg

SEQ ID NO: 426166 - RNA, 18 nt, Bordetella pertussis
gcagaucggcggccuggg

SEQ ID NO: 426167 - RNA, 15 nt, Bordetella pertussis
gcagaucgcggcggg

SEQ ID NO: 426168 - RNA, 19 nt, Bordetella pertussis
gcagaugaucuacgcgcgc

SEQ ID NO: 426169 - RNA, 14 nt, Bordetella pertussis
gcagaugcgacugg

SEQ ID NO: 426170 - RNA, 17 nt, Bordetella pertussis
gcagauggccagcagcg

SEQ ID NO: 426171 - RNA, 15 nt, Bordetella pertussis
gcagauggcggaugg

SEQ ID NO: 426172 - RNA, 19 nt, Bordetella pertussis
gcagauggcggcgaugccg

SEQ ID NO: 426173 - RNA, 20 nt, Bordetella pertussis
gcagauggcguaggcggccu

SEQ ID NO: 426174 - RNA, 21 nt, Bordetella pertussis
gcagauggcuuucuaucauca

SEQ ID NO: 426175 - RNA, 12 nt, Bordetella pertussis
gcagcaacggug

SEQ ID NO: 426176 - RNA, 16 nt, Bordetella pertussis
gcagcaagcccaccgg

SEQ ID NO: 426177 - RNA, 16 nt, Bordetella pertussis
gcagcaagcugcugcu

SEQ ID NO: 426178 - RNA, 22 nt, Bordetella pertussis
gcagcaagcugucggacgagca

SEQ ID NO: 426179 - RNA, 18 nt, Bordetella pertussis
gcagcaaggcgcgccacc

SEQ ID NO: 426180 - RNA, 16 nt, Bordetella pertussis
gcagcaagucagcccg

SEQ ID NO: 426181 - RNA, 21 nt, Bordetella pertussis
gcagcaauugccccagcacga

SEQ ID NO: 426182 - RNA, 23 nt, Bordetella pertussis
gcagcacacgcauuugcagcggc

SEQ ID NO: 426183 - RNA, 14 nt, Bordetella pertussis
gcagcaccggcaga

SEQ ID NO: 426184 - RNA, 15 nt, Bordetella pertussis
gcagcaccgugccgg

SEQ ID NO: 426185 - RNA, 22 nt, Bordetella pertussis
gcagcaccucggacgagacagg

SEQ ID NO: 426186 - RNA, 18 nt, Bordetella pertussis
gcagcaccucggcguggc

SEQ ID NO: 426187 - RNA, 21 nt, Bordetella pertussis
gcagcaccucggcguggcggg

SEQ ID NO: 426188 - RNA, 21 nt, Bordetella pertussis
gcagcaccucggggcgcggcc

SEQ ID NO: 426189 - RNA, 18 nt, Bordetella pertussis
gcagcaccuucugccgcc

SEQ ID NO: 426190 - RNA, 21 nt, Bordetella pertussis
gcagcaccuucugccgccagg

SEQ ID NO: 426191 - RNA, 22 nt, Bordetella pertussis
gcagcaccuucugccgccaggc

SEQ ID NO: 426192 - RNA, 19 nt, Bordetella pertussis
gcagcacgauggcgcccac

SEQ ID NO: 426193 - RNA, 18 nt, Bordetella pertussis
gcagcacgcaccaggcgc

SEQ ID NO: 426194 - RNA, 16 nt, Bordetella pertussis
gcagcacgcccauggu

SEQ ID NO: 426195 - RNA, 20 nt, Bordetella pertussis
gcagcacgcccauggucagg

SEQ ID NO: 426196 - RNA, 14 nt, Bordetella pertussis
gcagcacgccgcgc

SEQ ID NO: 426197 - RNA, 19 nt, Bordetella pertussis
gcagcacgccgcgccaggc

SEQ ID NO: 426198 - RNA, 17 nt, Bordetella pertussis
gcagcacggccacggcc

SEQ ID NO: 426199 - RNA, 13 nt, Bordetella pertussis
gcagcagcgcggu

SEQ ID NO: 426200 - RNA, 16 nt, Bordetella pertussis
gcagcagcgcgguggc

SEQ ID NO: 426201 - RNA, 20 nt, Bordetella pertussis
gcagcagcggcagcucggcg

SEQ ID NO: 426202 - RNA, 18 nt, Bordetella pertussis
gcagcaggaacaggcugc

SEQ ID NO: 426203 - RNA, 14 nt, Bordetella pertussis
gcagcaggccagga

SEQ ID NO: 426204 - RNA, 22 nt, Bordetella pertussis
gcagcaggccaggaagcggcgc

SEQ ID NO: 426205 - RNA, 16 nt, Bordetella pertussis
gcagcaggcccaugcc

SEQ ID NO: 426206 - RNA, 14 nt, Bordetella pertussis
gcagcaggcccucc

SEQ ID NO: 426207 - RNA, 15 nt, Bordetella pertussis
gcagcaggccgcgcg

SEQ ID NO: 426208 - RNA, 16 nt, Bordetella pertussis
gcagcaggccggcggc

SEQ ID NO: 426209 - RNA, 12 nt, Bordetella pertussis
gcagcaggcgca

SEQ ID NO: 426210 - RNA, 17 nt, Bordetella pertussis
gcagcaggcgcgcggcc

SEQ ID NO: 426211 - RNA, 16 nt, Bordetella pertussis
gcagcaggcgcgugcu

SEQ ID NO: 426212 - RNA, 13 nt, Bordetella pertussis
gcagcaggcgcuc

SEQ ID NO: 426213 - RNA, 16 nt, Bordetella pertussis
gcagcagggccaggcc

SEQ ID NO: 426214 - RNA, 13 nt, Bordetella pertussis
gcagcagggccug

SEQ ID NO: 426215 - RNA, 18 nt, Bordetella pertussis
gcagccacuggaacagcu

SEQ ID NO: 426216 - RNA, 17 nt, Bordetella pertussis
gcagccagaacaugagc

SEQ ID NO: 426217 - RNA, 21 nt, Bordetella pertussis
gcagccagaacaugagccaug

SEQ ID NO: 426218 - RNA, 20 nt, Bordetella pertussis
gcagccagguaagcuggcgc

SEQ ID NO: 426219 - RNA, 21 nt, Bordetella pertussis
gcagccagguaagcuggcgcu

SEQ ID NO: 426220 - RNA, 17 nt, Bordetella pertussis
gcagccauucggccagg

SEQ ID NO: 426221 - RNA, 20 nt, Bordetella pertussis
gcagcccacucagggcgggg

SEQ ID NO: 426222 - RNA, 19 nt, Bordetella pertussis
gcagccgacaggcgcgcag

SEQ ID NO: 426223 - RNA, 16 nt, Bordetella pertussis
gcagccgcaccagcgc

SEQ ID NO: 426224 - RNA, 17 nt, Bordetella pertussis
gcagccgcaccagcgca

SEQ ID NO: 426225 - RNA, 17 nt, Bordetella pertussis
gcagccgccagcgccug

SEQ ID NO: 426226 - RNA, 13 nt, Bordetella pertussis
gcagccgccgcga

SEQ ID NO: 426227 - RNA, 22 nt, Bordetella pertussis
gcagccgcgccaagggcgugcg

SEQ ID NO: 426228 - RNA, 15 nt, Bordetella pertussis
gcagccgcgcgccuu

SEQ ID NO: 426229 - RNA, 19 nt, Bordetella pertussis
gcagccgggcugccggcag

SEQ ID NO: 426230 - RNA, 18 nt, Bordetella pertussis
gcagccgguuggcgccuu

SEQ ID NO: 426231 - RNA, 23 nt, Bordetella pertussis
gcagccgguuggcgccuuccggc

SEQ ID NO: 426232 - RNA, 15 nt, Bordetella pertussis
gcagccuugaaagag

SEQ ID NO: 426233 - RNA, 15 nt, Bordetella pertussis
gcagcgacuucuacc

SEQ ID NO: 426234 - RNA, 18 nt, Bordetella pertussis
gcagcgagagcgccacgc

SEQ ID NO: 426235 - RNA, 21 nt, Bordetella pertussis
gcagcgacuugucgcgcccga

SEQ ID NO: 426236 - RNA, 19 nt, Bordetella pertussis
gcagcgagaacagccacac

SEQ ID NO: 426237 - RNA, 13 nt, Bordetella pertussis
gcagcgagcccgc

SEQ ID NO: 426238 - RNA, 17 nt, Bordetella pertussis
gcagcgaggacacgcag

SEQ ID NO: 426239 - RNA, 13 nt, Bordetella pertussis
gcagcgaggcgca

SEQ ID NO: 426240 - RNA, 21 nt, Bordetella pertussis
gcagcgugauggggccgggcg

SEQ ID NO: 426241 - RNA, 17 nt, Bordetella pertussis
gcagcgugcggaccagc

SEQ ID NO: 426242 - RNA, 17 nt, Bordetella pertussis
gcagcguggccgccacc

SEQ ID NO: 426243 - RNA, 13 nt, Bordetella pertussis
gcagcguuucacc

SEQ ID NO: 426244 - RNA, 14 nt, Bordetella pertussis
gcagcuccucggcc

SEQ ID NO: 426245 - RNA, 22 nt, Bordetella pertussis
gcagcuccucggccugccggcg

SEQ ID NO: 426246 - RNA, 23 nt, Bordetella pertussis
gcagcucggcgaucugcgcggcg

SEQ ID NO: 426247 - RNA, 17 nt, Bordetella pertussis
gcagcuggcgcgggcgg

SEQ ID NO: 426248 - RNA, 15 nt, Bordetella pertussis
gcagcuguagcccug

SEQ ID NO: 426249 - RNA, 16 nt, Bordetella pertussis
gcagcuguagcccugg

SEQ ID NO: 426250 - RNA, 17 nt, Bordetella pertussis
gcagcuguagcccuggc

SEQ ID NO: 426251 - RNA, 18 nt, Bordetella pertussis
gcaggaacaggcugcgca

SEQ ID NO: 426252 - RNA, 17 nt, Bordetella pertussis
gcaggaauccuggugcc

SEQ ID NO: 426253 - RNA, 22 nt, Bordetella pertussis
gcaggaauuccucgcggcuguc

SEQ ID NO: 426254 - RNA, 21 nt, Bordetella pertussis
gcaggacgaacaggccgccgu

SEQ ID NO: 426255 - RNA, 13 nt, Bordetella pertussis
gcaggacgccggc

SEQ ID NO: 426256 - RNA, 14 nt, Bordetella pertussis
gcaggacgccggcg

SEQ ID NO: 426257 - RNA, 15 nt, Bordetella pertussis
gcaggaugaggcgcc

SEQ ID NO: 426258 - RNA, 15 nt, Bordetella pertussis
gcaggaugcgcggca

SEQ ID NO: 426259 - RNA, 23 nt, Bordetella pertussis
gcaggauggcgucgaccgccaug

SEQ ID NO: 426260 - RNA, 13 nt, Bordetella pertussis
gcaggcccugccg

SEQ ID NO: 426261 - RNA, 16 nt, Bordetella pertussis
gcaggcccugggcgag

SEQ ID NO: 426262 - RNA, 19 nt, Bordetella pertussis
gcaggccgaggaccugcug

SEQ ID NO: 426263 - RNA, 23 nt, Bordetella pertussis
gcaggccgaggaccugcuggcgu

SEQ ID NO: 426264 - RNA, 21 nt, Bordetella pertussis
gcaggccgcgcgcauccaggu

SEQ ID NO: 426265 - RNA, 22 nt, Bordetella pertussis
gcaggccgcgcgugcggggcgg

SEQ ID NO: 426266 - RNA, 15 nt, Bordetella pertussis
gcaggccgcgcugcc

SEQ ID NO: 426267 - RNA, 17 nt, Bordetella pertussis
gcaggccgcgcuggugc

SEQ ID NO: 426268 - RNA, 19 nt, Bordetella pertussis
gcaggccgcgcuggugcug

SEQ ID NO: 426269 - RNA, 11 nt, Bordetella pertussis
gcaggccgcgg

SEQ ID NO: 426270 - RNA, 15 nt, Bordetella pertussis
gcaggccgcggccag

SEQ ID NO: 426271 - RNA, 16 nt, Bordetella pertussis
gcaggccgcggccagg

SEQ ID NO: 426272 - RNA, 18 nt, Bordetella pertussis
gcaggccgcggccaggcc

SEQ ID NO: 426273 - RNA, 22 nt, Bordetella pertussis
gcaggccgcggccaggcccaug

SEQ ID NO: 426274 - RNA, 20 nt, Bordetella pertussis
gcaggcccuugaucaggcgc

SEQ ID NO: 426275 - RNA, 20 nt, Bordetella pertussis
gcaggccgauguagcccaug

SEQ ID NO: 426276 - RNA, 16 nt, Bordetella pertussis
gcaggccgcagcgggc

SEQ ID NO: 426277 - RNA, 17 nt, Bordetella pertussis
gcaggccgcccagcgca

SEQ ID NO: 426278 - RNA, 13 nt, Bordetella pertussis
gcaggccgccggc

SEQ ID NO: 426279 - RNA, 15 nt, Bordetella pertussis
gcaggccgcgccggc

SEQ ID NO: 426280 - RNA, 14 nt, Bordetella pertussis
gcaggccggcgcgc

SEQ ID NO: 426281 - RNA, 12 nt, Bordetella pertussis
gcaggccgggca

SEQ ID NO: 426282 - RNA, 14 nt, Bordetella pertussis
gcaggcgcagcggc

SEQ ID NO: 426283 - RNA, 12 nt, Bordetella pertussis
gcaggcgcaggc

SEQ ID NO: 426284 - RNA, 17 nt, Bordetella pertussis
gcaggcgcaggccgcgc

SEQ ID NO: 426285 - RNA, 14 nt, Bordetella pertussis
gcaggcgcaucagc

SEQ ID NO: 426286 - RNA, 13 nt, Bordetella pertussis
gcaggcgccgcac

SEQ ID NO: 426287 - RNA, 12 nt, Bordetella pertussis
gcaggcgccgcc

SEQ ID NO: 426288 - RNA, 13 nt, Bordetella pertussis
gcaggcgccgccg

SEQ ID NO: 426289 - RNA, 16 nt, Bordetella pertussis
gcaggcgccggcuggc

SEQ ID NO: 426290 - RNA, 13 nt, Bordetella pertussis
gcaggcgccuucg

SEQ ID NO: 426291 - RNA, 15 nt, Bordetella pertussis
gcaggcgcgccgggc

SEQ ID NO: 426292 - RNA, 16 nt, Bordetella pertussis
gcaggcgcgccgggcc

SEQ ID NO: 426293 - RNA, 12 nt, Bordetella pertussis
gcaggcgcgcgc

SEQ ID NO: 426294 - RNA, 15 nt, Bordetella pertussis
gcaggcgcgcgccuu

SEQ ID NO: 426295 - RNA, 18 nt, Bordetella pertussis
gcaggcgcucgaggcgcu

SEQ ID NO: 426296 - RNA, 12 nt, Bordetella pertussis
gcaggcgcucgg

SEQ ID NO: 426297 - RNA, 13 nt, Bordetella pertussis
gcaggcgcugcag

SEQ ID NO: 426298 - RNA, 16 nt, Bordetella pertussis
gcaggcgcugcagcaa

SEQ ID NO: 426299 - RNA, 14 nt, Bordetella pertussis
gcaggcgcugcgca

SEQ ID NO: 426300 - RNA, 18 nt, Bordetella pertussis
gcaggcgcugcgcauaga

SEQ ID NO: 426301 - RNA, 12 nt, Bordetella pertussis
gcaggcgcuggu

SEQ ID NO: 426302 - RNA, 16 nt, Bordetella pertussis
gcaggcggcagaaggc

SEQ ID NO: 426303 - RNA, 21 nt, Bordetella pertussis
gcaggcggcagaaggcgacau

SEQ ID NO: 426304 - RNA, 15 nt, Bordetella pertussis
gcaggcggccgacca

SEQ ID NO: 426305 - RNA, 22 nt, Bordetella pertussis
gcaggcggcggccuccagcagg

SEQ ID NO: 426306 - RNA, 15 nt, Bordetella pertussis
gcaggcucagcccgg

SEQ ID NO: 426307 - RNA, 17 nt, Bordetella pertussis
gcaggcucagcccggcg

SEQ ID NO: 426308 - RNA, 16 nt, Bordetella pertussis
gcaggcuccacagcca

SEQ ID NO: 426309 - RNA, 20 nt, Bordetella pertussis
gcaggcuccacagccacugc

SEQ ID NO: 426310 - RNA, 18 nt, Bordetella pertussis
gcaggcuccucgccacac

SEQ ID NO: 426311 - RNA, 16 nt, Bordetella pertussis
gcaggcugauccaggu

SEQ ID NO: 426312 - RNA, 17 nt, Bordetella pertussis
gcaggcugccgccggcg

SEQ ID NO: 426313 - RNA, 13 nt, Bordetella pertussis
gcaggcuggaagu

SEQ ID NO: 426314 - RNA, 15 nt, Bordetella pertussis
gcaggcuggccggcg

SEQ ID NO: 426315 - RNA, 15 nt, Bordetella pertussis
gcaggcuggcgcggu

SEQ ID NO: 426316 - RNA, 19 nt, Bordetella pertussis
gcagggccagcgccagcac

SEQ ID NO: 426317 - RNA, 13 nt, Bordetella pertussis
gcagggccaggcc

SEQ ID NO: 426318 - RNA, 20 nt, Bordetella pertussis
gcagggccuggaagcuggcc

SEQ ID NO: 426319 - RNA, 14 nt, Bordetella pertussis
gcagggccuggcag

SEQ ID NO: 426320 - RNA, 18 nt, Bordetella pertussis
gcagggcgcaacgccggc

SEQ ID NO: 426321 - RNA, 14 nt, Bordetella pertussis
gcagggcgccgcgc

SEQ ID NO: 426322 - RNA, 15 nt, Bordetella pertussis
gcagggcgccgcgcg

SEQ ID NO: 426323 - RNA, 18 nt, Bordetella pertussis
gcagggcgccgcgcgguc

SEQ ID NO: 426324 - RNA, 20 nt, Bordetella pertussis
gcagggcggaaaacagcacc

SEQ ID NO: 426325 - RNA, 15 nt, Bordetella pertussis
gcagggcggccggca

SEQ ID NO: 426326 - RNA, 21 nt, Bordetella pertussis
gcagggcgggggacgcccgcc

SEQ ID NO: 426327 - RNA, 20 nt, Bordetella pertussis
gcagggcgucugcucgccgu

SEQ ID NO: 426328 - RNA, 20 nt, Bordetella pertussis
gcaggggauugccgcgcggu

SEQ ID NO: 426329 - RNA, 18 nt, Bordetella pertussis
gcaggggcucgcgcccga

SEQ ID NO: 426330 - RNA, 23 nt, Bordetella pertussis
gcaggggcucuucgacagcgcgc

SEQ ID NO: 426331 - RNA, 16 nt, Bordetella pertussis
gcagggucagcccgcc

SEQ ID NO: 426332 - RNA, 19 nt, Bordetella pertussis
gcagggucagcccgccauc

SEQ ID NO: 426333 - RNA, 14 nt, Bordetella pertussis
gcagggucagcggc

SEQ ID NO: 426334 - RNA, 15 nt, Bordetella pertussis
gcagggucagcggcc

SEQ ID NO: 426335 - RNA, 20 nt, Bordetella pertussis
gcagggucgagaccagcagc

SEQ ID NO: 426336 - RNA, 16 nt, Bordetella pertussis
gcagggucggccccau

SEQ ID NO: 426337 - RNA, 18 nt, Bordetella pertussis
gcagggugacgggcuggg

SEQ ID NO: 426338 - RNA, 14 nt, Bordetella pertussis
gcagggugcccagu

SEQ ID NO: 426339 - RNA, 15 nt, Bordetella pertussis
gcagggugcggggug

SEQ ID NO: 426340 - RNA, 20 nt, Bordetella pertussis
gcagggugucggccagggcg

SEQ ID NO: 426341 - RNA, 19 nt, Bordetella pertussis
gcagguacugggccaccuu

SEQ ID NO: 426342 - RNA, 22 nt, Bordetella pertussis
gcagguagucggucaccguccc

SEQ ID NO: 426343 - RNA, 22 nt, Bordetella pertussis
gcagguccugcacgcgggccag

SEQ ID NO: 426344 - RNA, 12 nt, Bordetella pertussis
gcagguccuggu

SEQ ID NO: 426345 - RNA, 22 nt, Bordetella pertussis
gcagguccugguaucccucgcc

SEQ ID NO: 426346 - RNA, 23 nt, Bordetella pertussis
gcagguccugguaucccucgccc

SEQ ID NO: 426347 - RNA, 16 nt, Bordetella pertussis
gcaggucgccagcagg

SEQ ID NO: 426348 - RNA, 17 nt, Bordetella pertussis
gcaggucgccagcaggc

SEQ ID NO: 426349 - RNA, 18 nt, Bordetella pertussis
gcaggucgccagcaggcc

SEQ ID NO: 426350 - RNA, 17 nt, Bordetella pertussis
gcaggucgaugcccucc

SEQ ID NO: 426351 - RNA, 17 nt, Bordetella pertussis
gcagguggccagcccgg

SEQ ID NO: 426352 - RNA, 17 nt, Bordetella pertussis
gcagguggggcagcagg

SEQ ID NO: 426353 - RNA, 19 nt, Bordetella pertussis
gcagguucugcgcguccug

SEQ ID NO: 426354 - RNA, 20 nt, Bordetella pertussis
gcagugguggugcagcggca

SEQ ID NO: 426355 - RNA, 16 nt, Bordetella pertussis
gcaguguuucggccug

SEQ ID NO: 426356 - RNA, 21 nt, Bordetella pertussis
gcaguguuucggccugcucgc

SEQ ID NO: 426357 - RNA, 15 nt, Bordetella pertussis
gcaguuccacaggag

SEQ ID NO: 426358 - RNA, 18 nt, Bordetella pertussis
gcaguucggcgucggugc

SEQ ID NO: 426359 - RNA, 18 nt, Bordetella pertussis
gcaguucggucagcgcgg

SEQ ID NO: 426360 - RNA, 21 nt, Bordetella pertussis
gcaguugcuggcggccgugcc

SEQ ID NO: 426361 - RNA, 13 nt, Bordetella pertussis
gcaguuggcggcg

SEQ ID NO: 426362 - RNA, 22 nt, Bordetella pertussis
gcauacaggcuguggccgcggc

SEQ ID NO: 426363 - RNA, 15 nt, Bordetella pertussis
gcauacccauggcca

SEQ ID NO: 426364 - RNA, 24 nt, Bordetella pertussis
gcauagcaguugacccauaccagc

SEQ ID NO: 426365 - RNA, 18 nt, Bordetella pertussis
gcauaggcggcgcaggcc

SEQ ID NO: 426366 - RNA, 20 nt, Bordetella pertussis
gccacagggcgaaggccagc

SEQ ID NO: 426367 - RNA, 15 nt, Bordetella pertussis
gccacaggugcgcgg

SEQ ID NO: 426368 - RNA, 18 nt, Bordetella pertussis
gccacaggugcgcggcgc

SEQ ID NO: 426369 - RNA, 12 nt, Bordetella pertussis
gccacaucaucg

SEQ ID NO: 426370 - RNA, 15 nt, Bordetella pertussis
gccacauccugcacg

SEQ ID NO: 426371 - RNA, 12 nt, Bordetella pertussis
gccaccaccggc

SEQ ID NO: 426372 - RNA, 15 nt, Bordetella pertussis
gccaccaccucggcc

SEQ ID NO: 426373 - RNA, 19 nt, Bordetella pertussis
gccaccaccucggccucgc

SEQ ID NO: 426374 - RNA, 21 nt, Bordetella pertussis
gccaccacgcccaucugccag

SEQ ID NO: 426375 - RNA, 12 nt, Bordetella pertussis
gccaccacugca

SEQ ID NO: 426376 - RNA, 17 nt, Bordetella pertussis
gccaccacugcaaggcc

SEQ ID NO: 426377 - RNA, 18 nt, Bordetella pertussis
gccaccacugcaaggccc

SEQ ID NO: 426378 - RNA, 15 nt, Bordetella pertussis
gccaccagcagcgcc

SEQ ID NO: 426379 - RNA, 12 nt, Bordetella pertussis
gccaccagcagc

SEQ ID NO: 426380 - RNA, 14 nt, Bordetella pertussis
gccaccagcgcgcc

SEQ ID NO: 426381 - RNA, 15 nt, Bordetella pertussis
gccaccagcgcgcca

SEQ ID NO: 426382 - RNA, 14 nt, Bordetella pertussis
gccaccagcggcgc

SEQ ID NO: 426383 - RNA, 20 nt, Bordetella pertussis
gccaccagcggcguggcggc

SEQ ID NO: 426384 - RNA, 19 nt, Bordetella pertussis
gccaccagcuugcgcgccg

SEQ ID NO: 426385 - RNA, 21 nt, Bordetella pertussis
gccaccaggaacgccagcagc

SEQ ID NO: 426386 - RNA, 23 nt, Bordetella pertussis
gccaccaggaacgccagcagcac

SEQ ID NO: 426387 - RNA, 18 nt, Bordetella pertussis
gccaccaggcgcgcgcca

SEQ ID NO: 426388 - RNA, 14 nt, Bordetella pertussis
gccaccagggcccg

SEQ ID NO: 426389 - RNA, 15 nt, Bordetella pertussis
gccaccagggcgccc

SEQ ID NO: 426390 - RNA, 18 nt, Bordetella pertussis
gccaccagguagggcagc

SEQ ID NO: 426391 - RNA, 17 nt, Bordetella pertussis
gccaccgacggcgcggc

SEQ ID NO: 426392 - RNA, 13 nt, Bordetella pertussis
gccaccgcauggg

SEQ ID NO: 426393 - RNA, 18 nt, Bordetella pertussis
gccaccgcccaggcgcag

SEQ ID NO: 426394 - RNA, 17 nt, Bordetella pertussis
gccaccgcccccgccgc

SEQ ID NO: 426395 - RNA, 19 nt, Bordetella pertussis
gccaccgcccccgccgcca

SEQ ID NO: 426396 - RNA, 21 nt, Bordetella pertussis
gccaccgguugcagcgcgcca

SEQ ID NO: 426397 - RNA, 21 nt, Bordetella pertussis
gccaccucgaucaccaccggc

SEQ ID NO: 426398 - RNA, 15 nt, Bordetella pertussis
gccaccucgcuugcc

SEQ ID NO: 426399 - RNA, 20 nt, Bordetella pertussis
gccaccuggcgcccggcggc

SEQ ID NO: 426400 - RNA, 16 nt, Bordetella pertussis
gccaccuucgccgcgc

SEQ ID NO: 426401 - RNA, 17 nt, Bordetella pertussis
gccaccuucgccgcgca

SEQ ID NO: 426402 - RNA, 14 nt, Bordetella pertussis
gccacgaaacccag

SEQ ID NO: 426403 - RNA, 16 nt, Bordetella pertussis
gccacgaaacccagga

SEQ ID NO: 426404 - RNA, 23 nt, Bordetella pertussis
gccacgaagcgcagcaccgcgcg

SEQ ID NO: 426405 - RNA, 16 nt, Bordetella pertussis
gccacgaagugcgccc

SEQ ID NO: 426406 - RNA, 14 nt, Bordetella pertussis
gccacgcagaaggc

SEQ ID NO: 426407 - RNA, 20 nt, Bordetella pertussis
gccacgcaggcgggcgccgc

SEQ ID NO: 426408 - RNA, 20 nt, Bordetella pertussis
gccacgcccacuuccucggc

SEQ ID NO: 426409 - RNA, 18 nt, Bordetella pertussis
gccacgcccaggccgcuu

SEQ ID NO: 426410 - RNA, 22 nt, Bordetella pertussis
gccacgcccgucucgcgcgcca

SEQ ID NO: 426411 - RNA, 20 nt, Bordetella pertussis
gccacgcccuggcagcuggc

SEQ ID NO: 426412 - RNA, 23 nt, Bordetella pertussis
gccacgcccuggcagcuggcgcg

SEQ ID NO: 426413 - RNA, 12 nt, Bordetella pertussis
gccacgcccugu

SEQ ID NO: 426414 - RNA, 15 nt, Bordetella pertussis
gccacgccggccacg

SEQ ID NO: 426415 - RNA, 15 nt, Bordetella pertussis
gccacgccggccagc

SEQ ID NO: 426416 - RNA, 16 nt, Bordetella pertussis
gccacgccggccgccu

SEQ ID NO: 426417 - RNA, 20 nt, Bordetella pertussis
gccacgccggccgccuggcc

SEQ ID NO: 426418 - RNA, 20 nt, Bordetella pertussis
gccacgccggcgcgccggcc

SEQ ID NO: 426419 - RNA, 13 nt, Bordetella pertussis
gccacgccuggcc

SEQ ID NO: 426420 - RNA, 14 nt, Bordetella pertussis
gccacgccuggccg

SEQ ID NO: 426421 - RNA, 18 nt, Bordetella pertussis
gccacgcgagcccgcguc

SEQ ID NO: 426422 - RNA, 18 nt, Bordetella pertussis
gccacgcgcaacgccgcc

SEQ ID NO: 426423 - RNA, 20 nt, Bordetella pertussis
gccacgcgcaacgccgccac

SEQ ID NO: 426424 - RNA, 14 nt, Bordetella pertussis
gccacgcgccgugc

SEQ ID NO: 426425 - RNA, 20 nt, Bordetella pertussis
gccacgcgcgauccgcgcca

SEQ ID NO: 426426 - RNA, 14 nt, Bordetella pertussis
gccacgcgcgggcu

SEQ ID NO: 426427 - RNA, 16 nt, Bordetella pertussis
gccacgcgcgggcugg

SEQ ID NO: 426428 - RNA, 14 nt, Bordetella pertussis
gccacgcgggccgg

SEQ ID NO: 426429 - RNA, 16 nt, Bordetella pertussis
gccacgcgggccggcc

SEQ ID NO: 426430 - RNA, 17 nt, Bordetella pertussis
gccacgcgggccggccg

SEQ ID NO: 426431 - RNA, 16 nt, Bordetella pertussis
gccacgcgguccagcc

SEQ ID NO: 426432 - RNA, 18 nt, Bordetella pertussis
gccacgcgguccagcccc

SEQ ID NO: 426433 - RNA, 13 nt, Bordetella pertussis
gccacgcgccgcc

SEQ ID NO: 426434 - RNA, 16 nt, Bordetella pertussis
gccacgcugcccugcu

SEQ ID NO: 426435 - RNA, 17 nt, Bordetella pertussis
gccacgcugcccugcug

SEQ ID NO: 426436 - RNA, 18 nt, Bordetella pertussis
gccacgcugcccugcugc

SEQ ID NO: 426437 - RNA, 21 nt, Bordetella pertussis
gccacggcaaugucgcaggcc

SEQ ID NO: 426438 - RNA, 20 nt, Bordetella pertussis
gccacggcaggcgccugccc

SEQ ID NO: 426439 - RNA, 14 nt, Bordetella pertussis
gccacggcccgcca

SEQ ID NO: 426440 - RNA, 16 nt, Bordetella pertussis
gccacggcccgccagg

SEQ ID NO: 426441 - RNA, 17 nt, Bordetella pertussis
gccacggcccgccagga

SEQ ID NO: 426442 - RNA, 16 nt, Bordetella pertussis
gccacggccggcagcg

SEQ ID NO: 426443 - RNA, 14 nt, Bordetella pertussis
gccacggccgggcc

SEQ ID NO: 426444 - RNA, 14 nt, Bordetella pertussis
gccacggccugccc

SEQ ID NO: 426445 - RNA, 17 nt, Bordetella pertussis
gccacggccugcccggg

SEQ ID NO: 426446 - RNA, 13 nt, Bordetella pertussis
gccacggcgauga

SEQ ID NO: 426447 - RNA, 21 nt, Bordetella pertussis
gccacggcgaugaacagcggc

SEQ ID NO: 426448 - RNA, 12 nt, Bordetella pertussis
gccacggcgccc

SEQ ID NO: 426449 - RNA, 14 nt, Bordetella pertussis
gccacggcgcccga

SEQ ID NO: 426450 - RNA, 17 nt, Bordetella pertussis
gccacggcgcccgaggc

SEQ ID NO: 426451 - RNA, 22 nt, Bordetella pertussis
gccacggcgucgaugcgcgcgc

SEQ ID NO: 426452 - RNA, 16 nt, Bordetella pertussis
gccacggcgucgccgg

SEQ ID NO: 426453 - RNA, 19 nt, Bordetella pertussis
gccacggcgucgccggcca

SEQ ID NO: 426454 - RNA, 21 nt, Bordetella pertussis
gccacggcuggaaagaccugc

SEQ ID NO: 426455 - RNA, 21 nt, Bordetella pertussis
gccacggcuucgcccagcgcu

SEQ ID NO: 426456 - RNA, 21 nt, Bordetella pertussis
gccacgggcgucaccggcgag

SEQ ID NO: 426457 - RNA, 22 nt, Bordetella pertussis
gccacgggcgucaccggcgagc

SEQ ID NO: 426458 - RNA, 19 nt, Bordetella pertussis
gccacggucugcacgccgg

SEQ ID NO: 426459 - RNA, 21 nt, Bordetella pertussis
gccacggucugcacgccgggc

SEQ ID NO: 426460 - RNA, 12 nt, Bordetella pertussis
gccacguccagc

SEQ ID NO: 426461 - RNA, 15 nt, Bordetella pertussis
gccacguccagcacg

SEQ ID NO: 426462 - RNA, 18 nt, Bordetella pertussis
gccacguccagcacggcc

SEQ ID NO: 426463 - RNA, 19 nt, Bordetella pertussis
gccacgucgaccucgagca

SEQ ID NO: 426464 - RNA, 15 nt, Bordetella pertussis
gccacgucgccggcg

SEQ ID NO: 426465 - RNA, 20 nt, Bordetella pertussis
gccacgucgcucggccuccc

SEQ ID NO: 426466 - RNA, 15 nt, Bordetella pertussis
gccacgucggcggcc

SEQ ID NO: 426467 - RNA, 22 nt, Bordetella pertussis
gccacgucggucgcuuccagcg

SEQ ID NO: 426468 - RNA, 15 nt, Bordetella pertussis
gccacgugaagcgcc

SEQ ID NO: 426469 - RNA, 17 nt, Bordetella pertussis
gccacguguggcaggcc

SEQ ID NO: 426470 - RNA, 19 nt, Bordetella pertussis
gccacguguggcaggccag

SEQ ID NO: 426471 - RNA, 16 nt, Bordetella pertussis
gccacgugcugcugga

SEQ ID NO: 426472 - RNA, 18 nt, Bordetella pertussis
gccacguugaagcgcagc

SEQ ID NO: 426473 - RNA, 23 nt, Bordetella pertussis
gccacguugaagcgcagccacgg

SEQ ID NO: 426474 - RNA, 16 nt, Bordetella pertussis
gccacuauuuucagaa

SEQ ID NO: 426475 - RNA, 18 nt, Bordetella pertussis
gccacuauuuucagaagc

SEQ ID NO: 426476 - RNA, 22 nt, Bordetella pertussis
gccacuccugguugaccgagcc

SEQ ID NO: 426477 - RNA, 20 nt, Bordetella pertussis
gccacucgaugggcgcgcgc

SEQ ID NO: 426478 - RNA, 22 nt, Bordetella pertussis
gccagaacgcugaugcgcguca

SEQ ID NO: 426479 - RNA, 23 nt, Bordetella pertussis
gccagacauugucaagcagcgcc

SEQ ID NO: 426480 - RNA, 16 nt, Bordetella pertussis
gccagaccgcgcgcac

SEQ ID NO: 426481 - RNA, 18 nt, Bordetella pertussis
gccagaucgaacacgagc

SEQ ID NO: 426482 - RNA, 21 nt, Bordetella pertussis
gccagcacgccauucauccag

SEQ ID NO: 426483 - RNA, 13 nt, Bordetella pertussis
gccagcacgccgg

SEQ ID NO: 426484 - RNA, 15 nt, Bordetella pertussis
gccagcacgccggcg

SEQ ID NO: 426485 - RNA, 21 nt, Bordetella pertussis
gccagcacgcgcagcuugccc

SEQ ID NO: 426486 - RNA, 14 nt, Bordetella pertussis
gccagcacggcgca

SEQ ID NO: 426487 - RNA, 19 nt, Bordetella pertussis
gccagcacggcgcacacca

SEQ ID NO: 426488 - RNA, 14 nt, Bordetella pertussis
gccagcagaaugcc

SEQ ID NO: 426489 - RNA, 21 nt, Bordetella pertussis
gccagcagcacgaucgcggcg

SEQ ID NO: 426490 - RNA, 13 nt, Bordetella pertussis
gccagcagcacgu

SEQ ID NO: 426491 - RNA, 13 nt, Bordetella pertussis
gccagcagcaggc

SEQ ID NO: 426492 - RNA, 16 nt, Bordetella pertussis
gccagcagcuggcgca

SEQ ID NO: 426493 - RNA, 19 nt, Bordetella pertussis
gccagcagcuguuccugcu

SEQ ID NO: 426494 - RNA, 21 nt, Bordetella pertussis
gccagcaggagcccgcugccg

SEQ ID NO: 426495 - RNA, 11 nt, Bordetella pertussis
gccagcaggcc

SEQ ID NO: 426496 - RNA, 21 nt, Bordetella pertussis
gccagcaggcccugggccagc

SEQ ID NO: 426497 - RNA, 22 nt, Bordetella pertussis
gccagcaggcgaaacgccagcc

SEQ ID NO: 426498 - RNA, 16 nt, Bordetella pertussis
gccagcagggucagcg

SEQ ID NO: 426499 - RNA, 19 nt, Bordetella pertussis
gccagccgcucgcgcgacc

SEQ ID NO: 426500 - RNA, 18 nt, Bordetella pertussis
gccagccgcuggcgcgcc

SEQ ID NO: 426501 - RNA, 22 nt, Bordetella pertussis
gccagccgcuugcggccaggcg

SEQ ID NO: 426502 - RNA, 15 nt, Bordetella pertussis
gccagccggcgcgcc

SEQ ID NO: 426503 - RNA, 18 nt, Bordetella pertussis
gccagccggcggccagcu

SEQ ID NO: 426504 - RNA, 16 nt, Bordetella pertussis
gccagccggcccagca

SEQ ID NO: 426505 - RNA, 20 nt, Bordetella pertussis
gccagccggcccagcacgcc

SEQ ID NO: 426506 - RNA, 22 nt, Bordetella pertussis
gccagccggcccagcacgccgc

SEQ ID NO: 426507 - RNA, 21 nt, Bordetella pertussis
gccagccggguggucgcgccc

SEQ ID NO: 426508 - RNA, 21 nt, Bordetella pertussis
gccagccguugcgccagcggc

SEQ ID NO: 426509 - RNA, 22 nt, Bordetella pertussis
gccagcgccagaaagcgcggcc

SEQ ID NO: 426510 - RNA, 14 nt, Bordetella pertussis
gccagcgccagcac

SEQ ID NO: 426511 - RNA, 16 nt, Bordetella pertussis
gccagcgccacgcgag

SEQ ID NO: 426512 - RNA, 18 nt, Bordetella pertussis
gccagcgccagcgucagg

SEQ ID NO: 426513 - RNA, 15 nt, Bordetella pertussis
gccagcgccagccgc

SEQ ID NO: 426514 - RNA, 22 nt, Bordetella pertussis
gccagcgccaguccgcgcucgc

SEQ ID NO: 426515 - RNA, 19 nt, Bordetella pertussis
gccagcgcgaucucgcgca

SEQ ID NO: 426516 - RNA, 20 nt, Bordetella pertussis
gccagcgcgaucucgcgcag

SEQ ID NO: 426517 - RNA, 21 nt, Bordetella pertussis
gccagcgcgcaggugugccag

SEQ ID NO: 426518 - RNA, 23 nt, Bordetella pertussis
gccagcgcgcaggugugccagcc

SEQ ID NO: 426519 - RNA, 17 nt, Bordetella pertussis
gccagcgcgccgccagc

SEQ ID NO: 426520 - RNA, 19 nt, Bordetella pertussis
gccagcgcgccgcccacca

SEQ ID NO: 426521 - RNA, 20 nt, Bordetella pertussis
gccagcgcgccgcccaccac

SEQ ID NO: 426522 - RNA, 12 nt, Bordetella pertussis
gccagcgcgcgc

SEQ ID NO: 426523 - RNA, 14 nt, Bordetella pertussis
gccagcgcgccggc

SEQ ID NO: 426524 - RNA, 13 nt, Bordetella pertussis
gccagcgcgcggc

SEQ ID NO: 426525 - RNA, 14 nt, Bordetella pertussis
gccagcgcgcggcc

SEQ ID NO: 426526 - RNA, 12 nt, Bordetella pertussis
gccagcgcggcc

SEQ ID NO: 426527 - RNA, 15 nt, Bordetella pertussis
gccagcgcgcgggcg

SEQ ID NO: 426528 - RNA, 20 nt, Bordetella pertussis
gccagcgcgcggggcaggcc

SEQ ID NO: 426529 - RNA, 15 nt, Bordetella pertussis
gccagcgcggcggca

SEQ ID NO: 426530 - RNA, 16 nt, Bordetella pertussis
gccagcgcgguguugc

SEQ ID NO: 426531 - RNA, 18 nt, Bordetella pertussis
gccagcgcgucguccagc

SEQ ID NO: 426532 - RNA, 15 nt, Bordetella pertussis
gccagcggcgcggcg

SEQ ID NO: 426533 - RNA, 17 nt, Bordetella pertussis
gccagcggugcgcggcg

SEQ ID NO: 426534 - RNA, 16 nt, Bordetella pertussis
gccagcgucaggcugg

SEQ ID NO: 426535 - RNA, 17 nt, Bordetella pertussis
gccagcguaucgccgcc

SEQ ID NO: 426536 - RNA, 12 nt, Bordetella pertussis
gccagcuccagg

SEQ ID NO: 426537 - RNA, 16 nt, Bordetella pertussis
gccagcuccccgggcg

SEQ ID NO: 426538 - RNA, 19 nt, Bordetella pertussis
gccagcucgcgcagcaggc

SEQ ID NO: 426539 - RNA, 16 nt, Bordetella pertussis
gccagcucgcguugca

SEQ ID NO: 426540 - RNA, 19 nt, Bordetella pertussis
gccagcucggccaaggcau

SEQ ID NO: 426541 - RNA, 13 nt, Bordetella pertussis
gccagcucggcca

SEQ ID NO: 426542 - RNA, 17 nt, Bordetella pertussis
gccaggaagaucggccc

SEQ ID NO: 426543 - RNA, 23 nt, Bordetella pertussis
gccaggaagcgggccugccgcgc

SEQ ID NO: 426544 - RNA, 21 nt, Bordetella pertussis
gccaggaccgaggugccagcc

SEQ ID NO: 426545 - RNA, 15 nt, Bordetella pertussis
gccaggcagauccgc

SEQ ID NO: 426546 - RNA, 22 nt, Bordetella pertussis
gccaggcauugaagcuggcgcc

SEQ ID NO: 426547 - RNA, 14 nt, Bordetella pertussis
gccaggccagcagc

SEQ ID NO: 426548 - RNA, 14 nt, Bordetella pertussis
gccaggccagcgcc

SEQ ID NO: 426549 - RNA, 14 nt, Bordetella pertussis
gccaggcccacggc

SEQ ID NO: 426550 - RNA, 18 nt, Bordetella pertussis
gccaggcccaugccgccc

SEQ ID NO: 426551 - RNA, 20 nt, Bordetella pertussis
gccaggcccaugccgcccgc

SEQ ID NO: 426552 - RNA, 16 nt, Bordetella pertussis
gccaggcccggcgcgc

SEQ ID NO: 426553 - RNA, 14 nt, Bordetella pertussis
gccaggccccgccg

SEQ ID NO: 426554 - RNA, 21 nt, Bordetella pertussis
gccaggcccucgcggccgucg

SEQ ID NO: 426555 - RNA, 22 nt, Bordetella pertussis
gccaggcuuugggcaaaacgcg

SEQ ID NO: 426556 - RNA, 18 nt, Bordetella pertussis
gccagggaaggggcggcu

SEQ ID NO: 426557 - RNA, 12 nt, Bordetella pertussis
gccagggccacg

SEQ ID NO: 426558 - RNA, 19 nt, Bordetella pertussis
gccagggccacgccggccg

SEQ ID NO: 426559 - RNA, 14 nt, Bordetella pertussis
gccagggccaggcc

SEQ ID NO: 426560 - RNA, 19 nt, Bordetella pertussis
gccagggccauguggcgca

SEQ ID NO: 426561 - RNA, 21 nt, Bordetella pertussis
gccagggccauguggcgcagc

SEQ ID NO: 426562 - RNA, 20 nt, Bordetella pertussis
gccagggccccuccggcgcc

SEQ ID NO: 426563 - RNA, 13 nt, Bordetella pertussis
gccagggccuccu

SEQ ID NO: 426564 - RNA, 12 nt, Bordetella pertussis
gccagggccugc

SEQ ID NO: 426565 - RNA, 16 nt, Bordetella pertussis
gccagggccuggcaca

SEQ ID NO: 426566 - RNA, 22 nt, Bordetella pertussis
gccagggcgcggaucaugggcu

SEQ ID NO: 426567 - RNA, 21 nt, Bordetella pertussis
gccagggccgccgcgcccagc

SEQ ID NO: 426568 - RNA, 21 nt, Bordetella pertussis
gccaggguuugcuggcgcagc

SEQ ID NO: 426569 - RNA, 18 nt, Bordetella pertussis
gccagguaagcuggcgcu

SEQ ID NO: 426570 - RNA, 19 nt, Bordetella pertussis
gccagguacaggccgccgg

SEQ ID NO: 426571 - RNA, 18 nt, Bordetella pertussis
gccagguagcggguggcc

SEQ ID NO: 426572 - RNA, 21 nt, Bordetella pertussis
gccagguaggccggcgcgacc

SEQ ID NO: 426573 - RNA, 21 nt, Bordetella pertussis
gccagguauugcggggcggcg

SEQ ID NO: 426574 - RNA, 18 nt, Bordetella pertussis
gccaggucggccagccgg

SEQ ID NO: 426575 - RNA, 21 nt, Bordetella pertussis
gccaggucggccagccggccg

SEQ ID NO: 426576 - RNA, 13 nt, Bordetella pertussis
gccaguacaggcu

SEQ ID NO: 426577 - RNA, 16 nt, Bordetella pertussis
gccaguacaggcugcc

SEQ ID NO: 426578 - RNA, 17 nt, Bordetella pertussis
gccaguacaggcugccg

SEQ ID NO: 426579 - RNA, 18 nt, Bordetella pertussis
gccaguaccugacccugc

SEQ ID NO: 426580 - RNA, 22 nt, Bordetella pertussis
gccaguacgucggacagggccc

SEQ ID NO: 426581 - RNA, 16 nt, Bordetella pertussis
gccaguagcgccggcu

SEQ ID NO: 426582 - RNA, 17 nt, Bordetella pertussis
gccaguccgcgcucgcc

SEQ ID NO: 426583 - RNA, 21 nt, Bordetella pertussis
gccaguccgcgcucgcccagc

SEQ ID NO: 426584 - RNA, 22 nt, Bordetella pertussis
gccaguccgcgcucgcccagcc

SEQ ID NO: 426585 - RNA, 14 nt, Bordetella pertussis
gccagucgccgcgg

SEQ ID NO: 426586 - RNA, 15 nt, Bordetella pertussis
gccagucgcggugca

SEQ ID NO: 426587 - RNA, 23 nt, Bordetella pertussis
gccagugaaacgcgacgcgccgg

SEQ ID NO: 426588 - RNA, 21 nt, Bordetella pertussis
gccagugguccaucagguucu

SEQ ID NO: 426589 - RNA, 19 nt, Bordetella pertussis
gccaguuccgugcgcgccc

SEQ ID NO: 426590 - RNA, 21 nt, Bordetella pertussis
gccaguucgaugcgcuugccg

SEQ ID NO: 426591 - RNA, 15 nt, Bordetella pertussis
gccaguucgcggcgc

SEQ ID NO: 426592 - RNA, 23 nt, Bordetella pertussis
gccaguugaaccgcaacgccagc

SEQ ID NO: 426593 - RNA, 18 nt, Bordetella pertussis
gccaguugcgcaccgcuu

SEQ ID NO: 426594 - RNA, 13 nt, Bordetella pertussis
gccaguugggcca

SEQ ID NO: 426595 - RNA, 19 nt, Bordetella pertussis
gccauacccggucgaucag

SEQ ID NO: 426596 - RNA, 19 nt, Bordetella pertussis
gccauaggcgcgcaccagc

SEQ ID NO: 426597 - RNA, 20 nt, Bordetella pertussis
gccauaggcgcgcaccagcc

SEQ ID NO: 426598 - RNA, 20 nt, Bordetella pertussis
gccauagggcgacugcagca

SEQ ID NO: 426599 - RNA, 22 nt, Bordetella pertussis
gccauagggcgacugcagcagg

SEQ ID NO: 426600 - RNA, 18 nt, Bordetella pertussis
gccauauugaugcagcac

SEQ ID NO: 426601 - RNA, 15 nt, Bordetella pertussis
gccauccagccaggc

SEQ ID NO: 426602 - RNA, 19 nt, Bordetella pertussis
gccauccagccaggccgca

SEQ ID NO: 426603 - RNA, 11 nt, Bordetella pertussis
gccauccggcc

SEQ ID NO: 426604 - RNA, 17 nt, Bordetella pertussis
gccauccggccgcacgc

SEQ ID NO: 426605 - RNA, 20 nt, Bordetella pertussis
gccauccggccgcacgcggc

SEQ ID NO: 426606 - RNA, 13 nt, Bordetella pertussis
gccaucgccgcca

SEQ ID NO: 426607 - RNA, 14 nt, Bordetella pertussis
gccaucgccgccgc

SEQ ID NO: 426608 - RNA, 17 nt, Bordetella pertussis
gccaucgccgccgccgg

SEQ ID NO: 426609 - RNA, 22 nt, Bordetella pertussis
gccaucgcgguccugaccggcg

SEQ ID NO: 426610 - RNA, 23 nt, Bordetella pertussis
gccaucgcugguaugcacgaugc

SEQ ID NO: 426611 - RNA, 18 nt, Bordetella pertussis
gccaucggcgccaagcgg

SEQ ID NO: 426612 - RNA, 22 nt, Bordetella pertussis
gccaucgggauaccgcuggcca

SEQ ID NO: 426613 - RNA, 20 nt, Bordetella pertussis
gccaugcaacacgaccagca

SEQ ID NO: 426614 - RNA, 21 nt, Bordetella pertussis
gccaugcaacacgaccagcag

SEQ ID NO: 426615 - RNA, 23 nt, Bordetella pertussis
gccaugcaacacgaccagcaggc

SEQ ID NO: 426616 - RNA, 21 nt, Bordetella pertussis
gccaugcagcuggauggccug

SEQ ID NO: 426617 - RNA, 15 nt, Bordetella pertussis
gccaugcccaggccc

SEQ ID NO: 426618 - RNA, 17 nt, Bordetella pertussis
gccaugccccauccagc

SEQ ID NO: 426619 - RNA, 21 nt, Bordetella pertussis
gccaugccccauccagcggac

SEQ ID NO: 426620 - RNA, 23 nt, Bordetella pertussis
gccaugccccauccagcggacgg

SEQ ID NO: 426621 - RNA, 14 nt, Bordetella pertussis
gccaugccgcgcgc

SEQ ID NO: 426622 - RNA, 16 nt, Bordetella pertussis
gccaugccgcgcgccu

SEQ ID NO: 426623 - RNA, 17 nt, Bordetella pertussis
gccaugccgucaccggc

SEQ ID NO: 426624 - RNA, 16 nt, Bordetella pertussis
gccaugccguccugcu

SEQ ID NO: 426625 - RNA, 18 nt, Bordetella pertussis
gccaugccguccugcugc

SEQ ID NO: 426626 - RNA, 15 nt, Bordetella pertussis
gccaugccgucgcgc

SEQ ID NO: 426627 - RNA, 23 nt, Bordetella pertussis
gccaugccgucgcgcaccaccug

SEQ ID NO: 426628 - RNA, 19 nt, Bordetella pertussis
gccaugccgucuggcggca

SEQ ID NO: 426629 - RNA, 19 nt, Bordetella pertussis
gccaugcgauacagcuugg

SEQ ID NO: 426630 - RNA, 20 nt, Bordetella pertussis
gccaugcgauacagcuuggc

SEQ ID NO: 426631 - RNA, 16 nt, Bordetella pertussis
gccaugcgaugcugca

SEQ ID NO: 426632 - RNA, 16 nt, Bordetella pertussis
gccaugcgcaccaccg

SEQ ID NO: 426633 - RNA, 22 nt, Bordetella pertussis
gccaugcgcacucgaccgccgg

SEQ ID NO: 426634 - RNA, 14 nt, Bordetella pertussis
gccaugcgcuugga

SEQ ID NO: 426635 - RNA, 19 nt, Bordetella pertussis
gccaugcggacgccagccc

SEQ ID NO: 426636 - RNA, 14 nt, Bordetella pertussis
gccaugcggcuggc

SEQ ID NO: 426637 - RNA, 17 nt, Bordetella pertussis
gccaugcgggucaggcc

SEQ ID NO: 426638 - RNA, 22 nt, Bordetella pertussis
gccaugcgggucaggccgccgu

SEQ ID NO: 426639 - RNA, 13 nt, Bordetella pertussis
gccaugcucagca

SEQ ID NO: 426640 - RNA, 15 nt, Bordetella pertussis
gccaugcucagcagc

SEQ ID NO: 426641 - RNA, 17 nt, Bordetella pertussis
gccaugcucagcagcac

SEQ ID NO: 426642 - RNA, 19 nt, Bordetella pertussis
gccaugcucagcagcaccg

SEQ ID NO: 426643 - RNA, 14 nt, Bordetella pertussis
gccaugcggugcgc

SEQ ID NO: 426644 - RNA, 19 nt, Bordetella pertussis
gccaugcggugcgccgcgu

SEQ ID NO: 426645 - RNA, 21 nt, Bordetella pertussis
gccaugcggugcgccgcguca

SEQ ID NO: 426646 - RNA, 18 nt, Bordetella pertussis
gccaugcugccaaccgcg

SEQ ID NO: 426647 - RNA, 19 nt, Bordetella pertussis
gccaugcuggccgccgcgc

SEQ ID NO: 426648 - RNA, 23 nt, Bordetella pertussis
gcccacucacgcaaggccgacug

SEQ ID NO: 426649 - RNA, 14 nt, Bordetella pertussis
gcccacugccaggc

SEQ ID NO: 426650 - RNA, 16 nt, Bordetella pertussis
gcccacugccaggcga

SEQ ID NO: 426651 - RNA, 17 nt, Bordetella pertussis
gcccacugccaggcgag

SEQ ID NO: 426652 - RNA, 21 nt, Bordetella pertussis
gcccacuggaucgccgaucgg

SEQ ID NO: 426653 - RNA, 15 nt, Bordetella pertussis
gcccagcaccacggc

SEQ ID NO: 426654 - RNA, 22 nt, Bordetella pertussis
gcccagcaccacgggcucgcug

SEQ ID NO: 426655 - RNA, 14 nt, Bordetella pertussis
gcccagcaccgcca

SEQ ID NO: 426656 - RNA, 15 nt, Bordetella pertussis
gcccagcaccugcag

SEQ ID NO: 426657 - RNA, 16 nt, Bordetella pertussis
gcccagcaccugcagg

SEQ ID NO: 426658 - RNA, 22 nt, Bordetella pertussis
gcccagcaccugcaggccgccg

SEQ ID NO: 426659 - RNA, 20 nt, Bordetella pertussis
gcccagcacgaugagcauga

SEQ ID NO: 426660 - RNA, 16 nt, Bordetella pertussis
gcccagcacgccgcgc

SEQ ID NO: 426661 - RNA, 15 nt, Bordetella pertussis
gcccagcacgcgcgc

SEQ ID NO: 426662 - RNA, 20 nt, Bordetella pertussis
gcccagcacgcgcgccagcu

SEQ ID NO: 426663 - RNA, 22 nt, Bordetella pertussis
gcccagcagauaccggcauggc

SEQ ID NO: 426664 - RNA, 12 nt, Bordetella pertussis
gcccagcccugc

SEQ ID NO: 426665 - RNA, 13 nt, Bordetella pertussis
gcccagccgcagc

SEQ ID NO: 426666 - RNA, 16 nt, Bordetella pertussis
gcccagccgcagcagg

SEQ ID NO: 426667 - RNA, 17 nt, Bordetella pertussis
gcccagccgccugagca

SEQ ID NO: 426668 - RNA, 19 nt, Bordetella pertussis
gcccagccgcucggccacg

SEQ ID NO: 426669 - RNA, 15 nt, Bordetella pertussis
gcccagccugccggc

SEQ ID NO: 426670 - RNA, 18 nt, Bordetella pertussis
gcccagccugccggcggc

SEQ ID NO: 426671 - RNA, 19 nt, Bordetella pertussis
gcccagccugccggcggcc

SEQ ID NO: 426672 - RNA, 16 nt, Bordetella pertussis
gcccagcgagccggcc

SEQ ID NO: 426673 - RNA, 21 nt, Bordetella pertussis
gcccagcgagccggccagcgc

SEQ ID NO: 426674 - RNA, 18 nt, Bordetella pertussis
gcccagcgagcggggcug

SEQ ID NO: 426675 - RNA, 13 nt, Bordetella pertussis
gcccagcgagcug

SEQ ID NO: 426676 - RNA, 18 nt, Bordetella pertussis
gcccagcgagaucagcac

SEQ ID NO: 426677 - RNA, 17 nt, Bordetella pertussis
gcccagcgcguccugca

SEQ ID NO: 426678 - RNA, 16 nt, Bordetella pertussis
gcccagcgcgucggcc

SEQ ID NO: 426679 - RNA, 20 nt, Bordetella pertussis
gcccagcgcgucggccagcg

SEQ ID NO: 426680 - RNA, 21 nt, Bordetella pertussis
gcccagcgcgucggccagcgc

SEQ ID NO: 426681 - RNA, 23 nt, Bordetella pertussis
gcccagcgcgucggccagcgccg

SEQ ID NO: 426682 - RNA, 19 nt, Bordetella pertussis
gcccagcgcgugggccagc

SEQ ID NO: 426683 - RNA, 22 nt, Bordetella pertussis
gcccagcgcggcggccaugccc

SEQ ID NO: 426684 - RNA, 15 nt, Bordetella pertussis
gcccagcggcaggcu

SEQ ID NO: 426685 - RNA, 17 nt, Bordetella pertussis
gcccagcggcaggcugg

SEQ ID NO: 426686 - RNA, 13 nt, Bordetella pertussis
gcccagcggcgcc

SEQ ID NO: 426687 - RNA, 19 nt, Bordetella pertussis
gcccagcguguaggcggcc

SEQ ID NO: 426688 - RNA, 22 nt, Bordetella pertussis
gcccagcguguaggcggccggc

SEQ ID NO: 426689 - RNA, 23 nt, Bordetella pertussis
gcccagcguguaggcggccggcu

SEQ ID NO: 426690 - RNA, 13 nt, Bordetella pertussis
gcccagcucaugg

SEQ ID NO: 426691 - RNA, 19 nt, Bordetella pertussis
gcccagcucauggcacagc

SEQ ID NO: 426692 - RNA, 22 nt, Bordetella pertussis
gcccagcucauggcacagcgcg

SEQ ID NO: 426693 - RNA, 24 nt, Bordetella pertussis
gcccagcucauggcacagcgcggc

SEQ ID NO: 426694 - RNA, 15 nt, Bordetella pertussis
gcccagcuccagcug

SEQ ID NO: 426695 - RNA, 17 nt, Bordetella pertussis
gcccagcuccagcuggc

SEQ ID NO: 426696 - RNA, 13 nt, Bordetella pertussis
gcccaggccagcg

SEQ ID NO: 426697 - RNA, 17 nt, Bordetella pertussis
gcccaggccagcgccgc

SEQ ID NO: 426698 - RNA, 19 nt, Bordetella pertussis
gcccaggccagcgccgcgg

SEQ ID NO: 426699 - RNA, 16 nt, Bordetella pertussis
gcccaggcccagcauc

SEQ ID NO: 426700 - RNA, 17 nt, Bordetella pertussis
gcccaggcccagcgcgc

SEQ ID NO: 426701 - RNA, 15 nt, Bordetella pertussis
gcccaggcccaguuc

SEQ ID NO: 426702 - RNA, 22 nt, Bordetella pertussis
gcccaggcccaguucggcgcgc

SEQ ID NO: 426703 - RNA, 14 nt, Bordetella pertussis
gcccaggccgaacc

SEQ ID NO: 426704 - RNA, 20 nt, Bordetella pertussis
gcccaggccgaaccacagca

SEQ ID NO: 426705 - RNA, 17 nt, Bordetella pertussis
gcccaggccggcgcgcu

SEQ ID NO: 426706 - RNA, 18 nt, Bordetella pertussis
gcccaggccggcgcgcuc

SEQ ID NO: 426707 - RNA, 13 nt, Bordetella pertussis
gcccaggccggcg

SEQ ID NO: 426708 - RNA, 18 nt, Bordetella pertussis
gcccaggccguggcgcac

SEQ ID NO: 426709 - RNA, 18 nt, Bordetella pertussis
gcccaggcgacccagcac

SEQ ID NO: 426710 - RNA, 18 nt, Bordetella pertussis
gcccaggcgaugcccagc

SEQ ID NO: 426711 - RNA, 15 nt, Bordetella pertussis
gcccaggcgcagccg

SEQ ID NO: 426712 - RNA, 18 nt, Bordetella pertussis
gcccaggcgcagccgcgc

SEQ ID NO: 426713 - RNA, 14 nt, Bordetella pertussis
gcccaggcgcgcug

SEQ ID NO: 426714 - RNA, 14 nt, Bordetella pertussis
gcccaggcgcuggu

SEQ ID NO: 426715 - RNA, 15 nt, Bordetella pertussis
gcccaggcugggcca

SEQ ID NO: 426716 - RNA, 16 nt, Bordetella pertussis
gcccaggggccggcgc

SEQ ID NO: 426717 - RNA, 14 nt, Bordetella pertussis
gcccaggguggugg

SEQ ID NO: 426718 - RNA, 13 nt, Bordetella pertussis
gcccagguccagc

SEQ ID NO: 426719 - RNA, 21 nt, Bordetella pertussis
gcccagguccagcgccacggc

SEQ ID NO: 426720 - RNA, 19 nt, Bordetella pertussis
gcccagguccugcgccagc

SEQ ID NO: 426721 - RNA, 15 nt, Bordetella pertussis
gcccaggucaucgcc

SEQ ID NO: 426722 - RNA, 23 nt, Bordetella pertussis
gcccaggucaucgccaggcgcgu

SEQ ID NO: 426723 - RNA, 22 nt, Bordetella pertussis
gcccaggucggacgcgccgggc

SEQ ID NO: 426724 - RNA, 16 nt, Bordetella pertussis
gcccaggugcgggagc

SEQ ID NO: 426725 - RNA, 18 nt, Bordetella pertussis
gcccagguugaaggccgc

SEQ ID NO: 426726 - RNA, 19 nt, Bordetella pertussis
gcccagguugaaggccgcg

SEQ ID NO: 426727 - RNA, 17 nt, Bordetella pertussis
gcccagguugcggccgc

SEQ ID NO: 426728 - RNA, 18 nt, Bordetella pertussis
gcccagguugcggccgcc

SEQ ID NO: 426729 - RNA, 17 nt, Bordetella pertussis
gcccagugucucgacca

SEQ ID NO: 426730 - RNA, 18 nt, Bordetella pertussis
gcccaguucggcgcgcgu

SEQ ID NO: 426731 - RNA, 18 nt, Bordetella pertussis
gcccaguucgcggccggc

SEQ ID NO: 426732 - RNA, 19 nt, Bordetella pertussis
gcccaguucgcggccggcc

SEQ ID NO: 426733 - RNA, 17 nt, Bordetella pertussis
gcccaguugaaucggcg

SEQ ID NO: 426734 - RNA, 17 nt, Bordetella pertussis
gcccaguugcuggccca

SEQ ID NO: 426735 - RNA, 18 nt, Bordetella pertussis
gcccaguugcuggcccag

SEQ ID NO: 426736 - RNA, 16 nt, Bordetella pertussis
gcccauaugccgccgg

SEQ ID NO: 426737 - RNA, 22 nt, Bordetella pertussis
gcccaucaggugaaacagcagc

SEQ ID NO: 426738 - RNA, 16 nt, Bordetella pertussis
gcccauccaucuggug

SEQ ID NO: 426739 - RNA, 20 nt, Bordetella pertussis
gcccaucugguugagcagca

SEQ ID NO: 426740 - RNA, 23 nt, Bordetella pertussis
gcccaugaaggcggccagcaugc

SEQ ID NO: 426741 - RNA, 15 nt, Bordetella pertussis
gcccaugccgccaug

SEQ ID NO: 426742 - RNA, 13 nt, Bordetella pertussis
gcccaugccgcgg

SEQ ID NO: 426743 - RNA, 15 nt, Bordetella pertussis
gcccaugcgcauggc

SEQ ID NO: 426744 - RNA, 21 nt, Bordetella pertussis
gcccaugcgcauggccagcac

SEQ ID NO: 426745 - RNA, 22 nt, Bordetella pertussis
gcccaugcgcauggccagcaca

SEQ ID NO: 426746 - RNA, 18 nt, Bordetella pertussis
gcccaugcgcugcgccuu

SEQ ID NO: 426747 - RNA, 15 nt, Bordetella pertussis
gcccaugcgcuggcg

SEQ ID NO: 426748 - RNA, 22 nt, Bordetella pertussis
gcccaugcgggcguagaaagcc

SEQ ID NO: 426749 - RNA, 16 nt, Bordetella pertussis
gcccauggccagggag

SEQ ID NO: 426750 - RNA, 16 nt, Bordetella pertussis
gcccauggcgcgcagc

SEQ ID NO: 426751 - RNA, 20 nt, Bordetella pertussis
gcccaugggaaucugcuugc

SEQ ID NO: 426752 - RNA, 22 nt, Bordetella pertussis
gcccauggggugcuccugccag

SEQ ID NO: 426753 - RNA, 16 nt, Bordetella pertussis
gcccauguugaacugc

SEQ ID NO: 426754 - RNA, 18 nt, Bordetella pertussis
gcccauguugaacugcag

SEQ ID NO: 426755 - RNA, 18 nt, Bordetella pertussis
gcccauuccgagcgggcc

SEQ ID NO: 426756 - RNA, 17 nt, Bordetella pertussis
gcccauugcggcaccug

SEQ ID NO: 426757 - RNA, 15 nt, Bordetella pertussis
gcccauugcggcggg

SEQ ID NO: 426758 - RNA, 19 nt, Bordetella pertussis
gcccauuuucugccacagc

SEQ ID NO: 426759 - RNA, 15 nt, Bordetella pertussis
gccccaacgcggcca

SEQ ID NO: 426760 - RNA, 17 nt, Bordetella pertussis
gccccaacgcggccagc

SEQ ID NO: 426761 - RNA, 14 nt, Bordetella pertussis
gccccaaugugcug

SEQ ID NO: 426762 - RNA, 21 nt, Bordetella pertussis
gccccaccuggcggugcgccg

SEQ ID NO: 426763 - RNA, 23 nt, Bordetella pertussis
gccccaccuggcggugcgccgca

SEQ ID NO: 426764 - RNA, 14 nt, Bordetella pertussis
gccccacggguacc

SEQ ID NO: 426765 - RNA, 14 nt, Bordetella pertussis
gccccacuuggcga

SEQ ID NO: 426766 - RNA, 20 nt, Bordetella pertussis
gccccagcagcacgcccagu

SEQ ID NO: 426767 - RNA, 15 nt, Bordetella pertussis
gccccagcagcagcg

SEQ ID NO: 426768 - RNA, 20 nt, Bordetella pertussis
gccccagcaucugccccagc

SEQ ID NO: 426769 - RNA, 13 nt, Bordetella pertussis
gccccagcgccgc

SEQ ID NO: 426770 - RNA, 17 nt, Bordetella pertussis
gccccagcgccgcgagc

SEQ ID NO: 426771 - RNA, 15 nt, Bordetella pertussis
gccccagcggcuggc

SEQ ID NO: 426772 - RNA, 22 nt, Bordetella pertussis
gccccagcguccaggcggccau

SEQ ID NO: 426773 - RNA, 20 nt, Bordetella pertussis
gccccaggcaggcgggcccg

SEQ ID NO: 426774 - RNA, 21 nt, Bordetella pertussis
gccccaggcaggcgggcccgc

SEQ ID NO: 426775 - RNA, 22 nt, Bordetella pertussis
gccccaggaugcgcaccggcca

SEQ ID NO: 426776 - RNA, 15 nt, Bordetella pertussis
gccccaggcgucggc

SEQ ID NO: 426777 - RNA, 20 nt, Bordetella pertussis
gccccaguccaggccggccu

SEQ ID NO: 426778 - RNA, 23 nt, Bordetella pertussis
gccccaguccaggccggccugca

SEQ ID NO: 426779 - RNA, 20 nt, Bordetella pertussis
gccccaucaacgacaaagcc

SEQ ID NO: 426780 - RNA, 23 nt, Bordetella pertussis
gccccaucaccauggccgacagc

SEQ ID NO: 426781 - RNA, 17 nt, Bordetella pertussis
gccccauccucaucgug

SEQ ID NO: 426782 - RNA, 18 nt, Bordetella pertussis
gccccauggcaugcaccg

SEQ ID NO: 426783 - RNA, 21 nt, Bordetella pertussis
gccccauugggacgccagccc

SEQ ID NO: 426784 - RNA, 12 nt, Bordetella pertussis
gcccccagcagc

SEQ ID NO: 426785 - RNA, 13 nt, Bordetella pertussis
gcccccagcagcg

SEQ ID NO: 426786 - RNA, 16 nt, Bordetella pertussis
gcccccagcagcgagg

SEQ ID NO: 426787 - RNA, 20 nt, Bordetella pertussis
gcccccagcgccgucagcag

SEQ ID NO: 426788 - RNA, 16 nt, Bordetella pertussis
gcccccagcgcgccug

SEQ ID NO: 426789 - RNA, 19 nt, Bordetella pertussis
gcccccagcgcgccugccc

SEQ ID NO: 426790 - RNA, 16 nt, Bordetella pertussis
gcccccauguccaggu

SEQ ID NO: 426791 - RNA, 16 nt, Bordetella pertussis
gccccccgagggggcu

SEQ ID NO: 426792 - RNA, 17 nt, Bordetella pertussis
gcccccgaaggccgcgc

SEQ ID NO: 426793 - RNA, 20 nt, Bordetella pertussis
gcccccgaaggccgcgccua

SEQ ID NO: 426794 - RNA, 18 nt, Bordetella pertussis
gcccccgauccccugccc

SEQ ID NO: 426795 - RNA, 22 nt, Bordetella pertussis
gcccccgauccccugcccgccu

SEQ ID NO: 426796 - RNA, 16 nt, Bordetella pertussis
gcccccgccgcacggg

SEQ ID NO: 426797 - RNA, 21 nt, Bordetella pertussis
gcccccgcgcugcgcccgcua

SEQ ID NO: 426798 - RNA, 16 nt, Bordetella pertussis
gccccgaucagcaagg

SEQ ID NO: 426799 - RNA, 23 nt, Bordetella pertussis
gccccgaucagcaagggccccag

SEQ ID NO: 426800 - RNA, 17 nt, Bordetella pertussis
gccccgauccgcgggcg

SEQ ID NO: 426801 - RNA, 24 nt, Bordetella pertussis
gccccgaugauggauucgcgccgg

SEQ ID NO: 426802 - RNA, 18 nt, Bordetella pertussis
gccccgcaaggggccggc

SEQ ID NO: 426803 - RNA, 22 nt, Bordetella pertussis
gccccgcaaggggccggcgccg

SEQ ID NO: 426804 - RNA, 17 nt, Bordetella pertussis
gccccgcagggcccgca

SEQ ID NO: 426805 - RNA, 14 nt, Bordetella pertussis
gccccgcaguuuga

SEQ ID NO: 426806 - RNA, 18 nt, Bordetella pertussis
gccccgcaucugcggggc

SEQ ID NO: 426807 - RNA, 11 nt, Bordetella pertussis
gccccgcccgc

SEQ ID NO: 426808 - RNA, 15 nt, Bordetella pertussis
gccccgcccgcguca

SEQ ID NO: 426809 - RNA, 20 nt, Bordetella pertussis
gccccgccgggacacacgcu

SEQ ID NO: 426810 - RNA, 15 nt, Bordetella pertussis
gccccgccugcgcca

SEQ ID NO: 426811 - RNA, 18 nt, Bordetella pertussis
gccccgcgacccagaacc

SEQ ID NO: 426812 - RNA, 24 nt, Bordetella pertussis
gccccgcgcgagcgcaagcaccgc

SEQ ID NO: 426813 - RNA, 21 nt, Bordetella pertussis
gccccgcggccgcggucagcc

SEQ ID NO: 426814 - RNA, 22 nt, Bordetella pertussis
gccccgcggccgcggucagcca

SEQ ID NO: 426815 - RNA, 18 nt, Bordetella pertussis
gccccgcgucggcgaagc

SEQ ID NO: 426816 - RNA, 22 nt, Bordetella pertussis
gccccgcuggccgucgccgccc

SEQ ID NO: 426817 - RNA, 18 nt, Bordetella pertussis
gccccgcuucgggccgga

SEQ ID NO: 426818 - RNA, 20 nt, Bordetella pertussis
gccccgcuucgggccggaug

SEQ ID NO: 426819 - RNA, 23 nt, Bordetella pertussis
gccccggcaccaucgccgccugc

SEQ ID NO: 426820 - RNA, 14 nt, Bordetella pertussis
gccccggcccggcg

SEQ ID NO: 426821 - RNA, 15 nt, Bordetella pertussis
gccccggcccggcgg

SEQ ID NO: 426822 - RNA, 21 nt, Bordetella pertussis
gccccggccgaucgcgccguc

SEQ ID NO: 426823 - RNA, 13 nt, Bordetella pertussis
gccccggccgccc

SEQ ID NO: 426824 - RNA, 13 nt, Bordetella pertussis
gccccggccuccc

SEQ ID NO: 426825 - RNA, 18 nt, Bordetella pertussis
gccccggccucgcggcgc

SEQ ID NO: 426826 - RNA, 13 nt, Bordetella pertussis
gccccggcgcauc

SEQ ID NO: 426827 - RNA, 17 nt, Bordetella pertussis
gccccggcgcgcagcgc

SEQ ID NO: 426828 - RNA, 19 nt, Bordetella pertussis
gccccggcgcgcagcgccu

SEQ ID NO: 426829 - RNA, 22 nt, Bordetella pertussis
gccccggcgcgcagcgccugca

SEQ ID NO: 426830 - RNA, 16 nt, Bordetella pertussis
gccccggcgcgccggc

SEQ ID NO: 426831 - RNA, 17 nt, Bordetella pertussis
gccccggcgcgccggcc

SEQ ID NO: 426832 - RNA, 13 nt, Bordetella pertussis
gccccggcgcggc

SEQ ID NO: 426833 - RNA, 14 nt, Bordetella pertussis
gccccggcgcggcg

SEQ ID NO: 426834 - RNA, 18 nt, Bordetella pertussis
gccccgguagucgccggc

SEQ ID NO: 426835 - RNA, 14 nt, Bordetella pertussis
gccccugcgggccg

SEQ ID NO: 426836 - RNA, 20 nt, Bordetella pertussis
gccccugcggggacaggcac

SEQ ID NO: 426837 - RNA, 13 nt, Bordetella pertussis
gcccgacagcgcc

SEQ ID NO: 426838 - RNA, 16 nt, Bordetella pertussis
gcccgacagcgccccg

SEQ ID NO: 426839 - RNA, 15 nt, Bordetella pertussis
gcccgacaggaacau

SEQ ID NO: 426840 - RNA, 15 nt, Bordetella pertussis
gcccgaccgcauggg

SEQ ID NO: 426841 - RNA, 16 nt, Bordetella pertussis
gcccgaccgcaugggc

SEQ ID NO: 426842 - RNA, 19 nt, Bordetella pertussis
gcccgaccugcuggcgcgc

SEQ ID NO: 426843 - RNA, 23 nt, Bordetella pertussis
gcccgacgacgacuacuggcaac

SEQ ID NO: 426844 - RNA, 22 nt, Bordetella pertussis
gcccgacgaggagccggcgggc

SEQ ID NO: 426845 - RNA, 17 nt, Bordetella pertussis
gcccgacggccagcgcg

SEQ ID NO: 426846 - RNA, 17 nt, Bordetella pertussis
gcccgacggcgcgcccg

SEQ ID NO: 426847 - RNA, 22 nt, Bordetella pertussis
gcccgacgguaucucagcgcgc

SEQ ID NO: 426848 - RNA, 20 nt, Bordetella pertussis
gcccgacuuggugggcaccu

SEQ ID NO: 426849 - RNA, 14 nt, Bordetella pertussis
gcccgagaagggcu

SEQ ID NO: 426850 - RNA, 16 nt, Bordetella pertussis
gcccgagaccgcccgc

SEQ ID NO: 426851 - RNA, 22 nt, Bordetella pertussis
gcccgagagcugcgucuugagc

SEQ ID NO: 426852 - RNA, 23 nt, Bordetella pertussis
gcccgagagcugcgucuugagca

SEQ ID NO: 426853 - RNA, 13 nt, Bordetella pertussis
gcccgagaugccc

SEQ ID NO: 426854 - RNA, 17 nt, Bordetella pertussis
gcccgagauggcgcagg

SEQ ID NO: 426855 - RNA, 15 nt, Bordetella pertussis
gcccgcaccgggcgg

SEQ ID NO: 426856 - RNA, 16 nt, Bordetella pertussis
gcccgcaccgggcggc

SEQ ID NO: 426857 - RNA, 21 nt, Bordetella pertussis
gcccgcaccgggcggcccggc

SEQ ID NO: 426858 - RNA, 20 nt, Bordetella pertussis
gcccgcaggcggcggccucc

SEQ ID NO: 426859 - RNA, 21 nt, Bordetella pertussis
gcccgcaggcggcggccucca

SEQ ID NO: 426860 - RNA, 18 nt, Bordetella pertussis
gcccgcagguggggcagc

SEQ ID NO: 426861 - RNA, 21 nt, Bordetella pertussis
gcccgcauagacgccgaccgc

SEQ ID NO: 426862 - RNA, 24 nt, Bordetella pertussis
gcccgcaucggcguaccaggcagc

SEQ ID NO: 426863 - RNA, 13 nt, Bordetella pertussis
gcccgcaucggcu

SEQ ID NO: 426864 - RNA, 20 nt, Bordetella pertussis
gcccgcauggaccgccgccg

SEQ ID NO: 426865 - RNA, 21 nt, Bordetella pertussis
gcccgcauggaccgccgccgu

SEQ ID NO: 426866 - RNA, 16 nt, Bordetella pertussis
gcccgcaugcaggucc

SEQ ID NO: 426867 - RNA, 17 nt, Bordetella pertussis
gcccgccaccacgcgca

SEQ ID NO: 426868 - RNA, 22 nt, Bordetella pertussis
gcccgccaccacgcgcaccagc

SEQ ID NO: 426869 - RNA, 15 nt, Bordetella pertussis
gcccgccaccacggc

SEQ ID NO: 426870 - RNA, 15 nt, Bordetella pertussis
gcccgccacgcgggc

SEQ ID NO: 426871 - RNA, 17 nt, Bordetella pertussis
gcccgccacgcgggccg

SEQ ID NO: 426872 - RNA, 19 nt, Bordetella pertussis
gcccgccacggucgcgagc

SEQ ID NO: 426873 - RNA, 14 nt, Bordetella pertussis
gcccgccagcagcu

SEQ ID NO: 426874 - RNA, 14 nt, Bordetella pertussis
gcccgcccugggca

SEQ ID NO: 426875 - RNA, 15 nt, Bordetella pertussis
gcccgcccugggcag

SEQ ID NO: 426876 - RNA, 16 nt, Bordetella pertussis
gcccgcccugggcagc

SEQ ID NO: 426877 - RNA, 23 nt, Bordetella pertussis
gcccgcccugggcagcauucugg

SEQ ID NO: 426878 - RNA, 23 nt, Bordetella pertussis
gcccgccgauccacucggccagc

SEQ ID NO: 426879 - RNA, 14 nt, Bordetella pertussis
gcccgccgccgccc

SEQ ID NO: 426880 - RNA, 15 nt, Bordetella pertussis
gcccgccgccugcgc

SEQ ID NO: 426881 - RNA, 13 nt, Bordetella pertussis
gcccgccgcggca

SEQ ID NO: 426882 - RNA, 14 nt, Bordetella pertussis
gcccgccgcggcag

SEQ ID NO: 426883 - RNA, 18 nt, Bordetella pertussis
gcccgcgaaagcgggcaa

SEQ ID NO: 426884 - RNA, 17 nt, Bordetella pertussis
gcccgcgagcggccagc

SEQ ID NO: 426885 - RNA, 24 nt, Bordetella pertussis
gcccgcgagcggccagccugccgc

SEQ ID NO: 426886 - RNA, 20 nt, Bordetella pertussis
gcccgcgcaccaggcgcggc

SEQ ID NO: 426887 - RNA, 13 nt, Bordetella pertussis
gcccgcgcagacg

SEQ ID NO: 426888 - RNA, 13 nt, Bordetella pertussis
gcccgcgcaugca

SEQ ID NO: 426889 - RNA, 18 nt, Bordetella pertussis
gcccgcgcaugcaagaca

SEQ ID NO: 426890 - RNA, 15 nt, Bordetella pertussis
gcccgcgccagcgcc

SEQ ID NO: 426891 - RNA, 19 nt, Bordetella pertussis
gcccgcgccagcgccacgc

SEQ ID NO: 426892 - RNA, 13 nt, Bordetella pertussis
gcccgcgcccagc

SEQ ID NO: 426893 - RNA, 15 nt, Bordetella pertussis
gcccgcgccgcguca

SEQ ID NO: 426894 - RNA, 19 nt, Bordetella pertussis
gcccgcgguccagcacggc

SEQ ID NO: 426895 - RNA, 22 nt, Bordetella pertussis
gcccgcgguccagcacggcgag

SEQ ID NO: 426896 - RNA, 18 nt, Bordetella pertussis
gcccgcgucagacgcgcu

SEQ ID NO: 426897 - RNA, 14 nt, Bordetella pertussis
gcccgcguacagcc

SEQ ID NO: 426898 - RNA, 20 nt, Bordetella pertussis
gcccgcgugacggccgccac

SEQ ID NO: 426899 - RNA, 22 nt, Bordetella pertussis
gcccgcuaugcgggcuugcugc

SEQ ID NO: 426900 - RNA, 15 nt, Bordetella pertussis
gcccgcuccaggcgg

SEQ ID NO: 426901 - RNA, 16 nt, Bordetella pertussis
gcccgcugaccggccu

SEQ ID NO: 426902 - RNA, 23 nt, Bordetella pertussis
gcccgcugaccggccuggucaug

SEQ ID NO: 426903 - RNA, 15 nt, Bordetella pertussis
gcccggcccaggccg

SEQ ID NO: 426904 - RNA, 13 nt, Bordetella pertussis
gcccggccccagg

SEQ ID NO: 426905 - RNA, 13 nt, Bordetella pertussis
gcccggccgccgc

SEQ ID NO: 426906 - RNA, 14 nt, Bordetella pertussis
gcccggccgccgcc

SEQ ID NO: 426907 - RNA, 15 nt, Bordetella pertussis
gcccggccgccgccg

SEQ ID NO: 426908 - RNA, 17 nt, Bordetella pertussis
gcccggccgccgccggc

SEQ ID NO: 426909 - RNA, 12 nt, Bordetella pertussis
gcccggccgccu

SEQ ID NO: 426910 - RNA, 13 nt, Bordetella pertussis
gcccggccgccuc

SEQ ID NO: 426911 - RNA, 21 nt, Bordetella pertussis
gcccggccgccagcauggcgu

SEQ ID NO: 426912 - RNA, 16 nt, Bordetella pertussis
gcccggccggcacggc

SEQ ID NO: 426913 - RNA, 18 nt, Bordetella pertussis
gcccggccggcacggccg

SEQ ID NO: 426914 - RNA, 20 nt, Bordetella pertussis
gcccggccggcacggccggc

SEQ ID NO: 426915 - RNA, 12 nt, Bordetella pertussis
gcccggccggcc

SEQ ID NO: 426916 - RNA, 15 nt, Bordetella pertussis
gcccggccggcccgc

SEQ ID NO: 426917 - RNA, 20 nt, Bordetella pertussis
gcccggccugcgggcgccgc

SEQ ID NO: 426918 - RNA, 19 nt, Bordetella pertussis
gcccggcggaucacccagc

SEQ ID NO: 426919 - RNA, 22 nt, Bordetella pertussis
gcccggcggaucacccagcggc

SEQ ID NO: 426920 - RNA, 19 nt, Bordetella pertussis
gcccggcggccaggccggc

SEQ ID NO: 426921 - RNA, 14 nt, Bordetella pertussis
gcccggcggcgcgc

SEQ ID NO: 426922 - RNA, 15 nt, Bordetella pertussis
gcccggcggcgcggc

SEQ ID NO: 426923 - RNA, 16 nt, Bordetella pertussis
gcccggcggcgcggcg

SEQ ID NO: 426924 - RNA, 18 nt, Bordetella pertussis
gcccggcgggaacaggca

SEQ ID NO: 426925 - RNA, 20 nt, Bordetella pertussis
gcccggcguagcugcgccgc

SEQ ID NO: 426926 - RNA, 22 nt, Bordetella pertussis
gcccggcgugacgcugacccug

SEQ ID NO: 426927 - RNA, 15 nt, Bordetella pertussis
gcccggcgugcugag

SEQ ID NO: 426928 - RNA, 14 nt, Bordetella pertussis
gcccgggcgccggc

SEQ ID NO: 426929 - RNA, 13 nt, Bordetella pertussis
gcccgggcgccug

SEQ ID NO: 426930 - RNA, 22 nt, Bordetella pertussis
gcccgggcgccugcgccaccug

SEQ ID NO: 426931 - RNA, 12 nt, Bordetella pertussis
gcccgggcgcgc

SEQ ID NO: 426932 - RNA, 20 nt, Bordetella pertussis
gcccgggcgagauggcgugc

SEQ ID NO: 426933 - RNA, 18 nt, Bordetella pertussis
gcccgggcgugccugcuu

SEQ ID NO: 426934 - RNA, 17 nt, Bordetella pertussis
gcccgggcuggccgccu

SEQ ID NO: 426935 - RNA, 18 nt, Bordetella pertussis
gcccgggcuggccgccug

SEQ ID NO: 426936 - RNA, 19 nt, Bordetella pertussis
gcccggguuggcguccagg

SEQ ID NO: 426937 - RNA, 13 nt, Bordetella pertussis
gcccgucaggcgg

SEQ ID NO: 426938 - RNA, 13 nt, Bordetella pertussis
gcccguccgggcg

SEQ ID NO: 426939 - RNA, 16 nt, Bordetella pertussis
gcccguccgggcggcg

SEQ ID NO: 426940 - RNA, 17 nt, Bordetella pertussis
gcccgucgcgccaggcc

SEQ ID NO: 426941 - RNA, 20 nt, Bordetella pertussis
gcccgucgcgccaggccggc

SEQ ID NO: 426942 - RNA, 18 nt, Bordetella pertussis
gcccguucacgcgcagcg

SEQ ID NO: 426943 - RNA, 16 nt, Bordetella pertussis
gcccguugcggcgccu

SEQ ID NO: 426944 - RNA, 18 nt, Bordetella pertussis
gcccguuggcaggccagc

SEQ ID NO: 426945 - RNA, 16 nt, Bordetella pertussis
gcccucgucgcggccg

SEQ ID NO: 426946 - RNA, 17 nt, Bordetella pertussis
gcccucgucgcggccgu

SEQ ID NO: 426947 - RNA, 23 nt, Bordetella pertussis
gcccucuucggcggccagccggc

SEQ ID NO: 426948 - RNA, 17 nt, Bordetella pertussis
gcccugaacuauggcgc

SEQ ID NO: 426949 - RNA, 18 nt, Bordetella pertussis
gcccugacgaccaaccug

SEQ ID NO: 426950 - RNA, 23 nt, Bordetella pertussis
gcccugcccggcgagcauggcgg

SEQ ID NO: 426951 - RNA, 13 nt, Bordetella pertussis
gcccugacccgcu

SEQ ID NO: 426952 - RNA, 22 nt, Bordetella pertussis
gcccugacccgcuggcuggcag

SEQ ID NO: 426953 - RNA, 14 nt, Bordetella pertussis
gcccugccgccaag

SEQ ID NO: 426954 - RNA, 19 nt, Bordetella pertussis
gcccugccgcccuggcgca

SEQ ID NO: 426955 - RNA, 21 nt, Bordetella pertussis
gcccugccgcccuggcgcagg

SEQ ID NO: 426956 - RNA, 15 nt, Bordetella pertussis
gcccugcgaacccgc

SEQ ID NO: 426957 - RNA, 18 nt, Bordetella pertussis
gcccugcgaacccgccgc

SEQ ID NO: 426958 - RNA, 15 nt, Bordetella pertussis
gcccugcgccagcgc

SEQ ID NO: 426959 - RNA, 23 nt, Bordetella pertussis
gcccugcgcguacguggcgcggc

SEQ ID NO: 426960 - RNA, 24 nt, Bordetella pertussis
gcccugcgcguugagcagcaugug

SEQ ID NO: 426961 - RNA, 16 nt, Bordetella pertussis
gcccugcggacccagu

SEQ ID NO: 426962 - RNA, 15 nt, Bordetella pertussis
gcccugcggcgcggc

SEQ ID NO: 426963 - RNA, 22 nt, Bordetella pertussis
gcccugcggcgcggccagcacg

SEQ ID NO: 426964 - RNA, 23 nt, Bordetella pertussis
gcccugcguggcgcagugggcca

SEQ ID NO: 426965 - RNA, 21 nt, Bordetella pertussis
gcccugcgugugccugucccc

SEQ ID NO: 426966 - RNA, 16 nt, Bordetella pertussis
gcccugcugcccgccg

SEQ ID NO: 426967 - RNA, 19 nt, Bordetella pertussis
gcccuggcgcagggcauac

SEQ ID NO: 426968 - RNA, 18 nt, Bordetella pertussis
gcccuggcgccgcggccg

SEQ ID NO: 426969 - RNA, 19 nt, Bordetella pertussis
gcccuggcgccgcggccgg

SEQ ID NO: 426970 - RNA, 22 nt, Bordetella pertussis
gcccuggcgcaggccggcggcc

SEQ ID NO: 426971 - RNA, 14 nt, Bordetella pertussis
gcccuggcgcugca

SEQ ID NO: 426972 - RNA, 18 nt, Bordetella pertussis
gcccuggcgcugcagcgu

SEQ ID NO: 426973 - RNA, 23 nt, Bordetella pertussis
gcccuggcguucgcgcgcggggu

SEQ ID NO: 426974 - RNA, 13 nt, Bordetella pertussis
gcccugggccagc

SEQ ID NO: 426975 - RNA, 17 nt, Bordetella pertussis
gcccugggccagccagc

SEQ ID NO: 426976 - RNA, 18 nt, Bordetella pertussis
gcccugggccagccagcg

SEQ ID NO: 426977 - RNA, 22 nt, Bordetella pertussis
gcccugggccagccagcgccgc

SEQ ID NO: 426978 - RNA, 16 nt, Bordetella pertussis
gcccuggcuggccagc

SEQ ID NO: 426979 - RNA, 21 nt, Bordetella pertussis
gcccuggcuggccagccggcc

SEQ ID NO: 426980 - RNA, 16 nt, Bordetella pertussis
gcccuggggccgcggc

SEQ ID NO: 426981 - RNA, 17 nt, Bordetella pertussis
gcccugggcgcggcggu

SEQ ID NO: 426982 - RNA, 22 nt, Bordetella pertussis
gcccuggguggcggggcgcauc

SEQ ID NO: 426983 - RNA, 18 nt, Bordetella pertussis
gcccuggucaucgccaug

SEQ ID NO: 426984 - RNA, 22 nt, Bordetella pertussis
gcccuggucaucgccaugcugc

SEQ ID NO: 426985 - RNA, 19 nt, Bordetella pertussis
gcccuggucgucgcggccc

SEQ ID NO: 426986 - RNA, 20 nt, Bordetella pertussis
gccgauacaggcgcucgcgc

SEQ ID NO: 426987 - RNA, 21 nt, Bordetella pertussis
gccgauaccacgcgcggcggc

SEQ ID NO: 426988 - RNA, 19 nt, Bordetella pertussis
gccgauagccgugaccugc

SEQ ID NO: 426989 - RNA, 17 nt, Bordetella pertussis
gccgaucagcaccacgg

SEQ ID NO: 426990 - RNA, 16 nt, Bordetella pertussis
gccgaucagccggcca

SEQ ID NO: 426991 - RNA, 20 nt, Bordetella pertussis
gccgaucagccggccauggc

SEQ ID NO: 426992 - RNA, 18 nt, Bordetella pertussis
gccgaucgcgcacagcau

SEQ ID NO: 426993 - RNA, 21 nt, Bordetella pertussis
gccgaucgcgccguccgagcc

SEQ ID NO: 426994 - RNA, 19 nt, Bordetella pertussis
gccgaucgugcacgcccgc

SEQ ID NO: 426995 - RNA, 22 nt, Bordetella pertussis
gccgaucgugcacgcccgcggc

SEQ ID NO: 426996 - RNA, 14 nt, Bordetella pertussis
gccgaucugcuggg

SEQ ID NO: 426997 - RNA, 15 nt, Bordetella pertussis
gccgaucugcuucca

SEQ ID NO: 426998 - RNA, 15 nt, Bordetella pertussis
gccgaugaagacgcc

SEQ ID NO: 426999 - RNA, 20 nt, Bordetella pertussis
gccgaugaauugcgccacgc

SEQ ID NO: 427000 - RNA, 20 nt, Bordetella pertussis
gccgaugacaucgccgcugc

SEQ ID NO: 427001 - RNA, 15 nt, Bordetella pertussis
gccgaugauggccau

SEQ ID NO: 427002 - RNA, 23 nt, Bordetella pertussis
gccgaugccgccaucauccuggu

SEQ ID NO: 427003 - RNA, 13 nt, Bordetella pertussis
gccgaugccgcgc

SEQ ID NO: 427004 - RNA, 14 nt, Bordetella pertussis
gccgaugccgcgca

SEQ ID NO: 427005 - RNA, 18 nt, Bordetella pertussis
gccgaugccgcgcaccug

SEQ ID NO: 427006 - RNA, 14 nt, Bordetella pertussis
gccgaugcgcucgg

SEQ ID NO: 427007 - RNA, 13 nt, Bordetella pertussis
gccgaugcggcgc

SEQ ID NO: 427008 - RNA, 20 nt, Bordetella pertussis
gccgaugcguccgccgugca

SEQ ID NO: 427009 - RNA, 24 nt, Bordetella pertussis
gccgauggcauggggcaggcgcag

SEQ ID NO: 427010 - RNA, 13 nt, Bordetella pertussis
gccgauggcgcgc

SEQ ID NO: 427011 - RNA, 18 nt, Bordetella pertussis
gccgauggcgcgcggcug

SEQ ID NO: 427012 - RNA, 15 nt, Bordetella pertussis
gccgauggcgcggcc

SEQ ID NO: 427013 - RNA, 17 nt, Bordetella pertussis
gccgauggcggugguga

SEQ ID NO: 427014 - RNA, 17 nt, Bordetella pertussis
gccgauggcguccagca

SEQ ID NO: 427015 - RNA, 19 nt, Bordetella pertussis
gccgauggcguccagcagc

SEQ ID NO: 427016 - RNA, 23 nt, Bordetella pertussis
gccgauggcguccagcagcagga

SEQ ID NO: 427017 - RNA, 21 nt, Bordetella pertussis
gccgauggcgccaccuucgcc

SEQ ID NO: 427018 - RNA, 20 nt, Bordetella pertussis
gccgaugucgaacagcugca

SEQ ID NO: 427019 - RNA, 15 nt, Bordetella pertussis
gccgaugucgccgcc

SEQ ID NO: 427020 - RNA, 17 nt, Bordetella pertussis
gccgaugucgccgccug

SEQ ID NO: 427021 - RNA, 13 nt, Bordetella pertussis
gccgcaccaggcc

SEQ ID NO: 427022 - RNA, 18 nt, Bordetella pertussis
gccgcaccaggccgcggc

SEQ ID NO: 427023 - RNA, 19 nt, Bordetella pertussis
gccgcaccaggccgcggcg

SEQ ID NO: 427024 - RNA, 18 nt, Bordetella pertussis
gccgcacgaucgcgccgg

SEQ ID NO: 427025 - RNA, 19 nt, Bordetella pertussis
gccgcacgaucgcgccggc

SEQ ID NO: 427026 - RNA, 21 nt, Bordetella pertussis
gccgcacgaucgcgccggccu

SEQ ID NO: 427027 - RNA, 14 nt, Bordetella pertussis
gccgcacgcgcggc

SEQ ID NO: 427028 - RNA, 15 nt, Bordetella pertussis
gccgcacgcggccgc

SEQ ID NO: 427029 - RNA, 19 nt, Bordetella pertussis
gccgcacgggcgccugucc

SEQ ID NO: 427030 - RNA, 21 nt, Bordetella pertussis
gccgcacgguggcgccgucgc

SEQ ID NO: 427031 - RNA, 23 nt, Bordetella pertussis
gccgcacugaucuuucagcgcga

SEQ ID NO: 427032 - RNA, 20 nt, Bordetella pertussis
gccgcacuucgggccacccg

SEQ ID NO: 427033 - RNA, 15 nt, Bordetella pertussis
gccgcagaacagcag

SEQ ID NO: 427034 - RNA, 17 nt, Bordetella pertussis
gccgcagauggccagca

SEQ ID NO: 427035 - RNA, 19 nt, Bordetella pertussis
gccgcagauggccagcagc

SEQ ID NO: 427036 - RNA, 20 nt, Bordetella pertussis
gccgcagcaauugccccagc

SEQ ID NO: 427037 - RNA, 22 nt, Bordetella pertussis
gccgcagcaccacaucgccggc

SEQ ID NO: 427038 - RNA, 13 nt, Bordetella pertussis
gccgcagcaccuc

SEQ ID NO: 427039 - RNA, 13 nt, Bordetella pertussis
gccgcagcaccuu

SEQ ID NO: 427040 - RNA, 15 nt, Bordetella pertussis
gccgcagcaggcgcu

SEQ ID NO: 427041 - RNA, 16 nt, Bordetella pertussis
gccgcagcaggcgcuc

SEQ ID NO: 427042 - RNA, 18 nt, Bordetella pertussis
gccgcagcaggcgcucgg

SEQ ID NO: 427043 - RNA, 19 nt, Bordetella pertussis
gccgcagcauggcgccagc

SEQ ID NO: 427044 - RNA, 12 nt, Bordetella pertussis
gccgcagcccgc

SEQ ID NO: 427045 - RNA, 17 nt, Bordetella pertussis
gccgcagcccgcgcgcc

SEQ ID NO: 427046 - RNA, 16 nt, Bordetella pertussis
gccgcagccgccagcg

SEQ ID NO: 427047 - RNA, 13 nt, Bordetella pertussis
gccgcagccggcu

SEQ ID NO: 427048 - RNA, 16 nt, Bordetella pertussis
gccgcagccggcugca

SEQ ID NO: 427049 - RNA, 14 nt, Bordetella pertussis
gccgcagcggcagc

SEQ ID NO: 427050 - RNA, 15 nt, Bordetella pertussis
gccgcagcggcagcg

SEQ ID NO: 427051 - RNA, 13 nt, Bordetella pertussis
gccgcagcgggcc

SEQ ID NO: 427052 - RNA, 15 nt, Bordetella pertussis
gccgcaggccagccc

SEQ ID NO: 427053 - RNA, 19 nt, Bordetella pertussis
gccgcaggccagcccgcgc

SEQ ID NO: 427054 - RNA, 18 nt, Bordetella pertussis
gccgcaggcuaugcaggc

SEQ ID NO: 427055 - RNA, 16 nt, Bordetella pertussis
gccgcagguccaggcc

SEQ ID NO: 427056 - RNA, 21 nt, Bordetella pertussis
gccgcagguccaggccuggga

SEQ ID NO: 427057 - RNA, 20 nt, Bordetella pertussis
gccgcaguauuccugcuggu

SEQ ID NO: 427058 - RNA, 23 nt, Bordetella pertussis
gccgcaguauuccugcugguaga

SEQ ID NO: 427059 - RNA, 16 nt, Bordetella pertussis
gccgcagugcgcgcgc

SEQ ID NO: 427060 - RNA, 21 nt, Bordetella pertussis
gccgcaucccgcccccgccgc

SEQ ID NO: 427061 - RNA, 16 nt, Bordetella pertussis
gccgcaugggcgcgcc

SEQ ID NO: 427062 - RNA, 16 nt, Bordetella pertussis
gccgcaugcggcggcu

SEQ ID NO: 427063 - RNA, 17 nt, Bordetella pertussis
gccgccaagggcgcgcc

SEQ ID NO: 427064 - RNA, 20 nt, Bordetella pertussis
gccgccaagggcgcgccagc

SEQ ID NO: 427065 - RNA, 23 nt, Bordetella pertussis
gccgccaagggcgcgccagcacg

SEQ ID NO: 427066 - RNA, 18 nt, Bordetella pertussis
gccgccacacgaggaccg

SEQ ID NO: 427067 - RNA, 15 nt, Bordetella pertussis
gccgccaccagcggc

SEQ ID NO: 427068 - RNA, 18 nt, Bordetella pertussis
gccgccacccaggcggca

SEQ ID NO: 427069 - RNA, 16 nt, Bordetella pertussis
gccgccacgcccuggc

SEQ ID NO: 427070 - RNA, 16 nt, Bordetella pertussis
gccgccacgcuggccg

SEQ ID NO: 427071 - RNA, 22 nt, Bordetella pertussis
gccgccaccugggccgccugcu

SEQ ID NO: 427072 - RNA, 15 nt, Bordetella pertussis
gccgccagcacgcca

SEQ ID NO: 427073 - RNA, 16 nt, Bordetella pertussis
gccgccagccaccccg

SEQ ID NO: 427074 - RNA, 18 nt, Bordetella pertussis
gccgccagccggcccagc

SEQ ID NO: 427075 - RNA, 16 nt, Bordetella pertussis
gccgccagcgccauga

SEQ ID NO: 427076 - RNA, 16 nt, Bordetella pertussis
gccgccagcgccugga

SEQ ID NO: 427077 - RNA, 20 nt, Bordetella pertussis
gccgccagcgccuggaccug

SEQ ID NO: 427078 - RNA, 15 nt, Bordetella pertussis
gccgccagcgcgccg

SEQ ID NO: 427079 - RNA, 16 nt, Bordetella pertussis
gccgccagcggcuggc

SEQ ID NO: 427080 - RNA, 20 nt, Bordetella pertussis
gccgccagcggcuggcgccg

SEQ ID NO: 427081 - RNA, 13 nt, Bordetella pertussis
gccgccagcuugg

SEQ ID NO: 427082 - RNA, 17 nt, Bordetella pertussis
gccgccagggccgagcc

SEQ ID NO: 427083 - RNA, 13 nt, Bordetella pertussis
gccgccaugcagc

SEQ ID NO: 427084 - RNA, 15 nt, Bordetella pertussis
gccgccaugcagcug

SEQ ID NO: 427085 - RNA, 20 nt, Bordetella pertussis
gccgccaugcgccagcagga

SEQ ID NO: 427086 - RNA, 19 nt, Bordetella pertussis
gccgccauggugccgcgca

SEQ ID NO: 427087 - RNA, 23 nt, Bordetella pertussis
gccgccauggugccgcgcaggcc

SEQ ID NO: 427088 - RNA, 13 nt, Bordetella pertussis
gccgccauggcgc

SEQ ID NO: 427089 - RNA, 17 nt, Bordetella pertussis
gccgccauggcgcuggc

SEQ ID NO: 427090 - RNA, 16 nt, Bordetella pertussis
gccgcccaccaccagc

SEQ ID NO: 427091 - RNA, 14 nt, Bordetella pertussis
gccgcccacggcga

SEQ ID NO: 427092 - RNA, 17 nt, Bordetella pertussis
gccgcccacgggcgccu

SEQ ID NO: 427093 - RNA, 20 nt, Bordetella pertussis
gccgcccacgggcgccuggu

SEQ ID NO: 427094 - RNA, 22 nt, Bordetella pertussis
gccgcccacgccauggacgccg

SEQ ID NO: 427095 - RNA, 21 nt, Bordetella pertussis
gccgcccacugccaggcgagc

SEQ ID NO: 427096 - RNA, 14 nt, Bordetella pertussis
gccgcccagcaccu

SEQ ID NO: 427097 - RNA, 19 nt, Bordetella pertussis
gccgcccagcgcgugggcc

SEQ ID NO: 427098 - RNA, 21 nt, Bordetella pertussis
gccgcccagcgcgugggccag

SEQ ID NO: 427099 - RNA, 22 nt, Bordetella pertussis
gccgcccagcgcgugggccagc

SEQ ID NO: 427100 - RNA, 13 nt, Bordetella pertussis
gccgcccaggagc

SEQ ID NO: 427101 - RNA, 20 nt, Bordetella pertussis
gccgcccaggagcaacuggg

SEQ ID NO: 427102 - RNA, 16 nt, Bordetella pertussis
gccgcccaugccgccc

SEQ ID NO: 427103 - RNA, 11 nt, Bordetella pertussis
gccgccccagc

SEQ ID NO: 427104 - RNA, 15 nt, Bordetella pertussis
gccgccccaacggcc

SEQ ID NO: 427105 - RNA, 17 nt, Bordetella pertussis
gccgcccccgcccagca

SEQ ID NO: 427106 - RNA, 19 nt, Bordetella pertussis
gccgcccccgcccagcauc

SEQ ID NO: 427107 - RNA, 22 nt, Bordetella pertussis
gccgcccccgcccagcauccgc

SEQ ID NO: 427108 - RNA, 23 nt, Bordetella pertussis
gccgccccggcgcggcgcgcgcc

SEQ ID NO: 427109 - RNA, 14 nt, Bordetella pertussis
gccgcccgacagca

SEQ ID NO: 427110 - RNA, 17 nt, Bordetella pertussis
gccgcccgcacgaagcg

SEQ ID NO: 427111 - RNA, 15 nt, Bordetella pertussis
gccgcccgcaggcau

SEQ ID NO: 427112 - RNA, 15 nt, Bordetella pertussis
gccgcccgccgggcc

SEQ ID NO: 427113 - RNA, 16 nt, Bordetella pertussis
gccgcccgccucaggc

SEQ ID NO: 427114 - RNA, 15 nt, Bordetella pertussis
gccgcccgccugccg

SEQ ID NO: 427115 - RNA, 12 nt, Bordetella pertussis
gccgcccgcggc

SEQ ID NO: 427116 - RNA, 11 nt, Bordetella pertussis
gccgcccggca

SEQ ID NO: 427117 - RNA, 14 nt, Bordetella pertussis
gccgcccggcagcu

SEQ ID NO: 427118 - RNA, 19 nt, Bordetella pertussis
gccgcccguccgggcggcg

SEQ ID NO: 427119 - RNA, 20 nt, Bordetella pertussis
gccgcccugcugcccgccgc

SEQ ID NO: 427120 - RNA, 15 nt, Bordetella pertussis
gccgccgcacagcgu

SEQ ID NO: 427121 - RNA, 14 nt, Bordetella pertussis
gccgccgcagccgc

SEQ ID NO: 427122 - RNA, 18 nt, Bordetella pertussis
gccgccgcccacgccgcc

SEQ ID NO: 427123 - RNA, 19 nt, Bordetella pertussis
gccgccgcccacgccgccu

SEQ ID NO: 427124 - RNA, 20 nt, Bordetella pertussis
gccgccgcccacgccgccug

SEQ ID NO: 427125 - RNA, 18 nt, Bordetella pertussis
gccgccgccagcgcgccg

SEQ ID NO: 427126 - RNA, 22 nt, Bordetella pertussis
gccgccgcccgcacgaagcggc

SEQ ID NO: 427127 - RNA, 14 nt, Bordetella pertussis
gccgccgcccgccc

SEQ ID NO: 427128 - RNA, 16 nt, Bordetella pertussis
gccgccgcccgcccgc

SEQ ID NO: 427129 - RNA, 17 nt, Bordetella pertussis
gccgccgcccgcccgcc

SEQ ID NO: 427130 - RNA, 22 nt, Bordetella pertussis
gccgccgcccgcccgccgccug

SEQ ID NO: 427131 - RNA, 16 nt, Bordetella pertussis
gccgccgcccucgccc

SEQ ID NO: 427132 - RNA, 15 nt, Bordetella pertussis
gccgccgcccuggcc

SEQ ID NO: 427133 - RNA, 14 nt, Bordetella pertussis
gccgccggcgcacc

SEQ ID NO: 427134 - RNA, 22 nt, Bordetella pertussis
gccgccggccucuucgucgccg

SEQ ID NO: 427135 - RNA, 17 nt, Bordetella pertussis
gccgccggcgcgcggau

SEQ ID NO: 427136 - RNA, 15 nt, Bordetella pertussis
gccgccggcgcggcu

SEQ ID NO: 427137 - RNA, 16 nt, Bordetella pertussis
gccgccggcgcggcug

SEQ ID NO: 427138 - RNA, 14 nt, Bordetella pertussis
gccgccggcgcggu

SEQ ID NO: 427139 - RNA, 21 nt, Bordetella pertussis
gccgccggcgcgguggccaug

SEQ ID NO: 427140 - RNA, 23 nt, Bordetella pertussis
gccgccggcggauuugcucgcgu

SEQ ID NO: 427141 - RNA, 15 nt, Bordetella pertussis
gccgccggcggccug

SEQ ID NO: 427142 - RNA, 17 nt, Bordetella pertussis
gccgccggcggccugga

SEQ ID NO: 427143 - RNA, 20 nt, Bordetella pertussis
gccgccggcggccuggaccu

SEQ ID NO: 427144 - RNA, 21 nt, Bordetella pertussis
gccgccggcggccuggaccug

SEQ ID NO: 427145 - RNA, 18 nt, Bordetella pertussis
gccgccggcggcgcacca

SEQ ID NO: 427146 - RNA, 21 nt, Bordetella pertussis
gccgccgggcaugcaccaggc

SEQ ID NO: 427147 - RNA, 22 nt, Bordetella pertussis
gccgccgggcauugccggagca

SEQ ID NO: 427148 - RNA, 18 nt, Bordetella pertussis
gccgccguacgaguggcc

SEQ ID NO: 427149 - RNA, 19 nt, Bordetella pertussis
gccgccguaggacagcccc

SEQ ID NO: 427150 - RNA, 20 nt, Bordetella pertussis
gccgccguaggacagcccca

SEQ ID NO: 427151 - RNA, 23 nt, Bordetella pertussis
gccgccguaggacagccccagca

SEQ ID NO: 427152 - RNA, 18 nt, Bordetella pertussis
gccgccgucaacgcccag

SEQ ID NO: 427153 - RNA, 20 nt, Bordetella pertussis
gccgccgucaacgcccaggu

SEQ ID NO: 427154 - RNA, 18 nt, Bordetella pertussis
gccgccgugaugccgccc

SEQ ID NO: 427155 - RNA, 16 nt, Bordetella pertussis
gccgccgugcgcgggc

SEQ ID NO: 427156 - RNA, 19 nt, Bordetella pertussis
gccgccgugcgcgggcgcg

SEQ ID NO: 427157 - RNA, 18 nt, Bordetella pertussis
gccgccguuuucgcccgc

SEQ ID NO: 427158 - RNA, 19 nt, Bordetella pertussis
gccgccguuuucgcccgcc

SEQ ID NO: 427159 - RNA, 19 nt, Bordetella pertussis
gccgccuauguaggcgccg

SEQ ID NO: 427160 - RNA, 17 nt, Bordetella pertussis
gccgccucaccgcgccg

SEQ ID NO: 427161 - RNA, 12 nt, Bordetella pertussis
gccgccucagcc

SEQ ID NO: 427162 - RNA, 13 nt, Bordetella pertussis
gccgccucaggcc

SEQ ID NO: 427163 - RNA, 16 nt, Bordetella pertussis
gccgccucaggccggc

SEQ ID NO: 427164 - RNA, 22 nt, Bordetella pertussis
gccgccucgauugaccagcacc

SEQ ID NO: 427165 - RNA, 18 nt, Bordetella pertussis
gccgccucggcggccagc

SEQ ID NO: 427166 - RNA, 14 nt, Bordetella pertussis
gccgccucgggcac

SEQ ID NO: 427167 - RNA, 17 nt, Bordetella pertussis
gccgcgaacgcgccggc

SEQ ID NO: 427168 - RNA, 18 nt, Bordetella pertussis
gccgcgaacgcgccggcc

SEQ ID NO: 427169 - RNA, 19 nt, Bordetella pertussis
gccgcgaacgcgccggccc

SEQ ID NO: 427170 - RNA, 22 nt, Bordetella pertussis
gccgcgacaaauagccgaccgc

SEQ ID NO: 427171 - RNA, 23 nt, Bordetella pertussis
gccgcgacacaaggcggccgcgc

SEQ ID NO: 427172 - RNA, 19 nt, Bordetella pertussis
gccgcgacauagcgcugga

SEQ ID NO: 427173 - RNA, 18 nt, Bordetella pertussis
gccgcgaccaccagcacc

SEQ ID NO: 427174 - RNA, 20 nt, Bordetella pertussis
gccgcgaccaccagcaccau

SEQ ID NO: 427175 - RNA, 17 nt, Bordetella pertussis
gccgcgcacccaggccc

SEQ ID NO: 427176 - RNA, 17 nt, Bordetella pertussis
gccgcgcaccugggcgu

SEQ ID NO: 427177 - RNA, 19 nt, Bordetella pertussis
gccgcgcaccugggcgucg

SEQ ID NO: 427178 - RNA, 22 nt, Bordetella pertussis
gccgcgcagaaaccgccacagc

SEQ ID NO: 427179 - RNA, 13 nt, Bordetella pertussis
gccgcgcagcagc

SEQ ID NO: 427180 - RNA, 19 nt, Bordetella pertussis
gccgcgcagcgucugcgca

SEQ ID NO: 427181 - RNA, 15 nt, Bordetella pertussis
gccgcgcaugccagc

SEQ ID NO: 427182 - RNA, 19 nt, Bordetella pertussis
gccgcgcauuugccgcggc

SEQ ID NO: 427183 - RNA, 14 nt, Bordetella pertussis
gccgcgccaagggc

SEQ ID NO: 427184 - RNA, 19 nt, Bordetella pertussis
gccgcgcaucgaucaggcu

SEQ ID NO: 427185 - RNA, 14 nt, Bordetella pertussis
gccgcgccagcgcc

SEQ ID NO: 427186 - RNA, 16 nt, Bordetella pertussis
gccgcgccagggcgcg

SEQ ID NO: 427187 - RNA, 17 nt, Bordetella pertussis
gccgcgccaugcucgcg

SEQ ID NO: 427188 - RNA, 13 nt, Bordetella pertussis
gccgcgcccagcc

SEQ ID NO: 427189 - RNA, 15 nt, Bordetella pertussis
gccgcgcccagccgc

SEQ ID NO: 427190 - RNA, 18 nt, Bordetella pertussis
gccgcgcccagcgcggcc

SEQ ID NO: 427191 - RNA, 15 nt, Bordetella pertussis
gccgcgcccaugcgc

SEQ ID NO: 427192 - RNA, 14 nt, Bordetella pertussis
gccgcggcguccgc

SEQ ID NO: 427193 - RNA, 23 nt, Bordetella pertussis
gccgcggcuugccgcggcgcggc

SEQ ID NO: 427194 - RNA, 15 nt, Bordetella pertussis
gccgcgggccgcugg

SEQ ID NO: 427195 - RNA, 14 nt, Bordetella pertussis
gccgcgggcgaagc

SEQ ID NO: 427196 - RNA, 17 nt, Bordetella pertussis
gccgcgggcgaagcagu

SEQ ID NO: 427197 - RNA, 14 nt, Bordetella pertussis
gccgcgggcgccgc

SEQ ID NO: 427198 - RNA, 13 nt, Bordetella pertussis
gccgcgggcggcg

SEQ ID NO: 427199 - RNA, 19 nt, Bordetella pertussis
gccgcgggcggcgccggcc

SEQ ID NO: 427200 - RNA, 21 nt, Bordetella pertussis
gccgcgggcggcgccggccgc

SEQ ID NO: 427201 - RNA, 16 nt, Bordetella pertussis
gccgcggggcuggcca

SEQ ID NO: 427202 - RNA, 21 nt, Bordetella pertussis
gccgcgggugucgcuccccca

SEQ ID NO: 427203 - RNA, 22 nt, Bordetella pertussis
gccgcgguaaugacgcagccgc

SEQ ID NO: 427204 - RNA, 15 nt, Bordetella pertussis
gccgcgguccgggcc

SEQ ID NO: 427205 - RNA, 14 nt, Bordetella pertussis
gccgcggugcuggg

SEQ ID NO: 427206 - RNA, 15 nt, Bordetella pertussis
gccgcggugcugggc

SEQ ID NO: 427207 - RNA, 19 nt, Bordetella pertussis
gccgcgguugcgguucugg

SEQ ID NO: 427208 - RNA, 19 nt, Bordetella pertussis
gccgcguacaacgccgcgu

SEQ ID NO: 427209 - RNA, 22 nt, Bordetella pertussis
gccgcguacaacgccgcguccg

SEQ ID NO: 427210 - RNA, 23 nt, Bordetella pertussis
gccgcguacaacgccgcguccgc

SEQ ID NO: 427211 - RNA, 21 nt, Bordetella pertussis
gccgcguucacgccggcgcgc

SEQ ID NO: 427212 - RNA, 15 nt, Bordetella pertussis
gccgcguugcagcca

SEQ ID NO: 427213 - RNA, 19 nt, Bordetella pertussis
gccgcguugcagccacagg

SEQ ID NO: 427214 - RNA, 16 nt, Bordetella pertussis
gccgcuaggccuugcc

SEQ ID NO: 427215 - RNA, 19 nt, Bordetella pertussis
gccgcucguaguguuccug

SEQ ID NO: 427216 - RNA, 17 nt, Bordetella pertussis
gccgcugaccggcggca

SEQ ID NO: 427217 - RNA, 22 nt, Bordetella pertussis
gccgcugaucuuccugggcgaa

SEQ ID NO: 427218 - RNA, 20 nt, Bordetella pertussis
gccgcuggauuucgccgcgu

SEQ ID NO: 427219 - RNA, 21 nt, Bordetella pertussis
gccgcuggauuucgccgcguu

SEQ ID NO: 427220 - RNA, 12 nt, Bordetella pertussis
gccgcuggccac

SEQ ID NO: 427221 - RNA, 15 nt, Bordetella pertussis
gccgcuggcgcgccg

SEQ ID NO: 427222 - RNA, 16 nt, Bordetella pertussis
gccgcuggcgcgccgc

SEQ ID NO: 427223 - RNA, 13 nt, Bordetella pertussis
gccgcuggcggcc

SEQ ID NO: 427224 - RNA, 18 nt, Bordetella pertussis
gccgcuggcggcccugcc

SEQ ID NO: 427225 - RNA, 14 nt, Bordetella pertussis
gccgcuggcggccg

SEQ ID NO: 427226 - RNA, 15 nt, Bordetella pertussis
gccgcuggcggccgc

SEQ ID NO: 427227 - RNA, 16 nt, Bordetella pertussis
gccgcuggcgucgcgc

SEQ ID NO: 427228 - RNA, 21 nt, Bordetella pertussis
gccgcuggucguaucgccgcu

SEQ ID NO: 427229 - RNA, 20 nt, Bordetella pertussis
gccgcugucgcaggcgcugc

SEQ ID NO: 427230 - RNA, 22 nt, Bordetella pertussis
gccggaaacgcggucaccgagc

SEQ ID NO: 427231 - RNA, 16 nt, Bordetella pertussis
gccggaaagcugucca

SEQ ID NO: 427232 - RNA, 16 nt, Bordetella pertussis
gccggaaaugccgcgc

SEQ ID NO: 427233 - RNA, 17 nt, Bordetella pertussis
gccggaaaugccgcgcg

SEQ ID NO: 427234 - RNA, 21 nt, Bordetella pertussis
gccggaacagcguccagccgc

SEQ ID NO: 427235 - RNA, 15 nt, Bordetella pertussis
gccggaacaggcgcc

SEQ ID NO: 427236 - RNA, 14 nt, Bordetella pertussis
gccggacagcugcg

SEQ ID NO: 427237 - RNA, 13 nt, Bordetella pertussis
gccggacccgcgc

SEQ ID NO: 427238 - RNA, 16 nt, Bordetella pertussis
gccggacccgcgccgc

SEQ ID NO: 427239 - RNA, 21 nt, Bordetella pertussis
gccggacccgcgccgcaggcc

SEQ ID NO: 427240 - RNA, 22 nt, Bordetella pertussis
gccggaccuugcgaggcccggc

SEQ ID NO: 427241 - RNA, 20 nt, Bordetella pertussis
gccggacgcaaccggucggc

SEQ ID NO: 427242 - RNA, 21 nt, Bordetella pertussis
gccggacgcggggauggcuuc

SEQ ID NO: 427243 - RNA, 17 nt, Bordetella pertussis
gccggaggcgcgcagcu

SEQ ID NO: 427244 - RNA, 17 nt, Bordetella pertussis
gccggaucggccggcag

SEQ ID NO: 427245 - RNA, 21 nt, Bordetella pertussis
gccggauugacguccaugauu

SEQ ID NO: 427246 - RNA, 21 nt, Bordetella pertussis
gccggauugcuugacgccgcc

SEQ ID NO: 427247 - RNA, 15 nt, Bordetella pertussis
gccggcaacguggug

SEQ ID NO: 427248 - RNA, 19 nt, Bordetella pertussis
gccggcaaggggccagccu

SEQ ID NO: 427249 - RNA, 18 nt, Bordetella pertussis
gccggcaaggucagcagc

SEQ ID NO: 427250 - RNA, 15 nt, Bordetella pertussis
gccggcaccagcgcc

SEQ ID NO: 427251 - RNA, 16 nt, Bordetella pertussis
gccggcaccaggaucc

SEQ ID NO: 427252 - RNA, 15 nt, Bordetella pertussis
gccggcaccaucugc

SEQ ID NO: 427253 - RNA, 14 nt, Bordetella pertussis
gccggcagggccag

SEQ ID NO: 427254 - RNA, 20 nt, Bordetella pertussis
gccggcagggcggccaggcc

SEQ ID NO: 427255 - RNA, 14 nt, Bordetella pertussis
gccggcaggccggc

SEQ ID NO: 427256 - RNA, 17 nt, Bordetella pertussis
gccggcauugcccacca

SEQ ID NO: 427257 - RNA, 18 nt, Bordetella pertussis
gccggcauuucgcugggc

SEQ ID NO: 427258 - RNA, 22 nt, Bordetella pertussis
gccggcauuucgcugggcgcgc

SEQ ID NO: 427259 - RNA, 22 nt, Bordetella pertussis
gccggccaacagcucgcgccag

SEQ ID NO: 427260 - RNA, 14 nt, Bordetella pertussis
gccggccagggcca

SEQ ID NO: 427261 - RNA, 15 nt, Bordetella pertussis
gccggccagggccac

SEQ ID NO: 427262 - RNA, 19 nt, Bordetella pertussis
gccggccaguggcgcggcg

SEQ ID NO: 427263 - RNA, 15 nt, Bordetella pertussis
gccggccauggcggc

SEQ ID NO: 427264 - RNA, 16 nt, Bordetella pertussis
gccggccauggcggcc

SEQ ID NO: 427265 - RNA, 20 nt, Bordetella pertussis
gccggccauggcggccggcg

SEQ ID NO: 427266 - RNA, 12 nt, Bordetella pertussis
gccggcccccuc

SEQ ID NO: 427267 - RNA, 20 nt, Bordetella pertussis
gccggccccgcaaggggccg

SEQ ID NO: 427268 - RNA, 20 nt, Bordetella pertussis
gccggcccgacaccuggacc

SEQ ID NO: 427269 - RNA, 15 nt, Bordetella pertussis
gccggcccgccacgc

SEQ ID NO: 427270 - RNA, 12 nt, Bordetella pertussis
gccggcccgcgc

SEQ ID NO: 427271 - RNA, 22 nt, Bordetella pertussis
gccggcccguuggcaggccagc

SEQ ID NO: 427272 - RNA, 18 nt, Bordetella pertussis
gccggccgaccggcgcgc

SEQ ID NO: 427273 - RNA, 14 nt, Bordetella pertussis
gccggccgacggcg

SEQ ID NO: 427274 - RNA, 19 nt, Bordetella pertussis
gccggccgauagccgcggc

SEQ ID NO: 427275 - RNA, 23 nt, Bordetella pertussis
gccggccgauagccgcggcgccg

SEQ ID NO: 427276 - RNA, 18 nt, Bordetella pertussis
gccggccgcccaggcgca

SEQ ID NO: 427277 - RNA, 15 nt, Bordetella pertussis
gccggccgcgcccga

SEQ ID NO: 427278 - RNA, 16 nt, Bordetella pertussis
gccggccgcgccgcgc

SEQ ID NO: 427279 - RNA, 15 nt, Bordetella pertussis
gccggccgcgcgcgc

SEQ ID NO: 427280 - RNA, 14 nt, Bordetella pertussis
gccggccgcgcggc

SEQ ID NO: 427281 - RNA, 16 nt, Bordetella pertussis
gccggccgcgcggccg

SEQ ID NO: 427282 - RNA, 15 nt, Bordetella pertussis
gccggccggaccgcu

SEQ ID NO: 427283 - RNA, 14 nt, Bordetella pertussis
gccggccgggcgcg

SEQ ID NO: 427284 - RNA, 16 nt, Bordetella pertussis
gccggccgggcgcggc

SEQ ID NO: 427285 - RNA, 17 nt, Bordetella pertussis
gccggccgggcgcggcg

SEQ ID NO: 427286 - RNA, 20 nt, Bordetella pertussis
gccggccgggcgcggcgccc

SEQ ID NO: 427287 - RNA, 16 nt, Bordetella pertussis
gccggccgucauccac

SEQ ID NO: 427288 - RNA, 20 nt, Bordetella pertussis
gccggccguuucaggccugc

SEQ ID NO: 427289 - RNA, 23 nt, Bordetella pertussis
gccggccguuucaggccugcggc

SEQ ID NO: 427290 - RNA, 13 nt, Bordetella pertussis
gccggccuccagc

SEQ ID NO: 427291 - RNA, 16 nt, Bordetella pertussis
gccggccuccagcauc

SEQ ID NO: 427292 - RNA, 14 nt, Bordetella pertussis
gccggccugaggcc

SEQ ID NO: 427293 - RNA, 17 nt, Bordetella pertussis
gccggccugccggcgca

SEQ ID NO: 427294 - RNA, 18 nt, Bordetella pertussis
gccggccugccggcgcac

SEQ ID NO: 427295 - RNA, 22 nt, Bordetella pertussis
gccggccugcucgccggccagc

SEQ ID NO: 427296 - RNA, 19 nt, Bordetella pertussis
gccggccuggcgcgcggcc

SEQ ID NO: 427297 - RNA, 15 nt, Bordetella pertussis
gccggccuggcgggc

SEQ ID NO: 427298 - RNA, 18 nt, Bordetella pertussis
gccggccugggcggcggc

SEQ ID NO: 427299 - RNA, 13 nt, Bordetella pertussis
gccggccugucug

SEQ ID NO: 427300 - RNA, 17 nt, Bordetella pertussis
gccggcgacgccgcggu

SEQ ID NO: 427301 - RNA, 20 nt, Bordetella pertussis
gccggcgacgccgcggugcu

SEQ ID NO: 427302 - RNA, 15 nt, Bordetella pertussis
gccggcgacguggug

SEQ ID NO: 427303 - RNA, 18 nt, Bordetella pertussis
gccggcgacguggugugc

SEQ ID NO: 427304 - RNA, 18 nt, Bordetella pertussis
gccggcgauugcgccagc

SEQ ID NO: 427305 - RNA, 20 nt, Bordetella pertussis
gccggcgauugcgccagcgc

SEQ ID NO: 427306 - RNA, 21 nt, Bordetella pertussis
gccggcgauugcgccagcgcu

SEQ ID NO: 427307 - RNA, 14 nt, Bordetella pertussis
gccggcgcaacggg

SEQ ID NO: 427308 - RNA, 18 nt, Bordetella pertussis
gccggcgcaacgggccga

SEQ ID NO: 427309 - RNA, 16 nt, Bordetella pertussis
gccggcgcaugagccg

SEQ ID NO: 427310 - RNA, 15 nt, Bordetella pertussis
gccggcgccagccgc

SEQ ID NO: 427311 - RNA, 16 nt, Bordetella pertussis
gccggcgccagccgcu

SEQ ID NO: 427312 - RNA, 18 nt, Bordetella pertussis
gccggcgcccggcagccg

SEQ ID NO: 427313 - RNA, 14 nt, Bordetella pertussis
gccggcgcggcggu

SEQ ID NO: 427314 - RNA, 18 nt, Bordetella pertussis
gccggcgcggcugcuggg

SEQ ID NO: 427315 - RNA, 13 nt, Bordetella pertussis
gccggcgcgggcg

SEQ ID NO: 427316 - RNA, 17 nt, Bordetella pertussis
gccggcgcgggcgcagg

SEQ ID NO: 427317 - RNA, 23 nt, Bordetella pertussis
gccggcgcgguggccaugcuggg

SEQ ID NO: 427318 - RNA, 16 nt, Bordetella pertussis
gccggcgcgucgcgcg

SEQ ID NO: 427319 - RNA, 18 nt, Bordetella pertussis
gccggcgcgucgcgcggc

SEQ ID NO: 427320 - RNA, 19 nt, Bordetella pertussis
gccggcgcgucgcgcggcg

SEQ ID NO: 427321 - RNA, 22 nt, Bordetella pertussis
gccggcgcgucgcgcggcggca

SEQ ID NO: 427322 - RNA, 19 nt, Bordetella pertussis
gccggcgcgugcuggcgca

SEQ ID NO: 427323 - RNA, 20 nt, Bordetella pertussis
gccggcgcgugcuggcgcag

SEQ ID NO: 427324 - RNA, 21 nt, Bordetella pertussis
gccggcgcgugcuggcgcagc

SEQ ID NO: 427325 - RNA, 14 nt, Bordetella pertussis
gccggcgcucgcgc

SEQ ID NO: 427326 - RNA, 13 nt, Bordetella pertussis
gccggcgcugcgc

SEQ ID NO: 427327 - RNA, 15 nt, Bordetella pertussis
gccggcgcugcgcag

SEQ ID NO: 427328 - RNA, 18 nt, Bordetella pertussis
gccggcggcacgcugcgc

SEQ ID NO: 427329 - RNA, 14 nt, Bordetella pertussis
gccggcggcagccg

SEQ ID NO: 427330 - RNA, 16 nt, Bordetella pertussis
gccggcggcagccggc

SEQ ID NO: 427331 - RNA, 19 nt, Bordetella pertussis
gccggcggcaugcgccagc

SEQ ID NO: 427332 - RNA, 23 nt, Bordetella pertussis
gccggcggcaugcgccagccagc

SEQ ID NO: 427333 - RNA, 13 nt, Bordetella pertussis
gccggcggccagc

SEQ ID NO: 427334 - RNA, 17 nt, Bordetella pertussis
gccggcggccagcgcgc

SEQ ID NO: 427335 - RNA, 18 nt, Bordetella pertussis
gccggcggccagcgcgcc

SEQ ID NO: 427336 - RNA, 15 nt, Bordetella pertussis
gccggcggccagcuu

SEQ ID NO: 427337 - RNA, 15 nt, Bordetella pertussis
gccggcucaggccag

SEQ ID NO: 427338 - RNA, 16 nt, Bordetella pertussis
gccggcucaggccagc

SEQ ID NO: 427339 - RNA, 19 nt, Bordetella pertussis
gccggcucauucggcgcgc

SEQ ID NO: 427340 - RNA, 21 nt, Bordetella pertussis
gccggcucauucggcgcgcuc

SEQ ID NO: 427341 - RNA, 21 nt, Bordetella pertussis
gccggcucccgcgcugccgcu

SEQ ID NO: 427342 - RNA, 22 nt, Bordetella pertussis
gccggcuccgauagcggcgccg

SEQ ID NO: 427343 - RNA, 12 nt, Bordetella pertussis
gccggcuccgcu

SEQ ID NO: 427344 - RNA, 17 nt, Bordetella pertussis
gccggcucgaacaggcu

SEQ ID NO: 427345 - RNA, 19 nt, Bordetella pertussis
gccggcugaauuggcgccc

SEQ ID NO: 427346 - RNA, 15 nt, Bordetella pertussis
gccggcugcgcgccg

SEQ ID NO: 427347 - RNA, 19 nt, Bordetella pertussis
gccggcugggcggccuugg

SEQ ID NO: 427348 - RNA, 17 nt, Bordetella pertussis
gccggcuucagccgcaa

SEQ ID NO: 427349 - RNA, 13 nt, Bordetella pertussis
gccggcuuccagc

SEQ ID NO: 427350 - RNA, 23 nt, Bordetella pertussis
gccggcuugcgcaagccggccgc

SEQ ID NO: 427351 - RNA, 20 nt, Bordetella pertussis
gccgggcagcgggccgcagc

SEQ ID NO: 427352 - RNA, 22 nt, Bordetella pertussis
gccgggcauggcccggcucgcc

SEQ ID NO: 427353 - RNA, 14 nt, Bordetella pertussis
gccgggccaaggug

SEQ ID NO: 427354 - RNA, 16 nt, Bordetella pertussis
gccgggcccggcgcgc

SEQ ID NO: 427355 - RNA, 12 nt, Bordetella pertussis
gccgggccgcgc

SEQ ID NO: 427356 - RNA, 15 nt, Bordetella pertussis
gccgggccgcgccgc

SEQ ID NO: 427357 - RNA, 18 nt, Bordetella pertussis
gccgggccuggugcccga

SEQ ID NO: 427358 - RNA, 19 nt, Bordetella pertussis
gccgggcgacggcgugcug

SEQ ID NO: 427359 - RNA, 15 nt, Bordetella pertussis
gccgggcgccaggcu

SEQ ID NO: 427360 - RNA, 15 nt, Bordetella pertussis
gccgggcgcccagcg

SEQ ID NO: 427361 - RNA, 18 nt, Bordetella pertussis
gccgggcgccgauccagc

SEQ ID NO: 427362 - RNA, 20 nt, Bordetella pertussis
gccgggcgccgauccagccc

SEQ ID NO: 427363 - RNA, 19 nt, Bordetella pertussis
gccgggcgccgcgccccau

SEQ ID NO: 427364 - RNA, 13 nt, Bordetella pertussis
gccgggcgccggc

SEQ ID NO: 427365 - RNA, 14 nt, Bordetella pertussis
gccggggaggccuc

SEQ ID NO: 427366 - RNA, 15 nt, Bordetella pertussis
gccggggcccgcggg

SEQ ID NO: 427367 - RNA, 22 nt, Bordetella pertussis
gccggggcccgcgggcgcccgg

SEQ ID NO: 427368 - RNA, 19 nt, Bordetella pertussis
gccggggccgcccugccua

SEQ ID NO: 427369 - RNA, 16 nt, Bordetella pertussis
gccggggccgcccugg

SEQ ID NO: 427370 - RNA, 20 nt, Bordetella pertussis
gccggggccgcccuggucau

SEQ ID NO: 427371 - RNA, 12 nt, Bordetella pertussis
gccggggcgagc

SEQ ID NO: 427372 - RNA, 20 nt, Bordetella pertussis
gccggggcggcggcgcccgc

SEQ ID NO: 427373 - RNA, 13 nt, Bordetella pertussis
gccggggcggcuc

SEQ ID NO: 427374 - RNA, 19 nt, Bordetella pertussis
gccggggcguggccgcagu

SEQ ID NO: 427375 - RNA, 13 nt, Bordetella pertussis
gccggggggcgca

SEQ ID NO: 427376 - RNA, 16 nt, Bordetella pertussis
gccggggggcgcacgc

SEQ ID NO: 427377 - RNA, 21 nt, Bordetella pertussis
gccggggggcgcacgccgcgc

SEQ ID NO: 427378 - RNA, 20 nt, Bordetella pertussis
gccgggggcguugcggugca

SEQ ID NO: 427379 - RNA, 15 nt, Bordetella pertussis
gccggggucagcgcc

SEQ ID NO: 427380 - RNA, 18 nt, Bordetella pertussis
gccggggucagcgccggc

SEQ ID NO: 427381 - RNA, 18 nt, Bordetella pertussis
gccggggucuugccgcgc

SEQ ID NO: 427382 - RNA, 21 nt, Bordetella pertussis
gccggggucuugccgcgcagc

SEQ ID NO: 427383 - RNA, 22 nt, Bordetella pertussis
gccggggucuugccgcgcagcg

SEQ ID NO: 427384 - RNA, 23 nt, Bordetella pertussis
gccggguggucgcgcccgccgug

SEQ ID NO: 427385 - RNA, 19 nt, Bordetella pertussis
gccggguguuccggcgcgc

SEQ ID NO: 427386 - RNA, 18 nt, Bordetella pertussis
gccgguaaccgacgcagc

SEQ ID NO: 427387 - RNA, 21 nt, Bordetella pertussis
gccgguaaggcgcuugcgcag

SEQ ID NO: 427388 - RNA, 16 nt, Bordetella pertussis
gccgguacagccaggc

SEQ ID NO: 427389 - RNA, 19 nt, Bordetella pertussis
gccgguacagccaggccag

SEQ ID NO: 427390 - RNA, 22 nt, Bordetella pertussis
gccgguacagccaggccagcag

SEQ ID NO: 427391 - RNA, 22 nt, Bordetella pertussis
gccgucggcguugugccggcgc

SEQ ID NO: 427392 - RNA, 13 nt, Bordetella pertussis
gccgucggggccg

SEQ ID NO: 427393 - RNA, 22 nt, Bordetella pertussis
gccgucgugcgccuggcggcug

SEQ ID NO: 427394 - RNA, 21 nt, Bordetella pertussis
gccgucuacaggcccagcgcc

SEQ ID NO: 427395 - RNA, 15 nt, Bordetella pertussis
gccgugaugccgccc

SEQ ID NO: 427396 - RNA, 17 nt, Bordetella pertussis
gccgugaugccgcccgc

SEQ ID NO: 427397 - RNA, 22 nt, Bordetella pertussis
gccgugaugccgcccgcaugca

SEQ ID NO: 427398 - RNA, 13 nt, Bordetella pertussis
gccgugcccgagg

SEQ ID NO: 427399 - RNA, 13 nt, Bordetella pertussis
gccgugccgggcc

SEQ ID NO: 427400 - RNA, 15 nt, Bordetella pertussis
gccgugccgggccug

SEQ ID NO: 427401 - RNA, 15 nt, Bordetella pertussis
gccguggcgcaaggc

SEQ ID NO: 427402 - RNA, 12 nt, Bordetella pertussis
gccguggcggcc

SEQ ID NO: 427403 - RNA, 21 nt, Bordetella pertussis
gccguggcggccugcgccggc

SEQ ID NO: 427404 - RNA, 16 nt, Bordetella pertussis
gccgugggacaggcac

SEQ ID NO: 427405 - RNA, 20 nt, Bordetella pertussis
gccgugggacaggcacucuu

SEQ ID NO: 427406 - RNA, 17 nt, Bordetella pertussis
gccguguaggcggucuu

SEQ ID NO: 427407 - RNA, 19 nt, Bordetella pertussis
gccguguuguccuggacag

SEQ ID NO: 427408 - RNA, 23 nt, Bordetella pertussis
gccguucucaggccgaggcugcg

SEQ ID NO: 427409 - RNA, 22 nt, Bordetella pertussis
gccguucuucgaucgccugggg

SEQ ID NO: 427410 - RNA, 13 nt, Bordetella pertussis
gccguugagcacg

SEQ ID NO: 427411 - RNA, 16 nt, Bordetella pertussis
gccguugcggcccgcc

SEQ ID NO: 427412 - RNA, 14 nt, Bordetella pertussis
gccguuggccgcgc

SEQ ID NO: 427413 - RNA, 18 nt, Bordetella pertussis
gccuaccggcgccgacgc

SEQ ID NO: 427414 - RNA, 13 nt, Bordetella pertussis
gccuacggcggcg

SEQ ID NO: 427415 - RNA, 12 nt, Bordetella pertussis
gccuagcccggc

SEQ ID NO: 427416 - RNA, 13 nt, Bordetella pertussis
gccuagcccggcg

SEQ ID NO: 427417 - RNA, 16 nt, Bordetella pertussis
gccuagcccggcgcca

SEQ ID NO: 427418 - RNA, 19 nt, Bordetella pertussis
gccuagcccggcgccaccc

SEQ ID NO: 427419 - RNA, 19 nt, Bordetella pertussis
gccuauguaggcgccgcgc

SEQ ID NO: 427420 - RNA, 19 nt, Bordetella pertussis
gccuauugcgacgccgccg

SEQ ID NO: 427421 - RNA, 18 nt, Bordetella pertussis
gccucaacuggccggccu

SEQ ID NO: 427422 - RNA, 18 nt, Bordetella pertussis
gccucaaucgaugaugug

SEQ ID NO: 427423 - RNA, 23 nt, Bordetella pertussis
gccucacaugucacacgaagaac

SEQ ID NO: 427424 - RNA, 17 nt, Bordetella pertussis
gccucagcccgcguuca

SEQ ID NO: 427425 - RNA, 13 nt, Bordetella pertussis
gccucaggccggc

SEQ ID NO: 427426 - RNA, 16 nt, Bordetella pertussis
gccucaggccggcgcc

SEQ ID NO: 427427 - RNA, 19 nt, Bordetella pertussis
gccucaggccggcgccugg

SEQ ID NO: 427428 - RNA, 22 nt, Bordetella pertussis
gccucauccccgcgugccuguc

SEQ ID NO: 427429 - RNA, 23 nt, Bordetella pertussis
gccucaucccgauuucggagcgg

SEQ ID NO: 427430 - RNA, 17 nt, Bordetella pertussis
gccucaugacggggccu

SEQ ID NO: 427431 - RNA, 19 nt, Bordetella pertussis
gccuccagcaucgccgcca

SEQ ID NO: 427432 - RNA, 21 nt, Bordetella pertussis
gccuccagcaucgccgccagc

SEQ ID NO: 427433 - RNA, 13 nt, Bordetella pertussis
gccuccagcucca

SEQ ID NO: 427434 - RNA, 21 nt, Bordetella pertussis
gccuccagcuccagcgcgccg

SEQ ID NO: 427435 - RNA, 18 nt, Bordetella pertussis
gccuccaggaugagcgcc

SEQ ID NO: 427436 - RNA, 18 nt, Bordetella pertussis
gccuccaggcgcaagccu

SEQ ID NO: 427437 - RNA, 16 nt, Bordetella pertussis
gccuccaggcggcggu

SEQ ID NO: 427438 - RNA, 18 nt, Bordetella pertussis
gccuccagcgcggcgggc

SEQ ID NO: 427439 - RNA, 18 nt, Bordetella pertussis
gccuccaucagcagcacc

SEQ ID NO: 427440 - RNA, 18 nt, Bordetella pertussis
gccucccauugcgcggcc

SEQ ID NO: 427441 - RNA, 21 nt, Bordetella pertussis
gccucccauugcgcggccagg

SEQ ID NO: 427442 - RNA, 23 nt, Bordetella pertussis
gccucccauugcgcggccagggc

SEQ ID NO: 427443 - RNA, 16 nt, Bordetella pertussis
gccuccccaggccagc

SEQ ID NO: 427444 - RNA, 21 nt, Bordetella pertussis
gccuccccaggccagcugcgc

SEQ ID NO: 427445 - RNA, 14 nt, Bordetella pertussis
gccucccgccgccc

SEQ ID NO: 427446 - RNA, 18 nt, Bordetella pertussis
gccucccgccgcccggcc

SEQ ID NO: 427447 - RNA, 22 nt, Bordetella pertussis
gccucccgucgucguccacgcc

SEQ ID NO: 427448 - RNA, 18 nt, Bordetella pertussis
gccuccgcgcacagcgcg

SEQ ID NO: 427449 - RNA, 16 nt, Bordetella pertussis
gccuccgcgccgacca

SEQ ID NO: 427450 - RNA, 13 nt, Bordetella pertussis
gccuccggguaua

SEQ ID NO: 427451 - RNA, 22 nt, Bordetella pertussis
gccucgaacccgaacgcgugca

SEQ ID NO: 427452 - RNA, 19 nt, Bordetella pertussis
gccucgaacguccgcccca

SEQ ID NO: 427453 - RNA, 21 nt, Bordetella pertussis
gccucgaagaucaacaaggcg

SEQ ID NO: 427454 - RNA, 15 nt, Bordetella pertussis
gccucgaagcccggc

SEQ ID NO: 427455 - RNA, 20 nt, Bordetella pertussis
gccucgaccggcgaagagcc

SEQ ID NO: 427456 - RNA, 12 nt, Bordetella pertussis
gccucgacgaau

SEQ ID NO: 427457 - RNA, 22 nt, Bordetella pertussis
gccucgacgaugcccugcgcca

SEQ ID NO: 427458 - RNA, 15 nt, Bordetella pertussis
gccucgacgauggcc

SEQ ID NO: 427459 - RNA, 16 nt, Bordetella pertussis
gccucgacgcccgggc

SEQ ID NO: 427460 - RNA, 21 nt, Bordetella pertussis
gccucgacgcuguagaggcgc

SEQ ID NO: 427461 - RNA, 17 nt, Bordetella pertussis
gccucgacggccgccgg

SEQ ID NO: 427462 - RNA, 17 nt, Bordetella pertussis
gccucgaucgccagguc

SEQ ID NO: 427463 - RNA, 21 nt, Bordetella pertussis
gccucgaugaaggugcgcagc

SEQ ID NO: 427464 - RNA, 19 nt, Bordetella pertussis
gccucgaugcccucgcgca

SEQ ID NO: 427465 - RNA, 17 nt, Bordetella pertussis
gccucgaugucaucgcc

SEQ ID NO: 427466 - RNA, 20 nt, Bordetella pertussis
gccucgcaucggccugcacc

SEQ ID NO: 427467 - RNA, 21 nt, Bordetella pertussis
gccucgcaucggccugcaccg

SEQ ID NO: 427468 - RNA, 12 nt, Bordetella pertussis
gccucgcccugg

SEQ ID NO: 427469 - RNA, 16 nt, Bordetella pertussis
gccucgcccuggcgca

SEQ ID NO: 427470 - RNA, 12 nt, Bordetella pertussis
gccucgccggcc

SEQ ID NO: 427471 - RNA, 16 nt, Bordetella pertussis
gccucgccggcccugc

SEQ ID NO: 427472 - RNA, 21 nt, Bordetella pertussis
gccucgccggcccugccgccc

SEQ ID NO: 427473 - RNA, 16 nt, Bordetella pertussis
gccucgccggccuggc

SEQ ID NO: 427474 - RNA, 18 nt, Bordetella pertussis
gccucgcgcagggcggcc

SEQ ID NO: 427475 - RNA, 16 nt, Bordetella pertussis
gccucgcgcuccagca

SEQ ID NO: 427476 - RNA, 13 nt, Bordetella pertussis
gccucgcggcgca

SEQ ID NO: 427477 - RNA, 17 nt, Bordetella pertussis
gccucgcgggccuuggc

SEQ ID NO: 427478 - RNA, 21 nt, Bordetella pertussis
gccucgcgggccuuggccagc

SEQ ID NO: 427479 - RNA, 18 nt, Bordetella pertussis
gccucgcugcgggcggcc

SEQ ID NO: 427480 - RNA, 16 nt, Bordetella pertussis
gccucggacgccuggc

SEQ ID NO: 427481 - RNA, 14 nt, Bordetella pertussis
gccucggcauccag

SEQ ID NO: 427482 - RNA, 13 nt, Bordetella pertussis
gccucggccagcu

SEQ ID NO: 427483 - RNA, 15 nt, Bordetella pertussis
gccucggccagcugg

SEQ ID NO: 427484 - RNA, 21 nt, Bordetella pertussis
gccucggccaggaaagccggc

SEQ ID NO: 427485 - RNA, 12 nt, Bordetella pertussis
gccucggccggc

SEQ ID NO: 427486 - RNA, 13 nt, Bordetella pertussis
gccucggccggca

SEQ ID NO: 427487 - RNA, 15 nt, Bordetella pertussis
gccucggccaccugg

SEQ ID NO: 427488 - RNA, 13 nt, Bordetella pertussis
gccucggcggccu

SEQ ID NO: 427489 - RNA, 18 nt, Bordetella pertussis
gccucggcggccuccggc

SEQ ID NO: 427490 - RNA, 20 nt, Bordetella pertussis
gccucggcggccuccggcag

SEQ ID NO: 427491 - RNA, 19 nt, Bordetella pertussis
gccucggcggccagcgcgc

SEQ ID NO: 427492 - RNA, 16 nt, Bordetella pertussis
gccucggcgggcggcg

SEQ ID NO: 427493 - RNA, 18 nt, Bordetella pertussis
gccucggcgggcggcgcc

SEQ ID NO: 427494 - RNA, 19 nt, Bordetella pertussis
gccucggcgggcggcgcca

SEQ ID NO: 427495 - RNA, 15 nt, Bordetella pertussis
gccucggcuccgcca

SEQ ID NO: 427496 - RNA, 18 nt, Bordetella pertussis
gccucggcuugcgcggcg

SEQ ID NO: 427497 - RNA, 19 nt, Bordetella pertussis
gccucggcuugcgcggcgc

SEQ ID NO: 427498 - RNA, 18 nt, Bordetella pertussis
gccucgggcacggccagc

SEQ ID NO: 427499 - RNA, 21 nt, Bordetella pertussis
gccucgggcacggccagcacc

SEQ ID NO: 427500 - RNA, 14 nt, Bordetella pertussis
gccucgggcgcaac

SEQ ID NO: 427501 - RNA, 20 nt, Bordetella pertussis
gccucggggcucgugguggg

SEQ ID NO: 427502 - RNA, 16 nt, Bordetella pertussis
gccucggucagggugg

SEQ ID NO: 427503 - RNA, 22 nt, Bordetella pertussis
gccucguccucgucggcgaagc

SEQ ID NO: 427504 - RNA, 20 nt, Bordetella pertussis
gccucgucgaccacgccggc

SEQ ID NO: 427505 - RNA, 19 nt, Bordetella pertussis
gccucguccugcaggcggc

SEQ ID NO: 427506 - RNA, 22 nt, Bordetella pertussis
gccucgucgcgcaacgccgggu

SEQ ID NO: 427507 - RNA, 22 nt, Bordetella pertussis
gccucgugcugcugcaggcgcg

SEQ ID NO: 427508 - RNA, 21 nt, Bordetella pertussis
gccucguucaugucgcgggug

SEQ ID NO: 427509 - RNA, 23 nt, Bordetella pertussis
gccucguuccuguuccugcaggg

SEQ ID NO: 427510 - RNA, 14 nt, Bordetella pertussis
gccucuagcucaug

SEQ ID NO: 427511 - RNA, 16 nt, Bordetella pertussis
gccugaaaccgcaggc

SEQ ID NO: 427512 - RNA, 17 nt, Bordetella pertussis
gccugacgcucauccag

SEQ ID NO: 427513 - RNA, 18 nt, Bordetella pertussis
gccugacgcucauccagg

SEQ ID NO: 427514 - RNA, 22 nt, Bordetella pertussis
gccugacgcgcaagcggcccca

SEQ ID NO: 427515 - RNA, 20 nt, Bordetella pertussis
gccugacggcuacacccugc

SEQ ID NO: 427516 - RNA, 17 nt, Bordetella pertussis
gccugacgugcgccaca

SEQ ID NO: 427517 - RNA, 12 nt, Bordetella pertussis
gccugagcacau

SEQ ID NO: 427518 - RNA, 15 nt, Bordetella pertussis
gccugaggcccgaug

SEQ ID NO: 427519 - RNA, 22 nt, Bordetella pertussis
gccugaggcccgauggcgggga

SEQ ID NO: 427520 - RNA, 18 nt, Bordetella pertussis
gccugauggcgcguguca

SEQ ID NO: 427521 - RNA, 20 nt, Bordetella pertussis
gccugauucccaggcccggc

SEQ ID NO: 427522 - RNA, 21 nt, Bordetella pertussis
gccugcaaaaaacaagcucgc

SEQ ID NO: 427523 - RNA, 15 nt, Bordetella pertussis
gccugcaaguccagc

SEQ ID NO: 427524 - RNA, 21 nt, Bordetella pertussis
gccugcacggugggcagcagc

SEQ ID NO: 427525 - RNA, 23 nt, Bordetella pertussis
gccugcacggugggcagcagcac

SEQ ID NO: 427526 - RNA, 18 nt, Bordetella pertussis
gccugcacgucccagucg

SEQ ID NO: 427527 - RNA, 14 nt, Bordetella pertussis
gccugcagaccagc

SEQ ID NO: 427528 - RNA, 12 nt, Bordetella pertussis
gccugcagcagc

SEQ ID NO: 427529 - RNA, 13 nt, Bordetella pertussis
gccugcagcagcg

SEQ ID NO: 427530 - RNA, 16 nt, Bordetella pertussis
gccugcagcgccgccu

SEQ ID NO: 427531 - RNA, 17 nt, Bordetella pertussis
gccugcaggcccagcac

SEQ ID NO: 427532 - RNA, 24 nt, Bordetella pertussis
gccugcaggccguuccaguccagc

SEQ ID NO: 427533 - RNA, 14 nt, Bordetella pertussis
gccugcaggcucuu

SEQ ID NO: 427534 - RNA, 17 nt, Bordetella pertussis
gccugcaggugccgccg

SEQ ID NO: 427535 - RNA, 18 nt, Bordetella pertussis
gccugcaggugccgccgg

SEQ ID NO: 427536 - RNA, 18 nt, Bordetella pertussis
gccugcaguucggccgcc

SEQ ID NO: 427537 - RNA, 23 nt, Bordetella pertussis
gccugcaguucggccgccagguc

SEQ ID NO: 427538 - RNA, 16 nt, Bordetella pertussis
gccugcauguccagcg

SEQ ID NO: 427539 - RNA, 18 nt, Bordetella pertussis
gccugcauguccagcggc

SEQ ID NO: 427540 - RNA, 16 nt, Bordetella pertussis
gccugccaccagcgcg

SEQ ID NO: 427541 - RNA, 13 nt, Bordetella pertussis
gccugccagccca

SEQ ID NO: 427542 - RNA, 18 nt, Bordetella pertussis
gccugccagcccaccagc

SEQ ID NO: 427543 - RNA, 12 nt, Bordetella pertussis
gccugccagccu

SEQ ID NO: 427544 - RNA, 13 nt, Bordetella pertussis
gccugccaguucg

SEQ ID NO: 427545 - RNA, 16 nt, Bordetella pertussis
gccugccauccggccg

SEQ ID NO: 427546 - RNA, 17 nt, Bordetella pertussis
gccugccauccggccgc

SEQ ID NO: 427547 - RNA, 16 nt, Bordetella pertussis
gccugcccauggccug

SEQ ID NO: 427548 - RNA, 20 nt, Bordetella pertussis
gccugcccauggccugcaac

SEQ ID NO: 427549 - RNA, 15 nt, Bordetella pertussis
gccugccccgccugc

SEQ ID NO: 427550 - RNA, 14 nt, Bordetella pertussis
gccugccccggcag

SEQ ID NO: 427551 - RNA, 20 nt, Bordetella pertussis
gccugccccugcggggacag

SEQ ID NO: 427552 - RNA, 14 nt, Bordetella pertussis
gccugcccgcaacg

SEQ ID NO: 427553 - RNA, 14 nt, Bordetella pertussis
gccugcccgggcag

SEQ ID NO: 427554 - RNA, 18 nt, Bordetella pertussis
gccugcccgggcagcacc

SEQ ID NO: 427555 - RNA, 21 nt, Bordetella pertussis
gccugccgaucgugcacgccc

SEQ ID NO: 427556 - RNA, 16 nt, Bordetella pertussis
gccugccgcaucccgc

SEQ ID NO: 427557 - RNA, 22 nt, Bordetella pertussis
gccugccgcaucccgcccccgc

SEQ ID NO: 427558 - RNA, 18 nt, Bordetella pertussis
gccugccgcgcccggcgg

SEQ ID NO: 427559 - RNA, 20 nt, Bordetella pertussis
gccugccgcgcccggcggcc

SEQ ID NO: 427560 - RNA, 14 nt, Bordetella pertussis
gccugccgcggccg

SEQ ID NO: 427561 - RNA, 16 nt, Bordetella pertussis
gccugccgcggccgcc

SEQ ID NO: 427562 - RNA, 22 nt, Bordetella pertussis
gccugccgcggccgcccccagc

SEQ ID NO: 427563 - RNA, 16 nt, Bordetella pertussis
gccugccgccugccag

SEQ ID NO: 427564 - RNA, 19 nt, Bordetella pertussis
gccugccggccuggcucag

SEQ ID NO: 427565 - RNA, 15 nt, Bordetella pertussis
gccugccggcggccu

SEQ ID NO: 427566 - RNA, 18 nt, Bordetella pertussis
gccugcgaacgcccggcc

SEQ ID NO: 427567 - RNA, 22 nt, Bordetella pertussis
gccugcgaacgcccggcccagg

SEQ ID NO: 427568 - RNA, 21 nt, Bordetella pertussis
gccugcgagagauagcccagc

SEQ ID NO: 427569 - RNA, 16 nt, Bordetella pertussis
gccugcgaugccggcg

SEQ ID NO: 427570 - RNA, 19 nt, Bordetella pertussis
gccugcgccaccuggcgcc

SEQ ID NO: 427571 - RNA, 22 nt, Bordetella pertussis
gccugcgccaccuggcgcccgg

SEQ ID NO: 427572 - RNA, 18 nt, Bordetella pertussis
gccugcgccacguccagc

SEQ ID NO: 427573 - RNA, 15 nt, Bordetella pertussis
gccugcgccagcucc

SEQ ID NO: 427574 - RNA, 17 nt, Bordetella pertussis
gccugcgccagcuccag

SEQ ID NO: 427575 - RNA, 18 nt, Bordetella pertussis
gccugcgccagcuccagc

SEQ ID NO: 427576 - RNA, 14 nt, Bordetella pertussis
gccugcgccgccgc

SEQ ID NO: 427577 - RNA, 17 nt, Bordetella pertussis
gccugcgccgccgcgcg

SEQ ID NO: 427578 - RNA, 22 nt, Bordetella pertussis
gccugcgccgccgcgcgcuggc

SEQ ID NO: 427579 - RNA, 23 nt, Bordetella pertussis
gccugcgccgggcgcggccaggc

SEQ ID NO: 427580 - RNA, 17 nt, Bordetella pertussis
gccugcgccgucugcgc

SEQ ID NO: 427581 - RNA, 19 nt, Bordetella pertussis
gccugcgcgccggguuuuu

SEQ ID NO: 427582 - RNA, 14 nt, Bordetella pertussis
gccugcgcgcgagc

SEQ ID NO: 427583 - RNA, 15 nt, Bordetella pertussis
gccugcgcgcgagca

SEQ ID NO: 427584 - RNA, 16 nt, Bordetella pertussis
gccugcgcgcgcuggg

SEQ ID NO: 427585 - RNA, 22 nt, Bordetella pertussis
gccugcgcgcgcuggggcagca

SEQ ID NO: 427586 - RNA, 18 nt, Bordetella pertussis
gccugcggacggcgggcg

SEQ ID NO: 427587 - RNA, 14 nt, Bordetella pertussis
gccugcggcaggcc

SEQ ID NO: 427588 - RNA, 16 nt, Bordetella pertussis
gccugcggcaggccgc

SEQ ID NO: 427589 - RNA, 20 nt, Bordetella pertussis
gccugcggcgccagcgccgc

SEQ ID NO: 427590 - RNA, 16 nt, Bordetella pertussis
gccugcggcgcggccg

SEQ ID NO: 427591 - RNA, 21 nt, Bordetella pertussis
gccugcgggugcgccugcagc

SEQ ID NO: 427592 - RNA, 22 nt, Bordetella pertussis
gccugcgggugcgccugcagcg

SEQ ID NO: 427593 - RNA, 22 nt, Bordetella pertussis
gccugcguggcgggccgcgccg

SEQ ID NO: 427594 - RNA, 18 nt, Bordetella pertussis
gccugcucacgccccgcc

SEQ ID NO: 427595 - RNA, 23 nt, Bordetella pertussis
gccugcucacgccccgcccucuu

SEQ ID NO: 427596 - RNA, 16 nt, Bordetella pertussis
gccugcucgcaggccu

SEQ ID NO: 427597 - RNA, 17 nt, Bordetella pertussis
gccugcucgcaggccug

SEQ ID NO: 427598 - RNA, 18 nt, Bordetella pertussis
gccugcucgccggccagc

SEQ ID NO: 427599 - RNA, 20 nt, Bordetella pertussis
gccugcucgaccugcucggg

SEQ ID NO: 427600 - RNA, 16 nt, Bordetella pertussis
gccugcugcagcguga

SEQ ID NO: 427601 - RNA, 15 nt, Bordetella pertussis
gccugcuggucggcc

SEQ ID NO: 427602 - RNA, 16 nt, Bordetella pertussis
gccugcuggugcuggu

SEQ ID NO: 427603 - RNA, 15 nt, Bordetella pertussis
gccugcuugaagacg

SEQ ID NO: 427604 - RNA, 24 nt, Bordetella pertussis
gccugcuugaagacgcccaggucc

SEQ ID NO: 427605 - RNA, 13 nt, Bordetella pertussis
gccugcuugcagg

SEQ ID NO: 427606 - RNA, 16 nt, Bordetella pertussis
gccugcuugcaggaag

SEQ ID NO: 427607 - RNA, 13 nt, Bordetella pertussis
gccugcuuggcag

SEQ ID NO: 427608 - RNA, 18 nt, Bordetella pertussis
gccugcuuggcagccuug

SEQ ID NO: 427609 - RNA, 19 nt, Bordetella pertussis
gccugcuuggcagccuugg

SEQ ID NO: 427610 - RNA, 13 nt, Bordetella pertussis
gccugcuuggccg

SEQ ID NO: 427611 - RNA, 19 nt, Bordetella pertussis
gccugcuuggccgcguaca

SEQ ID NO: 427612 - RNA, 15 nt, Bordetella pertussis
gccuggaagcuggcc

SEQ ID NO: 427613 - RNA, 17 nt, Bordetella pertussis
gccuggaagcuggccag

SEQ ID NO: 427614 - RNA, 18 nt, Bordetella pertussis
gccuggaagcuggccagc

SEQ ID NO: 427615 - RNA, 22 nt, Bordetella pertussis
gccuggaagugaugccgccggc

SEQ ID NO: 427616 - RNA, 17 nt, Bordetella pertussis
gccuggaccugagccag

SEQ ID NO: 427617 - RNA, 16 nt, Bordetella pertussis
gccuggaccuggacga

SEQ ID NO: 427618 - RNA, 14 nt, Bordetella pertussis
gccuggacgcgcug

SEQ ID NO: 427619 - RNA, 16 nt, Bordetella pertussis
gccuggacgcgcuggc

SEQ ID NO: 427620 - RNA, 16 nt, Bordetella pertussis
gccuggacggcgagga

SEQ ID NO: 427621 - RNA, 18 nt, Bordetella pertussis
gccuggaugugcaggccg

SEQ ID NO: 427622 - RNA, 19 nt, Bordetella pertussis
gccuggcacaucggcccug

SEQ ID NO: 427623 - RNA, 22 nt, Bordetella pertussis
gccuggcacaucggcccuggca

SEQ ID NO: 427624 - RNA, 20 nt, Bordetella pertussis
gccuggccagauagcccagg

SEQ ID NO: 427625 - RNA, 15 nt, Bordetella pertussis
gccuggcccagcucc

SEQ ID NO: 427626 - RNA, 17 nt, Bordetella pertussis
gccuggcccagcuccag

SEQ ID NO: 427627 - RNA, 18 nt, Bordetella pertussis
gccuggcccagcuccagc

SEQ ID NO: 427628 - RNA, 20 nt, Bordetella pertussis
gccuggccccaggcgcccga

SEQ ID NO: 427629 - RNA, 14 nt, Bordetella pertussis
gccuggccccgcgc

SEQ ID NO: 427630 - RNA, 20 nt, Bordetella pertussis
gccuggccgagcgcggcaug

SEQ ID NO: 427631 - RNA, 21 nt, Bordetella pertussis
gccuggccgcccagcgccugc

SEQ ID NO: 427632 - RNA, 22 nt, Bordetella pertussis
gccuggccgcccagcgccugca

SEQ ID NO: 427633 - RNA, 13 nt, Bordetella pertussis
gccuggccgccgg

SEQ ID NO: 427634 - RNA, 14 nt, Bordetella pertussis
gccuggccgccggc

SEQ ID NO: 427635 - RNA, 17 nt, Bordetella pertussis
gccuggccgccggcggc

SEQ ID NO: 427636 - RNA, 14 nt, Bordetella pertussis
gccuggccgcgcgc

SEQ ID NO: 427637 - RNA, 14 nt, Bordetella pertussis
gccuggccgcgcug

SEQ ID NO: 427638 - RNA, 12 nt, Bordetella pertussis
gccuggccggcu

SEQ ID NO: 427639 - RNA, 22 nt, Bordetella pertussis
gccuggccggggaagccgccgg

SEQ ID NO: 427640 - RNA, 15 nt, Bordetella pertussis
gccuggccugcgccg

SEQ ID NO: 427641 - RNA, 16 nt, Bordetella pertussis
gccuggccugcgccgc

SEQ ID NO: 427642 - RNA, 20 nt, Bordetella pertussis
gccuggcgaacaguugcacc

SEQ ID NO: 427643 - RNA, 21 nt, Bordetella pertussis
gccuggcgccaacccgccauc

SEQ ID NO: 427644 - RNA, 17 nt, Bordetella pertussis
gccuggcgcgcggccug

SEQ ID NO: 427645 - RNA, 13 nt, Bordetella pertussis
gccuggcgcggcc

SEQ ID NO: 427646 - RNA, 18 nt, Bordetella pertussis
gccuggcgcggcgccugc

SEQ ID NO: 427647 - RNA, 16 nt, Bordetella pertussis
gccuggcgcuccucgc

SEQ ID NO: 427648 - RNA, 18 nt, Bordetella pertussis
gccuggcggaucucggcc

SEQ ID NO: 427649 - RNA, 21 nt, Bordetella pertussis
gccuggcggaucucggccagc

SEQ ID NO: 427650 - RNA, 12 nt, Bordetella pertussis
gccuggcggcug

SEQ ID NO: 427651 - RNA, 13 nt, Bordetella pertussis
gccuggcggcugg

SEQ ID NO: 427652 - RNA, 19 nt, Bordetella pertussis
gccuggcucaggccugcac

SEQ ID NO: 427653 - RNA, 21 nt, Bordetella pertussis
gccuggcucaggccugcacgu

SEQ ID NO: 427654 - RNA, 13 nt, Bordetella pertussis
gccuggcugcaag

SEQ ID NO: 427655 - RNA, 21 nt, Bordetella pertussis
gccuggcuucccgguccaggc

SEQ ID NO: 427656 - RNA, 22 nt, Bordetella pertussis
gccuggcuucccgguccaggcc

SEQ ID NO: 427657 - RNA, 16 nt, Bordetella pertussis
gccuggcuuggcggcc

SEQ ID NO: 427658 - RNA, 18 nt, Bordetella pertussis
gccuggcuuucgccgcgg

SEQ ID NO: 427659 - RNA, 15 nt, Bordetella pertussis
gccugggccauggcc

SEQ ID NO: 427660 - RNA, 17 nt, Bordetella pertussis
gccugggccuucuuguc

SEQ ID NO: 427661 - RNA, 17 nt, Bordetella pertussis
gccugggcgccuggcug

SEQ ID NO: 427662 - RNA, 15 nt, Bordetella pertussis
gccugggcggcgcgc

SEQ ID NO: 427663 - RNA, 17 nt, Bordetella pertussis
gccugggcgggccguug

SEQ ID NO: 427664 - RNA, 21 nt, Bordetella pertussis
gccugggcgucgagcggcgug

SEQ ID NO: 427665 - RNA, 17 nt, Bordetella pertussis
gccuggggacgggcgca

SEQ ID NO: 427666 - RNA, 18 nt, Bordetella pertussis
gccuggggacgggcgcac

SEQ ID NO: 427667 - RNA, 9 nt, Bordetella pertussis
gccuggggc

SEQ ID NO: 427668 - RNA, 20 nt, Bordetella pertussis
gccuggggggucaaccaggu

SEQ ID NO: 427669 - RNA, 13 nt, Bordetella pertussis
gccugggugcugg

SEQ ID NO: 427670 - RNA, 14 nt, Bordetella pertussis
gccuggguggccag

SEQ ID NO: 427671 - RNA, 17 nt, Bordetella pertussis
gccuggguggccagcug

SEQ ID NO: 427672 - RNA, 18 nt, Bordetella pertussis
gccugguauugccugugg

SEQ ID NO: 427673 - RNA, 16 nt, Bordetella pertussis
gccugguccgccgcga

SEQ ID NO: 427674 - RNA, 17 nt, Bordetella pertussis
gccuggucgacgccggc

SEQ ID NO: 427675 - RNA, 14 nt, Bordetella pertussis
gccuggucgcgcgc

SEQ ID NO: 427676 - RNA, 17 nt, Bordetella pertussis
gccuggucgcgcgccug

SEQ ID NO: 427677 - RNA, 17 nt, Bordetella pertussis
gccuggucgcuggcgcc

SEQ ID NO: 427678 - RNA, 17 nt, Bordetella pertussis
gccuguaucagcgccug

SEQ ID NO: 427679 - RNA, 20 nt, Bordetella pertussis
gccuguaucagcgccugcag

SEQ ID NO: 427680 - RNA, 24 nt, Bordetella pertussis
gccugucccaaccgggacaggcac

SEQ ID NO: 427681 - RNA, 15 nt, Bordetella pertussis
gccuguccccacaug

SEQ ID NO: 427682 - RNA, 20 nt, Bordetella pertussis
gccuguccccacguggacag

SEQ ID NO: 427683 - RNA, 17 nt, Bordetella pertussis
gccuguccccgaacggg

SEQ ID NO: 427684 - RNA, 16 nt, Bordetella pertussis
gccuguccccgcagga

SEQ ID NO: 427685 - RNA, 19 nt, Bordetella pertussis
gccuguccccgcaggagca

SEQ ID NO: 427686 - RNA, 18 nt, Bordetella pertussis
gccuguccccgccggggc

SEQ ID NO: 427687 - RNA, 14 nt, Bordetella pertussis
gccuguccccgcgg

SEQ ID NO: 427688 - RNA, 15 nt, Bordetella pertussis
gccuguccccgcgga

SEQ ID NO: 427689 - RNA, 17 nt, Bordetella pertussis
gccuguccccgcgggga

SEQ ID NO: 427690 - RNA, 24 nt, Bordetella pertussis
gccuguccccgcggggacaggcac

SEQ ID NO: 427691 - RNA, 14 nt, Bordetella pertussis
gccuguccccgcug

SEQ ID NO: 427692 - RNA, 15 nt, Bordetella pertussis
gccuguccccgcugg

SEQ ID NO: 427693 - RNA, 19 nt, Bordetella pertussis
gccuguccccgcugggaca

SEQ ID NO: 427694 - RNA, 24 nt, Bordetella pertussis
gccuguccccgcugggacaggcac

SEQ ID NO: 427695 - RNA, 19 nt, Bordetella pertussis
gccuguccccgucgggaca

SEQ ID NO: 427696 - RNA, 18 nt, Bordetella pertussis
gccuguccccguggggac

SEQ ID NO: 427697 - RNA, 20 nt, Bordetella pertussis
gccuguccccguggggacag

SEQ ID NO: 427698 - RNA, 18 nt, Bordetella pertussis
gccugucacaccccacca

SEQ ID NO: 427699 - RNA, 20 nt, Bordetella pertussis
gccugucccgacggggacag

SEQ ID NO: 427700 - RNA, 15 nt, Bordetella pertussis
gccugucccgcacgc

SEQ ID NO: 427701 - RNA, 23 nt, Bordetella pertussis
gccugucccgcacgcagcccuuc

SEQ ID NO: 427702 - RNA, 13 nt, Bordetella pertussis
gccugucccgcug

SEQ ID NO: 427703 - RNA, 20 nt, Bordetella pertussis
gccugucccugcgggggcag

SEQ ID NO: 427704 - RNA, 13 nt, Bordetella pertussis
gccugucguucgg

SEQ ID NO: 427705 - RNA, 23 nt, Bordetella pertussis
gccugucugguggcgauccaugu

SEQ ID NO: 427706 - RNA, 15 nt, Bordetella pertussis
gccugugccagcugg

SEQ ID NO: 427707 - RNA, 20 nt, Bordetella pertussis
gccuguucggacgcaccuuu

SEQ ID NO: 427708 - RNA, 14 nt, Bordetella pertussis
gccuguucuuucuu

SEQ ID NO: 427709 - RNA, 19 nt, Bordetella pertussis
gccuucacauccacugucu

SEQ ID NO: 427710 - RNA, 16 nt, Bordetella pertussis
gccuucaccccgccac

SEQ ID NO: 427711 - RNA, 17 nt, Bordetella pertussis
gccuucaugaucuggcc

SEQ ID NO: 427712 - RNA, 24 nt, Bordetella pertussis
gccuucaugaucuggccgaccagc

SEQ ID NO: 427713 - RNA, 14 nt, Bordetella pertussis
gccuucccaggcga

SEQ ID NO: 427714 - RNA, 15 nt, Bordetella pertussis
gccuucccaggcgag

SEQ ID NO: 427715 - RNA, 21 nt, Bordetella pertussis
gccuucccaggcgaggcuggc

SEQ ID NO: 427716 - RNA, 16 nt, Bordetella pertussis
gccuuccggcagcggc

SEQ ID NO: 427717 - RNA, 19 nt, Bordetella pertussis
gccuuccggcagcggccag

SEQ ID NO: 427718 - RNA, 23 nt, Bordetella pertussis
gccuuccggcagcggccagcgcg

SEQ ID NO: 427719 - RNA, 24 nt, Bordetella pertussis
gccuucgaacucgauggccucggc

SEQ ID NO: 427720 - RNA, 22 nt, Bordetella pertussis
gccuucgaucuucucgccgcgc

SEQ ID NO: 427721 - RNA, 16 nt, Bordetella pertussis
gccuucgcgauccagc

SEQ ID NO: 427722 - RNA, 19 nt, Bordetella pertussis
gccuucgcgauccagcagc

SEQ ID NO: 427723 - RNA, 19 nt, Bordetella pertussis
gccuucggcaggcgccggc

SEQ ID NO: 427724 - RNA, 13 nt, Bordetella pertussis
gccuucggccggc

SEQ ID NO: 427725 - RNA, 19 nt, Bordetella pertussis
gccuucggcgcgcgccggc

SEQ ID NO: 427726 - RNA, 21 nt, Bordetella pertussis
gccuucggcgcgcgccggcuc

SEQ ID NO: 427727 - RNA, 15 nt, Bordetella pertussis
gccuucggcggcggg

SEQ ID NO: 427728 - RNA, 18 nt, Bordetella pertussis
gccuucggcggcgggcug

SEQ ID NO: 427729 - RNA, 22 nt, Bordetella pertussis
gccuucgggcgguuuuuucuug

SEQ ID NO: 427730 - RNA, 21 nt, Bordetella pertussis
gccuucguaaacaucgcgcau

SEQ ID NO: 427731 - RNA, 18 nt, Bordetella pertussis
gccuucgucgaggucagc

SEQ ID NO: 427732 - RNA, 15 nt, Bordetella pertussis
gccuucuacccgcuc

SEQ ID NO: 427733 - RNA, 20 nt, Bordetella pertussis
gccuucuucacguagccggc

SEQ ID NO: 427734 - RNA, 20 nt, Bordetella pertussis
gccuucuucugcaucggcau

SEQ ID NO: 427735 - RNA, 20 nt, Bordetella pertussis
gccuucuuucgcgagucgca

SEQ ID NO: 427736 - RNA, 17 nt, Bordetella pertussis
gccuugacgcugcucuu

SEQ ID NO: 427737 - RNA, 18 nt, Bordetella pertussis
gccuugcccgucagggua

SEQ ID NO: 427738 - RNA, 15 nt, Bordetella pertussis
gccuugccgccgcgc

SEQ ID NO: 427739 - RNA, 22 nt, Bordetella pertussis
gccuugccgguggacggccagc

SEQ ID NO: 427740 - RNA, 13 nt, Bordetella pertussis
gccuugcgcggcc

SEQ ID NO: 427741 - RNA, 14 nt, Bordetella pertussis
gccuugcgcggcca

SEQ ID NO: 427742 - RNA, 16 nt, Bordetella pertussis
gccuugcgcggccacc

SEQ ID NO: 427743 - RNA, 16 nt, Bordetella pertussis
gccuugcgcggccagc

SEQ ID NO: 427744 - RNA, 19 nt, Bordetella pertussis
gccuugcgcggccagcacc

SEQ ID NO: 427745 - RNA, 22 nt, Bordetella pertussis
gccuugcgcggccagcaccggc

SEQ ID NO: 427746 - RNA, 17 nt, Bordetella pertussis
gccuugcugcccgacgg

SEQ ID NO: 427747 - RNA, 15 nt, Bordetella pertussis
gccuuggccagcagc

SEQ ID NO: 427748 - RNA, 21 nt, Bordetella pertussis
gccuuggccauguccuggcag

SEQ ID NO: 427749 - RNA, 15 nt, Bordetella pertussis
gccuuggccgcagcc

SEQ ID NO: 427750 - RNA, 18 nt, Bordetella pertussis
gccuuggccgcagccggc

SEQ ID NO: 427751 - RNA, 17 nt, Bordetella pertussis
gccuuggccugggccga

SEQ ID NO: 427752 - RNA, 21 nt, Bordetella pertussis
gccuuggccugggccgacaug

SEQ ID NO: 427753 - RNA, 15 nt, Bordetella pertussis
gccuugggcgcggcg

SEQ ID NO: 427754 - RNA, 17 nt, Bordetella pertussis
gccuugggcgcggcggc

SEQ ID NO: 427755 - RNA, 11 nt, Bordetella pertussis
gccuuggggcg

SEQ ID NO: 427756 - RNA, 18 nt, Bordetella pertussis
gccuuggggcggcccagc

SEQ ID NO: 427757 - RNA, 15 nt, Bordetella pertussis
gccuugguggggucg

SEQ ID NO: 427758 - RNA, 16 nt, Bordetella pertussis
gccuugucgcgcccga

SEQ ID NO: 427759 - RNA, 15 nt, Bordetella pertussis
gccuugucgcgggca

SEQ ID NO: 427760 - RNA, 17 nt, Bordetella pertussis
gccuuuauugcuuuucc

SEQ ID NO: 427761 - RNA, 18 nt, Bordetella pertussis
gcgaaaugcccagcgagc

SEQ ID NO: 427762 - RNA, 23 nt, Bordetella pertussis
gcgaaaugucgagcgcgaugcca

SEQ ID NO: 427763 - RNA, 19 nt, Bordetella pertussis
gcgaacaacgggaucggcg

SEQ ID NO: 427764 - RNA, 18 nt, Bordetella pertussis
gcgaacaccggcaggccg

SEQ ID NO: 427765 - RNA, 22 nt, Bordetella pertussis
gcgaacagauccacgcccgcgc

SEQ ID NO: 427766 - RNA, 16 nt, Bordetella pertussis
gcgaacggauggucgu

SEQ ID NO: 427767 - RNA, 19 nt, Bordetella pertussis
gcgaacggcgggcggauca

SEQ ID NO: 427768 - RNA, 16 nt, Bordetella pertussis
gcgaacgugcgcgcca

SEQ ID NO: 427769 - RNA, 13 nt, Bordetella pertussis
gcgaacugcucgu

SEQ ID NO: 427770 - RNA, 14 nt, Bordetella pertussis
gcgaaggccagcgc

SEQ ID NO: 427771 - RNA, 17 nt, Bordetella pertussis
gcgaaggucuggucgca

SEQ ID NO: 427772 - RNA, 18 nt, Bordetella pertussis
gcgaaggucuggucgcac

SEQ ID NO: 427773 - RNA, 15 nt, Bordetella pertussis
gcgaagugcccgcug

SEQ ID NO: 427774 - RNA, 16 nt, Bordetella pertussis
gcgaagugccuguccc

SEQ ID NO: 427775 - RNA, 21 nt, Bordetella pertussis
gcgacaacagcuugcccggcg

SEQ ID NO: 427776 - RNA, 18 nt, Bordetella pertussis
gcgacacaaggcggccgc

SEQ ID NO: 427777 - RNA, 20 nt, Bordetella pertussis
gcgacacccccagggcgcgc

SEQ ID NO: 427778 - RNA, 17 nt, Bordetella pertussis
gcgacacccgcggccag

SEQ ID NO: 427779 - RNA, 14 nt, Bordetella pertussis
gcgacaccgcggcc

SEQ ID NO: 427780 - RNA, 20 nt, Bordetella pertussis
gcgacaccgugcgauggaac

SEQ ID NO: 427781 - RNA, 20 nt, Bordetella pertussis
gcgacagcaaugacgacgcc

SEQ ID NO: 427782 - RNA, 13 nt, Bordetella pertussis
gcgacagcaggcc

SEQ ID NO: 427783 - RNA, 12 nt, Bordetella pertussis
gcgacagcaggg

SEQ ID NO: 427784 - RNA, 15 nt, Bordetella pertussis
gcgacagcagggcca

SEQ ID NO: 427785 - RNA, 13 nt, Bordetella pertussis
gcgacagcagggu

SEQ ID NO: 427786 - RNA, 15 nt, Bordetella pertussis
gcgacagcagggucg

SEQ ID NO: 427787 - RNA, 19 nt, Bordetella pertussis
gcgacagccaggccagcgc

SEQ ID NO: 427788 - RNA, 14 nt, Bordetella pertussis
gcgacagcgcuggu

SEQ ID NO: 427789 - RNA, 21 nt, Bordetella pertussis
gcgacagcgcugguggccaga

SEQ ID NO: 427790 - RNA, 23 nt, Bordetella pertussis
gcgaccagcuucugcgccugcug

SEQ ID NO: 427791 - RNA, 17 nt, Bordetella pertussis
gcgaccaggugcgggcc

SEQ ID NO: 427792 - RNA, 18 nt, Bordetella pertussis
gcgacccgauagccgcgc

SEQ ID NO: 427793 - RNA, 21 nt, Bordetella pertussis
gcgacccgauagccgcgcgcc

SEQ ID NO: 427794 - RNA, 22 nt, Bordetella pertussis
gcgacccgauagccgcgcgccu

SEQ ID NO: 427795 - RNA, 23 nt, Bordetella pertussis
gcgacccgauagccgcgcgccug

SEQ ID NO: 427796 - RNA, 22 nt, Bordetella pertussis
gcgacccgcaaaaccgggcccg

SEQ ID NO: 427797 - RNA, 15 nt, Bordetella pertussis
gcgaccucggcggcg

SEQ ID NO: 427798 - RNA, 16 nt, Bordetella pertussis
gcgacgaacccgggcg

SEQ ID NO: 427799 - RNA, 22 nt, Bordetella pertussis
gcgacgacagcggcgagcgcgg

SEQ ID NO: 427800 - RNA, 22 nt, Bordetella pertussis
gcgacgaccccgccgugccggg

SEQ ID NO: 427801 - RNA, 22 nt, Bordetella pertussis
gcgacgaucuccacccccgggc

SEQ ID NO: 427802 - RNA, 23 nt, Bordetella pertussis
gcgacgaucuccacccccgggcg

SEQ ID NO: 427803 - RNA, 21 nt, Bordetella pertussis
gcgacgcaacagacccgggcc

SEQ ID NO: 427804 - RNA, 12 nt, Bordetella pertussis
gcgacugcagga

SEQ ID NO: 427805 - RNA, 18 nt, Bordetella pertussis
gcgacuucggcggccaug

SEQ ID NO: 427806 - RNA, 16 nt, Bordetella pertussis
gcgacuucggcggccu

SEQ ID NO: 427807 - RNA, 18 nt, Bordetella pertussis
gcgacuucggcggccugc

SEQ ID NO: 427808 - RNA, 24 nt, Bordetella pertussis
gcgacuucgcgaaagcgcugcgcc

SEQ ID NO: 427809 - RNA, 18 nt, Bordetella pertussis
gcgacuucuaccuggacg

SEQ ID NO: 427810 - RNA, 19 nt, Bordetella pertussis
gcgagagauagcccagcac

SEQ ID NO: 427811 - RNA, 20 nt, Bordetella pertussis
gcgagagcgccacgccagcg

SEQ ID NO: 427812 - RNA, 20 nt, Bordetella pertussis
gcgagaggguguugccgagg

SEQ ID NO: 427813 - RNA, 22 nt, Bordetella pertussis
gcgagcccgcgucagacgcgcu

SEQ ID NO: 427814 - RNA, 15 nt, Bordetella pertussis
gcgagccgggcaccg

SEQ ID NO: 427815 - RNA, 22 nt, Bordetella pertussis
gcgagccgggcaccgagccgca

SEQ ID NO: 427816 - RNA, 22 nt, Bordetella pertussis
gcgagccggccagcgccaccac

SEQ ID NO: 427817 - RNA, 18 nt, Bordetella pertussis
gcgagccuucggccggcu

SEQ ID NO: 427818 - RNA, 17 nt, Bordetella pertussis
gcgagcgaaagccgucg

SEQ ID NO: 427819 - RNA, 16 nt, Bordetella pertussis
gcgagcgcagccgcuc

SEQ ID NO: 427820 - RNA, 13 nt, Bordetella pertussis
gcgagcgccgggc

SEQ ID NO: 427821 - RNA, 14 nt, Bordetella pertussis
gcgagcgccgggcg

SEQ ID NO: 427822 - RNA, 22 nt, Bordetella pertussis
gcgagcgccgggcgccgcgccc

SEQ ID NO: 427823 - RNA, 22 nt, Bordetella pertussis
gcgaggacgaccuugcuggacc

SEQ ID NO: 427824 - RNA, 17 nt, Bordetella pertussis
gcgaggacacgcagcug

SEQ ID NO: 427825 - RNA, 16 nt, Bordetella pertussis
gcgaggcaucgaaggc

SEQ ID NO: 427826 - RNA, 12 nt, Bordetella pertussis
gcgaggccgccc

SEQ ID NO: 427827 - RNA, 14 nt, Bordetella pertussis
gcgaggccgcccgc

SEQ ID NO: 427828 - RNA, 22 nt, Bordetella pertussis
gcgaggccucgugcugcugcag

SEQ ID NO: 427829 - RNA, 14 nt, Bordetella pertussis
gcgaggcgcagcgc

SEQ ID NO: 427830 - RNA, 21 nt, Bordetella pertussis
gcgaggcgcaggccgacgcgc

SEQ ID NO: 427831 - RNA, 23 nt, Bordetella pertussis
gcgaggcgcuggccggcgugccc

SEQ ID NO: 427832 - RNA, 19 nt, Bordetella pertussis
gcgaggcggggcuggcgcg

SEQ ID NO: 427833 - RNA, 14 nt, Bordetella pertussis
gcgaggcggcggcc

SEQ ID NO: 427834 - RNA, 23 nt, Bordetella pertussis
gcgaggcuuuuuuucgccgggcg

SEQ ID NO: 427835 - RNA, 17 nt, Bordetella pertussis
gcgaggcuggcgcccac

SEQ ID NO: 427836 - RNA, 15 nt, Bordetella pertussis
gcgagggcucgaccg

SEQ ID NO: 427837 - RNA, 20 nt, Bordetella pertussis
gcgagggcucgaccgccgcc

SEQ ID NO: 427838 - RNA, 21 nt, Bordetella pertussis
gcgagggcucgaccgccgcca

SEQ ID NO: 427839 - RNA, 18 nt, Bordetella pertussis
gcgagggucaggcgcgcu

SEQ ID NO: 427840 - RNA, 19 nt, Bordetella pertussis
gcgagggucaggcgcgcuu

SEQ ID NO: 427841 - RNA, 16 nt, Bordetella pertussis
gcgagggugccugucc

SEQ ID NO: 427842 - RNA, 17 nt, Bordetella pertussis
gcgaggucagcccggcg

SEQ ID NO: 427843 - RNA, 18 nt, Bordetella pertussis
gcgaggucagcccggcgg

SEQ ID NO: 427844 - RNA, 19 nt, Bordetella pertussis
gcgauacgcgccgccuggc

SEQ ID NO: 427845 - RNA, 17 nt, Bordetella pertussis
gcgauacugcgcauggg

SEQ ID NO: 427846 - RNA, 19 nt, Bordetella pertussis
gcgauagcgggccugcagc

SEQ ID NO: 427847 - RNA, 22 nt, Bordetella pertussis
gcgaucaugcaguacaggcgcg

SEQ ID NO: 427848 - RNA, 12 nt, Bordetella pertussis
gcgauccaggcc

SEQ ID NO: 427849 - RNA, 19 nt, Bordetella pertussis
gcgauccagggccgccagc

SEQ ID NO: 427850 - RNA, 22 nt, Bordetella pertussis
gcgauccagggccgccagcacc

SEQ ID NO: 427851 - RNA, 18 nt, Bordetella pertussis
gcgauccauguggccagc

SEQ ID NO: 427852 - RNA, 16 nt, Bordetella pertussis
gcgauccgccgcggcc

SEQ ID NO: 427853 - RNA, 18 nt, Bordetella pertussis
gcgauccgcgccaggcgg

SEQ ID NO: 427854 - RNA, 15 nt, Bordetella pertussis
gcgauccugcccacc

SEQ ID NO: 427855 - RNA, 16 nt, Bordetella pertussis
gcgauccuucgcggcc

SEQ ID NO: 427856 - RNA, 23 nt, Bordetella pertussis
gcgaucgaacgacucgucgacca

SEQ ID NO: 427857 - RNA, 16 nt, Bordetella pertussis
gcgaucgaacgcggcc

SEQ ID NO: 427858 - RNA, 22 nt, Bordetella pertussis
gcgaucgaauggucggccucgg

SEQ ID NO: 427859 - RNA, 15 nt, Bordetella pertussis
gcgaucgccagcagg

SEQ ID NO: 427860 - RNA, 23 nt, Bordetella pertussis
gcgaucgccagcaggcgcugguc

SEQ ID NO: 427861 - RNA, 21 nt, Bordetella pertussis
gcgaucgcgucggccaaggcc

SEQ ID NO: 427862 - RNA, 20 nt, Bordetella pertussis
gcgaugaccucggcgagcgc

SEQ ID NO: 427863 - RNA, 21 nt, Bordetella pertussis
gcgaugaccucggcgagcgcc

SEQ ID NO: 427864 - RNA, 13 nt, Bordetella pertussis
gcgaugauggggu

SEQ ID NO: 427865 - RNA, 21 nt, Bordetella pertussis
gcgaugauggggucgccgggc

SEQ ID NO: 427866 - RNA, 18 nt, Bordetella pertussis
gcgaugcauucggcggcc

SEQ ID NO: 427867 - RNA, 19 nt, Bordetella pertussis
gcgaugcauucggcggccg

SEQ ID NO: 427868 - RNA, 20 nt, Bordetella pertussis
gcgaugcauucggcggccgg

SEQ ID NO: 427869 - RNA, 22 nt, Bordetella pertussis
gcgauggacacgaugaacgcgc

SEQ ID NO: 427870 - RNA, 22 nt, Bordetella pertussis
gcgauggcacggcacgccucgc

SEQ ID NO: 427871 - RNA, 16 nt, Bordetella pertussis
gcgauggcgcggccgg

SEQ ID NO: 427872 - RNA, 15 nt, Bordetella pertussis
gcgaugggccugccc

SEQ ID NO: 427873 - RNA, 22 nt, Bordetella pertussis
gcgauggucaccacccgcacgc

SEQ ID NO: 427874 - RNA, 13 nt, Bordetella pertussis
gcgauggucuggg

SEQ ID NO: 427875 - RNA, 17 nt, Bordetella pertussis
gcgauguaggccagguu

SEQ ID NO: 427876 - RNA, 16 nt, Bordetella pertussis
gcgauguccagcgagc

SEQ ID NO: 427877 - RNA, 15 nt, Bordetella pertussis
gcgauguccagcucc

SEQ ID NO: 427878 - RNA, 17 nt, Bordetella pertussis
gcgauguccagcuccag

SEQ ID NO: 427879 - RNA, 18 nt, Bordetella pertussis
gcgauguccagcuccagc

SEQ ID NO: 427880 - RNA, 14 nt, Bordetella pertussis
gcgaugucgcgcgc

SEQ ID NO: 427881 - RNA, 18 nt, Bordetella pertussis
gcgauucguacaugucga

SEQ ID NO: 427882 - RNA, 20 nt, Bordetella pertussis
gcgauugaguucgcgcgccg

SEQ ID NO: 427883 - RNA, 21 nt, Bordetella pertussis
gcgauugaguucgcgcgccgg

SEQ ID NO: 427884 - RNA, 17 nt, Bordetella pertussis
gcgauugcggcccgcgg

SEQ ID NO: 427885 - RNA, 23 nt, Bordetella pertussis
gcgauugcggcccgcggccuugg

SEQ ID NO: 427886 - RNA, 15 nt, Bordetella pertussis
gcgcaaacgggggca

SEQ ID NO: 427887 - RNA, 23 nt, Bordetella pertussis
gcgcaaguguggcgcaccgcgcu

SEQ ID NO: 427888 - RNA, 16 nt, Bordetella pertussis
gcgcaauacgccgccg

SEQ ID NO: 427889 - RNA, 15 nt, Bordetella pertussis
gcgcaauaggccgcg

SEQ ID NO: 427890 - RNA, 14 nt, Bordetella pertussis
gcgcaaugcgcggc

SEQ ID NO: 427891 - RNA, 15 nt, Bordetella pertussis
gcgcaaugcgcggcg

SEQ ID NO: 427892 - RNA, 19 nt, Bordetella pertussis
gcgcaauggacacagcggc

SEQ ID NO: 427893 - RNA, 20 nt, Bordetella pertussis
gcgcaauggacacagcggcg

SEQ ID NO: 427894 - RNA, 15 nt, Bordetella pertussis
gcgcacgcccagacu

SEQ ID NO: 427895 - RNA, 14 nt, Bordetella pertussis
gcgcacgccgggcg

SEQ ID NO: 427896 - RNA, 18 nt, Bordetella pertussis
gcgcacgccgggcgcggc

SEQ ID NO: 427897 - RNA, 19 nt, Bordetella pertussis
gcgcacgcguucgggcggc

SEQ ID NO: 427898 - RNA, 19 nt, Bordetella pertussis
gcgcacgcuggcgcccgcc

SEQ ID NO: 427899 - RNA, 21 nt, Bordetella pertussis
gcgcacgcuggcgcccgccug

SEQ ID NO: 427900 - RNA, 24 nt, Bordetella pertussis
gcgcacgcugggcgaggcgcuggc

SEQ ID NO: 427901 - RNA, 13 nt, Bordetella pertussis
gcgcacggcgccc

SEQ ID NO: 427902 - RNA, 13 nt, Bordetella pertussis
gcgcacggcggcg

SEQ ID NO: 427903 - RNA, 17 nt, Bordetella pertussis
gcgcacggugcgcacga

SEQ ID NO: 427904 - RNA, 14 nt, Bordetella pertussis
gcgcacgggcgccu

SEQ ID NO: 427905 - RNA, 14 nt, Bordetella pertussis
gcgcacguggacca

SEQ ID NO: 427906 - RNA, 17 nt, Bordetella pertussis
gcgcacguggaccaggg

SEQ ID NO: 427907 - RNA, 20 nt, Bordetella pertussis
gcgcagcaagcugcugcugg

SEQ ID NO: 427908 - RNA, 17 nt, Bordetella pertussis
gcgcagcaaggcgcgcc

SEQ ID NO: 427909 - RNA, 13 nt, Bordetella pertussis
gcgcagcaccagg

SEQ ID NO: 427910 - RNA, 13 nt, Bordetella pertussis
gcgcagcaccgcc

SEQ ID NO: 427911 - RNA, 17 nt, Bordetella pertussis
gcgcagcaccgccagcg

SEQ ID NO: 427912 - RNA, 22 nt, Bordetella pertussis
gcgcagcaccggcgugagcgcc

SEQ ID NO: 427913 - RNA, 23 nt, Bordetella pertussis
gcgcagcaccucggggcgcggcc

SEQ ID NO: 427914 - RNA, 20 nt, Bordetella pertussis
gcgcagcacgauggggccau

SEQ ID NO: 427915 - RNA, 23 nt, Bordetella pertussis
gcgcagcacgauggggccauggc

SEQ ID NO: 427916 - RNA, 13 nt, Bordetella pertussis
gcgcagcacgccc

SEQ ID NO: 427917 - RNA, 21 nt, Bordetella pertussis
gcgcagcacgccgcgccaggc

SEQ ID NO: 427918 - RNA, 22 nt, Bordetella pertussis
gcgcagcacgccgcgccaggca

SEQ ID NO: 427919 - RNA, 14 nt, Bordetella pertussis
gcgcagcagacgcu

SEQ ID NO: 427920 - RNA, 20 nt, Bordetella pertussis
gcgcagcagauugccgcgcg

SEQ ID NO: 427921 - RNA, 22 nt, Bordetella pertussis
gcgcagcagauugccgcgcggc

SEQ ID NO: 427922 - RNA, 18 nt, Bordetella pertussis
gcgcagcagcgacaggac

SEQ ID NO: 427923 - RNA, 16 nt, Bordetella pertussis
gcgcagcagcgccggc

SEQ ID NO: 427924 - RNA, 11 nt, Bordetella pertussis
gcgcagcaggc

SEQ ID NO: 427925 - RNA, 15 nt, Bordetella pertussis
gcgcagcaggcccau

SEQ ID NO: 427926 - RNA, 17 nt, Bordetella pertussis
gcgcagcaggcgcgcgg

SEQ ID NO: 427927 - RNA, 18 nt, Bordetella pertussis
gcgcagcaggcgcgcggc

SEQ ID NO: 427928 - RNA, 19 nt, Bordetella pertussis
gcgcagcaggcgcgcggcc

SEQ ID NO: 427929 - RNA, 15 nt, Bordetella pertussis
gcgcagcagggccug

SEQ ID NO: 427930 - RNA, 17 nt, Bordetella pertussis
gcgcagcagggccuggc

SEQ ID NO: 427931 - RNA, 15 nt, Bordetella pertussis
gcgcagcagggcggc

SEQ ID NO: 427932 - RNA, 19 nt, Bordetella pertussis
gcgcagcagcgcgguggcc

SEQ ID NO: 427933 - RNA, 23 nt, Bordetella pertussis
gcgcagcagcuugccgaccgcuu

SEQ ID NO: 427934 - RNA, 14 nt, Bordetella pertussis
gcgcagcagggugg

SEQ ID NO: 427935 - RNA, 23 nt, Bordetella pertussis
gcgcagcauuucggcgccgccgg

SEQ ID NO: 427936 - RNA, 21 nt, Bordetella pertussis
gcgcagccacagcgcguggcc

SEQ ID NO: 427937 - RNA, 24 nt, Bordetella pertussis
gcgcagccacagcgcguggccggg

SEQ ID NO: 427938 - RNA, 14 nt, Bordetella pertussis
gcgcagcaugagcu

SEQ ID NO: 427939 - RNA, 14 nt, Bordetella pertussis
gcgcagcccagcgc

SEQ ID NO: 427940 - RNA, 17 nt, Bordetella pertussis
gcgcagcccggcgugcc

SEQ ID NO: 427941 - RNA, 21 nt, Bordetella pertussis
gcgcagccgccauaggcgcgc

SEQ ID NO: 427942 - RNA, 23 nt, Bordetella pertussis
gcgcagccgccauaggcgcgcac

SEQ ID NO: 427943 - RNA, 18 nt, Bordetella pertussis
gcgcagccgacaggcgcg

SEQ ID NO: 427944 - RNA, 23 nt, Bordetella pertussis
gcgcagccgacaggcgcgcaggc

SEQ ID NO: 427945 - RNA, 15 nt, Bordetella pertussis
gcgcagcgcguccug

SEQ ID NO: 427946 - RNA, 17 nt, Bordetella pertussis
gcgcagcgcguccugcc

SEQ ID NO: 427947 - RNA, 15 nt, Bordetella pertussis
gcgcagcgcgucggc

SEQ ID NO: 427948 - RNA, 14 nt, Bordetella pertussis
gcgcagcggcaggc

SEQ ID NO: 427949 - RNA, 15 nt, Bordetella pertussis
gcgcagcggcaggcc

SEQ ID NO: 427950 - RNA, 18 nt, Bordetella pertussis
gcgcagcggcaggcccug

SEQ ID NO: 427951 - RNA, 12 nt, Bordetella pertussis
gcgcagcggcgc

SEQ ID NO: 427952 - RNA, 13 nt, Bordetella pertussis
gcgcagcggcgcg

SEQ ID NO: 427953 - RNA, 16 nt, Bordetella pertussis
gcgcagcggcgcgcgc

SEQ ID NO: 427954 - RNA, 13 nt, Bordetella pertussis
gcgcagcggcggc

SEQ ID NO: 427955 - RNA, 15 nt, Bordetella pertussis
gcgcagcguggcggc

SEQ ID NO: 427956 - RNA, 17 nt, Bordetella pertussis
gcgcagcguggcggcga

SEQ ID NO: 427957 - RNA, 20 nt, Bordetella pertussis
gcgcagcucgaccgucagca

SEQ ID NO: 427958 - RNA, 15 nt, Bordetella pertussis
gcgcaggacggcgcc

SEQ ID NO: 427959 - RNA, 19 nt, Bordetella pertussis
gcgcaggaugacguggcag

SEQ ID NO: 427960 - RNA, 15 nt, Bordetella pertussis
gcgcaggaugggcag

SEQ ID NO: 427961 - RNA, 22 nt, Bordetella pertussis
gcgcaggaugggcagcucgccu

SEQ ID NO: 427962 - RNA, 19 nt, Bordetella pertussis
gcgcaggauuuccucgccg

SEQ ID NO: 427963 - RNA, 23 nt, Bordetella pertussis
gcgcaggcaguuggcggcgcagc

SEQ ID NO: 427964 - RNA, 19 nt, Bordetella pertussis
gcgcaggcccgacaggauc

SEQ ID NO: 427965 - RNA, 17 nt, Bordetella pertussis
gcgcaggccgcgccggc

SEQ ID NO: 427966 - RNA, 22 nt, Bordetella pertussis
gcgcaggccgcgccggcucccg

SEQ ID NO: 427967 - RNA, 21 nt, Bordetella pertussis
gcgcaggccgcgcgcauccag

SEQ ID NO: 427968 - RNA, 16 nt, Bordetella pertussis
gcgcaggccgacgcgc

SEQ ID NO: 427969 - RNA, 18 nt, Bordetella pertussis
gcgcaggccggcggccag

SEQ ID NO: 427970 - RNA, 17 nt, Bordetella pertussis
gcgcaggccugcggcga

SEQ ID NO: 427971 - RNA, 12 nt, Bordetella pertussis
gcgcaggcgcgc

SEQ ID NO: 427972 - RNA, 14 nt, Bordetella pertussis
gcgcaggcgcgcgc

SEQ ID NO: 427973 - RNA, 22 nt, Bordetella pertussis
gcgccacgucgaccucgagcac

SEQ ID NO: 427974 - RNA, 18 nt, Bordetella pertussis
gcgccagaaagcgcggcc

SEQ ID NO: 427975 - RNA, 16 nt, Bordetella pertussis
gcgccagaugcgccgc

SEQ ID NO: 427976 - RNA, 21 nt, Bordetella pertussis
gcgccagaugcgccgcacguc

SEQ ID NO: 427977 - RNA, 17 nt, Bordetella pertussis
gcgccagccgcuccagg

SEQ ID NO: 427978 - RNA, 19 nt, Bordetella pertussis
gcgccagccgcuccaggaa

SEQ ID NO: 427979 - RNA, 13 nt, Bordetella pertussis
gcgccagccgcuu

SEQ ID NO: 427980 - RNA, 21 nt, Bordetella pertussis
gcgccagccgcgccugcagca

SEQ ID NO: 427981 - RNA, 16 nt, Bordetella pertussis
gcgccagcgccagcgu

SEQ ID NO: 427982 - RNA, 16 nt, Bordetella pertussis
gcgccagcgccccggc

SEQ ID NO: 427983 - RNA, 18 nt, Bordetella pertussis
gcgccagcgccccggcgu

SEQ ID NO: 427984 - RNA, 21 nt, Bordetella pertussis
gcgccagcgccgcgcgcgugc

SEQ ID NO: 427985 - RNA, 15 nt, Bordetella pertussis
gcgccagcgccucca

SEQ ID NO: 427986 - RNA, 13 nt, Bordetella pertussis
gcgccagcgcggc

SEQ ID NO: 427987 - RNA, 20 nt, Bordetella pertussis
gcgccagcgcggcgggccgg

SEQ ID NO: 427988 - RNA, 20 nt, Bordetella pertussis
gcgccagcgcuucgggcagc

SEQ ID NO: 427989 - RNA, 13 nt, Bordetella pertussis
gcgccagcggccg

SEQ ID NO: 427990 - RNA, 14 nt, Bordetella pertussis
gcgccagcggcgac

SEQ ID NO: 427991 - RNA, 16 nt, Bordetella pertussis
gcgccagcggcugcuu

SEQ ID NO: 427992 - RNA, 20 nt, Bordetella pertussis
gcgccagcguucggccaccc

SEQ ID NO: 427993 - RNA, 15 nt, Bordetella pertussis
gcgccaggccgcgca

SEQ ID NO: 427994 - RNA, 16 nt, Bordetella pertussis
gcgccaggccggcggc

SEQ ID NO: 427995 - RNA, 18 nt, Bordetella pertussis
gcgccaggcgccgggccg

SEQ ID NO: 427996 - RNA, 13 nt, Bordetella pertussis
gcgccaggcgcgc

SEQ ID NO: 427997 - RNA, 23 nt, Bordetella pertussis
gcgccaggcgcgcaucgcgcggc

SEQ ID NO: 427998 - RNA, 15 nt, Bordetella pertussis
gcgccaggcgcucgg

SEQ ID NO: 427999 - RNA, 16 nt, Bordetella pertussis
gcgccaggcgcucggc

SEQ ID NO: 428000 - RNA, 22 nt, Bordetella pertussis
gcgccaggcugaaugccgccgu

SEQ ID NO: 428001 - RNA, 15 nt, Bordetella pertussis
gcgccagggccaggc

SEQ ID NO: 428002 - RNA, 16 nt, Bordetella pertussis
gcgccagggccaggcc

SEQ ID NO: 428003 - RNA, 18 nt, Bordetella pertussis
gcgccagggccaggccgc

SEQ ID NO: 428004 - RNA, 21 nt, Bordetella pertussis
gcgccagggccaggccgccgc

SEQ ID NO: 428005 - RNA, 23 nt, Bordetella pertussis
gcgccaggcgguacaggccggcg

SEQ ID NO: 428006 - RNA, 16 nt, Bordetella pertussis
gcgccagggccgccgc

SEQ ID NO: 428007 - RNA, 12 nt, Bordetella pertussis
gcgccagggcgc

SEQ ID NO: 428008 - RNA, 14 nt, Bordetella pertussis
gcgccagggugccg

SEQ ID NO: 428009 - RNA, 18 nt, Bordetella pertussis
gcgccagguaggccggcg

SEQ ID NO: 428010 - RNA, 20 nt, Bordetella pertussis
gcgccaguccagcgcgccgc

SEQ ID NO: 428011 - RNA, 17 nt, Bordetella pertussis
gcgccagucgcgcagca

SEQ ID NO: 428012 - RNA, 20 nt, Bordetella pertussis
gcgccagucgcgcagcaccu

SEQ ID NO: 428013 - RNA, 21 nt, Bordetella pertussis
gcgccagucgcgcagcaccuc

SEQ ID NO: 428014 - RNA, 16 nt, Bordetella pertussis
gcgccaugccgcgccc

SEQ ID NO: 428015 - RNA, 14 nt, Bordetella pertussis
gcgccaugccggga

SEQ ID NO: 428016 - RNA, 15 nt, Bordetella pertussis
gcgccaugcgacagc

SEQ ID NO: 428017 - RNA, 16 nt, Bordetella pertussis
gcgccaugcgcccggc

SEQ ID NO: 428018 - RNA, 11 nt, Bordetella pertussis
gcgccauggca

SEQ ID NO: 428019 - RNA, 14 nt, Bordetella pertussis
gcgccauggcgcgc

SEQ ID NO: 428020 - RNA, 21 nt, Bordetella pertussis
gcgccauggugaacggccccg

SEQ ID NO: 428021 - RNA, 22 nt, Bordetella pertussis
gcgccauguggcgacgcccagc

SEQ ID NO: 428022 - RNA, 16 nt, Bordetella pertussis
gcgccauugccacggc

SEQ ID NO: 428023 - RNA, 20 nt, Bordetella pertussis
gcgccauugccacggcgggc

SEQ ID NO: 428024 - RNA, 16 nt, Bordetella pertussis
gcgcccaaucgggcag

SEQ ID NO: 428025 - RNA, 23 nt, Bordetella pertussis
gcgcccaggcgaugcccagcgcc

SEQ ID NO: 428026 - RNA, 19 nt, Bordetella pertussis
gcgcccaggcccagcgcgc

SEQ ID NO: 428027 - RNA, 20 nt, Bordetella pertussis
gcgcccaggggccggcgcgc

SEQ ID NO: 428028 - RNA, 20 nt, Bordetella pertussis
gcgcccaguuccacgcggcc

SEQ ID NO: 428029 - RNA, 13 nt, Bordetella pertussis
gcgcccauggcgc

SEQ ID NO: 428030 - RNA, 15 nt, Bordetella pertussis
gcgcccauggcgcgc

SEQ ID NO: 428031 - RNA, 19 nt, Bordetella pertussis
gcgcccauuccgagcgggc

SEQ ID NO: 428032 - RNA, 22 nt, Bordetella pertussis
gcgcccauuccgagcgggcccg

SEQ ID NO: 428033 - RNA, 12 nt, Bordetella pertussis
gcgccccagagc

SEQ ID NO: 428034 - RNA, 22 nt, Bordetella pertussis
gcgccccaggcgucggcggccc

SEQ ID NO: 428035 - RNA, 15 nt, Bordetella pertussis
gcgcccccagcagcg

SEQ ID NO: 428036 - RNA, 14 nt, Bordetella pertussis
gcgcccccagcgcc

SEQ ID NO: 428037 - RNA, 15 nt, Bordetella pertussis
gcgcccccgcggcgc

SEQ ID NO: 428038 - RNA, 19 nt, Bordetella pertussis
gcgcccccucuucucgucc

SEQ ID NO: 428039 - RNA, 20 nt, Bordetella pertussis
gcgccccgaucagcaagggc

SEQ ID NO: 428040 - RNA, 17 nt, Bordetella pertussis
gcgccccuugcggggcg

SEQ ID NO: 428041 - RNA, 19 nt, Bordetella pertussis
gcgccccuugcggggcgcg

SEQ ID NO: 428042 - RNA, 20 nt, Bordetella pertussis
gcgccccuugcggggcgcgu

SEQ ID NO: 428043 - RNA, 17 nt, Bordetella pertussis
gcgcccgacggcgcgcc

SEQ ID NO: 428044 - RNA, 18 nt, Bordetella pertussis
gcgcccgagcgccacaua

SEQ ID NO: 428045 - RNA, 15 nt, Bordetella pertussis
gcgcccgaugccuug

SEQ ID NO: 428046 - RNA, 19 nt, Bordetella pertussis
gcgcccgaugcucgccggc

SEQ ID NO: 428047 - RNA, 23 nt, Bordetella pertussis
gcgcccgaugcucgccggcgccg

SEQ ID NO: 428048 - RNA, 14 nt, Bordetella pertussis
gcgcccgauggugc

SEQ ID NO: 428049 - RNA, 12 nt, Bordetella pertussis
gcgcccgcaggc

SEQ ID NO: 428050 - RNA, 17 nt, Bordetella pertussis
gcgcccgcaggcggcgg

SEQ ID NO: 428051 - RNA, 21 nt, Bordetella pertussis
gcgcccgcaggcggcggccuc

SEQ ID NO: 428052 - RNA, 20 nt, Bordetella pertussis
gcgcccgccgccgggcgcgc

SEQ ID NO: 428053 - RNA, 21 nt, Bordetella pertussis
gcgcccgccgcgucggcgccg

SEQ ID NO: 428054 - RNA, 21 nt, Bordetella pertussis
gcgcccgccugcgccagccgc

SEQ ID NO: 428055 - RNA, 21 nt, Bordetella pertussis
gcgcccgccuucggcggcggg

SEQ ID NO: 428056 - RNA, 14 nt, Bordetella pertussis
gcgcccgcgccauc

SEQ ID NO: 428057 - RNA, 14 nt, Bordetella pertussis
gcgcccgcgcgcga

SEQ ID NO: 428058 - RNA, 17 nt, Bordetella pertussis
gcgcccgcuacgcgggc

SEQ ID NO: 428059 - RNA, 23 nt, Bordetella pertussis
gcgcccgcuaugcgggcuugcug

SEQ ID NO: 428060 - RNA, 19 nt, Bordetella pertussis
gcgcccgcuugcggccggc

SEQ ID NO: 428061 - RNA, 15 nt, Bordetella pertussis
gcgcccggccaccgc

SEQ ID NO: 428062 - RNA, 15 nt, Bordetella pertussis
gcgcccggccggccc

SEQ ID NO: 428063 - RNA, 21 nt, Bordetella pertussis
gcgcccggccggccuuccggc

SEQ ID NO: 428064 - RNA, 18 nt, Bordetella pertussis
gcgcccggccugcgggcg

SEQ ID NO: 428065 - RNA, 21 nt, Bordetella pertussis
gcgcccggccugcgggcgccg

SEQ ID NO: 428066 - RNA, 22 nt, Bordetella pertussis
gcgcccggccugcgggcgccgc

SEQ ID NO: 428067 - RNA, 16 nt, Bordetella pertussis
gcgcccggcgccgcgc

SEQ ID NO: 428068 - RNA, 14 nt, Bordetella pertussis
gcgcccggcggcca

SEQ ID NO: 428069 - RNA, 17 nt, Bordetella pertussis
gcgcccggcggccaggc

SEQ ID NO: 428070 - RNA, 18 nt, Bordetella pertussis
gcgcccggcggccaggcc

SEQ ID NO: 428071 - RNA, 14 nt, Bordetella pertussis
gcgcccggcggcgc

SEQ ID NO: 428072 - RNA, 13 nt, Bordetella pertussis
gcgcccggcguga

SEQ ID NO: 428073 - RNA, 14 nt, Bordetella pertussis
gcgcccgggcugcc

SEQ ID NO: 428074 - RNA, 18 nt, Bordetella pertussis
gcgcccggucugccacac

SEQ ID NO: 428075 - RNA, 15 nt, Bordetella pertussis
gcgcccguccacggc

SEQ ID NO: 428076 - RNA, 16 nt, Bordetella pertussis
gcgcccucaguccagc

SEQ ID NO: 428077 - RNA, 23 nt, Bordetella pertussis
gcgcccucuuucgccgcgcgcuc

SEQ ID NO: 428078 - RNA, 23 nt, Bordetella pertussis
gcgcccugcagggcaugggcccg

SEQ ID NO: 428079 - RNA, 14 nt, Bordetella pertussis
gcgcccugcgcgua

SEQ ID NO: 428080 - RNA, 19 nt, Bordetella pertussis
gcgcccuggcgccgcggcc

SEQ ID NO: 428081 - RNA, 23 nt, Bordetella pertussis
gcgcccuggcgccgcggccgggu

SEQ ID NO: 428082 - RNA, 15 nt, Bordetella pertussis
gcgcccuggcguggc

SEQ ID NO: 428083 - RNA, 22 nt, Bordetella pertussis
gcgcccuggcguggcgcgcgcc

SEQ ID NO: 428084 - RNA, 23 nt, Bordetella pertussis
gcgcccuggcguggcgcgcgccg

SEQ ID NO: 428085 - RNA, 14 nt, Bordetella pertussis
gcgcccuugaugcc

SEQ ID NO: 428086 - RNA, 23 nt, Bordetella pertussis
gcgcccuuugcauugcggcuggg

SEQ ID NO: 428087 - RNA, 16 nt, Bordetella pertussis
gcgccgaacaccagcu

SEQ ID NO: 428088 - RNA, 21 nt, Bordetella pertussis
gcgccgaacaccagcucggcg

SEQ ID NO: 428089 - RNA, 23 nt, Bordetella pertussis
gcgccgaacaccagcucggcggc

SEQ ID NO: 428090 - RNA, 16 nt, Bordetella pertussis
gcgccgaacgcgcagc

SEQ ID NO: 428091 - RNA, 22 nt, Bordetella pertussis
gcgccgaacgcgcagcgaacgg

SEQ ID NO: 428092 - RNA, 23 nt, Bordetella pertussis
gcgccgaacgcgcagcgaacggc

SEQ ID NO: 428093 - RNA, 15 nt, Bordetella pertussis
gcgccgaagcgcagg

SEQ ID NO: 428094 - RNA, 16 nt, Bordetella pertussis
gcgccgaaggcggcgc

SEQ ID NO: 428095 - RNA, 18 nt, Bordetella pertussis
gcgccgaaggcggcgccg

SEQ ID NO: 428096 - RNA, 18 nt, Bordetella pertussis
gcgccgaaguugcggccg

SEQ ID NO: 428097 - RNA, 23 nt, Bordetella pertussis
gcgccgaccaccugcaccgccgc

SEQ ID NO: 428098 - RNA, 16 nt, Bordetella pertussis
gcgccgacccugcccg

SEQ ID NO: 428099 - RNA, 17 nt, Bordetella pertussis
gcgccgaccggccccac

SEQ ID NO: 428100 - RNA, 15 nt, Bordetella pertussis
gcgccgaccgggccg

SEQ ID NO: 428101 - RNA, 16 nt, Bordetella pertussis
gcgccgaccgggccga

SEQ ID NO: 428102 - RNA, 22 nt, Bordetella pertussis
gcgccgacgaugccgcccacgc

SEQ ID NO: 428103 - RNA, 13 nt, Bordetella pertussis
gcgccgacgcgcu

SEQ ID NO: 428104 - RNA, 16 nt, Bordetella pertussis
gcgccgacggcauggc

SEQ ID NO: 428105 - RNA, 16 nt, Bordetella pertussis
gcgccgacggcgcccu

SEQ ID NO: 428106 - RNA, 17 nt, Bordetella pertussis
gcgccgacggcgcccug

SEQ ID NO: 428107 - RNA, 17 nt, Bordetella pertussis
gcgccgacucgaagaag

SEQ ID NO: 428108 - RNA, 14 nt, Bordetella pertussis
gcgccgagcgccag

SEQ ID NO: 428109 - RNA, 14 nt, Bordetella pertussis
gcgccgaggcgggc

SEQ ID NO: 428110 - RNA, 16 nt, Bordetella pertussis
gcgccgaggcgggcag

SEQ ID NO: 428111 - RNA, 15 nt, Bordetella pertussis
gcgccgaggcggucg

SEQ ID NO: 428112 - RNA, 16 nt, Bordetella pertussis
gcgccgaggccugcug

SEQ ID NO: 428113 - RNA, 15 nt, Bordetella pertussis
gcgccgauccagccc

SEQ ID NO: 428114 - RNA, 17 nt, Bordetella pertussis
gcgccgauccagggccg

SEQ ID NO: 428115 - RNA, 18 nt, Bordetella pertussis
gcgccgauccagggccgc

SEQ ID NO: 428116 - RNA, 21 nt, Bordetella pertussis
gcgccgauccagggccgcagc

SEQ ID NO: 428117 - RNA, 18 nt, Bordetella pertussis
gcgccgauccggcgcaga

SEQ ID NO: 428118 - RNA, 15 nt, Bordetella pertussis
gcgccgaucgcggcu

SEQ ID NO: 428119 - RNA, 17 nt, Bordetella pertussis
gcgccgauggcgccgcu

SEQ ID NO: 428120 - RNA, 18 nt, Bordetella pertussis
gcgccgauggugcgggcg

SEQ ID NO: 428121 - RNA, 19 nt, Bordetella pertussis
gcgccgcaacgccgggccg

SEQ ID NO: 428122 - RNA, 15 nt, Bordetella pertussis
gcgccgcaccagcgc

SEQ ID NO: 428123 - RNA, 16 nt, Bordetella pertussis
gcgccgcaccagcgcc

SEQ ID NO: 428124 - RNA, 21 nt, Bordetella pertussis
gcgccgcaccagcgccgacgg

SEQ ID NO: 428125 - RNA, 17 nt, Bordetella pertussis
gcgccgcaccagcggcg

SEQ ID NO: 428126 - RNA, 20 nt, Bordetella pertussis
gcgccgcagugcgcgcgccc

SEQ ID NO: 428127 - RNA, 19 nt, Bordetella pertussis
gcgccgcaugcggcggcug

SEQ ID NO: 428128 - RNA, 20 nt, Bordetella pertussis
gcgccgccaccucggcgucg

SEQ ID NO: 428129 - RNA, 23 nt, Bordetella pertussis
gcgccgccaccucggcgucgccc

SEQ ID NO: 428130 - RNA, 22 nt, Bordetella pertussis
gcgccgccagccgcuggcgcgc

SEQ ID NO: 428131 - RNA, 19 nt, Bordetella pertussis
gcgccgccagcgcgcgcga

SEQ ID NO: 428132 - RNA, 13 nt, Bordetella pertussis
gcgccgccaggcc

SEQ ID NO: 428133 - RNA, 16 nt, Bordetella pertussis
gcgccgccaggcgcga

SEQ ID NO: 428134 - RNA, 18 nt, Bordetella pertussis
gcgccgcccccgcccagc

SEQ ID NO: 428135 - RNA, 21 nt, Bordetella pertussis
gcgccgcccccgcccagcauc

SEQ ID NO: 428136 - RNA, 20 nt, Bordetella pertussis
gcgccgccccuucagcuucc

SEQ ID NO: 428137 - RNA, 15 nt, Bordetella pertussis
gcgccgcccgggccg

SEQ ID NO: 428138 - RNA, 20 nt, Bordetella pertussis
gcgccgcgcucgcgccaggc

SEQ ID NO: 428139 - RNA, 14 nt, Bordetella pertussis
gcgccgcggccggg

SEQ ID NO: 428140 - RNA, 12 nt, Bordetella pertussis
gcgccgcggcgc

SEQ ID NO: 428141 - RNA, 13 nt, Bordetella pertussis
gcgccgcggcgcu

SEQ ID NO: 428142 - RNA, 23 nt, Bordetella pertussis
gcgccgcggcggcgagggcgucg

SEQ ID NO: 428143 - RNA, 13 nt, Bordetella pertussis
gcgccgcggcggg

SEQ ID NO: 428144 - RNA, 15 nt, Bordetella pertussis
gcgccgcggugaugc

SEQ ID NO: 428145 - RNA, 18 nt, Bordetella pertussis
gcgccgcguccggcgccc

SEQ ID NO: 428146 - RNA, 18 nt, Bordetella pertussis
gcgccgcguucacgccgg

SEQ ID NO: 428147 - RNA, 19 nt, Bordetella pertussis
gcgccgcguucacgccggc

SEQ ID NO: 428148 - RNA, 15 nt, Bordetella pertussis
gcgccgcuacagcgu

SEQ ID NO: 428149 - RNA, 21 nt, Bordetella pertussis
gcgccgcuacagcgucacggc

SEQ ID NO: 428150 - RNA, 18 nt, Bordetella pertussis
gcgccgcuacgcggcguc

SEQ ID NO: 428151 - RNA, 15 nt, Bordetella pertussis
gcgccgcgggcugcg

SEQ ID NO: 428152 - RNA, 17 nt, Bordetella pertussis
gcgccggaucggccggc

SEQ ID NO: 428153 - RNA, 22 nt, Bordetella pertussis
gcgccggaucggccggcagcgc

SEQ ID NO: 428154 - RNA, 22 nt, Bordetella pertussis
gcgccggcaggcgcgccagccc

SEQ ID NO: 428155 - RNA, 19 nt, Bordetella pertussis
gcgccggcagggcggccag

SEQ ID NO: 428156 - RNA, 16 nt, Bordetella pertussis
gcgccggcagggugcu

SEQ ID NO: 428157 - RNA, 15 nt, Bordetella pertussis
gcgccggcaucggcg

SEQ ID NO: 428158 - RNA, 18 nt, Bordetella pertussis
gcgccggcaucggcggcu

SEQ ID NO: 428159 - RNA, 13 nt, Bordetella pertussis
gcgccggcauggc

SEQ ID NO: 428160 - RNA, 19 nt, Bordetella pertussis
gcgccggcauuucgcuggg

SEQ ID NO: 428161 - RNA, 21 nt, Bordetella pertussis
gcgccggcauuucgcugggcg

SEQ ID NO: 428162 - RNA, 21 nt, Bordetella pertussis
gcgccggcaugaagcgcagca

SEQ ID NO: 428163 - RNA, 18 nt, Bordetella pertussis
gcgccggccaccgccugu

SEQ ID NO: 428164 - RNA, 13 nt, Bordetella pertussis
gcgccggccagcg

SEQ ID NO: 428165 - RNA, 14 nt, Bordetella pertussis
gcgccggccagcgc

SEQ ID NO: 428166 - RNA, 17 nt, Bordetella pertussis
gcgccggccagcggcag

SEQ ID NO: 428167 - RNA, 13 nt, Bordetella pertussis
gcgccggccaggc

SEQ ID NO: 428168 - RNA, 14 nt, Bordetella pertussis
gcgccggccaggcc

SEQ ID NO: 428169 - RNA, 15 nt, Bordetella pertussis
gcgccggccagggcc

SEQ ID NO: 428170 - RNA, 16 nt, Bordetella pertussis
gcgccggccagggcca

SEQ ID NO: 428171 - RNA, 18 nt, Bordetella pertussis
gcgccggcccaggcgcgc

SEQ ID NO: 428172 - RNA, 13 nt, Bordetella pertussis
gcgccggcccggc

SEQ ID NO: 428173 - RNA, 13 nt, Bordetella pertussis
gcgccggccgccc

SEQ ID NO: 428174 - RNA, 14 nt, Bordetella pertussis
gcgccggccgcgcg

SEQ ID NO: 428175 - RNA, 20 nt, Bordetella pertussis
gcgccggccugcgccgggcg

SEQ ID NO: 428176 - RNA, 13 nt, Bordetella pertussis
gcgccggccuggg

SEQ ID NO: 428177 - RNA, 13 nt, Bordetella pertussis
gcgccggccuugc

SEQ ID NO: 428178 - RNA, 16 nt, Bordetella pertussis
gcgccggcgacgccgc

SEQ ID NO: 428179 - RNA, 14 nt, Bordetella pertussis
gcgccggcgccggc

SEQ ID NO: 428180 - RNA, 18 nt, Bordetella pertussis
gcgccggcgccggcgcgc

SEQ ID NO: 428181 - RNA, 13 nt, Bordetella pertussis
gcgccggcgccuu

SEQ ID NO: 428182 - RNA, 21 nt, Bordetella pertussis
gcgccggugaccgccagcagg

SEQ ID NO: 428183 - RNA, 14 nt, Bordetella pertussis
gcgccggucgccgc

SEQ ID NO: 428184 - RNA, 16 nt, Bordetella pertussis
gcgccggugcgcggcg

SEQ ID NO: 428185 - RNA, 19 nt, Bordetella pertussis
gcgccggugcgcggcgccc

SEQ ID NO: 428186 - RNA, 23 nt, Bordetella pertussis
gcgccggugcgcggcgcccccgc

SEQ ID NO: 428187 - RNA, 15 nt, Bordetella pertussis
gcgccguaccagcgc

SEQ ID NO: 428188 - RNA, 16 nt, Bordetella pertussis
gcgccguaccugcagc

SEQ ID NO: 428189 - RNA, 14 nt, Bordetella pertussis
gcgccgucagcagc

SEQ ID NO: 428190 - RNA, 18 nt, Bordetella pertussis
gcgccgucagcagcgcgg

SEQ ID NO: 428191 - RNA, 12 nt, Bordetella pertussis
gcgccguccagu

SEQ ID NO: 428192 - RNA, 15 nt, Bordetella pertussis
gcgccguccaguccc

SEQ ID NO: 428193 - RNA, 23 nt, Bordetella pertussis
gcgccguccgugagugcagcgcu

SEQ ID NO: 428194 - RNA, 21 nt, Bordetella pertussis
gcgccguccucaggcccgcgg

SEQ ID NO: 428195 - RNA, 21 nt, Bordetella pertussis
gcgccgucgaacuccugcagc

SEQ ID NO: 428196 - RNA, 18 nt, Bordetella pertussis
gcgccgucgaagccggcg

SEQ ID NO: 428197 - RNA, 21 nt, Bordetella pertussis
gcgccgucgaagccggcgcca

SEQ ID NO: 428198 - RNA, 19 nt, Bordetella pertussis
gcgccgucgggggccggcu

SEQ ID NO: 428199 - RNA, 19 nt, Bordetella pertussis
gcgccgucgcuggggcgca

SEQ ID NO: 428200 - RNA, 18 nt, Bordetella pertussis
gcgccgucugcgccgccg

SEQ ID NO: 428201 - RNA, 19 nt, Bordetella pertussis
gcgccgucugcgccgccgc

SEQ ID NO: 428202 - RNA, 17 nt, Bordetella pertussis
gcgccgucugugcgccc

SEQ ID NO: 428203 - RNA, 21 nt, Bordetella pertussis
gcgccgucugugcgccccgcu

SEQ ID NO: 428204 - RNA, 15 nt, Bordetella pertussis
gcgccgugaaugcgc

SEQ ID NO: 428205 - RNA, 20 nt, Bordetella pertussis
gcgccgugaaugcgccuggc

SEQ ID NO: 428206 - RNA, 21 nt, Bordetella pertussis
gcgccgugaaugcgccuggcg

SEQ ID NO: 428207 - RNA, 21 nt, Bordetella pertussis
gcgccgugacguugagcgccg

SEQ ID NO: 428208 - RNA, 19 nt, Bordetella pertussis
gcgccgugcagacggcggc

SEQ ID NO: 428209 - RNA, 21 nt, Bordetella pertussis
gcgccgugcagacggcggcug

SEQ ID NO: 428210 - RNA, 14 nt, Bordetella pertussis
gcgccgugcccggc

SEQ ID NO: 428211 - RNA, 14 nt, Bordetella pertussis
gcgccguggugcug

SEQ ID NO: 428212 - RNA, 17 nt, Bordetella pertussis
gcgccguucagggacgg

SEQ ID NO: 428213 - RNA, 16 nt, Bordetella pertussis
gcgccguuccugcagc

SEQ ID NO: 428214 - RNA, 19 nt, Bordetella pertussis
gcgccguucgucgcgcagc

SEQ ID NO: 428215 - RNA, 21 nt, Bordetella pertussis
gcgccguucucaggccgaggc

SEQ ID NO: 428216 - RNA, 20 nt, Bordetella pertussis
gcgccguuuucagcgcaggc

SEQ ID NO: 428217 - RNA, 19 nt, Bordetella pertussis
gcgccuacacgguggcggu

SEQ ID NO: 428218 - RNA, 23 nt, Bordetella pertussis
gcgccuacaguuccaccugcaug

SEQ ID NO: 428219 - RNA, 17 nt, Bordetella pertussis
gcgccuauaucgacggc

SEQ ID NO: 428220 - RNA, 22 nt, Bordetella pertussis
gcgcgaaauccagcgcgcccga

SEQ ID NO: 428221 - RNA, 16 nt, Bordetella pertussis
gcgccuacggcggcgg

SEQ ID NO: 428222 - RNA, 17 nt, Bordetella pertussis
gcgcgaacauccgggug

SEQ ID NO: 428223 - RNA, 14 nt, Bordetella pertussis
gcgcgaacgcgcgc

SEQ ID NO: 428224 - RNA, 18 nt, Bordetella pertussis
gcgcgaacgcgcgccggc

SEQ ID NO: 428225 - RNA, 15 nt, Bordetella pertussis
gcgcgaacggcgggc

SEQ ID NO: 428226 - RNA, 17 nt, Bordetella pertussis
gcgcgaaccccuccggc

SEQ ID NO: 428227 - RNA, 13 nt, Bordetella pertussis
gcgcgaagcgccc

SEQ ID NO: 428228 - RNA, 17 nt, Bordetella pertussis
gcgcgaagcgcccuggc

SEQ ID NO: 428229 - RNA, 23 nt, Bordetella pertussis
gcgcgaagcggaaacgcgcgcgc

SEQ ID NO: 428230 - RNA, 16 nt, Bordetella pertussis
gcgcgaaggccgcccc

SEQ ID NO: 428231 - RNA, 18 nt, Bordetella pertussis
gcgcgaaggugcggauca

SEQ ID NO: 428232 - RNA, 23 nt, Bordetella pertussis
gcgcgaauuuuucuuccaguucg

SEQ ID NO: 428233 - RNA, 14 nt, Bordetella pertussis
gcgcgacagcaggc

SEQ ID NO: 428234 - RNA, 15 nt, Bordetella pertussis
gcgcgacagcaggcc

SEQ ID NO: 428235 - RNA, 23 nt, Bordetella pertussis
gcgcgaccgccuccagcgcggcg

SEQ ID NO: 428236 - RNA, 17 nt, Bordetella pertussis
gcgcgacgcgcucgucg

SEQ ID NO: 428237 - RNA, 12 nt, Bordetella pertussis
gcgcgacggcga

SEQ ID NO: 428238 - RNA, 16 nt, Bordetella pertussis
gcgcgacggcgccggc

SEQ ID NO: 428239 - RNA, 14 nt, Bordetella pertussis
gcgcgacggcggcc

SEQ ID NO: 428240 - RNA, 13 nt, Bordetella pertussis
gcgcgagccgccc

SEQ ID NO: 428241 - RNA, 16 nt, Bordetella pertussis
gcgcgagcgccgggcg

SEQ ID NO: 428242 - RNA, 13 nt, Bordetella pertussis
gcgcgagcggcgg

SEQ ID NO: 428243 - RNA, 16 nt, Bordetella pertussis
gcgcgagcugcgcggc

SEQ ID NO: 428244 - RNA, 15 nt, Bordetella pertussis
gcgcgaggcggcggc

SEQ ID NO: 428245 - RNA, 17 nt, Bordetella pertussis
gcgcgaggcggcggccg

SEQ ID NO: 428246 - RNA, 14 nt, Bordetella pertussis
gcgcgcaucgucag

SEQ ID NO: 428247 - RNA, 19 nt, Bordetella pertussis
gcgcgcaugcccgaccgca

SEQ ID NO: 428248 - RNA, 20 nt, Bordetella pertussis
gcgcgcaugcgcacgcgcgu

SEQ ID NO: 428249 - RNA, 13 nt, Bordetella pertussis
gcgcgcaucggcg

SEQ ID NO: 428250 - RNA, 20 nt, Bordetella pertussis
gcgcgccaaucagauggcgc

SEQ ID NO: 428251 - RNA, 17 nt, Bordetella pertussis
gcgcgccacauccugca

SEQ ID NO: 428252 - RNA, 19 nt, Bordetella pertussis
gcgcgccacggcgucgccg

SEQ ID NO: 428253 - RNA, 22 nt, Bordetella pertussis
gcgcgccacuauguggcguucg

SEQ ID NO: 428254 - RNA, 13 nt, Bordetella pertussis
gcgcgccagcaug

SEQ ID NO: 428255 - RNA, 16 nt, Bordetella pertussis
gcgcgccagccgcgcg

SEQ ID NO: 428256 - RNA, 17 nt, Bordetella pertussis
gcgcgccagccgcgcga

SEQ ID NO: 428257 - RNA, 12 nt, Bordetella pertussis
gcgcgccagcgc

SEQ ID NO: 428258 - RNA, 16 nt, Bordetella pertussis
gcgcgccagcgcggcc

SEQ ID NO: 428259 - RNA, 18 nt, Bordetella pertussis
gcgcgccagcgcggccag

SEQ ID NO: 428260 - RNA, 20 nt, Bordetella pertussis
gcgcgccagcgcggcgggcc

SEQ ID NO: 428261 - RNA, 13 nt, Bordetella pertussis
gcgcgccagcggc

SEQ ID NO: 428262 - RNA, 20 nt, Bordetella pertussis
gcgcgccaggaagcgcgccg

SEQ ID NO: 428263 - RNA, 12 nt, Bordetella pertussis
gcgcgccaggcc

SEQ ID NO: 428264 - RNA, 17 nt, Bordetella pertussis
gcgcgccaggcccaggg

SEQ ID NO: 428265 - RNA, 21 nt, Bordetella pertussis
gcgcgccaggcccagggccag

SEQ ID NO: 428266 - RNA, 15 nt, Bordetella pertussis
gcgcgccaggcuguc

SEQ ID NO: 428267 - RNA, 16 nt, Bordetella pertussis
gcgcgccaggucgcgc

SEQ ID NO: 428268 - RNA, 21 nt, Bordetella pertussis
gcgcgccaucgacgggcggcu

SEQ ID NO: 428269 - RNA, 22 nt, Bordetella pertussis
gcgcgccaucgacgggcggcug

SEQ ID NO: 428270 - RNA, 12 nt, Bordetella pertussis
gcgcgccgcagc

SEQ ID NO: 428271 - RNA, 13 nt, Bordetella pertussis
gcgcgccgcauca

SEQ ID NO: 428272 - RNA, 13 nt, Bordetella pertussis
gcgcgccgcccac

SEQ ID NO: 428273 - RNA, 12 nt, Bordetella pertussis
gcgcgccgccgu

SEQ ID NO: 428274 - RNA, 22 nt, Bordetella pertussis
gcgcgccgcgauggcgccggcc

SEQ ID NO: 428275 - RNA, 13 nt, Bordetella pertussis
gcgcgccgcggcg

SEQ ID NO: 428276 - RNA, 14 nt, Bordetella pertussis
gcgcgccgcgggcu

SEQ ID NO: 428277 - RNA, 15 nt, Bordetella pertussis
gcgcgccgcgggcug

SEQ ID NO: 428278 - RNA, 14 nt, Bordetella pertussis
gcgcgccgcgccgg

SEQ ID NO: 428279 - RNA, 15 nt, Bordetella pertussis
gcgcgccgcgcugcc

SEQ ID NO: 428280 - RNA, 20 nt, Bordetella pertussis
gcgcgccggccgacaggugg

SEQ ID NO: 428281 - RNA, 18 nt, Bordetella pertussis
gcgcgccggccgccagca

SEQ ID NO: 428282 - RNA, 13 nt, Bordetella pertussis
gcgcgccggcgcu

SEQ ID NO: 428283 - RNA, 20 nt, Bordetella pertussis
gcgcgccggcgcucgcgcac

SEQ ID NO: 428284 - RNA, 23 nt, Bordetella pertussis
gcgcgccggcggccugcaggccg

SEQ ID NO: 428285 - RNA, 14 nt, Bordetella pertussis
gcgcgccggccagg

SEQ ID NO: 428286 - RNA, 12 nt, Bordetella pertussis
gcgcgccggccg

SEQ ID NO: 428287 - RNA, 13 nt, Bordetella pertussis
gcgcgccgggcca

SEQ ID NO: 428288 - RNA, 15 nt, Bordetella pertussis
gcgcgcugcccagcc

SEQ ID NO: 428289 - RNA, 16 nt, Bordetella pertussis
gcgcgcugcccagcca

SEQ ID NO: 428290 - RNA, 17 nt, Bordetella pertussis
gcgcgcuggcgcccggc

SEQ ID NO: 428291 - RNA, 13 nt, Bordetella pertussis
gcgcgcuggcugu

SEQ ID NO: 428292 - RNA, 21 nt, Bordetella pertussis
gcgcgcuggcugugcccgccc

SEQ ID NO: 428293 - RNA, 21 nt, Bordetella pertussis
gcgcgcuucaggcgccgcaga

SEQ ID NO: 428294 - RNA, 17 nt, Bordetella pertussis
gcgcgcuucgagccggu

SEQ ID NO: 428295 - RNA, 16 nt, Bordetella pertussis
gcgcgcuugagcggcu

SEQ ID NO: 428296 - RNA, 20 nt, Bordetella pertussis
gcgcggaacagccuggucag

SEQ ID NO: 428297 - RNA, 24 nt, Bordetella pertussis
gcgcggaccugcucgagcggcgga

SEQ ID NO: 428298 - RNA, 24 nt, Bordetella pertussis
gcgcggauugaugucgcgcaccgc

SEQ ID NO: 428299 - RNA, 15 nt, Bordetella pertussis
gcgcggcacgcugcu

SEQ ID NO: 428300 - RNA, 14 nt, Bordetella pertussis
gcgcggcagccugg

SEQ ID NO: 428301 - RNA, 14 nt, Bordetella pertussis
gcgcggcagguucu

SEQ ID NO: 428302 - RNA, 16 nt, Bordetella pertussis
gcgcggcagugggcgg

SEQ ID NO: 428303 - RNA, 20 nt, Bordetella pertussis
gcgcggcauagcccaggccg

SEQ ID NO: 428304 - RNA, 17 nt, Bordetella pertussis
gcgcggcauggcgccgc

SEQ ID NO: 428305 - RNA, 19 nt, Bordetella pertussis
gcgcggcaucggccauggc

SEQ ID NO: 428306 - RNA, 22 nt, Bordetella pertussis
gcgcggcaucggccauggcggu

SEQ ID NO: 428307 - RNA, 14 nt, Bordetella pertussis
gcgcggccaacccc

SEQ ID NO: 428308 - RNA, 17 nt, Bordetella pertussis
gcgcggccaaccccgag

SEQ ID NO: 428309 - RNA, 16 nt, Bordetella pertussis
gcgcggccacccugcc

SEQ ID NO: 428310 - RNA, 16 nt, Bordetella pertussis
gcgcggccacggccug

SEQ ID NO: 428311 - RNA, 14 nt, Bordetella pertussis
gcgcggccagcacc

SEQ ID NO: 428312 - RNA, 18 nt, Bordetella pertussis
gcgcggccagcaccggcc

SEQ ID NO: 428313 - RNA, 18 nt, Bordetella pertussis
gcgcggccagcgccggcg

SEQ ID NO: 428314 - RNA, 13 nt, Bordetella pertussis
gcgcggccaggcg

SEQ ID NO: 428315 - RNA, 16 nt, Bordetella pertussis
gcgcggcgacaccccc

SEQ ID NO: 428316 - RNA, 21 nt, Bordetella pertussis
gcgcggcgagcacggccugcu

SEQ ID NO: 428317 - RNA, 16 nt, Bordetella pertussis
gcgcggcgagccgcgc

SEQ ID NO: 428318 - RNA, 14 nt, Bordetella pertussis
gcgcggcgcaggcc

SEQ ID NO: 428319 - RNA, 15 nt, Bordetella pertussis
gcgcggcgcaggccu

SEQ ID NO: 428320 - RNA, 16 nt, Bordetella pertussis
gcgcggcgcaggccug

SEQ ID NO: 428321 - RNA, 17 nt, Bordetella pertussis
gcgcggcgcaggccugc

SEQ ID NO: 428322 - RNA, 13 nt, Bordetella pertussis
gcgcggcgcaggc

SEQ ID NO: 428323 - RNA, 18 nt, Bordetella pertussis
gcgcggcgccagcgcccc

SEQ ID NO: 428324 - RNA, 21 nt, Bordetella pertussis
gcgcggcgccaugccgcgccc

SEQ ID NO: 428325 - RNA, 15 nt, Bordetella pertussis
gcgcggcgcccgccu

SEQ ID NO: 428326 - RNA, 16 nt, Bordetella pertussis
gcgcggcgcccgccug

SEQ ID NO: 428327 - RNA, 13 nt, Bordetella pertussis
gcgcggcgccggc

SEQ ID NO: 428328 - RNA, 18 nt, Bordetella pertussis
gcgcggcgccguccagcg

SEQ ID NO: 428329 - RNA, 12 nt, Bordetella pertussis
gcgcggcgccug

SEQ ID NO: 428330 - RNA, 13 nt, Bordetella pertussis
gcgcggcgcgccg

SEQ ID NO: 428331 - RNA, 13 nt, Bordetella pertussis
gcgcggcgcgcgc

SEQ ID NO: 428332 - RNA, 14 nt, Bordetella pertussis
gcgcggcgcgcgcc

SEQ ID NO: 428333 - RNA, 15 nt, Bordetella pertussis
gcgcggcgcgcgcca

SEQ ID NO: 428334 - RNA, 15 nt, Bordetella pertussis
gcgcggcgcgcgccg

SEQ ID NO: 428335 - RNA, 14 nt, Bordetella pertussis
gcgcggcgcggcug

SEQ ID NO: 428336 - RNA, 15 nt, Bordetella pertussis
gcgcggcgcggcugg

SEQ ID NO: 428337 - RNA, 17 nt, Bordetella pertussis
gcgcggcgcggcuggcg

SEQ ID NO: 428338 - RNA, 16 nt, Bordetella pertussis
gcgcggcgcuggcgcc

SEQ ID NO: 428339 - RNA, 23 nt, Bordetella pertussis
gcgcggcgcuggcgccgcgcgcc

SEQ ID NO: 428340 - RNA, 13 nt, Bordetella pertussis
gcgcggcggacug

SEQ ID NO: 428341 - RNA, 14 nt, Bordetella pertussis
gcgcgggagcccgc

SEQ ID NO: 428342 - RNA, 14 nt, Bordetella pertussis
gcgcgggccgccgc

SEQ ID NO: 428343 - RNA, 21 nt, Bordetella pertussis
gcgcgggcgauuugccgcagc

SEQ ID NO: 428344 - RNA, 12 nt, Bordetella pertussis
gcgcgggcgcca

SEQ ID NO: 428345 - RNA, 21 nt, Bordetella pertussis
gcgcgggcgcgccgucgcugg

SEQ ID NO: 428346 - RNA, 14 nt, Bordetella pertussis
gcgcgggcgcggca

SEQ ID NO: 428347 - RNA, 15 nt, Bordetella pertussis
gcgcgggcgcgggcu

SEQ ID NO: 428348 - RNA, 16 nt, Bordetella pertussis
gcgcgggcgcgggcug

SEQ ID NO: 428349 - RNA, 14 nt, Bordetella pertussis
gcgcgggcggcccg

SEQ ID NO: 428350 - RNA, 19 nt, Bordetella pertussis
gcgcgggcggcuaggcgca

SEQ ID NO: 428351 - RNA, 20 nt, Bordetella pertussis
gcgcgggcggucggcgcggc

SEQ ID NO: 428352 - RNA, 15 nt, Bordetella pertussis
gcgcgggcugucgca

SEQ ID NO: 428353 - RNA, 13 nt, Bordetella pertussis
gcgcggggcaccg

SEQ ID NO: 428354 - RNA, 17 nt, Bordetella pertussis
gcgcggggccaggcgca

SEQ ID NO: 428355 - RNA, 19 nt, Bordetella pertussis
gcgcggggccaggcgcagu

SEQ ID NO: 428356 - RNA, 15 nt, Bordetella pertussis
gcgcguccuggcgcg

SEQ ID NO: 428357 - RNA, 17 nt, Bordetella pertussis
gcgcgucgagcaggccg

SEQ ID NO: 428358 - RNA, 19 nt, Bordetella pertussis
gcgcguccuuggcggccuu

SEQ ID NO: 428359 - RNA, 17 nt, Bordetella pertussis
gcgcgucgccgcuggcc

SEQ ID NO: 428360 - RNA, 14 nt, Bordetella pertussis
gcgcgucgcgcggc

SEQ ID NO: 428361 - RNA, 20 nt, Bordetella pertussis
gcgcgucgcguagcgcggcc

SEQ ID NO: 428362 - RNA, 16 nt, Bordetella pertussis
gcgcgucggccaggcg

SEQ ID NO: 428363 - RNA, 15 nt, Bordetella pertussis
gcgcgucuccagcgc

SEQ ID NO: 428364 - RNA, 16 nt, Bordetella pertussis
gcgcgucuccagcgcc

SEQ ID NO: 428365 - RNA, 19 nt, Bordetella pertussis
gcgcgucggcgcggucggc

SEQ ID NO: 428366 - RNA, 12 nt, Bordetella pertussis
gcgcgugcaggg

SEQ ID NO: 428367 - RNA, 14 nt, Bordetella pertussis
gcgcgugccagcag

SEQ ID NO: 428368 - RNA, 15 nt, Bordetella pertussis
gcgcgugccagcagg

SEQ ID NO: 428369 - RNA, 15 nt, Bordetella pertussis
gcgcgugccgcaggc

SEQ ID NO: 428370 - RNA, 14 nt, Bordetella pertussis
gcgcgugcgcgcgc

SEQ ID NO: 428371 - RNA, 15 nt, Bordetella pertussis
gcgcgugcgcgcgcc

SEQ ID NO: 428372 - RNA, 14 nt, Bordetella pertussis
gcgcgugcugacgg

SEQ ID NO: 428373 - RNA, 20 nt, Bordetella pertussis
gcgcgugcuggcgcagcagc

SEQ ID NO: 428374 - RNA, 15 nt, Bordetella pertussis
gcgcguggccagcac

SEQ ID NO: 428375 - RNA, 17 nt, Bordetella pertussis
gcgcguggcccgcgccg

SEQ ID NO: 428376 - RNA, 14 nt, Bordetella pertussis
gcgcguggccggcg

SEQ ID NO: 428377 - RNA, 22 nt, Bordetella pertussis
gcgcgugggccaguccgcagcg

SEQ ID NO: 428378 - RNA, 19 nt, Bordetella pertussis
gcgcgugugguuggcgcug

SEQ ID NO: 428379 - RNA, 14 nt, Bordetella pertussis
gcgcguucagcagc

SEQ ID NO: 428380 - RNA, 16 nt, Bordetella pertussis
gcgcguuccggccgcg

SEQ ID NO: 428381 - RNA, 16 nt, Bordetella pertussis
gcgcguucgccgcagc

SEQ ID NO: 428382 - RNA, 17 nt, Bordetella pertussis
gcgcguucgccgcagcc

SEQ ID NO: 428383 - RNA, 21 nt, Bordetella pertussis
gcgcguucucagccgcccgcc

SEQ ID NO: 428384 - RNA, 15 nt, Bordetella pertussis
gcgcuacagggugcc

SEQ ID NO: 428385 - RNA, 15 nt, Bordetella pertussis
gcgcuaugggggcga

SEQ ID NO: 428386 - RNA, 16 nt, Bordetella pertussis
gcgcuaugggggcgag

SEQ ID NO: 428387 - RNA, 17 nt, Bordetella pertussis
gcgcucaagggccuguc

SEQ ID NO: 428388 - RNA, 19 nt, Bordetella pertussis
gcgcucagcgacgcgcgcc

SEQ ID NO: 428389 - RNA, 20 nt, Bordetella pertussis
gcgcucagcgacgcgcgccg

SEQ ID NO: 428390 - RNA, 22 nt, Bordetella pertussis
gcgcucagcgacgcgcgccggc

SEQ ID NO: 428391 - RNA, 15 nt, Bordetella pertussis
gcgcucagcgcgccg

SEQ ID NO: 428392 - RNA, 19 nt, Bordetella pertussis
gcgcucaggaaccagcggc

SEQ ID NO: 428393 - RNA, 23 nt, Bordetella pertussis
gcgcucaggaaccagcggcuggc

SEQ ID NO: 428394 - RNA, 17 nt, Bordetella pertussis
gcgcucaggccgccggc

SEQ ID NO: 428395 - RNA, 18 nt, Bordetella pertussis
gcgcucaggccgcugggc

SEQ ID NO: 428396 - RNA, 17 nt, Bordetella pertussis
gcgcucagggggcgccc

SEQ ID NO: 428397 - RNA, 13 nt, Bordetella pertussis
gcgcucaucaucg

SEQ ID NO: 428398 - RNA, 13 nt, Bordetella pertussis
gcgcuccagcaug

SEQ ID NO: 428399 - RNA, 19 nt, Bordetella pertussis
gcgcuccagcgucauggcc

SEQ ID NO: 428400 - RNA, 23 nt, Bordetella pertussis
gcgcuccagcgucauggccuggc

SEQ ID NO: 428401 - RNA, 19 nt, Bordetella pertussis
gcgcuccaugggcguggug

SEQ ID NO: 428402 - RNA, 19 nt, Bordetella pertussis
gcgcucccgccaacacgau

SEQ ID NO: 428403 - RNA, 16 nt, Bordetella pertussis
gcgcuccggcugcgcg

SEQ ID NO: 428404 - RNA, 19 nt, Bordetella pertussis
gcgcuccggcugcgcgcgc

SEQ ID NO: 428405 - RNA, 20 nt, Bordetella pertussis
gcgcucgaaaaagcccugcg

SEQ ID NO: 428406 - RNA, 22 nt, Bordetella pertussis
gcgcucgaaaaagcccugcgug

SEQ ID NO: 428407 - RNA, 21 nt, Bordetella pertussis
gcgcucgaaggcgccgacggc

SEQ ID NO: 428408 - RNA, 22 nt, Bordetella pertussis
gcgcucgaauggcugcgcgccg

SEQ ID NO: 428409 - RNA, 14 nt, Bordetella pertussis
gcgcucggccagcg

SEQ ID NO: 428410 - RNA, 23 nt, Bordetella pertussis
gcgcucggccagcgcgcggccgg

SEQ ID NO: 428411 - RNA, 16 nt, Bordetella pertussis
gcgcucggccucgguc

SEQ ID NO: 428412 - RNA, 14 nt, Bordetella pertussis
gcgcucggccuugc

SEQ ID NO: 428413 - RNA, 13 nt, Bordetella pertussis
gcgcucgggcgcg

SEQ ID NO: 428414 - RNA, 14 nt, Bordetella pertussis
gcgcucgggcgcgg

SEQ ID NO: 428415 - RNA, 21 nt, Bordetella pertussis
gcgcucggucauguccagcgc

SEQ ID NO: 428416 - RNA, 17 nt, Bordetella pertussis
gcgcucgguguggaugg

SEQ ID NO: 428417 - RNA, 18 nt, Bordetella pertussis
gcgcucguccaugccggc

SEQ ID NO: 428418 - RNA, 16 nt, Bordetella pertussis
gcgcugaugcgcggcg

SEQ ID NO: 428419 - RNA, 11 nt, Bordetella pertussis
gcgcugauucg

SEQ ID NO: 428420 - RNA, 19 nt, Bordetella pertussis
gcgcugcaauugcgcggcc

SEQ ID NO: 428421 - RNA, 22 nt, Bordetella pertussis
gcgcugcagcaauccaucguga

SEQ ID NO: 428422 - RNA, 19 nt, Bordetella pertussis
gcgcugcagcgucugcugg

SEQ ID NO: 428423 - RNA, 19 nt, Bordetella pertussis
gcgcugcaggaucgcggcc

SEQ ID NO: 428424 - RNA, 15 nt, Bordetella pertussis
gcgcugcccaccgcc

SEQ ID NO: 428425 - RNA, 23 nt, Bordetella pertussis
gcgcugcccaccgccguggccgg

SEQ ID NO: 428426 - RNA, 13 nt, Bordetella pertussis
gcgcugcccagcc

SEQ ID NO: 428427 - RNA, 16 nt, Bordetella pertussis
gcgcugccgcugcagg

SEQ ID NO: 428428 - RNA, 22 nt, Bordetella pertussis
gcgcugccugaaaccgcaggca

SEQ ID NO: 428429 - RNA, 24 nt, Bordetella pertussis
gcgcugccugaaaccgcaggcaag

SEQ ID NO: 428430 - RNA, 15 nt, Bordetella pertussis
gcgcugccugccggc

SEQ ID NO: 428431 - RNA, 19 nt, Bordetella pertussis
gcgcugccugccggccggc

SEQ ID NO: 428432 - RNA, 16 nt, Bordetella pertussis
gcgcugcgacagcagc

SEQ ID NO: 428433 - RNA, 16 nt, Bordetella pertussis
gcgcugcgagccgccg

SEQ ID NO: 428434 - RNA, 13 nt, Bordetella pertussis
gcgcugcgccaac

SEQ ID NO: 428435 - RNA, 14 nt, Bordetella pertussis
gcgcugcgccgcgg

SEQ ID NO: 428436 - RNA, 16 nt, Bordetella pertussis
gcgcugcgccggcggc

SEQ ID NO: 428437 - RNA, 14 nt, Bordetella pertussis
gcgcugcgcgccgc

SEQ ID NO: 428438 - RNA, 15 nt, Bordetella pertussis
gcgcugcgcggucug

SEQ ID NO: 428439 - RNA, 18 nt, Bordetella pertussis
gcgcugggcgccagcagc

SEQ ID NO: 428440 - RNA, 15 nt, Bordetella pertussis
gcgcugggcgcugcu

SEQ ID NO: 428441 - RNA, 18 nt, Bordetella pertussis
gcgcugggcguggcgcgc

SEQ ID NO: 428442 - RNA, 23 nt, Bordetella pertussis
gcgcugggcguggcgcgcgugcu

SEQ ID NO: 428443 - RNA, 21 nt, Bordetella pertussis
gcgcuggggcaggacgccggc

SEQ ID NO: 428444 - RNA, 22 nt, Bordetella pertussis
gcgcuggguguagucgcggccg

SEQ ID NO: 428445 - RNA, 17 nt, Bordetella pertussis
gcgcugguaguaggcca

SEQ ID NO: 428446 - RNA, 21 nt, Bordetella pertussis
gcgcugguaaagggcgcggau

SEQ ID NO: 428447 - RNA, 17 nt, Bordetella pertussis
gcgcuggucgcgcagca

SEQ ID NO: 428448 - RNA, 22 nt, Bordetella pertussis
gcgcuggucgggaugccccgcc

SEQ ID NO: 428449 - RNA, 16 nt, Bordetella pertussis
gcgcuggugcuggccg

SEQ ID NO: 428450 - RNA, 17 nt, Bordetella pertussis
gcgcuguaggcgccggc

SEQ ID NO: 428451 - RNA, 22 nt, Bordetella pertussis
gcgcuguccgaugcgcugcugg

SEQ ID NO: 428452 - RNA, 23 nt, Bordetella pertussis
gcgcuguucgauacggccacgca

SEQ ID NO: 428453 - RNA, 17 nt, Bordetella pertussis
gcgcuguucgggcgcgg

SEQ ID NO: 428454 - RNA, 18 nt, Bordetella pertussis
gcgcuguucgggcgcggu

SEQ ID NO: 428455 - RNA, 16 nt, Bordetella pertussis
gcgcuguuggccggcg

SEQ ID NO: 428456 - RNA, 21 nt, Bordetella pertussis
gcgcuguuggccggcgcgccc

SEQ ID NO: 428457 - RNA, 17 nt, Bordetella pertussis
gcgcuguuuccgggccu

SEQ ID NO: 428458 - RNA, 20 nt, Bordetella pertussis
gcgcuguuuccgggccuggc

SEQ ID NO: 428459 - RNA, 22 nt, Bordetella pertussis
gcgcuguuuccgggccuggccu

SEQ ID NO: 428460 - RNA, 23 nt, Bordetella pertussis
gcgcuguuuccgggccuggccug

SEQ ID NO: 428461 - RNA, 17 nt, Bordetella pertussis
gcggcagaaggcgacau

SEQ ID NO: 428462 - RNA, 13 nt, Bordetella pertussis
gcggcagcagcag

SEQ ID NO: 428463 - RNA, 12 nt, Bordetella pertussis
gcggcagcaggg

SEQ ID NO: 428464 - RNA, 16 nt, Bordetella pertussis
gcggcagcagggccac

SEQ ID NO: 428465 - RNA, 13 nt, Bordetella pertussis
gcggcagccaggu

SEQ ID NO: 428466 - RNA, 15 nt, Bordetella pertussis
gcggcagcgcaccgu

SEQ ID NO: 428467 - RNA, 17 nt, Bordetella pertussis
gcggcagcgcgaacggc

SEQ ID NO: 428468 - RNA, 13 nt, Bordetella pertussis
gcggcagcggccc

SEQ ID NO: 428469 - RNA, 19 nt, Bordetella pertussis
gcggcaggccccggcccgg

SEQ ID NO: 428470 - RNA, 23 nt, Bordetella pertussis
gcggcaggccgcagcgggcccgu

SEQ ID NO: 428471 - RNA, 20 nt, Bordetella pertussis
gcggcaggccgcgccacagg

SEQ ID NO: 428472 - RNA, 15 nt, Bordetella pertussis
gcggcaggcgccgcc

SEQ ID NO: 428473 - RNA, 17 nt, Bordetella pertussis
gcggcaggcgccgccgc

SEQ ID NO: 428474 - RNA, 13 nt, Bordetella pertussis
gcggcaggcgcga

SEQ ID NO: 428475 - RNA, 15 nt, Bordetella pertussis
gcggcaggcggcaga

SEQ ID NO: 428476 - RNA, 15 nt, Bordetella pertussis
gcggcaggucgcgcg

SEQ ID NO: 428477 - RNA, 19 nt, Bordetella pertussis
gcggcaggugcgccagcac

SEQ ID NO: 428478 - RNA, 23 nt, Bordetella pertussis
gcggcaggugcgccagcacggca

SEQ ID NO: 428479 - RNA, 19 nt, Bordetella pertussis
gcggcagguucugcgcguc

SEQ ID NO: 428480 - RNA, 23 nt, Bordetella pertussis
gcggcagguugaaguugcucggc

SEQ ID NO: 428481 - RNA, 14 nt, Bordetella pertussis
gcggcagugggcgg

SEQ ID NO: 428482 - RNA, 16 nt, Bordetella pertussis
gcggcauagcccaggc

SEQ ID NO: 428483 - RNA, 23 nt, Bordetella pertussis
gcggcaucgagaaaccagccgcc

SEQ ID NO: 428484 - RNA, 18 nt, Bordetella pertussis
gcggcaucggccauggcg

SEQ ID NO: 428485 - RNA, 22 nt, Bordetella pertussis
gcggcaucguaguugggcgccu

SEQ ID NO: 428486 - RNA, 24 nt, Bordetella pertussis
gcggcaucguucaggcgcauggug

SEQ ID NO: 428487 - RNA, 17 nt, Bordetella pertussis
gcggcaucucgcggcgg

SEQ ID NO: 428488 - RNA, 20 nt, Bordetella pertussis
gcggcaucuugccuuggcga

SEQ ID NO: 428489 - RNA, 18 nt, Bordetella pertussis
gcggcaugcugguugggc

SEQ ID NO: 428490 - RNA, 14 nt, Bordetella pertussis
gcggccaaccccga

SEQ ID NO: 428491 - RNA, 18 nt, Bordetella pertussis
gcggccaaccccgagggc

SEQ ID NO: 428492 - RNA, 14 nt, Bordetella pertussis
gcggccacaacccu

SEQ ID NO: 428493 - RNA, 16 nt, Bordetella pertussis
gcggccacccugccgu

SEQ ID NO: 428494 - RNA, 16 nt, Bordetella pertussis
gcggccacgcgccgcc

SEQ ID NO: 428495 - RNA, 23 nt, Bordetella pertussis
gcggccagaccuugcgcgacggc

SEQ ID NO: 428496 - RNA, 15 nt, Bordetella pertussis
gcggccacggccugc

SEQ ID NO: 428497 - RNA, 17 nt, Bordetella pertussis
gcggccagaucggacgg

SEQ ID NO: 428498 - RNA, 12 nt, Bordetella pertussis
gcggccagcagc

SEQ ID NO: 428499 - RNA, 22 nt, Bordetella pertussis
gcggccagcaagcgcgccauga

SEQ ID NO: 428500 - RNA, 14 nt, Bordetella pertussis
gcggccagcagcgg

SEQ ID NO: 428501 - RNA, 12 nt, Bordetella pertussis
gcggccagcaug

SEQ ID NO: 428502 - RNA, 15 nt, Bordetella pertussis
gcggccagccgggug

SEQ ID NO: 428503 - RNA, 20 nt, Bordetella pertussis
gcggccagcgccgcgccgga

SEQ ID NO: 428504 - RNA, 15 nt, Bordetella pertussis
gcggccagcgcggug

SEQ ID NO: 428505 - RNA, 13 nt, Bordetella pertussis
gcggccagcggca

SEQ ID NO: 428506 - RNA, 18 nt, Bordetella pertussis
gcggccagcggcaggggc

SEQ ID NO: 428507 - RNA, 14 nt, Bordetella pertussis
gcggccagcggcgc

SEQ ID NO: 428508 - RNA, 22 nt, Bordetella pertussis
gcggccagcuugaccgccagca

SEQ ID NO: 428509 - RNA, 22 nt, Bordetella pertussis
gcggccaggccggcgcgccggc

SEQ ID NO: 428510 - RNA, 23 nt, Bordetella pertussis
gcggccaggccggcgcgccggcc

SEQ ID NO: 428511 - RNA, 20 nt, Bordetella pertussis
gcggccaggcgcgccgcgau

SEQ ID NO: 428512 - RNA, 14 nt, Bordetella pertussis
gcggccaggcucug

SEQ ID NO: 428513 - RNA, 20 nt, Bordetella pertussis
gcggccagggaaggggcggc

SEQ ID NO: 428514 - RNA, 13 nt, Bordetella pertussis
gcggccagggcaa

SEQ ID NO: 428515 - RNA, 17 nt, Bordetella pertussis
gcggccagggcugcggc

SEQ ID NO: 428516 - RNA, 24 nt, Bordetella pertussis
gcggccaucuuggugcgcgccagg

SEQ ID NO: 428517 - RNA, 18 nt, Bordetella pertussis
gcggccaugauacccaug

SEQ ID NO: 428518 - RNA, 21 nt, Bordetella pertussis
gcggccaugcccaggcccagu

SEQ ID NO: 428519 - RNA, 18 nt, Bordetella pertussis
gcggcccacagcgccccc

SEQ ID NO: 428520 - RNA, 22 nt, Bordetella pertussis
gcggcccacagcgcccccagca

SEQ ID NO: 428521 - RNA, 14 nt, Bordetella pertussis
gcggcccacccggc

SEQ ID NO: 428522 - RNA, 23 nt, Bordetella pertussis
gcggcccacccggcacgcgccga

SEQ ID NO: 428523 - RNA, 13 nt, Bordetella pertussis
gcggcccacggcc

SEQ ID NO: 428524 - RNA, 22 nt, Bordetella pertussis
gcggcccagcgcggcggccaug

SEQ ID NO: 428525 - RNA, 18 nt, Bordetella pertussis
gcggcccaggcguccagg

SEQ ID NO: 428526 - RNA, 19 nt, Bordetella pertussis
gcggcccauucgcgcaccg

SEQ ID NO: 428527 - RNA, 15 nt, Bordetella pertussis
gcggccccagucgcu

SEQ ID NO: 428528 - RNA, 18 nt, Bordetella pertussis
gcggccccagucgcugcu

SEQ ID NO: 428529 - RNA, 21 nt, Bordetella pertussis
gcggccccagucgcugcucga

SEQ ID NO: 428530 - RNA, 16 nt, Bordetella pertussis
gcggccccggccgccc

SEQ ID NO: 428531 - RNA, 16 nt, Bordetella pertussis
gcggcccgccagggcg

SEQ ID NO: 428532 - RNA, 15 nt, Bordetella pertussis
gcggcccgcggccuu

SEQ ID NO: 428533 - RNA, 17 nt, Bordetella pertussis
gcggcccguagcuggac

SEQ ID NO: 428534 - RNA, 21 nt, Bordetella pertussis
gcggcccuggucgucgcggcc

SEQ ID NO: 428535 - RNA, 20 nt, Bordetella pertussis
gcggcccuguucgcgcggcc

SEQ ID NO: 428536 - RNA, 20 nt, Bordetella pertussis
gcggcccuugcgcgaaggcc

SEQ ID NO: 428537 - RNA, 22 nt, Bordetella pertussis
gcggcccuugcgcgaaggccgc

SEQ ID NO: 428538 - RNA, 16 nt, Bordetella pertussis
gcggccgaagcgcaag

SEQ ID NO: 428539 - RNA, 18 nt, Bordetella pertussis
gcggccgaccagcacgau

SEQ ID NO: 428540 - RNA, 18 nt, Bordetella pertussis
gcggccgacgggcggcug

SEQ ID NO: 428541 - RNA, 21 nt, Bordetella pertussis
gcggccgacgggcggcugcug

SEQ ID NO: 428542 - RNA, 18 nt, Bordetella pertussis
gcggccgaggucggcggu

SEQ ID NO: 428543 - RNA, 22 nt, Bordetella pertussis
gcggccgauguuuuccugggau

SEQ ID NO: 428544 - RNA, 12 nt, Bordetella pertussis
gcggccgcagcg

SEQ ID NO: 428545 - RNA, 13 nt, Bordetella pertussis
gcggccgccgccc

SEQ ID NO: 428546 - RNA, 16 nt, Bordetella pertussis
gcggccgccgcccgcc

SEQ ID NO: 428547 - RNA, 17 nt, Bordetella pertussis
gcggccgccgcccgccu

SEQ ID NO: 428548 - RNA, 18 nt, Bordetella pertussis
gcggccgccgcccgccuc

SEQ ID NO: 428549 - RNA, 20 nt, Bordetella pertussis
gcggccgccggcggcgccgg

SEQ ID NO: 428550 - RNA, 22 nt, Bordetella pertussis
gcggccgcgcaccugcugcggc

SEQ ID NO: 428551 - RNA, 22 nt, Bordetella pertussis
gcggccgcgcgcuucaggcgcc

SEQ ID NO: 428552 - RNA, 16 nt, Bordetella pertussis
gcggccgcgcgggcgg

SEQ ID NO: 428553 - RNA, 13 nt, Bordetella pertussis
gcggccgcgggcg

SEQ ID NO: 428554 - RNA, 21 nt, Bordetella pertussis
gcggccgcguccagcgcgcgg

SEQ ID NO: 428555 - RNA, 19 nt, Bordetella pertussis
gcggccgcggaagucgggc

SEQ ID NO: 428556 - RNA, 23 nt, Bordetella pertussis
gcggccgcggaagucgggcacca

SEQ ID NO: 428557 - RNA, 17 nt, Bordetella pertussis
gcggccgcugccgcgcg

SEQ ID NO: 428558 - RNA, 14 nt, Bordetella pertussis
gcggccggacaggg

SEQ ID NO: 428559 - RNA, 23 nt, Bordetella pertussis
gcggccggacagggccgcgagca

SEQ ID NO: 428560 - RNA, 17 nt, Bordetella pertussis
gcggccggcacgcccag

SEQ ID NO: 428561 - RNA, 15 nt, Bordetella pertussis
gcggccggcaggccg

SEQ ID NO: 428562 - RNA, 13 nt, Bordetella pertussis
gcggccggccagc

SEQ ID NO: 428563 - RNA, 11 nt, Bordetella pertussis
gcggccggccc

SEQ ID NO: 428564 - RNA, 16 nt, Bordetella pertussis
gcggccggccgcgccc

SEQ ID NO: 428565 - RNA, 14 nt, Bordetella pertussis
gcggccggccgggu

SEQ ID NO: 428566 - RNA, 12 nt, Bordetella pertussis
gcggccggcgcu

SEQ ID NO: 428567 - RNA, 13 nt, Bordetella pertussis
gcggccggcgcug

SEQ ID NO: 428568 - RNA, 13 nt, Bordetella pertussis
gcggccggcggcg

SEQ ID NO: 428569 - RNA, 16 nt, Bordetella pertussis
gcggccggcggcgccg

SEQ ID NO: 428570 - RNA, 22 nt, Bordetella pertussis
gcggccggcuugcgcaagccgg

SEQ ID NO: 428571 - RNA, 16 nt, Bordetella pertussis
gcggccgggagccugu

SEQ ID NO: 428572 - RNA, 14 nt, Bordetella pertussis
gcggccgggcuauc

SEQ ID NO: 428573 - RNA, 17 nt, Bordetella pertussis
gcggccgggcuuccagu

SEQ ID NO: 428574 - RNA, 12 nt, Bordetella pertussis
gcggccggggcc

SEQ ID NO: 428575 - RNA, 16 nt, Bordetella pertussis
gcggccggggccgccc

SEQ ID NO: 428576 - RNA, 19 nt, Bordetella pertussis
gcggccggggccgcccugc

SEQ ID NO: 428577 - RNA, 18 nt, Bordetella pertussis
gcggccggcgcgccggcc

SEQ ID NO: 428578 - RNA, 16 nt, Bordetella pertussis
gcggccgggucggccu

SEQ ID NO: 428579 - RNA, 20 nt, Bordetella pertussis
gcggccgggucggccugcca

SEQ ID NO: 428580 - RNA, 16 nt, Bordetella pertussis
gcggccguccaaaaca

SEQ ID NO: 428581 - RNA, 16 nt, Bordetella pertussis
gcggccgucgccgccc

SEQ ID NO: 428582 - RNA, 17 nt, Bordetella pertussis
gcggccguggaggcggc

SEQ ID NO: 428583 - RNA, 14 nt, Bordetella pertussis
gcggccguggcggc

SEQ ID NO: 428584 - RNA, 20 nt, Bordetella pertussis
gcggccgucggcgcuggcgc

SEQ ID NO: 428585 - RNA, 13 nt, Bordetella pertussis
gcggccgucgggg

SEQ ID NO: 428586 - RNA, 21 nt, Bordetella pertussis
gcggccguugcuccagccagg

SEQ ID NO: 428587 - RNA, 18 nt, Bordetella pertussis
gcggccuaucaccugggc

SEQ ID NO: 428588 - RNA, 22 nt, Bordetella pertussis
gcggccuaugugcaggccaccg

SEQ ID NO: 428589 - RNA, 21 nt, Bordetella pertussis
gcggccuauuuggcggccugg

SEQ ID NO: 428590 - RNA, 15 nt, Bordetella pertussis
gcggccuccggcagg

SEQ ID NO: 428591 - RNA, 23 nt, Bordetella pertussis
gcggccucgacgauggccggggc

SEQ ID NO: 428592 - RNA, 20 nt, Bordetella pertussis
gcggccucggccagcuggga

SEQ ID NO: 428593 - RNA, 18 nt, Bordetella pertussis
gcggccucggcgggcggc

SEQ ID NO: 428594 - RNA, 22 nt, Bordetella pertussis
gcggccugcagaccagcaccgg

SEQ ID NO: 428595 - RNA, 14 nt, Bordetella pertussis
gcggccugcgccgg

SEQ ID NO: 428596 - RNA, 19 nt, Bordetella pertussis
gcggccugcuuggcagccu

SEQ ID NO: 428597 - RNA, 20 nt, Bordetella pertussis
gcggccugcuuggcagccuu

SEQ ID NO: 428598 - RNA, 16 nt, Bordetella pertussis
gcggccuggccgcgcg

SEQ ID NO: 428599 - RNA, 15 nt, Bordetella pertussis
gcggccuggccgggg

SEQ ID NO: 428600 - RNA, 14 nt, Bordetella pertussis
gcggccugggcggc

SEQ ID NO: 428601 - RNA, 15 nt, Bordetella pertussis
gcggccugggcggcg

SEQ ID NO: 428602 - RNA, 15 nt, Bordetella pertussis
gcggccuugcgggcc

SEQ ID NO: 428603 - RNA, 20 nt, Bordetella pertussis
gcggccuuggccgcagccgg

SEQ ID NO: 428604 - RNA, 22 nt, Bordetella pertussis
gcggccuuuuuuugcggcacgg

SEQ ID NO: 428605 - RNA, 18 nt, Bordetella pertussis
gcggcgaaggcgcggcug

SEQ ID NO: 428606 - RNA, 20 nt, Bordetella pertussis
gcggcgaaggcgcggcugcg

SEQ ID NO: 428607 - RNA, 23 nt, Bordetella pertussis
gcggcgacacccccagggcgcgc

SEQ ID NO: 428608 - RNA, 18 nt, Bordetella pertussis
gcggcgaccggcgccggc

SEQ ID NO: 428609 - RNA, 19 nt, Bordetella pertussis
gcggcgacgcagcacggcu

SEQ ID NO: 428610 - RNA, 16 nt, Bordetella pertussis
gcggcgacggcgccug

SEQ ID NO: 428611 - RNA, 17 nt, Bordetella pertussis
gcggcgacugccccagc

SEQ ID NO: 428612 - RNA, 14 nt, Bordetella pertussis
gcggcgagcacggc

SEQ ID NO: 428613 - RNA, 17 nt, Bordetella pertussis
gcggcgagcacggccug

SEQ ID NO: 428614 - RNA, 15 nt, Bordetella pertussis
gcggcgagccgcgcg

SEQ ID NO: 428615 - RNA, 15 nt, Bordetella pertussis
gcggcgagcgcggcg

SEQ ID NO: 428616 - RNA, 20 nt, Bordetella pertussis
gcggcgagcgcggcgcgcgc

SEQ ID NO: 428617 - RNA, 21 nt, Bordetella pertussis
gcggcgauaccaguagcgcga

SEQ ID NO: 428618 - RNA, 17 nt, Bordetella pertussis
gcggcgauacgcgccgc

SEQ ID NO: 428619 - RNA, 20 nt, Bordetella pertussis
gcggcgauacgcgccgccug

SEQ ID NO: 428620 - RNA, 22 nt, Bordetella pertussis
gcggcgaucucgcgcgcgcggu

SEQ ID NO: 428621 - RNA, 16 nt, Bordetella pertussis
gcggcgaugccgcugg

SEQ ID NO: 428622 - RNA, 21 nt, Bordetella pertussis
gcggcgaugccgcugucggug

SEQ ID NO: 428623 - RNA, 17 nt, Bordetella pertussis
gcggcgauguggcgcgc

SEQ ID NO: 428624 - RNA, 12 nt, Bordetella pertussis
gcggcgccuucg

SEQ ID NO: 428625 - RNA, 14 nt, Bordetella pertussis
gcggcgcgacgcgc

SEQ ID NO: 428626 - RNA, 15 nt, Bordetella pertussis
gcggcgcgagcgcac

SEQ ID NO: 428627 - RNA, 16 nt, Bordetella pertussis
gcggcgcgcacgggcg

SEQ ID NO: 428628 - RNA, 14 nt, Bordetella pertussis
gcggcgcgcccgcc

SEQ ID NO: 428629 - RNA, 15 nt, Bordetella pertussis
gcggcgcgccguccg

SEQ ID NO: 428630 - RNA, 14 nt, Bordetella pertussis
gcggcgcgcgcgcc

SEQ ID NO: 428631 - RNA, 15 nt, Bordetella pertussis
gcggcgcgcgcggcg

SEQ ID NO: 428632 - RNA, 18 nt, Bordetella pertussis
gcggcgcgcgcggcgccu

SEQ ID NO: 428633 - RNA, 14 nt, Bordetella pertussis
gcggcgcgcggcug

SEQ ID NO: 428634 - RNA, 13 nt, Bordetella pertussis
gcggcgcgcugga

SEQ ID NO: 428635 - RNA, 18 nt, Bordetella pertussis
gcggcgcgcuuggucagc

SEQ ID NO: 428636 - RNA, 20 nt, Bordetella pertussis
gcggcgcggccaaccccgag

SEQ ID NO: 428637 - RNA, 14 nt, Bordetella pertussis
gcggcgcggccagc

SEQ ID NO: 428638 - RNA, 15 nt, Bordetella pertussis
gcggcgcggcccgcc

SEQ ID NO: 428639 - RNA, 11 nt, Bordetella pertussis
gcggcgcggcg

SEQ ID NO: 428640 - RNA, 15 nt, Bordetella pertussis
gcggcgcggcgcagg

SEQ ID NO: 428641 - RNA, 14 nt, Bordetella pertussis
gcggcgcggcgcug

SEQ ID NO: 428642 - RNA, 17 nt, Bordetella pertussis
gcggcgcggcgcuggcg

SEQ ID NO: 428643 - RNA, 20 nt, Bordetella pertussis
gcggcgcguauccgccguug

SEQ ID NO: 428644 - RNA, 21 nt, Bordetella pertussis
gcggcgcguucagcagcaggc

SEQ ID NO: 428645 - RNA, 20 nt, Bordetella pertussis
gcggcgcguucagggcgccg

SEQ ID NO: 428646 - RNA, 19 nt, Bordetella pertussis
gcggcgcguucgccgcagc

SEQ ID NO: 428647 - RNA, 16 nt, Bordetella pertussis
gcggcgcucaucaucg

SEQ ID NO: 428648 - RNA, 22 nt, Bordetella pertussis
gcggcgcugcuggccggccagc

SEQ ID NO: 428649 - RNA, 14 nt, Bordetella pertussis
gcggcgcuggccug

SEQ ID NO: 428650 - RNA, 18 nt, Bordetella pertussis
gcggcgcuuaccgcgccg

SEQ ID NO: 428651 - RNA, 15 nt, Bordetella pertussis
gcggcggccugggcg

SEQ ID NO: 428652 - RNA, 21 nt, Bordetella pertussis
gcggcggccuugugcgccagc

SEQ ID NO: 428653 - RNA, 22 nt, Bordetella pertussis
gcggcggcgaugccgcuggcga

SEQ ID NO: 428654 - RNA, 22 nt, Bordetella pertussis
gcggcggcgcguucgccgcagc

SEQ ID NO: 428655 - RNA, 14 nt, Bordetella pertussis
gcggcggcgcuggc

SEQ ID NO: 428656 - RNA, 15 nt, Bordetella pertussis
gcggcggcgcuggcc

SEQ ID NO: 428657 - RNA, 17 nt, Bordetella pertussis
gcggcggcgcuggccug

SEQ ID NO: 428658 - RNA, 13 nt, Bordetella pertussis
gcggcggcggcca

SEQ ID NO: 428659 - RNA, 12 nt, Bordetella pertussis
gcggcggcgggc

SEQ ID NO: 428660 - RNA, 18 nt, Bordetella pertussis
gcggcggcgucgcgcugu

SEQ ID NO: 428661 - RNA, 19 nt, Bordetella pertussis
gcggcggcguuccugggca

SEQ ID NO: 428662 - RNA, 12 nt, Bordetella pertussis
gcggcgggcacg

SEQ ID NO: 428663 - RNA, 19 nt, Bordetella pertussis
gcggcgggccccgcagggc

SEQ ID NO: 428664 - RNA, 15 nt, Bordetella pertussis
gcggcugcccaccuu

SEQ ID NO: 428665 - RNA, 14 nt, Bordetella pertussis
gcggcugucgggcg

SEQ ID NO: 428666 - RNA, 18 nt, Bordetella pertussis
gcggcugucgggcggcgc

SEQ ID NO: 428667 - RNA, 15 nt, Bordetella pertussis
gcggcugcccucggu

SEQ ID NO: 428668 - RNA, 16 nt, Bordetella pertussis
gcggcuucaggcgcgc

SEQ ID NO: 428669 - RNA, 14 nt, Bordetella pertussis
gcggcuucggccgu

SEQ ID NO: 428670 - RNA, 19 nt, Bordetella pertussis
gcggcuucggccgucagca

SEQ ID NO: 428671 - RNA, 18 nt, Bordetella pertussis
gcggcuugcagcggacgg

SEQ ID NO: 428672 - RNA, 16 nt, Bordetella pertussis
gcggcuugccgcggcg

SEQ ID NO: 428673 - RNA, 22 nt, Bordetella pertussis
gcggcuugccgcggcgcggccu

SEQ ID NO: 428674 - RNA, 17 nt, Bordetella pertussis
gcgggcaccaugcgcga

SEQ ID NO: 428675 - RNA, 21 nt, Bordetella pertussis
gcgggcacucggccauggugc

SEQ ID NO: 428676 - RNA, 20 nt, Bordetella pertussis
gcgggcagcaccggggcagg

SEQ ID NO: 428677 - RNA, 19 nt, Bordetella pertussis
gcgggcagggcgggggacg

SEQ ID NO: 428678 - RNA, 19 nt, Bordetella pertussis
gcgggcaugacgaccgcga

SEQ ID NO: 428679 - RNA, 16 nt, Bordetella pertussis
gcgggccagcgcggcc

SEQ ID NO: 428680 - RNA, 17 nt, Bordetella pertussis
gcgggccccgcagggcc

SEQ ID NO: 428681 - RNA, 19 nt, Bordetella pertussis
gcgggccccgcagggcccg

SEQ ID NO: 428682 - RNA, 21 nt, Bordetella pertussis
gcgggccccgcagggcccgca

SEQ ID NO: 428683 - RNA, 17 nt, Bordetella pertussis
gcgggcccgacagcgcc

SEQ ID NO: 428684 - RNA, 14 nt, Bordetella pertussis
gcgggccugcagca

SEQ ID NO: 428685 - RNA, 16 nt, Bordetella pertussis
gcgggccugcaguucg

SEQ ID NO: 428686 - RNA, 18 nt, Bordetella pertussis
gcgggccuuggccagcag

SEQ ID NO: 428687 - RNA, 19 nt, Bordetella pertussis
gcgggccuuggccagcagc

SEQ ID NO: 428688 - RNA, 22 nt, Bordetella pertussis
gcgggccuuggccagcagcgca

SEQ ID NO: 428689 - RNA, 21 nt, Bordetella pertussis
gcgggcgaggacuacgcggug

SEQ ID NO: 428690 - RNA, 15 nt, Bordetella pertussis
gcgggcgauggccac

SEQ ID NO: 428691 - RNA, 19 nt, Bordetella pertussis
gcgggcgauguagggcagc

SEQ ID NO: 428692 - RNA, 20 nt, Bordetella pertussis
gcgggcgauuugccgcagcc

SEQ ID NO: 428693 - RNA, 19 nt, Bordetella pertussis
gcgggcgcaagccagcacg

SEQ ID NO: 428694 - RNA, 16 nt, Bordetella pertussis
gcgggcgcagcgccgc

SEQ ID NO: 428695 - RNA, 14 nt, Bordetella pertussis
gcgggcuggggcag

SEQ ID NO: 428696 - RNA, 15 nt, Bordetella pertussis
gcgggcuggucgcgc

SEQ ID NO: 428697 - RNA, 22 nt, Bordetella pertussis
gcgggcugucgcagucggggcc

SEQ ID NO: 428698 - RNA, 20 nt, Bordetella pertussis
gcgggcuugcugccccccga

SEQ ID NO: 428699 - RNA, 21 nt, Bordetella pertussis
gcgggcuugcugccccccgag

SEQ ID NO: 428700 - RNA, 18 nt, Bordetella pertussis
gcgggcuugucgcugcgc

SEQ ID NO: 428701 - RNA, 16 nt, Bordetella pertussis
gcggggacaggcacac

SEQ ID NO: 428702 - RNA, 18 nt, Bordetella pertussis
gcggggacaggcacacca

SEQ ID NO: 428703 - RNA, 23 nt, Bordetella pertussis
gcggggacaggcacacucugucg

SEQ ID NO: 428704 - RNA, 20 nt, Bordetella pertussis
gcggggacaggcacccccga

SEQ ID NO: 428705 - RNA, 19 nt, Bordetella pertussis
gcggggacaggcacccugu

SEQ ID NO: 428706 - RNA, 16 nt, Bordetella pertussis
gcggggacaggcaccg

SEQ ID NO: 428707 - RNA, 17 nt, Bordetella pertussis
gcggggacaggcgccuc

SEQ ID NO: 428708 - RNA, 14 nt, Bordetella pertussis
gcggggacaggcuc

SEQ ID NO: 428709 - RNA, 21 nt, Bordetella pertussis
gcggggacuggcaccaggauu

SEQ ID NO: 428710 - RNA, 22 nt, Bordetella pertussis
gcggggacuggcaccaggauuc

SEQ ID NO: 428711 - RNA, 13 nt, Bordetella pertussis
gcggggccacaug

SEQ ID NO: 428712 - RNA, 15 nt, Bordetella pertussis
gcggggccaggcgca

SEQ ID NO: 428713 - RNA, 14 nt, Bordetella pertussis
gcggggcgcccagc

SEQ ID NO: 428714 - RNA, 15 nt, Bordetella pertussis
gcggggcgcccagcg

SEQ ID NO: 428715 - RNA, 19 nt, Bordetella pertussis
gcggggcgcccagcgcguc

SEQ ID NO: 428716 - RNA, 19 nt, Bordetella pertussis
gcggggcggcaggucgcgc

SEQ ID NO: 428717 - RNA, 22 nt, Bordetella pertussis
gcggggcgcguuuucgcuggcg

SEQ ID NO: 428718 - RNA, 13 nt, Bordetella pertussis
gcggggcggcggg

SEQ ID NO: 428719 - RNA, 17 nt, Bordetella pertussis
gcggggcuggccagcug

SEQ ID NO: 428720 - RNA, 13 nt, Bordetella pertussis
gcggguccagcag

SEQ ID NO: 428721 - RNA, 14 nt, Bordetella pertussis
gcggguccagcagg

SEQ ID NO: 428722 - RNA, 15 nt, Bordetella pertussis
gcggguccagcagga

SEQ ID NO: 428723 - RNA, 18 nt, Bordetella pertussis
gcggguccagcaggaugg

SEQ ID NO: 428724 - RNA, 22 nt, Bordetella pertussis
gcgggucgaguugcgcgccaug

SEQ ID NO: 428725 - RNA, 21 nt, Bordetella pertussis
gcgggucggcgccaugaccac

SEQ ID NO: 428726 - RNA, 17 nt, Bordetella pertussis
gcgggugggcgcgccgc

SEQ ID NO: 428727 - RNA, 19 nt, Bordetella pertussis
gcgggugggcgcgccgcga

SEQ ID NO: 428728 - RNA, 19 nt, Bordetella pertussis
gcgggugucgcuccucccc

SEQ ID NO: 428729 - RNA, 21 nt, Bordetella pertussis
gcggguucgacgccggcagcg

SEQ ID NO: 428730 - RNA, 14 nt, Bordetella pertussis
gcggguucgcccgg

SEQ ID NO: 428731 - RNA, 20 nt, Bordetella pertussis
gcggguuggcagucggcagg

SEQ ID NO: 428732 - RNA, 15 nt, Bordetella pertussis
gcggguugugcccgc

SEQ ID NO: 428733 - RNA, 14 nt, Bordetella pertussis
gcggguugcgcgcc

SEQ ID NO: 428734 - RNA, 16 nt, Bordetella pertussis
gcggguugcggcagcg

SEQ ID NO: 428735 - RNA, 18 nt, Bordetella pertussis
gcgguauugcgccacccc

SEQ ID NO: 428736 - RNA, 16 nt, Bordetella pertussis
gcggucaaugcggcgg

SEQ ID NO: 428737 - RNA, 17 nt, Bordetella pertussis
gcggucaaugcggcggc

SEQ ID NO: 428738 - RNA, 15 nt, Bordetella pertussis
gcggucagccagagc

SEQ ID NO: 428739 - RNA, 14 nt, Bordetella pertussis
gcggucagcgcggc

SEQ ID NO: 428740 - RNA, 15 nt, Bordetella pertussis
gcggucagcgcggcg

SEQ ID NO: 428741 - RNA, 17 nt, Bordetella pertussis
gcggucagcgcggcgcc

SEQ ID NO: 428742 - RNA, 17 nt, Bordetella pertussis
gcgguccacagcccggc

SEQ ID NO: 428743 - RNA, 19 nt, Bordetella pertussis
gcggucgccaucggccggc

SEQ ID NO: 428744 - RNA, 18 nt, Bordetella pertussis
gcggucgccuugucgggg

SEQ ID NO: 428745 - RNA, 15 nt, Bordetella pertussis
gcggucgcgcuggcc

SEQ ID NO: 428746 - RNA, 21 nt, Bordetella pertussis
gcggucggugcaaugcccagu

SEQ ID NO: 428747 - RNA, 16 nt, Bordetella pertussis
gcggucguagcguucg

SEQ ID NO: 428748 - RNA, 12 nt, Bordetella pertussis
gcggucguccuc

SEQ ID NO: 428749 - RNA, 20 nt, Bordetella pertussis
gcggugcgacugcaggauga

SEQ ID NO: 428750 - RNA, 14 nt, Bordetella pertussis
gcggugcgcgcggc

SEQ ID NO: 428751 - RNA, 14 nt, Bordetella pertussis
gcggugcgcggcgc

SEQ ID NO: 428752 - RNA, 13 nt, Bordetella pertussis
gcggugcggccuc

SEQ ID NO: 428753 - RNA, 20 nt, Bordetella pertussis
gcggugcgggugggcgcgcc

SEQ ID NO: 428754 - RNA, 18 nt, Bordetella pertussis
gcggugcgugcgcccaug

SEQ ID NO: 428755 - RNA, 20 nt, Bordetella pertussis
gcgguggccaugcugggcgg

SEQ ID NO: 428756 - RNA, 22 nt, Bordetella pertussis
gcgguggccaugcugggcgggc

SEQ ID NO: 428757 - RNA, 17 nt, Bordetella pertussis
gcgguggccgccgcgcg

SEQ ID NO: 428758 - RNA, 13 nt, Bordetella pertussis
gcgguggccgcgc

SEQ ID NO: 428759 - RNA, 21 nt, Bordetella pertussis
gcgguggccgcuucggcggcc

SEQ ID NO: 428760 - RNA, 23 nt, Bordetella pertussis
gcgguggccgcuucggcggccgc

SEQ ID NO: 428761 - RNA, 12 nt, Bordetella pertussis
gcgguggcggcc

SEQ ID NO: 428762 - RNA, 19 nt, Bordetella pertussis
gcgguggcguuggccugcc

SEQ ID NO: 428763 - RNA, 14 nt, Bordetella pertussis
gcggugggcagcgc

SEQ ID NO: 428764 - RNA, 22 nt, Bordetella pertussis
gcgguggggcaguugaccauga

SEQ ID NO: 428765 - RNA, 19 nt, Bordetella pertussis
gcgguggggcgcaaaagca

SEQ ID NO: 428766 - RNA, 18 nt, Bordetella pertussis
gcgguggugauaaggcuc

SEQ ID NO: 428767 - RNA, 15 nt, Bordetella pertussis
gcgguggugcgccuc

SEQ ID NO: 428768 - RNA, 18 nt, Bordetella pertussis
gcgguguagaccaccagc

SEQ ID NO: 428769 - RNA, 22 nt, Bordetella pertussis
gcggugucggacaacugcgcga

SEQ ID NO: 428770 - RNA, 18 nt, Bordetella pertussis
gcgguucgccgugcaggg

SEQ ID NO: 428771 - RNA, 18 nt, Bordetella pertussis
gcgguucggcgaaccagu

SEQ ID NO: 428772 - RNA, 18 nt, Bordetella pertussis
gcgguugaaggcgaacgg

SEQ ID NO: 428773 - RNA, 18 nt, Bordetella pertussis
gcgguuucuuccagcagg

SEQ ID NO: 428774 - RNA, 19 nt, Bordetella pertussis
gcgguuucuuccagcaggg

SEQ ID NO: 428775 - RNA, 21 nt, Bordetella pertussis
gcgguuugguagcaggcgcgc

SEQ ID NO: 428776 - RNA, 15 nt, Bordetella pertussis
gcguaaggccgccgg

SEQ ID NO: 428777 - RNA, 18 nt, Bordetella pertussis
gcguaauugggcugguag

SEQ ID NO: 428778 - RNA, 14 nt, Bordetella pertussis
gcguaccaggcagc

SEQ ID NO: 428779 - RNA, 19 nt, Bordetella pertussis
gcguaccaggcagccggcc

SEQ ID NO: 428780 - RNA, 16 nt, Bordetella pertussis
gcguacguaccaggcc

SEQ ID NO: 428781 - RNA, 17 nt, Bordetella pertussis
gcguacugcugcaagga

SEQ ID NO: 428782 - RNA, 19 nt, Bordetella pertussis
gcguacugcugcaaggaca

SEQ ID NO: 428783 - RNA, 23 nt, Bordetella pertussis
gcguacgacggggugccuguccc

SEQ ID NO: 428784 - RNA, 15 nt, Bordetella pertussis
gcguagaccaccugc

SEQ ID NO: 428785 - RNA, 22 nt, Bordetella pertussis
gcguagagcagugugccugucc

SEQ ID NO: 428786 - RNA, 12 nt, Bordetella pertussis
gcguagagcgcc

SEQ ID NO: 428787 - RNA, 18 nt, Bordetella pertussis
gcguaguugucggcgcag

SEQ ID NO: 428788 - RNA, 23 nt, Bordetella pertussis
gcguaucaacuuccagcgcccgc

SEQ ID NO: 428789 - RNA, 19 nt, Bordetella pertussis
gcguauccagcaucaccag

SEQ ID NO: 428790 - RNA, 17 nt, Bordetella pertussis
gcguaucgcccgcgcgg

SEQ ID NO: 428791 - RNA, 17 nt, Bordetella pertussis
gcguaugacagggugcc

SEQ ID NO: 428792 - RNA, 21 nt, Bordetella pertussis
gcgucugcuacaccgugcugg

SEQ ID NO: 428793 - RNA, 14 nt, Bordetella pertussis
gcgucuggagcggc

SEQ ID NO: 428794 - RNA, 21 nt, Bordetella pertussis
gcgucuggagcggccuggccc

SEQ ID NO: 428795 - RNA, 21 nt, Bordetella pertussis
gcgucuucaguugacgccggc

SEQ ID NO: 428796 - RNA, 18 nt, Bordetella pertussis
gcgucuucggcgcggcgg

SEQ ID NO: 428797 - RNA, 20 nt, Bordetella pertussis
gcgugaaaggccagcggcgg

SEQ ID NO: 428798 - RNA, 14 nt, Bordetella pertussis
gcgugaacuggucc

SEQ ID NO: 428799 - RNA, 15 nt, Bordetella pertussis
gcgugaaggucggca

SEQ ID NO: 428800 - RNA, 23 nt, Bordetella pertussis
gcgugaauaccgcgcacaggucg

SEQ ID NO: 428801 - RNA, 20 nt, Bordetella pertussis
gcgugauggggccgggcgcc

SEQ ID NO: 428802 - RNA, 21 nt, Bordetella pertussis
gcgugauggggccgggcgcca

SEQ ID NO: 428803 - RNA, 19 nt, Bordetella pertussis
gcgugcagagcaccacggc

SEQ ID NO: 428804 - RNA, 13 nt, Bordetella pertussis
gcgugcagccagc

SEQ ID NO: 428805 - RNA, 17 nt, Bordetella pertussis
gcgugcagccagcggcc

SEQ ID NO: 428806 - RNA, 21 nt, Bordetella pertussis
gcgugcacgcguaugcccugc

SEQ ID NO: 428807 - RNA, 14 nt, Bordetella pertussis
gcgugcaggccggc

SEQ ID NO: 428808 - RNA, 17 nt, Bordetella pertussis
gcgugcaggccggcggc

SEQ ID NO: 428809 - RNA, 12 nt, Bordetella pertussis
gcgugccagcag

SEQ ID NO: 428810 - RNA, 18 nt, Bordetella pertussis
gcgugcccagcgagauca

SEQ ID NO: 428811 - RNA, 19 nt, Bordetella pertussis
gcgugcccguugccgcgcg

SEQ ID NO: 428812 - RNA, 23 nt, Bordetella pertussis
gcgugcccugcggcgcggccagc

SEQ ID NO: 428813 - RNA, 15 nt, Bordetella pertussis
gcgugcugaacgcgc

SEQ ID NO: 428814 - RNA, 17 nt, Bordetella pertussis
gcgugcugaacgcgcgu

SEQ ID NO: 428815 - RNA, 16 nt, Bordetella pertussis
gcgugcuugccgccgg

SEQ ID NO: 428816 - RNA, 16 nt, Bordetella pertussis
gcgugggccagcaacu

SEQ ID NO: 428817 - RNA, 13 nt, Bordetella pertussis
gcgugggcggcgg

SEQ ID NO: 428818 - RNA, 18 nt, Bordetella pertussis
gcguggggccggccgcgc

SEQ ID NO: 428819 - RNA, 22 nt, Bordetella pertussis
gcguggggccggccgcgcgcgc

SEQ ID NO: 428820 - RNA, 15 nt, Bordetella pertussis
gcguggggagcgcgg

SEQ ID NO: 428821 - RNA, 17 nt, Bordetella pertussis
gcguggggagcgcggcc

SEQ ID NO: 428822 - RNA, 19 nt, Bordetella pertussis
gcguggucgcggguggugg

SEQ ID NO: 428823 - RNA, 14 nt, Bordetella pertussis
gcguggugcccugc

SEQ ID NO: 428824 - RNA, 18 nt, Bordetella pertussis
gcgugguggccuugcugc

SEQ ID NO: 428825 - RNA, 15 nt, Bordetella pertussis
gcguguaggcggccg

SEQ ID NO: 428826 - RNA, 17 nt, Bordetella pertussis
gcguucgaaagccagcg

SEQ ID NO: 428827 - RNA, 18 nt, Bordetella pertussis
gcguucgaaagccagcgc

SEQ ID NO: 428828 - RNA, 23 nt, Bordetella pertussis
gcguucgcgccaggcgccgggcc

SEQ ID NO: 428829 - RNA, 15 nt, Bordetella pertussis
gcguucgcgccgcgu

SEQ ID NO: 428830 - RNA, 15 nt, Bordetella pertussis
gcguucgcggcccug

SEQ ID NO: 428831 - RNA, 17 nt, Bordetella pertussis
gcguucgcggugggcag

SEQ ID NO: 428832 - RNA, 19 nt, Bordetella pertussis
gcguucggccacuuccugg

SEQ ID NO: 428833 - RNA, 21 nt, Bordetella pertussis
gcguucggccacuuccuggug

SEQ ID NO: 428834 - RNA, 14 nt, Bordetella pertussis
gcguucgggacgca

SEQ ID NO: 428835 - RNA, 19 nt, Bordetella pertussis
gcguucgggacgcaggagu

SEQ ID NO: 428836 - RNA, 14 nt, Bordetella pertussis
gcguucgggcggca

SEQ ID NO: 428837 - RNA, 18 nt, Bordetella pertussis
gcguucgguggcguggug

SEQ ID NO: 428838 - RNA, 16 nt, Bordetella pertussis
gcguucuggcgcagca

SEQ ID NO: 428839 - RNA, 22 nt, Bordetella pertussis
gcguucuucagcuacggcuggc

SEQ ID NO: 428840 - RNA, 23 nt, Bordetella pertussis
gcguugaaggcgaugggcaccug

SEQ ID NO: 428841 - RNA, 16 nt, Bordetella pertussis
gcuaaauacgcuggcu

SEQ ID NO: 428842 - RNA, 17 nt, Bordetella pertussis
gcuacaccgugcuggcc

SEQ ID NO: 428843 - RNA, 20 nt, Bordetella pertussis
gcuacccccugaccggcggc

SEQ ID NO: 428844 - RNA, 21 nt, Bordetella pertussis
gcuacccccugaccggcggcg

SEQ ID NO: 428845 - RNA, 12 nt, Bordetella pertussis
gcuaccgcgcca

SEQ ID NO: 428846 - RNA, 12 nt, Bordetella pertussis
gcuacgccgccg

SEQ ID NO: 428847 - RNA, 19 nt, Bordetella pertussis
gcuacgcgggcuugcugcc

SEQ ID NO: 428848 - RNA, 12 nt, Bordetella pertussis
gcuaggccuugc

SEQ ID NO: 428849 - RNA, 22 nt, Bordetella pertussis
gcuaguacaccgucgcgcgcac

SEQ ID NO: 428850 - RNA, 23 nt, Bordetella pertussis
gcucacagggucaaggcgcggcc

SEQ ID NO: 428851 - RNA, 22 nt, Bordetella pertussis
gcucaccgagggccggacuggc

SEQ ID NO: 428852 - RNA, 19 nt, Bordetella pertussis
gcucagcagcgccagggcc

SEQ ID NO: 428853 - RNA, 18 nt, Bordetella pertussis
gcucaggauacgugcugc

SEQ ID NO: 428854 - RNA, 12 nt, Bordetella pertussis
gcucaggccagc

SEQ ID NO: 428855 - RNA, 15 nt, Bordetella pertussis
gcucaggccagcgac

SEQ ID NO: 428856 - RNA, 16 nt, Bordetella pertussis
gcucaggccagcgacc

SEQ ID NO: 428857 - RNA, 14 nt, Bordetella pertussis
gcucaggccgccgg

SEQ ID NO: 428858 - RNA, 17 nt, Bordetella pertussis
gcucaggccgcugggca

SEQ ID NO: 428859 - RNA, 16 nt, Bordetella pertussis
gcucaggcugcgcguc

SEQ ID NO: 428860 - RNA, 17 nt, Bordetella pertussis
gcucagggggcgcccca

SEQ ID NO: 428861 - RNA, 18 nt, Bordetella pertussis
gcucaggucgaacaggcu

SEQ ID NO: 428862 - RNA, 16 nt, Bordetella pertussis
gcucagucggccuggc

SEQ ID NO: 428863 - RNA, 11 nt, Bordetella pertussis
gcucaucaucg

SEQ ID NO: 428864 - RNA, 13 nt, Bordetella pertussis
gcucaucaucgcg

SEQ ID NO: 428865 - RNA, 18 nt, Bordetella pertussis
gcucaucaucgcgcuggc

SEQ ID NO: 428866 - RNA, 15 nt, Bordetella pertussis
gcucauccaggcgcg

SEQ ID NO: 428867 - RNA, 20 nt, Bordetella pertussis
gcuccagcauguacagcggu

SEQ ID NO: 428868 - RNA, 16 nt, Bordetella pertussis
gcuccagccaggcgcg

SEQ ID NO: 428869 - RNA, 17 nt, Bordetella pertussis
gcuccagccaggcgcgc

SEQ ID NO: 428870 - RNA, 14 nt, Bordetella pertussis
gcuccagccgcagg

SEQ ID NO: 428871 - RNA, 12 nt, Bordetella pertussis
gcuccagccggg

SEQ ID NO: 428872 - RNA, 16 nt, Bordetella pertussis
gcuccaugcggcggcg

SEQ ID NO: 428873 - RNA, 20 nt, Bordetella pertussis
gcuccaugcggcggcgggcg

SEQ ID NO: 428874 - RNA, 19 nt, Bordetella pertussis
gcuccggcugcgcgcgcag

SEQ ID NO: 428875 - RNA, 20 nt, Bordetella pertussis
gcuccggcugcgcgcgcagc

SEQ ID NO: 428876 - RNA, 17 nt, Bordetella pertussis
gcuccgguacgccugca

SEQ ID NO: 428877 - RNA, 18 nt, Bordetella pertussis
gcuccgguacgccugcac

SEQ ID NO: 428878 - RNA, 19 nt, Bordetella pertussis
gcuccgguacgccugcacc

SEQ ID NO: 428879 - RNA, 21 nt, Bordetella pertussis
gcuccggguagcggaugcggg

SEQ ID NO: 428880 - RNA, 18 nt, Bordetella pertussis
gcuccggucguggccagc

SEQ ID NO: 428881 - RNA, 15 nt, Bordetella pertussis
gcuccucgagcgugg

SEQ ID NO: 428882 - RNA, 13 nt, Bordetella pertussis
gcuccucgcccga

SEQ ID NO: 428883 - RNA, 22 nt, Bordetella pertussis
gcuccucgcccgaccugcuggc

SEQ ID NO: 428884 - RNA, 19 nt, Bordetella pertussis
gcuccucgcgcgcggacug

SEQ ID NO: 428885 - RNA, 16 nt, Bordetella pertussis
gcucgaaaaagcccug

SEQ ID NO: 428886 - RNA, 16 nt, Bordetella pertussis
gcucgaacaggcuggc

SEQ ID NO: 428887 - RNA, 22 nt, Bordetella pertussis
gcucgaacaggcuggcauggaa

SEQ ID NO: 428888 - RNA, 17 nt, Bordetella pertussis
gcucgaccacggcggcu

SEQ ID NO: 428889 - RNA, 18 nt, Bordetella pertussis
gcucgaccacggcggcuu

SEQ ID NO: 428890 - RNA, 15 nt, Bordetella pertussis
gcucgaugccggccu

SEQ ID NO: 428891 - RNA, 17 nt, Bordetella pertussis
gcucgaugaccagcagc

SEQ ID NO: 428892 - RNA, 22 nt, Bordetella pertussis
gcucgauggcuucgcgcacauc

SEQ ID NO: 428893 - RNA, 18 nt, Bordetella pertussis
gcucgcacggcaaugucc

SEQ ID NO: 428894 - RNA, 18 nt, Bordetella pertussis
gcucgccucgaugaaggu

SEQ ID NO: 428895 - RNA, 23 nt, Bordetella pertussis
gcucgcgcaacgcaugcgcgauc

SEQ ID NO: 428896 - RNA, 16 nt, Bordetella pertussis
gcucgcgcacagcgcg

SEQ ID NO: 428897 - RNA, 16 nt, Bordetella pertussis
gcucgcgcagcaggcc

SEQ ID NO: 428898 - RNA, 13 nt, Bordetella pertussis
gcucgcgcaugca

SEQ ID NO: 428899 - RNA, 17 nt, Bordetella pertussis
gcucgcgcccgagcgcc

SEQ ID NO: 428900 - RNA, 14 nt, Bordetella pertussis
gcucgcgcgagccc

SEQ ID NO: 428901 - RNA, 14 nt, Bordetella pertussis
gcucgcgcucgccc

SEQ ID NO: 428902 - RNA, 17 nt, Bordetella pertussis
gcucgcgggugcgcagc

SEQ ID NO: 428903 - RNA, 23 nt, Bordetella pertussis
gcucggccaaggcauuggcgccg

SEQ ID NO: 428904 - RNA, 19 nt, Bordetella pertussis
gcucggccacgcgcugcug

SEQ ID NO: 428905 - RNA, 12 nt, Bordetella pertussis
gcucggccagca

SEQ ID NO: 428906 - RNA, 15 nt, Bordetella pertussis
gcucggccagcgagg

SEQ ID NO: 428907 - RNA, 15 nt, Bordetella pertussis
gcucggccagcgcgc

SEQ ID NO: 428908 - RNA, 17 nt, Bordetella pertussis
gcucggccagcgcgcgc

SEQ ID NO: 428909 - RNA, 15 nt, Bordetella pertussis
gcucggccugcggcu

SEQ ID NO: 428910 - RNA, 18 nt, Bordetella pertussis
gcucggcgaagccgcagc

SEQ ID NO: 428911 - RNA, 17 nt, Bordetella pertussis
gcucggcgaccaggccc

SEQ ID NO: 428912 - RNA, 20 nt, Bordetella pertussis
gcucggcgaucugcgcggcg

SEQ ID NO: 428913 - RNA, 16 nt, Bordetella pertussis
gcucggcggccgccug

SEQ ID NO: 428914 - RNA, 22 nt, Bordetella pertussis
gcucggcguccucgcgguccug

SEQ ID NO: 428915 - RNA, 14 nt, Bordetella pertussis
gcucggcuggagcu

SEQ ID NO: 428916 - RNA, 18 nt, Bordetella pertussis
gcucggcuggagcucuau

SEQ ID NO: 428917 - RNA, 15 nt, Bordetella pertussis
gcucgggcucgagcc

SEQ ID NO: 428918 - RNA, 14 nt, Bordetella pertussis
gcucggugagcggc

SEQ ID NO: 428919 - RNA, 16 nt, Bordetella pertussis
gcucggugagcggcac

SEQ ID NO: 428920 - RNA, 20 nt, Bordetella pertussis
gcucggugcagcccagcacc

SEQ ID NO: 428921 - RNA, 21 nt, Bordetella pertussis
gcucggugcgggccggcgcgc

SEQ ID NO: 428922 - RNA, 19 nt, Bordetella pertussis
gcucggugcucuggcccgc

SEQ ID NO: 428923 - RNA, 22 nt, Bordetella pertussis
ggaauacgccguugcggcccgc

SEQ ID NO: 428924 - RNA, 19 nt, Bordetella pertussis
ggacagauccagcgcggcc

SEQ ID NO: 428925 - RNA, 23 nt, Bordetella pertussis
ggacagcaccgacaggccgaugc

SEQ ID NO: 428926 - RNA, 22 nt, Bordetella pertussis
ggacagcaguucggccggcggc

SEQ ID NO: 428927 - RNA, 13 nt, Bordetella pertussis
ggacagccccagc

SEQ ID NO: 428928 - RNA, 20 nt, Bordetella pertussis
ggaccagcgguugcgccagc

SEQ ID NO: 428929 - RNA, 12 nt, Bordetella pertussis
ggacccaggccu

SEQ ID NO: 428930 - RNA, 19 nt, Bordetella pertussis
ggacccaguucggccgcca

SEQ ID NO: 428931 - RNA, 20 nt, Bordetella pertussis
ggacccaguucggccgccag

SEQ ID NO: 428932 - RNA, 20 nt, Bordetella pertussis
ggaccccaguuccagcacga

SEQ ID NO: 428933 - RNA, 23 nt, Bordetella pertussis
ggaccgcgcugcggucagcugug

SEQ ID NO: 428934 - RNA, 19 nt, Bordetella pertussis
ggaccggcguccaugaaaa

SEQ ID NO: 428935 - RNA, 18 nt, Bordetella pertussis
ggaccugcucgagcggcg

SEQ ID NO: 428936 - RNA, 20 nt, Bordetella pertussis
ggaccuggacgagggccgcg

SEQ ID NO: 428937 - RNA, 18 nt, Bordetella pertussis
ggaccuggccagcguggg

SEQ ID NO: 428938 - RNA, 14 nt, Bordetella pertussis
ggacgaacaggccg

SEQ ID NO: 428939 - RNA, 13 nt, Bordetella pertussis
ggacgacaggcau

SEQ ID NO: 428940 - RNA, 17 nt, Bordetella pertussis
ggacgagacaggcgcgc

SEQ ID NO: 428941 - RNA, 18 nt, Bordetella pertussis
ggacgagggccgcggcga

SEQ ID NO: 428942 - RNA, 15 nt, Bordetella pertussis
ggacgaucccggcca

SEQ ID NO: 428943 - RNA, 19 nt, Bordetella pertussis
ggacgcaaaaacgcccggc

SEQ ID NO: 428944 - RNA, 23 nt, Bordetella pertussis
ggacgcaaaaacgcccggcgcgg

SEQ ID NO: 428945 - RNA, 20 nt, Bordetella pertussis
ggacgcaggcccagccagcc

SEQ ID NO: 428946 - RNA, 18 nt, Bordetella pertussis
ggacgccauggcggcggc

SEQ ID NO: 428947 - RNA, 18 nt, Bordetella pertussis
ggacgcccuggcgcaggc

SEQ ID NO: 428948 - RNA, 14 nt, Bordetella pertussis
ggacgggccaggcc

SEQ ID NO: 428949 - RNA, 22 nt, Bordetella pertussis
ggacggguaucgucgaccugga

SEQ ID NO: 428950 - RNA, 19 nt, Bordetella pertussis
ggacgucugagcgccgggg

SEQ ID NO: 428951 - RNA, 14 nt, Bordetella pertussis
ggacuggcaccggc

SEQ ID NO: 428952 - RNA, 17 nt, Bordetella pertussis
ggacuggcaccugcaag

SEQ ID NO: 428953 - RNA, 16 nt, Bordetella pertussis
ggacuggcucccgcug

SEQ ID NO: 428954 - RNA, 15 nt, Bordetella pertussis
ggacuguccggcaac

SEQ ID NO: 428955 - RNA, 19 nt, Bordetella pertussis
ggacuucgucgaucauggc

SEQ ID NO: 428956 - RNA, 14 nt, Bordetella pertussis
ggagaguucaucca

SEQ ID NO: 428957 - RNA, 18 nt, Bordetella pertussis
ggagaguucauccacagc

SEQ ID NO: 428958 - RNA, 14 nt, Bordetella pertussis
ggagauacuggccg

SEQ ID NO: 428959 - RNA, 17 nt, Bordetella pertussis
ggagaucaugaccacgu

SEQ ID NO: 428960 - RNA, 18 nt, Bordetella pertussis
ggagaucgccgagcggca

SEQ ID NO: 428961 - RNA, 16 nt, Bordetella pertussis
ggagcgacacccgcgg

SEQ ID NO: 428962 - RNA, 19 nt, Bordetella pertussis
ggagcgccgucucgugccc

SEQ ID NO: 428963 - RNA, 14 nt, Bordetella pertussis
ggagcgcggcggcg

SEQ ID NO: 428964 - RNA, 12 nt, Bordetella pertussis
ggagcgcgggcc

SEQ ID NO: 428965 - RNA, 13 nt, Bordetella pertussis
ggagcggccagca

SEQ ID NO: 428966 - RNA, 15 nt, Bordetella pertussis
ggagcggccagcaag

SEQ ID NO: 428967 - RNA, 23 nt, Bordetella pertussis
ggaggacgccgaccucggcaccg

SEQ ID NO: 428968 - RNA, 12 nt, Bordetella pertussis
ggaggagguggc

SEQ ID NO: 428969 - RNA, 14 nt, Bordetella pertussis
ggaggagguggcug

SEQ ID NO: 428970 - RNA, 20 nt, Bordetella pertussis
ggaggagguuuuccuggagc

SEQ ID NO: 428971 - RNA, 17 nt, Bordetella pertussis
ggaggcgcgcagcuccg

SEQ ID NO: 428972 - RNA, 23 nt, Bordetella pertussis
ggagguugcccgcccgacgagga

SEQ ID NO: 428973 - RNA, 13 nt, Bordetella pertussis
ggagucgugcagg

SEQ ID NO: 428974 - RNA, 23 nt, Bordetella pertussis
ggauacgcgucauaccgaaggac

SEQ ID NO: 428975 - RNA, 15 nt, Bordetella pertussis
ggauacggccagcgc

SEQ ID NO: 428976 - RNA, 13 nt, Bordetella pertussis
ggaucaaggcccg

SEQ ID NO: 428977 - RNA, 16 nt, Bordetella pertussis
ggaucaccgccgcgcc

SEQ ID NO: 428978 - RNA, 15 nt, Bordetella pertussis
ggaucacccagcggc

SEQ ID NO: 428979 - RNA, 19 nt, Bordetella pertussis
ggaucacgggaaugaagcg

SEQ ID NO: 428980 - RNA, 15 nt, Bordetella pertussis
ggaucucggccagca

SEQ ID NO: 428981 - RNA, 21 nt, Bordetella pertussis
ggaucucggccagcagcgccu

SEQ ID NO: 428982 - RNA, 20 nt, Bordetella pertussis
ggaugaugcggcgccacgca

SEQ ID NO: 428983 - RNA, 17 nt, Bordetella pertussis
ggaugccaugccgggca

SEQ ID NO: 428984 - RNA, 14 nt, Bordetella pertussis
ggaugccccgcccg

SEQ ID NO: 428985 - RNA, 12 nt, Bordetella pertussis
ggaugcccgcgg

SEQ ID NO: 428986 - RNA, 22 nt, Bordetella pertussis
ggaugcccuggguggcggggcg

SEQ ID NO: 428987 - RNA, 23 nt, Bordetella pertussis
ggauggccacgaccaccagcguc

SEQ ID NO: 428988 - RNA, 17 nt, Bordetella pertussis
ggauggcgccagcccgc

SEQ ID NO: 428989 - RNA, 23 nt, Bordetella pertussis
ggauggcgcggaugaccugcgcc

SEQ ID NO: 428990 - RNA, 11 nt, Bordetella pertussis
ggauggcggcc

SEQ ID NO: 428991 - RNA, 20 nt, Bordetella pertussis
ggauggcggccgccagcgcc

SEQ ID NO: 428992 - RNA, 17 nt, Bordetella pertussis
ggauggcucgggcagca

SEQ ID NO: 428993 - RNA, 20 nt, Bordetella pertussis
ggauggcucgggcagcagca

SEQ ID NO: 428994 - RNA, 17 nt, Bordetella pertussis
ggauuucaccuaccuca

SEQ ID NO: 428995 - RNA, 19 nt, Bordetella pertussis
ggcaaaaaaaaccgcgcgc

SEQ ID NO: 428996 - RNA, 12 nt, Bordetella pertussis
ggcaaaacggug

SEQ ID NO: 428997 - RNA, 13 nt, Bordetella pertussis
ggcaaagcccagc

SEQ ID NO: 428998 - RNA, 14 nt, Bordetella pertussis
ggcaaagcccagca

SEQ ID NO: 428999 - RNA, 14 nt, Bordetella pertussis
ggcaaauggggcgg

SEQ ID NO: 429000 - RNA, 12 nt, Bordetella pertussis
ggcaacagcagg

SEQ ID NO: 429001 - RNA, 11 nt, Bordetella pertussis
ggcaacaucuc

SEQ ID NO: 429002 - RNA, 17 nt, Bordetella pertussis
ggcaacaucuccaccag

SEQ ID NO: 429003 - RNA, 12 nt, Bordetella pertussis
ggcaaccgcgcc

SEQ ID NO: 429004 - RNA, 17 nt, Bordetella pertussis
ggcaaccgcgccucguc

SEQ ID NO: 429005 - RNA, 17 nt, Bordetella pertussis
ggcaacguugcugcagc

SEQ ID NO: 429006 - RNA, 14 nt, Bordetella pertussis
ggcaagacggcgcu

SEQ ID NO: 429007 - RNA, 17 nt, Bordetella pertussis
ggcaagacggcgcucgg

SEQ ID NO: 429008 - RNA, 12 nt, Bordetella pertussis
ggcaagagccug

SEQ ID NO: 429009 - RNA, 13 nt, Bordetella pertussis
ggcaagagccugg

SEQ ID NO: 429010 - RNA, 16 nt, Bordetella pertussis
ggcaagaucgccggcu

SEQ ID NO: 429011 - RNA, 16 nt, Bordetella pertussis
ggcaagccagggcagg

SEQ ID NO: 429012 - RNA, 17 nt, Bordetella pertussis
ggcaagccagggcagga

SEQ ID NO: 429013 - RNA, 15 nt, Bordetella pertussis
ggcaagcgcucgccg

SEQ ID NO: 429014 - RNA, 16 nt, Bordetella pertussis
ggcaagcgcucgccgg

SEQ ID NO: 429015 - RNA, 20 nt, Bordetella pertussis
ggcaagcggcguggggccgg

SEQ ID NO: 429016 - RNA, 21 nt, Bordetella pertussis
ggcaagccuugcggcuugccg

SEQ ID NO: 429017 - RNA, 15 nt, Bordetella pertussis
ggcaaggcccgccgc

SEQ ID NO: 429018 - RNA, 22 nt, Bordetella pertussis
ggcaaggcccgccgcggcaggc

SEQ ID NO: 429019 - RNA, 12 nt, Bordetella pertussis
ggcaaggccgcg

SEQ ID NO: 429020 - RNA, 22 nt, Bordetella pertussis
ggcaaggccgcgaacgcgccgg

SEQ ID NO: 429021 - RNA, 21 nt, Bordetella pertussis
ggcaaggcgcacaaccuggua

SEQ ID NO: 429022 - RNA, 18 nt, Bordetella pertussis
ggcaagggugccuguccc

SEQ ID NO: 429023 - RNA, 20 nt, Bordetella pertussis
ggcaagucgacgcugaucgg

SEQ ID NO: 429024 - RNA, 16 nt, Bordetella pertussis
ggcaaguucgcugccg

SEQ ID NO: 429025 - RNA, 15 nt, Bordetella pertussis
ggcaaucgaaaagcc

SEQ ID NO: 429026 - RNA, 16 nt, Bordetella pertussis
ggcaaugcgcgcgcgg

SEQ ID NO: 429027 - RNA, 17 nt, Bordetella pertussis
ggcaaugguccagcagg

SEQ ID NO: 429028 - RNA, 18 nt, Bordetella pertussis
ggcaaugguccagcaggg

SEQ ID NO: 429029 - RNA, 20 nt, Bordetella pertussis
ggcaaugucgcaggccgcgg

SEQ ID NO: 429030 - RNA, 16 nt, Bordetella pertussis
ggcacaacccgcccgg

SEQ ID NO: 429031 - RNA, 20 nt, Bordetella pertussis
ggcacaacccgcccggggcc

SEQ ID NO: 429032 - RNA, 18 nt, Bordetella pertussis
ggcaccaugcgcgagggc

SEQ ID NO: 429033 - RNA, 14 nt, Bordetella pertussis
ggcaccccgucguc

SEQ ID NO: 429034 - RNA, 14 nt, Bordetella pertussis
ggcacccgcaaacc

SEQ ID NO: 429035 - RNA, 22 nt, Bordetella pertussis
ggcacccgcuaccccggcagcg

SEQ ID NO: 429036 - RNA, 14 nt, Bordetella pertussis
ggcacccggccgcu

SEQ ID NO: 429037 - RNA, 13 nt, Bordetella pertussis
ggcacccgcgcgc

SEQ ID NO: 429038 - RNA, 17 nt, Bordetella pertussis
ggcacccggcucagccu

SEQ ID NO: 429039 - RNA, 17 nt, Bordetella pertussis
ggcacccuugccgcagc

SEQ ID NO: 429040 - RNA, 16 nt, Bordetella pertussis
ggcaccgaacccugcc

SEQ ID NO: 429041 - RNA, 13 nt, Bordetella pertussis
ggcaccggccaag

SEQ ID NO: 429042 - RNA, 15 nt, Bordetella pertussis
ggcaccggccaagcu

SEQ ID NO: 429043 - RNA, 20 nt, Bordetella pertussis
ggcaccggccaagcuccagg

SEQ ID NO: 429044 - RNA, 18 nt, Bordetella pertussis
ggcaccgaacgggcgugg

SEQ ID NO: 429045 - RNA, 19 nt, Bordetella pertussis
ggcaccgugaugcgcgccg

SEQ ID NO: 429046 - RNA, 16 nt, Bordetella pertussis
ggcaccucggccgggg

SEQ ID NO: 429047 - RNA, 19 nt, Bordetella pertussis
ggcaccucggccggggcgg

SEQ ID NO: 429048 - RNA, 15 nt, Bordetella pertussis
ggcaccugccgacuu

SEQ ID NO: 429049 - RNA, 20 nt, Bordetella pertussis
ggcaccugcgaccgagccac

SEQ ID NO: 429050 - RNA, 19 nt, Bordetella pertussis
ggcaccucggggugcagcu

SEQ ID NO: 429051 - RNA, 16 nt, Bordetella pertussis
ggcaccuuggcccggc

SEQ ID NO: 429052 - RNA, 22 nt, Bordetella pertussis
ggcacgaaaagccgcggccgcc

SEQ ID NO: 429053 - RNA, 14 nt, Bordetella pertussis
ggcacgccucgccg

SEQ ID NO: 429054 - RNA, 22 nt, Bordetella pertussis
ggcacgccucgccggcccugcc

SEQ ID NO: 429055 - RNA, 13 nt, Bordetella pertussis
ggcacgcgccagc

SEQ ID NO: 429056 - RNA, 15 nt, Bordetella pertussis
ggcacgcgccagcug

SEQ ID NO: 429057 - RNA, 12 nt, Bordetella pertussis
ggcacgcgccga

SEQ ID NO: 429058 - RNA, 14 nt, Bordetella pertussis
ggcacgcgcgccgg

SEQ ID NO: 429059 - RNA, 18 nt, Bordetella pertussis
ggcacgcgcgccggcagg

SEQ ID NO: 429060 - RNA, 15 nt, Bordetella pertussis
ggcacgcgcgguucg

SEQ ID NO: 429061 - RNA, 16 nt, Bordetella pertussis
ggcacgcugaucgccg

SEQ ID NO: 429062 - RNA, 19 nt, Bordetella pertussis
ggcacgcugaucgccggcg

SEQ ID NO: 429063 - RNA, 21 nt, Bordetella pertussis
ggcacgcugaucgccggcgcc

SEQ ID NO: 429064 - RNA, 16 nt, Bordetella pertussis
ggcacgcugcgcaggc

SEQ ID NO: 429065 - RNA, 19 nt, Bordetella pertussis
ggcacgcugcgcaggcgcg

SEQ ID NO: 429066 - RNA, 18 nt, Bordetella pertussis
ggcacgcuugccgcaacc

SEQ ID NO: 429067 - RNA, 12 nt, Bordetella pertussis
ggcacggccagc

SEQ ID NO: 429068 - RNA, 17 nt, Bordetella pertussis
ggcacggccagcggcga

SEQ ID NO: 429069 - RNA, 16 nt, Bordetella pertussis
ggcacggccggccagg

SEQ ID NO: 429070 - RNA, 18 nt, Bordetella pertussis
ggcacggccggccaggcg

SEQ ID NO: 429071 - RNA, 20 nt, Bordetella pertussis
ggcacgguggcgaaggccgc

SEQ ID NO: 429072 - RNA, 21 nt, Bordetella pertussis
ggcacgguggcgaaggccgcc

SEQ ID NO: 429073 - RNA, 15 nt, Bordetella pertussis
ggcacuggcgcggcg

SEQ ID NO: 429074 - RNA, 20 nt, Bordetella pertussis
ggcagaacagcggaucgccg

SEQ ID NO: 429075 - RNA, 13 nt, Bordetella pertussis
ggcaggcuggccg

SEQ ID NO: 429076 - RNA, 22 nt, Bordetella pertussis
ggcaggggcucgcgcccgagcg

SEQ ID NO: 429077 - RNA, 19 nt, Bordetella pertussis
ggcagggcggccaggccgg

SEQ ID NO: 429078 - RNA, 20 nt, Bordetella pertussis
ggcagggucucggccacggu

SEQ ID NO: 429079 - RNA, 14 nt, Bordetella pertussis
ggcagggugacggg

SEQ ID NO: 429080 - RNA, 18 nt, Bordetella pertussis
ggcagggugacgggcugg

SEQ ID NO: 429081 - RNA, 19 nt, Bordetella pertussis
ggcagggugacgggcuggg

SEQ ID NO: 429082 - RNA, 22 nt, Bordetella pertussis
ggcaggguucggugccuguccc

SEQ ID NO: 429083 - RNA, 21 nt, Bordetella pertussis
ggcaggguuuuauacggcgcg

SEQ ID NO: 429084 - RNA, 16 nt, Bordetella pertussis
ggcaggucgccagcag

SEQ ID NO: 429085 - RNA, 17 nt, Bordetella pertussis
ggcaggucgccagcagg

SEQ ID NO: 429086 - RNA, 18 nt, Bordetella pertussis
ggcaggucgccagcaggc

SEQ ID NO: 429087 - RNA, 21 nt, Bordetella pertussis
ggcaggucgccagcaggcccu

SEQ ID NO: 429088 - RNA, 15 nt, Bordetella pertussis
ggcaggucggccagc

SEQ ID NO: 429089 - RNA, 19 nt, Bordetella pertussis
ggcaggucgucgagccggg

SEQ ID NO: 429090 - RNA, 16 nt, Bordetella pertussis
ggcaggugcggccgca

SEQ ID NO: 429091 - RNA, 22 nt, Bordetella pertussis
ggcagguugaaguugcucggcg

SEQ ID NO: 429092 - RNA, 18 nt, Bordetella pertussis
ggcagugguggugcagcg

SEQ ID NO: 429093 - RNA, 20 nt, Bordetella pertussis
ggcagugguggugcagcggc

SEQ ID NO: 429094 - RNA, 18 nt, Bordetella pertussis
ggcagugucaggaugccc

SEQ ID NO: 429095 - RNA, 16 nt, Bordetella pertussis
ggcaguucgcccggcu

SEQ ID NO: 429096 - RNA, 23 nt, Bordetella pertussis
ggcaguugaccaugaccaugccg

SEQ ID NO: 429097 - RNA, 13 nt, Bordetella pertussis
ggcaucacgccgg

SEQ ID NO: 429098 - RNA, 20 nt, Bordetella pertussis
ggcaucagguuugcgggugc

SEQ ID NO: 429099 - RNA, 17 nt, Bordetella pertussis
ggcaucaguucaggcug

SEQ ID NO: 429100 - RNA, 18 nt, Bordetella pertussis
ggcaucaguucaggcugg

SEQ ID NO: 429101 - RNA, 20 nt, Bordetella pertussis
ggcaucccgacaugccgccc

SEQ ID NO: 429102 - RNA, 21 nt, Bordetella pertussis
ggcaucccgacaugccgcccc

SEQ ID NO: 429103 - RNA, 12 nt, Bordetella pertussis
ggcaugaaaaag

SEQ ID NO: 429104 - RNA, 16 nt, Bordetella pertussis
ggcaugaagcgcagca

SEQ ID NO: 429105 - RNA, 22 nt, Bordetella pertussis
ggcaugaaacggcaagagccug

SEQ ID NO: 429106 - RNA, 17 nt, Bordetella pertussis
ggcauucccgcccagcg

SEQ ID NO: 429107 - RNA, 19 nt, Bordetella pertussis
ggcauucucggacaggucg

SEQ ID NO: 429108 - RNA, 16 nt, Bordetella pertussis
ggcauugccggagcag

SEQ ID NO: 429109 - RNA, 18 nt, Bordetella pertussis
ggcauugccggagcagca

SEQ ID NO: 429110 - RNA, 20 nt, Bordetella pertussis
ggcauugccggagcagcagc

SEQ ID NO: 429111 - RNA, 15 nt, Bordetella pertussis
ggcauuggcggcggc

SEQ ID NO: 429112 - RNA, 16 nt, Bordetella pertussis
ggcauuggcggcggcg

SEQ ID NO: 429113 - RNA, 18 nt, Bordetella pertussis
ggcauuggcggcggcguu

SEQ ID NO: 429114 - RNA, 14 nt, Bordetella pertussis
ggcauugggcagcg

SEQ ID NO: 429115 - RNA, 15 nt, Bordetella pertussis
ggcauuucccagccg

SEQ ID NO: 429116 - RNA, 13 nt, Bordetella pertussis
ggcauuucgcugg

SEQ ID NO: 429117 - RNA, 19 nt, Bordetella pertussis
ggcauuucgcugggcgcgc

SEQ ID NO: 429118 - RNA, 20 nt, Bordetella pertussis
ggccaacggaagagggcggg

SEQ ID NO: 429119 - RNA, 22 nt, Bordetella pertussis
ggccaacggaagagggcggggc

SEQ ID NO: 429120 - RNA, 20 nt, Bordetella pertussis
ggccaacgggauccggcagc

SEQ ID NO: 429121 - RNA, 14 nt, Bordetella pertussis
ggccaagcgcgccg

SEQ ID NO: 429122 - RNA, 22 nt, Bordetella pertussis
ggccaagcuggagaagcgccgc

SEQ ID NO: 429123 - RNA, 19 nt, Bordetella pertussis
ggccaaggugccugucccc

SEQ ID NO: 429124 - RNA, 21 nt, Bordetella pertussis
ggccaaugccuauuggcugua

SEQ ID NO: 429125 - RNA, 17 nt, Bordetella pertussis
ggccacagggcgaaggc

SEQ ID NO: 429126 - RNA, 22 nt, Bordetella pertussis
ggccacagggcgaaggccagcg

SEQ ID NO: 429127 - RNA, 20 nt, Bordetella pertussis
ggccaccaccaggcccaggg

SEQ ID NO: 429128 - RNA, 14 nt, Bordetella pertussis
ggccaccucuucag

SEQ ID NO: 429129 - RNA, 20 nt, Bordetella pertussis
ggccaccucuucagcccggc

SEQ ID NO: 429130 - RNA, 16 nt, Bordetella pertussis
ggccacgaagcgcagc

SEQ ID NO: 429131 - RNA, 19 nt, Bordetella pertussis
ggccacgaauuccucgccg

SEQ ID NO: 429132 - RNA, 16 nt, Bordetella pertussis
ggccacgaccaccagc

SEQ ID NO: 429133 - RNA, 17 nt, Bordetella pertussis
ggccacgaaacccagga

SEQ ID NO: 429134 - RNA, 15 nt, Bordetella pertussis
ggccacgaugaugga

SEQ ID NO: 429135 - RNA, 22 nt, Bordetella pertussis
ggccacgaugauggaggccagg

SEQ ID NO: 429136 - RNA, 23 nt, Bordetella pertussis
ggccacgaugauggaggccagga

SEQ ID NO: 429137 - RNA, 22 nt, Bordetella pertussis
ggccacgauguugcgcaggcug

SEQ ID NO: 429138 - RNA, 23 nt, Bordetella pertussis
ggccacgauguugcgcaggcugu

SEQ ID NO: 429139 - RNA, 15 nt, Bordetella pertussis
ggccacgcagcgcgu

SEQ ID NO: 429140 - RNA, 17 nt, Bordetella pertussis
ggccacgcagcgcgugu

SEQ ID NO: 429141 - RNA, 15 nt, Bordetella pertussis
ggccacgucggcggc

SEQ ID NO: 429142 - RNA, 17 nt, Bordetella pertussis
ggccacguguggcaggc

SEQ ID NO: 429143 - RNA, 17 nt, Bordetella pertussis
ggccacguugauccagc

SEQ ID NO: 429144 - RNA, 19 nt, Bordetella pertussis
ggccacguugauccagcgc

SEQ ID NO: 429145 - RNA, 20 nt, Bordetella pertussis
ggccacguugauccagcgcu

SEQ ID NO: 429146 - RNA, 15 nt, Bordetella pertussis
ggccacuuccagcgc

SEQ ID NO: 429147 - RNA, 16 nt, Bordetella pertussis
ggccacuuccagcgcc

SEQ ID NO: 429148 - RNA, 20 nt, Bordetella pertussis
ggccacuucgcggccgaugu

SEQ ID NO: 429149 - RNA, 21 nt, Bordetella pertussis
ggccagaccuugcgcgacggc

SEQ ID NO: 429150 - RNA, 22 nt, Bordetella pertussis
ggccagaccuugcgcgacggcg

SEQ ID NO: 429151 - RNA, 15 nt, Bordetella pertussis
ggccagcacgccggc

SEQ ID NO: 429152 - RNA, 20 nt, Bordetella pertussis
ggccagcacgccggccaggu

SEQ ID NO: 429153 - RNA, 19 nt, Bordetella pertussis
ggccagcacgccggcgggc

SEQ ID NO: 429154 - RNA, 22 nt, Bordetella pertussis
ggccagcacgccggcgggcagg

SEQ ID NO: 429155 - RNA, 13 nt, Bordetella pertussis
ggccagcagcacg

SEQ ID NO: 429156 - RNA, 22 nt, Bordetella pertussis
ggccagcagcacgaucgcggcg

SEQ ID NO: 429157 - RNA, 16 nt, Bordetella pertussis
ggccagcagcgacggc

SEQ ID NO: 429158 - RNA, 17 nt, Bordetella pertussis
ggccagcagcgacggcc

SEQ ID NO: 429159 - RNA, 21 nt, Bordetella pertussis
ggccagcagcgacggccccag

SEQ ID NO: 429160 - RNA, 19 nt, Bordetella pertussis
ggccagcagcgccgccagc

SEQ ID NO: 429161 - RNA, 15 nt, Bordetella pertussis
ggccagcagcgccug

SEQ ID NO: 429162 - RNA, 16 nt, Bordetella pertussis
ggccagcagcgcgugc

SEQ ID NO: 429163 - RNA, 14 nt, Bordetella pertussis
ggccagccgcucgc

SEQ ID NO: 429164 - RNA, 14 nt, Bordetella pertussis
ggccagccgggugg

SEQ ID NO: 429165 - RNA, 13 nt, Bordetella pertussis
ggccagccugccc

SEQ ID NO: 429166 - RNA, 14 nt, Bordetella pertussis
ggccagcgccagca

SEQ ID NO: 429167 - RNA, 15 nt, Bordetella pertussis
ggccagcgccagcac

SEQ ID NO: 429168 - RNA, 12 nt, Bordetella pertussis
ggccagcgccga

SEQ ID NO: 429169 - RNA, 19 nt, Bordetella pertussis
ggccagcggcaggcccagc

SEQ ID NO: 429170 - RNA, 13 nt, Bordetella pertussis
ggccagcggcggu

SEQ ID NO: 429171 - RNA, 16 nt, Bordetella pertussis
ggccagcgugcccagc

SEQ ID NO: 429172 - RNA, 22 nt, Bordetella pertussis
ggccagcucggcggccgccugc

SEQ ID NO: 429173 - RNA, 18 nt, Bordetella pertussis
ggccaggcccucgcggcc

SEQ ID NO: 429174 - RNA, 14 nt, Bordetella pertussis
ggccaggcccugcg

SEQ ID NO: 429175 - RNA, 17 nt, Bordetella pertussis
ggccaggcccugcgcgu

SEQ ID NO: 429176 - RNA, 14 nt, Bordetella pertussis
ggccaggccgccgc

SEQ ID NO: 429177 - RNA, 18 nt, Bordetella pertussis
ggccaggccggcgcgccg

SEQ ID NO: 429178 - RNA, 15 nt, Bordetella pertussis
ggccaggccggggcc

SEQ ID NO: 429179 - RNA, 15 nt, Bordetella pertussis
ggccaggcgccggcg

SEQ ID NO: 429180 - RNA, 16 nt, Bordetella pertussis
ggccaggcgccugagc

SEQ ID NO: 429181 - RNA, 14 nt, Bordetella pertussis
ggccaggcgcgccg

SEQ ID NO: 429182 - RNA, 18 nt, Bordetella pertussis
ggccaggcgcuccagcac

SEQ ID NO: 429183 - RNA, 17 nt, Bordetella pertussis
ggccaggcgcugcgcgg

SEQ ID NO: 429184 - RNA, 14 nt, Bordetella pertussis
ggccaggcucuggg

SEQ ID NO: 429185 - RNA, 18 nt, Bordetella pertussis
ggccaggcugaccagcgc

SEQ ID NO: 429186 - RNA, 20 nt, Bordetella pertussis
ggccaggcugaccagcgcgu

SEQ ID NO: 429187 - RNA, 23 nt, Bordetella pertussis
ggccagggaggaacugggcgccg

SEQ ID NO: 429188 - RNA, 14 nt, Bordetella pertussis
ggccagggccacca

SEQ ID NO: 429189 - RNA, 18 nt, Bordetella pertussis
ggccagggccacgccggc

SEQ ID NO: 429190 - RNA, 15 nt, Bordetella pertussis
ggccagguucugguc

SEQ ID NO: 429191 - RNA, 22 nt, Bordetella pertussis
ggccagguugggugcgccgccg

SEQ ID NO: 429192 - RNA, 14 nt, Bordetella pertussis
ggccagucccagga

SEQ ID NO: 429193 - RNA, 16 nt, Bordetella pertussis
ggccagucccaggauc

SEQ ID NO: 429194 - RNA, 14 nt, Bordetella pertussis
ggccaguccgcagc

SEQ ID NO: 429195 - RNA, 16 nt, Bordetella pertussis
ggccaguggcgcggcg

SEQ ID NO: 429196 - RNA, 19 nt, Bordetella pertussis
ggccauccguccgccagga

SEQ ID NO: 429197 - RNA, 23 nt, Bordetella pertussis
ggccaucgccgccgccgggcugg

SEQ ID NO: 429198 - RNA, 23 nt, Bordetella pertussis
ggccaucuuggugcgcgccaggu

SEQ ID NO: 429199 - RNA, 16 nt, Bordetella pertussis
ggccaugcaccagcac

SEQ ID NO: 429200 - RNA, 18 nt, Bordetella pertussis
ggccaugcaccagcacau

SEQ ID NO: 429201 - RNA, 13 nt, Bordetella pertussis
ggcccacagcgcc

SEQ ID NO: 429202 - RNA, 19 nt, Bordetella pertussis
ggcccacaucgucgcgcug

SEQ ID NO: 429203 - RNA, 21 nt, Bordetella pertussis
ggcccacaucgucgcgcuggg

SEQ ID NO: 429204 - RNA, 19 nt, Bordetella pertussis
ggcccaccagggccagcuu

SEQ ID NO: 429205 - RNA, 21 nt, Bordetella pertussis
ggcccaccgcaucgcgcagcg

SEQ ID NO: 429206 - RNA, 16 nt, Bordetella pertussis
ggccccguugucgccg

SEQ ID NO: 429207 - RNA, 15 nt, Bordetella pertussis
ggccccuccggcgcc

SEQ ID NO: 429208 - RNA, 17 nt, Bordetella pertussis
ggcccgaaacgcgcagc

SEQ ID NO: 429209 - RNA, 18 nt, Bordetella pertussis
ggcccgaauuccagcucu

SEQ ID NO: 429210 - RNA, 14 nt, Bordetella pertussis
ggcccgacagcgcc

SEQ ID NO: 429211 - RNA, 15 nt, Bordetella pertussis
ggcccgccagggcgu

SEQ ID NO: 429212 - RNA, 19 nt, Bordetella pertussis
ggcccgccccgggcaggag

SEQ ID NO: 429213 - RNA, 13 nt, Bordetella pertussis
ggcccgccgcggc

SEQ ID NO: 429214 - RNA, 21 nt, Bordetella pertussis
ggcccgccgcggcaggccccg

SEQ ID NO: 429215 - RNA, 23 nt, Bordetella pertussis
ggcccgccgcggcaggccccggc

SEQ ID NO: 429216 - RNA, 15 nt, Bordetella pertussis
ggcccgccucaaccu

SEQ ID NO: 429217 - RNA, 22 nt, Bordetella pertussis
ggcccgcgcgccuuacuccggc

SEQ ID NO: 429218 - RNA, 13 nt, Bordetella pertussis
ggcccgcggccgc

SEQ ID NO: 429219 - RNA, 12 nt, Bordetella pertussis
ggcccgcggccu

SEQ ID NO: 429220 - RNA, 14 nt, Bordetella pertussis
ggcccggcgcgccu

SEQ ID NO: 429221 - RNA, 10 nt, Bordetella pertussis
ggcccggcgg

SEQ ID NO: 429222 - RNA, 12 nt, Bordetella pertussis
ggcccggcggca

SEQ ID NO: 429223 - RNA, 13 nt, Bordetella pertussis
ggcccggcgggcc

SEQ ID NO: 429224 - RNA, 22 nt, Bordetella pertussis
ggcccggcguagcugcgccgca

SEQ ID NO: 429225 - RNA, 13 nt, Bordetella pertussis
ggcccgggcaggc

SEQ ID NO: 429226 - RNA, 18 nt, Bordetella pertussis
ggcccgggcaggcucagc

SEQ ID NO: 429227 - RNA, 21 nt, Bordetella pertussis
ggcccggcugccgcggauugc

SEQ ID NO: 429228 - RNA, 18 nt, Bordetella pertussis
ggcccgggcgccugcgcc

SEQ ID NO: 429229 - RNA, 16 nt, Bordetella pertussis
ggcccgggugggcggc

SEQ ID NO: 429230 - RNA, 15 nt, Bordetella pertussis
ggcccggugcagccg

SEQ ID NO: 429231 - RNA, 16 nt, Bordetella pertussis
ggcccgguuggggucg

SEQ ID NO: 429232 - RNA, 19 nt, Bordetella pertussis
ggcccgucaugggcggggc

SEQ ID NO: 429233 - RNA, 20 nt, Bordetella pertussis
ggcccgucaugggcggggcc

SEQ ID NO: 429234 - RNA, 21 nt, Bordetella pertussis
ggcccguguagacggcaaucu

SEQ ID NO: 429235 - RNA, 15 nt, Bordetella pertussis
ggcccguuggcaggc

SEQ ID NO: 429236 - RNA, 19 nt, Bordetella pertussis
ggcccguuggcaggccagc

SEQ ID NO: 429237 - RNA, 20 nt, Bordetella pertussis
ggcccguuggcaggccagca

SEQ ID NO: 429238 - RNA, 22 nt, Bordetella pertussis
ggcccuagagcaugcggcgucc

SEQ ID NO: 429239 - RNA, 22 nt, Bordetella pertussis
ggcccuggcaugugccaccgcc

SEQ ID NO: 429240 - RNA, 18 nt, Bordetella pertussis
ggcccuggcgggccggaa

SEQ ID NO: 429241 - RNA, 19 nt, Bordetella pertussis
ggcccugggccagcagcug

SEQ ID NO: 429242 - RNA, 21 nt, Bordetella pertussis
ggcccugggccagccagcgcc

SEQ ID NO: 429243 - RNA, 18 nt, Bordetella pertussis
ggcccugggcgcggcggu

SEQ ID NO: 429244 - RNA, 21 nt, Bordetella pertussis
ggcccugggcgcggcgguggc

SEQ ID NO: 429245 - RNA, 21 nt, Bordetella pertussis
ggcccugggcuuuggcuuggc

SEQ ID NO: 429246 - RNA, 23 nt, Bordetella pertussis
ggcccuguaugccguaggcgccg

SEQ ID NO: 429247 - RNA, 15 nt, Bordetella pertussis
ggcccugucggccga

SEQ ID NO: 429248 - RNA, 21 nt, Bordetella pertussis
ggcccuugagcaaucaagggc

SEQ ID NO: 429249 - RNA, 18 nt, Bordetella pertussis
ggcccuugauggccgggc

SEQ ID NO: 429250 - RNA, 14 nt, Bordetella pertussis
ggcccuugcccagc

SEQ ID NO: 429251 - RNA, 21 nt, Bordetella pertussis
ggcccuuggucugcaggcucu

SEQ ID NO: 429252 - RNA, 20 nt, Bordetella pertussis
ggcccuugcgcgaacggcag

SEQ ID NO: 429253 - RNA, 15 nt, Bordetella pertussis
ggccgaaaccgccgc

SEQ ID NO: 429254 - RNA, 16 nt, Bordetella pertussis
ggccgaaauggcggcg

SEQ ID NO: 429255 - RNA, 17 nt, Bordetella pertussis
ggccgaccaggccggcg

SEQ ID NO: 429256 - RNA, 20 nt, Bordetella pertussis
ggccgaccaggccggcggcg

SEQ ID NO: 429257 - RNA, 23 nt, Bordetella pertussis
ggccgaccaggccggcggcgggc

SEQ ID NO: 429258 - RNA, 14 nt, Bordetella pertussis
ggccgaccggcgcg

SEQ ID NO: 429259 - RNA, 15 nt, Bordetella pertussis
ggccgacgaggcgcu

SEQ ID NO: 429260 - RNA, 13 nt, Bordetella pertussis
ggccgacgcgcug

SEQ ID NO: 429261 - RNA, 15 nt, Bordetella pertussis
ggccgacgcgcuggu

SEQ ID NO: 429262 - RNA, 20 nt, Bordetella pertussis
ggccgacgcgcuguccgaug

SEQ ID NO: 429263 - RNA, 22 nt, Bordetella pertussis
ggccgacucgaaacgggcggcg

SEQ ID NO: 429264 - RNA, 16 nt, Bordetella pertussis
ggccgacuggaugaag

SEQ ID NO: 429265 - RNA, 22 nt, Bordetella pertussis
ggccgagccauugucggugagc

SEQ ID NO: 429266 - RNA, 18 nt, Bordetella pertussis
ggccgcauugggacgcgg

SEQ ID NO: 429267 - RNA, 20 nt, Bordetella pertussis
ggccgcauugggacgcggcc

SEQ ID NO: 429268 - RNA, 16 nt, Bordetella pertussis
ggccgcauggcggccc

SEQ ID NO: 429269 - RNA, 20 nt, Bordetella pertussis
ggccgccacacgaggaccgc

SEQ ID NO: 429270 - RNA, 23 nt, Bordetella pertussis
ggccgccacccaggcggcaggcg

SEQ ID NO: 429271 - RNA, 17 nt, Bordetella pertussis
ggccgccacgcccuggc

SEQ ID NO: 429272 - RNA, 22 nt, Bordetella pertussis
ggccgccacgcccuggcagcug

SEQ ID NO: 429273 - RNA, 23 nt, Bordetella pertussis
ggccgccacgcccuggcagcugg

SEQ ID NO: 429274 - RNA, 12 nt, Bordetella pertussis
ggccgccagcac

SEQ ID NO: 429275 - RNA, 16 nt, Bordetella pertussis
ggccgccagcaccugc

SEQ ID NO: 429276 - RNA, 17 nt, Bordetella pertussis
ggccgccagcaccugcu

SEQ ID NO: 429277 - RNA, 13 nt, Bordetella pertussis
ggccgccagcaug

SEQ ID NO: 429278 - RNA, 19 nt, Bordetella pertussis
ggccgccagccggcccagc

SEQ ID NO: 429279 - RNA, 12 nt, Bordetella pertussis
ggccgccagcgc

SEQ ID NO: 429280 - RNA, 13 nt, Bordetella pertussis
ggccgcccgcccc

SEQ ID NO: 429281 - RNA, 15 nt, Bordetella pertussis
ggccgcccgccugcc

SEQ ID NO: 429282 - RNA, 22 nt, Bordetella pertussis
ggccgcccgccugccggccugg

SEQ ID NO: 429283 - RNA, 17 nt, Bordetella pertussis
ggccgcccgcggccugc

SEQ ID NO: 429284 - RNA, 19 nt, Bordetella pertussis
ggccgccgaacgaggcgcg

SEQ ID NO: 429285 - RNA, 14 nt, Bordetella pertussis
ggccgccgaacggc

SEQ ID NO: 429286 - RNA, 23 nt, Bordetella pertussis
ggccgccgacgccgccacgcugg

SEQ ID NO: 429287 - RNA, 16 nt, Bordetella pertussis
ggccgccgcacagcgu

SEQ ID NO: 429288 - RNA, 17 nt, Bordetella pertussis
ggccgccgcacagcgug

SEQ ID NO: 429289 - RNA, 16 nt, Bordetella pertussis
ggccgccgccagcgcg

SEQ ID NO: 429290 - RNA, 15 nt, Bordetella pertussis
ggccgccgcggccuc

SEQ ID NO: 429291 - RNA, 12 nt, Bordetella pertussis
ggccgccgcggg

SEQ ID NO: 429292 - RNA, 14 nt, Bordetella pertussis
ggccgccggccacc

SEQ ID NO: 429293 - RNA, 15 nt, Bordetella pertussis
ggccgccggccacca

SEQ ID NO: 429294 - RNA, 16 nt, Bordetella pertussis
ggccgccggccaccag

SEQ ID NO: 429295 - RNA, 17 nt, Bordetella pertussis
ggccgccggccagcgcc

SEQ ID NO: 429296 - RNA, 19 nt, Bordetella pertussis
ggccgccggcgcgguggcc

SEQ ID NO: 429297 - RNA, 24 nt, Bordetella pertussis
ggccgccggcgcgguggccaugcu

SEQ ID NO: 429298 - RNA, 13 nt, Bordetella pertussis
ggccgccggcggc

SEQ ID NO: 429299 - RNA, 23 nt, Bordetella pertussis
ggccgccggcggcauucagcgcu

SEQ ID NO: 429300 - RNA, 18 nt, Bordetella pertussis
ggccgccgggucgcugug

SEQ ID NO: 429301 - RNA, 13 nt, Bordetella pertussis
ggccgccgugacu

SEQ ID NO: 429302 - RNA, 22 nt, Bordetella pertussis
ggccgccgugacuucggccgcc

SEQ ID NO: 429303 - RNA, 24 nt, Bordetella pertussis
ggccgccgugacuucggccgccag

SEQ ID NO: 429304 - RNA, 18 nt, Bordetella pertussis
ggccgccuccaggcggcg

SEQ ID NO: 429305 - RNA, 17 nt, Bordetella pertussis
ggccgccugcugcgccg

SEQ ID NO: 429306 - RNA, 22 nt, Bordetella pertussis
ggccgccucggcggccagcgcg

SEQ ID NO: 429307 - RNA, 23 nt, Bordetella pertussis
ggccgccucggcggccagcgcgc

SEQ ID NO: 429308 - RNA, 18 nt, Bordetella pertussis
ggccgccuuuucgcagcg

SEQ ID NO: 429309 - RNA, 19 nt, Bordetella pertussis
ggccgcgaacgcgccggcc

SEQ ID NO: 429310 - RNA, 20 nt, Bordetella pertussis
ggccgcgagcaugcgcagcg

SEQ ID NO: 429311 - RNA, 14 nt, Bordetella pertussis
ggccgcgcccagcg

SEQ ID NO: 429312 - RNA, 14 nt, Bordetella pertussis
ggccgcgcccaggu

SEQ ID NO: 429313 - RNA, 13 nt, Bordetella pertussis
ggccgcgccgccu

SEQ ID NO: 429314 - RNA, 17 nt, Bordetella pertussis
ggccgcgccgcgccggu

SEQ ID NO: 429315 - RNA, 14 nt, Bordetella pertussis
ggccgcgccgcggc

SEQ ID NO: 429316 - RNA, 19 nt, Bordetella pertussis
ggccgcgccgcuggcggcc

SEQ ID NO: 429317 - RNA, 12 nt, Bordetella pertussis
ggccgcgccggc

SEQ ID NO: 429318 - RNA, 13 nt, Bordetella pertussis
ggccgcgccgccg

SEQ ID NO: 429319 - RNA, 19 nt, Bordetella pertussis
ggccgcgcgaugcgcggcc

SEQ ID NO: 429320 - RNA, 20 nt, Bordetella pertussis
ggccgcgcgaugcgcggccc

SEQ ID NO: 429321 - RNA, 15 nt, Bordetella pertussis
ggccgcgcgcaucca

SEQ ID NO: 429322 - RNA, 12 nt, Bordetella pertussis
ggccgcgcgccg

SEQ ID NO: 429323 - RNA, 14 nt, Bordetella pertussis
ggccgcgcgcgcca

SEQ ID NO: 429324 - RNA, 21 nt, Bordetella pertussis
ggccgcgcgguacgcaccgcc

SEQ ID NO: 429325 - RNA, 18 nt, Bordetella pertussis
ggccgcgcucaggccgcu

SEQ ID NO: 429326 - RNA, 21 nt, Bordetella pertussis
ggccgcgcuggcggcgcaggc

SEQ ID NO: 429327 - RNA, 23 nt, Bordetella pertussis
ggccgcgcuggcggcgcaggccg

SEQ ID NO: 429328 - RNA, 15 nt, Bordetella pertussis
ggccgcggccaggcc

SEQ ID NO: 429329 - RNA, 13 nt, Bordetella pertussis
ggccgcggcccag

SEQ ID NO: 429330 - RNA, 13 nt, Bordetella pertussis
ggccgcggcgucc

SEQ ID NO: 429331 - RNA, 18 nt, Bordetella pertussis
ggccgcggcgugcugccc

SEQ ID NO: 429332 - RNA, 14 nt, Bordetella pertussis
ggccgcgggcagca

SEQ ID NO: 429333 - RNA, 22 nt, Bordetella pertussis
ggccgcggucagccagagcggg

SEQ ID NO: 429334 - RNA, 21 nt, Bordetella pertussis
ggccgcgucgaucagcgcggg

SEQ ID NO: 429335 - RNA, 16 nt, Bordetella pertussis
ggccgcgucggccuca

SEQ ID NO: 429336 - RNA, 14 nt, Bordetella pertussis
ggccgcuccagagc

SEQ ID NO: 429337 - RNA, 16 nt, Bordetella pertussis
ggccgcuccagagcgc

SEQ ID NO: 429338 - RNA, 22 nt, Bordetella pertussis
ggccgcugggcacauccagcgc

SEQ ID NO: 429339 - RNA, 21 nt, Bordetella pertussis
ggccgcuguucggcgagccgg

SEQ ID NO: 429340 - RNA, 20 nt, Bordetella pertussis
ggccgcuucggcggccgcgu

SEQ ID NO: 429341 - RNA, 17 nt, Bordetella pertussis
ggccgcuucgugcggcc

SEQ ID NO: 429342 - RNA, 21 nt, Bordetella pertussis
ggccgcuucgugcggccgcag

SEQ ID NO: 429343 - RNA, 17 nt, Bordetella pertussis
ggccgcuuucgaccagc

SEQ ID NO: 429344 - RNA, 23 nt, Bordetella pertussis
ggccgcuuucgaccagcgacagc

SEQ ID NO: 429345 - RNA, 14 nt, Bordetella pertussis
ggccggaacagcgu

SEQ ID NO: 429346 - RNA, 22 nt, Bordetella pertussis
ggccggaacagcguccagccgc

SEQ ID NO: 429347 - RNA, 22 nt, Bordetella pertussis
ggccggacgcaaccggucggcc

SEQ ID NO: 429348 - RNA, 15 nt, Bordetella pertussis
ggccggacagggccg

SEQ ID NO: 429349 - RNA, 17 nt, Bordetella pertussis
ggccggaggccgcccac

SEQ ID NO: 429350 - RNA, 13 nt, Bordetella pertussis
ggccggauccagc

SEQ ID NO: 429351 - RNA, 21 nt, Bordetella pertussis
ggccggaucguagugcguggu

SEQ ID NO: 429352 - RNA, 21 nt, Bordetella pertussis
ggccggcaaggggccagccug

SEQ ID NO: 429353 - RNA, 17 nt, Bordetella pertussis
ggccggcaaggucagca

SEQ ID NO: 429354 - RNA, 20 nt, Bordetella pertussis
ggccggcacgcccagccgca

SEQ ID NO: 429355 - RNA, 21 nt, Bordetella pertussis
ggccggcacguccggcacggc

SEQ ID NO: 429356 - RNA, 15 nt, Bordetella pertussis
ggccggcagcgccuu

SEQ ID NO: 429357 - RNA, 22 nt, Bordetella pertussis
ggccggcagcgcgaccggcgcg

SEQ ID NO: 429358 - RNA, 14 nt, Bordetella pertussis
ggccggcaagaugc

SEQ ID NO: 429359 - RNA, 16 nt, Bordetella pertussis
ggccggcaucgcgcug

SEQ ID NO: 429360 - RNA, 18 nt, Bordetella pertussis
ggccggcaugcgccggcc

SEQ ID NO: 429361 - RNA, 14 nt, Bordetella pertussis
ggccggccaacagc

SEQ ID NO: 429362 - RNA, 13 nt, Bordetella pertussis
ggccggccagcaa

SEQ ID NO: 429363 - RNA, 14 nt, Bordetella pertussis
ggccggccagcaag

SEQ ID NO: 429364 - RNA, 13 nt, Bordetella pertussis
ggccggccaggcg

SEQ ID NO: 429365 - RNA, 14 nt, Bordetella pertussis
ggccggccgccggg

SEQ ID NO: 429366 - RNA, 13 nt, Bordetella pertussis
ggccggccuuggc

SEQ ID NO: 429367 - RNA, 15 nt, Bordetella pertussis
ggccggccugcaggc

SEQ ID NO: 429368 - RNA, 21 nt, Bordetella pertussis
ggccggcgauugcgccagcgc

SEQ ID NO: 429369 - RNA, 13 nt, Bordetella pertussis
ggccggcgcacgc

SEQ ID NO: 429370 - RNA, 16 nt, Bordetella pertussis
ggccggcgccagcauc

SEQ ID NO: 429371 - RNA, 12 nt, Bordetella pertussis
ggccggcgccgg

SEQ ID NO: 429372 - RNA, 13 nt, Bordetella pertussis
ggccggcgccggc

SEQ ID NO: 429373 - RNA, 13 nt, Bordetella pertussis
ggccggcgcgccg

SEQ ID NO: 429374 - RNA, 14 nt, Bordetella pertussis
ggccggcgcgccgg

SEQ ID NO: 429375 - RNA, 16 nt, Bordetella pertussis
ggccggcgcgccggcc

SEQ ID NO: 429376 - RNA, 15 nt, Bordetella pertussis
ggccggcgcgcgcgu

SEQ ID NO: 429377 - RNA, 14 nt, Bordetella pertussis
ggccggcgcgcggc

SEQ ID NO: 429378 - RNA, 15 nt, Bordetella pertussis
ggccggcgcgcggcc

SEQ ID NO: 429379 - RNA, 16 nt, Bordetella pertussis
ggccggcgcgcucgcu

SEQ ID NO: 429380 - RNA, 16 nt, Bordetella pertussis
ggccggcgcggcagcc

SEQ ID NO: 429381 - RNA, 16 nt, Bordetella pertussis
ggccggcgccgguguc

SEQ ID NO: 429382 - RNA, 20 nt, Bordetella pertussis
ggccggcgccuggggcgggc

SEQ ID NO: 429383 - RNA, 17 nt, Bordetella pertussis
ggccggcgcgugcuggc

SEQ ID NO: 429384 - RNA, 17 nt, Bordetella pertussis
ggccggcggccagcgcg

SEQ ID NO: 429385 - RNA, 18 nt, Bordetella pertussis
ggccggcggccagcgcgc

SEQ ID NO: 429386 - RNA, 14 nt, Bordetella pertussis
ggccggcgggggcg

SEQ ID NO: 429387 - RNA, 19 nt, Bordetella pertussis
ggccggcggucgcgcuggc

SEQ ID NO: 429388 - RNA, 16 nt, Bordetella pertussis
ggccggcguugcgccc

SEQ ID NO: 429389 - RNA, 22 nt, Bordetella pertussis
ggccggcuacagcucgccggcg

SEQ ID NO: 429390 - RNA, 13 nt, Bordetella pertussis
ggccggcucgccc

SEQ ID NO: 429391 - RNA, 13 nt, Bordetella pertussis
ggccggcucggcg

SEQ ID NO: 429392 - RNA, 15 nt, Bordetella pertussis
ggccggcucggcggc

SEQ ID NO: 429393 - RNA, 16 nt, Bordetella pertussis
ggccggcucggcggca

SEQ ID NO: 429394 - RNA, 14 nt, Bordetella pertussis
ggccggcugcacca

SEQ ID NO: 429395 - RNA, 12 nt, Bordetella pertussis
ggccggcugccg

SEQ ID NO: 429396 - RNA, 20 nt, Bordetella pertussis
ggccggcuuuggacaggcgu

SEQ ID NO: 429397 - RNA, 23 nt, Bordetella pertussis
ggccgggaccuuggcggcuggcg

SEQ ID NO: 429398 - RNA, 13 nt, Bordetella pertussis
ggccgggagccug

SEQ ID NO: 429399 - RNA, 19 nt, Bordetella pertussis
ggccgggcaggccgcgcug

SEQ ID NO: 429400 - RNA, 14 nt, Bordetella pertussis
ggccgggcaguccu

SEQ ID NO: 429401 - RNA, 12 nt, Bordetella pertussis
ggccgggccagc

SEQ ID NO: 429402 - RNA, 14 nt, Bordetella pertussis
ggccgggccagcgc

SEQ ID NO: 429403 - RNA, 15 nt, Bordetella pertussis
ggccgggccagcgcg

SEQ ID NO: 429404 - RNA, 13 nt, Bordetella pertussis
ggccgggccggcg

SEQ ID NO: 429405 - RNA, 13 nt, Bordetella pertussis
ggccgggccgggc

SEQ ID NO: 429406 - RNA, 15 nt, Bordetella pertussis
ggccgggcgccaggc

SEQ ID NO: 429407 - RNA, 12 nt, Bordetella pertussis
ggccgggcgccc

SEQ ID NO: 429408 - RNA, 15 nt, Bordetella pertussis
ggccgggcgcccagc

SEQ ID NO: 429409 - RNA, 14 nt, Bordetella pertussis
ggccgggcucaggc

SEQ ID NO: 429410 - RNA, 15 nt, Bordetella pertussis
ggccgggcucaggcu

SEQ ID NO: 429411 - RNA, 23 nt, Bordetella pertussis
ggccggggaaacggccaagcagc

SEQ ID NO: 429412 - RNA, 18 nt, Bordetella pertussis
ggccggggaagccgccgg

SEQ ID NO: 429413 - RNA, 22 nt, Bordetella pertussis
ggccggggaagccgccggcgug

SEQ ID NO: 429414 - RNA, 15 nt, Bordetella pertussis
ggccggggcccgcgg

SEQ ID NO: 429415 - RNA, 17 nt, Bordetella pertussis
ggccggggccgcccugg

SEQ ID NO: 429416 - RNA, 23 nt, Bordetella pertussis
ggccggggguuccugcccauggc

SEQ ID NO: 429417 - RNA, 15 nt, Bordetella pertussis
ggccgggucccuggc

SEQ ID NO: 429418 - RNA, 23 nt, Bordetella pertussis
ggccgggucccuggcccuggcgg

SEQ ID NO: 429419 - RNA, 17 nt, Bordetella pertussis
ggccgggucgcgcagca

SEQ ID NO: 429420 - RNA, 20 nt, Bordetella pertussis
ggccgggucgcgcagcaggg

SEQ ID NO: 429421 - RNA, 16 nt, Bordetella pertussis
ggccgguaccagacgg

SEQ ID NO: 429422 - RNA, 15 nt, Bordetella pertussis
ggccggucagcccag

SEQ ID NO: 429423 - RNA, 17 nt, Bordetella pertussis
ggccggugaugcggcgc

SEQ ID NO: 429424 - RNA, 20 nt, Bordetella pertussis
ggccggugaugcggcgcgcc

SEQ ID NO: 429425 - RNA, 21 nt, Bordetella pertussis
ggccggugaugcggcgcgccg

SEQ ID NO: 429426 - RNA, 23 nt, Bordetella pertussis
ggccggugcaucggccggcgguc

SEQ ID NO: 429427 - RNA, 17 nt, Bordetella pertussis
ggccguaaccggccagu

SEQ ID NO: 429428 - RNA, 20 nt, Bordetella pertussis
ggccguaaccggccaguccc

SEQ ID NO: 429429 - RNA, 21 nt, Bordetella pertussis
ggccgguuucggccugcaggc

SEQ ID NO: 429430 - RNA, 19 nt, Bordetella pertussis
ggccguagcguuggcggcc

SEQ ID NO: 429431 - RNA, 16 nt, Bordetella pertussis
ggccgucaacagcaug

SEQ ID NO: 429432 - RNA, 17 nt, Bordetella pertussis
ggccgucaccgccgccg

SEQ ID NO: 429433 - RNA, 13 nt, Bordetella pertussis
ggccgucaggcgu

SEQ ID NO: 429434 - RNA, 16 nt, Bordetella pertussis
ggccguccacgaaggc

SEQ ID NO: 429435 - RNA, 20 nt, Bordetella pertussis
ggccguccacgaaggcagca

SEQ ID NO: 429436 - RNA, 15 nt, Bordetella pertussis
ggccgucgaccgaca

SEQ ID NO: 429437 - RNA, 21 nt, Bordetella pertussis
ggccgucgaccgacagcacau

SEQ ID NO: 429438 - RNA, 14 nt, Bordetella pertussis
ggccgucgagccgg

SEQ ID NO: 429439 - RNA, 21 nt, Bordetella pertussis
ggccgucgagccgggcgccga

SEQ ID NO: 429440 - RNA, 22 nt, Bordetella pertussis
ggccgucgagccgguccgccuc

SEQ ID NO: 429441 - RNA, 13 nt, Bordetella pertussis
ggccgucgccagc

SEQ ID NO: 429442 - RNA, 18 nt, Bordetella pertussis
ggccgucgccgcccaugc

SEQ ID NO: 429443 - RNA, 20 nt, Bordetella pertussis
ggccgucgccuucggcggcg

SEQ ID NO: 429444 - RNA, 14 nt, Bordetella pertussis
ggccgucggggccg

SEQ ID NO: 429445 - RNA, 14 nt, Bordetella pertussis
ggccgucgugcagc

SEQ ID NO: 429446 - RNA, 14 nt, Bordetella pertussis
ggccgugagcgccg

SEQ ID NO: 429447 - RNA, 17 nt, Bordetella pertussis
ggccgugagcgccgccg

SEQ ID NO: 429448 - RNA, 15 nt, Bordetella pertussis
ggccgugacgugcuu

SEQ ID NO: 429449 - RNA, 18 nt, Bordetella pertussis
ggccgugcccgagggcgc

SEQ ID NO: 429450 - RNA, 15 nt, Bordetella pertussis
ggccgugccgcccgg

SEQ ID NO: 429451 - RNA, 17 nt, Bordetella pertussis
ggccgugcgccagcgcc

SEQ ID NO: 429452 - RNA, 13 nt, Bordetella pertussis
ggccguggcccag

SEQ ID NO: 429453 - RNA, 14 nt, Bordetella pertussis
ggccguggcccagc

SEQ ID NO: 429454 - RNA, 17 nt, Bordetella pertussis
ggccguggcccagccgc

SEQ ID NO: 429455 - RNA, 16 nt, Bordetella pertussis
ggccguggcgauccag

SEQ ID NO: 429456 - RNA, 13 nt, Bordetella pertussis
ggccguggcggcc

SEQ ID NO: 429457 - RNA, 18 nt, Bordetella pertussis
ggccguguucgagcaggc

SEQ ID NO: 429458 - RNA, 20 nt, Bordetella pertussis
ggccguuaugguucggccuc

SEQ ID NO: 429459 - RNA, 21 nt, Bordetella pertussis
ggccguuaugguucggccucg

SEQ ID NO: 429460 - RNA, 22 nt, Bordetella pertussis
ggccguuggcgauggcgcggcc

SEQ ID NO: 429461 - RNA, 17 nt, Bordetella pertussis
ggccguuggcgcgccuu

SEQ ID NO: 429462 - RNA, 22 nt, Bordetella pertussis
ggccguuucaggccugcggcgc

SEQ ID NO: 429463 - RNA, 22 nt, Bordetella pertussis
ggccguuuccucuggagacggc

SEQ ID NO: 429464 - RNA, 13 nt, Bordetella pertussis
ggccuagcccggc

SEQ ID NO: 429465 - RNA, 20 nt, Bordetella pertussis
ggccuaugugcaggccaccg

SEQ ID NO: 429466 - RNA, 21 nt, Bordetella pertussis
ggccucaugacggggccuuca

SEQ ID NO: 429467 - RNA, 18 nt, Bordetella pertussis
ggccuccagcaucgccgc

SEQ ID NO: 429468 - RNA, 18 nt, Bordetella pertussis
ggccucccgccgcccggc

SEQ ID NO: 429469 - RNA, 16 nt, Bordetella pertussis
ggccuccgcgcacagc

SEQ ID NO: 429470 - RNA, 22 nt, Bordetella pertussis
ggccuccgcgcacagcgcggcg

SEQ ID NO: 429471 - RNA, 12 nt, Bordetella pertussis
ggccuccugcag

SEQ ID NO: 429472 - RNA, 15 nt, Bordetella pertussis
ggccucgaagcccgg

SEQ ID NO: 429473 - RNA, 21 nt, Bordetella pertussis
ggccucgacggggaaccccgc

SEQ ID NO: 429474 - RNA, 14 nt, Bordetella pertussis
ggccucgcccaugc

SEQ ID NO: 429475 - RNA, 17 nt, Bordetella pertussis
ggccucgcccaugcggg

SEQ ID NO: 429476 - RNA, 14 nt, Bordetella pertussis
ggccucgcccuggc

SEQ ID NO: 429477 - RNA, 17 nt, Bordetella pertussis
ggccucgaugaccgggu

SEQ ID NO: 429478 - RNA, 16 nt, Bordetella pertussis
ggccucgccggccugg

SEQ ID NO: 429479 - RNA, 15 nt, Bordetella pertussis
ggccucgcgcagggc

SEQ ID NO: 429480 - RNA, 19 nt, Bordetella pertussis
ggccucgcggcgcagcaug

SEQ ID NO: 429481 - RNA, 18 nt, Bordetella pertussis
ggccucgcgggccuuggc

SEQ ID NO: 429482 - RNA, 19 nt, Bordetella pertussis
ggccucgcgggccuuggcc

SEQ ID NO: 429483 - RNA, 22 nt, Bordetella pertussis
ggccucgcgggccuuggccagc

SEQ ID NO: 429484 - RNA, 23 nt, Bordetella pertussis
ggccucgcgggccuuggccagca

SEQ ID NO: 429485 - RNA, 20 nt, Bordetella pertussis
ggccucgcugcgggcggccu

SEQ ID NO: 429486 - RNA, 13 nt, Bordetella pertussis
ggccucgcuggag

SEQ ID NO: 429487 - RNA, 17 nt, Bordetella pertussis
ggccucggccauguaga

SEQ ID NO: 429488 - RNA, 14 nt, Bordetella pertussis
ggccucggcggccu

SEQ ID NO: 429489 - RNA, 22 nt, Bordetella pertussis
ggccucggcgggcggcgccagc

SEQ ID NO: 429490 - RNA, 19 nt, Bordetella pertussis
ggccucguaucgccugacg

SEQ ID NO: 429491 - RNA, 16 nt, Bordetella pertussis
ggccucgugcugcugc

SEQ ID NO: 429492 - RNA, 17 nt, Bordetella pertussis
ggccucgugcugcugca

SEQ ID NO: 429493 - RNA, 21 nt, Bordetella pertussis
ggccugacgcgcaagcggccc

SEQ ID NO: 429494 - RNA, 13 nt, Bordetella pertussis
ggccugacgcuca

SEQ ID NO: 429495 - RNA, 16 nt, Bordetella pertussis
ggccugacgggccucg

SEQ ID NO: 429496 - RNA, 22 nt, Bordetella pertussis
ggccugcacggugggcagcagc

SEQ ID NO: 429497 - RNA, 23 nt, Bordetella pertussis
ggccugcacggugggcagcagca

SEQ ID NO: 429498 - RNA, 22 nt, Bordetella pertussis
ggccugcacgucccagucgccg

SEQ ID NO: 429499 - RNA, 23 nt, Bordetella pertussis
ggccugcacgucccagucgccgc

SEQ ID NO: 429500 - RNA, 16 nt, Bordetella pertussis
ggccugcaggcccagc

SEQ ID NO: 429501 - RNA, 18 nt, Bordetella pertussis
ggccugcaggcccagcac

SEQ ID NO: 429502 - RNA, 19 nt, Bordetella pertussis
ggccugcaggcccagcacg

SEQ ID NO: 429503 - RNA, 13 nt, Bordetella pertussis
ggccugcaggccg

SEQ ID NO: 429504 - RNA, 13 nt, Bordetella pertussis
ggccugcaggcuc

SEQ ID NO: 429505 - RNA, 22 nt, Bordetella pertussis
ggccugcaggcucuugaccagc

SEQ ID NO: 429506 - RNA, 13 nt, Bordetella pertussis
ggccugcaggaag

SEQ ID NO: 429507 - RNA, 20 nt, Bordetella pertussis
ggccugcaggugccgccggc

SEQ ID NO: 429508 - RNA, 22 nt, Bordetella pertussis
ggccugccauccggccgcacgc

SEQ ID NO: 429509 - RNA, 14 nt, Bordetella pertussis
ggccugccgcgcgu

SEQ ID NO: 429510 - RNA, 14 nt, Bordetella pertussis
ggccugcgccgccg

SEQ ID NO: 429511 - RNA, 21 nt, Bordetella pertussis
ggccugcgccgccgcgcgcug

SEQ ID NO: 429512 - RNA, 22 nt, Bordetella pertussis
ggccugcgccggcauggccaau

SEQ ID NO: 429513 - RNA, 21 nt, Bordetella pertussis
ggccugcgggugcgccugcag

SEQ ID NO: 429514 - RNA, 22 nt, Bordetella pertussis
ggccugcgggugcgccugcagc

SEQ ID NO: 429515 - RNA, 19 nt, Bordetella pertussis
ggccugcucgccggccagc

SEQ ID NO: 429516 - RNA, 20 nt, Bordetella pertussis
ggccugcucgccggccagcg

SEQ ID NO: 429517 - RNA, 18 nt, Bordetella pertussis
ggccugcucgggcgccuc

SEQ ID NO: 429518 - RNA, 14 nt, Bordetella pertussis
ggccugcugcagcg

SEQ ID NO: 429519 - RNA, 16 nt, Bordetella pertussis
ggccugcugucgcugg

SEQ ID NO: 429520 - RNA, 23 nt, Bordetella pertussis
ggccugcugugcgauggcacggc

SEQ ID NO: 429521 - RNA, 16 nt, Bordetella pertussis
ggccugcuuggcagcc

SEQ ID NO: 429522 - RNA, 19 nt, Bordetella pertussis
ggccugcuuggcagccuug

SEQ ID NO: 429523 - RNA, 22 nt, Bordetella pertussis
ggccugcuuggcgcgcagcagc

SEQ ID NO: 429524 - RNA, 23 nt, Bordetella pertussis
ggccugcuugaagacgcccaggu

SEQ ID NO: 429525 - RNA, 13 nt, Bordetella pertussis
ggccuggaccuga

SEQ ID NO: 429526 - RNA, 19 nt, Bordetella pertussis
ggccuggaugugcaggccg

SEQ ID NO: 429527 - RNA, 23 nt, Bordetella pertussis
ggccuggcgcgcaucggcgccga

SEQ ID NO: 429528 - RNA, 15 nt, Bordetella pertussis
ggccuggcgcgcggc

SEQ ID NO: 429529 - RNA, 16 nt, Bordetella pertussis
ggccuggcgcgcggcc

SEQ ID NO: 429530 - RNA, 21 nt, Bordetella pertussis
ggccuggcgguaugcggcgcc

SEQ ID NO: 429531 - RNA, 22 nt, Bordetella pertussis
ggccuggcucagucggccuggc

SEQ ID NO: 429532 - RNA, 15 nt, Bordetella pertussis
ggccuggccgccggc

SEQ ID NO: 429533 - RNA, 20 nt, Bordetella pertussis
ggccuggccggggaagccgc

SEQ ID NO: 429534 - RNA, 21 nt, Bordetella pertussis
ggccuggcuuggcggccagga

SEQ ID NO: 429535 - RNA, 13 nt, Bordetella pertussis
ggccugggcgcga

SEQ ID NO: 429536 - RNA, 13 nt, Bordetella pertussis
ggccugggcgcgg

SEQ ID NO: 429537 - RNA, 14 nt, Bordetella pertussis
ggccugggcggcgg

SEQ ID NO: 429538 - RNA, 18 nt, Bordetella pertussis
ggccugguuggccgccug

SEQ ID NO: 429539 - RNA, 19 nt, Bordetella pertussis
ggccuuccaaguugcucau

SEQ ID NO: 429540 - RNA, 13 nt, Bordetella pertussis
ggccuuccugcug

SEQ ID NO: 429541 - RNA, 22 nt, Bordetella pertussis
ggccuucuugucgcuggagaac

SEQ ID NO: 429542 - RNA, 21 nt, Bordetella pertussis
ggccuugcccaggcugggcca

SEQ ID NO: 429543 - RNA, 19 nt, Bordetella pertussis
ggccuugcccuuggcggcc

SEQ ID NO: 429544 - RNA, 13 nt, Bordetella pertussis
ggccuugccguug

SEQ ID NO: 429545 - RNA, 16 nt, Bordetella pertussis
ggccuuggccugggcc

SEQ ID NO: 429546 - RNA, 14 nt, Bordetella pertussis
ggccuugggcgcgg

SEQ ID NO: 429547 - RNA, 18 nt, Bordetella pertussis
ggccuugggcgcggcggc

SEQ ID NO: 429548 - RNA, 19 nt, Bordetella pertussis
ggccuugugcgccagcgcg

SEQ ID NO: 429549 - RNA, 22 nt, Bordetella pertussis
ggccuugugcgccgucgcacug

SEQ ID NO: 429550 - RNA, 15 nt, Bordetella pertussis
ggccuuugcggcagg

SEQ ID NO: 429551 - RNA, 14 nt, Bordetella pertussis
ggcgaaauggugcg

SEQ ID NO: 429552 - RNA, 14 nt, Bordetella pertussis
ggcgaacaggcaca

SEQ ID NO: 429553 - RNA, 16 nt, Bordetella pertussis
ggcgaaccgcucagcc

SEQ ID NO: 429554 - RNA, 15 nt, Bordetella pertussis
ggcgaacgugcgcgc

SEQ ID NO: 429555 - RNA, 16 nt, Bordetella pertussis
ggcgaacgugcgcgcc

SEQ ID NO: 429556 - RNA, 20 nt, Bordetella pertussis
ggcgaacgugcgcgccagcu

SEQ ID NO: 429557 - RNA, 18 nt, Bordetella pertussis
ggcgaagccacggcccgc

SEQ ID NO: 429558 - RNA, 15 nt, Bordetella pertussis
ggcgaagccgcagcg

SEQ ID NO: 429559 - RNA, 13 nt, Bordetella pertussis
ggcgaagcgcgcc

SEQ ID NO: 429560 - RNA, 14 nt, Bordetella pertussis
ggcgaaggccagcg

SEQ ID NO: 429561 - RNA, 14 nt, Bordetella pertussis
ggcgaaggccgccg

SEQ ID NO: 429562 - RNA, 15 nt, Bordetella pertussis
ggcgaaggccgccgc

SEQ ID NO: 429563 - RNA, 16 nt, Bordetella pertussis
ggcgaaggcgucggcc

SEQ ID NO: 429564 - RNA, 20 nt, Bordetella pertussis
ggcgaagucauguagcggcc

SEQ ID NO: 429565 - RNA, 15 nt, Bordetella pertussis
ggcgacaccgcggcc

SEQ ID NO: 429566 - RNA, 21 nt, Bordetella pertussis
ggcgaccgcgaaccggugcug

SEQ ID NO: 429567 - RNA, 14 nt, Bordetella pertussis
ggcgaccgccggcc

SEQ ID NO: 429568 - RNA, 14 nt, Bordetella pertussis
ggcgaccggcggca

SEQ ID NO: 429569 - RNA, 17 nt, Bordetella pertussis
ggcgacgaucuccaccc

SEQ ID NO: 429570 - RNA, 19 nt, Bordetella pertussis
ggcgacgacuacgcgcugg

SEQ ID NO: 429571 - RNA, 20 nt, Bordetella pertussis
ggcgacgcaacagacccggg

SEQ ID NO: 429572 - RNA, 18 nt, Bordetella pertussis
ggcgacgccgcggugcug

SEQ ID NO: 429573 - RNA, 16 nt, Bordetella pertussis
ggcgacgcgcugccgg

SEQ ID NO: 429574 - RNA, 19 nt, Bordetella pertussis
ggcgacggcgucggccugg

SEQ ID NO: 429575 - RNA, 13 nt, Bordetella pertussis
ggcgacggucagg

SEQ ID NO: 429576 - RNA, 16 nt, Bordetella pertussis
ggcgacggucaggggc

SEQ ID NO: 429577 - RNA, 16 nt, Bordetella pertussis
ggcgacgguggcuggg

SEQ ID NO: 429578 - RNA, 19 nt, Bordetella pertussis
ggcgacguggugugcgagg

SEQ ID NO: 429579 - RNA, 16 nt, Bordetella pertussis
ggcgacguuggcgaau

SEQ ID NO: 429580 - RNA, 20 nt, Bordetella pertussis
ggcgacugcagcaggcuggg

SEQ ID NO: 429581 - RNA, 22 nt, Bordetella pertussis
ggcgacuuccgcuuccggccgg

SEQ ID NO: 429582 - RNA, 21 nt, Bordetella pertussis
ggcgacuucggcggccaugcc

SEQ ID NO: 429583 - RNA, 14 nt, Bordetella pertussis
ggcgagaggggcuc

SEQ ID NO: 429584 - RNA, 19 nt, Bordetella pertussis
ggcgagcacccgcaggcgg

SEQ ID NO: 429585 - RNA, 22 nt, Bordetella pertussis
ggcgagcccagguugcucgccu

SEQ ID NO: 429586 - RNA, 13 nt, Bordetella pertussis
ggcgagccgauga

SEQ ID NO: 429587 - RNA, 13 nt, Bordetella pertussis
ggcgagccgcgcg

SEQ ID NO: 429588 - RNA, 22 nt, Bordetella pertussis
ggcgagccgggcaccgagccgc

SEQ ID NO: 429589 - RNA, 13 nt, Bordetella pertussis
ggcgagcgcggcg

SEQ ID NO: 429590 - RNA, 22 nt, Bordetella pertussis
ggcgagcgcggcgcgcgccagg

SEQ ID NO: 429591 - RNA, 17 nt, Bordetella pertussis
ggcgagcuggcccuggg

SEQ ID NO: 429592 - RNA, 13 nt, Bordetella pertussis
ggcgaggcgcugg

SEQ ID NO: 429593 - RNA, 15 nt, Bordetella pertussis
ggcgaggccgcccgc

SEQ ID NO: 429594 - RNA, 15 nt, Bordetella pertussis
ggcgaggcggggcug

SEQ ID NO: 429595 - RNA, 16 nt, Bordetella pertussis
ggcgaggcuggcgccc

SEQ ID NO: 429596 - RNA, 12 nt, Bordetella pertussis
ggcgaggucagc

SEQ ID NO: 429597 - RNA, 17 nt, Bordetella pertussis
ggcgauauccagguagg

SEQ ID NO: 429598 - RNA, 20 nt, Bordetella pertussis
ggcgauauccaucggcgcgc

SEQ ID NO: 429599 - RNA, 22 nt, Bordetella pertussis
ggcgauauccaucggcgcgcgc

SEQ ID NO: 429600 - RNA, 21 nt, Bordetella pertussis
ggcgaucaccgacagcgccag

SEQ ID NO: 429601 - RNA, 15 nt, Bordetella pertussis
ggcgaucaggccgcc

SEQ ID NO: 429602 - RNA, 19 nt, Bordetella pertussis
ggcgaucaugcaguacagg

SEQ ID NO: 429603 - RNA, 14 nt, Bordetella pertussis
ggcgauccaggcca

SEQ ID NO: 429604 - RNA, 15 nt, Bordetella pertussis
ggcgauccaggccac

SEQ ID NO: 429605 - RNA, 20 nt, Bordetella pertussis
ggcgauccauguggccagcu

SEQ ID NO: 429606 - RNA, 20 nt, Bordetella pertussis
ggcgauccgccgcggccagc

SEQ ID NO: 429607 - RNA, 22 nt, Bordetella pertussis
ggcgaucgaauggucggccucg

SEQ ID NO: 429608 - RNA, 13 nt, Bordetella pertussis
ggcgaucgucacc

SEQ ID NO: 429609 - RNA, 22 nt, Bordetella pertussis
ggcgaucucguccugcaggaag

SEQ ID NO: 429610 - RNA, 17 nt, Bordetella pertussis
ggcgaucuucagcacca

SEQ ID NO: 429611 - RNA, 15 nt, Bordetella pertussis
ggcgaucuucugggc

SEQ ID NO: 429612 - RNA, 18 nt, Bordetella pertussis
ggcgaugaagucgcggcc

SEQ ID NO: 429613 - RNA, 22 nt, Bordetella pertussis
ggcgaugaacagcggcacgccg

SEQ ID NO: 429614 - RNA, 20 nt, Bordetella pertussis
ggcgaugaccucggcgagcg

SEQ ID NO: 429615 - RNA, 19 nt, Bordetella pertussis
ggcgaugauggggucgccg

SEQ ID NO: 429616 - RNA, 19 nt, Bordetella pertussis
ggcgaugcauucggcggcc

SEQ ID NO: 429617 - RNA, 23 nt, Bordetella pertussis
ggcgaugcccaccagccgcccgg

SEQ ID NO: 429618 - RNA, 21 nt, Bordetella pertussis
ggcgaugcccagcgccgccga

SEQ ID NO: 429619 - RNA, 17 nt, Bordetella pertussis
ggcgaugccggccagca

SEQ ID NO: 429620 - RNA, 16 nt, Bordetella pertussis
ggcgaugccguacuug

SEQ ID NO: 429621 - RNA, 13 nt, Bordetella pertussis
ggcgaugcgcggg

SEQ ID NO: 429622 - RNA, 13 nt, Bordetella pertussis
ggcgaugcugccg

SEQ ID NO: 429623 - RNA, 17 nt, Bordetella pertussis
ggcgauggccgccagcg

SEQ ID NO: 429624 - RNA, 24 nt, Bordetella pertussis
ggcgauggccgggagcggccagca

SEQ ID NO: 429625 - RNA, 13 nt, Bordetella pertussis
ggcgauggcgcgc

SEQ ID NO: 429626 - RNA, 16 nt, Bordetella pertussis
ggcgauggccgccagc

SEQ ID NO: 429627 - RNA, 16 nt, Bordetella pertussis
ggcgaugguggauccg

SEQ ID NO: 429628 - RNA, 17 nt, Bordetella pertussis
ggcgauguagggcagcu

SEQ ID NO: 429629 - RNA, 22 nt, Bordetella pertussis
ggcgauguccugguugccgagg

SEQ ID NO: 429630 - RNA, 16 nt, Bordetella pertussis
ggcgauugcgccagcg

SEQ ID NO: 429631 - RNA, 18 nt, Bordetella pertussis
ggcgcaacgggccgagug

SEQ ID NO: 429632 - RNA, 15 nt, Bordetella pertussis
ggcgcaagaucugga

SEQ ID NO: 429633 - RNA, 20 nt, Bordetella pertussis
ggcgcaaggcaugcgccagc

SEQ ID NO: 429634 - RNA, 21 nt, Bordetella pertussis
ggcgcaaggcaugcgccagcg

SEQ ID NO: 429635 - RNA, 23 nt, Bordetella pertussis
ggcgcacaaucugcgucgccugg

SEQ ID NO: 429636 - RNA, 17 nt, Bordetella pertussis
ggcgcaccagguuggcg

SEQ ID NO: 429637 - RNA, 21 nt, Bordetella pertussis
ggcgcaccaugcggugcgccc

SEQ ID NO: 429638 - RNA, 15 nt, Bordetella pertussis
ggcgcaccgacagca

SEQ ID NO: 429639 - RNA, 18 nt, Bordetella pertussis
ggcgcaccgucacgcgcu

SEQ ID NO: 429640 - RNA, 23 nt, Bordetella pertussis
ggcgcaccucguaaguggcggcg

SEQ ID NO: 429641 - RNA, 15 nt, Bordetella pertussis
ggcgcacgccgggcg

SEQ ID NO: 429642 - RNA, 20 nt, Bordetella pertussis
ggcgcacgccgggcgcggcc

SEQ ID NO: 429643 - RNA, 23 nt, Bordetella pertussis
ggcgcacgccgggcgcggccgcc

SEQ ID NO: 429644 - RNA, 21 nt, Bordetella pertussis
ggcgcagaugggcggcgacga

SEQ ID NO: 429645 - RNA, 15 nt, Bordetella pertussis
ggcgcagcaccaggc

SEQ ID NO: 429646 - RNA, 22 nt, Bordetella pertussis
ggcgcagcagcgccggcaggcg

SEQ ID NO: 429647 - RNA, 21 nt, Bordetella pertussis
ggcgcagcaggcgcgcggccu

SEQ ID NO: 429648 - RNA, 22 nt, Bordetella pertussis
ggcgcagcaucuugcgccgcug

SEQ ID NO: 429649 - RNA, 22 nt, Bordetella pertussis
ggcgcagcccacucagggcggg

SEQ ID NO: 429650 - RNA, 13 nt, Bordetella pertussis
ggcgcagccgcgc

SEQ ID NO: 429651 - RNA, 14 nt, Bordetella pertussis
ggcgcagccgcgcg

SEQ ID NO: 429652 - RNA, 14 nt, Bordetella pertussis
ggcgcagcggcggc

SEQ ID NO: 429653 - RNA, 15 nt, Bordetella pertussis
ggcgcagcggcggcg

SEQ ID NO: 429654 - RNA, 21 nt, Bordetella pertussis
ggcgcagcuccgggucgagcg

SEQ ID NO: 429655 - RNA, 17 nt, Bordetella pertussis
ggcgcaggaugcgcugg

SEQ ID NO: 429656 - RNA, 19 nt, Bordetella pertussis
ggcgcaggaugcgcuggcc

SEQ ID NO: 429657 - RNA, 20 nt, Bordetella pertussis
ggcgcaggaugcgcuggccg

SEQ ID NO: 429658 - RNA, 16 nt, Bordetella pertussis
ggcgcaggccagcgcc

SEQ ID NO: 429659 - RNA, 14 nt, Bordetella pertussis
ggcgcaggccgacg

SEQ ID NO: 429660 - RNA, 14 nt, Bordetella pertussis
ggcgcaggccggcg

SEQ ID NO: 429661 - RNA, 19 nt, Bordetella pertussis
ggcgcaggccggcggccag

SEQ ID NO: 429662 - RNA, 20 nt, Bordetella pertussis
ggcgcaggcguuucgccagg

SEQ ID NO: 429663 - RNA, 15 nt, Bordetella pertussis
ggcgcaggcgcgcgc

SEQ ID NO: 429664 - RNA, 17 nt, Bordetella pertussis
ggcgcaggcgcgcgccu

SEQ ID NO: 429665 - RNA, 12 nt, Bordetella pertussis
ggcgcaggucca

SEQ ID NO: 429666 - RNA, 17 nt, Bordetella pertussis
ggcgcagguccaccgcc

SEQ ID NO: 429667 - RNA, 19 nt, Bordetella pertussis
ggcgcaguaucccggccag

SEQ ID NO: 429668 - RNA, 22 nt, Bordetella pertussis
ggcgcaguaucccggccaggcg

SEQ ID NO: 429669 - RNA, 23 nt, Bordetella pertussis
ggcgcaguaucccggccaggcgc

SEQ ID NO: 429670 - RNA, 15 nt, Bordetella pertussis
ggcgcagucgagcac

SEQ ID NO: 429671 - RNA, 19 nt, Bordetella pertussis
ggcgcagucgagcaccgcg

SEQ ID NO: 429672 - RNA, 18 nt, Bordetella pertussis
ggcgcaguuccggcgggc

SEQ ID NO: 429673 - RNA, 17 nt, Bordetella pertussis
ggcgcauagcgaaagcc

SEQ ID NO: 429674 - RNA, 19 nt, Bordetella pertussis
ggcgcauauggagccaggc

SEQ ID NO: 429675 - RNA, 16 nt, Bordetella pertussis
ggcgcauccagcucgg

SEQ ID NO: 429676 - RNA, 19 nt, Bordetella pertussis
ggcgcaucgacagcgcgcc

SEQ ID NO: 429677 - RNA, 15 nt, Bordetella pertussis
ggcgcaucggcgcca

SEQ ID NO: 429678 - RNA, 17 nt, Bordetella pertussis
ggcgcaucucgucgagg

SEQ ID NO: 429679 - RNA, 18 nt, Bordetella pertussis
ggcgcaucucgucgagga

SEQ ID NO: 429680 - RNA, 16 nt, Bordetella pertussis
ggcgcaugagccggca

SEQ ID NO: 429681 - RNA, 16 nt, Bordetella pertussis
ggcgcaugcagccgca

SEQ ID NO: 429682 - RNA, 13 nt, Bordetella pertussis
ggcgcaugcugcg

SEQ ID NO: 429683 - RNA, 21 nt, Bordetella pertussis
ggcgcaugcugcgcgaggugg

SEQ ID NO: 429684 - RNA, 16 nt, Bordetella pertussis
ggcgcauggcuggucc

SEQ ID NO: 429685 - RNA, 22 nt, Bordetella pertussis
ggcgcaugcgcgcggcucgccg

SEQ ID NO: 429686 - RNA, 22 nt, Bordetella pertussis
ggcgcauucgcgccugagcugc

SEQ ID NO: 429687 - RNA, 21 nt, Bordetella pertussis
ggcgccaccuucgccgcgcac

SEQ ID NO: 429688 - RNA, 12 nt, Bordetella pertussis
ggcgccacggcu

SEQ ID NO: 429689 - RNA, 12 nt, Bordetella pertussis
ggcgccacugcc

SEQ ID NO: 429690 - RNA, 15 nt, Bordetella pertussis
ggcgccacugccagg

SEQ ID NO: 429691 - RNA, 13 nt, Bordetella pertussis
ggcgccagcagca

SEQ ID NO: 429692 - RNA, 12 nt, Bordetella pertussis
ggcgccagcaug

SEQ ID NO: 429693 - RNA, 21 nt, Bordetella pertussis
ggcgccagcaugcgcgcggcc

SEQ ID NO: 429694 - RNA, 22 nt, Bordetella pertussis
ggcgccagcaugcgcgcggccu

SEQ ID NO: 429695 - RNA, 22 nt, Bordetella pertussis
ggcgccagcccgcccgcgagcg

SEQ ID NO: 429696 - RNA, 15 nt, Bordetella pertussis
ggcgccagcagcggg

SEQ ID NO: 429697 - RNA, 21 nt, Bordetella pertussis
ggcgccagcgcuucgggcagc

SEQ ID NO: 429698 - RNA, 20 nt, Bordetella pertussis
ggcgccaguccccaugcggg

SEQ ID NO: 429699 - RNA, 16 nt, Bordetella pertussis
ggcgccaugaccacgu

SEQ ID NO: 429700 - RNA, 20 nt, Bordetella pertussis
ggcgccaugccgcgcccgcc

SEQ ID NO: 429701 - RNA, 14 nt, Bordetella pertussis
ggcgccaugccggg

SEQ ID NO: 429702 - RNA, 20 nt, Bordetella pertussis
ggcgccaugcgacagcccgg

SEQ ID NO: 429703 - RNA, 21 nt, Bordetella pertussis
ggcgccaugcgacagcccggg

SEQ ID NO: 429704 - RNA, 17 nt, Bordetella pertussis
ggcgccaugcgcccggc

SEQ ID NO: 429705 - RNA, 13 nt, Bordetella pertussis
ggcgccaugcugg

SEQ ID NO: 429706 - RNA, 16 nt, Bordetella pertussis
ggcgccaugcuggccg

SEQ ID NO: 429707 - RNA, 22 nt, Bordetella pertussis
ggcgccaugugcguugccagcc

SEQ ID NO: 429708 - RNA, 21 nt, Bordetella pertussis
ggcgcccaacccaggucgccg

SEQ ID NO: 429709 - RNA, 13 nt, Bordetella pertussis
ggcgcccacggcc

SEQ ID NO: 429710 - RNA, 11 nt, Bordetella pertussis
ggcgcccagcg

SEQ ID NO: 429711 - RNA, 13 nt, Bordetella pertussis
ggcgcccagcgcc

SEQ ID NO: 429712 - RNA, 17 nt, Bordetella pertussis
ggcgcccagcuccaccc

SEQ ID NO: 429713 - RNA, 19 nt, Bordetella pertussis
ggcgccccaggcgucggcg

SEQ ID NO: 429714 - RNA, 22 nt, Bordetella pertussis
ggcgcccgacggcgcgcccgcc

SEQ ID NO: 429715 - RNA, 19 nt, Bordetella pertussis
ggcgcccgccugcgccagc

SEQ ID NO: 429716 - RNA, 23 nt, Bordetella pertussis
ggcgcccgccugcgccagccgcg

SEQ ID NO: 429717 - RNA, 21 nt, Bordetella pertussis
ggcgcccgccugcguggcggg

SEQ ID NO: 429718 - RNA, 16 nt, Bordetella pertussis
ggcgcccgcggccugc

SEQ ID NO: 429719 - RNA, 20 nt, Bordetella pertussis
ggcgcccgccgccgggcgcg

SEQ ID NO: 429720 - RNA, 22 nt, Bordetella pertussis
ggcgcccggccugcgggcgccg

SEQ ID NO: 429721 - RNA, 14 nt, Bordetella pertussis
ggcgcccggcggcg

SEQ ID NO: 429722 - RNA, 14 nt, Bordetella pertussis
ggcgcccgggcugc

SEQ ID NO: 429723 - RNA, 16 nt, Bordetella pertussis
ggcgcccgggcugccg

SEQ ID NO: 429724 - RNA, 13 nt, Bordetella pertussis
ggcgcccgugcgc

SEQ ID NO: 429725 - RNA, 17 nt, Bordetella pertussis
ggcgcccgugcgcggcg

SEQ ID NO: 429726 - RNA, 22 nt, Bordetella pertussis
ggcgcccucuuucgccgcgcgc

SEQ ID NO: 429727 - RNA, 22 nt, Bordetella pertussis
ggcgcccuugaugccgucggcg

SEQ ID NO: 429728 - RNA, 22 nt, Bordetella pertussis
ggcgccgacccugcccggcagg

SEQ ID NO: 429729 - RNA, 15 nt, Bordetella pertussis
ggcgccgaccgggcc

SEQ ID NO: 429730 - RNA, 24 nt, Bordetella pertussis
ggcgccgacgaugccgcccacgcc

SEQ ID NO: 429731 - RNA, 14 nt, Bordetella pertussis
ggcgccgacgcgcu

SEQ ID NO: 429732 - RNA, 13 nt, Bordetella pertussis
ggcgccgacggcg

SEQ ID NO: 429733 - RNA, 16 nt, Bordetella pertussis
ggcgccgagggccgcg

SEQ ID NO: 429734 - RNA, 17 nt, Bordetella pertussis
ggcgccgaucagcaggu

SEQ ID NO: 429735 - RNA, 16 nt, Bordetella pertussis
ggcgccgauccagggc

SEQ ID NO: 429736 - RNA, 19 nt, Bordetella pertussis
ggcgccgcaacgccgggcc

SEQ ID NO: 429737 - RNA, 14 nt, Bordetella pertussis
ggcgccgccccguc

SEQ ID NO: 429738 - RNA, 17 nt, Bordetella pertussis
ggcgccgccgcccggca

SEQ ID NO: 429739 - RNA, 13 nt, Bordetella pertussis
ggcgccgccggcg

SEQ ID NO: 429740 - RNA, 19 nt, Bordetella pertussis
ggcgccgccggcggccugg

SEQ ID NO: 429741 - RNA, 16 nt, Bordetella pertussis
ggcgccgccggguuuc

SEQ ID NO: 429742 - RNA, 20 nt, Bordetella pertussis
ggcgccgccucaggccggcg

SEQ ID NO: 429743 - RNA, 12 nt, Bordetella pertussis
ggcgccgcgcac

SEQ ID NO: 429744 - RNA, 18 nt, Bordetella pertussis
ggcgccgcgcccggccgg

SEQ ID NO: 429745 - RNA, 22 nt, Bordetella pertussis
ggcgccgcgcccguccacggcc

SEQ ID NO: 429746 - RNA, 13 nt, Bordetella pertussis
ggcgccgcgccgc

SEQ ID NO: 429747 - RNA, 14 nt, Bordetella pertussis
ggcgccgcgccggg

SEQ ID NO: 429748 - RNA, 16 nt, Bordetella pertussis
ggcgccgcgccggggc

SEQ ID NO: 429749 - RNA, 16 nt, Bordetella pertussis
ggcgccgcgcgcggcc

SEQ ID NO: 429750 - RNA, 22 nt, Bordetella pertussis
ggcgccgcgcucgcgccaggcc

SEQ ID NO: 429751 - RNA, 18 nt, Bordetella pertussis
ggcgccgcgcugauccug

SEQ ID NO: 429752 - RNA, 14 nt, Bordetella pertussis
ggcgccgcgggccu

SEQ ID NO: 429753 - RNA, 13 nt, Bordetella pertussis
ggcgccgcggggc

SEQ ID NO: 429754 - RNA, 14 nt, Bordetella pertussis
ggcgccgcggggcg

SEQ ID NO: 429755 - RNA, 22 nt, Bordetella pertussis
ggcgccgcguccggcgcccgcc

SEQ ID NO: 429756 - RNA, 21 nt, Bordetella pertussis
ggcgccgcguucacgccggcg

SEQ ID NO: 429757 - RNA, 13 nt, Bordetella pertussis
ggcgccgcucagc

SEQ ID NO: 429758 - RNA, 15 nt, Bordetella pertussis
ggcgccgcgggggug

SEQ ID NO: 429759 - RNA, 19 nt, Bordetella pertussis
ggcgccggacugggcgucg

SEQ ID NO: 429760 - RNA, 13 nt, Bordetella pertussis
ggcgccggccacc

SEQ ID NO: 429761 - RNA, 16 nt, Bordetella pertussis
ggcgccggccagcgcg

SEQ ID NO: 429762 - RNA, 20 nt, Bordetella pertussis
ggcgccggccagcgcgccgg

SEQ ID NO: 429763 - RNA, 13 nt, Bordetella pertussis
ggcgccggccagg

SEQ ID NO: 429764 - RNA, 15 nt, Bordetella pertussis
ggcgccggccaggcc

SEQ ID NO: 429765 - RNA, 13 nt, Bordetella pertussis
ggcgccggccgcc

SEQ ID NO: 429766 - RNA, 20 nt, Bordetella pertussis
ggcgccggccgcccgccugc

SEQ ID NO: 429767 - RNA, 16 nt, Bordetella pertussis
ggcgccggccgcgcgc

SEQ ID NO: 429768 - RNA, 13 nt, Bordetella pertussis
ggcgccggccucc

SEQ ID NO: 429769 - RNA, 17 nt, Bordetella pertussis
ggcgccggaucggccgg

SEQ ID NO: 429770 - RNA, 21 nt, Bordetella pertussis
ggcgccggcgcccggcagccg

SEQ ID NO: 429771 - RNA, 14 nt, Bordetella pertussis
ggcgccggcgccgg

SEQ ID NO: 429772 - RNA, 16 nt, Bordetella pertussis
ggcgccggcgccgggc

SEQ ID NO: 429773 - RNA, 13 nt, Bordetella pertussis
ggcgccggcggcc

SEQ ID NO: 429774 - RNA, 16 nt, Bordetella pertussis
ggcgccggcggccucc

SEQ ID NO: 429775 - RNA, 15 nt, Bordetella pertussis
ggcgccggcggcgau

SEQ ID NO: 429776 - RNA, 22 nt, Bordetella pertussis
ggcgccggcggcgaugcgggcc

SEQ ID NO: 429777 - RNA, 22 nt, Bordetella pertussis
ggcgccggcgucacgcggccgg

SEQ ID NO: 429778 - RNA, 14 nt, Bordetella pertussis
ggcgccggcgucca

SEQ ID NO: 429779 - RNA, 14 nt, Bordetella pertussis
ggcgccgggcagcc

SEQ ID NO: 429780 - RNA, 23 nt, Bordetella pertussis
ggcgccgggcgacggcgugcugc

SEQ ID NO: 429781 - RNA, 13 nt, Bordetella pertussis
ggcgccgggcugg

SEQ ID NO: 429782 - RNA, 20 nt, Bordetella pertussis
ggcgccggugaccgccagca

SEQ ID NO: 429783 - RNA, 19 nt, Bordetella pertussis
ggcgccgucgaagccggcg

SEQ ID NO: 429784 - RNA, 21 nt, Bordetella pertussis
ggcgccgucgaagccggcgcc

SEQ ID NO: 429785 - RNA, 17 nt, Bordetella pertussis
ggcgccgguccagcgcc

SEQ ID NO: 429786 - RNA, 15 nt, Bordetella pertussis
ggcgccgugcuggag

SEQ ID NO: 429787 - RNA, 19 nt, Bordetella pertussis
ggcgccgugcuggaggugc

SEQ ID NO: 429788 - RNA, 20 nt, Bordetella pertussis
ggcgccguucgucgcgcagc

SEQ ID NO: 429789 - RNA, 23 nt, Bordetella pertussis
ggcgccguucgucgcgcagcagg

SEQ ID NO: 429790 - RNA, 16 nt, Bordetella pertussis
ggcgccuacggcggcg

SEQ ID NO: 429791 - RNA, 23 nt, Bordetella pertussis
ggcgccucgaacguccgccccau

SEQ ID NO: 429792 - RNA, 15 nt, Bordetella pertussis
ggcgccucgguccag

SEQ ID NO: 429793 - RNA, 23 nt, Bordetella pertussis
ggcgccucguccugcaggcggcg

SEQ ID NO: 429794 - RNA, 19 nt, Bordetella pertussis
ggcgccugagccgauacag

SEQ ID NO: 429795 - RNA, 14 nt, Bordetella pertussis
ggcgccugccccgc

SEQ ID NO: 429796 - RNA, 15 nt, Bordetella pertussis
ggcgccugccccgcc

SEQ ID NO: 429797 - RNA, 18 nt, Bordetella pertussis
ggcgccugccccggcaga

SEQ ID NO: 429798 - RNA, 24 nt, Bordetella pertussis
ggcgccugcgccaccuggcgcccg

SEQ ID NO: 429799 - RNA, 21 nt, Bordetella pertussis
ggcgccugcgcgcgcuggggc

SEQ ID NO: 429800 - RNA, 22 nt, Bordetella pertussis
ggcgccugcggcaggccgcagc

SEQ ID NO: 429801 - RNA, 14 nt, Bordetella pertussis
ggcgccugcggggc

SEQ ID NO: 429802 - RNA, 13 nt, Bordetella pertussis
ggcgccuggggcg

SEQ ID NO: 429803 - RNA, 14 nt, Bordetella pertussis
ggcgccuggggcgu

SEQ ID NO: 429804 - RNA, 22 nt, Bordetella pertussis
ggcgccugguacgacagcucgg

SEQ ID NO: 429805 - RNA, 19 nt, Bordetella pertussis
ggcgccuggucgcgcgccu

SEQ ID NO: 429806 - RNA, 15 nt, Bordetella pertussis
ggcgccuguccccgc

SEQ ID NO: 429807 - RNA, 16 nt, Bordetella pertussis
ggcgccuuccggcagc

SEQ ID NO: 429808 - RNA, 23 nt, Bordetella pertussis
ggcgccuuccggcagcggccagc

SEQ ID NO: 429809 - RNA, 22 nt, Bordetella pertussis
ggcgccuucgaucuucucgccg

SEQ ID NO: 429810 - RNA, 15 nt, Bordetella pertussis
ggcgccuucggcgcg

SEQ ID NO: 429811 - RNA, 22 nt, Bordetella pertussis
ggcgccuucggcgcggcgggcg

SEQ ID NO: 429812 - RNA, 15 nt, Bordetella pertussis
ggcgccuugccgccg

SEQ ID NO: 429813 - RNA, 12 nt, Bordetella pertussis
ggcgcgaaacug

SEQ ID NO: 429814 - RNA, 19 nt, Bordetella pertussis
ggcgcgaacaccggcaggc

SEQ ID NO: 429815 - RNA, 21 nt, Bordetella pertussis
ggcgcgaacaccggcaggccg

SEQ ID NO: 429816 - RNA, 22 nt, Bordetella pertussis
ggcgcgaccgccuccagcgcgg

SEQ ID NO: 429817 - RNA, 18 nt, Bordetella pertussis
ggcgcgacgccagcgcgc

SEQ ID NO: 429818 - RNA, 12 nt, Bordetella pertussis
ggcgcgagcgca

SEQ ID NO: 429819 - RNA, 17 nt, Bordetella pertussis
ggcgcgagcgcacaggc

SEQ ID NO: 429820 - RNA, 14 nt, Bordetella pertussis
ggcgcgagcgccgg

SEQ ID NO: 429821 - RNA, 11 nt, Bordetella pertussis
ggcgcgagcgu

SEQ ID NO: 429822 - RNA, 21 nt, Bordetella pertussis
ggcgcgaggcggcgacgcagc

SEQ ID NO: 429823 - RNA, 21 nt, Bordetella pertussis
ggcgcgauggucaccacccgc

SEQ ID NO: 429824 - RNA, 17 nt, Bordetella pertussis
ggcgcgcaaccaggggc

SEQ ID NO: 429825 - RNA, 21 nt, Bordetella pertussis
ggcgcgcaaccaggggcggcg

SEQ ID NO: 429826 - RNA, 14 nt, Bordetella pertussis
ggcgcgcaccagcc

SEQ ID NO: 429827 - RNA, 21 nt, Bordetella pertussis
ggcgcgcaccaucgccgagcc

SEQ ID NO: 429828 - RNA, 18 nt, Bordetella pertussis
ggcgcgcaccugggaggg

SEQ ID NO: 429829 - RNA, 16 nt, Bordetella pertussis
ggcgcgcacgcucugc

SEQ ID NO: 429830 - RNA, 14 nt, Bordetella pertussis
ggcgcgcagcacau

SEQ ID NO: 429831 - RNA, 19 nt, Bordetella pertussis
ggcgcgcagcacauagggc

SEQ ID NO: 429832 - RNA, 14 nt, Bordetella pertussis
ggcgcgcagcacgc

SEQ ID NO: 429833 - RNA, 16 nt, Bordetella pertussis
ggcgcgcagcacgccg

SEQ ID NO: 429834 - RNA, 12 nt, Bordetella pertussis
ggcgcgcagcag

SEQ ID NO: 429835 - RNA, 18 nt, Bordetella pertussis
ggcgcgcacgggcgaggc

SEQ ID NO: 429836 - RNA, 13 nt, Bordetella pertussis
ggcgcgcaggccu

SEQ ID NO: 429837 - RNA, 13 nt, Bordetella pertussis
ggcgcgcaggcgg

SEQ ID NO: 429838 - RNA, 17 nt, Bordetella pertussis
ggcgcgcaggcgggccu

SEQ ID NO: 429839 - RNA, 17 nt, Bordetella pertussis
ggcgcgcaucggcgccg

SEQ ID NO: 429840 - RNA, 21 nt, Bordetella pertussis
ggcgcgcaucggcgccgagca

SEQ ID NO: 429841 - RNA, 20 nt, Bordetella pertussis
ggcgcgcaucgucaggcagg

SEQ ID NO: 429842 - RNA, 21 nt, Bordetella pertussis
ggcgcgcaucgucaggcaggc

SEQ ID NO: 429843 - RNA, 19 nt, Bordetella pertussis
ggcgcgccaccggucgccg

SEQ ID NO: 429844 - RNA, 16 nt, Bordetella pertussis
ggcgcgccagcccgcc

SEQ ID NO: 429845 - RNA, 16 nt, Bordetella pertussis
ggcgcgccagcucgcg

SEQ ID NO: 429846 - RNA, 17 nt, Bordetella pertussis
ggcgcgccaggaagcgc

SEQ ID NO: 429847 - RNA, 20 nt, Bordetella pertussis
ggcgcgccaugucggggcuu

SEQ ID NO: 429848 - RNA, 15 nt, Bordetella pertussis
ggcgcgcccagcggc

SEQ ID NO: 429849 - RNA, 18 nt, Bordetella pertussis
ggcgcgcccagcggcagg

SEQ ID NO: 429850 - RNA, 21 nt, Bordetella pertussis
ggcgcgcaguugcgucuccag

SEQ ID NO: 429851 - RNA, 13 nt, Bordetella pertussis
ggcgcgcccaggg

SEQ ID NO: 429852 - RNA, 15 nt, Bordetella pertussis
ggcgcgcccaggggc

SEQ ID NO: 429853 - RNA, 17 nt, Bordetella pertussis
ggcgcgcccgcaggcgg

SEQ ID NO: 429854 - RNA, 14 nt, Bordetella pertussis
ggcgcgccgcccgc

SEQ ID NO: 429855 - RNA, 12 nt, Bordetella pertussis
ggcgcgccgccg

SEQ ID NO: 429856 - RNA, 14 nt, Bordetella pertussis
ggcgcgccgcggcg

SEQ ID NO: 429857 - RNA, 22 nt, Bordetella pertussis
ggcgcgccgcugcagcgcuggu

SEQ ID NO: 429858 - RNA, 14 nt, Bordetella pertussis
ggcgcgccggcggg

SEQ ID NO: 429859 - RNA, 20 nt, Bordetella pertussis
ggcgcgccgggccggcgggc

SEQ ID NO: 429860 - RNA, 17 nt, Bordetella pertussis
ggcgcgccgucgcuggg

SEQ ID NO: 429861 - RNA, 18 nt, Bordetella pertussis
ggcgcgccuucggcaggc

SEQ ID NO: 429862 - RNA, 18 nt, Bordetella pertussis
ggcgcgccuugcgcggcg

SEQ ID NO: 429863 - RNA, 14 nt, Bordetella pertussis
ggcgcgcgacggcg

SEQ ID NO: 429864 - RNA, 16 nt, Bordetella pertussis
ggcgcgcgacggcgcc

SEQ ID NO: 429865 - RNA, 21 nt, Bordetella pertussis
ggcgcgcgccaggcccagggc

SEQ ID NO: 429866 - RNA, 16 nt, Bordetella pertussis
ggcgcgccucggcgcg

SEQ ID NO: 429867 - RNA, 14 nt, Bordetella pertussis
ggcgcgcgccgagg

SEQ ID NO: 429868 - RNA, 21 nt, Bordetella pertussis
ggcgcgcgccgaugcgccagg

SEQ ID NO: 429869 - RNA, 16 nt, Bordetella pertussis
ggcgcgcgccggcggc

SEQ ID NO: 429870 - RNA, 13 nt, Bordetella pertussis
ggcgcgcgcgccg

SEQ ID NO: 429871 - RNA, 20 nt, Bordetella pertussis
ggcgcgcgcggcgccgcgcg

SEQ ID NO: 429872 - RNA, 18 nt, Bordetella pertussis
ggcgcgcgcggcgccugg

SEQ ID NO: 429873 - RNA, 19 nt, Bordetella pertussis
ggcgcgcgcggcgccuggg

SEQ ID NO: 429874 - RNA, 19 nt, Bordetella pertussis
ggcgcgcgcguacagccgg

SEQ ID NO: 429875 - RNA, 20 nt, Bordetella pertussis
ggcgcgcgcguacagccggg

SEQ ID NO: 429876 - RNA, 21 nt, Bordetella pertussis
ggcgcgcgcguacagccgggu

SEQ ID NO: 429877 - RNA, 15 nt, Bordetella pertussis
ggcgcgcgcgcgccg

SEQ ID NO: 429878 - RNA, 18 nt, Bordetella pertussis
ggcgcgcgcgcgccgcac

SEQ ID NO: 429879 - RNA, 14 nt, Bordetella pertussis
ggcgcgcggccgcg

SEQ ID NO: 429880 - RNA, 15 nt, Bordetella pertussis
ggcgcgcggccucga

SEQ ID NO: 429881 - RNA, 14 nt, Bordetella pertussis
ggcgcgcggcuggg

SEQ ID NO: 429882 - RNA, 18 nt, Bordetella pertussis
ggcgcgcggcuggggcug

SEQ ID NO: 429883 - RNA, 17 nt, Bordetella pertussis
ggcgcgcgugcugggcc

SEQ ID NO: 429884 - RNA, 18 nt, Bordetella pertussis
ggcgcgcgugcugggcca

SEQ ID NO: 429885 - RNA, 21 nt, Bordetella pertussis
ggcgcgcucaggccgccggcg

SEQ ID NO: 429886 - RNA, 13 nt, Bordetella pertussis
ggcgcgcucuccg

SEQ ID NO: 429887 - RNA, 22 nt, Bordetella pertussis
ggcgcgcucuccgaacaggcgg

SEQ ID NO: 429888 - RNA, 17 nt, Bordetella pertussis
ggcgcgcugcccagcca

SEQ ID NO: 429889 - RNA, 13 nt, Bordetella pertussis
ggcgcgcucggcg

SEQ ID NO: 429890 - RNA, 15 nt, Bordetella pertussis
ggcgcgcucggcgcc

SEQ ID NO: 429891 - RNA, 16 nt, Bordetella pertussis
ggcgcgcucggcgccg

SEQ ID NO: 429892 - RNA, 13 nt, Bordetella pertussis
ggcgcgcucgcug

SEQ ID NO: 429893 - RNA, 16 nt, Bordetella pertussis
ggcgcgcuucagugcu

SEQ ID NO: 429894 - RNA, 18 nt, Bordetella pertussis
ggcgcgcuugagcggcuc

SEQ ID NO: 429895 - RNA, 21 nt, Bordetella pertussis
ggcgcgcuugagcggcucgcc

SEQ ID NO: 429896 - RNA, 22 nt, Bordetella pertussis
ggcgcgcuugagcggcucgccu

SEQ ID NO: 429897 - RNA, 23 nt, Bordetella pertussis
ggcgcggaccugcucgagcggcg

SEQ ID NO: 429898 - RNA, 21 nt, Bordetella pertussis
ggcgcggaucaugggcucgcg

SEQ ID NO: 429899 - RNA, 14 nt, Bordetella pertussis
ggcgcggcaggcgg

SEQ ID NO: 429900 - RNA, 18 nt, Bordetella pertussis
ggcgcggcagugggcggu

SEQ ID NO: 429901 - RNA, 12 nt, Bordetella pertussis
ggcgcggccagc

SEQ ID NO: 429902 - RNA, 14 nt, Bordetella pertussis
ggcgcggccagggu

SEQ ID NO: 429903 - RNA, 21 nt, Bordetella pertussis
ggcgcggcccgccacgcaggc

SEQ ID NO: 429904 - RNA, 17 nt, Bordetella pertussis
ggcgcggcccggcgucg

SEQ ID NO: 429905 - RNA, 13 nt, Bordetella pertussis
ggcgcggccgggc

SEQ ID NO: 429906 - RNA, 14 nt, Bordetella pertussis
ggcgcggcgcaggc

SEQ ID NO: 429907 - RNA, 22 nt, Bordetella pertussis
ggcgcggcgcaggccugcggcg

SEQ ID NO: 429908 - RNA, 18 nt, Bordetella pertussis
ggcgcggcgcauuggcca

SEQ ID NO: 429909 - RNA, 12 nt, Bordetella pertussis
ggcgcggcgcca

SEQ ID NO: 429910 - RNA, 16 nt, Bordetella pertussis
ggcgcggccuucccaa

SEQ ID NO: 429911 - RNA, 14 nt, Bordetella pertussis
ggcgcggcgcgcgc

SEQ ID NO: 429912 - RNA, 17 nt, Bordetella pertussis
ggcgcggcggccaggcg

SEQ ID NO: 429913 - RNA, 12 nt, Bordetella pertussis
ggcgcggcggcg

SEQ ID NO: 429914 - RNA, 13 nt, Bordetella pertussis
ggcgcggcggcgu

SEQ ID NO: 429915 - RNA, 14 nt, Bordetella pertussis
ggcgcggcucgccg

SEQ ID NO: 429916 - RNA, 20 nt, Bordetella pertussis
ggcgcggcucgccggccgcg

SEQ ID NO: 429917 - RNA, 14 nt, Bordetella pertussis
ggcgcgggccagcu

SEQ ID NO: 429918 - RNA, 17 nt, Bordetella pertussis
ggcgcgggccagcucuu

SEQ ID NO: 429919 - RNA, 17 nt, Bordetella pertussis
ggcgcgggcagcaccgg

SEQ ID NO: 429920 - RNA, 14 nt, Bordetella pertussis
ggcgcgggcggccu

SEQ ID NO: 429921 - RNA, 15 nt, Bordetella pertussis
ggcgcggggcaccgg

SEQ ID NO: 429922 - RNA, 23 nt, Bordetella pertussis
ggcgcggguaggcaaagcgcagc

SEQ ID NO: 429923 - RNA, 18 nt, Bordetella pertussis
ggcgcgguagcgccccuc

SEQ ID NO: 429924 - RNA, 22 nt, Bordetella pertussis
ggcgcgguauggccgcccagca

SEQ ID NO: 429925 - RNA, 23 nt, Bordetella pertussis
ggcgcgguccacgcccuggcugg

SEQ ID NO: 429926 - RNA, 19 nt, Bordetella pertussis
ggcgcggugaggcggccgg

SEQ ID NO: 429927 - RNA, 14 nt, Bordetella pertussis
ggcgcgguggccau

SEQ ID NO: 429928 - RNA, 19 nt, Bordetella pertussis
ggcgcgguggccaugcugg

SEQ ID NO: 429929 - RNA, 19 nt, Bordetella pertussis
ggcgcggugcgcaccaggc

SEQ ID NO: 429930 - RNA, 21 nt, Bordetella pertussis
ggcgcguaauaguggucgccg

SEQ ID NO: 429931 - RNA, 19 nt, Bordetella pertussis
ggcgcgucgccggcgauga

SEQ ID NO: 429932 - RNA, 16 nt, Bordetella pertussis
ggcgcgucgcgcggcg

SEQ ID NO: 429933 - RNA, 21 nt, Bordetella pertussis
ggcgcgucgcgguacaggcug

SEQ ID NO: 429934 - RNA, 13 nt, Bordetella pertussis
ggcgcgugccagc

SEQ ID NO: 429935 - RNA, 15 nt, Bordetella pertussis
ggcgcgugccagcag

SEQ ID NO: 429936 - RNA, 17 nt, Bordetella pertussis
ggcgcgugccagcaggu

SEQ ID NO: 429937 - RNA, 15 nt, Bordetella pertussis
ggcgcgugcgcgcgc

SEQ ID NO: 429938 - RNA, 21 nt, Bordetella pertussis
ggcgcgugcggaugcagcagc

SEQ ID NO: 429939 - RNA, 24 nt, Bordetella pertussis
ggcgcgugcucaucggcaggccgg

SEQ ID NO: 429940 - RNA, 17 nt, Bordetella pertussis
ggcgcguggcgcccagc

SEQ ID NO: 429941 - RNA, 18 nt, Bordetella pertussis
ggcgcguucucagccgcc

SEQ ID NO: 429942 - RNA, 21 nt, Bordetella pertussis
ggcgcguucucagccgcccgc

SEQ ID NO: 429943 - RNA, 23 nt, Bordetella pertussis
ggcgcguucucagccgcccgccg

SEQ ID NO: 429944 - RNA, 23 nt, Bordetella pertussis
ggcgcguugcgcaucgcgcaccc

SEQ ID NO: 429945 - RNA, 22 nt, Bordetella pertussis
ggcgcguugcgcuugcgcuugg

SEQ ID NO: 429946 - RNA, 13 nt, Bordetella pertussis
ggcgcucaagggc

SEQ ID NO: 429947 - RNA, 20 nt, Bordetella pertussis
ggcgcuccagcaccugcacc

SEQ ID NO: 429948 - RNA, 19 nt, Bordetella pertussis
ggcgcuccaugcggcggcg

SEQ ID NO: 429949 - RNA, 24 nt, Bordetella pertussis
ggcgcucgaucggauagcggugca

SEQ ID NO: 429950 - RNA, 19 nt, Bordetella pertussis
ggcgcucgcgcaccgcaug

SEQ ID NO: 429951 - RNA, 13 nt, Bordetella pertussis
ggcgcucgcgccc

SEQ ID NO: 429952 - RNA, 15 nt, Bordetella pertussis
ggcgcucgcgcgcca

SEQ ID NO: 429953 - RNA, 18 nt, Bordetella pertussis
ggcgcucgcgcgccagca

SEQ ID NO: 429954 - RNA, 19 nt, Bordetella pertussis
ggcgcucgcgcgccagcag

SEQ ID NO: 429955 - RNA, 15 nt, Bordetella pertussis
ggcgcucgccccggc

SEQ ID NO: 429956 - RNA, 18 nt, Bordetella pertussis
ggcgcucgccccggcgcg

SEQ ID NO: 429957 - RNA, 14 nt, Bordetella pertussis
ggcgcucgcgcugc

SEQ ID NO: 429958 - RNA, 20 nt, Bordetella pertussis
ggcgcucgcgggugcgcagc

SEQ ID NO: 429959 - RNA, 21 nt, Bordetella pertussis
ggcgcucgcgggugcgcagca

SEQ ID NO: 429960 - RNA, 14 nt, Bordetella pertussis
ggcgcucggccagc

SEQ ID NO: 429961 - RNA, 23 nt, Bordetella pertussis
ggcgcugaugccguaccaggugc

SEQ ID NO: 429962 - RNA, 12 nt, Bordetella pertussis
ggcgcugcagca

SEQ ID NO: 429963 - RNA, 15 nt, Bordetella pertussis
ggcgcugcgcagcag

SEQ ID NO: 429964 - RNA, 18 nt, Bordetella pertussis
ggcgcugcgcagcagggc

SEQ ID NO: 429965 - RNA, 22 nt, Bordetella pertussis
ggcgcugcgcagcagggcggcg

SEQ ID NO: 429966 - RNA, 20 nt, Bordetella pertussis
ggcgcugcgcgaacgcggcc

SEQ ID NO: 429967 - RNA, 23 nt, Bordetella pertussis
ggcgcugcugcuggcugcccugg

SEQ ID NO: 429968 - RNA, 14 nt, Bordetella pertussis
ggcgcugcuggccg

SEQ ID NO: 429969 - RNA, 20 nt, Bordetella pertussis
ggcgcuggauggcucgggca

SEQ ID NO: 429970 - RNA, 19 nt, Bordetella pertussis
ggcgcuggccaucaccgcc

SEQ ID NO: 429971 - RNA, 21 nt, Bordetella pertussis
ggcgcuggccgcccgcggccu

SEQ ID NO: 429972 - RNA, 14 nt, Bordetella pertussis
ggcgcuggcgaaga

SEQ ID NO: 429973 - RNA, 17 nt, Bordetella pertussis
ggcgcuggcgccgcgcg

SEQ ID NO: 429974 - RNA, 16 nt, Bordetella pertussis
ggcgcuggcgcgcggc

SEQ ID NO: 429975 - RNA, 23 nt, Bordetella pertussis
ggcgcuggcuggacgcgcgcggc

SEQ ID NO: 429976 - RNA, 24 nt, Bordetella pertussis
ggcgcuggcuggacgcgcgcggcg

SEQ ID NO: 429977 - RNA, 17 nt, Bordetella pertussis
ggcgcugggcaggcugg

SEQ ID NO: 429978 - RNA, 20 nt, Bordetella pertussis
ggcgcuggggaagcgcucgu

SEQ ID NO: 429979 - RNA, 19 nt, Bordetella pertussis
ggcgcuguccggcgcucgc

SEQ ID NO: 429980 - RNA, 21 nt, Bordetella pertussis
ggcgcuguccggcgcucgccc

SEQ ID NO: 429981 - RNA, 12 nt, Bordetella pertussis
ggcgcugugcaa

SEQ ID NO: 429982 - RNA, 19 nt, Bordetella pertussis
ggcgcuguuggccggcgcg

SEQ ID NO: 429983 - RNA, 20 nt, Bordetella pertussis
ggcgcuguuucccuuccugg

SEQ ID NO: 429984 - RNA, 23 nt, Bordetella pertussis
ggcgcuguuucccuuccuggcca

SEQ ID NO: 429985 - RNA, 20 nt, Bordetella pertussis
ggcgcuguucgauacggcca

SEQ ID NO: 429986 - RNA, 16 nt, Bordetella pertussis
ggcgcuuggccagcug

SEQ ID NO: 429987 - RNA, 17 nt, Bordetella pertussis
ggcgcuuggccagcugg

SEQ ID NO: 429988 - RNA, 18 nt, Bordetella pertussis
ggcgcuuggcccugcagc

SEQ ID NO: 429989 - RNA, 23 nt, Bordetella pertussis
ggcgcuuuccgagccggugggcg

SEQ ID NO: 429990 - RNA, 22 nt, Bordetella pertussis
ggcggaaaacagcaccagcaug

SEQ ID NO: 429991 - RNA, 12 nt, Bordetella pertussis
ggcggaaucuug

SEQ ID NO: 429992 - RNA, 21 nt, Bordetella pertussis
ggcggaaugcggcgacagggc

SEQ ID NO: 429993 - RNA, 22 nt, Bordetella pertussis
ggcggaaugugcgagggcucga

SEQ ID NO: 429994 - RNA, 23 nt, Bordetella pertussis
ggcggaccacacgaucgucagca

SEQ ID NO: 429995 - RNA, 14 nt, Bordetella pertussis
ggcggacaggcccu

SEQ ID NO: 429996 - RNA, 21 nt, Bordetella pertussis
ggcggaucacccagcggcugg

SEQ ID NO: 429997 - RNA, 18 nt, Bordetella pertussis
ggcggaucucggccagca

SEQ ID NO: 429998 - RNA, 20 nt, Bordetella pertussis
ggcggaucucggccagcagc

SEQ ID NO: 429999 - RNA, 22 nt, Bordetella pertussis
ggcggaucuucccgccauggga

SEQ ID NO: 430000 - RNA, 20 nt, Bordetella pertussis
ggcggauucaggcgauccug

SEQ ID NO: 430001 - RNA, 16 nt, Bordetella pertussis
ggcggauuugcucgcg

SEQ ID NO: 430002 - RNA, 18 nt, Bordetella pertussis
ggcggcaaagucggggcg

SEQ ID NO: 430003 - RNA, 23 nt, Bordetella pertussis
ggcggcaaagucggggcgccggu

SEQ ID NO: 430004 - RNA, 21 nt, Bordetella pertussis
ggcggcaagcggcguggggcc

SEQ ID NO: 430005 - RNA, 14 nt, Bordetella pertussis
ggcggcaccagcag

SEQ ID NO: 430006 - RNA, 16 nt, Bordetella pertussis
ggcggcaccagcaggc

SEQ ID NO: 430007 - RNA, 19 nt, Bordetella pertussis
ggcggcaccauugccggcg

SEQ ID NO: 430008 - RNA, 19 nt, Bordetella pertussis
ggcggcacgcugcgcaggc

SEQ ID NO: 430009 - RNA, 19 nt, Bordetella pertussis
ggcggcaucguucaggcgc

SEQ ID NO: 430010 - RNA, 16 nt, Bordetella pertussis
ggcggcaugcgccagc

SEQ ID NO: 430011 - RNA, 13 nt, Bordetella pertussis
ggcggccagcaug

SEQ ID NO: 430012 - RNA, 14 nt, Bordetella pertussis
ggcggccagcaugc

SEQ ID NO: 430013 - RNA, 17 nt, Bordetella pertussis
ggcggccagcaugcugg

SEQ ID NO: 430014 - RNA, 14 nt, Bordetella pertussis
ggcggccagcgcgc

SEQ ID NO: 430015 - RNA, 23 nt, Bordetella pertussis
ggcggccagcuugaccgccagca

SEQ ID NO: 430016 - RNA, 10 nt, Bordetella pertussis
ggcggccagg

SEQ ID NO: 430017 - RNA, 20 nt, Bordetella pertussis
ggcggccaggccggugggcg

SEQ ID NO: 430018 - RNA, 12 nt, Bordetella pertussis
ggcggccaggcg

SEQ ID NO: 430019 - RNA, 12 nt, Bordetella pertussis
ggcggccagggc

SEQ ID NO: 430020 - RNA, 17 nt, Bordetella pertussis
ggcggccaugcccaggc

SEQ ID NO: 430021 - RNA, 21 nt, Bordetella pertussis
ggcggccaugcccaggcccag

SEQ ID NO: 430022 - RNA, 22 nt, Bordetella pertussis
ggcggcccagcggcaaaguagu

SEQ ID NO: 430023 - RNA, 23 nt, Bordetella pertussis
ggcggcccaggcguccaggcugc

SEQ ID NO: 430024 - RNA, 19 nt, Bordetella pertussis
ggcggccccggccgccccc

SEQ ID NO: 430025 - RNA, 14 nt, Bordetella pertussis
ggcggccgaagcgc

SEQ ID NO: 430026 - RNA, 15 nt, Bordetella pertussis
ggcggccgaagcgca

SEQ ID NO: 430027 - RNA, 14 nt, Bordetella pertussis
ggcggccgaccagc

SEQ ID NO: 430028 - RNA, 17 nt, Bordetella pertussis
ggcggccgaccagcacg

SEQ ID NO: 430029 - RNA, 21 nt, Bordetella pertussis
ggcggccgacgggcggcugcu

SEQ ID NO: 430030 - RNA, 13 nt, Bordetella pertussis
ggcggccgccagc

SEQ ID NO: 430031 - RNA, 14 nt, Bordetella pertussis
ggcggccgcccagc

SEQ ID NO: 430032 - RNA, 17 nt, Bordetella pertussis
ggcggccgcgggcagca

SEQ ID NO: 430033 - RNA, 20 nt, Bordetella pertussis
ggcggccgcgggcgugcugg

SEQ ID NO: 430034 - RNA, 14 nt, Bordetella pertussis
ggcggccggcaggc

SEQ ID NO: 430035 - RNA, 14 nt, Bordetella pertussis
ggcggccggcugca

SEQ ID NO: 430036 - RNA, 21 nt, Bordetella pertussis
ggcggccggggccgcccugcc

SEQ ID NO: 430037 - RNA, 13 nt, Bordetella pertussis
ggcggccgucggg

SEQ ID NO: 430038 - RNA, 15 nt, Bordetella pertussis
ggcggccuccagcag

SEQ ID NO: 430039 - RNA, 20 nt, Bordetella pertussis
ggcggccuccagcagggacu

SEQ ID NO: 430040 - RNA, 19 nt, Bordetella pertussis
ggcggccucgacggccgcc

SEQ ID NO: 430041 - RNA, 20 nt, Bordetella pertussis
ggcggccucgacggccgccg

SEQ ID NO: 430042 - RNA, 15 nt, Bordetella pertussis
ggcggccuccgcgca

SEQ ID NO: 430043 - RNA, 21 nt, Bordetella pertussis
ggcggccucggccagcuggga

SEQ ID NO: 430044 - RNA, 17 nt, Bordetella pertussis
ggcggccucgggcaacu

SEQ ID NO: 430045 - RNA, 14 nt, Bordetella pertussis
ggcggccugcaggc

SEQ ID NO: 430046 - RNA, 16 nt, Bordetella pertussis
ggcggccugcaggccg

SEQ ID NO: 430047 - RNA, 17 nt, Bordetella pertussis
ggcggccugcaggccgu

SEQ ID NO: 430048 - RNA, 20 nt, Bordetella pertussis
ggcggccugcuuggcagccu

SEQ ID NO: 430049 - RNA, 21 nt, Bordetella pertussis
ggcggccugcuuggcagccuu

SEQ ID NO: 430050 - RNA, 17 nt, Bordetella pertussis
ggcggccuggccgcgcg

SEQ ID NO: 430051 - RNA, 14 nt, Bordetella pertussis
ggcggccugggcca

SEQ ID NO: 430052 - RNA, 22 nt, Bordetella pertussis
ggcggccuugcgggccggcugg

SEQ ID NO: 430053 - RNA, 14 nt, Bordetella pertussis
ggcggcgacgcagc

SEQ ID NO: 430054 - RNA, 21 nt, Bordetella pertussis
ggcggcgacggcgucggccug

SEQ ID NO: 430055 - RNA, 12 nt, Bordetella pertussis
ggcggcgagcug

SEQ ID NO: 430056 - RNA, 24 nt, Bordetella pertussis
ggcggcgaucaacgugcgccaggc

SEQ ID NO: 430057 - RNA, 15 nt, Bordetella pertussis
ggcggcgaugccgcu

SEQ ID NO: 430058 - RNA, 12 nt, Bordetella pertussis
ggcggcgcagca

SEQ ID NO: 430059 - RNA, 13 nt, Bordetella pertussis
ggcggcgcagccg

SEQ ID NO: 430060 - RNA, 15 nt, Bordetella pertussis
ggcggcgcaggccag

SEQ ID NO: 430061 - RNA, 16 nt, Bordetella pertussis
ggcggcgcaggccgcg

SEQ ID NO: 430062 - RNA, 15 nt, Bordetella pertussis
ggcggcgcagcgccc

SEQ ID NO: 430063 - RNA, 12 nt, Bordetella pertussis
ggcggcgcaggc

SEQ ID NO: 430064 - RNA, 19 nt, Bordetella pertussis
ggcggcgcgaacggcagcu

SEQ ID NO: 430065 - RNA, 15 nt, Bordetella pertussis
ggcggcgcccgcaug

SEQ ID NO: 430066 - RNA, 12 nt, Bordetella pertussis
ggcggcgcgccc

SEQ ID NO: 430067 - RNA, 16 nt, Bordetella pertussis
ggcggcgcgcccgccu

SEQ ID NO: 430068 - RNA, 17 nt, Bordetella pertussis
ggcggcgcgcggcuggg

SEQ ID NO: 430069 - RNA, 12 nt, Bordetella pertussis
ggcggcgcgcug

SEQ ID NO: 430070 - RNA, 14 nt, Bordetella pertussis
ggcggcgcgcuugg

SEQ ID NO: 430071 - RNA, 12 nt, Bordetella pertussis
ggcggcgcggcg

SEQ ID NO: 430072 - RNA, 15 nt, Bordetella pertussis
ggcggcgcggcgcug

SEQ ID NO: 430073 - RNA, 16 nt, Bordetella pertussis
ggcggcgcggucagca

SEQ ID NO: 430074 - RNA, 18 nt, Bordetella pertussis
ggcggcgcggucagcaug

SEQ ID NO: 430075 - RNA, 22 nt, Bordetella pertussis
ggcggcgcucaucaucgcgcug

SEQ ID NO: 430076 - RNA, 12 nt, Bordetella pertussis
ggcggcgcuggc

SEQ ID NO: 430077 - RNA, 14 nt, Bordetella pertussis
ggcggcggcaugcu

SEQ ID NO: 430078 - RNA, 21 nt, Bordetella pertussis
ggcggcggccacgaccggcuc

SEQ ID NO: 430079 - RNA, 12 nt, Bordetella pertussis
ggcggcggccuc

SEQ ID NO: 430080 - RNA, 14 nt, Bordetella pertussis
ggcggcgggcugca

SEQ ID NO: 430081 - RNA, 15 nt, Bordetella pertussis
ggcggcggugccagc

SEQ ID NO: 430082 - RNA, 16 nt, Bordetella pertussis
ggcggcggugccagcg

SEQ ID NO: 430083 - RNA, 24 nt, Bordetella pertussis
ggcggcgguuucuuccagcagggc

SEQ ID NO: 430084 - RNA, 17 nt, Bordetella pertussis
ggcggcguacaggugcu

SEQ ID NO: 430085 - RNA, 15 nt, Bordetella pertussis
ggcggcguagagcgc

SEQ ID NO: 430086 - RNA, 18 nt, Bordetella pertussis
ggcggcguagagcgccgc

SEQ ID NO: 430087 - RNA, 20 nt, Bordetella pertussis
ggcggcgucgcuggcagccu

SEQ ID NO: 430088 - RNA, 19 nt, Bordetella pertussis
ggcggcgucggcgcccggc

SEQ ID NO: 430089 - RNA, 13 nt, Bordetella pertussis
ggcggcucggccc

SEQ ID NO: 430090 - RNA, 20 nt, Bordetella pertussis
ggcggcugaagaagcccggc

SEQ ID NO: 430091 - RNA, 17 nt, Bordetella pertussis
ggcggcuguagucgccg

SEQ ID NO: 430092 - RNA, 20 nt, Bordetella pertussis
ggcggcuguagucgccgcug

SEQ ID NO: 430093 - RNA, 17 nt, Bordetella pertussis
ggcggcuuccuggucac

SEQ ID NO: 430094 - RNA, 18 nt, Bordetella pertussis
ggcggcuucgcgcagcaa

SEQ ID NO: 430095 - RNA, 19 nt, Bordetella pertussis
ggcggcuucgcgcagcaag

SEQ ID NO: 430096 - RNA, 18 nt, Bordetella pertussis
ggcgggaccgugccgccg

SEQ ID NO: 430097 - RNA, 21 nt, Bordetella pertussis
ggcgggaccgugccgccgagg

SEQ ID NO: 430098 - RNA, 14 nt, Bordetella pertussis
ggcgggacgcaggc

SEQ ID NO: 430099 - RNA, 14 nt, Bordetella pertussis
ggcgggcagcggcg

SEQ ID NO: 430100 - RNA, 17 nt, Bordetella pertussis
ggcgggcaggcuccaca

SEQ ID NO: 430101 - RNA, 20 nt, Bordetella pertussis
ggcgggcaucgcccaccaug

SEQ ID NO: 430102 - RNA, 17 nt, Bordetella pertussis
ggcgggccccgcagggc

SEQ ID NO: 430103 - RNA, 22 nt, Bordetella pertussis
ggcgggcccgcaucgcgcgccg

SEQ ID NO: 430104 - RNA, 23 nt, Bordetella pertussis
ggcgggccagguauucggcggug

SEQ ID NO: 430105 - RNA, 21 nt, Bordetella pertussis
ggcgggccugggcgucgagcg

SEQ ID NO: 430106 - RNA, 15 nt, Bordetella pertussis
ggcgggcgcgcaggc

SEQ ID NO: 430107 - RNA, 13 nt, Bordetella pertussis
ggcgggcgcugcg

SEQ ID NO: 430108 - RNA, 13 nt, Bordetella pertussis
ggcgggcgcuggc

SEQ ID NO: 430109 - RNA, 15 nt, Bordetella pertussis
ggcgggcggccggcg

SEQ ID NO: 430110 - RNA, 14 nt, Bordetella pertussis
ggcgggcgggcgca

SEQ ID NO: 430111 - RNA, 23 nt, Bordetella pertussis
ggcgggcguacccgucgaagcug

SEQ ID NO: 430112 - RNA, 14 nt, Bordetella pertussis
ggcgggcucagccc

SEQ ID NO: 430113 - RNA, 11 nt, Bordetella pertussis
ggcggggacag

SEQ ID NO: 430114 - RNA, 18 nt, Bordetella pertussis
ggcggggauggcuggccg

SEQ ID NO: 430115 - RNA, 22 nt, Bordetella pertussis
ggcggggcuggcgcggcuggcg

SEQ ID NO: 430116 - RNA, 13 nt, Bordetella pertussis
ggcgggguuggcc

SEQ ID NO: 430117 - RNA, 18 nt, Bordetella pertussis
ggcggguugugcccgccc

SEQ ID NO: 430118 - RNA, 22 nt, Bordetella pertussis
ggcgguaagcguccgcgcgccg

SEQ ID NO: 430119 - RNA, 17 nt, Bordetella pertussis
ggcgguacaggccggcg

SEQ ID NO: 430120 - RNA, 19 nt, Bordetella pertussis
ggcgguacaggccggcggc

SEQ ID NO: 430121 - RNA, 18 nt, Bordetella pertussis
ggcgguaccguccuggca

SEQ ID NO: 430122 - RNA, 22 nt, Bordetella pertussis
ggcggucaaugcggcggcgcug

SEQ ID NO: 430123 - RNA, 20 nt, Bordetella pertussis
ggcggucauagacggcgucg

SEQ ID NO: 430124 - RNA, 17 nt, Bordetella pertussis
ggcggugaccaccaggc

SEQ ID NO: 430125 - RNA, 23 nt, Bordetella pertussis
ggcggugaucugcucgccgcgcg

SEQ ID NO: 430126 - RNA, 16 nt, Bordetella pertussis
ggcggugaugucgccg

SEQ ID NO: 430127 - RNA, 15 nt, Bordetella pertussis
ggcggugcgcgcggc

SEQ ID NO: 430128 - RNA, 16 nt, Bordetella pertussis
ggcggugcgcgcggcc

SEQ ID NO: 430129 - RNA, 16 nt, Bordetella pertussis
ggcggugcgccgcaug

SEQ ID NO: 430130 - RNA, 14 nt, Bordetella pertussis
ggcggugcggccuc

SEQ ID NO: 430131 - RNA, 16 nt, Bordetella pertussis
ggcggugcgugcgccc

SEQ ID NO: 430132 - RNA, 23 nt, Bordetella pertussis
ggcgguguagaccaccagcagga

SEQ ID NO: 430133 - RNA, 16 nt, Bordetella pertussis
ggcgguuccagccugg

SEQ ID NO: 430134 - RNA, 16 nt, Bordetella pertussis
ggcgguuucggccggg

SEQ ID NO: 430135 - RNA, 22 nt, Bordetella pertussis
ggcgguuucggccgggaaggcg

SEQ ID NO: 430136 - RNA, 20 nt, Bordetella pertussis
ggcgguuucuuccagcaggg

SEQ ID NO: 430137 - RNA, 21 nt, Bordetella pertussis
ggcgguuggugucgcgcagcg

SEQ ID NO: 430138 - RNA, 22 nt, Bordetella pertussis
ggcgguuuuuucuugccggccc

SEQ ID NO: 430139 - RNA, 14 nt, Bordetella pertussis
ggcguacagcaggg

SEQ ID NO: 430140 - RNA, 14 nt, Bordetella pertussis
ggcguacggcugca

SEQ ID NO: 430141 - RNA, 17 nt, Bordetella pertussis
ggcguacuggcgcggcg

SEQ ID NO: 430142 - RNA, 22 nt, Bordetella pertussis
ggcguacuggcgcggcggccag

SEQ ID NO: 430143 - RNA, 17 nt, Bordetella pertussis
ggcguagaccaccugcu

SEQ ID NO: 430144 - RNA, 22 nt, Bordetella pertussis
ggcguagcccuuguggccgccg

SEQ ID NO: 430145 - RNA, 20 nt, Bordetella pertussis
ggcguagccggugcgcagca

SEQ ID NO: 430146 - RNA, 15 nt, Bordetella pertussis
ggcguagcucagccu

SEQ ID NO: 430147 - RNA, 14 nt, Bordetella pertussis
ggcguaggcggccu

SEQ ID NO: 430148 - RNA, 17 nt, Bordetella pertussis
ggcguaguagcccaggc

SEQ ID NO: 430149 - RNA, 22 nt, Bordetella pertussis
ggcguagucguugccggccagc

SEQ ID NO: 430150 - RNA, 19 nt, Bordetella pertussis
ggcguaucgauagccgacg

SEQ ID NO: 430151 - RNA, 15 nt, Bordetella pertussis
ggcguauggcgcggg

SEQ ID NO: 430152 - RNA, 18 nt, Bordetella pertussis
ggcgucaaaccaagcagg

SEQ ID NO: 430153 - RNA, 23 nt, Bordetella pertussis
ggcgucaagccagcggcgcggcg

SEQ ID NO: 430154 - RNA, 17 nt, Bordetella pertussis
ggcgucaccggcgagcc

SEQ ID NO: 430155 - RNA, 19 nt, Bordetella pertussis
ggcgucaucggcgcgcagc

SEQ ID NO: 430156 - RNA, 21 nt, Bordetella pertussis
ggcgucaugcgcuugucgccg

SEQ ID NO: 430157 - RNA, 20 nt, Bordetella pertussis
ggcguccaccuugacgcgca

SEQ ID NO: 430158 - RNA, 13 nt, Bordetella pertussis
ggcguccacggca

SEQ ID NO: 430159 - RNA, 14 nt, Bordetella pertussis
ggcguccagcagca

SEQ ID NO: 430160 - RNA, 17 nt, Bordetella pertussis
ggcguccagcagcagga

SEQ ID NO: 430161 - RNA, 17 nt, Bordetella pertussis
ggcguccagccugcccg

SEQ ID NO: 430162 - RNA, 18 nt, Bordetella pertussis
ggcguccaggcugccggc

SEQ ID NO: 430163 - RNA, 11 nt, Bordetella pertussis
ggcguccaggu

SEQ ID NO: 430164 - RNA, 11 nt, Bordetella pertussis
ggcguccaggc

SEQ ID NO: 430165 - RNA, 15 nt, Bordetella pertussis
ggcgucccaggccac

SEQ ID NO: 430166 - RNA, 19 nt, Bordetella pertussis
ggcguccggccccaggaug

SEQ ID NO: 430167 - RNA, 13 nt, Bordetella pertussis
ggcguccugccgc

SEQ ID NO: 430168 - RNA, 22 nt, Bordetella pertussis
ggcgucgaucuucgccugcaug

SEQ ID NO: 430169 - RNA, 20 nt, Bordetella pertussis
ggcgucgauguccuucucuu

SEQ ID NO: 430170 - RNA, 19 nt, Bordetella pertussis
ggcgucgcccggggcggcg

SEQ ID NO: 430171 - RNA, 14 nt, Bordetella pertussis
ggcgucgccgcgca

SEQ ID NO: 430172 - RNA, 22 nt, Bordetella pertussis
ggcgucgcgcuguucgggcgcg

SEQ ID NO: 430173 - RNA, 15 nt, Bordetella pertussis
ggcgucggccacguc

SEQ ID NO: 430174 - RNA, 14 nt, Bordetella pertussis
ggcgucggccagcg

SEQ ID NO: 430175 - RNA, 16 nt, Bordetella pertussis
ggcgucgggcagcagg

SEQ ID NO: 430176 - RNA, 13 nt, Bordetella pertussis
ggcgucgggggcg

SEQ ID NO: 430177 - RNA, 22 nt, Bordetella pertussis
ggcgucguccaucgacgcggcg

SEQ ID NO: 430178 - RNA, 15 nt, Bordetella pertussis
ggcgucguccugcag

SEQ ID NO: 430179 - RNA, 21 nt, Bordetella pertussis
ggcgucgucgccgucgcccug

SEQ ID NO: 430180 - RNA, 16 nt, Bordetella pertussis
ggcgucgucgcggucc

SEQ ID NO: 430181 - RNA, 16 nt, Bordetella pertussis
ggcgucguggggcgcg

SEQ ID NO: 430182 - RNA, 15 nt, Bordetella pertussis
ggcgucugcucgccg

SEQ ID NO: 430183 - RNA, 16 nt, Bordetella pertussis
ggcgugaaaggccagc

SEQ ID NO: 430184 - RNA, 20 nt, Bordetella pertussis
ggcgugaaaggccagcggcg

SEQ ID NO: 430185 - RNA, 17 nt, Bordetella pertussis
ggcgugaacgccccggc

SEQ ID NO: 430186 - RNA, 23 nt, Bordetella pertussis
ggcgugaacgccccggccgaucg

SEQ ID NO: 430187 - RNA, 13 nt, Bordetella pertussis
ggcgugacgcuga

SEQ ID NO: 430188 - RNA, 16 nt, Bordetella pertussis
ggcgugaugcccaggc

SEQ ID NO: 430189 - RNA, 16 nt, Bordetella pertussis
ggcgugcagcagguag

SEQ ID NO: 430190 - RNA, 20 nt, Bordetella pertussis
ggcgugcccguugccgcgcg

SEQ ID NO: 430191 - RNA, 23 nt, Bordetella pertussis
ggcgugcccuugagcgugggcug

SEQ ID NO: 430192 - RNA, 13 nt, Bordetella pertussis
ggcgugccgcgca

SEQ ID NO: 430193 - RNA, 17 nt, Bordetella pertussis
ggcgugccgcgcugggc

SEQ ID NO: 430194 - RNA, 16 nt, Bordetella pertussis
ggcgugcaggccggcg

SEQ ID NO: 430195 - RNA, 14 nt, Bordetella pertussis
ggcgugcaggcugg

SEQ ID NO: 430196 - RNA, 21 nt, Bordetella pertussis
ggcgugccugcuuguacaggc

SEQ ID NO: 430197 - RNA, 23 nt, Bordetella pertussis
ggcgugccugcuuguacaggcgc

SEQ ID NO: 430198 - RNA, 20 nt, Bordetella pertussis
ggcgugcgcuggcugggccu

SEQ ID NO: 430199 - RNA, 12 nt, Bordetella pertussis
ggcgugcggccc

SEQ ID NO: 430200 - RNA, 16 nt, Bordetella pertussis
ggcgugcggcccagcc

SEQ ID NO: 430201 - RNA, 23 nt, Bordetella pertussis
ggcgugcgcgaccuccggcaaca

SEQ ID NO: 430202 - RNA, 15 nt, Bordetella pertussis
ggcgugcugcaccug

SEQ ID NO: 430203 - RNA, 16 nt, Bordetella pertussis
ggcgugcuugccgccg

SEQ ID NO: 430204 - RNA, 23 nt, Bordetella pertussis
ggcgugcuugccgccggacggcg

SEQ ID NO: 430205 - RNA, 20 nt, Bordetella pertussis
ggcguggaacgaccacggaa

SEQ ID NO: 430206 - RNA, 16 nt, Bordetella pertussis
ggcguggcgcgcgccg

SEQ ID NO: 430207 - RNA, 14 nt, Bordetella pertussis
ggcguggcgcaggg

SEQ ID NO: 430208 - RNA, 19 nt, Bordetella pertussis
ggcguggcggccaggccgg

SEQ ID NO: 430209 - RNA, 14 nt, Bordetella pertussis
ggcguggcggggcg

SEQ ID NO: 430210 - RNA, 18 nt, Bordetella pertussis
ggcguggggagcgcggcc

SEQ ID NO: 430211 - RNA, 18 nt, Bordetella pertussis
ggcguggggccggccgcg

SEQ ID NO: 430212 - RNA, 20 nt, Bordetella pertussis
ggcguggggccggccgcgcg

SEQ ID NO: 430213 - RNA, 23 nt, Bordetella pertussis
ggcguggggccggccgcgcgcgc

SEQ ID NO: 430214 - RNA, 20 nt, Bordetella pertussis
ggcgugguacgacgagcgca

SEQ ID NO: 430215 - RNA, 20 nt, Bordetella pertussis
ggcgugguaucgcgccagcg

SEQ ID NO: 430216 - RNA, 16 nt, Bordetella pertussis
ggcguguccagcggcg

SEQ ID NO: 430217 - RNA, 18 nt, Bordetella pertussis
ggcguguccgccguagcg

SEQ ID NO: 430218 - RNA, 14 nt, Bordetella pertussis
ggcgugugcccagc

SEQ ID NO: 430219 - RNA, 15 nt, Bordetella pertussis
ggcgugugcccagca

SEQ ID NO: 430220 - RNA, 19 nt, Bordetella pertussis
ggcguucaccaggaagcgc

SEQ ID NO: 430221 - RNA, 20 nt, Bordetella pertussis
ggcguucggcaccggcagcc

SEQ ID NO: 430222 - RNA, 15 nt, Bordetella pertussis
ggcguucggccacuu

SEQ ID NO: 430223 - RNA, 22 nt, Bordetella pertussis
ggcguugacguggcugagccau

SEQ ID NO: 430224 - RNA, 23 nt, Bordetella pertussis
ggcguuugcccuucgcggcuggu

SEQ ID NO: 430225 - RNA, 16 nt, Bordetella pertussis
ggcguuuuccagcauc

SEQ ID NO: 430226 - RNA, 14 nt, Bordetella pertussis
ggcuaggcgcagca

SEQ ID NO: 430227 - RNA, 16 nt, Bordetella pertussis
ggcuaggcgcagcagg

SEQ ID NO: 430228 - RNA, 17 nt, Bordetella pertussis
ggcuaggcgcagcaggc

SEQ ID NO: 430229 - RNA, 21 nt, Bordetella pertussis
ggcuaggcgcagcaggccagg

SEQ ID NO: 430230 - RNA, 17 nt, Bordetella pertussis
ggcuauaccgggcuggu

SEQ ID NO: 430231 - RNA, 21 nt, Bordetella pertussis
ggcuauaccgucguccucggc

SEQ ID NO: 430232 - RNA, 16 nt, Bordetella pertussis
ggcucaggccugcacg

SEQ ID NO: 430233 - RNA, 14 nt, Bordetella pertussis
ggcucaggcgcgga

SEQ ID NO: 430234 - RNA, 13 nt, Bordetella pertussis
ggcucaggcggcc

SEQ ID NO: 430235 - RNA, 13 nt, Bordetella pertussis
ggcucaggcugcg

SEQ ID NO: 430236 - RNA, 20 nt, Bordetella pertussis
ggcucauucggcgcgcucgg

SEQ ID NO: 430237 - RNA, 18 nt, Bordetella pertussis
ggcuccagcucagcagcg

SEQ ID NO: 430238 - RNA, 20 nt, Bordetella pertussis
ggcuccagcucagcagcgcc

SEQ ID NO: 430239 - RNA, 18 nt, Bordetella pertussis
ggcuccaguggugcuccc

SEQ ID NO: 430240 - RNA, 18 nt, Bordetella pertussis
ggcucccgagggaucagc

SEQ ID NO: 430241 - RNA, 17 nt, Bordetella pertussis
ggcuccgaagggcugcg

SEQ ID NO: 430242 - RNA, 15 nt, Bordetella pertussis
ggcuccgagggacac

SEQ ID NO: 430243 - RNA, 17 nt, Bordetella pertussis
ggcuccgauagcggcgc

SEQ ID NO: 430244 - RNA, 19 nt, Bordetella pertussis
ggcuccgauagcggcgccg

SEQ ID NO: 430245 - RNA, 20 nt, Bordetella pertussis
ggcuccucgcccgaccugcu

SEQ ID NO: 430246 - RNA, 17 nt, Bordetella pertussis
ggcucgaacaggcuggc

SEQ ID NO: 430247 - RNA, 15 nt, Bordetella pertussis
ggcucgagcaagggc

SEQ ID NO: 430248 - RNA, 19 nt, Bordetella pertussis
ggcucgagcggcagcagcg

SEQ ID NO: 430249 - RNA, 18 nt, Bordetella pertussis
ggcucgagcuccugcucg

SEQ ID NO: 430250 - RNA, 19 nt, Bordetella pertussis
ggcucgagcuccugcucga

SEQ ID NO: 430251 - RNA, 17 nt, Bordetella pertussis
ggcucgagcuggcuggc

SEQ ID NO: 430252 - RNA, 13 nt, Bordetella pertussis
ggcucgccccugg

SEQ ID NO: 430253 - RNA, 17 nt, Bordetella pertussis
ggcucgccuccccaggc

SEQ ID NO: 430254 - RNA, 18 nt, Bordetella pertussis
ggcucgccuccccaggcc

SEQ ID NO: 430255 - RNA, 17 nt, Bordetella pertussis
ggcucgcgcgagcccau

SEQ ID NO: 430256 - RNA, 18 nt, Bordetella pertussis
ggcucgcgcucgcccggc

SEQ ID NO: 430257 - RNA, 19 nt, Bordetella pertussis
ggcucgcugucgugccgca

SEQ ID NO: 430258 - RNA, 18 nt, Bordetella pertussis
ggcucggcgccggcggcg

SEQ ID NO: 430259 - RNA, 21 nt, Bordetella pertussis
ggcucgggaaugaugcagcug

SEQ ID NO: 430260 - RNA, 20 nt, Bordetella pertussis
ggcucggugaugauggccag

SEQ ID NO: 430261 - RNA, 19 nt, Bordetella pertussis
ggcucguagucgguggggu

SEQ ID NO: 430262 - RNA, 17 nt, Bordetella pertussis
ggcucgugcagcagggg

SEQ ID NO: 430263 - RNA, 20 nt, Bordetella pertussis
ggcucguucgcucggcgucc

SEQ ID NO: 430264 - RNA, 21 nt, Bordetella pertussis
ggcucuuuuucgagccgcaga

SEQ ID NO: 430265 - RNA, 16 nt, Bordetella pertussis
ggcugaaaucccccgc

SEQ ID NO: 430266 - RNA, 14 nt, Bordetella pertussis
ggcugaccagcagc

SEQ ID NO: 430267 - RNA, 20 nt, Bordetella pertussis
ggcugagccauuccggcugg

SEQ ID NO: 430268 - RNA, 18 nt, Bordetella pertussis
ggcugaucacccacagca

SEQ ID NO: 430269 - RNA, 20 nt, Bordetella pertussis
ggcugauccgcaccggcgug

SEQ ID NO: 430270 - RNA, 15 nt, Bordetella pertussis
ggcugaugcaggccu

SEQ ID NO: 430271 - RNA, 18 nt, Bordetella pertussis
ggcugcaagacgcccagg

SEQ ID NO: 430272 - RNA, 16 nt, Bordetella pertussis
ggcugcaaggcagccu

SEQ ID NO: 430273 - RNA, 23 nt, Bordetella pertussis
ggcugcaagucuucuucagcaug

SEQ ID NO: 430274 - RNA, 18 nt, Bordetella pertussis
ggcugcaccagcgcgccg

SEQ ID NO: 430275 - RNA, 16 nt, Bordetella pertussis
ggcugcaccaguuugc

SEQ ID NO: 430276 - RNA, 13 nt, Bordetella pertussis
ggcugcaccugcc

SEQ ID NO: 430277 - RNA, 16 nt, Bordetella pertussis
ggcugcaccugccugc

SEQ ID NO: 430278 - RNA, 19 nt, Bordetella pertussis
ggcugcagcuugcgcgcca

SEQ ID NO: 430279 - RNA, 14 nt, Bordetella pertussis
ggcugccagggccg

SEQ ID NO: 430280 - RNA, 13 nt, Bordetella pertussis
ggcugccauucca

SEQ ID NO: 430281 - RNA, 20 nt, Bordetella pertussis
ggcugcccucggucagcgcc

SEQ ID NO: 430282 - RNA, 15 nt, Bordetella pertussis
ggcugccggcagcag

SEQ ID NO: 430283 - RNA, 17 nt, Bordetella pertussis
ggcugccgugaggcagc

SEQ ID NO: 430284 - RNA, 19 nt, Bordetella pertussis
ggcugccgugaggcagccu

SEQ ID NO: 430285 - RNA, 15 nt, Bordetella pertussis
ggcugcgacaggcgc

SEQ ID NO: 430286 - RNA, 16 nt, Bordetella pertussis
ggcugcgacaggcgca

SEQ ID NO: 430287 - RNA, 21 nt, Bordetella pertussis
ggcugccguagcccaggucca

SEQ ID NO: 430288 - RNA, 14 nt, Bordetella pertussis
ggcugcgcgccggc

SEQ ID NO: 430289 - RNA, 15 nt, Bordetella pertussis
ggcugcgcgccggcg

SEQ ID NO: 430290 - RNA, 15 nt, Bordetella pertussis
ggcugcgcgccuggc

SEQ ID NO: 430291 - RNA, 19 nt, Bordetella pertussis
ggcugcgcgcgcagccagg

SEQ ID NO: 430292 - RNA, 19 nt, Bordetella pertussis
ggcugcgcgcgccagcgcc

SEQ ID NO: 430293 - RNA, 12 nt, Bordetella pertussis
ggcugcgcaggc

SEQ ID NO: 430294 - RNA, 17 nt, Bordetella pertussis
ggcugcgcggccgagcg

SEQ ID NO: 430295 - RNA, 14 nt, Bordetella pertussis
ggcugcggcguggc

SEQ ID NO: 430296 - RNA, 15 nt, Bordetella pertussis
ggcugcgggccggcg

SEQ ID NO: 430297 - RNA, 18 nt, Bordetella pertussis
ggcugcgggccggcgccg

SEQ ID NO: 430298 - RNA, 20 nt, Bordetella pertussis
ggcugcgggcgcaagccagc

SEQ ID NO: 430299 - RNA, 23 nt, Bordetella pertussis
ggcugcgggcgcaagccagcacg

SEQ ID NO: 430300 - RNA, 18 nt, Bordetella pertussis
ggcugcugggccggcgcg

SEQ ID NO: 430301 - RNA, 15 nt, Bordetella pertussis
ggcugcuugcccagc

SEQ ID NO: 430302 - RNA, 14 nt, Bordetella pertussis
ggcuggaagucagc

SEQ ID NO: 430303 - RNA, 23 nt, Bordetella pertussis
ggcuggagaacgagccggccgcg

SEQ ID NO: 430304 - RNA, 13 nt, Bordetella pertussis
ggcuggagcucua

SEQ ID NO: 430305 - RNA, 17 nt, Bordetella pertussis
ggcuggacccggagcug

SEQ ID NO: 430306 - RNA, 19 nt, Bordetella pertussis
ggcuggacgcgcgcggcga

SEQ ID NO: 430307 - RNA, 21 nt, Bordetella pertussis
ggcuggacgcgcgcggcgacc

SEQ ID NO: 430308 - RNA, 18 nt, Bordetella pertussis
ggcuggauccggcgcugg

SEQ ID NO: 430309 - RNA, 18 nt, Bordetella pertussis
ggcuggcaugcggcggac

SEQ ID NO: 430310 - RNA, 21 nt, Bordetella pertussis
ggcuggcauggaacgggcggg

SEQ ID NO: 430311 - RNA, 19 nt, Bordetella pertussis
ggcuggcauggcggucucc

SEQ ID NO: 430312 - RNA, 22 nt, Bordetella pertussis
ggcuggccaccgaagcggcguu

SEQ ID NO: 430313 - RNA, 14 nt, Bordetella pertussis
ggcuggccacuggc

SEQ ID NO: 430314 - RNA, 14 nt, Bordetella pertussis
ggcuggccagccgg

SEQ ID NO: 430315 - RNA, 21 nt, Bordetella pertussis
ggcuggccagccggcccagca

SEQ ID NO: 430316 - RNA, 23 nt, Bordetella pertussis
ggcuggccagccggcccagcaug

SEQ ID NO: 430317 - RNA, 15 nt, Bordetella pertussis
ggcuggccagcuggc

SEQ ID NO: 430318 - RNA, 19 nt, Bordetella pertussis
ggcuggccgccgcggccuc

SEQ ID NO: 430319 - RNA, 22 nt, Bordetella pertussis
ggcuggccgaucaccugcaggc

SEQ ID NO: 430320 - RNA, 21 nt, Bordetella pertussis
ggcuggccggcguggccugcc

SEQ ID NO: 430321 - RNA, 17 nt, Bordetella pertussis
ggcuggcgaucaccgac

SEQ ID NO: 430322 - RNA, 15 nt, Bordetella pertussis
ggcuggcgcggccgu

SEQ ID NO: 430323 - RNA, 15 nt, Bordetella pertussis
ggcuggcgcggcugg

SEQ ID NO: 430324 - RNA, 15 nt, Bordetella pertussis
ggcuggcugggcgcg

SEQ ID NO: 430325 - RNA, 14 nt, Bordetella pertussis
ggcugggacaggca

SEQ ID NO: 430326 - RNA, 13 nt, Bordetella pertussis
ggcugggccagau

SEQ ID NO: 430327 - RNA, 14 nt, Bordetella pertussis
ggcugggccagaug

SEQ ID NO: 430328 - RNA, 17 nt, Bordetella pertussis
ggcugggccgaggcgcc

SEQ ID NO: 430329 - RNA, 16 nt, Bordetella pertussis
ggcugggcggccuugg

SEQ ID NO: 430330 - RNA, 18 nt, Bordetella pertussis
ggcugggcggccuuggcc

SEQ ID NO: 430331 - RNA, 17 nt, Bordetella pertussis
ggcugggcgcgccgcug

SEQ ID NO: 430332 - RNA, 14 nt, Bordetella pertussis
ggcuggggcaggca

SEQ ID NO: 430333 - RNA, 15 nt, Bordetella pertussis
ggcuggggcaggcac

SEQ ID NO: 430334 - RNA, 16 nt, Bordetella pertussis
ggcuggggcaggcacu

SEQ ID NO: 430335 - RNA, 19 nt, Bordetella pertussis
ggcuggggcaggcacuggc

SEQ ID NO: 430336 - RNA, 15 nt, Bordetella pertussis
ggcuggggcugcugg

SEQ ID NO: 430337 - RNA, 16 nt, Bordetella pertussis
ggcuggguucaggccu

SEQ ID NO: 430338 - RNA, 15 nt, Bordetella pertussis
ggcuggucagccugg

SEQ ID NO: 430339 - RNA, 16 nt, Bordetella pertussis
ggcuggucagccuggg

SEQ ID NO: 430340 - RNA, 14 nt, Bordetella pertussis
ggcuggucaggcgg

SEQ ID NO: 430341 - RNA, 13 nt, Bordetella pertussis
ggcuggucgccgu

SEQ ID NO: 430342 - RNA, 13 nt, Bordetella pertussis
ggcugugggccuc

SEQ ID NO: 430343 - RNA, 18 nt, Bordetella pertussis
ggcuguucgcgcagcagg

SEQ ID NO: 430344 - RNA, 19 nt, Bordetella pertussis
ggcuguucgcgcagcaggc

SEQ ID NO: 430345 - RNA, 13 nt, Bordetella pertussis
ggcuuccaguucg

SEQ ID NO: 430346 - RNA, 13 nt, Bordetella pertussis
ggcuuccugcacc

SEQ ID NO: 430347 - RNA, 18 nt, Bordetella pertussis
ggcuuccugcaccucagg

SEQ ID NO: 430348 - RNA, 21 nt, Bordetella pertussis
ggcuucgacucccucgaugag

SEQ ID NO: 430349 - RNA, 18 nt, Bordetella pertussis
ggcuucgauggcggcggc

SEQ ID NO: 430350 - RNA, 22 nt, Bordetella pertussis
ggcuucggccgucagcagcagg

SEQ ID NO: 430351 - RNA, 19 nt, Bordetella pertussis
ggcuucggcguacugcugc

SEQ ID NO: 430352 - RNA, 14 nt, Bordetella pertussis
ggcuucgucgccgg

SEQ ID NO: 430353 - RNA, 22 nt, Bordetella pertussis
ggcuucguuggugucggcggcg

SEQ ID NO: 430354 - RNA, 14 nt, Bordetella pertussis
ggcuugcugccccc

SEQ ID NO: 430355 - RNA, 12 nt, Bordetella pertussis
ggcuuggcggcc

SEQ ID NO: 430356 - RNA, 20 nt, Bordetella pertussis
ggcuuggcgugcgcgagcug

SEQ ID NO: 430357 - RNA, 23 nt, Bordetella pertussis
ggcuuuuuuucgccgggcggcgc

SEQ ID NO: 430358 - RNA, 13 nt, Bordetella pertussis
gggaaacaggccc

SEQ ID NO: 430359 - RNA, 17 nt, Bordetella pertussis
gggaaacaggcccacgg

SEQ ID NO: 430360 - RNA, 13 nt, Bordetella pertussis
gggaaaugauagu

SEQ ID NO: 430361 - RNA, 13 nt, Bordetella pertussis
gggaacaggcacc

SEQ ID NO: 430362 - RNA, 14 nt, Bordetella pertussis
gggagcggccagca

SEQ ID NO: 430363 - RNA, 16 nt, Bordetella pertussis
gggaggaacugggcgc

SEQ ID NO: 430364 - RNA, 15 nt, Bordetella pertussis
gggagugcgaggacg

SEQ ID NO: 430365 - RNA, 17 nt, Bordetella pertussis
gggaugacgggcgagca

SEQ ID NO: 430366 - RNA, 19 nt, Bordetella pertussis
gggaugcaggucggggcgc

SEQ ID NO: 430367 - RNA, 13 nt, Bordetella pertussis
gggaugccccgcc

SEQ ID NO: 430368 - RNA, 14 nt, Bordetella pertussis
gggaugcugcucgg

SEQ ID NO: 430369 - RNA, 16 nt, Bordetella pertussis
gggcaccaccaccgcc

SEQ ID NO: 430370 - RNA, 21 nt, Bordetella pertussis
gggcaccagguccuggcggcc

SEQ ID NO: 430371 - RNA, 21 nt, Bordetella pertussis
gggcacccaggcgggcuggcg

SEQ ID NO: 430372 - RNA, 14 nt, Bordetella pertussis
gggcaccgagccgc

SEQ ID NO: 430373 - RNA, 22 nt, Bordetella pertussis
gggcaccgagccgcagguccag

SEQ ID NO: 430374 - RNA, 20 nt, Bordetella pertussis
gggcaccugcuugagcacca

SEQ ID NO: 430375 - RNA, 16 nt, Bordetella pertussis
gggcacgaucaccgcc

SEQ ID NO: 430376 - RNA, 14 nt, Bordetella pertussis
gggcacgccggccu

SEQ ID NO: 430377 - RNA, 12 nt, Bordetella pertussis
gggcagcucgcg

SEQ ID NO: 430378 - RNA, 18 nt, Bordetella pertussis
gggcagcuuggcgcgccg

SEQ ID NO: 430379 - RNA, 20 nt, Bordetella pertussis
gggcaggcccagccagcggu

SEQ ID NO: 430380 - RNA, 20 nt, Bordetella pertussis
gggcaggcgggccaggccgg

SEQ ID NO: 430381 - RNA, 22 nt, Bordetella pertussis
gggcaggcgggccaggccggug

SEQ ID NO: 430382 - RNA, 13 nt, Bordetella pertussis
gggcaggcucagc

SEQ ID NO: 430383 - RNA, 17 nt, Bordetella pertussis
gggcaggcucagcccgg

SEQ ID NO: 430384 - RNA, 18 nt, Bordetella pertussis
gggcaggcucagcccggc

SEQ ID NO: 430385 - RNA, 12 nt, Bordetella pertussis
gggcaggcggcu

SEQ ID NO: 430386 - RNA, 18 nt, Bordetella pertussis
gggcagggcgccugcaga

SEQ ID NO: 430387 - RNA, 14 nt, Bordetella pertussis
gggcagggcuucca

SEQ ID NO: 430388 - RNA, 22 nt, Bordetella pertussis
gggcaggucgccagcaggcccu

SEQ ID NO: 430389 - RNA, 16 nt, Bordetella pertussis
gggcaggucggccagc

SEQ ID NO: 430390 - RNA, 18 nt, Bordetella pertussis
gggcaggucggccagcgu

SEQ ID NO: 430391 - RNA, 18 nt, Bordetella pertussis
gggcaggucgggcagggu

SEQ ID NO: 430392 - RNA, 20 nt, Bordetella pertussis
gggcaggucgggcagggugg

SEQ ID NO: 430393 - RNA, 19 nt, Bordetella pertussis
gggcaggucgucgagccgg

SEQ ID NO: 430394 - RNA, 24 nt, Bordetella pertussis
gggcauagcguuuuguacucugug

SEQ ID NO: 430395 - RNA, 17 nt, Bordetella pertussis
gggcaucaggggcucgg

SEQ ID NO: 430396 - RNA, 23 nt, Bordetella pertussis
gggcaucaggggcucggccaggu

SEQ ID NO: 430397 - RNA, 19 nt, Bordetella pertussis
gggcaugacgaucacgggc

SEQ ID NO: 430398 - RNA, 19 nt, Bordetella pertussis
gggcaugauggugcugccg

SEQ ID NO: 430399 - RNA, 13 nt, Bordetella pertussis
gggcaugccggca

SEQ ID NO: 430400 - RNA, 12 nt, Bordetella pertussis
gggcauggcgcc

SEQ ID NO: 430401 - RNA, 14 nt, Bordetella pertussis
gggcaugggcggcc

SEQ ID NO: 430402 - RNA, 14 nt, Bordetella pertussis
gggcauugccggag

SEQ ID NO: 430403 - RNA, 15 nt, Bordetella pertussis
gggcauugggcagcg

SEQ ID NO: 430404 - RNA, 18 nt, Bordetella pertussis
gggcauuucccagccguc

SEQ ID NO: 430405 - RNA, 17 nt, Bordetella pertussis
gggccacccgccgccgg

SEQ ID NO: 430406 - RNA, 22 nt, Bordetella pertussis
gggccacgcccacgcgccgcca

SEQ ID NO: 430407 - RNA, 14 nt, Bordetella pertussis
gggccacgcccagg

SEQ ID NO: 430408 - RNA, 15 nt, Bordetella pertussis
gggccacgcccaggc

SEQ ID NO: 430409 - RNA, 17 nt, Bordetella pertussis
gggccacgcccaggccg

SEQ ID NO: 430410 - RNA, 14 nt, Bordetella pertussis
gggccacgccggcc

SEQ ID NO: 430411 - RNA, 16 nt, Bordetella pertussis
gggccacgccggccgg

SEQ ID NO: 430412 - RNA, 16 nt, Bordetella pertussis
gggccagaccgcgcgc

SEQ ID NO: 430413 - RNA, 11 nt, Bordetella pertussis
gggccagcaac

SEQ ID NO: 430414 - RNA, 21 nt, Bordetella pertussis
gggccccuccggcgccgccuc

SEQ ID NO: 430415 - RNA, 16 nt, Bordetella pertussis
gggcccgcgcagacgg

SEQ ID NO: 430416 - RNA, 21 nt, Bordetella pertussis
gggcccgcgccgacggcggcg

SEQ ID NO: 430417 - RNA, 13 nt, Bordetella pertussis
gggcccggccacg

SEQ ID NO: 430418 - RNA, 21 nt, Bordetella pertussis
gggcccgucgcgccaggccgg

SEQ ID NO: 430419 - RNA, 23 nt, Bordetella pertussis
gggcccgucgcgccaggccggcg

SEQ ID NO: 430420 - RNA, 13 nt, Bordetella pertussis
gggcccgggcagg

SEQ ID NO: 430421 - RNA, 14 nt, Bordetella pertussis
gggcccgggcgcgc

SEQ ID NO: 430422 - RNA, 13 nt, Bordetella pertussis
gggccgcgcgcca

SEQ ID NO: 430423 - RNA, 22 nt, Bordetella pertussis
gggccgcgcgccaaucagaugg

SEQ ID NO: 430424 - RNA, 22 nt, Bordetella pertussis
gggccgcggacgaagccuaggc

SEQ ID NO: 430425 - RNA, 16 nt, Bordetella pertussis
gggccgcggcgcgcgc

SEQ ID NO: 430426 - RNA, 18 nt, Bordetella pertussis
gggccgcggcgcgcgcgg

SEQ ID NO: 430427 - RNA, 23 nt, Bordetella pertussis
gggccgcuaggccuugccgccgc

SEQ ID NO: 430428 - RNA, 14 nt, Bordetella pertussis
gggccgcuggcccg

SEQ ID NO: 430429 - RNA, 14 nt, Bordetella pertussis
gggccgcugguggc

SEQ ID NO: 430430 - RNA, 21 nt, Bordetella pertussis
gggccggaacagcguccagcc

SEQ ID NO: 430431 - RNA, 23 nt, Bordetella pertussis
gggccggccgcgcgcgccaggcc

SEQ ID NO: 430432 - RNA, 17 nt, Bordetella pertussis
gggccggccgggcgcgg

SEQ ID NO: 430433 - RNA, 12 nt, Bordetella pertussis
gggccggcgcca

SEQ ID NO: 430434 - RNA, 14 nt, Bordetella pertussis
gggccggcgccagc

SEQ ID NO: 430435 - RNA, 15 nt, Bordetella pertussis
gggccggcgccagca

SEQ ID NO: 430436 - RNA, 15 nt, Bordetella pertussis
gggccggcgcgccgc

SEQ ID NO: 430437 - RNA, 20 nt, Bordetella pertussis
gggccggcgccagcauccgg

SEQ ID NO: 430438 - RNA, 13 nt, Bordetella pertussis
gggccggcgccgg

SEQ ID NO: 430439 - RNA, 17 nt, Bordetella pertussis
gggccugcgggccgggc

SEQ ID NO: 430440 - RNA, 17 nt, Bordetella pertussis
gggccuggaucgggggg

SEQ ID NO: 430441 - RNA, 12 nt, Bordetella pertussis
gggccuggcaga

SEQ ID NO: 430442 - RNA, 21 nt, Bordetella pertussis
gggccuggcagaugcgcgcca

SEQ ID NO: 430443 - RNA, 23 nt, Bordetella pertussis
gggccuggcagaugcgcgccagg

SEQ ID NO: 430444 - RNA, 20 nt, Bordetella pertussis
gggccuggcguucggcaccg

SEQ ID NO: 430445 - RNA, 21 nt, Bordetella pertussis
gggccuggcguucggcaccgg

SEQ ID NO: 430446 - RNA, 21 nt, Bordetella pertussis
gggccuucuugucgcuggaga

SEQ ID NO: 430447 - RNA, 18 nt, Bordetella pertussis
gggccuuggccagcagcg

SEQ ID NO: 430448 - RNA, 17 nt, Bordetella pertussis
gggccuuugcggcaggg

SEQ ID NO: 430449 - RNA, 15 nt, Bordetella pertussis
gggcgaagcgcgccu

SEQ ID NO: 430450 - RNA, 19 nt, Bordetella pertussis
gggcgaagcggaccugguc

SEQ ID NO: 430451 - RNA, 16 nt, Bordetella pertussis
gggcgaccccggaggg

SEQ ID NO: 430452 - RNA, 17 nt, Bordetella pertussis
gggcgagaucagccacc

SEQ ID NO: 430453 - RNA, 15 nt, Bordetella pertussis
gggcgagcgggccgg

SEQ ID NO: 430454 - RNA, 22 nt, Bordetella pertussis
gggcgaucgcgucggccaaggc

SEQ ID NO: 430455 - RNA, 22 nt, Bordetella pertussis
gggcgaugcauucggcggccgg

SEQ ID NO: 430456 - RNA, 15 nt, Bordetella pertussis
gggcgaugccgcaga

SEQ ID NO: 430457 - RNA, 15 nt, Bordetella pertussis
gggcgcaagccagca

SEQ ID NO: 430458 - RNA, 21 nt, Bordetella pertussis
gggcgcaaguguggcgcaccg

SEQ ID NO: 430459 - RNA, 17 nt, Bordetella pertussis
gggcgcauccagcucgg

SEQ ID NO: 430460 - RNA, 19 nt, Bordetella pertussis
gggcgccagcagcgggcug

SEQ ID NO: 430461 - RNA, 13 nt, Bordetella pertussis
gggcgccaggcug

SEQ ID NO: 430462 - RNA, 16 nt, Bordetella pertussis
gggcgcccgcgcgcga

SEQ ID NO: 430463 - RNA, 19 nt, Bordetella pertussis
gggcgcccgcgcgcgagcu

SEQ ID NO: 430464 - RNA, 18 nt, Bordetella pertussis
gggcgccgauccagccca

SEQ ID NO: 430465 - RNA, 22 nt, Bordetella pertussis
gggcgccgcgccggggcggcgc

SEQ ID NO: 430466 - RNA, 17 nt, Bordetella pertussis
gggcgccgcggcggcga

SEQ ID NO: 430467 - RNA, 12 nt, Bordetella pertussis
gggcgccgggcg

SEQ ID NO: 430468 - RNA, 17 nt, Bordetella pertussis
gggcgccugcggcaggc

SEQ ID NO: 430469 - RNA, 16 nt, Bordetella pertussis
gggcgccuggcugcaa

SEQ ID NO: 430470 - RNA, 20 nt, Bordetella pertussis
gggcgccuugccgccgcgca

SEQ ID NO: 430471 - RNA, 13 nt, Bordetella pertussis
gggcgcgacgcca

SEQ ID NO: 430472 - RNA, 13 nt, Bordetella pertussis
gggcgcgaugggc

SEQ ID NO: 430473 - RNA, 20 nt, Bordetella pertussis
gggcgcgaugggccugccca

SEQ ID NO: 430474 - RNA, 14 nt, Bordetella pertussis
gggcgcgcagcagg

SEQ ID NO: 430475 - RNA, 13 nt, Bordetella pertussis
gggcgcgcccagc

SEQ ID NO: 430476 - RNA, 13 nt, Bordetella pertussis
gggcgcgcccggc

SEQ ID NO: 430477 - RNA, 15 nt, Bordetella pertussis
gggcgcgccgcagcg

SEQ ID NO: 430478 - RNA, 15 nt, Bordetella pertussis
gggcgcgccgcggcg

SEQ ID NO: 430479 - RNA, 16 nt, Bordetella pertussis
gggcgcgccggcgggc

SEQ ID NO: 430480 - RNA, 12 nt, Bordetella pertussis
gggcgcgcgcca

SEQ ID NO: 430481 - RNA, 16 nt, Bordetella pertussis
gggcgcgcgcccaggc

SEQ ID NO: 430482 - RNA, 23 nt, Bordetella pertussis
gggcgcgccagcacgaaccacag

SEQ ID NO: 430483 - RNA, 16 nt, Bordetella pertussis
gggcgcgcugcccagc

SEQ ID NO: 430484 - RNA, 15 nt, Bordetella pertussis
gggcgcggcaggcgg

SEQ ID NO: 430485 - RNA, 14 nt, Bordetella pertussis
gggcgcggccaggc

SEQ ID NO: 430486 - RNA, 17 nt, Bordetella pertussis
gggcgcggccaggcgcu

SEQ ID NO: 430487 - RNA, 22 nt, Bordetella pertussis
gggcgcggccaggcgcucagcg

SEQ ID NO: 430488 - RNA, 15 nt, Bordetella pertussis
gggcgcggccagggu

SEQ ID NO: 430489 - RNA, 21 nt, Bordetella pertussis
gggcgcggcgcgcgccgaggu

SEQ ID NO: 430490 - RNA, 14 nt, Bordetella pertussis
gggcgcggcggccu

SEQ ID NO: 430491 - RNA, 22 nt, Bordetella pertussis
gggcgcggcggccugggcgggc

SEQ ID NO: 430492 - RNA, 15 nt, Bordetella pertussis
gggcgcgggagcccg

SEQ ID NO: 430493 - RNA, 20 nt, Bordetella pertussis
gggcgcggugcgcaccaggc

SEQ ID NO: 430494 - RNA, 15 nt, Bordetella pertussis
gggcgcguccaagca

SEQ ID NO: 430495 - RNA, 16 nt, Bordetella pertussis
gggcgcucgagcgccu

SEQ ID NO: 430496 - RNA, 18 nt, Bordetella pertussis
gggcgcucgagcgccugc

SEQ ID NO: 430497 - RNA, 20 nt, Bordetella pertussis
gggcggucaaugcggcggcg

SEQ ID NO: 430498 - RNA, 21 nt, Bordetella pertussis
gggcgguccgguucgcccacc

SEQ ID NO: 430499 - RNA, 17 nt, Bordetella pertussis
gggcgguacaggucgag

SEQ ID NO: 430500 - RNA, 14 nt, Bordetella pertussis
gggcggugcggccu

SEQ ID NO: 430501 - RNA, 16 nt, Bordetella pertussis
gggcgucaucggcgcg

SEQ ID NO: 430502 - RNA, 13 nt, Bordetella pertussis
gggcgucccaggc

SEQ ID NO: 430503 - RNA, 14 nt, Bordetella pertussis
gggcgucgcggcgu

SEQ ID NO: 430504 - RNA, 18 nt, Bordetella pertussis
gggcgucguccugcagca

SEQ ID NO: 430505 - RNA, 22 nt, Bordetella pertussis
gggcgucguccugcagcagggu

SEQ ID NO: 430506 - RNA, 23 nt, Bordetella pertussis
gggcgugaaaggccagcggcggu

SEQ ID NO: 430507 - RNA, 13 nt, Bordetella pertussis
gggcgugagcagg

SEQ ID NO: 430508 - RNA, 18 nt, Bordetella pertussis
gggcgugagcaggcgccu

SEQ ID NO: 430509 - RNA, 20 nt, Bordetella pertussis
gggcgugaugccgaccaggc

SEQ ID NO: 430510 - RNA, 20 nt, Bordetella pertussis
gggcgugcccuugagcgugg

SEQ ID NO: 430511 - RNA, 15 nt, Bordetella pertussis
gggcguggcgcaggg

SEQ ID NO: 430512 - RNA, 19 nt, Bordetella pertussis
gggcguucgacgggcaggc

SEQ ID NO: 430513 - RNA, 21 nt, Bordetella pertussis
gggcguucgacgggcaggccc

SEQ ID NO: 430514 - RNA, 23 nt, Bordetella pertussis
gggcugcacgauguugccgccgg

SEQ ID NO: 430515 - RNA, 14 nt, Bordetella pertussis
gggcugcccucgcc

SEQ ID NO: 430516 - RNA, 18 nt, Bordetella pertussis
gggcugccguagcccagg

SEQ ID NO: 430517 - RNA, 19 nt, Bordetella pertussis
gggcugccguagcccaggu

SEQ ID NO: 430518 - RNA, 12 nt, Bordetella pertussis
gggcugcggcgg

SEQ ID NO: 430519 - RNA, 15 nt, Bordetella pertussis
gggcugcgugcggga

SEQ ID NO: 430520 - RNA, 18 nt, Bordetella pertussis
gggcugcugggccggcgc

SEQ ID NO: 430521 - RNA, 19 nt, Bordetella pertussis
gggcuggagaacgagccgg

SEQ ID NO: 430522 - RNA, 13 nt, Bordetella pertussis
gggcuggccgccg

SEQ ID NO: 430523 - RNA, 18 nt, Bordetella pertussis
gggcuggccgccgcggcc

SEQ ID NO: 430524 - RNA, 16 nt, Bordetella pertussis
gggcuggccgccugcu

SEQ ID NO: 430525 - RNA, 16 nt, Bordetella pertussis
gggcuggcgcggcugg

SEQ ID NO: 430526 - RNA, 18 nt, Bordetella pertussis
gggcuugccggugcucgg

SEQ ID NO: 430527 - RNA, 20 nt, Bordetella pertussis
gggcuugcggcgcuggcugg

SEQ ID NO: 430528 - RNA, 14 nt, Bordetella pertussis
gggcuuuuuccugu

SEQ ID NO: 430529 - RNA, 14 nt, Bordetella pertussis
gggcuuuuugccuu

SEQ ID NO: 430530 - RNA, 23 nt, Bordetella pertussis
gggcuuuuugccuuggggcggcc

SEQ ID NO: 430531 - RNA, 15 nt, Bordetella pertussis
gggcuuuuuugccuu

SEQ ID NO: 430532 - RNA, 23 nt, Bordetella pertussis
ggggaacaggcgcgccagccgcg

SEQ ID NO: 430533 - RNA, 16 nt, Bordetella pertussis
ggggaaccgcaccgga

SEQ ID NO: 430534 - RNA, 13 nt, Bordetella pertussis
ggggacaggcacc

SEQ ID NO: 430535 - RNA, 16 nt, Bordetella pertussis
ggggacaggcacccug

SEQ ID NO: 430536 - RNA, 21 nt, Bordetella pertussis
ggggacaggcaccgaacccug

SEQ ID NO: 430537 - RNA, 13 nt, Bordetella pertussis
ggggacaggcgcc

SEQ ID NO: 430538 - RNA, 19 nt, Bordetella pertussis
ggggacgccggcgggcagg

SEQ ID NO: 430539 - RNA, 19 nt, Bordetella pertussis
ggggacggcgcacccgcgg

SEQ ID NO: 430540 - RNA, 23 nt, Bordetella pertussis
ggggagcgacccguggcccgggu

SEQ ID NO: 430541 - RNA, 22 nt, Bordetella pertussis
ggguagcugcugacugugcagc

SEQ ID NO: 430542 - RNA, 14 nt, Bordetella pertussis
ggguagucggccac

SEQ ID NO: 430543 - RNA, 18 nt, Bordetella pertussis
gggucaggcugcggcgga

SEQ ID NO: 430544 - RNA, 17 nt, Bordetella pertussis
gggucaggggcaggugc

SEQ ID NO: 430545 - RNA, 15 nt, Bordetella pertussis
ggguccggccgcgca

SEQ ID NO: 430546 - RNA, 21 nt, Bordetella pertussis
ggguccggccgcgcaaggcgg

SEQ ID NO: 430547 - RNA, 14 nt, Bordetella pertussis
ggguccugaggcca

SEQ ID NO: 430548 - RNA, 17 nt, Bordetella pertussis
ggguccugaggccaggc

SEQ ID NO: 430549 - RNA, 14 nt, Bordetella pertussis
gggucggggcaggc

SEQ ID NO: 430550 - RNA, 21 nt, Bordetella pertussis
gggucuaucccccgcggagga

SEQ ID NO: 430551 - RNA, 16 nt, Bordetella pertussis
gggucugcaggccgaa

SEQ ID NO: 430552 - RNA, 20 nt, Bordetella pertussis
gggucugcuggucgcgggcc

SEQ ID NO: 430553 - RNA, 18 nt, Bordetella pertussis
gggucuugccgcgcagcg

SEQ ID NO: 430554 - RNA, 19 nt, Bordetella pertussis
gggugaagccaagcagggc

SEQ ID NO: 430555 - RNA, 15 nt, Bordetella pertussis
gggugaggcgacggu

SEQ ID NO: 430556 - RNA, 21 nt, Bordetella pertussis
gggugccuguccccgcgggga

SEQ ID NO: 430557 - RNA, 19 nt, Bordetella pertussis
gggugccugucccggcugg

SEQ ID NO: 430558 - RNA, 20 nt, Bordetella pertussis
ggguggaaaugccggcggcg

SEQ ID NO: 430559 - RNA, 19 nt, Bordetella pertussis
ggguggagaauucggcgcg

SEQ ID NO: 430560 - RNA, 14 nt, Bordetella pertussis
ggguggccggcgcg

SEQ ID NO: 430561 - RNA, 12 nt, Bordetella pertussis
ggguuccacagc

SEQ ID NO: 430562 - RNA, 21 nt, Bordetella pertussis
ggguuccugcccauggcaagc

SEQ ID NO: 430563 - RNA, 17 nt, Bordetella pertussis
ggguucgugggcgagcg

SEQ ID NO: 430564 - RNA, 20 nt, Bordetella pertussis
ggguugcaguucgccggcgc

SEQ ID NO: 430565 - RNA, 21 nt, Bordetella pertussis
ggguugccaagauggcccagg

SEQ ID NO: 430566 - RNA, 15 nt, Bordetella pertussis
ggguugcccggcagg

SEQ ID NO: 430567 - RNA, 20 nt, Bordetella pertussis
ggguuuuuuuuugggaaggc

SEQ ID NO: 430568 - RNA, 16 nt, Bordetella pertussis
gguaaagaccuuggga

SEQ ID NO: 430569 - RNA, 18 nt, Bordetella pertussis
gguaaagcgccggcccgc

SEQ ID NO: 430570 - RNA, 21 nt, Bordetella pertussis
gguaaugacgcagccgcccgg

SEQ ID NO: 430571 - RNA, 13 nt, Bordetella pertussis
gguacagccccag

SEQ ID NO: 430572 - RNA, 19 nt, Bordetella pertussis
gguacagccccagcgccag

SEQ ID NO: 430573 - RNA, 22 nt, Bordetella pertussis
gguacagccccagcgccagcgu

SEQ ID NO: 430574 - RNA, 17 nt, Bordetella pertussis
gguacaggccggcggcg

SEQ ID NO: 430575 - RNA, 15 nt, Bordetella pertussis
gguaccaggcggcga

SEQ ID NO: 430576 - RNA, 23 nt, Bordetella pertussis
gguacgacggccggggcccgcgg

SEQ ID NO: 430577 - RNA, 18 nt, Bordetella pertussis
gguacgcccagcugggcc

SEQ ID NO: 430578 - RNA, 21 nt, Bordetella pertussis
gguaggccacgcgcgggcugg

SEQ ID NO: 430579 - RNA, 17 nt, Bordetella pertussis
gguaggcaaagcgcagc

SEQ ID NO: 430580 - RNA, 22 nt, Bordetella pertussis
gguaggcgcccgacggcgcgcc

SEQ ID NO: 430581 - RNA, 15 nt, Bordetella pertussis
gguaggcgggacugg

SEQ ID NO: 430582 - RNA, 15 nt, Bordetella pertussis
gguaggugugagcgu

SEQ ID NO: 430583 - RNA, 18 nt, Bordetella pertussis
gguaguaaucgcgcgcca

SEQ ID NO: 430584 - RNA, 17 nt, Bordetella pertussis
gguagucggccaccagg

SEQ ID NO: 430585 - RNA, 19 nt, Bordetella pertussis
gguagugcggcgccagcug

SEQ ID NO: 430586 - RNA, 17 nt, Bordetella pertussis
gguaucggccagcacgu

SEQ ID NO: 430587 - RNA, 20 nt, Bordetella pertussis
gguaucggccgggccgggca

SEQ ID NO: 430588 - RNA, 20 nt, Bordetella pertussis
gguaugaccggcgcggccug

SEQ ID NO: 430589 - RNA, 23 nt, Bordetella pertussis
gguaugcacgaugccgucgccgc

SEQ ID NO: 430590 - RNA, 20 nt, Bordetella pertussis
ggucacccggcgcaugcugg

SEQ ID NO: 430591 - RNA, 14 nt, Bordetella pertussis
ggucacgcccaggc

SEQ ID NO: 430592 - RNA, 21 nt, Bordetella pertussis
ggucagcaucagcagacccug

SEQ ID NO: 430593 - RNA, 22 nt, Bordetella pertussis
ggucagcaugaagcugcccagc

SEQ ID NO: 430594 - RNA, 23 nt, Bordetella pertussis
ggucagcaugaagcugcccagca

SEQ ID NO: 430595 - RNA, 12 nt, Bordetella pertussis
ggucagcccagg

SEQ ID NO: 430596 - RNA, 13 nt, Bordetella pertussis
ggucagccagagc

SEQ ID NO: 430597 - RNA, 15 nt, Bordetella pertussis
ggucagcgccagggu

SEQ ID NO: 430598 - RNA, 23 nt, Bordetella pertussis
ggucagcucgucgccgcuggaca

SEQ ID NO: 430599 - RNA, 17 nt, Bordetella pertussis
ggucagcuggaacgcgc

SEQ ID NO: 430600 - RNA, 15 nt, Bordetella pertussis
ggucaggaaguccug

SEQ ID NO: 430601 - RNA, 14 nt, Bordetella pertussis
ggucaggacgacga

SEQ ID NO: 430602 - RNA, 15 nt, Bordetella pertussis
ggucaggaugcgcgc

SEQ ID NO: 430603 - RNA, 13 nt, Bordetella pertussis
ggucaggccgccg

SEQ ID NO: 430604 - RNA, 19 nt, Bordetella pertussis
ggucaggccguuggcgcgc

SEQ ID NO: 430605 - RNA, 14 nt, Bordetella pertussis
ggucaggggcaggc

SEQ ID NO: 430606 - RNA, 18 nt, Bordetella pertussis
gguccuggcggccgccca

SEQ ID NO: 430607 - RNA, 12 nt, Bordetella pertussis
gguccugggccg

SEQ ID NO: 430608 - RNA, 18 nt, Bordetella pertussis
gguccuuggaguucuucu

SEQ ID NO: 430609 - RNA, 20 nt, Bordetella pertussis
ggucgaagcacugcaggcca

SEQ ID NO: 430610 - RNA, 22 nt, Bordetella pertussis
ggucgacauacgcgaugccgau

SEQ ID NO: 430611 - RNA, 17 nt, Bordetella pertussis
ggucgacauagacgcgc

SEQ ID NO: 430612 - RNA, 14 nt, Bordetella pertussis
ggucgaccagcagc

SEQ ID NO: 430613 - RNA, 22 nt, Bordetella pertussis
ggucgaccugcuugcccagcag

SEQ ID NO: 430614 - RNA, 23 nt, Bordetella pertussis
ggucgacguccgcccgguuggug

SEQ ID NO: 430615 - RNA, 18 nt, Bordetella pertussis
ggucgagcgccugcgcca

SEQ ID NO: 430616 - RNA, 12 nt, Bordetella pertussis
ggucgagcgcuc

SEQ ID NO: 430617 - RNA, 17 nt, Bordetella pertussis
ggucgagcgggcgccag

SEQ ID NO: 430618 - RNA, 23 nt, Bordetella pertussis
ggucgaucgcaucgcggcagccc

SEQ ID NO: 430619 - RNA, 16 nt, Bordetella pertussis
ggucgaucagccccug

SEQ ID NO: 430620 - RNA, 11 nt, Bordetella pertussis
ggucgaugcca

SEQ ID NO: 430621 - RNA, 13 nt, Bordetella pertussis
ggucgaugccagu

SEQ ID NO: 430622 - RNA, 14 nt, Bordetella pertussis
ggucgauucgaaac

SEQ ID NO: 430623 - RNA, 12 nt, Bordetella pertussis
ggucgccagcag

SEQ ID NO: 430624 - RNA, 22 nt, Bordetella pertussis
ggucgccgcgggcaaagcccag

SEQ ID NO: 430625 - RNA, 17 nt, Bordetella pertussis
ggucgccgggcagcggg

SEQ ID NO: 430626 - RNA, 16 nt, Bordetella pertussis
ggucgccguucuggug

SEQ ID NO: 430627 - RNA, 19 nt, Bordetella pertussis
ggucgcgaccaccgugaua

SEQ ID NO: 430628 - RNA, 18 nt, Bordetella pertussis
ggucgcgaccucggcggc

SEQ ID NO: 430629 - RNA, 20 nt, Bordetella pertussis
ggucgcgaccucggcggcgu

SEQ ID NO: 430630 - RNA, 17 nt, Bordetella pertussis
ggucgcuguagcgcagc

SEQ ID NO: 430631 - RNA, 21 nt, Bordetella pertussis
ggucgcuguagcgcagccccg

SEQ ID NO: 430632 - RNA, 12 nt, Bordetella pertussis
ggucggacgcgc

SEQ ID NO: 430633 - RNA, 17 nt, Bordetella pertussis
ggucggagucggcgccg

SEQ ID NO: 430634 - RNA, 21 nt, Bordetella pertussis
ggucggauagaguucggcgcg

SEQ ID NO: 430635 - RNA, 21 nt, Bordetella pertussis
ggucggcaaugacauccucgg

SEQ ID NO: 430636 - RNA, 22 nt, Bordetella pertussis
ggucggcacgucgggcaggaug

SEQ ID NO: 430637 - RNA, 19 nt, Bordetella pertussis
ggucggcauggccaggaag

SEQ ID NO: 430638 - RNA, 16 nt, Bordetella pertussis
ggucggccgcuccgcc

SEQ ID NO: 430639 - RNA, 15 nt, Bordetella pertussis
ggucggcgcccacgc

SEQ ID NO: 430640 - RNA, 13 nt, Bordetella pertussis
ggucgucgcggcc

SEQ ID NO: 430641 - RNA, 14 nt, Bordetella pertussis
ggucgucggccacg

SEQ ID NO: 430642 - RNA, 23 nt, Bordetella pertussis
ggucgugcggcacgcacagcaug

SEQ ID NO: 430643 - RNA, 20 nt, Bordetella pertussis
ggucugguuuuucgaagagc

SEQ ID NO: 430644 - RNA, 18 nt, Bordetella pertussis
ggucuucacauagcccgg

SEQ ID NO: 430645 - RNA, 20 nt, Bordetella pertussis
ggugaaagccgccggcgcgc

SEQ ID NO: 430646 - RNA, 16 nt, Bordetella pertussis
ggugaacggccccgcc

SEQ ID NO: 430647 - RNA, 19 nt, Bordetella pertussis
ggugaacggccccgccagg

SEQ ID NO: 430648 - RNA, 14 nt, Bordetella pertussis
ggugacgcccugcc

SEQ ID NO: 430649 - RNA, 19 nt, Bordetella pertussis
ggugacgcuggagcgcggc

SEQ ID NO: 430650 - RNA, 21 nt, Bordetella pertussis
ggugacgggcugggccgaggc

SEQ ID NO: 430651 - RNA, 18 nt, Bordetella pertussis
ggugacuuccugguacac

SEQ ID NO: 430652 - RNA, 13 nt, Bordetella pertussis
ggugagugcccau

SEQ ID NO: 430653 - RNA, 14 nt, Bordetella pertussis
ggugauaaggcuca

SEQ ID NO: 430654 - RNA, 15 nt, Bordetella pertussis
ggugaucugcucgcc

SEQ ID NO: 430655 - RNA, 15 nt, Bordetella pertussis
ggugcaagcggccgg

SEQ ID NO: 430656 - RNA, 19 nt, Bordetella pertussis
ggugcacagcgucccagcc

SEQ ID NO: 430657 - RNA, 20 nt, Bordetella pertussis
ggugcacgugggcacgccgg

SEQ ID NO: 430658 - RNA, 13 nt, Bordetella pertussis
ggugcagccgccg

SEQ ID NO: 430659 - RNA, 15 nt, Bordetella pertussis
ggugcagccgccgca

SEQ ID NO: 430660 - RNA, 17 nt, Bordetella pertussis
ggugcagcggcucgacg

SEQ ID NO: 430661 - RNA, 18 nt, Bordetella pertussis
ggugcagcguggcgcggg

SEQ ID NO: 430662 - RNA, 21 nt, Bordetella pertussis
ggugccgaagaugggggugga

SEQ ID NO: 430663 - RNA, 19 nt, Bordetella pertussis
ggugccgcccaccgugacc

SEQ ID NO: 430664 - RNA, 19 nt, Bordetella pertussis
ggugccgcgcacccaggcc

SEQ ID NO: 430665 - RNA, 18 nt, Bordetella pertussis
ggugccgcgcgcggccgg

SEQ ID NO: 430666 - RNA, 21 nt, Bordetella pertussis
ggugccgcguaugcggcagca

SEQ ID NO: 430667 - RNA, 23 nt, Bordetella pertussis
ggugccgcguaugcggcagcagg

SEQ ID NO: 430668 - RNA, 14 nt, Bordetella pertussis
ggugccggccagcc

SEQ ID NO: 430669 - RNA, 20 nt, Bordetella pertussis
ggugccggccagccugcccg

SEQ ID NO: 430670 - RNA, 13 nt, Bordetella pertussis
ggugccguccagc

SEQ ID NO: 430671 - RNA, 17 nt, Bordetella pertussis
ggugccguccagcgcgg

SEQ ID NO: 430672 - RNA, 18 nt, Bordetella pertussis
ggugccguccagcgcggc

SEQ ID NO: 430673 - RNA, 18 nt, Bordetella pertussis
ggugccguccggcaccuc

SEQ ID NO: 430674 - RNA, 19 nt, Bordetella pertussis
ggugccgugggcgaacugg

SEQ ID NO: 430675 - RNA, 17 nt, Bordetella pertussis
ggugccguucggccagc

SEQ ID NO: 430676 - RNA, 20 nt, Bordetella pertussis
ggugccguucggccagcgcg

SEQ ID NO: 430677 - RNA, 23 nt, Bordetella pertussis
ggugccguucggccagcgcgcgg

SEQ ID NO: 430678 - RNA, 20 nt, Bordetella pertussis
ggugccugccccugcgggga

SEQ ID NO: 430679 - RNA, 15 nt, Bordetella pertussis
ggugccuguccccac

SEQ ID NO: 430680 - RNA, 14 nt, Bordetella pertussis
ggugccuguccccc

SEQ ID NO: 430681 - RNA, 15 nt, Bordetella pertussis
ggugccuguccccga

SEQ ID NO: 430682 - RNA, 19 nt, Bordetella pertussis
ggugccugucccggcuggg

SEQ ID NO: 430683 - RNA, 22 nt, Bordetella pertussis
ggugccugucccugcgggggca

SEQ ID NO: 430684 - RNA, 18 nt, Bordetella pertussis
ggugccuguccuccccgc

SEQ ID NO: 430685 - RNA, 24 nt, Bordetella pertussis
ggugccugugcccgcagagggagc

SEQ ID NO: 430686 - RNA, 19 nt, Bordetella pertussis
ggugcgcacgauggggccg

SEQ ID NO: 430687 - RNA, 13 nt, Bordetella pertussis
ggugcgcagccgg

SEQ ID NO: 430688 - RNA, 19 nt, Bordetella pertussis
ggugcgcagcggcaggcgg

SEQ ID NO: 430689 - RNA, 15 nt, Bordetella pertussis
ggugcgccagcacgg

SEQ ID NO: 430690 - RNA, 18 nt, Bordetella pertussis
ggugcgccgccgccgcgg

SEQ ID NO: 430691 - RNA, 17 nt, Bordetella pertussis
ggugcgccugacccagu

SEQ ID NO: 430692 - RNA, 19 nt, Bordetella pertussis
ggugcgccugcagcgccgc

SEQ ID NO: 430693 - RNA, 15 nt, Bordetella pertussis
ggugcgcgcagggcg

SEQ ID NO: 430694 - RNA, 20 nt, Bordetella pertussis
ggugcgcgccacauccugca

SEQ ID NO: 430695 - RNA, 16 nt, Bordetella pertussis
ggugcgcgcgcccacc

SEQ ID NO: 430696 - RNA, 17 nt, Bordetella pertussis
ggugcgcgcggccgagg

SEQ ID NO: 430697 - RNA, 17 nt, Bordetella pertussis
ggugcgcggcuugcagc

SEQ ID NO: 430698 - RNA, 19 nt, Bordetella pertussis
ggugcgcggcuugcagcgg

SEQ ID NO: 430699 - RNA, 18 nt, Bordetella pertussis
ggugcgcguccugggccg

SEQ ID NO: 430700 - RNA, 20 nt, Bordetella pertussis
ggugcggccaugauacccau

SEQ ID NO: 430701 - RNA, 15 nt, Bordetella pertussis
ggugcggccgcagcg

SEQ ID NO: 430702 - RNA, 20 nt, Bordetella pertussis
ggugcgggcaaacggcggca

SEQ ID NO: 430703 - RNA, 19 nt, Bordetella pertussis
ggugcggggugccuguccc

SEQ ID NO: 430704 - RNA, 23 nt, Bordetella pertussis
ggugcgguaggcgcccgacggcg

SEQ ID NO: 430705 - RNA, 21 nt, Bordetella pertussis
ggugcgguugcgaggcggccu

SEQ ID NO: 430706 - RNA, 14 nt, Bordetella pertussis
ggugcguccaggac

SEQ ID NO: 430707 - RNA, 17 nt, Bordetella pertussis
ggugcgugcgcccaugg

SEQ ID NO: 430708 - RNA, 18 nt, Bordetella pertussis
ggugcucaguuucuucgg

SEQ ID NO: 430709 - RNA, 15 nt, Bordetella pertussis
ggugcuccugccagg

SEQ ID NO: 430710 - RNA, 17 nt, Bordetella pertussis
ggugcuccugccaggcg

SEQ ID NO: 430711 - RNA, 16 nt, Bordetella pertussis
gguggaaaugccggcg

SEQ ID NO: 430712 - RNA, 19 nt, Bordetella pertussis
gguggaaaugccggcggcg

SEQ ID NO: 430713 - RNA, 12 nt, Bordetella pertussis
gguggagcgcgg

SEQ ID NO: 430714 - RNA, 16 nt, Bordetella pertussis
gguggagcgcggcgcu

SEQ ID NO: 430715 - RNA, 15 nt, Bordetella pertussis
gguggaggacgccga

SEQ ID NO: 430716 - RNA, 22 nt, Bordetella pertussis
gguggaucgacgagaugccgau

SEQ ID NO: 430717 - RNA, 17 nt, Bordetella pertussis
gguggcgaucaguuccu

SEQ ID NO: 430718 - RNA, 15 nt, Bordetella pertussis
gguggcgggcgccug

SEQ ID NO: 430719 - RNA, 17 nt, Bordetella pertussis
gguggcuggggcuggca

SEQ ID NO: 430720 - RNA, 16 nt, Bordetella pertussis
ggugggaaucggcacc

SEQ ID NO: 430721 - RNA, 19 nt, Bordetella pertussis
ggugggcaccucggggugc

SEQ ID NO: 430722 - RNA, 23 nt, Bordetella pertussis
ggugggcacgcgcuugaggcugg

SEQ ID NO: 430723 - RNA, 22 nt, Bordetella pertussis
ggugggauccucgcugccggcg

SEQ ID NO: 430724 - RNA, 23 nt, Bordetella pertussis
ggugggcaggucgggcagggugg

SEQ ID NO: 430725 - RNA, 17 nt, Bordetella pertussis
gguggucugccagucca

SEQ ID NO: 430726 - RNA, 16 nt, Bordetella pertussis
gguggugcugggcggc

SEQ ID NO: 430727 - RNA, 23 nt, Bordetella pertussis
gguggugcugcucaacggccacc

SEQ ID NO: 430728 - RNA, 16 nt, Bordetella pertussis
gguggugucggcggcc

SEQ ID NO: 430729 - RNA, 21 nt, Bordetella pertussis
gguggugucggcggccagcag

SEQ ID NO: 430730 - RNA, 16 nt, Bordetella pertussis
gguguccuggucggcg

SEQ ID NO: 430731 - RNA, 13 nt, Bordetella pertussis
ggugucgaacagc

SEQ ID NO: 430732 - RNA, 11 nt, Bordetella pertussis
ggugucgccgc

SEQ ID NO: 430733 - RNA, 11 nt, Bordetella pertussis
ggugucgccgu

SEQ ID NO: 430734 - RNA, 13 nt, Bordetella pertussis
ggugucggccagg

SEQ ID NO: 430735 - RNA, 19 nt, Bordetella pertussis
ggugucggccagggcggcg

SEQ ID NO: 430736 - RNA, 13 nt, Bordetella pertussis
ggugucggcggcc

SEQ ID NO: 430737 - RNA, 21 nt, Bordetella pertussis
ggugugagcguaagcccacuc

SEQ ID NO: 430738 - RNA, 22 nt, Bordetella pertussis
gguuaacgaaucgcugccuucg

SEQ ID NO: 430739 - RNA, 16 nt, Bordetella pertussis
guaaagcggugcuuga

SEQ ID NO: 430740 - RNA, 15 nt, Bordetella pertussis
guacccaugcggggc

SEQ ID NO: 430741 - RNA, 21 nt, Bordetella pertussis
guacccaugcggggcggcggg

SEQ ID NO: 430742 - RNA, 18 nt, Bordetella pertussis
guacccgcgccggcggca

SEQ ID NO: 430743 - RNA, 19 nt, Bordetella pertussis
guacccggcuucuggguca

SEQ ID NO: 430744 - RNA, 18 nt, Bordetella pertussis
guaccguccuggcaguca

SEQ ID NO: 430745 - RNA, 15 nt, Bordetella pertussis
guaccguucgcugcc

SEQ ID NO: 430746 - RNA, 22 nt, Bordetella pertussis
guacuccuaucuuucgggcgcg

SEQ ID NO: 430747 - RNA, 17 nt, Bordetella pertussis
guacuggccgacgggug

SEQ ID NO: 430748 - RNA, 21 nt, Bordetella pertussis
guacuggcgcggcggccaggc

SEQ ID NO: 430749 - RNA, 22 nt, Bordetella pertussis
guacuggcgcggcggccaggcg

SEQ ID NO: 430750 - RNA, 15 nt, Bordetella pertussis
guacuggcuggucuu

SEQ ID NO: 430751 - RNA, 22 nt, Bordetella pertussis
guacuggucgcgcagcugccug

SEQ ID NO: 430752 - RNA, 18 nt, Bordetella pertussis
guagaccaccagcaggau

SEQ ID NO: 430753 - RNA, 20 nt, Bordetella pertussis
guagaccugcgggccgcaca

SEQ ID NO: 430754 - RNA, 14 nt, Bordetella pertussis
guagagcgccgcgu

SEQ ID NO: 430755 - RNA, 14 nt, Bordetella pertussis
guagaggcgcggcu

SEQ ID NO: 430756 - RNA, 13 nt, Bordetella pertussis
guagaucagcgcg

SEQ ID NO: 430757 - RNA, 22 nt, Bordetella pertussis
guagaucagccgcugcagcacg

SEQ ID NO: 430758 - RNA, 18 nt, Bordetella pertussis
guagcgcagccccguuuc

SEQ ID NO: 430759 - RNA, 23 nt, Bordetella pertussis
guagcgcaucgcgaugcgcagca

SEQ ID NO: 430760 - RNA, 16 nt, Bordetella pertussis
guagcgcguggccagc

SEQ ID NO: 430761 - RNA, 17 nt, Bordetella pertussis
guagcgcguggccagca

SEQ ID NO: 430762 - RNA, 12 nt, Bordetella pertussis
guagcucagccu

SEQ ID NO: 430763 - RNA, 14 nt, Bordetella pertussis
guaggcaaagcgca

SEQ ID NO: 430764 - RNA, 18 nt, Bordetella pertussis
guaggcaaagcgcagcag

SEQ ID NO: 430765 - RNA, 23 nt, Bordetella pertussis
guaggccacgcgcgggcuggggu

SEQ ID NO: 430766 - RNA, 19 nt, Bordetella pertussis
guaggccuggucggggucg

SEQ ID NO: 430767 - RNA, 14 nt, Bordetella pertussis
guaggcggccaggc

SEQ ID NO: 430768 - RNA, 23 nt, Bordetella pertussis
guaggcggccggcugcaccagcg

SEQ ID NO: 430769 - RNA, 21 nt, Bordetella pertussis
guaggcggccuugagcaucug

SEQ ID NO: 430770 - RNA, 16 nt, Bordetella pertussis
guagguaugguuggcc

SEQ ID NO: 430771 - RNA, 21 nt, Bordetella pertussis
guagguaugguuggccacgaa

SEQ ID NO: 430772 - RNA, 14 nt, Bordetella pertussis
guaggucaggccca

SEQ ID NO: 430773 - RNA, 14 nt, Bordetella pertussis
guaggugugagcgu

SEQ ID NO: 430774 - RNA, 17 nt, Bordetella pertussis
guaguacagcagcagca

SEQ ID NO: 430775 - RNA, 13 nt, Bordetella pertussis
guaguagcccagg

SEQ ID NO: 430776 - RNA, 18 nt, Bordetella pertussis
guagucggccaccaggcc

SEQ ID NO: 430777 - RNA, 23 nt, Bordetella pertussis
guagucgccggcuuccagcagca

SEQ ID NO: 430778 - RNA, 14 nt, Bordetella pertussis
guagugcuccacca

SEQ ID NO: 430779 - RNA, 18 nt, Bordetella pertussis
guagugguguagccagga

SEQ ID NO: 430780 - RNA, 23 nt, Bordetella pertussis
guaguguucgauggcggccaggg

SEQ ID NO: 430781 - RNA, 22 nt, Bordetella pertussis
guaguucggcgcgugcggaugc

SEQ ID NO: 430782 - RNA, 18 nt, Bordetella pertussis
guaguugggcgccuugcc

SEQ ID NO: 430783 - RNA, 13 nt, Bordetella pertussis
gucaagcggcugc

SEQ ID NO: 430784 - RNA, 14 nt, Bordetella pertussis
gucaaugcggcggc

SEQ ID NO: 430785 - RNA, 14 nt, Bordetella pertussis
gucacccggcgcau

SEQ ID NO: 430786 - RNA, 17 nt, Bordetella pertussis
gucaccgccgccgccac

SEQ ID NO: 430787 - RNA, 17 nt, Bordetella pertussis
gucacgcccaggcgcug

SEQ ID NO: 430788 - RNA, 18 nt, Bordetella pertussis
gucacgccgaugaccagg

SEQ ID NO: 430789 - RNA, 20 nt, Bordetella pertussis
gucacgccgaugaccagggc

SEQ ID NO: 430790 - RNA, 19 nt, Bordetella pertussis
gucacgcggccgggcacac

SEQ ID NO: 430791 - RNA, 15 nt, Bordetella pertussis
gucacggaucagccg

SEQ ID NO: 430792 - RNA, 20 nt, Bordetella pertussis
gucacguucgaccugccgcc

SEQ ID NO: 430793 - RNA, 23 nt, Bordetella pertussis
gucacugccgaaacgcuggcgua

SEQ ID NO: 430794 - RNA, 14 nt, Bordetella pertussis
gucagacgcgcuuu

SEQ ID NO: 430795 - RNA, 19 nt, Bordetella pertussis
gucagcacgcccuggcuga

SEQ ID NO: 430796 - RNA, 19 nt, Bordetella pertussis
gucagcacuugccggccgc

SEQ ID NO: 430797 - RNA, 10 nt, Bordetella pertussis
gucagcagcg

SEQ ID NO: 430798 - RNA, 14 nt, Bordetella pertussis
gucagcccggcggc

SEQ ID NO: 430799 - RNA, 22 nt, Bordetella pertussis
gucagccugggcgccuggcugc

SEQ ID NO: 430800 - RNA, 22 nt, Bordetella pertussis
gucagcgcaaacgggggcaggc

SEQ ID NO: 430801 - RNA, 23 nt, Bordetella pertussis
gucagcgcaaacgggggcaggcc

SEQ ID NO: 430802 - RNA, 15 nt, Bordetella pertussis
gucagcggcgcgccc

SEQ ID NO: 430803 - RNA, 23 nt, Bordetella pertussis
gucagcuuccagaucgaccagga

SEQ ID NO: 430804 - RNA, 16 nt, Bordetella pertussis
gucaggaugcgcgcca

SEQ ID NO: 430805 - RNA, 22 nt, Bordetella pertussis
gucaggaugcgcgccaggcugu

SEQ ID NO: 430806 - RNA, 17 nt, Bordetella pertussis
gucaggcccacgccgcc

SEQ ID NO: 430807 - RNA, 21 nt, Bordetella pertussis
gucaggcugggagagccggcc

SEQ ID NO: 430808 - RNA, 15 nt, Bordetella pertussis
gucagggccgcccag

SEQ ID NO: 430809 - RNA, 13 nt, Bordetella pertussis
gucaggggcaggc

SEQ ID NO: 430810 - RNA, 21 nt, Bordetella pertussis
gucaggucgcugcccagcaug

SEQ ID NO: 430811 - RNA, 19 nt, Bordetella pertussis
gucaguccgcccagccagg

SEQ ID NO: 430812 - RNA, 21 nt, Bordetella pertussis
gucaguccgcccagccaggcg

SEQ ID NO: 430813 - RNA, 16 nt, Bordetella pertussis
gucaguccucaugcgg

SEQ ID NO: 430814 - RNA, 22 nt, Bordetella pertussis
gucagucgggacggcgcgggca

SEQ ID NO: 430815 - RNA, 23 nt, Bordetella pertussis
gucauaaaacagcuuccuuuauu

SEQ ID NO: 430816 - RNA, 24 nt, Bordetella pertussis
gucaugaacgucaccccgcccugc

SEQ ID NO: 430817 - RNA, 14 nt, Bordetella pertussis
gucaugacgggcgg

SEQ ID NO: 430818 - RNA, 20 nt, Bordetella pertussis
gucaugacgggcggcggcgc

SEQ ID NO: 430819 - RNA, 18 nt, Bordetella pertussis
gucaugaggccccugucc

SEQ ID NO: 430820 - RNA, 16 nt, Bordetella pertussis
gucaugcaccugcagg

SEQ ID NO: 430821 - RNA, 16 nt, Bordetella pertussis
gucaugcagaacaggg

SEQ ID NO: 430822 - RNA, 15 nt, Bordetella pertussis
guccaaaacagacag

SEQ ID NO: 430823 - RNA, 16 nt, Bordetella pertussis
guccaucgccugcacg

SEQ ID NO: 430824 - RNA, 17 nt, Bordetella pertussis
guccaucgcguccaggc

SEQ ID NO: 430825 - RNA, 18 nt, Bordetella pertussis
guccaugcgaaagcggcc

SEQ ID NO: 430826 - RNA, 20 nt, Bordetella pertussis
gucccagcggggacaggcac

SEQ ID NO: 430827 - RNA, 24 nt, Bordetella pertussis
gucccagcuucucgcaagugcugg

SEQ ID NO: 430828 - RNA, 19 nt, Bordetella pertussis
gucccaggaucaccgccgc

SEQ ID NO: 430829 - RNA, 20 nt, Bordetella pertussis
gucccaguccggcagcaccc

SEQ ID NO: 430830 - RNA, 17 nt, Bordetella pertussis
gucccagucgccgcgcc

SEQ ID NO: 430831 - RNA, 20 nt, Bordetella pertussis
guccccaccgggacaggcac

SEQ ID NO: 430832 - RNA, 21 nt, Bordetella pertussis
guccccaccgggacaggcacc

SEQ ID NO: 430833 - RNA, 19 nt, Bordetella pertussis
guccccacggggacaggca

SEQ ID NO: 430834 - RNA, 21 nt, Bordetella pertussis
guccccacggggacaggcacc

SEQ ID NO: 430835 - RNA, 19 nt, Bordetella pertussis
guccccacguggacaggca

SEQ ID NO: 430836 - RNA, 21 nt, Bordetella pertussis
guccccacguggacaggcacc

SEQ ID NO: 430837 - RNA, 22 nt, Bordetella pertussis
guccccacguggacaggcaccu

SEQ ID NO: 430838 - RNA, 15 nt, Bordetella pertussis
guccccagauccgca

SEQ ID NO: 430839 - RNA, 16 nt, Bordetella pertussis
guccccaauacccgcc

SEQ ID NO: 430840 - RNA, 23 nt, Bordetella pertussis
guccccauguggggacaggcacc

SEQ ID NO: 430841 - RNA, 17 nt, Bordetella pertussis
gucccccuacugcccuc

SEQ ID NO: 430842 - RNA, 22 nt, Bordetella pertussis
guccccgcaagggggacuggca

SEQ ID NO: 430843 - RNA, 15 nt, Bordetella pertussis
guccccgcacgggga

SEQ ID NO: 430844 - RNA, 21 nt, Bordetella pertussis
guccccgcacggggacaggca

SEQ ID NO: 430845 - RNA, 20 nt, Bordetella pertussis
guccccgcaggagcaugccc

SEQ ID NO: 430846 - RNA, 19 nt, Bordetella pertussis
guccccgcagggacaggcu

SEQ ID NO: 430847 - RNA, 21 nt, Bordetella pertussis
guccccgcagggacaggcucc

SEQ ID NO: 430848 - RNA, 23 nt, Bordetella pertussis
guccccgcauggagaccggcgcc

SEQ ID NO: 430849 - RNA, 19 nt, Bordetella pertussis
guccccgccgggacaggca

SEQ ID NO: 430850 - RNA, 21 nt, Bordetella pertussis
guccccgcggggacaggcacc

SEQ ID NO: 430851 - RNA, 23 nt, Bordetella pertussis
guccccgcggggacaggcaccgc

SEQ ID NO: 430852 - RNA, 19 nt, Bordetella pertussis
guccccgcugggacaggca

SEQ ID NO: 430853 - RNA, 22 nt, Bordetella pertussis
guccccugcggggacaggcacc

SEQ ID NO: 430854 - RNA, 15 nt, Bordetella pertussis
gucccgacggggaca

SEQ ID NO: 430855 - RNA, 19 nt, Bordetella pertussis
gucccgcaccgaccagcgc

SEQ ID NO: 430856 - RNA, 17 nt, Bordetella pertussis
gucccgcacgcagcccu

SEQ ID NO: 430857 - RNA, 21 nt, Bordetella pertussis
gucccgcacgcagcccuucgg

SEQ ID NO: 430858 - RNA, 19 nt, Bordetella pertussis
guccgcagcgcagcgccac

SEQ ID NO: 430859 - RNA, 20 nt, Bordetella pertussis
guccgcagcgcagcgccacg

SEQ ID NO: 430860 - RNA, 18 nt, Bordetella pertussis
guccgccacgccggccac

SEQ ID NO: 430861 - RNA, 16 nt, Bordetella pertussis
guccgcccagccaggc

SEQ ID NO: 430862 - RNA, 17 nt, Bordetella pertussis
guccgcccagccaggcg

SEQ ID NO: 430863 - RNA, 22 nt, Bordetella pertussis
guccgccccauccacggcgcca

SEQ ID NO: 430864 - RNA, 17 nt, Bordetella pertussis
guccgccgccgcgugga

SEQ ID NO: 430865 - RNA, 19 nt, Bordetella pertussis
guccgcuucgucgggcagc

SEQ ID NO: 430866 - RNA, 23 nt, Bordetella pertussis
guccggaucuuccuugaagccgu

SEQ ID NO: 430867 - RNA, 20 nt, Bordetella pertussis
guccggccccaggaugcgca

SEQ ID NO: 430868 - RNA, 13 nt, Bordetella pertussis
guccggccgcgca

SEQ ID NO: 430869 - RNA, 15 nt, Bordetella pertussis
guccggcgccgccgg

SEQ ID NO: 430870 - RNA, 16 nt, Bordetella pertussis
guccggcgggccgcug

SEQ ID NO: 430871 - RNA, 16 nt, Bordetella pertussis
guccguggcggccgcg

SEQ ID NO: 430872 - RNA, 14 nt, Bordetella pertussis
guccucaggcccgc

SEQ ID NO: 430873 - RNA, 18 nt, Bordetella pertussis
guccucaugcgggacagg

SEQ ID NO: 430874 - RNA, 17 nt, Bordetella pertussis
guccucgucggccaugc

SEQ ID NO: 430875 - RNA, 19 nt, Bordetella pertussis
guccugaaucgcccgggcg

SEQ ID NO: 430876 - RNA, 21 nt, Bordetella pertussis
guccugaccggcggcgcucau

SEQ ID NO: 430877 - RNA, 16 nt, Bordetella pertussis
guccugaggccaggcc

SEQ ID NO: 430878 - RNA, 17 nt, Bordetella pertussis
guccugauucacaggcc

SEQ ID NO: 430879 - RNA, 20 nt, Bordetella pertussis
guccugauucacaggcccgc

SEQ ID NO: 430880 - RNA, 18 nt, Bordetella pertussis
guccugcaggaaggccgc

SEQ ID NO: 430881 - RNA, 11 nt, Bordetella pertussis
guccugcaggu

SEQ ID NO: 430882 - RNA, 15 nt, Bordetella pertussis
guccuggcagucagc

SEQ ID NO: 430883 - RNA, 19 nt, Bordetella pertussis
guccugguugccgaggacg

SEQ ID NO: 430884 - RNA, 19 nt, Bordetella pertussis
guccuuacuugcgcacggc

SEQ ID NO: 430885 - RNA, 13 nt, Bordetella pertussis
guccuugaacgcc

SEQ ID NO: 430886 - RNA, 16 nt, Bordetella pertussis
guccuugagggcgcgg

SEQ ID NO: 430887 - RNA, 21 nt, Bordetella pertussis
guccuugagggcgcgggccag

SEQ ID NO: 430888 - RNA, 17 nt, Bordetella pertussis
guccuugacgccgccga

SEQ ID NO: 430889 - RNA, 14 nt, Bordetella pertussis
guccuugagcgcca

SEQ ID NO: 430890 - RNA, 15 nt, Bordetella pertussis
gucgagcgggcgcca

SEQ ID NO: 430891 - RNA, 19 nt, Bordetella pertussis
gucgagguacucgggggcg

SEQ ID NO: 430892 - RNA, 15 nt, Bordetella pertussis
gucgauaucgccauc

SEQ ID NO: 430893 - RNA, 20 nt, Bordetella pertussis
gucgaucauggcgccgaugg

SEQ ID NO: 430894 - RNA, 22 nt, Bordetella pertussis
gucgcacuggguggccagcgcc

SEQ ID NO: 430895 - RNA, 21 nt, Bordetella pertussis
gucgcagcacgcccagauggc

SEQ ID NO: 430896 - RNA, 20 nt, Bordetella pertussis
gucgcaggccgcggccaggc

SEQ ID NO: 430897 - RNA, 13 nt, Bordetella pertussis
gucgcaggcgcug

SEQ ID NO: 430898 - RNA, 16 nt, Bordetella pertussis
gucgcagucccagucc

SEQ ID NO: 430899 - RNA, 15 nt, Bordetella pertussis
gucgcagucggggcc

SEQ ID NO: 430900 - RNA, 16 nt, Bordetella pertussis
gucgcauuggccgccg

SEQ ID NO: 430901 - RNA, 17 nt, Bordetella pertussis
gucgcauuggccgccgc

SEQ ID NO: 430902 - RNA, 18 nt, Bordetella pertussis
gucgccagcacgcgcagc

SEQ ID NO: 430903 - RNA, 12 nt, Bordetella pertussis
gucgccagcagg

SEQ ID NO: 430904 - RNA, 14 nt, Bordetella pertussis
gucgccagcaggcc

SEQ ID NO: 430905 - RNA, 16 nt, Bordetella pertussis
gucgccaugcggcugg

SEQ ID NO: 430906 - RNA, 17 nt, Bordetella pertussis
gucgccaugcggcuggc

SEQ ID NO: 430907 - RNA, 17 nt, Bordetella pertussis
gucgcccaacgaggaca

SEQ ID NO: 430908 - RNA, 21 nt, Bordetella pertussis
gucgcccacauagaccggcug

SEQ ID NO: 430909 - RNA, 12 nt, Bordetella pertussis
gucgcccgccgc

SEQ ID NO: 430910 - RNA, 16 nt, Bordetella pertussis
gucgccgaagggcagg

SEQ ID NO: 430911 - RNA, 16 nt, Bordetella pertussis
gucgccgcccugcugc

SEQ ID NO: 430912 - RNA, 22 nt, Bordetella pertussis
gucgccgcccugcugcccgccg

SEQ ID NO: 430913 - RNA, 14 nt, Bordetella pertussis
gucgccggccaggc

SEQ ID NO: 430914 - RNA, 16 nt, Bordetella pertussis
gucgccggccaggcaa

SEQ ID NO: 430915 - RNA, 13 nt, Bordetella pertussis
gucgccggcgcug

SEQ ID NO: 430916 - RNA, 18 nt, Bordetella pertussis
gucgccgggcagcgggcc

SEQ ID NO: 430917 - RNA, 14 nt, Bordetella pertussis
gucgccgguggugu

SEQ ID NO: 430918 - RNA, 14 nt, Bordetella pertussis
gucgccguggcggg

SEQ ID NO: 430919 - RNA, 18 nt, Bordetella pertussis
gucgccguucuggcugcg

SEQ ID NO: 430920 - RNA, 23 nt, Bordetella pertussis
gucgccguucuggcugcgcgccu

SEQ ID NO: 430921 - RNA, 12 nt, Bordetella pertussis
gucgcgcgugca

SEQ ID NO: 430922 - RNA, 14 nt, Bordetella pertussis
gucgcgcgugcagg

SEQ ID NO: 430923 - RNA, 22 nt, Bordetella pertussis
gucgcgcuggggcaggacgccg

SEQ ID NO: 430924 - RNA, 20 nt, Bordetella pertussis
gucgcggaccuccugguccg

SEQ ID NO: 430925 - RNA, 18 nt, Bordetella pertussis
gucgcggccgaggccagc

SEQ ID NO: 430926 - RNA, 22 nt, Bordetella pertussis
gucgcggccguaguucggcggg

SEQ ID NO: 430927 - RNA, 23 nt, Bordetella pertussis
gucgcggcccacggccagcacuu

SEQ ID NO: 430928 - RNA, 14 nt, Bordetella pertussis
gucgcggcugggca

SEQ ID NO: 430929 - RNA, 16 nt, Bordetella pertussis
gucgcggcugggcaau

SEQ ID NO: 430930 - RNA, 15 nt, Bordetella pertussis
gucgcugaucugcuu

SEQ ID NO: 430931 - RNA, 16 nt, Bordetella pertussis
gucgcugcuggcggcg

SEQ ID NO: 430932 - RNA, 19 nt, Bordetella pertussis
gucgcugcuggcggcgcug

SEQ ID NO: 430933 - RNA, 22 nt, Bordetella pertussis
gucgcuggagaacaggcggcug

SEQ ID NO: 430934 - RNA, 13 nt, Bordetella pertussis
gucgcuggcagcc

SEQ ID NO: 430935 - RNA, 16 nt, Bordetella pertussis
gucgcuggcagccuug

SEQ ID NO: 430936 - RNA, 18 nt, Bordetella pertussis
gucgcuggccggacgcaa

SEQ ID NO: 430937 - RNA, 16 nt, Bordetella pertussis
gucgcugugcgcggcg

SEQ ID NO: 430938 - RNA, 13 nt, Bordetella pertussis
gucgcuuccagcg

SEQ ID NO: 430939 - RNA, 21 nt, Bordetella pertussis
gugaugccccagguccgccgg

SEQ ID NO: 430940 - RNA, 15 nt, Bordetella pertussis
gugaugcugcagcgc

SEQ ID NO: 430941 - RNA, 16 nt, Bordetella pertussis
gugauguccugcaggc

SEQ ID NO: 430942 - RNA, 13 nt, Bordetella pertussis
gugaugucgccgu

SEQ ID NO: 430943 - RNA, 17 nt, Bordetella pertussis
gugcaccacgcgcucca

SEQ ID NO: 430944 - RNA, 13 nt, Bordetella pertussis
gugcaccagcccg

SEQ ID NO: 430945 - RNA, 17 nt, Bordetella pertussis
gugcagacggcggcugg

SEQ ID NO: 430946 - RNA, 18 nt, Bordetella pertussis
gugcagacggcggcugga

SEQ ID NO: 430947 - RNA, 17 nt, Bordetella pertussis
gugcagcaggggcugcc

SEQ ID NO: 430948 - RNA, 16 nt, Bordetella pertussis
gugccaccgcccaggc

SEQ ID NO: 430949 - RNA, 13 nt, Bordetella pertussis
gugccagcccccu

SEQ ID NO: 430950 - RNA, 16 nt, Bordetella pertussis
gugccagcccccugcg

SEQ ID NO: 430951 - RNA, 23 nt, Bordetella pertussis
gugccagcccccugcggggucug

SEQ ID NO: 430952 - RNA, 15 nt, Bordetella pertussis
gugccagccgcuggc

SEQ ID NO: 430953 - RNA, 16 nt, Bordetella pertussis
gugccagcuggcccag

SEQ ID NO: 430954 - RNA, 16 nt, Bordetella pertussis
gugccaggugaacacc

SEQ ID NO: 430955 - RNA, 20 nt, Bordetella pertussis
gugcccaguucgcggccggc

SEQ ID NO: 430956 - RNA, 13 nt, Bordetella pertussis
gugccccaugcgc

SEQ ID NO: 430957 - RNA, 20 nt, Bordetella pertussis
gugcccccacgcugcgcccg

SEQ ID NO: 430958 - RNA, 13 nt, Bordetella pertussis
gugccccggccuc

SEQ ID NO: 430959 - RNA, 15 nt, Bordetella pertussis
gugcccgagggcgcg

SEQ ID NO: 430960 - RNA, 19 nt, Bordetella pertussis
gugcccgagggcgcgucga

SEQ ID NO: 430961 - RNA, 16 nt, Bordetella pertussis
gugcccgccacccagg

SEQ ID NO: 430962 - RNA, 15 nt, Bordetella pertussis
gugcccgcuggccau

SEQ ID NO: 430963 - RNA, 19 nt, Bordetella pertussis
gugcccgguucugcggcgc

SEQ ID NO: 430964 - RNA, 15 nt, Bordetella pertussis
gugcccguagcagau

SEQ ID NO: 430965 - RNA, 12 nt, Bordetella pertussis
gugcccucgcug

SEQ ID NO: 430966 - RNA, 22 nt, Bordetella pertussis
gugcccugacccgcuggcuggc

SEQ ID NO: 430967 - RNA, 14 nt, Bordetella pertussis
gugcccugcggcgc

SEQ ID NO: 430968 - RNA, 23 nt, Bordetella pertussis
gugcccugcucccacgaacgcca

SEQ ID NO: 430969 - RNA, 13 nt, Bordetella pertussis
gugccgcccagga

SEQ ID NO: 430970 - RNA, 15 nt, Bordetella pertussis
gugccgcccaggagc

SEQ ID NO: 430971 - RNA, 17 nt, Bordetella pertussis
gugccgcgagaaaaucg

SEQ ID NO: 430972 - RNA, 17 nt, Bordetella pertussis
gugccgcgcacccaggc

SEQ ID NO: 430973 - RNA, 19 nt, Bordetella pertussis
gugccgcgcacccaggccc

SEQ ID NO: 430974 - RNA, 16 nt, Bordetella pertussis
gugccgcgcaggcccu

SEQ ID NO: 430975 - RNA, 18 nt, Bordetella pertussis
gugccgcgcugggcgcug

SEQ ID NO: 430976 - RNA, 20 nt, Bordetella pertussis
gugccuguccccgcugggac

SEQ ID NO: 430977 - RNA, 23 nt, Bordetella pertussis
gugccuguccccgcugggacagg

SEQ ID NO: 430978 - RNA, 23 nt, Bordetella pertussis
gugccuguccccguggggacagg

SEQ ID NO: 430979 - RNA, 23 nt, Bordetella pertussis
gugccugucccugccgggacagg

SEQ ID NO: 430980 - RNA, 20 nt, Bordetella pertussis
gugccugucccugcgggggc

SEQ ID NO: 430981 - RNA, 17 nt, Bordetella pertussis
gugcgacggaugggcgc

SEQ ID NO: 430982 - RNA, 14 nt, Bordetella pertussis
gugcgacugcagga

SEQ ID NO: 430983 - RNA, 22 nt, Bordetella pertussis
gugcgagcacggcguggcgcgc

SEQ ID NO: 430984 - RNA, 16 nt, Bordetella pertussis
gugcgaggccacggca

SEQ ID NO: 430985 - RNA, 21 nt, Bordetella pertussis
gugcgccgugcccggcgggcc

SEQ ID NO: 430986 - RNA, 14 nt, Bordetella pertussis
gugcgccugcagcg

SEQ ID NO: 430987 - RNA, 20 nt, Bordetella pertussis
gugcgcgaccgcgcggcgcu

SEQ ID NO: 430988 - RNA, 14 nt, Bordetella pertussis
gugcgcgugggcac

SEQ ID NO: 430989 - RNA, 15 nt, Bordetella pertussis
gugcgcuggcugggc

SEQ ID NO: 430990 - RNA, 19 nt, Bordetella pertussis
gugcggaucaagcggcccg

SEQ ID NO: 430991 - RNA, 20 nt, Bordetella pertussis
gugcggcagggccuccugca

SEQ ID NO: 430992 - RNA, 14 nt, Bordetella pertussis
gugcggccgcagca

SEQ ID NO: 430993 - RNA, 14 nt, Bordetella pertussis
gugcggccgcagcg

SEQ ID NO: 430994 - RNA, 21 nt, Bordetella pertussis
gugcggcgccacugccaggcg

SEQ ID NO: 430995 - RNA, 12 nt, Bordetella pertussis
gugcggcgccug

SEQ ID NO: 430996 - RNA, 21 nt, Bordetella pertussis
gugcggcgccugcgucguugc

SEQ ID NO: 430997 - RNA, 14 nt, Bordetella pertussis
gugcggcguggcgg

SEQ ID NO: 430998 - RNA, 15 nt, Bordetella pertussis
gugcggcguggcggg

SEQ ID NO: 430999 - RNA, 18 nt, Bordetella pertussis
gugcggcuguugggcaag

SEQ ID NO: 431000 - RNA, 15 nt, Bordetella pertussis
gugcgggccugcagu

SEQ ID NO: 431001 - RNA, 15 nt, Bordetella pertussis
gugcggggaccggca

SEQ ID NO: 431002 - RNA, 16 nt, Bordetella pertussis
gugcggggcggcaggu

SEQ ID NO: 431003 - RNA, 17 nt, Bordetella pertussis
gugcgguucgucagggc

SEQ ID NO: 431004 - RNA, 15 nt, Bordetella pertussis
gugcguaccagccca

SEQ ID NO: 431005 - RNA, 16 nt, Bordetella pertussis
gugcguaccagcccag

SEQ ID NO: 431006 - RNA, 13 nt, Bordetella pertussis
gugcgugcgccug

SEQ ID NO: 431007 - RNA, 22 nt, Bordetella pertussis
gugcuauagucucgcuucuucg

SEQ ID NO: 431008 - RNA, 14 nt, Bordetella pertussis
gugcucaucggcag

SEQ ID NO: 431009 - RNA, 16 nt, Bordetella pertussis
gugcuccugccaggcg

SEQ ID NO: 431010 - RNA, 13 nt, Bordetella pertussis
gugcucgugcugg

SEQ ID NO: 431011 - RNA, 14 nt, Bordetella pertussis
gugcucgugcuggg

SEQ ID NO: 431012 - RNA, 17 nt, Bordetella pertussis
gugcucuggcccgccuc

SEQ ID NO: 431013 - RNA, 18 nt, Bordetella pertussis
gugcugaacgccucgggc

SEQ ID NO: 431014 - RNA, 14 nt, Bordetella pertussis
gugcugcaccugcg

SEQ ID NO: 431015 - RNA, 22 nt, Bordetella pertussis
gugcugcaccugcgucugcacg

SEQ ID NO: 431016 - RNA, 13 nt, Bordetella pertussis
gugcugcccugca

SEQ ID NO: 431017 - RNA, 15 nt, Bordetella pertussis
gugcugcggcagcca

SEQ ID NO: 431018 - RNA, 16 nt, Bordetella pertussis
gugcuggcacugucgg

SEQ ID NO: 431019 - RNA, 13 nt, Bordetella pertussis
gugcugcugcacg

SEQ ID NO: 431020 - RNA, 10 nt, Bordetella pertussis
gugcuggagg

SEQ ID NO: 431021 - RNA, 13 nt, Bordetella pertussis
gugcuggcccgcc

SEQ ID NO: 431022 - RNA, 20 nt, Bordetella pertussis
gugcuggccgaaccauugca

SEQ ID NO: 431023 - RNA, 14 nt, Bordetella pertussis
gugcuggcgcgugc

SEQ ID NO: 431024 - RNA, 18 nt, Bordetella pertussis
gugcuggcugagcaggcc

SEQ ID NO: 431025 - RNA, 17 nt, Bordetella pertussis
gugcugggcggccaggc

SEQ ID NO: 431026 - RNA, 15 nt, Bordetella pertussis
gugcugggcggcggg

SEQ ID NO: 431027 - RNA, 16 nt, Bordetella pertussis
gugcuggugccgcugg

SEQ ID NO: 431028 - RNA, 22 nt, Bordetella pertussis
gugcuguaccucagccugcugg

SEQ ID NO: 431029 - RNA, 13 nt, Bordetella pertussis
gugcuugcggcug

SEQ ID NO: 431030 - RNA, 14 nt, Bordetella pertussis
gugcuugcggcugu

SEQ ID NO: 431031 - RNA, 21 nt, Bordetella pertussis
guggccacgcccaucugguug

SEQ ID NO: 431032 - RNA, 12 nt, Bordetella pertussis
guggccaccagc

SEQ ID NO: 431033 - RNA, 11 nt, Bordetella pertussis
guggccagcac

SEQ ID NO: 431034 - RNA, 13 nt, Bordetella pertussis
guggccagcagcu

SEQ ID NO: 431035 - RNA, 15 nt, Bordetella pertussis
guggccagcgccgcc

SEQ ID NO: 431036 - RNA, 19 nt, Bordetella pertussis
guggccagcgccgccagcc

SEQ ID NO: 431037 - RNA, 23 nt, Bordetella pertussis
guggccagcgccgccagccgcug

SEQ ID NO: 431038 - RNA, 22 nt, Bordetella pertussis
guggccagcuccaccgggcuga

SEQ ID NO: 431039 - RNA, 16 nt, Bordetella pertussis
guggccaugcaccagc

SEQ ID NO: 431040 - RNA, 22 nt, Bordetella pertussis
guggcgacgcccagccugccgg

SEQ ID NO: 431041 - RNA, 19 nt, Bordetella pertussis
guggcgauagcgcuccagc

SEQ ID NO: 431042 - RNA, 16 nt, Bordetella pertussis
guggcgaugccgggca

SEQ ID NO: 431043 - RNA, 21 nt, Bordetella pertussis
guggcgauggcaucgggcagg

SEQ ID NO: 431044 - RNA, 20 nt, Bordetella pertussis
guggcgcagaugggcggcga

SEQ ID NO: 431045 - RNA, 17 nt, Bordetella pertussis
guggcgcccggcggcgc

SEQ ID NO: 431046 - RNA, 15 nt, Bordetella pertussis
guggcgccgaaggcg

SEQ ID NO: 431047 - RNA, 20 nt, Bordetella pertussis
guggcgccgacccugcccgg

SEQ ID NO: 431048 - RNA, 23 nt, Bordetella pertussis
guggcgcgcacacuggccagcaa

SEQ ID NO: 431049 - RNA, 19 nt, Bordetella pertussis
guggcgcgcaccugggagg

SEQ ID NO: 431050 - RNA, 19 nt, Bordetella pertussis
guggcgcuguccggcgcuc

SEQ ID NO: 431051 - RNA, 23 nt, Bordetella pertussis
guggcggccgucggggccgaugg

SEQ ID NO: 431052 - RNA, 21 nt, Bordetella pertussis
guggcucugguaacucaugcc

SEQ ID NO: 431053 - RNA, 19 nt, Bordetella pertussis
guggggacaggcacccgag

SEQ ID NO: 431054 - RNA, 19 nt, Bordetella pertussis
guggggacaggcaccugcg

SEQ ID NO: 431055 - RNA, 22 nt, Bordetella pertussis
guggggcagcaggccggcggcg

SEQ ID NO: 431056 - RNA, 14 nt, Bordetella pertussis
gugggggacaggca

SEQ ID NO: 431057 - RNA, 23 nt, Bordetella pertussis
gugggggacaggcacgccggggu

SEQ ID NO: 431058 - RNA, 17 nt, Bordetella pertussis
gugggggcgcggcggcg

SEQ ID NO: 431059 - RNA, 18 nt, Bordetella pertussis
guggggguuguggcgggu

SEQ ID NO: 431060 - RNA, 20 nt, Bordetella pertussis
guggguuggccuugcgcguc

SEQ ID NO: 431061 - RNA, 23 nt, Bordetella pertussis
guggucacguucgaccugccgcc

SEQ ID NO: 431062 - RNA, 20 nt, Bordetella pertussis
guggucaucgaugcgccgca

SEQ ID NO: 431063 - RNA, 18 nt, Bordetella pertussis
guggucaucgauggccac

SEQ ID NO: 431064 - RNA, 15 nt, Bordetella pertussis
guggugaccacggcg

SEQ ID NO: 431065 - RNA, 16 nt, Bordetella pertussis
guggugcgggccgcgc

SEQ ID NO: 431066 - RNA, 12 nt, Bordetella pertussis
guggugcuccca

SEQ ID NO: 431067 - RNA, 12 nt, Bordetella pertussis
guggugcugcuc

SEQ ID NO: 431068 - RNA, 22 nt, Bordetella pertussis
guggugucgaacagcgagacgg

SEQ ID NO: 431069 - RNA, 15 nt, Bordetella pertussis
guggugucggcggcc

SEQ ID NO: 431070 - RNA, 19 nt, Bordetella pertussis
guggugucggcggccagca

SEQ ID NO: 431071 - RNA, 17 nt, Bordetella pertussis
gugguuggcgcugcugc

SEQ ID NO: 431072 - RNA, 15 nt, Bordetella pertussis
guguacagccgccug

SEQ ID NO: 431073 - RNA, 15 nt, Bordetella pertussis
gugugccuguccccg

SEQ ID NO: 431074 - RNA, 15 nt, Bordetella pertussis
guguucucgcuggug

SEQ ID NO: 431075 - RNA, 20 nt, Bordetella pertussis
guguugcgugcgagcagaug

SEQ ID NO: 431076 - RNA, 14 nt, Bordetella pertussis
guguuucggccugc

SEQ ID NO: 431077 - RNA, 14 nt, Bordetella pertussis
guucagacugcugc

SEQ ID NO: 431078 - RNA, 13 nt, Bordetella pertussis
guucagcagcagg

SEQ ID NO: 431079 - RNA, 15 nt, Bordetella pertussis
guucagcagcgccac

SEQ ID NO: 431080 - RNA, 21 nt, Bordetella pertussis
guucagcauuucgcaaagaag

SEQ ID NO: 431081 - RNA, 23 nt, Bordetella pertussis
guucagcuucagccugggccugu

SEQ ID NO: 431082 - RNA, 16 nt, Bordetella pertussis
guucagcuucuggauc

SEQ ID NO: 431083 - RNA, 14 nt, Bordetella pertussis
guucaggcgagcgg

SEQ ID NO: 431084 - RNA, 18 nt, Bordetella pertussis
guucagggcgaacugcuc

SEQ ID NO: 431085 - RNA, 23 nt, Bordetella pertussis
guucagucgaguucgucgucgcc

SEQ ID NO: 431086 - RNA, 22 nt, Bordetella pertussis
guucccgccgggccaaggugcc

SEQ ID NO: 431087 - RNA, 21 nt, Bordetella pertussis
guucccgccgggcuccucgcc

SEQ ID NO: 431088 - RNA, 12 nt, Bordetella pertussis
guucccggugcc

SEQ ID NO: 431089 - RNA, 19 nt, Bordetella pertussis
guucccggugccagucccc

SEQ ID NO: 431090 - RNA, 18 nt, Bordetella pertussis
guuccugcaaggccggcg

SEQ ID NO: 431091 - RNA, 21 nt, Bordetella pertussis
guucgauguaguagccgccgc

SEQ ID NO: 431092 - RNA, 21 nt, Bordetella pertussis
guucgcccaccaccagcggcg

SEQ ID NO: 431093 - RNA, 21 nt, Bordetella pertussis
guucgcccggcuccaggccgc

SEQ ID NO: 431094 - RNA, 15 nt, Bordetella pertussis
guucgcccggugcgu

SEQ ID NO: 431095 - RNA, 17 nt, Bordetella pertussis
guucgccgugcagggcc

SEQ ID NO: 431096 - RNA, 14 nt, Bordetella pertussis
guucgcgcagcagg

SEQ ID NO: 431097 - RNA, 20 nt, Bordetella pertussis
guucgcgcaacucggccacc

SEQ ID NO: 431098 - RNA, 12 nt, Bordetella pertussis
guucgcuuucca

SEQ ID NO: 431099 - RNA, 21 nt, Bordetella pertussis
guucggagcacggaagaaauu

SEQ ID NO: 431100 - RNA, 15 nt, Bordetella pertussis
guucgucgcgcagca

SEQ ID NO: 431101 - RNA, 16 nt, Bordetella pertussis
guucuaccugaucgcc

SEQ ID NO: 431102 - RNA, 21 nt, Bordetella pertussis
guucuuguugcucuugaccug

SEQ ID NO: 431103 - RNA, 17 nt, Bordetella pertussis
guugaaauccuucaggu

SEQ ID NO: 431104 - RNA, 18 nt, Bordetella pertussis
guugaccacgcccuggau

SEQ ID NO: 431105 - RNA, 21 nt, Bordetella pertussis
guugaccgcuuccgagaaggc

SEQ ID NO: 431106 - RNA, 16 nt, Bordetella pertussis
guugagaaugcccagg

SEQ ID NO: 431107 - RNA, 16 nt, Bordetella pertussis
guugagcagcaccugg

SEQ ID NO: 431108 - RNA, 20 nt, Bordetella pertussis
guugagcagcaugugcucgg

SEQ ID NO: 431109 - RNA, 16 nt, Bordetella pertussis
guugagucuggagaug

SEQ ID NO: 431110 - RNA, 20 nt, Bordetella pertussis
guugaucucgcccagcaggu

SEQ ID NO: 431111 - RNA, 18 nt, Bordetella pertussis
guugcaaauucugcaaaa

SEQ ID NO: 431112 - RNA, 14 nt, Bordetella pertussis
guugcaggccaggc

SEQ ID NO: 431113 - RNA, 15 nt, Bordetella pertussis
guugcaggccaggcu

SEQ ID NO: 431114 - RNA, 19 nt, Bordetella pertussis
guugcaggccaggcucagc

SEQ ID NO: 431115 - RNA, 12 nt, Bordetella pertussis
guugcaggccau

SEQ ID NO: 431116 - RNA, 13 nt, Bordetella pertussis
guugcagcggcuu

SEQ ID NO: 431117 - RNA, 15 nt, Bordetella pertussis
guugcccggcaggca

SEQ ID NO: 431118 - RNA, 17 nt, Bordetella pertussis
guugcccggcaggcaca

SEQ ID NO: 431119 - RNA, 20 nt, Bordetella pertussis
guugccgaagcgucggccug

SEQ ID NO: 431120 - RNA, 18 nt, Bordetella pertussis
guugccggccugaggccc

SEQ ID NO: 431121 - RNA, 23 nt, Bordetella pertussis
guugccgggauccacgccgccgg

SEQ ID NO: 431122 - RNA, 19 nt, Bordetella pertussis
guugccugggugcuggugc

SEQ ID NO: 431123 - RNA, 20 nt, Bordetella pertussis
guugcgaaacccgcugggcc

SEQ ID NO: 431124 - RNA, 16 nt, Bordetella pertussis
guugcgaggcggccuu

SEQ ID NO: 431125 - RNA, 17 nt, Bordetella pertussis
guugcgccggcucagcc

SEQ ID NO: 431126 - RNA, 15 nt, Bordetella pertussis
guugcgcgacaggcc

SEQ ID NO: 431127 - RNA, 13 nt, Bordetella pertussis
guugcgcugcccg

SEQ ID NO: 431128 - RNA, 22 nt, Bordetella pertussis
guugcgcugcugucgcgcugcc

SEQ ID NO: 431129 - RNA, 16 nt, Bordetella pertussis
guugcgucucggccug

SEQ ID NO: 431130 - RNA, 17 nt, Bordetella pertussis
guugcuccagccaggcg

SEQ ID NO: 431131 - RNA, 16 nt, Bordetella pertussis
guugcucgugcuggcc

SEQ ID NO: 431132 - RNA, 16 nt, Bordetella pertussis
guugcucuugaccugg

SEQ ID NO: 431133 - RNA, 17 nt, Bordetella pertussis
guugcucuugaccuggg

SEQ ID NO: 431134 - RNA, 22 nt, Bordetella pertussis
guugcuggcggccgugccucaa

SEQ ID NO: 431135 - RNA, 14 nt, Bordetella pertussis
guuggcaggccagc

SEQ ID NO: 431136 - RNA, 14 nt, Bordetella pertussis
guuggccagcucca

SEQ ID NO: 431137 - RNA, 15 nt, Bordetella pertussis
guuggccagcuccag

SEQ ID NO: 431138 - RNA, 18 nt, Bordetella pertussis
guuggcccuucuucagcu

SEQ ID NO: 431139 - RNA, 16 nt, Bordetella pertussis
guuggccgccagccgg

SEQ ID NO: 431140 - RNA, 20 nt, Bordetella pertussis
guuggccgcguagcccaugu

SEQ ID NO: 431141 - RNA, 16 nt, Bordetella pertussis
guuggccgggucgcgc

SEQ ID NO: 431142 - RNA, 20 nt, Bordetella pertussis
guuggcgaggacaggccagu

SEQ ID NO: 431143 - RNA, 18 nt, Bordetella pertussis
guuguugccgcgucgauc

SEQ ID NO: 431144 - RNA, 12 nt, Bordetella pertussis
guuuccagggcu

SEQ ID NO: 431145 - RNA, 18 nt, Bordetella pertussis
guuuccaucggggggcag

SEQ ID NO: 431146 - RNA, 15 nt, Bordetella pertussis
guuucccgauuccag

SEQ ID NO: 431147 - RNA, 14 nt, Bordetella pertussis
guuuccgggccugg

SEQ ID NO: 431148 - RNA, 15 nt, Bordetella pertussis
guuucgcugcgcacg

SEQ ID NO: 431149 - RNA, 16 nt, Bordetella pertussis
guuucucaacccgccg

SEQ ID NO: 431150 - RNA, 19 nt, Bordetella pertussis
guuucucaacccgccggcc

SEQ ID NO: 431151 - RNA, 22 nt, Bordetella pertussis
guuucucgacgcaaucggcgaa

SEQ ID NO: 431152 - RNA, 15 nt, Bordetella pertussis
guuucucgcucuugg

SEQ ID NO: 431153 - RNA, 21 nt, Bordetella pertussis
uaaaaacccggccugcgcgcc

SEQ ID NO: 431154 - RNA, 14 nt, Bordetella pertussis
uaaagaugcgcgcc

SEQ ID NO: 431155 - RNA, 21 nt, Bordetella pertussis
uaaauacgcuggcuaucgccu

SEQ ID NO: 431156 - RNA, 22 nt, Bordetella pertussis
uaacgccacuugcaggccgcga

SEQ ID NO: 431157 - RNA, 18 nt, Bordetella pertussis
uaagcaggucugcacgag

SEQ ID NO: 431158 - RNA, 23 nt, Bordetella pertussis
uaagccucacaugucacacgaag

SEQ ID NO: 431159 - RNA, 18 nt, Bordetella pertussis
uaagcuggcgcuuggcca

SEQ ID NO: 431160 - RNA, 22 nt, Bordetella pertussis
uacaaccgcgccgaguuuccgc

SEQ ID NO: 431161 - RNA, 17 nt, Bordetella pertussis
uacagaugggcggccua

SEQ ID NO: 431162 - RNA, 22 nt, Bordetella pertussis
uacagccugcccugguggcaga

SEQ ID NO: 431163 - RNA, 23 nt, Bordetella pertussis
uacagccugcccugguggcagag

SEQ ID NO: 431164 - RNA, 15 nt, Bordetella pertussis
uacaggcagcggccg

SEQ ID NO: 431165 - RNA, 19 nt, Bordetella pertussis
uacaggcgcucgcgcugca

SEQ ID NO: 431166 - RNA, 13 nt, Bordetella pertussis
uacagggccgcga

SEQ ID NO: 431167 - RNA, 16 nt, Bordetella pertussis
uacauauucacagcca

SEQ ID NO: 431168 - RNA, 20 nt, Bordetella pertussis
uacaugaguucuggcaucag

SEQ ID NO: 431169 - RNA, 12 nt, Bordetella pertussis
uaccaacugccu

SEQ ID NO: 431170 - RNA, 23 nt, Bordetella pertussis
uaccaauacaggaagcgcuggcc

SEQ ID NO: 431171 - RNA, 18 nt, Bordetella pertussis
uaccacaguucggccagc

SEQ ID NO: 431172 - RNA, 13 nt, Bordetella pertussis
uacccgccgggcg

SEQ ID NO: 431173 - RNA, 21 nt, Bordetella pertussis
uacccgcgccgucgaacuccu

SEQ ID NO: 431174 - RNA, 23 nt, Bordetella pertussis
uacccgcuucgacggcuugcgca

SEQ ID NO: 431175 - RNA, 13 nt, Bordetella pertussis
uaccgcuggccag

SEQ ID NO: 431176 - RNA, 18 nt, Bordetella pertussis
uaccgcuucccuggcaag

SEQ ID NO: 431177 - RNA, 17 nt, Bordetella pertussis
uaccucggugaggauuu

SEQ ID NO: 431178 - RNA, 13 nt, Bordetella pertussis
uaccugcagcagg

SEQ ID NO: 431179 - RNA, 16 nt, Bordetella pertussis
uacgccacuuccuugc

SEQ ID NO: 431180 - RNA, 17 nt, Bordetella pertussis
uacgccacuuccuugcc

SEQ ID NO: 431181 - RNA, 18 nt, Bordetella pertussis
uacgccaugaacgcuuga

SEQ ID NO: 431182 - RNA, 18 nt, Bordetella pertussis
uacgcuggcuaucgccuc

SEQ ID NO: 431183 - RNA, 17 nt, Bordetella pertussis
uacgugcuggacccgcu

SEQ ID NO: 431184 - RNA, 19 nt, Bordetella pertussis
uagaacgcaugcgugcgca

SEQ ID NO: 431185 - RNA, 22 nt, Bordetella pertussis
uagaacgcaugcgugcgcauca

SEQ ID NO: 431186 - RNA, 16 nt, Bordetella pertussis
uagaagaacagcagau

SEQ ID NO: 431187 - RNA, 17 nt, Bordetella pertussis
uagaaguaggcggccag

SEQ ID NO: 431188 - RNA, 19 nt, Bordetella pertussis
uagaaguaggcggccaggc

SEQ ID NO: 431189 - RNA, 20 nt, Bordetella pertussis
uagaaguaggcggccaggcc

SEQ ID NO: 431190 - RNA, 13 nt, Bordetella pertussis
uagaccaccagca

SEQ ID NO: 431191 - RNA, 17 nt, Bordetella pertussis
uagaccaccagcaggau

SEQ ID NO: 431192 - RNA, 20 nt, Bordetella pertussis
uagaccacgcgcugcgcgcc

SEQ ID NO: 431193 - RNA, 13 nt, Bordetella pertussis
uagaccagcagcu

SEQ ID NO: 431194 - RNA, 22 nt, Bordetella pertussis
uagagcagugugccugucccag

SEQ ID NO: 431195 - RNA, 22 nt, Bordetella pertussis
uagagcgccgcgugguggcgca

SEQ ID NO: 431196 - RNA, 20 nt, Bordetella pertussis
uagagcuguugcagcggcuu

SEQ ID NO: 431197 - RNA, 16 nt, Bordetella pertussis
uagaucauccaggugg

SEQ ID NO: 431198 - RNA, 22 nt, Bordetella pertussis
uagauccaggcggccaccacca

SEQ ID NO: 431199 - RNA, 24 nt, Bordetella pertussis
uagcacacgccgauugaggccagc

SEQ ID NO: 431200 - RNA, 15 nt, Bordetella pertussis
uagccaggauuucau

SEQ ID NO: 431201 - RNA, 16 nt, Bordetella pertussis
uagccgaucuggcccu

SEQ ID NO: 431202 - RNA, 20 nt, Bordetella pertussis
uagccgccgacguagucgcg

SEQ ID NO: 431203 - RNA, 15 nt, Bordetella pertussis
uagccgcugcgcgcg

SEQ ID NO: 431204 - RNA, 22 nt, Bordetella pertussis
uagccgguaucgcggcgcaggc

SEQ ID NO: 431205 - RNA, 13 nt, Bordetella pertussis
uagccggucuggu

SEQ ID NO: 431206 - RNA, 22 nt, Bordetella pertussis
uagccguccucgcgggccuggc

SEQ ID NO: 431207 - RNA, 21 nt, Bordetella pertussis
uagccucguuggucagcaccu

SEQ ID NO: 431208 - RNA, 17 nt, Bordetella pertussis
uagcguuggcggccggc

SEQ ID NO: 431209 - RNA, 12 nt, Bordetella pertussis
uagcguuuugua

SEQ ID NO: 431210 - RNA, 11 nt, Bordetella pertussis
uagcucagccu

SEQ ID NO: 431211 - RNA, 22 nt, Bordetella pertussis
uaggccggcgcgaccgccucca

SEQ ID NO: 431212 - RNA, 13 nt, Bordetella pertussis
uaggccuggucgg

SEQ ID NO: 431213 - RNA, 19 nt, Bordetella pertussis
uaggcgcagcaggccagga

SEQ ID NO: 431214 - RNA, 19 nt, Bordetella pertussis
uagggaaucgucaugaacg

SEQ ID NO: 431215 - RNA, 16 nt, Bordetella pertussis
uagggccauggcaggg

SEQ ID NO: 431216 - RNA, 18 nt, Bordetella pertussis
uagggccauggcagggcg

SEQ ID NO: 431217 - RNA, 11 nt, Bordetella pertussis
uagggcccagc

SEQ ID NO: 431218 - RNA, 19 nt, Bordetella pertussis
uagggcguggcgcgaugug

SEQ ID NO: 431219 - RNA, 15 nt, Bordetella pertussis
uagggggcauggcgc

SEQ ID NO: 431220 - RNA, 16 nt, Bordetella pertussis
uaggucagcgccuugc

SEQ ID NO: 431221 - RNA, 13 nt, Bordetella pertussis
uaggucaggccca

SEQ ID NO: 431222 - RNA, 15 nt, Bordetella pertussis
uaggucaggcccacg

SEQ ID NO: 431223 - RNA, 18 nt, Bordetella pertussis
uagucguugccggccagc

SEQ ID NO: 431224 - RNA, 16 nt, Bordetella pertussis
uauaauucguuggagc

SEQ ID NO: 431225 - RNA, 18 nt, Bordetella pertussis
uauaugacguagagacca

SEQ ID NO: 431226 - RNA, 16 nt, Bordetella pertussis
uaucagcgccugcagg

SEQ ID NO: 431227 - RNA, 12 nt, Bordetella pertussis
uaucauccgcgc

SEQ ID NO: 431228 - RNA, 18 nt, Bordetella pertussis
uauccagcaucaccagcu

SEQ ID NO: 431229 - RNA, 22 nt, Bordetella pertussis
uaucgagguuuccgccaugcgg

SEQ ID NO: 431230 - RNA, 21 nt, Bordetella pertussis
ucagcgccaucaucgcgaucc

SEQ ID NO: 431231 - RNA, 13 nt, Bordetella pertussis
ucagcgcccaggu

SEQ ID NO: 431232 - RNA, 19 nt, Bordetella pertussis
ucagcgccgacucgaagaa

SEQ ID NO: 431233 - RNA, 15 nt, Bordetella pertussis
ucagcgccugcaggu

SEQ ID NO: 431234 - RNA, 16 nt, Bordetella pertussis
ucagcgccugcagguc

SEQ ID NO: 431235 - RNA, 19 nt, Bordetella pertussis
ucagcgccugcaggucuuc

SEQ ID NO: 431236 - RNA, 16 nt, Bordetella pertussis
ucagcgcggcgcggcc

SEQ ID NO: 431237 - RNA, 22 nt, Bordetella pertussis
ucagcgcggcgcggccagcagc

SEQ ID NO: 431238 - RNA, 23 nt, Bordetella pertussis
ucagcgcggcgcggccagcagcg

SEQ ID NO: 431239 - RNA, 13 nt, Bordetella pertussis
ucagcgcggcgcc

SEQ ID NO: 431240 - RNA, 23 nt, Bordetella pertussis
ucagcggauugaccagcgcggcc

SEQ ID NO: 431241 - RNA, 23 nt, Bordetella pertussis
ucagcggcagcacgauggcgccc

SEQ ID NO: 431242 - RNA, 13 nt, Bordetella pertussis
ucagcggcagcac

SEQ ID NO: 431243 - RNA, 16 nt, Bordetella pertussis
ucagcgggcuggccag

SEQ ID NO: 431244 - RNA, 17 nt, Bordetella pertussis
ucagcgugcgccccgcc

SEQ ID NO: 431245 - RNA, 17 nt, Bordetella pertussis
ucagcguuuccagggcg

SEQ ID NO: 431246 - RNA, 13 nt, Bordetella pertussis
ucagcucgucgcc

SEQ ID NO: 431247 - RNA, 12 nt, Bordetella pertussis
ucagcuuccaga

SEQ ID NO: 431248 - RNA, 17 nt, Bordetella pertussis
ucagcuuccagguacag

SEQ ID NO: 431249 - RNA, 22 nt, Bordetella pertussis
ucagcuugggcuugauggccag

SEQ ID NO: 431250 - RNA, 21 nt, Bordetella pertussis
ucagcuuggccaccacgccca

SEQ ID NO: 431251 - RNA, 20 nt, Bordetella pertussis
ucaggaacauguccaccagc

SEQ ID NO: 431252 - RNA, 14 nt, Bordetella pertussis
ucaggaugcgcgcc

SEQ ID NO: 431253 - RNA, 13 nt, Bordetella pertussis
ucaggcagcaacc

SEQ ID NO: 431254 - RNA, 18 nt, Bordetella pertussis
ucaggcagcaaccggaac

SEQ ID NO: 431255 - RNA, 15 nt, Bordetella pertussis
ucaggcaggcgcgcc

SEQ ID NO: 431256 - RNA, 14 nt, Bordetella pertussis
ucaggcccacgccg

SEQ ID NO: 431257 - RNA, 20 nt, Bordetella pertussis
ucaggcccacgccgccgaag

SEQ ID NO: 431258 - RNA, 19 nt, Bordetella pertussis
ucaggccaugcugggccau

SEQ ID NO: 431259 - RNA, 15 nt, Bordetella pertussis
ucaggcccuggggcc

SEQ ID NO: 431260 - RNA, 23 nt, Bordetella pertussis
ucaggccggcccgccccacggcg

SEQ ID NO: 431261 - RNA, 15 nt, Bordetella pertussis
ucaggccggcgccug

SEQ ID NO: 431262 - RNA, 22 nt, Bordetella pertussis
ucaggccggcgccuggggcggg

SEQ ID NO: 431263 - RNA, 22 nt, Bordetella pertussis
ucaggccgucgagccgggcgcc

SEQ ID NO: 431264 - RNA, 20 nt, Bordetella pertussis
ucaggccguuggcgcgccuu

SEQ ID NO: 431265 - RNA, 19 nt, Bordetella pertussis
ucaggcgauccugcccacc

SEQ ID NO: 431266 - RNA, 20 nt, Bordetella pertussis
ucaggcgcgcggcagggcgu

SEQ ID NO: 431267 - RNA, 17 nt, Bordetella pertussis
ucaggcgcggcuggaug

SEQ ID NO: 431268 - RNA, 14 nt, Bordetella pertussis
ucaggcggccaggg

SEQ ID NO: 431269 - RNA, 16 nt, Bordetella pertussis
ucaggcggccagggcc

SEQ ID NO: 431270 - RNA, 15 nt, Bordetella pertussis
ucaggcggcgcggcg

SEQ ID NO: 431271 - RNA, 13 nt, Bordetella pertussis
ucaggcggcugcc

SEQ ID NO: 431272 - RNA, 19 nt, Bordetella pertussis
ucaggcguggcgacagcaa

SEQ ID NO: 431273 - RNA, 22 nt, Bordetella pertussis
ucaggcuccaguggugcuccca

SEQ ID NO: 431274 - RNA, 21 nt, Bordetella pertussis
ucaggcuugcagcaacgcggc

SEQ ID NO: 431275 - RNA, 16 nt, Bordetella pertussis
ucagggacgggccagc

SEQ ID NO: 431276 - RNA, 13 nt, Bordetella pertussis
ucagggaggcugu

SEQ ID NO: 431277 - RNA, 14 nt, Bordetella pertussis
ucagggccacggcg

SEQ ID NO: 431278 - RNA, 13 nt, Bordetella pertussis
ucagggccgccag

SEQ ID NO: 431279 - RNA, 17 nt, Bordetella pertussis
ucagggcgaugccgcag

SEQ ID NO: 431280 - RNA, 16 nt, Bordetella pertussis
ucagggcgccggcgua

SEQ ID NO: 431281 - RNA, 20 nt, Bordetella pertussis
ucaggggcucggccaggugc

SEQ ID NO: 431282 - RNA, 15 nt, Bordetella pertussis
ucagggggcgcccca

SEQ ID NO: 431283 - RNA, 22 nt, Bordetella pertussis
ucaggguacggcgaugccggcg

SEQ ID NO: 431284 - RNA, 16 nt, Bordetella pertussis
ucagggugggcacgcg

SEQ ID NO: 431285 - RNA, 15 nt, Bordetella pertussis
ucaggguggccgcga

SEQ ID NO: 431286 - RNA, 19 nt, Bordetella pertussis
ucagguagguggacacgcc

SEQ ID NO: 431287 - RNA, 15 nt, Bordetella pertussis
ucaggucgcugccca

SEQ ID NO: 431288 - RNA, 18 nt, Bordetella pertussis
ucaggucgcugcccagca

SEQ ID NO: 431289 - RNA, 18 nt, Bordetella pertussis
ucagguguucgcgcacca

SEQ ID NO: 431290 - RNA, 14 nt, Bordetella pertussis
ucagguuagccagu

SEQ ID NO: 431291 - RNA, 19 nt, Bordetella pertussis
ucagguuagcggcaguguc

SEQ ID NO: 431292 - RNA, 17 nt, Bordetella pertussis
ucagguuugcgggugcc

SEQ ID NO: 431293 - RNA, 19 nt, Bordetella pertussis
ucaguccgcccagccaggc

SEQ ID NO: 431294 - RNA, 23 nt, Bordetella pertussis
ucaguccguaguugcgccccgcc

SEQ ID NO: 431295 - RNA, 22 nt, Bordetella pertussis
ucaguugggcgcgcccagcccc

SEQ ID NO: 431296 - RNA, 23 nt, Bordetella pertussis
ucaguugggcgcgcccagccccg

SEQ ID NO: 431297 - RNA, 20 nt, Bordetella pertussis
ucauaccgaaggaccaaguc

SEQ ID NO: 431298 - RNA, 18 nt, Bordetella pertussis
ucauacgccaugaacgcu

SEQ ID NO: 431299 - RNA, 20 nt, Bordetella pertussis
ucaucaaacgcggcgccgcc

SEQ ID NO: 431300 - RNA, 13 nt, Bordetella pertussis
ucaucagcacgau

SEQ ID NO: 431301 - RNA, 18 nt, Bordetella pertussis
ucaucagguccacuucac

SEQ ID NO: 431302 - RNA, 16 nt, Bordetella pertussis
ucauccaggccgugag

SEQ ID NO: 431303 - RNA, 18 nt, Bordetella pertussis
ucauccuguucgugaucc

SEQ ID NO: 431304 - RNA, 19 nt, Bordetella pertussis
ucaucgagcauugccgcgg

SEQ ID NO: 431305 - RNA, 12 nt, Bordetella pertussis
ucaucggcccga

SEQ ID NO: 431306 - RNA, 16 nt, Bordetella pertussis
ucaucgucggcgccau

SEQ ID NO: 431307 - RNA, 15 nt, Bordetella pertussis
ucaucguggccgcgc

SEQ ID NO: 431308 - RNA, 20 nt, Bordetella pertussis
ucaugacgggcggcggcgcg

SEQ ID NO: 431309 - RNA, 18 nt, Bordetella pertussis
ucaugaggccccuguccu

SEQ ID NO: 431310 - RNA, 17 nt, Bordetella pertussis
ucaugaugcgcugggcc

SEQ ID NO: 431311 - RNA, 18 nt, Bordetella pertussis
ucaugaugcgcugggcca

SEQ ID NO: 431312 - RNA, 11 nt, Bordetella pertussis
ucaugcagaac

SEQ ID NO: 431313 - RNA, 21 nt, Bordetella pertussis
ucaugcgccguccucaggccc

SEQ ID NO: 431314 - RNA, 16 nt, Bordetella pertussis
ucaugcgcugcuggcc

SEQ ID NO: 431315 - RNA, 15 nt, Bordetella pertussis
ucaugcgggacaggc

SEQ ID NO: 431316 - RNA, 14 nt, Bordetella pertussis
ucaugcucuugcuc

SEQ ID NO: 431317 - RNA, 18 nt, Bordetella pertussis
ucauggaaaaucugggau

SEQ ID NO: 431318 - RNA, 13 nt, Bordetella pertussis
ucauggccagggc

SEQ ID NO: 431319 - RNA, 20 nt, Bordetella pertussis
ucauggccuggcccagcucc

SEQ ID NO: 431320 - RNA, 13 nt, Bordetella pertussis
ucaugggccuggg

SEQ ID NO: 431321 - RNA, 14 nt, Bordetella pertussis
ucaugggccugggc

SEQ ID NO: 431322 - RNA, 18 nt, Bordetella pertussis
uccaaaacagacaggccg

SEQ ID NO: 431323 - RNA, 23 nt, Bordetella pertussis
uccaagcgcacgcgcagcacgcu

SEQ ID NO: 431324 - RNA, 21 nt, Bordetella pertussis
uccacagcccggcccccagcc

SEQ ID NO: 431325 - RNA, 19 nt, Bordetella pertussis
uccacagucggucgccgca

SEQ ID NO: 431326 - RNA, 15 nt, Bordetella pertussis
uccaccaccaggccg

SEQ ID NO: 431327 - RNA, 15 nt, Bordetella pertussis
uccaccacccaggcc

SEQ ID NO: 431328 - RNA, 14 nt, Bordetella pertussis
uccaccagccggcc

SEQ ID NO: 431329 - RNA, 16 nt, Bordetella pertussis
uccaccagccggccgc

SEQ ID NO: 431330 - RNA, 20 nt, Bordetella pertussis
uccaccaucagccagccgcu

SEQ ID NO: 431331 - RNA, 13 nt, Bordetella pertussis
uccaccgccagcc

SEQ ID NO: 431332 - RNA, 19 nt, Bordetella pertussis
uccaccgccgaugccgcca

SEQ ID NO: 431333 - RNA, 20 nt, Bordetella pertussis
uccaccuugacgcgcaggcc

SEQ ID NO: 431334 - RNA, 16 nt, Bordetella pertussis
uccacgaugcccaugg

SEQ ID NO: 431335 - RNA, 17 nt, Bordetella pertussis
uccacgaugucguccag

SEQ ID NO: 431336 - RNA, 17 nt, Bordetella pertussis
uccacgccacuggccuu

SEQ ID NO: 431337 - RNA, 19 nt, Bordetella pertussis
uccacgcccagcgccggca

SEQ ID NO: 431338 - RNA, 18 nt, Bordetella pertussis
uccacgccgccggccagc

SEQ ID NO: 431339 - RNA, 22 nt, Bordetella pertussis
uccacgccuucggcgcgcgccg

SEQ ID NO: 431340 - RNA, 23 nt, Bordetella pertussis
uccacgcggccguggcggccugc

SEQ ID NO: 431341 - RNA, 13 nt, Bordetella pertussis
uccacgcgggcau

SEQ ID NO: 431342 - RNA, 20 nt, Bordetella pertussis
uccacggccggcgcacgccg

SEQ ID NO: 431343 - RNA, 16 nt, Bordetella pertussis
uccacggucgccggca

SEQ ID NO: 431344 - RNA, 20 nt, Bordetella pertussis
uccacgugcggcagggccuc

SEQ ID NO: 431345 - RNA, 12 nt, Bordetella pertussis
uccacguggcga

SEQ ID NO: 431346 - RNA, 14 nt, Bordetella pertussis
uccacucggccagc

SEQ ID NO: 431347 - RNA, 18 nt, Bordetella pertussis
uccacucggccagcgcgc

SEQ ID NO: 431348 - RNA, 22 nt, Bordetella pertussis
uccacuucaccgcugaucaggu

SEQ ID NO: 431349 - RNA, 21 nt, Bordetella pertussis
uccagagggaaaacagcgcgg

SEQ ID NO: 431350 - RNA, 16 nt, Bordetella pertussis
uccagagucugccugg

SEQ ID NO: 431351 - RNA, 22 nt, Bordetella pertussis
uccagauaugccccuccggguc

SEQ ID NO: 431352 - RNA, 15 nt, Bordetella pertussis
uccagaugcgcagca

SEQ ID NO: 431353 - RNA, 19 nt, Bordetella pertussis
uccagaugcgcagcaggcg

SEQ ID NO: 431354 - RNA, 23 nt, Bordetella pertussis
uccagcaccagggcgcgcagcag

SEQ ID NO: 431355 - RNA, 16 nt, Bordetella pertussis
uccagcagcagcgccg

SEQ ID NO: 431356 - RNA, 21 nt, Bordetella pertussis
uccagcagcagcgccgcgccg

SEQ ID NO: 431357 - RNA, 14 nt, Bordetella pertussis
uccagcagcaugcc

SEQ ID NO: 431358 - RNA, 23 nt, Bordetella pertussis
uccagcagggacuugggcaggcc

SEQ ID NO: 431359 - RNA, 18 nt, Bordetella pertussis
uccagcauguacagcggu

SEQ ID NO: 431360 - RNA, 21 nt, Bordetella pertussis
uccagccaccacugcaaggcc

SEQ ID NO: 431361 - RNA, 14 nt, Bordetella pertussis
uccagccaggccgc

SEQ ID NO: 431362 - RNA, 18 nt, Bordetella pertussis
uccagccaguacaggcug

SEQ ID NO: 431363 - RNA, 20 nt, Bordetella pertussis
uccagccauggaagcggcag

SEQ ID NO: 431364 - RNA, 23 nt, Bordetella pertussis
uccagcccaccgcgaaccaggcc

SEQ ID NO: 431365 - RNA, 18 nt, Bordetella pertussis
uccagccccacgccgacc

SEQ ID NO: 431366 - RNA, 13 nt, Bordetella pertussis
uccagccccugcc

SEQ ID NO: 431367 - RNA, 19 nt, Bordetella pertussis
uccagccugcccgggcagc

SEQ ID NO: 431368 - RNA, 23 nt, Bordetella pertussis
uccagccuggcaaugcguggccg

SEQ ID NO: 431369 - RNA, 22 nt, Bordetella pertussis
uccagcgccagcagggucagcg

SEQ ID NO: 431370 - RNA, 12 nt, Bordetella pertussis
uccagcgccugg

SEQ ID NO: 431371 - RNA, 23 nt, Bordetella pertussis
uccagcgcgccgaagcgcaggcc

SEQ ID NO: 431372 - RNA, 13 nt, Bordetella pertussis
uccagcgcggcca

SEQ ID NO: 431373 - RNA, 22 nt, Bordetella pertussis
uccagcgcggccacggccugcc

SEQ ID NO: 431374 - RNA, 21 nt, Bordetella pertussis
uccagcgcggcgggcggcgcg

SEQ ID NO: 431375 - RNA, 15 nt, Bordetella pertussis
uccagcgcguccagg

SEQ ID NO: 431376 - RNA, 21 nt, Bordetella pertussis
uccagcgcguccaggugcggc

SEQ ID NO: 431377 - RNA, 18 nt, Bordetella pertussis
uccagcgcgucggccagg

SEQ ID NO: 431378 - RNA, 19 nt, Bordetella pertussis
uccagcgcgucggccaggc

SEQ ID NO: 431379 - RNA, 20 nt, Bordetella pertussis
uccagcggacgggccaggcc

SEQ ID NO: 431380 - RNA, 17 nt, Bordetella pertussis
uccagcggcgccagcgg

SEQ ID NO: 431381 - RNA, 12 nt, Bordetella pertussis
uccagcggcgcg

SEQ ID NO: 431382 - RNA, 23 nt, Bordetella pertussis
uccagcgucggcguaaggccgcc

SEQ ID NO: 431383 - RNA, 19 nt, Bordetella pertussis
uccagcguggagcugcuca

SEQ ID NO: 431384 - RNA, 15 nt, Bordetella pertussis
uccagcucagcagcg

SEQ ID NO: 431385 - RNA, 20 nt, Bordetella pertussis
uccagcucagcagcgccagg

SEQ ID NO: 431386 - RNA, 21 nt, Bordetella pertussis
uccagcucagcagcgccaggg

SEQ ID NO: 431387 - RNA, 16 nt, Bordetella pertussis
uccagcuccagcgcgc

SEQ ID NO: 431388 - RNA, 18 nt, Bordetella pertussis
uccagcuccagcgcgccg

SEQ ID NO: 431389 - RNA, 17 nt, Bordetella pertussis
uccagcucugcucuguc

SEQ ID NO: 431390 - RNA, 22 nt, Bordetella pertussis
uccagcucgguggucaacggca

SEQ ID NO: 431391 - RNA, 20 nt, Bordetella pertussis
uccagcuggcccuggcagac

SEQ ID NO: 431392 - RNA, 22 nt, Bordetella pertussis
uccagcuggcccuggcagacgu

SEQ ID NO: 431393 - RNA, 18 nt, Bordetella pertussis
uccagcuggcgcaccagg

SEQ ID NO: 431394 - RNA, 21 nt, Bordetella pertussis
uccagcuggcgcaccaggcug

SEQ ID NO: 431395 - RNA, 15 nt, Bordetella pertussis
uccaggaaagaggcc

SEQ ID NO: 431396 - RNA, 18 nt, Bordetella pertussis
uccaggaaagaggccagg

SEQ ID NO: 431397 - RNA, 19 nt, Bordetella pertussis
uccaggaaagaggccaggc

SEQ ID NO: 431398 - RNA, 20 nt, Bordetella pertussis
uccaggaaagaggccaggcc

SEQ ID NO: 431399 - RNA, 22 nt, Bordetella pertussis
uccaggaaagaggccaggcccu

SEQ ID NO: 431400 - RNA, 18 nt, Bordetella pertussis
uccaggaaagcgccgccg

SEQ ID NO: 431401 - RNA, 14 nt, Bordetella pertussis
uccaggaguuccca

SEQ ID NO: 431402 - RNA, 16 nt, Bordetella pertussis
uccaggaugagcgccu

SEQ ID NO: 431403 - RNA, 17 nt, Bordetella pertussis
uccaggaugagcgccug

SEQ ID NO: 431404 - RNA, 23 nt, Bordetella pertussis
uccaggccaccgcggcggaccac

SEQ ID NO: 431405 - RNA, 13 nt, Bordetella pertussis
uccaggcccaggc

SEQ ID NO: 431406 - RNA, 19 nt, Bordetella pertussis
uccaggcccuggcggcgca

SEQ ID NO: 431407 - RNA, 14 nt, Bordetella pertussis
uccaggcccggcag

SEQ ID NO: 431408 - RNA, 17 nt, Bordetella pertussis
uccaggccggggccgcc

SEQ ID NO: 431409 - RNA, 18 nt, Bordetella pertussis
uccaggcgccgcacgccg

SEQ ID NO: 431410 - RNA, 19 nt, Bordetella pertussis
uccaggcgcgcaagguggc

SEQ ID NO: 431411 - RNA, 16 nt, Bordetella pertussis
uccaggcgcgccagcc

SEQ ID NO: 431412 - RNA, 20 nt, Bordetella pertussis
uccaggcgcgccagccgcug

SEQ ID NO: 431413 - RNA, 23 nt, Bordetella pertussis
uccaggcgcgugggcaggugcuu

SEQ ID NO: 431414 - RNA, 19 nt, Bordetella pertussis
uccaggcucaggcggccag

SEQ ID NO: 431415 - RNA, 21 nt, Bordetella pertussis
uccaggcucaggcggccaggg

SEQ ID NO: 431416 - RNA, 10 nt, Bordetella pertussis
uccaggcugc

SEQ ID NO: 431417 - RNA, 17 nt, Bordetella pertussis
uccaggcugccggcguu

SEQ ID NO: 431418 - RNA, 16 nt, Bordetella pertussis
uccagggccacgccca

SEQ ID NO: 431419 - RNA, 19 nt, Bordetella pertussis
uccagggcgucggcgacgu

SEQ ID NO: 431420 - RNA, 18 nt, Bordetella pertussis
uccagggcuugcggcgcu

SEQ ID NO: 431421 - RNA, 19 nt, Bordetella pertussis
uccagggcuugcggcgcug

SEQ ID NO: 431422 - RNA, 19 nt, Bordetella pertussis
uccagguagucguucuggg

SEQ ID NO: 431423 - RNA, 18 nt, Bordetella pertussis
uccaggucaucaccaggg

SEQ ID NO: 431424 - RNA, 21 nt, Bordetella pertussis
uccaggugccgcguaugcggc

SEQ ID NO: 431425 - RNA, 19 nt, Bordetella pertussis
uccagguggcccgcaccgg

SEQ ID NO: 431426 - RNA, 19 nt, Bordetella pertussis
uccagguggcggacaggcc

SEQ ID NO: 431427 - RNA, 21 nt, Bordetella pertussis
uccagguggcggacaggcccu

SEQ ID NO: 431428 - RNA, 19 nt, Bordetella pertussis
uccagguugagucuggaga

SEQ ID NO: 431429 - RNA, 12 nt, Bordetella pertussis
uccagguugggc

SEQ ID NO: 431430 - RNA, 18 nt, Bordetella pertussis
uccagguugggcaccacc

SEQ ID NO: 431431 - RNA, 14 nt, Bordetella pertussis
uccagguugucgcg

SEQ ID NO: 431432 - RNA, 20 nt, Bordetella pertussis
uccaguucgcgcagauccca

SEQ ID NO: 431433 - RNA, 15 nt, Bordetella pertussis
uccaguugcuguggg

SEQ ID NO: 431434 - RNA, 22 nt, Bordetella pertussis
uccauauauauagggccauggc

SEQ ID NO: 431435 - RNA, 19 nt, Bordetella pertussis
uccaucgccugcacgaccu

SEQ ID NO: 431436 - RNA, 17 nt, Bordetella pertussis
uccaucggggggcaggc

SEQ ID NO: 431437 - RNA, 18 nt, Bordetella pertussis
uccaucggggggcaggcu

SEQ ID NO: 431438 - RNA, 16 nt, Bordetella pertussis
uccaucuugccggccu

SEQ ID NO: 431439 - RNA, 16 nt, Bordetella pertussis
uccaugacggugccga

SEQ ID NO: 431440 - RNA, 21 nt, Bordetella pertussis
uccaugaggaacggcaccagc

SEQ ID NO: 431441 - RNA, 16 nt, Bordetella pertussis
uccaugccggccaugc

SEQ ID NO: 431442 - RNA, 20 nt, Bordetella pertussis
uccaugcgaaagcggccagc

SEQ ID NO: 431443 - RNA, 16 nt, Bordetella pertussis
uccaugcgauccaggg

SEQ ID NO: 431444 - RNA, 16 nt, Bordetella pertussis
uccaugcggaggcuuu

SEQ ID NO: 431445 - RNA, 13 nt, Bordetella pertussis
uccauggcgugcc

SEQ ID NO: 431446 - RNA, 20 nt, Bordetella pertussis
uccauggugggcaggucggg

SEQ ID NO: 431447 - RNA, 20 nt, Bordetella pertussis
ucccacaggcgcgcggcguu

SEQ ID NO: 431448 - RNA, 17 nt, Bordetella pertussis
ucccagcggggacaggc

SEQ ID NO: 431449 - RNA, 19 nt, Bordetella pertussis
ucccagcggggacaggcac

SEQ ID NO: 431450 - RNA, 21 nt, Bordetella pertussis
ucccagcggggacaggcaccc

SEQ ID NO: 431451 - RNA, 13 nt, Bordetella pertussis
ucccaggcccggc

SEQ ID NO: 431452 - RNA, 20 nt, Bordetella pertussis
ucccaggcccggccgcaggg

SEQ ID NO: 431453 - RNA, 22 nt, Bordetella pertussis
ucccaggcccggccgcagggcg

SEQ ID NO: 431454 - RNA, 21 nt, Bordetella pertussis
ucccaggccgaagccaccguc

SEQ ID NO: 431455 - RNA, 12 nt, Bordetella pertussis
ucccaggccggc

SEQ ID NO: 431456 - RNA, 18 nt, Bordetella pertussis
ucccaggcgcucagccgu

SEQ ID NO: 431457 - RNA, 12 nt, Bordetella pertussis
uccccacagggg

SEQ ID NO: 431458 - RNA, 17 nt, Bordetella pertussis
uccccaccgggacaggc

SEQ ID NO: 431459 - RNA, 18 nt, Bordetella pertussis
uccccaccgggacaggca

SEQ ID NO: 431460 - RNA, 21 nt, Bordetella pertussis
uccccacggggacuggcuccc

SEQ ID NO: 431461 - RNA, 18 nt, Bordetella pertussis
uccccacguggacaggca

SEQ ID NO: 431462 - RNA, 13 nt, Bordetella pertussis
uccccaggccagc

SEQ ID NO: 431463 - RNA, 12 nt, Bordetella pertussis
uccccaucaucu

SEQ ID NO: 431464 - RNA, 14 nt, Bordetella pertussis
uccccaugugggga

SEQ ID NO: 431465 - RNA, 19 nt, Bordetella pertussis
uccccauguggggacaggc

SEQ ID NO: 431466 - RNA, 21 nt, Bordetella pertussis
uccccauguggggacaggcac

SEQ ID NO: 431467 - RNA, 15 nt, Bordetella pertussis
uccccaugcggggac

SEQ ID NO: 431468 - RNA, 15 nt, Bordetella pertussis
ucccccacgccgccg

SEQ ID NO: 431469 - RNA, 18 nt, Bordetella pertussis
ucccccacgccgccguag

SEQ ID NO: 431470 - RNA, 16 nt, Bordetella pertussis
ucccccaugcggggac

SEQ ID NO: 431471 - RNA, 22 nt, Bordetella pertussis
uccccgcaagggggacuggcac

SEQ ID NO: 431472 - RNA, 21 nt, Bordetella pertussis
uccccgcacggggacuggcac

SEQ ID NO: 431473 - RNA, 22 nt, Bordetella pertussis
uccccgcacggggacuggcacg

SEQ ID NO: 431474 - RNA, 19 nt, Bordetella pertussis
uccccgcggggacaggcac

SEQ ID NO: 431475 - RNA, 21 nt, Bordetella pertussis
uccccgcggggacaggcaccc

SEQ ID NO: 431476 - RNA, 19 nt, Bordetella pertussis
uccccgcggggacaggcuc

SEQ ID NO: 431477 - RNA, 23 nt, Bordetella pertussis
uccccgcggaggugucgccgccc

SEQ ID NO: 431478 - RNA, 16 nt, Bordetella pertussis
uccccgcgugccuguc

SEQ ID NO: 431479 - RNA, 14 nt, Bordetella pertussis
uccccgcugcggca

SEQ ID NO: 431480 - RNA, 15 nt, Bordetella pertussis
uccccgcugggacag

SEQ ID NO: 431481 - RNA, 19 nt, Bordetella pertussis
uccccgcugggacaggcac

SEQ ID NO: 431482 - RNA, 17 nt, Bordetella pertussis
uccccgucgggacaggc

SEQ ID NO: 431483 - RNA, 19 nt, Bordetella pertussis
uccccgucgggacaggcuc

SEQ ID NO: 431484 - RNA, 18 nt, Bordetella pertussis
uccccguggggacaggca

SEQ ID NO: 431485 - RNA, 19 nt, Bordetella pertussis
uccccguggggacaggcac

SEQ ID NO: 431486 - RNA, 20 nt, Bordetella pertussis
uccccguucggggacaggca

SEQ ID NO: 431487 - RNA, 20 nt, Bordetella pertussis
uccccugcggggacaggcac

SEQ ID NO: 431488 - RNA, 22 nt, Bordetella pertussis
uccccugcggggacaggcaccc

SEQ ID NO: 431489 - RNA, 15 nt, Bordetella pertussis
uccccugcuaaggga

SEQ ID NO: 431490 - RNA, 15 nt, Bordetella pertussis
uccccuucucggccg

SEQ ID NO: 431491 - RNA, 22 nt, Bordetella pertussis
ucccgacccccggcccgcgccg

SEQ ID NO: 431492 - RNA, 14 nt, Bordetella pertussis
ucccgacgaggccg

SEQ ID NO: 431493 - RNA, 20 nt, Bordetella pertussis
ucccgcaccgaccagcgcgc

SEQ ID NO: 431494 - RNA, 24 nt, Bordetella pertussis
ucccgcaccgaccagcgcgcgccg

SEQ ID NO: 431495 - RNA, 23 nt, Bordetella pertussis
ucccgccaacacgauccacggcc

SEQ ID NO: 431496 - RNA, 22 nt, Bordetella pertussis
ucccgccgggccaaggugccug

SEQ ID NO: 431497 - RNA, 20 nt, Bordetella pertussis
ucccgccgggcuccucgccc

SEQ ID NO: 431498 - RNA, 20 nt, Bordetella pertussis
ucccgcgccgagcggggccg

SEQ ID NO: 431499 - RNA, 13 nt, Bordetella pertussis
ucccgcgcugccg

SEQ ID NO: 431500 - RNA, 20 nt, Bordetella pertussis
ucccggccaggcgccggcgg

SEQ ID NO: 431501 - RNA, 20 nt, Bordetella pertussis
ucccggcgacaccgcggccu

SEQ ID NO: 431502 - RNA, 19 nt, Bordetella pertussis
ucccggcggggacaggcgc

SEQ ID NO: 431503 - RNA, 17 nt, Bordetella pertussis
ucccggcggggcaggcg

SEQ ID NO: 431504 - RNA, 20 nt, Bordetella pertussis
ucccggcgcucagcgcgccg

SEQ ID NO: 431505 - RNA, 14 nt, Bordetella pertussis
ucccgguccaggcc

SEQ ID NO: 431506 - RNA, 19 nt, Bordetella pertussis
ucccgucauggcggcaggc

SEQ ID NO: 431507 - RNA, 14 nt, Bordetella pertussis
ucccgugccggccg

SEQ ID NO: 431508 - RNA, 22 nt, Bordetella pertussis
ucccuacccgccgggcggcgcc

SEQ ID NO: 431509 - RNA, 22 nt, Bordetella pertussis
ucccucgcccagcgagccggcc

SEQ ID NO: 431510 - RNA, 16 nt, Bordetella pertussis
ucccucggugcugcug

SEQ ID NO: 431511 - RNA, 18 nt, Bordetella pertussis
ucccucggugcugcuguu

SEQ ID NO: 431512 - RNA, 17 nt, Bordetella pertussis
ucccugccgggacaggc

SEQ ID NO: 431513 - RNA, 19 nt, Bordetella pertussis
ucccuggcccuggcgggcc

SEQ ID NO: 431514 - RNA, 15 nt, Bordetella pertussis
ucccugguccagcag

SEQ ID NO: 431515 - RNA, 19 nt, Bordetella pertussis
uccgaaagacugcggcgcg

SEQ ID NO: 431516 - RNA, 22 nt, Bordetella pertussis
uccgaaccacccggccaucgaa

SEQ ID NO: 431517 - RNA, 19 nt, Bordetella pertussis
uccgaacgcgacagcgcug

SEQ ID NO: 431518 - RNA, 16 nt, Bordetella pertussis
uccgacaggcgccgca

SEQ ID NO: 431519 - RNA, 16 nt, Bordetella pertussis
uccgaugcugguguga

SEQ ID NO: 431520 - RNA, 23 nt, Bordetella pertussis
uccgauggcgauguaggccaggu

SEQ ID NO: 431521 - RNA, 15 nt, Bordetella pertussis
uccgcaacccagcag

SEQ ID NO: 431522 - RNA, 18 nt, Bordetella pertussis
uccgcaacccagcagcgg

SEQ ID NO: 431523 - RNA, 21 nt, Bordetella pertussis
uccgcaccggcgugcgcuggc

SEQ ID NO: 431524 - RNA, 12 nt, Bordetella pertussis
uccgcagcgcag

SEQ ID NO: 431525 - RNA, 17 nt, Bordetella pertussis
uccgcagcgcagcgcca

SEQ ID NO: 431526 - RNA, 19 nt, Bordetella pertussis
uccgcaucgcgcaagggcc

SEQ ID NO: 431527 - RNA, 18 nt, Bordetella pertussis
uccgcauggacggaggcu

SEQ ID NO: 431528 - RNA, 18 nt, Bordetella pertussis
uccgcccagccaggcgcc

SEQ ID NO: 431529 - RNA, 20 nt, Bordetella pertussis
uccgccccccugcauaccca

SEQ ID NO: 431530 - RNA, 19 nt, Bordetella pertussis
uccgccgagaaauccagcg

SEQ ID NO: 431531 - RNA, 17 nt, Bordetella pertussis
uccgccgcggccagcgc

SEQ ID NO: 431532 - RNA, 20 nt, Bordetella pertussis
uccgccggcgauauggccag

SEQ ID NO: 431533 - RNA, 22 nt, Bordetella pertussis
uccgccggcgauauggccaggg

SEQ ID NO: 431534 - RNA, 19 nt, Bordetella pertussis
uccgccggugucggggccg

SEQ ID NO: 431535 - RNA, 20 nt, Bordetella pertussis
uccgccuacuggcgcgcgca

SEQ ID NO: 431536 - RNA, 16 nt, Bordetella pertussis
uccgcgacgcccuggc

SEQ ID NO: 431537 - RNA, 18 nt, Bordetella pertussis
uccgcgacgcccuggccu

SEQ ID NO: 431538 - RNA, 16 nt, Bordetella pertussis
uccgcgcacagcgcgg

SEQ ID NO: 431539 - RNA, 21 nt, Bordetella pertussis
uccgcgcauggacugcaggcg

SEQ ID NO: 431540 - RNA, 15 nt, Bordetella pertussis
uccgcgccaggaugg

SEQ ID NO: 431541 - RNA, 13 nt, Bordetella pertussis
uccgcgccgacca

SEQ ID NO: 431542 - RNA, 17 nt, Bordetella pertussis
uccgcgcucgcccagcc

SEQ ID NO: 431543 - RNA, 17 nt, Bordetella pertussis
uccgcgggcgggccgcg

SEQ ID NO: 431544 - RNA, 16 nt, Bordetella pertussis
uccgcguugcgcugcc

SEQ ID NO: 431545 - RNA, 17 nt, Bordetella pertussis
uccgcucgaggccaggc

SEQ ID NO: 431546 - RNA, 14 nt, Bordetella pertussis
uccgcugcgccgag

SEQ ID NO: 431547 - RNA, 13 nt, Bordetella pertussis
uccgcuuccggcc

SEQ ID NO: 431548 - RNA, 22 nt, Bordetella pertussis
uccggacugaacgcguccaggc

SEQ ID NO: 431549 - RNA, 14 nt, Bordetella pertussis
uccggcaacagcag

SEQ ID NO: 431550 - RNA, 16 nt, Bordetella pertussis
uccggcaacagcaggu

SEQ ID NO: 431551 - RNA, 14 nt, Bordetella pertussis
uccggcagcagcag

SEQ ID NO: 431552 - RNA, 22 nt, Bordetella pertussis
uccggcagcggccagcgcggcg

SEQ ID NO: 431553 - RNA, 19 nt, Bordetella pertussis
uccggcaugaccgcggacg

SEQ ID NO: 431554 - RNA, 20 nt, Bordetella pertussis
uccggccagcacgccggcgg

SEQ ID NO: 431555 - RNA, 19 nt, Bordetella pertussis
uccggcccagcgccaucgg

SEQ ID NO: 431556 - RNA, 17 nt, Bordetella pertussis
uccggcccggugcagcc

SEQ ID NO: 431557 - RNA, 18 nt, Bordetella pertussis
uccggccgcgcaaggcgg

SEQ ID NO: 431558 - RNA, 16 nt, Bordetella pertussis
uccggccgggccagcg

SEQ ID NO: 431559 - RNA, 16 nt, Bordetella pertussis
uccggccgugccgccc

SEQ ID NO: 431560 - RNA, 18 nt, Bordetella pertussis
uccggcgcccgccgccgg

SEQ ID NO: 431561 - RNA, 16 nt, Bordetella pertussis
uccggcgccuggccgu

SEQ ID NO: 431562 - RNA, 13 nt, Bordetella pertussis
uccggcgcgcgca

SEQ ID NO: 431563 - RNA, 22 nt, Bordetella pertussis
uccggcggcagcgcgaacggcg

SEQ ID NO: 431564 - RNA, 13 nt, Bordetella pertussis
uccggcucuucca

SEQ ID NO: 431565 - RNA, 15 nt, Bordetella pertussis
uccggcugcuugccc

SEQ ID NO: 431566 - RNA, 14 nt, Bordetella pertussis
uccgggccuggccu

SEQ ID NO: 431567 - RNA, 13 nt, Bordetella pertussis
uccgggccuggcg

SEQ ID NO: 431568 - RNA, 15 nt, Bordetella pertussis
uccgggccuggcguu

SEQ ID NO: 431569 - RNA, 15 nt, Bordetella pertussis
uccggggugccuguc

SEQ ID NO: 431570 - RNA, 17 nt, Bordetella pertussis
uccggugccuggcuccc

SEQ ID NO: 431571 - RNA, 15 nt, Bordetella pertussis
uccguccuggccacu

SEQ ID NO: 431572 - RNA, 18 nt, Bordetella pertussis
uccgucucggcuucuccu

SEQ ID NO: 431573 - RNA, 19 nt, Bordetella pertussis
uccgugcggcgcgcacggg

SEQ ID NO: 431574 - RNA, 20 nt, Bordetella pertussis
uccguggcggccgcgggcag

SEQ ID NO: 431575 - RNA, 15 nt, Bordetella pertussis
uccuaucuuucgggc

SEQ ID NO: 431576 - RNA, 20 nt, Bordetella pertussis
uccucagccugguauugccu

SEQ ID NO: 431577 - RNA, 13 nt, Bordetella pertussis
uccucaggcccgc

SEQ ID NO: 431578 - RNA, 20 nt, Bordetella pertussis
uccucaggcccgcggcgcca

SEQ ID NO: 431579 - RNA, 18 nt, Bordetella pertussis
uccucaugcgggacaggc

SEQ ID NO: 431580 - RNA, 15 nt, Bordetella pertussis
uccuccccaacgggg

SEQ ID NO: 431581 - RNA, 23 nt, Bordetella pertussis
uccucgaacaggccaucgccgcc

SEQ ID NO: 431582 - RNA, 13 nt, Bordetella pertussis
uccucgaccagga

SEQ ID NO: 431583 - RNA, 15 nt, Bordetella pertussis
uccucgaccaggucc

SEQ ID NO: 431584 - RNA, 23 nt, Bordetella pertussis
uccucgacgauggcgggguuggc

SEQ ID NO: 431585 - RNA, 13 nt, Bordetella pertussis
uccucgccagcgg

SEQ ID NO: 431586 - RNA, 20 nt, Bordetella pertussis
uccucgccgcccagccggcc

SEQ ID NO: 431587 - RNA, 19 nt, Bordetella pertussis
uccucgcuuuaccagcugu

SEQ ID NO: 431588 - RNA, 15 nt, Bordetella pertussis
uccucggccuggccc

SEQ ID NO: 431589 - RNA, 16 nt, Bordetella pertussis
uccucggccuggcccc

SEQ ID NO: 431590 - RNA, 14 nt, Bordetella pertussis
uccucggccagguc

SEQ ID NO: 431591 - RNA, 22 nt, Bordetella pertussis
uccucgucggccaugcgcgcca

SEQ ID NO: 431592 - RNA, 21 nt, Bordetella pertussis
uccugaacgacgguacaccug

SEQ ID NO: 431593 - RNA, 22 nt, Bordetella pertussis
uccugaacgccgcgcugccuga

SEQ ID NO: 431594 - RNA, 17 nt, Bordetella pertussis
uccugcaacuggugcac

SEQ ID NO: 431595 - RNA, 22 nt, Bordetella pertussis
uccugcaaccagcucagcuugg

SEQ ID NO: 431596 - RNA, 22 nt, Bordetella pertussis
uccugcaaggccggcggcacgc

SEQ ID NO: 431597 - RNA, 19 nt, Bordetella pertussis
uccugccauugcgcggccu

SEQ ID NO: 431598 - RNA, 17 nt, Bordetella pertussis
uccugcgaggacagggg

SEQ ID NO: 431599 - RNA, 18 nt, Bordetella pertussis
uccuggcgacggccugcc

SEQ ID NO: 431600 - RNA, 19 nt, Bordetella pertussis
uccuggcggccgcccagca

SEQ ID NO: 431601 - RNA, 22 nt, Bordetella pertussis
uccugggugcgccaaucggcgu

SEQ ID NO: 431602 - RNA, 18 nt, Bordetella pertussis
uccuggucggcgcggcag

SEQ ID NO: 431603 - RNA, 22 nt, Bordetella pertussis
uccuggucuuccgguacgcgca

SEQ ID NO: 431604 - RNA, 13 nt, Bordetella pertussis
uccugguucaggc

SEQ ID NO: 431605 - RNA, 16 nt, Bordetella pertussis
uccuguucgccaaucu

SEQ ID NO: 431606 - RNA, 19 nt, Bordetella pertussis
ucgaagagcagaagcauuc

SEQ ID NO: 431607 - RNA, 19 nt, Bordetella pertussis
ucgaagaucaacaaggcga

SEQ ID NO: 431608 - RNA, 14 nt, Bordetella pertussis
ucgaagccggugau

SEQ ID NO: 431609 - RNA, 15 nt, Bordetella pertussis
ucgaagcgcucgucc

SEQ ID NO: 431610 - RNA, 15 nt, Bordetella pertussis
ucgaaggcgcgcucc

SEQ ID NO: 431611 - RNA, 19 nt, Bordetella pertussis
ucgaaggcgcgcuccagca

SEQ ID NO: 431612 - RNA, 15 nt, Bordetella pertussis
ucgaaggcggccggc

SEQ ID NO: 431613 - RNA, 19 nt, Bordetella pertussis
ucgaaugcacgggcgcugc

SEQ ID NO: 431614 - RNA, 17 nt, Bordetella pertussis
ucgaauggcugcgcgcc

SEQ ID NO: 431615 - RNA, 13 nt, Bordetella pertussis
ucgacagcgcgcc

SEQ ID NO: 431616 - RNA, 16 nt, Bordetella pertussis
ucgacaugcuggccca

SEQ ID NO: 431617 - RNA, 17 nt, Bordetella pertussis
ucgaccacgcgcgcgcc

SEQ ID NO: 431618 - RNA, 13 nt, Bordetella pertussis
ucgaccagcaucc

SEQ ID NO: 431619 - RNA, 15 nt, Bordetella pertussis
ucgaccaggaaguug

SEQ ID NO: 431620 - RNA, 23 nt, Bordetella pertussis
ucgaccaggucgccguacucgcc

SEQ ID NO: 431621 - RNA, 22 nt, Bordetella pertussis
ucgaccaguucggccagcagcu

SEQ ID NO: 431622 - RNA, 22 nt, Bordetella pertussis
ucgacccacuugagcagcgccu

SEQ ID NO: 431623 - RNA, 22 nt, Bordetella pertussis
ucgaccugcuugcccagcagau

SEQ ID NO: 431624 - RNA, 21 nt, Bordetella pertussis
ucgaccugcuuggcgaacacc

SEQ ID NO: 431625 - RNA, 18 nt, Bordetella pertussis
ucgacgauggccggggcg

SEQ ID NO: 431626 - RNA, 16 nt, Bordetella pertussis
ucgacgggcggcugcc

SEQ ID NO: 431627 - RNA, 16 nt, Bordetella pertussis
ucgacguaagugccca

SEQ ID NO: 431628 - RNA, 14 nt, Bordetella pertussis
ucgagaaaccagcc

SEQ ID NO: 431629 - RNA, 15 nt, Bordetella pertussis
ucgagcaagggccag

SEQ ID NO: 431630 - RNA, 21 nt, Bordetella pertussis
ucgagcaccaugccggggaac

SEQ ID NO: 431631 - RNA, 13 nt, Bordetella pertussis
ucgagcaccgccu

SEQ ID NO: 431632 - RNA, 15 nt, Bordetella pertussis
ucgagcaccuugacg

SEQ ID NO: 431633 - RNA, 14 nt, Bordetella pertussis
ucgagcaggccggc

SEQ ID NO: 431634 - RNA, 13 nt, Bordetella pertussis
ucgagcaggcgca

SEQ ID NO: 431635 - RNA, 21 nt, Bordetella pertussis
ucgagccgcagaacagcagcg

SEQ ID NO: 431636 - RNA, 18 nt, Bordetella pertussis
ucgagccggcuccagucc

SEQ ID NO: 431637 - RNA, 22 nt, Bordetella pertussis
ucgagcgcgaaauccagcgcgc

SEQ ID NO: 431638 - RNA, 14 nt, Bordetella pertussis
ucgaucagcgcgcc

SEQ ID NO: 431639 - RNA, 15 nt, Bordetella pertussis
ucgaucaggcgcucc

SEQ ID NO: 431640 - RNA, 22 nt, Bordetella pertussis
ucgaucaugaugcgcugggcca

SEQ ID NO: 431641 - RNA, 19 nt, Bordetella pertussis
ucgaucauggccagccgcu

SEQ ID NO: 431642 - RNA, 14 nt, Bordetella pertussis
ucgauccagaagau

SEQ ID NO: 431643 - RNA, 15 nt, Bordetella pertussis
ucgauccgggccugg

SEQ ID NO: 431644 - RNA, 16 nt, Bordetella pertussis
ucgauccgggccuggc

SEQ ID NO: 431645 - RNA, 17 nt, Bordetella pertussis
ucgauccggcagcagca

SEQ ID NO: 431646 - RNA, 14 nt, Bordetella pertussis
ucgaugcgcuugcc

SEQ ID NO: 431647 - RNA, 23 nt, Bordetella pertussis
ucgaugcgcuugccgaccuccag

SEQ ID NO: 431648 - RNA, 22 nt, Bordetella pertussis
ucgaugcuggcgcggaccugcu

SEQ ID NO: 431649 - RNA, 13 nt, Bordetella pertussis
ucgaugcuggcgg

SEQ ID NO: 431650 - RNA, 15 nt, Bordetella pertussis
ucgauggccagggcg

SEQ ID NO: 431651 - RNA, 16 nt, Bordetella pertussis
ucgauggccaggugca

SEQ ID NO: 431652 - RNA, 16 nt, Bordetella pertussis
ucgauggcggccaggg

SEQ ID NO: 431653 - RNA, 21 nt, Bordetella pertussis
ucgauggcuucgcgcacaucc

SEQ ID NO: 431654 - RNA, 22 nt, Bordetella pertussis
ucgauguagagggucuggccgg

SEQ ID NO: 431655 - RNA, 19 nt, Bordetella pertussis
ucgauguccagcgccagca

SEQ ID NO: 431656 - RNA, 18 nt, Bordetella pertussis
ucgcaggccgcggccagg

SEQ ID NO: 431657 - RNA, 20 nt, Bordetella pertussis
ucgcaggccgcggccaggcc

SEQ ID NO: 431658 - RNA, 23 nt, Bordetella pertussis
ucgcaucgcggcagcccggcacg

SEQ ID NO: 431659 - RNA, 15 nt, Bordetella pertussis
ucgccagcaggcgcu

SEQ ID NO: 431660 - RNA, 20 nt, Bordetella pertussis
ucgccagcgccggggucagc

SEQ ID NO: 431661 - RNA, 20 nt, Bordetella pertussis
ucgccaggacguccaggccu

SEQ ID NO: 431662 - RNA, 15 nt, Bordetella pertussis
ucgccgcccacggcg

SEQ ID NO: 431663 - RNA, 17 nt, Bordetella pertussis
ucgccgccgccgggcug

SEQ ID NO: 431664 - RNA, 14 nt, Bordetella pertussis
ucgccggccagcgc

SEQ ID NO: 431665 - RNA, 13 nt, Bordetella pertussis
ucgccggccaggc

SEQ ID NO: 431666 - RNA, 13 nt, Bordetella pertussis
ucgccggccuggc

SEQ ID NO: 431667 - RNA, 23 nt, Bordetella pertussis
ucgccggccuggcgcgcggccug

SEQ ID NO: 431668 - RNA, 15 nt, Bordetella pertussis
ucgccggcgccccca

SEQ ID NO: 431669 - RNA, 18 nt, Bordetella pertussis
ucgccggcgcccccagca

SEQ ID NO: 431670 - RNA, 12 nt, Bordetella pertussis
ucgccggcgcug

SEQ ID NO: 431671 - RNA, 17 nt, Bordetella pertussis
ucgccggcguucuucag

SEQ ID NO: 431672 - RNA, 19 nt, Bordetella pertussis
ucgccggcuuccagcagca

SEQ ID NO: 431673 - RNA, 15 nt, Bordetella pertussis
ucgccgggcggcgcg

SEQ ID NO: 431674 - RNA, 18 nt, Bordetella pertussis
ucgccgggcagcgggccg

SEQ ID NO: 431675 - RNA, 21 nt, Bordetella pertussis
ucgccggggcgcaccggcacg

SEQ ID NO: 431676 - RNA, 14 nt, Bordetella pertussis
ucgccucgaugaag

SEQ ID NO: 431677 - RNA, 16 nt, Bordetella pertussis
ucgcgaccgccgccuu

SEQ ID NO: 431678 - RNA, 18 nt, Bordetella pertussis
ucgcgaugcgcagcagca

SEQ ID NO: 431679 - RNA, 21 nt, Bordetella pertussis
ucgcgauugaguucgcgcgcc

SEQ ID NO: 431680 - RNA, 15 nt, Bordetella pertussis
ucgcgauuuccauga

SEQ ID NO: 431681 - RNA, 15 nt, Bordetella pertussis
ucgcgcaagggccag

SEQ ID NO: 431682 - RNA, 18 nt, Bordetella pertussis
ucgcgcacagcgcgcaac

SEQ ID NO: 431683 - RNA, 14 nt, Bordetella pertussis
ucgcgcacauccag

SEQ ID NO: 431684 - RNA, 17 nt, Bordetella pertussis
ucgcgcaccaccuggcu

SEQ ID NO: 431685 - RNA, 13 nt, Bordetella pertussis
ucgcgcaccagcg

SEQ ID NO: 431686 - RNA, 24 nt, Bordetella pertussis
ucgcgccagcgccgcgcgcgugcc

SEQ ID NO: 431687 - RNA, 12 nt, Bordetella pertussis
ucgcgccaggcg

SEQ ID NO: 431688 - RNA, 20 nt, Bordetella pertussis
ucgcgccaggcgccgggccg

SEQ ID NO: 431689 - RNA, 16 nt, Bordetella pertussis
ucgcgcccagcgagcu

SEQ ID NO: 431690 - RNA, 18 nt, Bordetella pertussis
ucgcgcccaucucggccg

SEQ ID NO: 431691 - RNA, 17 nt, Bordetella pertussis
ucgcgcccgccguggcc

SEQ ID NO: 431692 - RNA, 19 nt, Bordetella pertussis
ucgcgcccggucugccaca

SEQ ID NO: 431693 - RNA, 19 nt, Bordetella pertussis
ucgcgccguccgagcccga

SEQ ID NO: 431694 - RNA, 12 nt, Bordetella pertussis
ucgcgccggccu

SEQ ID NO: 431695 - RNA, 21 nt, Bordetella pertussis
ucgcgcgacgugucggccacc

SEQ ID NO: 431696 - RNA, 17 nt, Bordetella pertussis
ucgcgcgagaccagcgg

SEQ ID NO: 431697 - RNA, 20 nt, Bordetella pertussis
ucgcgcgauugcaucuccag

SEQ ID NO: 431698 - RNA, 16 nt, Bordetella pertussis
ucgcgcgccagcgcgg

SEQ ID NO: 431699 - RNA, 18 nt, Bordetella pertussis
ucgcgcgccggcagggcg

SEQ ID NO: 431700 - RNA, 17 nt, Bordetella pertussis
ucgcgcgccugcgcgcc

SEQ ID NO: 431701 - RNA, 21 nt, Bordetella pertussis
ucgcgcgcgccggcaucggcg

SEQ ID NO: 431702 - RNA, 15 nt, Bordetella pertussis
ucgcgcgcgcggauc

SEQ ID NO: 431703 - RNA, 22 nt, Bordetella pertussis
ucgcgcgcgcgguccaugguga

SEQ ID NO: 431704 - RNA, 13 nt, Bordetella pertussis
ucgcgcuccagca

SEQ ID NO: 431705 - RNA, 18 nt, Bordetella pertussis
ucgcgcucgagcgcggcg

SEQ ID NO: 431706 - RNA, 22 nt, Bordetella pertussis
ucgcgcugcaggaucgcggcca

SEQ ID NO: 431707 - RNA, 18 nt, Bordetella pertussis
ucgcgcuggcgcgagaac

SEQ ID NO: 431708 - RNA, 13 nt, Bordetella pertussis
ucgcgcuggggca

SEQ ID NO: 431709 - RNA, 16 nt, Bordetella pertussis
ucgcgcuguuccagcc

SEQ ID NO: 431710 - RNA, 21 nt, Bordetella pertussis
ucgcgcuucuuguccuugaac

SEQ ID NO: 431711 - RNA, 17 nt, Bordetella pertussis
ucgcggaaauccgggcg

SEQ ID NO: 431712 - RNA, 15 nt, Bordetella pertussis
ucgcggaugcgcgcc

SEQ ID NO: 431713 - RNA, 13 nt, Bordetella pertussis
ucgcggccagcgg

SEQ ID NO: 431714 - RNA, 16 nt, Bordetella pertussis
ucgcggccagcggcag

SEQ ID NO: 431715 - RNA, 18 nt, Bordetella pertussis
ucgcggcccacggccagc

SEQ ID NO: 431716 - RNA, 20 nt, Bordetella pertussis
ucgcggcccugggcgcggcg

SEQ ID NO: 431717 - RNA, 20 nt, Bordetella pertussis
ucgcggccgagcuccucgag

SEQ ID NO: 431718 - RNA, 13 nt, Bordetella pertussis
ucgcggccgaggc

SEQ ID NO: 431719 - RNA, 17 nt, Bordetella pertussis
ucgcggccgaggccagc

SEQ ID NO: 431720 - RNA, 19 nt, Bordetella pertussis
ucgcggccggacagggccg

SEQ ID NO: 431721 - RNA, 13 nt, Bordetella pertussis
ucgcgggcagugc

SEQ ID NO: 431722 - RNA, 23 nt, Bordetella pertussis
ucgcgggccaggccggcccaguc

SEQ ID NO: 431723 - RNA, 23 nt, Bordetella pertussis
ucgcgggcccgcucggccagcag

SEQ ID NO: 431724 - RNA, 15 nt, Bordetella pertussis
ucgcgggccuuggcc

SEQ ID NO: 431725 - RNA, 16 nt, Bordetella pertussis
ucgcgggccuuggcca

SEQ ID NO: 431726 - RNA, 20 nt, Bordetella pertussis
ucgcgggccuuggccagcag

SEQ ID NO: 431727 - RNA, 20 nt, Bordetella pertussis
ucgcggugcaagcggccggc

SEQ ID NO: 431728 - RNA, 18 nt, Bordetella pertussis
ucgcggugucgcaccgca

SEQ ID NO: 431729 - RNA, 16 nt, Bordetella pertussis
ucgcguagcgcggccg

SEQ ID NO: 431730 - RNA, 15 nt, Bordetella pertussis
ucgcucccccaugcg

SEQ ID NO: 431731 - RNA, 19 nt, Bordetella pertussis
ucgcugacgcguucuucag

SEQ ID NO: 431732 - RNA, 15 nt, Bordetella pertussis
ucgcugaucugcuug

SEQ ID NO: 431733 - RNA, 20 nt, Bordetella pertussis
ucgcugccggcgcccuugau

SEQ ID NO: 431734 - RNA, 18 nt, Bordetella pertussis
ucgcugccgggauccgcu

SEQ ID NO: 431735 - RNA, 19 nt, Bordetella pertussis
ucgcugcgaaacagcagcg

SEQ ID NO: 431736 - RNA, 21 nt, Bordetella pertussis
ucggaagacauggcgcgcgcc

SEQ ID NO: 431737 - RNA, 15 nt, Bordetella pertussis
ucggaccuggccagc

SEQ ID NO: 431738 - RNA, 21 nt, Bordetella pertussis
ucggacgagacaggcgcgcca

SEQ ID NO: 431739 - RNA, 22 nt, Bordetella pertussis
ucggacgcaccuuucugcugcu

SEQ ID NO: 431740 - RNA, 14 nt, Bordetella pertussis
ucggacgccuggcg

SEQ ID NO: 431741 - RNA, 13 nt, Bordetella pertussis
ucggacgcgcgcc

SEQ ID NO: 431742 - RNA, 13 nt, Bordetella pertussis
ucggacgggccga

SEQ ID NO: 431743 - RNA, 15 nt, Bordetella pertussis
ucggcaaggcgcaca

SEQ ID NO: 431744 - RNA, 21 nt, Bordetella pertussis
ucggcaccaucguugccuggg

SEQ ID NO: 431745 - RNA, 14 nt, Bordetella pertussis
ucggcaggccggcg

SEQ ID NO: 431746 - RNA, 18 nt, Bordetella pertussis
ucggcauccagcucggcg

SEQ ID NO: 431747 - RNA, 20 nt, Bordetella pertussis
ucggcaucggccacgcugcc

SEQ ID NO: 431748 - RNA, 18 nt, Bordetella pertussis
ucggccaacggcuggcug

SEQ ID NO: 431749 - RNA, 19 nt, Bordetella pertussis
ucgguugcccgugacccgg

SEQ ID NO: 431750 - RNA, 16 nt, Bordetella pertussis
ucguagucgagccagg

SEQ ID NO: 431751 - RNA, 19 nt, Bordetella pertussis
ucgucagcacgcccuggcu

SEQ ID NO: 431752 - RNA, 16 nt, Bordetella pertussis
ucgucaugaacgucac

SEQ ID NO: 431753 - RNA, 14 nt, Bordetella pertussis
ucguccucggcacg

SEQ ID NO: 431754 - RNA, 17 nt, Bordetella pertussis
ucguccucggcacggcc

SEQ ID NO: 431755 - RNA, 18 nt, Bordetella pertussis
ucguccucgucggcgaag

SEQ ID NO: 431756 - RNA, 23 nt, Bordetella pertussis
ucguccugaucgaggagcugcug

SEQ ID NO: 431757 - RNA, 19 nt, Bordetella pertussis
ucgucgaccacgccggcgg

SEQ ID NO: 431758 - RNA, 17 nt, Bordetella pertussis
ucgucgacguccuggug

SEQ ID NO: 431759 - RNA, 15 nt, Bordetella pertussis
ucgucgagccgggcc

SEQ ID NO: 431760 - RNA, 16 nt, Bordetella pertussis
ucgucgaggucagcgg

SEQ ID NO: 431761 - RNA, 18 nt, Bordetella pertussis
ucgucgaggucagcggcu

SEQ ID NO: 431762 - RNA, 16 nt, Bordetella pertussis
ucgucgaugccgacca

SEQ ID NO: 431763 - RNA, 20 nt, Bordetella pertussis
ucgucuugaccagcaggccg

SEQ ID NO: 431764 - RNA, 13 nt, Bordetella pertussis
ucgugcaccagcc

SEQ ID NO: 431765 - RNA, 15 nt, Bordetella pertussis
ucgugcaccagcccg

SEQ ID NO: 431766 - RNA, 18 nt, Bordetella pertussis
ucgugcagcaggggcugc

SEQ ID NO: 431767 - RNA, 17 nt, Bordetella pertussis
ucgugcccagcuggcac

SEQ ID NO: 431768 - RNA, 22 nt, Bordetella pertussis
ucgugccccgcaugcgcagacu

SEQ ID NO: 431769 - RNA, 12 nt, Bordetella pertussis
ucgugccggaga

SEQ ID NO: 431770 - RNA, 14 nt, Bordetella pertussis
ucgugccgggcagc

SEQ ID NO: 431771 - RNA, 17 nt, Bordetella pertussis
ucgugcugcugcaggcg

SEQ ID NO: 431772 - RNA, 22 nt, Bordetella pertussis
ucguggucgacauagacgcgca

SEQ ID NO: 431773 - RNA, 23 nt, Bordetella pertussis
ucguguagggccuggcguaugcc

SEQ ID NO: 431774 - RNA, 15 nt, Bordetella pertussis
ucguguucgcggccg

SEQ ID NO: 431775 - RNA, 16 nt, Bordetella pertussis
ucguugaucuggccgu

SEQ ID NO: 431776 - RNA, 15 nt, Bordetella pertussis
ucguugccugggugc

SEQ ID NO: 431777 - RNA, 20 nt, Bordetella pertussis
ucguugcgccgaucgcggcu

SEQ ID NO: 431778 - RNA, 19 nt, Bordetella pertussis
ucguugcgcgaagcggaaa

SEQ ID NO: 431779 - RNA, 15 nt, Bordetella pertussis
ucuacacggccgcca

SEQ ID NO: 431780 - RNA, 23 nt, Bordetella pertussis
ucuacacggccgccaccugggcc

SEQ ID NO: 431781 - RNA, 18 nt, Bordetella pertussis
ucuacgcgcgcgccggca

SEQ ID NO: 431782 - RNA, 19 nt, Bordetella pertussis
ucuacgcgcgcgccggcau

SEQ ID NO: 431783 - RNA, 22 nt, Bordetella pertussis
ucuaggccguuuccucuggaga

SEQ ID NO: 431784 - RNA, 12 nt, Bordetella pertussis
ucuaucaucagg

SEQ ID NO: 431785 - RNA, 16 nt, Bordetella pertussis
ucuaugcgguguugcu

SEQ ID NO: 431786 - RNA, 18 nt, Bordetella pertussis
ucucaacccgccggccau

SEQ ID NO: 431787 - RNA, 21 nt, Bordetella pertussis
ucuccgguucggcgcggcgcg

SEQ ID NO: 431788 - RNA, 14 nt, Bordetella pertussis
ucucgcccaggccc

SEQ ID NO: 431789 - RNA, 13 nt, Bordetella pertussis
ucucgcccugcuc

SEQ ID NO: 431790 - RNA, 14 nt, Bordetella pertussis
ucucgcccugcucg

SEQ ID NO: 431791 - RNA, 21 nt, Bordetella pertussis
ucugcauguacucggccaggc

SEQ ID NO: 431792 - RNA, 20 nt, Bordetella pertussis
ucugcccgugcgugugccug

SEQ ID NO: 431793 - RNA, 22 nt, Bordetella pertussis
ucugcccgugcgugugccuguc

SEQ ID NO: 431794 - RNA, 19 nt, Bordetella pertussis
ucugcccgcgguccagcac

SEQ ID NO: 431795 - RNA, 23 nt, Bordetella pertussis
ucugcccgcgguccagcacggcg

SEQ ID NO: 431796 - RNA, 14 nt, Bordetella pertussis
ucugccgccaggca

SEQ ID NO: 431797 - RNA, 20 nt, Bordetella pertussis
ucugccgcgcauuugccgcg

SEQ ID NO: 431798 - RNA, 15 nt, Bordetella pertussis
ucugccguuccagcu

SEQ ID NO: 431799 - RNA, 13 nt, Bordetella pertussis
ucugcgccugcug

SEQ ID NO: 431800 - RNA, 16 nt, Bordetella pertussis
ucugcugguacagccc

SEQ ID NO: 431801 - RNA, 21 nt, Bordetella pertussis
ucugcuggucgcgggccaggc

SEQ ID NO: 431802 - RNA, 13 nt, Bordetella pertussis
ucugcgccgccgc

SEQ ID NO: 431803 - RNA, 15 nt, Bordetella pertussis
ucugcuugccggccc

SEQ ID NO: 431804 - RNA, 19 nt, Bordetella pertussis
ucuggaucaccgccggcgg

SEQ ID NO: 431805 - RNA, 15 nt, Bordetella pertussis
ucuggcacaccagcg

SEQ ID NO: 431806 - RNA, 15 nt, Bordetella pertussis
ucuggcacgcuugcc

SEQ ID NO: 431807 - RNA, 12 nt, Bordetella pertussis
ucuggccgacca

SEQ ID NO: 431808 - RNA, 21 nt, Bordetella pertussis
ucuggccggccgcguucagca

SEQ ID NO: 431809 - RNA, 23 nt, Bordetella pertussis
ucuggccggcgcugggcaggcug

SEQ ID NO: 431810 - RNA, 13 nt, Bordetella pertussis
ucuggccggugau

SEQ ID NO: 431811 - RNA, 17 nt, Bordetella pertussis
ucuggcgcagcaaggcg

SEQ ID NO: 431812 - RNA, 18 nt, Bordetella pertussis
ucuggcgcauggccggcg

SEQ ID NO: 431813 - RNA, 19 nt, Bordetella pertussis
ucugggccucggccagcug

SEQ ID NO: 431814 - RNA, 23 nt, Bordetella pertussis
ucugggccucggccagcugggcc

SEQ ID NO: 431815 - RNA, 14 nt, Bordetella pertussis
ucugggcgcggaac

SEQ ID NO: 431816 - RNA, 17 nt, Bordetella pertussis
ucugggcgucccaggcc

SEQ ID NO: 431817 - RNA, 19 nt, Bordetella pertussis
ucugggcgucgaaggcggc

SEQ ID NO: 431818 - RNA, 13 nt, Bordetella pertussis
ucuggugaaacag

SEQ ID NO: 431819 - RNA, 15 nt, Bordetella pertussis
ucugugcgccccgcu

SEQ ID NO: 431820 - RNA, 19 nt, Bordetella pertussis
ucuucgaaguauuucagga

SEQ ID NO: 431821 - RNA, 16 nt, Bordetella pertussis
ucuucgaucgccuggg

SEQ ID NO: 431822 - RNA, 18 nt, Bordetella pertussis
ucuucgaucgccuggggc

SEQ ID NO: 431823 - RNA, 13 nt, Bordetella pertussis
ucuucgaugauga

SEQ ID NO: 431824 - RNA, 21 nt, Bordetella pertussis
ucuucgccuggccggcuugca

SEQ ID NO: 431825 - RNA, 14 nt, Bordetella pertussis
ucuucguugucgcg

SEQ ID NO: 431826 - RNA, 15 nt, Bordetella pertussis
ucuucuggacgcuga

SEQ ID NO: 431827 - RNA, 13 nt, Bordetella pertussis
ucuucuucagcau

SEQ ID NO: 431828 - RNA, 13 nt, Bordetella pertussis
ucuucuuggccag

SEQ ID NO: 431829 - RNA, 14 nt, Bordetella pertussis
ucuucuuggccaga

SEQ ID NO: 431830 - RNA, 14 nt, Bordetella pertussis
ucuucuuugcccug

SEQ ID NO: 431831 - RNA, 15 nt, Bordetella pertussis
ucuugaacucggcca

SEQ ID NO: 431832 - RNA, 18 nt, Bordetella pertussis
ucuugaccugggccagca

SEQ ID NO: 431833 - RNA, 19 nt, Bordetella pertussis
ucuugaccugggccagcag

SEQ ID NO: 431834 - RNA, 19 nt, Bordetella pertussis
ucuugaugccgcccagcau

SEQ ID NO: 431835 - RNA, 16 nt, Bordetella pertussis
ucuugcccgccagcgc

SEQ ID NO: 431836 - RNA, 16 nt, Bordetella pertussis
ucuugccggccuguuc

SEQ ID NO: 431837 - RNA, 22 nt, Bordetella pertussis
ucuugcgugacccggggcagga

SEQ ID NO: 431838 - RNA, 19 nt, Bordetella pertussis
ucuuguaggcgauccaggc

SEQ ID NO: 431839 - RNA, 14 nt, Bordetella pertussis
ucuugucgcuggag

SEQ ID NO: 431840 - RNA, 16 nt, Bordetella pertussis
ucuuucaaagaucugc

SEQ ID NO: 431841 - RNA, 21 nt, Bordetella pertussis
ugaaucgcaugcgguuucuca

SEQ ID NO: 431842 - RNA, 14 nt, Bordetella pertussis
ugaaucgcccgggc

SEQ ID NO: 431843 - RNA, 16 nt, Bordetella pertussis
ugaauuccagccaggc

SEQ ID NO: 431844 - RNA, 16 nt, Bordetella pertussis
ugacauaggagaguuc

SEQ ID NO: 431845 - RNA, 13 nt, Bordetella pertussis
ugaccaccaggcc

SEQ ID NO: 431846 - RNA, 13 nt, Bordetella pertussis
ugaccacggccag

SEQ ID NO: 431847 - RNA, 23 nt, Bordetella pertussis
ugaccacggccagcagcacgauc

SEQ ID NO: 431848 - RNA, 15 nt, Bordetella pertussis
ugaccaugcgcaccg

SEQ ID NO: 431849 - RNA, 16 nt, Bordetella pertussis
ugacccauaccagccc

SEQ ID NO: 431850 - RNA, 13 nt, Bordetella pertussis
ugacccccgccgu

SEQ ID NO: 431851 - RNA, 16 nt, Bordetella pertussis
ugaccggcgcggccug

SEQ ID NO: 431852 - RNA, 18 nt, Bordetella pertussis
ugaccggcggcacggccg

SEQ ID NO: 431853 - RNA, 21 nt, Bordetella pertussis
ugaccggcggcgcucaucauc

SEQ ID NO: 431854 - RNA, 22 nt, Bordetella pertussis
ugaccggcggcgcucaucaucg

SEQ ID NO: 431855 - RNA, 18 nt, Bordetella pertussis
ugaccucgcgcugcagca

SEQ ID NO: 431856 - RNA, 15 nt, Bordetella pertussis
ugaccucgcgguugc

SEQ ID NO: 431857 - RNA, 18 nt, Bordetella pertussis
ugacgcuggagcgcggcg

SEQ ID NO: 431858 - RNA, 12 nt, Bordetella pertussis
ugacggccagga

SEQ ID NO: 431859 - RNA, 13 nt, Bordetella pertussis
ugacggcccagcu

SEQ ID NO: 431860 - RNA, 17 nt, Bordetella pertussis
ugacuugaccgcaugcu

SEQ ID NO: 431861 - RNA, 21 nt, Bordetella pertussis
ugagaaaagugaucaccgcca

SEQ ID NO: 431862 - RNA, 22 nt, Bordetella pertussis
ugagaaaagugaucaccgccau

SEQ ID NO: 431863 - RNA, 22 nt, Bordetella pertussis
ugagaaugcccaggaugcccuu

SEQ ID NO: 431864 - RNA, 20 nt, Bordetella pertussis
ugagcaccacguccuggggc

SEQ ID NO: 431865 - RNA, 15 nt, Bordetella pertussis
ugagcaccagcagcc

SEQ ID NO: 431866 - RNA, 21 nt, Bordetella pertussis
ugagccauuccggcuggucgg

SEQ ID NO: 431867 - RNA, 18 nt, Bordetella pertussis
ugagccccaagcgggaau

SEQ ID NO: 431868 - RNA, 23 nt, Bordetella pertussis
ugagccggcagaucggcgcuggc

SEQ ID NO: 431869 - RNA, 20 nt, Bordetella pertussis
ugagcgccggggcguggccg

SEQ ID NO: 431870 - RNA, 14 nt, Bordetella pertussis
ugagcgccggggcg

SEQ ID NO: 431871 - RNA, 14 nt, Bordetella pertussis
ugagcgcgccgccg

SEQ ID NO: 431872 - RNA, 13 nt, Bordetella pertussis
ugagcggcucgcc

SEQ ID NO: 431873 - RNA, 17 nt, Bordetella pertussis
ugagcuggcgcaggucc

SEQ ID NO: 431874 - RNA, 18 nt, Bordetella pertussis
ugaggauaucggccaggc

SEQ ID NO: 431875 - RNA, 17 nt, Bordetella pertussis
ugaggauuuccagcucg

SEQ ID NO: 431876 - RNA, 20 nt, Bordetella pertussis
ugaggccagggagugcgagg

SEQ ID NO: 431877 - RNA, 24 nt, Bordetella pertussis
ugaggcccgauggcggggauggag

SEQ ID NO: 431878 - RNA, 19 nt, Bordetella pertussis
ugaggccgaucucacgggc

SEQ ID NO: 431879 - RNA, 14 nt, Bordetella pertussis
ugaggccgcgcgcc

SEQ ID NO: 431880 - RNA, 18 nt, Bordetella pertussis
ugaggcgacgguggcugg

SEQ ID NO: 431881 - RNA, 14 nt, Bordetella pertussis
ugaggcggccgggc

SEQ ID NO: 431882 - RNA, 15 nt, Bordetella pertussis
ugaggcggccgggcg

SEQ ID NO: 431883 - RNA, 20 nt, Bordetella pertussis
ugaggcggcgguaccaggcc

SEQ ID NO: 431884 - RNA, 17 nt, Bordetella pertussis
ugagggcgcgggccagc

SEQ ID NO: 431885 - RNA, 14 nt, Bordetella pertussis
ugaggggccagccu

SEQ ID NO: 431886 - RNA, 14 nt, Bordetella pertussis
ugaucacgcgcucc

SEQ ID NO: 431887 - RNA, 14 nt, Bordetella pertussis
ugaucagcaggccc

SEQ ID NO: 431888 - RNA, 17 nt, Bordetella pertussis
ugaucagcaggcccacc

SEQ ID NO: 431889 - RNA, 14 nt, Bordetella pertussis
ugauccacugcagc

SEQ ID NO: 431890 - RNA, 12 nt, Bordetella pertussis
ugauccuggcuc

SEQ ID NO: 431891 - RNA, 12 nt, Bordetella pertussis
ugaugcaggccu

SEQ ID NO: 431892 - RNA, 18 nt, Bordetella pertussis
ugaugcgcgccgcucuug

SEQ ID NO: 431893 - RNA, 19 nt, Bordetella pertussis
ugaugcgcgccgcucuugg

SEQ ID NO: 431894 - RNA, 14 nt, Bordetella pertussis
ugaugcgcgcggcc

SEQ ID NO: 431895 - RNA, 14 nt, Bordetella pertussis
ugaugcgcugggcc

SEQ ID NO: 431896 - RNA, 20 nt, Bordetella pertussis
ugaugcggccguugcuccag

SEQ ID NO: 431897 - RNA, 22 nt, Bordetella pertussis
ugaugcggcgccacgcagaagg

SEQ ID NO: 431898 - RNA, 15 nt, Bordetella pertussis
ugaugcuggucagcc

SEQ ID NO: 431899 - RNA, 18 nt, Bordetella pertussis
ugauggaggccaggaucc

SEQ ID NO: 431900 - RNA, 15 nt, Bordetella pertussis
ugauggccaggucca

SEQ ID NO: 431901 - RNA, 17 nt, Bordetella pertussis
ugauggccauggccagc

SEQ ID NO: 431902 - RNA, 19 nt, Bordetella pertussis
ugauggccgccagcggcug

SEQ ID NO: 431903 - RNA, 20 nt, Bordetella pertussis
ugauggccgccagcggcugg

SEQ ID NO: 431904 - RNA, 22 nt, Bordetella pertussis
ugauggccgggccguggcgauc

SEQ ID NO: 431905 - RNA, 23 nt, Bordetella pertussis
ugauggccugcuuggcgcgcagc

SEQ ID NO: 431906 - RNA, 21 nt, Bordetella pertussis
ugauggcgauguccagcgagc

SEQ ID NO: 431907 - RNA, 14 nt, Bordetella pertussis
ugaugggcgcaucc

SEQ ID NO: 431908 - RNA, 16 nt, Bordetella pertussis
ugauggucggugccgc

SEQ ID NO: 431909 - RNA, 21 nt, Bordetella pertussis
ugauggugcugccgcugccca

SEQ ID NO: 431910 - RNA, 16 nt, Bordetella pertussis
ugaugguggggcuggc

SEQ ID NO: 431911 - RNA, 22 nt, Bordetella pertussis
ugaugucgcgcaccgccugcug

SEQ ID NO: 431912 - RNA, 16 nt, Bordetella pertussis
ugcaaggccugcugca

SEQ ID NO: 431913 - RNA, 15 nt, Bordetella pertussis
ugcaauacagugguu

SEQ ID NO: 431914 - RNA, 15 nt, Bordetella pertussis
ugcaaugcggccagg

SEQ ID NO: 431915 - RNA, 14 nt, Bordetella pertussis
ugcacgaccaggcc

SEQ ID NO: 431916 - RNA, 15 nt, Bordetella pertussis
ugcacgaccaggccg

SEQ ID NO: 431917 - RNA, 14 nt, Bordetella pertussis
ugcacgauauuggc

SEQ ID NO: 431918 - RNA, 17 nt, Bordetella pertussis
ugcacgauguugccgcc

SEQ ID NO: 431919 - RNA, 21 nt, Bordetella pertussis
ugcacgauguugccgccggcc

SEQ ID NO: 431920 - RNA, 21 nt, Bordetella pertussis
ugcacggccuugucgcgcccg

SEQ ID NO: 431921 - RNA, 19 nt, Bordetella pertussis
ugcacgggcgcugcccagg

SEQ ID NO: 431922 - RNA, 14 nt, Bordetella pertussis
ugcacggugccgcg

SEQ ID NO: 431923 - RNA, 21 nt, Bordetella pertussis
ugcacgugggcacgccggccu

SEQ ID NO: 431924 - RNA, 24 nt, Bordetella pertussis
ugcacguggaugaugcgcgagccg

SEQ ID NO: 431925 - RNA, 15 nt, Bordetella pertussis
ugcagaccagcaccg

SEQ ID NO: 431926 - RNA, 13 nt, Bordetella pertussis
ugcagagcaccac

SEQ ID NO: 431927 - RNA, 22 nt, Bordetella pertussis
ugcagaucaucggcgccaucaa

SEQ ID NO: 431928 - RNA, 11 nt, Bordetella pertussis
ugcagaucugc

SEQ ID NO: 431929 - RNA, 11 nt, Bordetella pertussis
ugcagauggcg

SEQ ID NO: 431930 - RNA, 13 nt, Bordetella pertussis
ugcagcaagccca

SEQ ID NO: 431931 - RNA, 18 nt, Bordetella pertussis
ugcagcaagcccaccggg

SEQ ID NO: 431932 - RNA, 22 nt, Bordetella pertussis
ugcagcacacggucagcaaccc

SEQ ID NO: 431933 - RNA, 16 nt, Bordetella pertussis
ugcagcacgcuggccu

SEQ ID NO: 431934 - RNA, 19 nt, Bordetella pertussis
ugcagcacggccacggccg

SEQ ID NO: 431935 - RNA, 10 nt, Bordetella pertussis
ugcagcagcg

SEQ ID NO: 431936 - RNA, 14 nt, Bordetella pertussis
ugcagcagcggcag

SEQ ID NO: 431937 - RNA, 16 nt, Bordetella pertussis
ugcagcagcguggccg

SEQ ID NO: 431938 - RNA, 19 nt, Bordetella pertussis
ugcagcagcguggccgcca

SEQ ID NO: 431939 - RNA, 19 nt, Bordetella pertussis
ugcagcaggcgcaccagcg

SEQ ID NO: 431940 - RNA, 21 nt, Bordetella pertussis
ugcagcaugaucuugccgacc

SEQ ID NO: 431941 - RNA, 13 nt, Bordetella pertussis
ugcagccacgccu

SEQ ID NO: 431942 - RNA, 21 nt, Bordetella pertussis
ugcagccagaucucgcguccg

SEQ ID NO: 431943 - RNA, 19 nt, Bordetella pertussis
ugcagccagauucccccgc

SEQ ID NO: 431944 - RNA, 15 nt, Bordetella pertussis
ugcagccagcggccg

SEQ ID NO: 431945 - RNA, 19 nt, Bordetella pertussis
ugcagccaguugggccagg

SEQ ID NO: 431946 - RNA, 22 nt, Bordetella pertussis
ugcagccaguugggccagggcc

SEQ ID NO: 431947 - RNA, 12 nt, Bordetella pertussis
ugcagcccagca

SEQ ID NO: 431948 - RNA, 16 nt, Bordetella pertussis
ugcagcccagcaccac

SEQ ID NO: 431949 - RNA, 12 nt, Bordetella pertussis
ugcagcccagcg

SEQ ID NO: 431950 - RNA, 18 nt, Bordetella pertussis
ugcagcgcacgguccagg

SEQ ID NO: 431951 - RNA, 16 nt, Bordetella pertussis
ugcagcgcgccaggcg

SEQ ID NO: 431952 - RNA, 17 nt, Bordetella pertussis
ugcagcgcgccaggcgc

SEQ ID NO: 431953 - RNA, 19 nt, Bordetella pertussis
ugcagcgcucaguagcucg

SEQ ID NO: 431954 - RNA, 20 nt, Bordetella pertussis
ugcagcgugauggggccggg

SEQ ID NO: 431955 - RNA, 22 nt, Bordetella pertussis
ugcagcgugauggggccgggcg

SEQ ID NO: 431956 - RNA, 18 nt, Bordetella pertussis
ugcagcuggauggccugc

SEQ ID NO: 431957 - RNA, 22 nt, Bordetella pertussis
ugcaggaaauacucgagccggc

SEQ ID NO: 431958 - RNA, 17 nt, Bordetella pertussis
ugcaggaucgcggccag

SEQ ID NO: 431959 - RNA, 20 nt, Bordetella pertussis
ugcaggauuuccucguccgu

SEQ ID NO: 431960 - RNA, 12 nt, Bordetella pertussis
ugcaggccaggc

SEQ ID NO: 431961 - RNA, 13 nt, Bordetella pertussis
ugcaggccaggcu

SEQ ID NO: 431962 - RNA, 16 nt, Bordetella pertussis
ugcaggccaggcucag

SEQ ID NO: 431963 - RNA, 18 nt, Bordetella pertussis
ugcaggccaugcucgucc

SEQ ID NO: 431964 - RNA, 12 nt, Bordetella pertussis
ugcaggcccagc

SEQ ID NO: 431965 - RNA, 23 nt, Bordetella pertussis
ugcaggccgccggccagcgcggc

SEQ ID NO: 431966 - RNA, 12 nt, Bordetella pertussis
ugcaggccgcga

SEQ ID NO: 431967 - RNA, 22 nt, Bordetella pertussis
ugcaggcgccuucggcgcggcg

SEQ ID NO: 431968 - RNA, 18 nt, Bordetella pertussis
ugcaggcgcggguaggca

SEQ ID NO: 431969 - RNA, 13 nt, Bordetella pertussis
ugcaggcgcugcg

SEQ ID NO: 431970 - RNA, 13 nt, Bordetella pertussis
ugcaggcggcgca

SEQ ID NO: 431971 - RNA, 22 nt, Bordetella pertussis
ugcaggcuggacccggagcugc

SEQ ID NO: 431972 - RNA, 22 nt, Bordetella pertussis
ugcagggcaugggcccgggcgc

SEQ ID NO: 431973 - RNA, 12 nt, Bordetella pertussis
ugcagggccagg

SEQ ID NO: 431974 - RNA, 21 nt, Bordetella pertussis
ugcagggcgucugcucgccgu

SEQ ID NO: 431975 - RNA, 15 nt, Bordetella pertussis
ugcagggucagggug

SEQ ID NO: 431976 - RNA, 19 nt, Bordetella pertussis
ugcagggugucggccaggg

SEQ ID NO: 431977 - RNA, 19 nt, Bordetella pertussis
ugcagguccggucgcgcgu

SEQ ID NO: 431978 - RNA, 15 nt, Bordetella pertussis
ugcaggucguugaac

SEQ ID NO: 431979 - RNA, 17 nt, Bordetella pertussis
ugcaggucuucgggcgu

SEQ ID NO: 431980 - RNA, 13 nt, Bordetella pertussis
ugcagguggccag

SEQ ID NO: 431981 - RNA, 14 nt, Bordetella pertussis
ugcaguacccagua

SEQ ID NO: 431982 - RNA, 13 nt, Bordetella pertussis
ugccaagauggcc

SEQ ID NO: 431983 - RNA, 14 nt, Bordetella pertussis
ugccaccagcgcgc

SEQ ID NO: 431984 - RNA, 15 nt, Bordetella pertussis
ugccacuauuuucag

SEQ ID NO: 431985 - RNA, 21 nt, Bordetella pertussis
ugccagcaggucgcgcacgcu

SEQ ID NO: 431986 - RNA, 15 nt, Bordetella pertussis
ugccagcggcgcagc

SEQ ID NO: 431987 - RNA, 16 nt, Bordetella pertussis
ugccagcggcgcagcc

SEQ ID NO: 431988 - RNA, 17 nt, Bordetella pertussis
ugccagcggcgcagccg

SEQ ID NO: 431989 - RNA, 20 nt, Bordetella pertussis
ugccagcggcgcagccggcc

SEQ ID NO: 431990 - RNA, 23 nt, Bordetella pertussis
ugccaggcgagcgccgcgcucca

SEQ ID NO: 431991 - RNA, 20 nt, Bordetella pertussis
ugccagucccccgcggggac

SEQ ID NO: 431992 - RNA, 21 nt, Bordetella pertussis
ugccagucccccgcggggaca

SEQ ID NO: 431993 - RNA, 14 nt, Bordetella pertussis
ugccagucccccug

SEQ ID NO: 431994 - RNA, 20 nt, Bordetella pertussis
ugccaguccccguucgggga

SEQ ID NO: 431995 - RNA, 20 nt, Bordetella pertussis
ugccaguccccugcggggac

SEQ ID NO: 431996 - RNA, 18 nt, Bordetella pertussis
ugccaguugccgccgccg

SEQ ID NO: 431997 - RNA, 15 nt, Bordetella pertussis
ugccauacagcaagg

SEQ ID NO: 431998 - RNA, 17 nt, Bordetella pertussis
ugccauaggccagcgcc

SEQ ID NO: 431999 - RNA, 13 nt, Bordetella pertussis
ugcccacagcacg

SEQ ID NO: 432000 - RNA, 23 nt, Bordetella pertussis
ugcccaccgccgcccgccaggcc

SEQ ID NO: 432001 - RNA, 16 nt, Bordetella pertussis
ugcccaccuuccugcu

SEQ ID NO: 432002 - RNA, 18 nt, Bordetella pertussis
ugcccacgcgcuccugcu

SEQ ID NO: 432003 - RNA, 18 nt, Bordetella pertussis
ugcccacgccuuccggcc

SEQ ID NO: 432004 - RNA, 16 nt, Bordetella pertussis
ugcccagcaccaggcc

SEQ ID NO: 432005 - RNA, 15 nt, Bordetella pertussis
ugcccagcaccgcca

SEQ ID NO: 432006 - RNA, 15 nt, Bordetella pertussis
ugcccagcagcuccu

SEQ ID NO: 432007 - RNA, 18 nt, Bordetella pertussis
ugcccagcgagcugguga

SEQ ID NO: 432008 - RNA, 23 nt, Bordetella pertussis
ugcccagcgagcuggugauggug

SEQ ID NO: 432009 - RNA, 15 nt, Bordetella pertussis
ugcccagcgccgccg

SEQ ID NO: 432010 - RNA, 15 nt, Bordetella pertussis
ugcccagcgccaggg

SEQ ID NO: 432011 - RNA, 18 nt, Bordetella pertussis
ugcccagcuggcaccgcg

SEQ ID NO: 432012 - RNA, 14 nt, Bordetella pertussis
ugcccaggcccagu

SEQ ID NO: 432013 - RNA, 20 nt, Bordetella pertussis
ugcccaggcccgccagggcc

SEQ ID NO: 432014 - RNA, 18 nt, Bordetella pertussis
ugcccaggccggcgcgcu

SEQ ID NO: 432015 - RNA, 17 nt, Bordetella pertussis
ugcccagggccgcgccg

SEQ ID NO: 432016 - RNA, 21 nt, Bordetella pertussis
ugcccaggucguugcgcgaag

SEQ ID NO: 432017 - RNA, 22 nt, Bordetella pertussis
ugcccagguugaaggccgcgau

SEQ ID NO: 432018 - RNA, 17 nt, Bordetella pertussis
ugcccaguucgcggccg

SEQ ID NO: 432019 - RNA, 21 nt, Bordetella pertussis
ugcccaguuucgcgaccacca

SEQ ID NO: 432020 - RNA, 21 nt, Bordetella pertussis
ugcccaugccgccaugcagcu

SEQ ID NO: 432021 - RNA, 18 nt, Bordetella pertussis
ugccccgauccgcgggcg

SEQ ID NO: 432022 - RNA, 18 nt, Bordetella pertussis
ugccccggccucgcggcg

SEQ ID NO: 432023 - RNA, 20 nt, Bordetella pertussis
ugccccugcggggacaggca

SEQ ID NO: 432024 - RNA, 21 nt, Bordetella pertussis
ugccccugcggggacaggcac

SEQ ID NO: 432025 - RNA, 15 nt, Bordetella pertussis
ugcccgcacgggccg

SEQ ID NO: 432026 - RNA, 19 nt, Bordetella pertussis
ugcccgcacgggccgacgg

SEQ ID NO: 432027 - RNA, 15 nt, Bordetella pertussis
ugcccgccagcgcgg

SEQ ID NO: 432028 - RNA, 23 nt, Bordetella pertussis
ugcccgcccgacgaggagccggc

SEQ ID NO: 432029 - RNA, 18 nt, Bordetella pertussis
ugcccgccggcacccggc

SEQ ID NO: 432030 - RNA, 23 nt, Bordetella pertussis
ugcccgggaucugcgagccuucg

SEQ ID NO: 432031 - RNA, 13 nt, Bordetella pertussis
ugcccgggcagca

SEQ ID NO: 432032 - RNA, 15 nt, Bordetella pertussis
ugcccgggcagcacc

SEQ ID NO: 432033 - RNA, 16 nt, Bordetella pertussis
ugcccgggcagcaccg

SEQ ID NO: 432034 - RNA, 18 nt, Bordetella pertussis
ugcccgggcagcaccgcu

SEQ ID NO: 432035 - RNA, 18 nt, Bordetella pertussis
ugcccgguucgugccggg

SEQ ID NO: 432036 - RNA, 17 nt, Bordetella pertussis
ugcccgguucugcggcg

SEQ ID NO: 432037 - RNA, 14 nt, Bordetella pertussis
ugcccguagcagau

SEQ ID NO: 432038 - RNA, 15 nt, Bordetella pertussis
ugcccuucgcggcug

SEQ ID NO: 432039 - RNA, 22 nt, Bordetella pertussis
ugcccuugaccgacgugcugcu

SEQ ID NO: 432040 - RNA, 23 nt, Bordetella pertussis
ugcccuugcucccaguucugcag

SEQ ID NO: 432041 - RNA, 16 nt, Bordetella pertussis
ugcccuugcuguacuc

SEQ ID NO: 432042 - RNA, 15 nt, Bordetella pertussis
ugccgaacucgcgcu

SEQ ID NO: 432043 - RNA, 21 nt, Bordetella pertussis
ugccgaacucgcgcucggcca

SEQ ID NO: 432044 - RNA, 20 nt, Bordetella pertussis
ugccgaagcgcgcgugcagg

SEQ ID NO: 432045 - RNA, 19 nt, Bordetella pertussis
ugccgaaucggccccugcc

SEQ ID NO: 432046 - RNA, 16 nt, Bordetella pertussis
ugccgaccuccaggcc

SEQ ID NO: 432047 - RNA, 20 nt, Bordetella pertussis
ugccgaccuccaggcccagg

SEQ ID NO: 432048 - RNA, 20 nt, Bordetella pertussis
ugccgacgaugccgccgccg

SEQ ID NO: 432049 - RNA, 12 nt, Bordetella pertussis
ugccgagcagau

SEQ ID NO: 432050 - RNA, 15 nt, Bordetella pertussis
ugccgaugcggcgca

SEQ ID NO: 432051 - RNA, 21 nt, Bordetella pertussis
ugccgauguuguuggccgcca

SEQ ID NO: 432052 - RNA, 19 nt, Bordetella pertussis
ugccgccaagggcgcgcca

SEQ ID NO: 432053 - RNA, 12 nt, Bordetella pertussis
ugccgccaggca

SEQ ID NO: 432054 - RNA, 17 nt, Bordetella pertussis
ugccgccaugcagcugg

SEQ ID NO: 432055 - RNA, 20 nt, Bordetella pertussis
ugccgcccaggagcaacugg

SEQ ID NO: 432056 - RNA, 22 nt, Bordetella pertussis
ugccgcccacgaucaccacgcc

SEQ ID NO: 432057 - RNA, 14 nt, Bordetella pertussis
ugccgccgcugccg

SEQ ID NO: 432058 - RNA, 18 nt, Bordetella pertussis
ugccgccgcugccggccg

SEQ ID NO: 432059 - RNA, 23 nt, Bordetella pertussis
ugccgccgcugccggccgaccgg

SEQ ID NO: 432060 - RNA, 17 nt, Bordetella pertussis
ugccgccggcgcggcug

SEQ ID NO: 432061 - RNA, 14 nt, Bordetella pertussis
ugccgccggcgcgu

SEQ ID NO: 432062 - RNA, 19 nt, Bordetella pertussis
ugccggaccugggcaucaa

SEQ ID NO: 432063 - RNA, 14 nt, Bordetella pertussis
ugccggagcagcag

SEQ ID NO: 432064 - RNA, 15 nt, Bordetella pertussis
ugccggagcagcagc

SEQ ID NO: 432065 - RNA, 16 nt, Bordetella pertussis
ugccggaucagcgccu

SEQ ID NO: 432066 - RNA, 14 nt, Bordetella pertussis
ugccggcgcgggcg

SEQ ID NO: 432067 - RNA, 19 nt, Bordetella pertussis
ugccggcgcgggcgcaggc

SEQ ID NO: 432068 - RNA, 20 nt, Bordetella pertussis
ugccggcgcgggcgcaggcg

SEQ ID NO: 432069 - RNA, 21 nt, Bordetella pertussis
ugccggcgcgggcgcaggcgu

SEQ ID NO: 432070 - RNA, 13 nt, Bordetella pertussis
ugccggcggccua

SEQ ID NO: 432071 - RNA, 22 nt, Bordetella pertussis
ugccggcguucuggucagccgu

SEQ ID NO: 432072 - RNA, 16 nt, Bordetella pertussis
ugccggcguuggccgg

SEQ ID NO: 432073 - RNA, 20 nt, Bordetella pertussis
ugccggcguuggccgggucg

SEQ ID NO: 432074 - RNA, 14 nt, Bordetella pertussis
ugccgggacaggca

SEQ ID NO: 432075 - RNA, 15 nt, Bordetella pertussis
ugccguagcccaggu

SEQ ID NO: 432076 - RNA, 19 nt, Bordetella pertussis
ugccguagcgcguggccag

SEQ ID NO: 432077 - RNA, 14 nt, Bordetella pertussis
ugccguaggugcgc

SEQ ID NO: 432078 - RNA, 19 nt, Bordetella pertussis
ugccguaggguucgccgcu

SEQ ID NO: 432079 - RNA, 20 nt, Bordetella pertussis
ugccguccacgccgcgcgcg

SEQ ID NO: 432080 - RNA, 16 nt, Bordetella pertussis
ugccguccggcaccuc

SEQ ID NO: 432081 - RNA, 14 nt, Bordetella pertussis
ugccguccugcugc

SEQ ID NO: 432082 - RNA, 20 nt, Bordetella pertussis
ugccgucgagaaugacggug

SEQ ID NO: 432083 - RNA, 16 nt, Bordetella pertussis
ugccgucgagcgcggc

SEQ ID NO: 432084 - RNA, 18 nt, Bordetella pertussis
ugccgucgagcgcggcca

SEQ ID NO: 432085 - RNA, 14 nt, Bordetella pertussis
ugccgucgccgccc

SEQ ID NO: 432086 - RNA, 16 nt, Bordetella pertussis
ugccgucgcgcaccac

SEQ ID NO: 432087 - RNA, 15 nt, Bordetella pertussis
ugccgucggccugga

SEQ ID NO: 432088 - RNA, 15 nt, Bordetella pertussis
ugccgugaggcagcc

SEQ ID NO: 432089 - RNA, 11 nt, Bordetella pertussis
ugccucagguc

SEQ ID NO: 432090 - RNA, 22 nt, Bordetella pertussis
ugccugacgugcgccacagcau

SEQ ID NO: 432091 - RNA, 17 nt, Bordetella pertussis
ugccugagcaccgccgc

SEQ ID NO: 432092 - RNA, 12 nt, Bordetella pertussis
ugccugccagcc

SEQ ID NO: 432093 - RNA, 13 nt, Bordetella pertussis
ugccugccggccg

SEQ ID NO: 432094 - RNA, 16 nt, Bordetella pertussis
ugccugccggccggcc

SEQ ID NO: 432095 - RNA, 14 nt, Bordetella pertussis
ugccuguucccgcc

SEQ ID NO: 432096 - RNA, 20 nt, Bordetella pertussis
ugccuguucccgccgggcca

SEQ ID NO: 432097 - RNA, 15 nt, Bordetella pertussis
ugccuugcgcggcca

SEQ ID NO: 432098 - RNA, 21 nt, Bordetella pertussis
ugccuuggggcggcccagcgg

SEQ ID NO: 432099 - RNA, 21 nt, Bordetella pertussis
ugccuuggggcggcccggcgg

SEQ ID NO: 432100 - RNA, 22 nt, Bordetella pertussis
ugccuugguggggucgaugcca

SEQ ID NO: 432101 - RNA, 19 nt, Bordetella pertussis
ugcgaaagcgcgucgagca

SEQ ID NO: 432102 - RNA, 15 nt, Bordetella pertussis
ugcgaaagcggccag

SEQ ID NO: 432103 - RNA, 20 nt, Bordetella pertussis
ugcgaacgcccggcccaggc

SEQ ID NO: 432104 - RNA, 21 nt, Bordetella pertussis
ugcgaaugccauacguccuuu

SEQ ID NO: 432105 - RNA, 19 nt, Bordetella pertussis
ugcgacagcagggccaggc

SEQ ID NO: 432106 - RNA, 20 nt, Bordetella pertussis
ugcgacagcagggccaggcc

SEQ ID NO: 432107 - RNA, 15 nt, Bordetella pertussis
ugcgaccgagccacg

SEQ ID NO: 432108 - RNA, 20 nt, Bordetella pertussis
ugcgacgcaugucagcgccu

SEQ ID NO: 432109 - RNA, 12 nt, Bordetella pertussis
ugcgacugcagg

SEQ ID NO: 432110 - RNA, 16 nt, Bordetella pertussis
ugcgagacgaaggcgc

SEQ ID NO: 432111 - RNA, 17 nt, Bordetella pertussis
ugcgagcacggcguggc

SEQ ID NO: 432112 - RNA, 19 nt, Bordetella pertussis
ugcgaggcgaacaggcaca

SEQ ID NO: 432113 - RNA, 21 nt, Bordetella pertussis
ugcgauagcgggccugcagca

SEQ ID NO: 432114 - RNA, 15 nt, Bordetella pertussis
ugcgcaagccggccg

SEQ ID NO: 432115 - RNA, 13 nt, Bordetella pertussis
ugcgcaccaggcc

SEQ ID NO: 432116 - RNA, 24 nt, Bordetella pertussis
ugcgcaccaggcgcucgcgcgcca

SEQ ID NO: 432117 - RNA, 16 nt, Bordetella pertussis
ugcgcaccggccaggg

SEQ ID NO: 432118 - RNA, 14 nt, Bordetella pertussis
ugcgcaccuugccc

SEQ ID NO: 432119 - RNA, 13 nt, Bordetella pertussis
ugcgcacgcgcgu

SEQ ID NO: 432120 - RNA, 20 nt, Bordetella pertussis
ugcgcacgcgcgugauggag

SEQ ID NO: 432121 - RNA, 22 nt, Bordetella pertussis
ugcgcacgcgcgugauggagac

SEQ ID NO: 432122 - RNA, 12 nt, Bordetella pertussis
ugcgcagcacca

SEQ ID NO: 432123 - RNA, 15 nt, Bordetella pertussis
ugcgcagcagcagcg

SEQ ID NO: 432124 - RNA, 16 nt, Bordetella pertussis
ugcgcagcaggcgcgu

SEQ ID NO: 432125 - RNA, 14 nt, Bordetella pertussis
ugcgcagcaggugg

SEQ ID NO: 432126 - RNA, 12 nt, Bordetella pertussis
ugcgcagcagcg

SEQ ID NO: 432127 - RNA, 17 nt, Bordetella pertussis
ugcgcagccgggcugcc

SEQ ID NO: 432128 - RNA, 23 nt, Bordetella pertussis
ugcgcagcgacucgaacaccggc

SEQ ID NO: 432129 - RNA, 23 nt, Bordetella pertussis
ugcgcagcgcgucggcgcggucg

SEQ ID NO: 432130 - RNA, 16 nt, Bordetella pertussis
ugcgcagcggcaggcg

SEQ ID NO: 432131 - RNA, 20 nt, Bordetella pertussis
ugcgcagcucguggcgcgcc

SEQ ID NO: 432132 - RNA, 20 nt, Bordetella pertussis
ugcgcaggcgcguggccacg

SEQ ID NO: 432133 - RNA, 18 nt, Bordetella pertussis
ugcgcaggucggccagga

SEQ ID NO: 432134 - RNA, 19 nt, Bordetella pertussis
ugcgcaucgaucagcgcgc

SEQ ID NO: 432135 - RNA, 17 nt, Bordetella pertussis
ugcgcaugcgccugucc

SEQ ID NO: 432136 - RNA, 14 nt, Bordetella pertussis
ugcgcauggccagc

SEQ ID NO: 432137 - RNA, 20 nt, Bordetella pertussis
ugcgccaacggugccagucc

SEQ ID NO: 432138 - RNA, 15 nt, Bordetella pertussis
ugcgcuggccggccg

SEQ ID NO: 432139 - RNA, 18 nt, Bordetella pertussis
ugcgcuggcgcgcggccg

SEQ ID NO: 432140 - RNA, 14 nt, Bordetella pertussis
ugcgcugggccagg

SEQ ID NO: 432141 - RNA, 18 nt, Bordetella pertussis
ugcgcuggucgcgcagca

SEQ ID NO: 432142 - RNA, 14 nt, Bordetella pertussis
ugcggcaccugcug

SEQ ID NO: 432143 - RNA, 15 nt, Bordetella pertussis
ugcggcaccugcugc

SEQ ID NO: 432144 - RNA, 16 nt, Bordetella pertussis
ugcggcaccugcugcu

SEQ ID NO: 432145 - RNA, 16 nt, Bordetella pertussis
ugcggcaccucggccg

SEQ ID NO: 432146 - RNA, 15 nt, Bordetella pertussis
ugcggcacggccagc

SEQ ID NO: 432147 - RNA, 13 nt, Bordetella pertussis
ugcggcacggcug

SEQ ID NO: 432148 - RNA, 16 nt, Bordetella pertussis
ugcggcagcagggcca

SEQ ID NO: 432149 - RNA, 19 nt, Bordetella pertussis
ugcggcagcagggccacgc

SEQ ID NO: 432150 - RNA, 19 nt, Bordetella pertussis
ugcggcggcgacucggcau

SEQ ID NO: 432151 - RNA, 12 nt, Bordetella pertussis
ugcggcugauca

SEQ ID NO: 432152 - RNA, 18 nt, Bordetella pertussis
ugcggcugaucaccgccg

SEQ ID NO: 432153 - RNA, 17 nt, Bordetella pertussis
ugcggcuugggcccggc

SEQ ID NO: 432154 - RNA, 19 nt, Bordetella pertussis
ugcggcuugggcccggcgu

SEQ ID NO: 432155 - RNA, 14 nt, Bordetella pertussis
ugcgggacggccag

SEQ ID NO: 432156 - RNA, 20 nt, Bordetella pertussis
ugcgggacggccaggggcag

SEQ ID NO: 432157 - RNA, 18 nt, Bordetella pertussis
ugcgggcaaacggcggca

SEQ ID NO: 432158 - RNA, 18 nt, Bordetella pertussis
ugcgggccacgccggccg

SEQ ID NO: 432159 - RNA, 16 nt, Bordetella pertussis
ugcgggucaaggcggg

SEQ ID NO: 432160 - RNA, 15 nt, Bordetella pertussis
ugcgggucaggccgc

SEQ ID NO: 432161 - RNA, 21 nt, Bordetella pertussis
ugcgggugcgccugcagcgcc

SEQ ID NO: 432162 - RNA, 13 nt, Bordetella pertussis
ugcgguaguucag

SEQ ID NO: 432163 - RNA, 14 nt, Bordetella pertussis
ugcguaccagccca

SEQ ID NO: 432164 - RNA, 17 nt, Bordetella pertussis
ugcgucaguugaagacg

SEQ ID NO: 432165 - RNA, 20 nt, Bordetella pertussis
ugcguccagccgagccuggc

SEQ ID NO: 432166 - RNA, 22 nt, Bordetella pertussis
ugcguccagccgagccuggcgu

SEQ ID NO: 432167 - RNA, 14 nt, Bordetella pertussis
ugcguccaggacgc

SEQ ID NO: 432168 - RNA, 20 nt, Bordetella pertussis
ugcguccgucggguugccgc

SEQ ID NO: 432169 - RNA, 19 nt, Bordetella pertussis
ugcgucgaacggccgggcg

SEQ ID NO: 432170 - RNA, 16 nt, Bordetella pertussis
ugcgucuccagcgcgg

SEQ ID NO: 432171 - RNA, 17 nt, Bordetella pertussis
ugcgucucggccuguuc

SEQ ID NO: 432172 - RNA, 17 nt, Bordetella pertussis
ugcguggcgggccgcgc

SEQ ID NO: 432173 - RNA, 15 nt, Bordetella pertussis
ugcgugugccugucc

SEQ ID NO: 432174 - RNA, 20 nt, Bordetella pertussis
ugcguuccaugacguccagc

SEQ ID NO: 432175 - RNA, 21 nt, Bordetella pertussis
ugcguuccaugacguccagcg

SEQ ID NO: 432176 - RNA, 15 nt, Bordetella pertussis
ugcguucgcccgugc

SEQ ID NO: 432177 - RNA, 17 nt, Bordetella pertussis
ugcguucgcccgugccg

SEQ ID NO: 432178 - RNA, 16 nt, Bordetella pertussis
ugcguuuucuggccuu

SEQ ID NO: 432179 - RNA, 15 nt, Bordetella pertussis
ugcucagcagcaccg

SEQ ID NO: 432180 - RNA, 14 nt, Bordetella pertussis
ugcuccagccaggc

SEQ ID NO: 432181 - RNA, 12 nt, Bordetella pertussis
ugcuccaggccg

SEQ ID NO: 432182 - RNA, 20 nt, Bordetella pertussis
ugcucgccucgaugaaggug

SEQ ID NO: 432183 - RNA, 20 nt, Bordetella pertussis
ugcucggcggucagcgcggc

SEQ ID NO: 432184 - RNA, 13 nt, Bordetella pertussis
ugcucgggcgccu

SEQ ID NO: 432185 - RNA, 19 nt, Bordetella pertussis
ugcucguucugcgcgcccg

SEQ ID NO: 432186 - RNA, 13 nt, Bordetella pertussis
ugcucuccaugcu

SEQ ID NO: 432187 - RNA, 15 nt, Bordetella pertussis
ugcucuccaugcuga

SEQ ID NO: 432188 - RNA, 17 nt, Bordetella pertussis
ugcucuggcacaccagc

SEQ ID NO: 432189 - RNA, 12 nt, Bordetella pertussis
ugcucuggcccg

SEQ ID NO: 432190 - RNA, 18 nt, Bordetella pertussis
ugcugaauugcgggccgg

SEQ ID NO: 432191 - RNA, 15 nt, Bordetella pertussis
ugcugacaggcgucu

SEQ ID NO: 432192 - RNA, 17 nt, Bordetella pertussis
ugcugaccaccgggaug

SEQ ID NO: 432193 - RNA, 20 nt, Bordetella pertussis
ugcugaccgacggccuggag

SEQ ID NO: 432194 - RNA, 22 nt, Bordetella pertussis
ugcugcgacagcagggccaggc

SEQ ID NO: 432195 - RNA, 23 nt, Bordetella pertussis
ugcugcgacagcagggccaggcc

SEQ ID NO: 432196 - RNA, 23 nt, Bordetella pertussis
ugcugcgcaagggagaccggguu

SEQ ID NO: 432197 - RNA, 13 nt, Bordetella pertussis
ugcugcgccgccu

SEQ ID NO: 432198 - RNA, 18 nt, Bordetella pertussis
ugcugcgccuggccgcgc

SEQ ID NO: 432199 - RNA, 19 nt, Bordetella pertussis
ugcuggaccgcgccugggg

SEQ ID NO: 432200 - RNA, 13 nt, Bordetella pertussis
ugcuggaccuggc

SEQ ID NO: 432201 - RNA, 15 nt, Bordetella pertussis
ugcuggaccuggcca

SEQ ID NO: 432202 - RNA, 10 nt, Bordetella pertussis
ugcuggaggu

SEQ ID NO: 432203 - RNA, 13 nt, Bordetella pertussis
ugcuggccgacgc

SEQ ID NO: 432204 - RNA, 23 nt, Bordetella pertussis
ugcugguacagccccagcgccag

SEQ ID NO: 432205 - RNA, 14 nt, Bordetella pertussis
ugcuggucagccug

SEQ ID NO: 432206 - RNA, 17 nt, Bordetella pertussis
ugcuggucagccugggc

SEQ ID NO: 432207 - RNA, 24 nt, Bordetella pertussis
ugcuggucaucuacagcgccuggc

SEQ ID NO: 432208 - RNA, 22 nt, Bordetella pertussis
ugcuggucgccaucugcugcga

SEQ ID NO: 432209 - RNA, 18 nt, Bordetella pertussis
ugcuggucgcgggccagg

SEQ ID NO: 432210 - RNA, 13 nt, Bordetella pertussis
ugcuggucggccu

SEQ ID NO: 432211 - RNA, 15 nt, Bordetella pertussis
ugcuggugcuggugc

SEQ ID NO: 432212 - RNA, 16 nt, Bordetella pertussis
ugcuggugcuggugcc

SEQ ID NO: 432213 - RNA, 16 nt, Bordetella pertussis
ugcuggugccgcuggc

SEQ ID NO: 432214 - RNA, 15 nt, Bordetella pertussis
ugcuggugugaauga

SEQ ID NO: 432215 - RNA, 14 nt, Bordetella pertussis
ugcuucaugcgcuc

SEQ ID NO: 432216 - RNA, 22 nt, Bordetella pertussis
ugcuucugguaguuggccaggg

SEQ ID NO: 432217 - RNA, 17 nt, Bordetella pertussis
ugcuuggcgcgcagcag

SEQ ID NO: 432218 - RNA, 14 nt, Bordetella pertussis
ugcuuguacaggcg

SEQ ID NO: 432219 - RNA, 17 nt, Bordetella pertussis
ugcuuugagcaggcgcu

SEQ ID NO: 432220 - RNA, 21 nt, Bordetella pertussis
uggaaaccgcgucgucgugca

SEQ ID NO: 432221 - RNA, 14 nt, Bordetella pertussis
uggaaagaccugcg

SEQ ID NO: 432222 - RNA, 17 nt, Bordetella pertussis
uggaacucguuggccag

SEQ ID NO: 432223 - RNA, 18 nt, Bordetella pertussis
uggaacucguuggccagc

SEQ ID NO: 432224 - RNA, 23 nt, Bordetella pertussis
uggaacuugggaucggccaggcc

SEQ ID NO: 432225 - RNA, 22 nt, Bordetella pertussis
uggaagauguaccagcccagcc

SEQ ID NO: 432226 - RNA, 14 nt, Bordetella pertussis
uggaagcuggccag

SEQ ID NO: 432227 - RNA, 18 nt, Bordetella pertussis
uggaagcuggccagcggu

SEQ ID NO: 432228 - RNA, 23 nt, Bordetella pertussis
uggaaucgucgaccagcagcacg

SEQ ID NO: 432229 - RNA, 12 nt, Bordetella pertussis
uggacaagaaag

SEQ ID NO: 432230 - RNA, 20 nt, Bordetella pertussis
uggacacgcccaugauggug

SEQ ID NO: 432231 - RNA, 14 nt, Bordetella pertussis
uggacagauccagc

SEQ ID NO: 432232 - RNA, 20 nt, Bordetella pertussis
uggacagauccagcgcggcc

SEQ ID NO: 432233 - RNA, 20 nt, Bordetella pertussis
uggacagcaguucggccggc

SEQ ID NO: 432234 - RNA, 18 nt, Bordetella pertussis
uggacagcgccagcccgc

SEQ ID NO: 432235 - RNA, 22 nt, Bordetella pertussis
uggacagcgccagcccgcugcc

SEQ ID NO: 432236 - RNA, 22 nt, Bordetella pertussis
uggacagcgcguuggcguugcc

SEQ ID NO: 432237 - RNA, 17 nt, Bordetella pertussis
uggacaggaacuccggc

SEQ ID NO: 432238 - RNA, 18 nt, Bordetella pertussis
uggacagugcccugaccc

SEQ ID NO: 432239 - RNA, 14 nt, Bordetella pertussis
uggaccugcuguuc

SEQ ID NO: 432240 - RNA, 16 nt, Bordetella pertussis
uggacgagggccgcgg

SEQ ID NO: 432241 - RNA, 15 nt, Bordetella pertussis
uggacgaugagcugg

SEQ ID NO: 432242 - RNA, 18 nt, Bordetella pertussis
uggacgccaagaccgcgg

SEQ ID NO: 432243 - RNA, 21 nt, Bordetella pertussis
uggacgccaagaccgcggccg

SEQ ID NO: 432244 - RNA, 13 nt, Bordetella pertussis
uggacgcccuggc

SEQ ID NO: 432245 - RNA, 21 nt, Bordetella pertussis
uggacgcccuggcgcaggccg

SEQ ID NO: 432246 - RNA, 20 nt, Bordetella pertussis
uggacgccgccggcccagga

SEQ ID NO: 432247 - RNA, 16 nt, Bordetella pertussis
uggacgcgcgcggcga

SEQ ID NO: 432248 - RNA, 17 nt, Bordetella pertussis
uggacggcgcuggggaa

SEQ ID NO: 432249 - RNA, 20 nt, Bordetella pertussis
uggacguaguugguggcagg

SEQ ID NO: 432250 - RNA, 15 nt, Bordetella pertussis
uggacuauggccugg

SEQ ID NO: 432251 - RNA, 17 nt, Bordetella pertussis
uggacuauggccuggau

SEQ ID NO: 432252 - RNA, 18 nt, Bordetella pertussis
uggacucgauggcgcagg

SEQ ID NO: 432253 - RNA, 16 nt, Bordetella pertussis
uggagaacgagccggc

SEQ ID NO: 432254 - RNA, 14 nt, Bordetella pertussis
uggagagggccugg

SEQ ID NO: 432255 - RNA, 20 nt, Bordetella pertussis
uggagauggguacagcgcgc

SEQ ID NO: 432256 - RNA, 23 nt, Bordetella pertussis
uggagccggagcagucgcgcagc

SEQ ID NO: 432257 - RNA, 17 nt, Bordetella pertussis
uggagcgcggcgcuggc

SEQ ID NO: 432258 - RNA, 20 nt, Bordetella pertussis
uggagcuggggccgcgcgcc

SEQ ID NO: 432259 - RNA, 14 nt, Bordetella pertussis
uggagcuuggccgg

SEQ ID NO: 432260 - RNA, 21 nt, Bordetella pertussis
uggaggccuuccaccagccgu

SEQ ID NO: 432261 - RNA, 17 nt, Bordetella pertussis
uggaggcgcagcgcggc

SEQ ID NO: 432262 - RNA, 23 nt, Bordetella pertussis
uggaggcgcauucgcgccugagc

SEQ ID NO: 432263 - RNA, 15 nt, Bordetella pertussis
uggaggggcgcaggc

SEQ ID NO: 432264 - RNA, 15 nt, Bordetella pertussis
uggaguaguggccca

SEQ ID NO: 432265 - RNA, 18 nt, Bordetella pertussis
uggaucgccgaucggcaa

SEQ ID NO: 432266 - RNA, 19 nt, Bordetella pertussis
uggaucggggggugcgagg

SEQ ID NO: 432267 - RNA, 14 nt, Bordetella pertussis
uggaucuuggccug

SEQ ID NO: 432268 - RNA, 15 nt, Bordetella pertussis
uggaugauggucugc

SEQ ID NO: 432269 - RNA, 20 nt, Bordetella pertussis
uggaugcguucgcggcccug

SEQ ID NO: 432270 - RNA, 15 nt, Bordetella pertussis
uggauggcucgggca

SEQ ID NO: 432271 - RNA, 18 nt, Bordetella pertussis
uggauggucacgcccagg

SEQ ID NO: 432272 - RNA, 16 nt, Bordetella pertussis
uggcaaggcccgccgc

SEQ ID NO: 432273 - RNA, 18 nt, Bordetella pertussis
uggcacagccgcagccgu

SEQ ID NO: 432274 - RNA, 13 nt, Bordetella pertussis
uggcacagcgcgg

SEQ ID NO: 432275 - RNA, 17 nt, Bordetella pertussis
uggcacaucagcgugcc

SEQ ID NO: 432276 - RNA, 20 nt, Bordetella pertussis
uggcaccggccgacccgcgg

SEQ ID NO: 432277 - RNA, 19 nt, Bordetella pertussis
uggcacgcuggaaacuaaa

SEQ ID NO: 432278 - RNA, 13 nt, Bordetella pertussis
uggcagccuuggu

SEQ ID NO: 432279 - RNA, 18 nt, Bordetella pertussis
uggcagccuuggucagcg

SEQ ID NO: 432280 - RNA, 23 nt, Bordetella pertussis
uggcagcgaccgcggcgguccug

SEQ ID NO: 432281 - RNA, 10 nt, Bordetella pertussis
uggcagcugg

SEQ ID NO: 432282 - RNA, 12 nt, Bordetella pertussis
uggcaggccagc

SEQ ID NO: 432283 - RNA, 22 nt, Bordetella pertussis
uggcaggcgucggccagcgcga

SEQ ID NO: 432284 - RNA, 12 nt, Bordetella pertussis
uggcaggcuggc

SEQ ID NO: 432285 - RNA, 16 nt, Bordetella pertussis
uggcaggugcggccgc

SEQ ID NO: 432286 - RNA, 22 nt, Bordetella pertussis
uggcaguacguacgcccggccg

SEQ ID NO: 432287 - RNA, 23 nt, Bordetella pertussis
uggcaucgucgcgcugcgacagc

SEQ ID NO: 432288 - RNA, 14 nt, Bordetella pertussis
uggcauggggcagg

SEQ ID NO: 432289 - RNA, 19 nt, Bordetella pertussis
uggccaauggccgcggcgu

SEQ ID NO: 432290 - RNA, 21 nt, Bordetella pertussis
uggccaccacgcccaucugcc

SEQ ID NO: 432291 - RNA, 13 nt, Bordetella pertussis
uggccacgaagac

SEQ ID NO: 432292 - RNA, 18 nt, Bordetella pertussis
uggccacgaccaccagcg

SEQ ID NO: 432293 - RNA, 18 nt, Bordetella pertussis
uggccacggcccuggucu

SEQ ID NO: 432294 - RNA, 19 nt, Bordetella pertussis
uggccacggcuugcuucag

SEQ ID NO: 432295 - RNA, 19 nt, Bordetella pertussis
uggccacguugucgcgcgu

SEQ ID NO: 432296 - RNA, 17 nt, Bordetella pertussis
uggccacugccuuacuc

SEQ ID NO: 432297 - RNA, 22 nt, Bordetella pertussis
uggccacuuccagcgccugcuc

SEQ ID NO: 432298 - RNA, 21 nt, Bordetella pertussis
uggccagcaagcgcucggcca

SEQ ID NO: 432299 - RNA, 12 nt, Bordetella pertussis
uggccagcagcg

SEQ ID NO: 432300 - RNA, 15 nt, Bordetella pertussis
uggccagcagcgcau

SEQ ID NO: 432301 - RNA, 21 nt, Bordetella pertussis
uggccagccaggcgguggccu

SEQ ID NO: 432302 - RNA, 14 nt, Bordetella pertussis
uggccagccggccc

SEQ ID NO: 432303 - RNA, 15 nt, Bordetella pertussis
uggccagcgccgcca

SEQ ID NO: 432304 - RNA, 14 nt, Bordetella pertussis
uggccagcuggcgc

SEQ ID NO: 432305 - RNA, 20 nt, Bordetella pertussis
uggccagcuccaccgggcug

SEQ ID NO: 432306 - RNA, 12 nt, Bordetella pertussis
uggccagggccg

SEQ ID NO: 432307 - RNA, 12 nt, Bordetella pertussis
uggccaggucca

SEQ ID NO: 432308 - RNA, 15 nt, Bordetella pertussis
uggccaugcugggcg

SEQ ID NO: 432309 - RNA, 23 nt, Bordetella pertussis
uggccaugcugggcgggcuggug

SEQ ID NO: 432310 - RNA, 12 nt, Bordetella pertussis
uggccauggaca

SEQ ID NO: 432311 - RNA, 18 nt, Bordetella pertussis
uggccauggacagcaccg

SEQ ID NO: 432312 - RNA, 20 nt, Bordetella pertussis
uggcccacucaugcgcugca

SEQ ID NO: 432313 - RNA, 13 nt, Bordetella pertussis
uggcccagaucug

SEQ ID NO: 432314 - RNA, 21 nt, Bordetella pertussis
uggcccagcuccagcuggcgc

SEQ ID NO: 432315 - RNA, 12 nt, Bordetella pertussis
uggccccgggcg

SEQ ID NO: 432316 - RNA, 16 nt, Bordetella pertussis
uggcccgauacaugau

SEQ ID NO: 432317 - RNA, 16 nt, Bordetella pertussis
uggcccgcaccgggcg

SEQ ID NO: 432318 - RNA, 17 nt, Bordetella pertussis
uggcccgccaccacggc

SEQ ID NO: 432319 - RNA, 19 nt, Bordetella pertussis
uggcccgccagcaaggcgg

SEQ ID NO: 432320 - RNA, 20 nt, Bordetella pertussis
uggcccgccucaaccuucuc

SEQ ID NO: 432321 - RNA, 16 nt, Bordetella pertussis
uggcccgcgccgcguc

SEQ ID NO: 432322 - RNA, 14 nt, Bordetella pertussis
uggcccggcucgcc

SEQ ID NO: 432323 - RNA, 16 nt, Bordetella pertussis
uggcccggcgggaaca

SEQ ID NO: 432324 - RNA, 17 nt, Bordetella pertussis
uggcccugcagcggcca

SEQ ID NO: 432325 - RNA, 12 nt, Bordetella pertussis
uggcccugcugg

SEQ ID NO: 432326 - RNA, 13 nt, Bordetella pertussis
uggcccuucuuca

SEQ ID NO: 432327 - RNA, 13 nt, Bordetella pertussis
uggcccuugccca

SEQ ID NO: 432328 - RNA, 21 nt, Bordetella pertussis
uggcccuugccgccuucccag

SEQ ID NO: 432329 - RNA, 22 nt, Bordetella pertussis
uggccgaaccauugcagggugu

SEQ ID NO: 432330 - RNA, 23 nt, Bordetella pertussis
uggccgacaugucgugcuggcug

SEQ ID NO: 432331 - RNA, 12 nt, Bordetella pertussis
uggccgaccagc

SEQ ID NO: 432332 - RNA, 14 nt, Bordetella pertussis
uggccgagcgcggc

SEQ ID NO: 432333 - RNA, 19 nt, Bordetella pertussis
uggccgaucugcugggccg

SEQ ID NO: 432334 - RNA, 21 nt, Bordetella pertussis
uggccgauuucgcgcgccagc

SEQ ID NO: 432335 - RNA, 21 nt, Bordetella pertussis
uggccgccagcggcuggcgcc

SEQ ID NO: 432336 - RNA, 13 nt, Bordetella pertussis
uggccgcccuggc

SEQ ID NO: 432337 - RNA, 22 nt, Bordetella pertussis
uggccgccgaacggcagcagcg

SEQ ID NO: 432338 - RNA, 15 nt, Bordetella pertussis
uggccgccgccacca

SEQ ID NO: 432339 - RNA, 16 nt, Bordetella pertussis
uggccgccgcgcgccg

SEQ ID NO: 432340 - RNA, 15 nt, Bordetella pertussis
uggccgccgcgggcg

SEQ ID NO: 432341 - RNA, 14 nt, Bordetella pertussis
uggccgccgggucg

SEQ ID NO: 432342 - RNA, 14 nt, Bordetella pertussis
uggccgccugcugc

SEQ ID NO: 432343 - RNA, 15 nt, Bordetella pertussis
uggccgccugcugcg

SEQ ID NO: 432344 - RNA, 16 nt, Bordetella pertussis
uggccgcgccgcuggc

SEQ ID NO: 432345 - RNA, 19 nt, Bordetella pertussis
uggccgcgccgcuggcggc

SEQ ID NO: 432346 - RNA, 21 nt, Bordetella pertussis
uggccgcgccgcuggcggccg

SEQ ID NO: 432347 - RNA, 17 nt, Bordetella pertussis
uggccgcgcgguacgca

SEQ ID NO: 432348 - RNA, 22 nt, Bordetella pertussis
uggccgcgcgguacgcaccgcc

SEQ ID NO: 432349 - RNA, 14 nt, Bordetella pertussis
uggccgcgcucagc

SEQ ID NO: 432350 - RNA, 18 nt, Bordetella pertussis
uggccgcgcucagccuug

SEQ ID NO: 432351 - RNA, 13 nt, Bordetella pertussis
uggccgcgcuggc

SEQ ID NO: 432352 - RNA, 17 nt, Bordetella pertussis
uggccgcggcccagcgc

SEQ ID NO: 432353 - RNA, 14 nt, Bordetella pertussis
uggccgcgcgcagc

SEQ ID NO: 432354 - RNA, 15 nt, Bordetella pertussis
uggccgcgcgccggc

SEQ ID NO: 432355 - RNA, 20 nt, Bordetella pertussis
uggccgcggcguccgcgccg

SEQ ID NO: 432356 - RNA, 22 nt, Bordetella pertussis
uggccgcguacaacgccgcguc

SEQ ID NO: 432357 - RNA, 19 nt, Bordetella pertussis
uggccggaucgagcgcggu

SEQ ID NO: 432358 - RNA, 12 nt, Bordetella pertussis
uggccggccagc

SEQ ID NO: 432359 - RNA, 18 nt, Bordetella pertussis
uggccggccgccgggccg

SEQ ID NO: 432360 - RNA, 19 nt, Bordetella pertussis
uggccggcgcgaaccccuc

SEQ ID NO: 432361 - RNA, 18 nt, Bordetella pertussis
uggccggcgcgcccuugc

SEQ ID NO: 432362 - RNA, 15 nt, Bordetella pertussis
uggccggcgcugggc

SEQ ID NO: 432363 - RNA, 22 nt, Bordetella pertussis
uggccggcgcugggcaggcugg

SEQ ID NO: 432364 - RNA, 21 nt, Bordetella pertussis
uggccggcguguucagcgcgc

SEQ ID NO: 432365 - RNA, 19 nt, Bordetella pertussis
uggccggcuugcauggugc

SEQ ID NO: 432366 - RNA, 19 nt, Bordetella pertussis
uggccgggguccugaggcc

SEQ ID NO: 432367 - RNA, 22 nt, Bordetella pertussis
uggccgggguccugaggccagg

SEQ ID NO: 432368 - RNA, 23 nt, Bordetella pertussis
uggccgggguccugaggccaggc

SEQ ID NO: 432369 - RNA, 19 nt, Bordetella pertussis
uggccggggaagccgccgg

SEQ ID NO: 432370 - RNA, 19 nt, Bordetella pertussis
uggccggugaugcggcgcg

SEQ ID NO: 432371 - RNA, 15 nt, Bordetella pertussis
uggccggugccaguc

SEQ ID NO: 432372 - RNA, 23 nt, Bordetella pertussis
uggccgguucgaugaccugggcc

SEQ ID NO: 432373 - RNA, 21 nt, Bordetella pertussis
uggccguagcguuggcggccg

SEQ ID NO: 432374 - RNA, 19 nt, Bordetella pertussis
uggccgucgccgcccugcu

SEQ ID NO: 432375 - RNA, 17 nt, Bordetella pertussis
uggccguggcgugcagg

SEQ ID NO: 432376 - RNA, 15 nt, Bordetella pertussis
uggccucgcccuggc

SEQ ID NO: 432377 - RNA, 16 nt, Bordetella pertussis
uggccucgcugccagg

SEQ ID NO: 432378 - RNA, 13 nt, Bordetella pertussis
uggccucggcaug

SEQ ID NO: 432379 - RNA, 14 nt, Bordetella pertussis
uggccucggcggcc

SEQ ID NO: 432380 - RNA, 14 nt, Bordetella pertussis
uggccugcaggaug

SEQ ID NO: 432381 - RNA, 18 nt, Bordetella pertussis
uggccugccauccggccg

SEQ ID NO: 432382 - RNA, 23 nt, Bordetella pertussis
uggccugcuuggcgcgcagcagc

SEQ ID NO: 432383 - RNA, 15 nt, Bordetella pertussis
uggccugggccagga

SEQ ID NO: 432384 - RNA, 18 nt, Bordetella pertussis
uggccuggccgccggcgg

SEQ ID NO: 432385 - RNA, 21 nt, Bordetella pertussis
uggccugguuggccgccuggc

SEQ ID NO: 432386 - RNA, 16 nt, Bordetella pertussis
uggccugucugguggc

SEQ ID NO: 432387 - RNA, 14 nt, Bordetella pertussis
uggccuuccugcug

SEQ ID NO: 432388 - RNA, 22 nt, Bordetella pertussis
uggccuugcccaggcugggcca

SEQ ID NO: 432389 - RNA, 16 nt, Bordetella pertussis
uggccuuggaguagcc

SEQ ID NO: 432390 - RNA, 20 nt, Bordetella pertussis
uggccuuggaguagccgcuc

SEQ ID NO: 432391 - RNA, 17 nt, Bordetella pertussis
uggccuuuuccaggcgu

SEQ ID NO: 432392 - RNA, 23 nt, Bordetella pertussis
uggcgaaaggcaccgagcacagc

SEQ ID NO: 432393 - RNA, 13 nt, Bordetella pertussis
uggcgaaggccgc

SEQ ID NO: 432394 - RNA, 22 nt, Bordetella pertussis
uggcgaaggcgucggccauggc

SEQ ID NO: 432395 - RNA, 19 nt, Bordetella pertussis
uggcgaggaccugaccauc

SEQ ID NO: 432396 - RNA, 15 nt, Bordetella pertussis
uggcgaucaguuccu

SEQ ID NO: 432397 - RNA, 22 nt, Bordetella pertussis
uggcgauccauguggccagcuc

SEQ ID NO: 432398 - RNA, 15 nt, Bordetella pertussis
uggcgaucucguccu

SEQ ID NO: 432399 - RNA, 17 nt, Bordetella pertussis
uggcgaugcccaccagc

SEQ ID NO: 432400 - RNA, 17 nt, Bordetella pertussis
uggcgaugcgggccacg

SEQ ID NO: 432401 - RNA, 18 nt, Bordetella pertussis
uggcgauguaggccaggu

SEQ ID NO: 432402 - RNA, 21 nt, Bordetella pertussis
uggcgcaaggcaugcgccagc

SEQ ID NO: 432403 - RNA, 19 nt, Bordetella pertussis
uggcgcagcauuucuucca

SEQ ID NO: 432404 - RNA, 18 nt, Bordetella pertussis
uggcgcaggcgcgccagg

SEQ ID NO: 432405 - RNA, 17 nt, Bordetella pertussis
uggcgcaggcgcgcgcc

SEQ ID NO: 432406 - RNA, 13 nt, Bordetella pertussis
uggcgccaugugc

SEQ ID NO: 432407 - RNA, 15 nt, Bordetella pertussis
uggcgcccacggccg

SEQ ID NO: 432408 - RNA, 17 nt, Bordetella pertussis
uggcgcccacggccgca

SEQ ID NO: 432409 - RNA, 12 nt, Bordetella pertussis
uggcgcccagcu

SEQ ID NO: 432410 - RNA, 15 nt, Bordetella pertussis
uggcgcccaucgcgg

SEQ ID NO: 432411 - RNA, 21 nt, Bordetella pertussis
uggcgcccgacggcgccgugc

SEQ ID NO: 432412 - RNA, 18 nt, Bordetella pertussis
uggcgcccgccugcgcca

SEQ ID NO: 432413 - RNA, 20 nt, Bordetella pertussis
uggcgccgauuucgccgccg

SEQ ID NO: 432414 - RNA, 22 nt, Bordetella pertussis
uggcgccgcgccgccgccuggc

SEQ ID NO: 432415 - RNA, 19 nt, Bordetella pertussis
uggcgccgcgggccuacuu

SEQ ID NO: 432416 - RNA, 14 nt, Bordetella pertussis
uggcgccggccacc

SEQ ID NO: 432417 - RNA, 18 nt, Bordetella pertussis
uggcgccggccaccgccu

SEQ ID NO: 432418 - RNA, 12 nt, Bordetella pertussis
uggcgccggccg

SEQ ID NO: 432419 - RNA, 23 nt, Bordetella pertussis
uggcgccggcuucgucauggucg

SEQ ID NO: 432420 - RNA, 15 nt, Bordetella pertussis
uggcgccgucgcgcu

SEQ ID NO: 432421 - RNA, 22 nt, Bordetella pertussis
uggcgccgugaaugcgccuggc

SEQ ID NO: 432422 - RNA, 22 nt, Bordetella pertussis
uggcgccguucgucgcgcagca

SEQ ID NO: 432423 - RNA, 23 nt, Bordetella pertussis
uggcgccggucugggcgcggaac

SEQ ID NO: 432424 - RNA, 17 nt, Bordetella pertussis
uggcggacgauggccug

SEQ ID NO: 432425 - RNA, 20 nt, Bordetella pertussis
uggcggacgauggccugugc

SEQ ID NO: 432426 - RNA, 13 nt, Bordetella pertussis
uggcggccacaac

SEQ ID NO: 432427 - RNA, 13 nt, Bordetella pertussis
uggcggccaggcc

SEQ ID NO: 432428 - RNA, 22 nt, Bordetella pertussis
uggcggcccauucgcccauggc

SEQ ID NO: 432429 - RNA, 23 nt, Bordetella pertussis
uggcggcccuguucgcgcggccc

SEQ ID NO: 432430 - RNA, 16 nt, Bordetella pertussis
uggcggccgacagcuu

SEQ ID NO: 432431 - RNA, 21 nt, Bordetella pertussis
uggcggccguuggcgugcagc

SEQ ID NO: 432432 - RNA, 20 nt, Bordetella pertussis
uggcggccuugcgggccggc

SEQ ID NO: 432433 - RNA, 23 nt, Bordetella pertussis
uggcggcgaacacgucgcgggcg

SEQ ID NO: 432434 - RNA, 17 nt, Bordetella pertussis
uggcuuucuaucaucag

SEQ ID NO: 432435 - RNA, 19 nt, Bordetella pertussis
ugggaaacagcgaaagcac

SEQ ID NO: 432436 - RNA, 15 nt, Bordetella pertussis
ugggaucggccaggc

SEQ ID NO: 432437 - RNA, 21 nt, Bordetella pertussis
ugggcaaccgccacgugcugc

SEQ ID NO: 432438 - RNA, 22 nt, Bordetella pertussis
ugggcacacaccauaucuggca

SEQ ID NO: 432439 - RNA, 19 nt, Bordetella pertussis
ugggcacauacagcggagc

SEQ ID NO: 432440 - RNA, 20 nt, Bordetella pertussis
ugggcaccgugaugcgcgcc

SEQ ID NO: 432441 - RNA, 19 nt, Bordetella pertussis
ugggcaccucggggugcag

SEQ ID NO: 432442 - RNA, 20 nt, Bordetella pertussis
ugggcaccucggggugcagc

SEQ ID NO: 432443 - RNA, 14 nt, Bordetella pertussis
ugggcacgcgcgcg

SEQ ID NO: 432444 - RNA, 21 nt, Bordetella pertussis
ugggcaguucgcccggcucca

SEQ ID NO: 432445 - RNA, 15 nt, Bordetella pertussis
ugggcauagcgcgcc

SEQ ID NO: 432446 - RNA, 16 nt, Bordetella pertussis
ugggcaggugcuuggc

SEQ ID NO: 432447 - RNA, 14 nt, Bordetella pertussis
ugggccgagcgcgc

SEQ ID NO: 432448 - RNA, 18 nt, Bordetella pertussis
ugggccgagcgcgccagc

SEQ ID NO: 432449 - RNA, 17 nt, Bordetella pertussis
ugggccgcgccugcagg

SEQ ID NO: 432450 - RNA, 15 nt, Bordetella pertussis
ugggccguccggccg

SEQ ID NO: 432451 - RNA, 21 nt, Bordetella pertussis
ugggccguccggccgugccgc

SEQ ID NO: 432452 - RNA, 19 nt, Bordetella pertussis
ugggcgaggcgcuggccgg

SEQ ID NO: 432453 - RNA, 18 nt, Bordetella pertussis
uggggcaggacgccggcg

SEQ ID NO: 432454 - RNA, 13 nt, Bordetella pertussis
uggggcaggaucc

SEQ ID NO: 432455 - RNA, 20 nt, Bordetella pertussis
uggggcaggcacuggcgcgg

SEQ ID NO: 432456 - RNA, 19 nt, Bordetella pertussis
uggggcaggcgcagcggcg

SEQ ID NO: 432457 - RNA, 22 nt, Bordetella pertussis
uggggcaggcggcuuucauggg

SEQ ID NO: 432458 - RNA, 13 nt, Bordetella pertussis
uggggcagcaggc

SEQ ID NO: 432459 - RNA, 16 nt, Bordetella pertussis
uggggcagccauccuc

SEQ ID NO: 432460 - RNA, 23 nt, Bordetella pertussis
uggggcgcucgaaaaagcccugc

SEQ ID NO: 432461 - RNA, 16 nt, Bordetella pertussis
uggggcgggcgcugcg

SEQ ID NO: 432462 - RNA, 20 nt, Bordetella pertussis
ugggucaggucgcugcccag

SEQ ID NO: 432463 - RNA, 14 nt, Bordetella pertussis
ugggucauggaaaa

SEQ ID NO: 432464 - RNA, 15 nt, Bordetella pertussis
ugggucauggaaaau

SEQ ID NO: 432465 - RNA, 16 nt, Bordetella pertussis
ugggugacgcuggagc

SEQ ID NO: 432466 - RNA, 17 nt, Bordetella pertussis
ugggugacgcuggagcg

SEQ ID NO: 432467 - RNA, 15 nt, Bordetella pertussis
uggguggccagcgcc

SEQ ID NO: 432468 - RNA, 22 nt, Bordetella pertussis
uggguggccagcgccgccagcc

SEQ ID NO: 432469 - RNA, 23 nt, Bordetella pertussis
uggguucgaaucccaccaucucc

SEQ ID NO: 432470 - RNA, 14 nt, Bordetella pertussis
uggguuggccuugc

SEQ ID NO: 432471 - RNA, 15 nt, Bordetella pertussis
ugguaguuggccagg

SEQ ID NO: 432472 - RNA, 14 nt, Bordetella pertussis
ugguaucccucgcc

SEQ ID NO: 432473 - RNA, 20 nt, Bordetella pertussis
ugguaucgcgccagcgccgc

SEQ ID NO: 432474 - RNA, 23 nt, Bordetella pertussis
ugguaucgcgccagcgccgcgcg

SEQ ID NO: 432475 - RNA, 22 nt, Bordetella pertussis
uggucacgcccaggcgcuggua

SEQ ID NO: 432476 - RNA, 20 nt, Bordetella pertussis
uggucagcaucagcagaccc

SEQ ID NO: 432477 - RNA, 14 nt, Bordetella pertussis
uggucagggcugca

SEQ ID NO: 432478 - RNA, 14 nt, Bordetella pertussis
ugguccgccgccgc

SEQ ID NO: 432479 - RNA, 13 nt, Bordetella pertussis
ugguccgugaagc

SEQ ID NO: 432480 - RNA, 17 nt, Bordetella pertussis
uggucgagagccugggc

SEQ ID NO: 432481 - RNA, 14 nt, Bordetella pertussis
uggucgcaguccca

SEQ ID NO: 432482 - RNA, 16 nt, Bordetella pertussis
uggucgucagcgccgc

SEQ ID NO: 432483 - RNA, 22 nt, Bordetella pertussis
uggucgucgcgaaacccuccca

SEQ ID NO: 432484 - RNA, 14 nt, Bordetella pertussis
ugguggccuugcug

SEQ ID NO: 432485 - RNA, 21 nt, Bordetella pertussis
ugguggcgcagaugggcggcg

SEQ ID NO: 432486 - RNA, 15 nt, Bordetella pertussis
uggugucggcggcga

SEQ ID NO: 432487 - RNA, 13 nt, Bordetella pertussis
uggugugccuguc

SEQ ID NO: 432488 - RNA, 17 nt, Bordetella pertussis
uguaccagcccagcccg

SEQ ID NO: 432489 - RNA, 22 nt, Bordetella pertussis
uguaccccauaguccucuacug

SEQ ID NO: 432490 - RNA, 23 nt, Bordetella pertussis
uguaccccauaguccucuacugg

SEQ ID NO: 432491 - RNA, 16 nt, Bordetella pertussis
uguaccgggccgacgc

SEQ ID NO: 432492 - RNA, 16 nt, Bordetella pertussis
uguacucggccaggcc

SEQ ID NO: 432493 - RNA, 15 nt, Bordetella pertussis
uguagaccaccagca

SEQ ID NO: 432494 - RNA, 17 nt, Bordetella pertussis
uguaggcgauccaggcc

SEQ ID NO: 432495 - RNA, 14 nt, Bordetella pertussis
uguaggucagcgcc

SEQ ID NO: 432496 - RNA, 18 nt, Bordetella pertussis
uguagugguguagccagg

SEQ ID NO: 432497 - RNA, 15 nt, Bordetella pertussis
uguaguucacccagg

SEQ ID NO: 432498 - RNA, 23 nt, Bordetella pertussis
uguauaacguggcgcgcaccugg

SEQ ID NO: 432499 - RNA, 21 nt, Bordetella pertussis
uguaucguugucgcgccgcga

SEQ ID NO: 432500 - RNA, 15 nt, Bordetella pertussis
ugugacggaccuugu

SEQ ID NO: 432501 - RNA, 20 nt, Bordetella pertussis
ugugcaggacgaacaggccg

SEQ ID NO: 432502 - RNA, 14 nt, Bordetella pertussis
ugugcaugcgcgcc

SEQ ID NO: 432503 - RNA, 18 nt, Bordetella pertussis
ugugccugucccagcggg

SEQ ID NO: 432504 - RNA, 15 nt, Bordetella pertussis
ugugccuguccccgc

SEQ ID NO: 432505 - RNA, 21 nt, Bordetella pertussis
ugugcgagagcuccagccggg

SEQ ID NO: 432506 - RNA, 23 nt, Bordetella pertussis
ugugcgccgcgccguacagggcc

SEQ ID NO: 432507 - RNA, 14 nt, Bordetella pertussis
ugugcgccggggcg

SEQ ID NO: 432508 - RNA, 13 nt, Bordetella pertussis
uguggccguggcg

SEQ ID NO: 432509 - RNA, 17 nt, Bordetella pertussis
ugugggggacaggcacg

SEQ ID NO: 432510 - RNA, 15 nt, Bordetella pertussis
ugugggggcgcggcg

SEQ ID NO: 432511 - RNA, 15 nt, Bordetella pertussis
uguggggggucaggc

SEQ ID NO: 432512 - RNA, 17 nt, Bordetella pertussis
uguggggggucaggccg

SEQ ID NO: 432513 - RNA, 21 nt, Bordetella pertussis
uguucacgcgcaagccgcugg

SEQ ID NO: 432514 - RNA, 18 nt, Bordetella pertussis
uguucagaaaccugaccu

SEQ ID NO: 432515 - RNA, 17 nt, Bordetella pertussis
uguucaggccaugcugg

SEQ ID NO: 432516 - RNA, 23 nt, Bordetella pertussis
uguuccacgaggucuugccgauc

SEQ ID NO: 432517 - RNA, 15 nt, Bordetella pertussis
uguucgacgcggccg

SEQ ID NO: 432518 - RNA, 14 nt, Bordetella pertussis
uguucuccaacugg

SEQ ID NO: 432519 - RNA, 15 nt, Bordetella pertussis
uguugcucgugcugg

SEQ ID NO: 432520 - RNA, 16 nt, Bordetella pertussis
uguugcucuugaccug

SEQ ID NO: 432521 - RNA, 18 nt, Bordetella pertussis
uguuggcgccggccgcgc

SEQ ID NO: 432522 - RNA, 14 nt, Bordetella pertussis
uguuggcgugcagg

SEQ ID NO: 432523 - RNA, 14 nt, Bordetella pertussis
uguuguccuggaca

SEQ ID NO: 432524 - RNA, 18 nt, Bordetella pertussis
uguuuccgggccuggccu

SEQ ID NO: 432525 - RNA, 11 nt, Bordetella pertussis
uuaccagcaac

SEQ ID NO: 432526 - RNA, 13 nt, Bordetella pertussis
uucggcgccgccg

SEQ ID NO: 432527 - RNA, 23 nt, Bordetella pertussis
uucggcgcgugcggaugcagcag

SEQ ID NO: 432528 - RNA, 19 nt, Bordetella pertussis
uucggcggccugcuuggca

SEQ ID NO: 432529 - RNA, 16 nt, Bordetella pertussis
uucggcggugaugucg

SEQ ID NO: 432530 - RNA, 11 nt, Bordetella pertussis
uucgggcaugu

SEQ ID NO: 432531 - RNA, 20 nt, Bordetella pertussis
uucgggcggcaggugcgcca

SEQ ID NO: 432532 - RNA, 12 nt, Bordetella pertussis
uucggggcagcg

SEQ ID NO: 432533 - RNA, 14 nt, Bordetella pertussis
uucggguugcaaau

SEQ ID NO: 432534 - RNA, 23 nt, Bordetella pertussis
uucgucagggccgcagcaccuug

SEQ ID NO: 432535 - RNA, 21 nt, Bordetella pertussis
uucucaaggccgaauugccgc

SEQ ID NO: 432536 - RNA, 13 nt, Bordetella pertussis
uucuccagcgcca

SEQ ID NO: 432537 - RNA, 18 nt, Bordetella pertussis
uucugcagcgugcggaca

SEQ ID NO: 432538 - RNA, 14 nt, Bordetella pertussis
uucuucuuggccag

SEQ ID NO: 432539 - RNA, 19 nt, Bordetella pertussis
uucuuguugcucuugaccu

SEQ ID NO: 432540 - RNA, 20 nt, Bordetella pertussis
uugaacagccgccccagcag

SEQ ID NO: 432541 - RNA, 21 nt, Bordetella pertussis
uugaaggcgaugggcaccugc

SEQ ID NO: 432542 - RNA, 19 nt, Bordetella pertussis
uugaccacggccagcagca

SEQ ID NO: 432543 - RNA, 15 nt, Bordetella pertussis
uugagaugccagcgg

SEQ ID NO: 432544 - RNA, 16 nt, Bordetella pertussis
uugagcaaucaagggc

SEQ ID NO: 432545 - RNA, 22 nt, Bordetella pertussis
uugagcaccacguccuggggcg

SEQ ID NO: 432546 - RNA, 16 nt, Bordetella pertussis
uugagcagcaugugcu

SEQ ID NO: 432547 - RNA, 23 nt, Bordetella pertussis
uugaugcgggucaaggcggggcu

SEQ ID NO: 432548 - RNA, 14 nt, Bordetella pertussis
uugauggccagcgc

SEQ ID NO: 432549 - RNA, 13 nt, Bordetella pertussis
uugauggccucgg

SEQ ID NO: 432550 - RNA, 23 nt, Bordetella pertussis
uugauggcgauggcuuggcgcuu

SEQ ID NO: 432551 - RNA, 24 nt, Bordetella pertussis
uugcaccgcgucggccugccagcc

SEQ ID NO: 432552 - RNA, 22 nt, Bordetella pertussis
uugcaugcgccgcaccagcggc

SEQ ID NO: 432553 - RNA, 23 nt, Bordetella pertussis
uugcaugcgccgcaccagcggcg

SEQ ID NO: 432554 - RNA, 14 nt, Bordetella pertussis
uugccaagauggcc

SEQ ID NO: 432555 - RNA, 22 nt, Bordetella pertussis
uugccccagcacgaagggcagc

SEQ ID NO: 432556 - RNA, 23 nt, Bordetella pertussis
uugccccagcacgaagggcagca

SEQ ID NO: 432557 - RNA, 19 nt, Bordetella pertussis
uugcccgagcgcgacagca

SEQ ID NO: 432558 - RNA, 17 nt, Bordetella pertussis
uugcccgccccgugcac

SEQ ID NO: 432559 - RNA, 12 nt, Bordetella pertussis
uugcccgucagc

SEQ ID NO: 432560 - RNA, 18 nt, Bordetella pertussis
uugccgaggucgcccuug

SEQ ID NO: 432561 - RNA, 12 nt, Bordetella pertussis
uugccgccgccc

SEQ ID NO: 432562 - RNA, 20 nt, Bordetella pertussis
uugccgccgggcaugcacca

SEQ ID NO: 432563 - RNA, 21 nt, Bordetella pertussis
uugccgcgaggcgcaggccga

SEQ ID NO: 432564 - RNA, 21 nt, Bordetella pertussis
uugccgcgcggcgcguucagc

SEQ ID NO: 432565 - RNA, 16 nt, Bordetella pertussis
uugcgacgccgccgau

SEQ ID NO: 432566 - RNA, 20 nt, Bordetella pertussis
uugcgccccgccaugcgcag

SEQ ID NO: 432567 - RNA, 20 nt, Bordetella pertussis
uugcgccgcaacgccgccgg

SEQ ID NO: 432568 - RNA, 13 nt, Bordetella pertussis
uugcgcgacagca

SEQ ID NO: 432569 - RNA, 15 nt, Bordetella pertussis
uugcgcgccaguuca

SEQ ID NO: 432570 - RNA, 15 nt, Bordetella pertussis
uugcgcggccagggc

SEQ ID NO: 432571 - RNA, 15 nt, Bordetella pertussis
uugcgcguccaggcc

SEQ ID NO: 432572 - RNA, 15 nt, Bordetella pertussis
uugcugaaccugcug

SEQ ID NO: 432573 - RNA, 16 nt, Bordetella pertussis
uugcugaaccugcugg

SEQ ID NO: 432574 - RNA, 23 nt, Bordetella pertussis
uugcugaaccugcuggccgccgg

SEQ ID NO: 432575 - RNA, 13 nt, Bordetella pertussis
uuggccagcgccg

SEQ ID NO: 432576 - RNA, 13 nt, Bordetella pertussis
uuggcgcacgccg

SEQ ID NO: 432577 - RNA, 16 nt, Bordetella pertussis
uuggcgcgcagcagcg

SEQ ID NO: 432578 - RNA, 20 nt, Bordetella pertussis
uuggcgcgccuugcgcggcg

SEQ ID NO: 432579 - RNA, 14 nt, Bordetella pertussis
uuggcgcugcugcu

SEQ ID NO: 432580 - RNA, 19 nt, Bordetella pertussis
uuggcguagauccaggcgg

SEQ ID NO: 432581 - RNA, 21 nt, Bordetella pertussis
uuggcguagccggugcgcagc

SEQ ID NO: 432582 - RNA, 22 nt, Bordetella pertussis
uuggcguagccggugcgcagca

SEQ ID NO: 432583 - RNA, 13 nt, Bordetella pertussis
uuggcgugcagcc

SEQ ID NO: 432584 - RNA, 16 nt, Bordetella pertussis
uuggcgugcaggcugg

SEQ ID NO: 432585 - RNA, 18 nt, Bordetella pertussis
uugggcaccaccaccgcc

SEQ ID NO: 432586 - RNA, 20 nt, Bordetella pertussis
uugguggggucgaugccagu

SEQ ID NO: 432587 - RNA, 19 nt, Bordetella pertussis
uuguaccccauaguccucu

SEQ ID NO: 432588 - RNA, 13 nt, Bordetella pertussis
uuguccagcggca

SEQ ID NO: 432589 - RNA, 13 nt, Bordetella pertussis
uuguccaggccga

SEQ ID NO: 432590 - RNA, 22 nt, Bordetella pertussis
uugucgucgggaccgaacacca

SEQ ID NO: 432591 - RNA, 17 nt, Bordetella pertussis
uugucguugauggggcc

SEQ ID NO: 432592 - RNA, 19 nt, Bordetella pertussis
uugugcaugacggccagga

SEQ ID NO: 432593 - RNA, 14 nt, Bordetella pertussis
uuucaaagaucugc

SEQ ID NO: 432594 - RNA, 15 nt, Bordetella pertussis
uuucaggaugccgcc

SEQ ID NO: 432595 - RNA, 12 nt, Bordetella pertussis
uuuccacagcca

SEQ ID NO: 432596 - RNA, 13 nt, Bordetella pertussis
uuuccaucagcuc

SEQ ID NO: 432597 - RNA, 19 nt, Bordetella pertussis
uuucccucggugcugcugu

SEQ ID NO: 432598 - RNA, 22 nt, Bordetella pertussis
uuuccgccgagaaauccagcgc

SEQ ID NO: 432599 - RNA, 16 nt, Bordetella pertussis
uuuccgggccuggccu

SEQ ID NO: 432600 - RNA, 17 nt, Bordetella pertussis
uuuccgggccuggccug

SEQ ID NO: 432601 - RNA, 16 nt, Bordetella pertussis
uuucgcgcguugccuu

SEQ ID NO: 432602 - RNA, 13 nt, Bordetella pertussis
uuucgcuggccau

SEQ ID NO: 432603 - RNA, 17 nt, Bordetella pertussis
uuucggccgggaaggcg

SEQ ID NO: 432604 - RNA, 18 nt, Bordetella pertussis
uuucgucaccgaacuguc

SEQ ID NO: 432605 - RNA, 13 nt, Bordetella pertussis
uuucgucgagcuc

SEQ ID NO: 432606 - RNA, 23 nt, Bordetella pertussis
uuucuacgccgaauugcuggagc

SEQ ID NO: 432607 - RNA, 15 nt, Bordetella pertussis
uuucucgcucuuggc

SEQ ID NO: 432608 - RNA, 15 nt, Bordetella pertussis
uuugcccuggccacg

SEQ ID NO: 432609 - RNA, 17 nt, Bordetella pertussis
uuugcgcaguggcgagg

SEQ ID NO: 432610 - RNA, 11 nt, Bordetella pertussis
uuuggcaggcu

SEQ ID NO: 432611 - RNA, 23 nt, Bordetella pertussis
uuuggcgcacgccgggcgcggcc

SEQ ID NO: 432612 - RNA, 15 nt, Bordetella pertussis
uuugguagcaggcgc

SEQ ID NO: 432613 - RNA, 22 nt, Bordetella pertussis
uuuuugccuuggggcggcccag

SEQ ID NO: 432614 - RNA, 18 nt, Bordetella pertussis
uuuuugggaaggccgcgc

SEQ ID NO: 432615 - RNA, 12 nt, Bordetella pertussis
aaaaaaagaggc

SEQ ID NO: 432616 - RNA, 21 nt, Bordetella pertussis
aaacgcugcgcgaugcgcgcg

SEQ ID NO: 432617 - RNA, 13 nt, Bordetella pertussis
aaacggcggcagg

SEQ ID NO: 432618 - RNA, 21 nt, Bordetella pertussis
aaacugcacuugcgaacggcc

SEQ ID NO: 432619 - RNA, 20 nt, Bordetella pertussis
aaacuuccccgcgugccugu

SEQ ID NO: 432620 - RNA, 16 nt, Bordetella pertussis
aaagcccgcgccacca

SEQ ID NO: 432621 - RNA, 22 nt, Bordetella pertussis
aaagggcgcggauguggggguu

SEQ ID NO: 432622 - RNA, 13 nt, Bordetella pertussis
aaauacgcuggcu

SEQ ID NO: 432623 - RNA, 13 nt, Bordetella pertussis
aaauagccaugcg

SEQ ID NO: 432624 - RNA, 17 nt, Bordetella pertussis
aaauaggaucccggcgc

SEQ ID NO: 432625 - RNA, 15 nt, Bordetella pertussis
aaaucgccgccggcg

SEQ ID NO: 432626 - RNA, 15 nt, Bordetella pertussis
aaauucugcaaaagu

SEQ ID NO: 432627 - RNA, 23 nt, Bordetella pertussis
aacaccccggucagcagggcgcc

SEQ ID NO: 432628 - RNA, 15 nt, Bordetella pertussis
aacacgaccagcagg

SEQ ID NO: 432629 - RNA, 20 nt, Bordetella pertussis
aacacgcgcgccgcgggcug

SEQ ID NO: 432630 - RNA, 12 nt, Bordetella pertussis
aacacguccagc

SEQ ID NO: 432631 - RNA, 16 nt, Bordetella pertussis
aacagcaccagcaugc

SEQ ID NO: 432632 - RNA, 20 nt, Bordetella pertussis
aacagcaucagcggcagcac

SEQ ID NO: 432633 - RNA, 16 nt, Bordetella pertussis
aacagccgccccagca

SEQ ID NO: 432634 - RNA, 14 nt, Bordetella pertussis
aacagcgccaggcu

SEQ ID NO: 432635 - RNA, 17 nt, Bordetella pertussis
aaccacgaacacgauga

SEQ ID NO: 432636 - RNA, 17 nt, Bordetella pertussis
aacccacccccagcagc

SEQ ID NO: 432637 - RNA, 19 nt, Bordetella pertussis
aacccacccccagcagcau

SEQ ID NO: 432638 - RNA, 19 nt, Bordetella pertussis
aacccguuccccaucaucu

SEQ ID NO: 432639 - RNA, 17 nt, Bordetella pertussis
aacccugccuccaggcg

SEQ ID NO: 432640 - RNA, 22 nt, Bordetella pertussis
aaccgcagaagcagccgcgcgg

SEQ ID NO: 432641 - RNA, 11 nt, Bordetella pertussis
aaccgccgcuu

SEQ ID NO: 432642 - RNA, 22 nt, Bordetella pertussis
aaccgcgacgcauauccaggcg

SEQ ID NO: 432643 - RNA, 22 nt, Bordetella pertussis
aaccggcaagccuugcggcuug

SEQ ID NO: 432644 - RNA, 19 nt, Bordetella pertussis
aaccggcgcgcgcggccag

SEQ ID NO: 432645 - RNA, 17 nt, Bordetella pertussis
aaccgggacaggcaccu

SEQ ID NO: 432646 - RNA, 22 nt, Bordetella pertussis
aacgauucuuuccuggccggcg

SEQ ID NO: 432647 - RNA, 12 nt, Bordetella pertussis
aacgccagcagc

SEQ ID NO: 432648 - RNA, 16 nt, Bordetella pertussis
aacgcccggcccaggc

SEQ ID NO: 432649 - RNA, 12 nt, Bordetella pertussis
aacgccgcccgu

SEQ ID NO: 432650 - RNA, 16 nt, Bordetella pertussis
aacgccggccauggcg

SEQ ID NO: 432651 - RNA, 23 nt, Bordetella pertussis
aacgccggccauggcggccggcg

SEQ ID NO: 432652 - RNA, 13 nt, Bordetella pertussis
aacgccggcggca

SEQ ID NO: 432653 - RNA, 21 nt, Bordetella pertussis
aacgccgggccgcgccgccua

SEQ ID NO: 432654 - RNA, 17 nt, Bordetella pertussis
aacgccucgggcuugag

SEQ ID NO: 432655 - RNA, 21 nt, Bordetella pertussis
aacgcugaugcgcgucaggcg

SEQ ID NO: 432656 - RNA, 16 nt, Bordetella pertussis
aacgcuuccugggccu

SEQ ID NO: 432657 - RNA, 17 nt, Bordetella pertussis
aacggggguugccagau

SEQ ID NO: 432658 - RNA, 11 nt, Bordetella pertussis
aacgugcaggc

SEQ ID NO: 432659 - RNA, 21 nt, Bordetella pertussis
aacuggccgacgauggccgga

SEQ ID NO: 432660 - RNA, 18 nt, Bordetella pertussis
aacuggccggccuggcgc

SEQ ID NO: 432661 - RNA, 17 nt, Bordetella pertussis
aacuggcgggugcugca

SEQ ID NO: 432662 - RNA, 13 nt, Bordetella pertussis
aacugggacaggc

SEQ ID NO: 432663 - RNA, 23 nt, Bordetella pertussis
aacugggccaaccacgagcugca

SEQ ID NO: 432664 - RNA, 19 nt, Bordetella pertussis
aagaacaccguuuccaagc

SEQ ID NO: 432665 - RNA, 23 nt, Bordetella pertussis
aagaagccgggcucgcugaccua

SEQ ID NO: 432666 - RNA, 15 nt, Bordetella pertussis
aagauguaccagccc

SEQ ID NO: 432667 - RNA, 18 nt, Bordetella pertussis
aagauguaccagcccagc

SEQ ID NO: 432668 - RNA, 14 nt, Bordetella pertussis
aagcacaagcgcgu

SEQ ID NO: 432669 - RNA, 16 nt, Bordetella pertussis
aagcacagaugcacca

SEQ ID NO: 432670 - RNA, 14 nt, Bordetella pertussis
aagcacgaacaggu

SEQ ID NO: 432671 - RNA, 17 nt, Bordetella pertussis
aagcacgaacagguuga

SEQ ID NO: 432672 - RNA, 20 nt, Bordetella pertussis
aagcagccggaaacggaaac

SEQ ID NO: 432673 - RNA, 18 nt, Bordetella pertussis
aagcagggcauguugcgc

SEQ ID NO: 432674 - RNA, 13 nt, Bordetella pertussis
aagccaagcaggg

SEQ ID NO: 432675 - RNA, 21 nt, Bordetella pertussis
aagcccguggcgggaggaagg

SEQ ID NO: 432676 - RNA, 21 nt, Bordetella pertussis
aagccgauccgcgacgcccug

SEQ ID NO: 432677 - RNA, 23 nt, Bordetella pertussis
aagccgcacgcccgccugcagca

SEQ ID NO: 432678 - RNA, 12 nt, Bordetella pertussis
aagccgccggcg

SEQ ID NO: 432679 - RNA, 16 nt, Bordetella pertussis
aagcgcgugucccagc

SEQ ID NO: 432680 - RNA, 15 nt, Bordetella pertussis
aagcgcucgccggcg

SEQ ID NO: 432681 - RNA, 17 nt, Bordetella pertussis
aagcgcucgcgcaggcg

SEQ ID NO: 432682 - RNA, 18 nt, Bordetella pertussis
aagcgcuucugccagacg

SEQ ID NO: 432683 - RNA, 13 nt, Bordetella pertussis
aagcugacgaaac

SEQ ID NO: 432684 - RNA, 11 nt, Bordetella pertussis
aagcugcggcc

SEQ ID NO: 432685 - RNA, 21 nt, Bordetella pertussis
aagcugcuggcgcgccaggcg

SEQ ID NO: 432686 - RNA, 22 nt, Bordetella pertussis
aaggagacaucaugcagaaaca

SEQ ID NO: 432687 - RNA, 18 nt, Bordetella pertussis
aaggauuucaccuaccuc

SEQ ID NO: 432688 - RNA, 13 nt, Bordetella pertussis
aaggcaagcagcg

SEQ ID NO: 432689 - RNA, 23 nt, Bordetella pertussis
aaggcgaaaccggugaucagcag

SEQ ID NO: 432690 - RNA, 22 nt, Bordetella pertussis
aaggcgaucugcggcguggcgu

SEQ ID NO: 432691 - RNA, 18 nt, Bordetella pertussis
aaggcgcccgggcugccg

SEQ ID NO: 432692 - RNA, 21 nt, Bordetella pertussis
aaggcgccgacggcgcccugc

SEQ ID NO: 432693 - RNA, 16 nt, Bordetella pertussis
aaggcgccggccaggc

SEQ ID NO: 432694 - RNA, 17 nt, Bordetella pertussis
aaggcgccggccaggcc

SEQ ID NO: 432695 - RNA, 22 nt, Bordetella pertussis
aaggcggcccggccgccgccgg

SEQ ID NO: 432696 - RNA, 16 nt, Bordetella pertussis
aaggcggccggcaggc

SEQ ID NO: 432697 - RNA, 17 nt, Bordetella pertussis
aaggcgggugucccagc

SEQ ID NO: 432698 - RNA, 21 nt, Bordetella pertussis
aaggguugcaguucgccggcg

SEQ ID NO: 432699 - RNA, 14 nt, Bordetella pertussis
aagguagccgauga

SEQ ID NO: 432700 - RNA, 16 nt, Bordetella pertussis
aagguccacggcaugg

SEQ ID NO: 432701 - RNA, 19 nt, Bordetella pertussis
aaggugaaauagccaugcg

SEQ ID NO: 432702 - RNA, 17 nt, Bordetella pertussis
aaggugcgcagcaggug

SEQ ID NO: 432703 - RNA, 17 nt, Bordetella pertussis
aagguuucguagccgcc

SEQ ID NO: 432704 - RNA, 16 nt, Bordetella pertussis
aaguaaucgcccggcg

SEQ ID NO: 432705 - RNA, 20 nt, Bordetella pertussis
aagugaucaccgccauggcg

SEQ ID NO: 432706 - RNA, 14 nt, Bordetella pertussis
aauacgucagagcc

SEQ ID NO: 432707 - RNA, 14 nt, Bordetella pertussis
aauacuuguccgcc

SEQ ID NO: 432708 - RNA, 16 nt, Bordetella pertussis
aauccacuugcggguc

SEQ ID NO: 432709 - RNA, 18 nt, Bordetella pertussis
aauccgcgaagugccugu

SEQ ID NO: 432710 - RNA, 19 nt, Bordetella pertussis
aauccggggugccuguccu

SEQ ID NO: 432711 - RNA, 14 nt, Bordetella pertussis
aaucgaugaugugg

SEQ ID NO: 432712 - RNA, 17 nt, Bordetella pertussis
aaucugcgucgccuggu

SEQ ID NO: 432713 - RNA, 14 nt, Bordetella pertussis
aaucuugccaggcc

SEQ ID NO: 432714 - RNA, 20 nt, Bordetella pertussis
aaugcacgggcgcugcccag

SEQ ID NO: 432715 - RNA, 13 nt, Bordetella pertussis
aaugccaggguga

SEQ ID NO: 432716 - RNA, 14 nt, Bordetella pertussis
aaugcggccaggcc

SEQ ID NO: 432717 - RNA, 17 nt, Bordetella pertussis
aauguauuuggcggcuu

SEQ ID NO: 432718 - RNA, 22 nt, Bordetella pertussis
aaugucccacaggcgcgcggcg

SEQ ID NO: 432719 - RNA, 18 nt, Bordetella pertussis
aaugucgagcgcgaugcc

SEQ ID NO: 432720 - RNA, 17 nt, Bordetella pertussis
aaugucguugcacagca

SEQ ID NO: 432721 - RNA, 19 nt, Bordetella pertussis
aauucauccggaaacuggc

SEQ ID NO: 432722 - RNA, 17 nt, Bordetella pertussis
aauuccaguugcgcgcc

SEQ ID NO: 432723 - RNA, 14 nt, Bordetella pertussis
aauugccgccgcug

SEQ ID NO: 432724 - RNA, 19 nt, Bordetella pertussis
aauugcuugccugucccca

SEQ ID NO: 432725 - RNA, 21 nt, Bordetella pertussis
aauugcuugccuguccccacu

SEQ ID NO: 432726 - RNA, 18 nt, Bordetella pertussis
aauuggcggcgaucucgc

SEQ ID NO: 432727 - RNA, 12 nt, Bordetella pertussis
acaaccuggcgc

SEQ ID NO: 432728 - RNA, 17 nt, Bordetella pertussis
acaagcgcacgcugggc

SEQ ID NO: 432729 - RNA, 16 nt, Bordetella pertussis
acaaggauggacuggc

SEQ ID NO: 432730 - RNA, 20 nt, Bordetella pertussis
acaaggcggccgcgcccgca

SEQ ID NO: 432731 - RNA, 19 nt, Bordetella pertussis
acaagguccaggcccggca

SEQ ID NO: 432732 - RNA, 13 nt, Bordetella pertussis
acaccgcaggugc

SEQ ID NO: 432733 - RNA, 21 nt, Bordetella pertussis
acaccggcgugcagagcacca

SEQ ID NO: 432734 - RNA, 15 nt, Bordetella pertussis
acaccggcuuggccu

SEQ ID NO: 432735 - RNA, 13 nt, Bordetella pertussis
acaccgugcuggc

SEQ ID NO: 432736 - RNA, 20 nt, Bordetella pertussis
acaccguucccggugccagu

SEQ ID NO: 432737 - RNA, 22 nt, Bordetella pertussis
acaccguucccggugccagucc

SEQ ID NO: 432738 - RNA, 19 nt, Bordetella pertussis
acaccguuuuggcaggcug

SEQ ID NO: 432739 - RNA, 20 nt, Bordetella pertussis
acacgaggaccgcgaugcug

SEQ ID NO: 432740 - RNA, 13 nt, Bordetella pertussis
acacgaccagcag

SEQ ID NO: 432741 - RNA, 14 nt, Bordetella pertussis
acacgcccagcagg

SEQ ID NO: 432742 - RNA, 15 nt, Bordetella pertussis
acacgcccagcaggc

SEQ ID NO: 432743 - RNA, 18 nt, Bordetella pertussis
acacggccgccaccuggg

SEQ ID NO: 432744 - RNA, 17 nt, Bordetella pertussis
acacggcgcgggcgguc

SEQ ID NO: 432745 - RNA, 13 nt, Bordetella pertussis
acacgguggcggu

SEQ ID NO: 432746 - RNA, 21 nt, Bordetella pertussis
acacggucaaccacgccaagg

SEQ ID NO: 432747 - RNA, 19 nt, Bordetella pertussis
acacggucagcaaccccag

SEQ ID NO: 432748 - RNA, 14 nt, Bordetella pertussis
acacguacaaccgc

SEQ ID NO: 432749 - RNA, 18 nt, Bordetella pertussis
acacguccagcgccgcgc

SEQ ID NO: 432750 - RNA, 15 nt, Bordetella pertussis
acagcagcggcucga

SEQ ID NO: 432751 - RNA, 21 nt, Bordetella pertussis
acagcagcggcucgagcggca

SEQ ID NO: 432752 - RNA, 14 nt, Bordetella pertussis
acagcagggccagg

SEQ ID NO: 432753 - RNA, 16 nt, Bordetella pertussis
acagccaggccagcgc

SEQ ID NO: 432754 - RNA, 14 nt, Bordetella pertussis
acagccgccccagc

SEQ ID NO: 432755 - RNA, 18 nt, Bordetella pertussis
acagccgcgccagcgccu

SEQ ID NO: 432756 - RNA, 20 nt, Bordetella pertussis
acagccgcgccagcgccucc

SEQ ID NO: 432757 - RNA, 18 nt, Bordetella pertussis
acagccuuuccuccugcc

SEQ ID NO: 432758 - RNA, 20 nt, Bordetella pertussis
acagcgacaacagcuugccc

SEQ ID NO: 432759 - RNA, 14 nt, Bordetella pertussis
acagcgacagccag

SEQ ID NO: 432760 - RNA, 15 nt, Bordetella pertussis
acagcgacagccagg

SEQ ID NO: 432761 - RNA, 13 nt, Bordetella pertussis
acagcgccaggcu

SEQ ID NO: 432762 - RNA, 16 nt, Bordetella pertussis
acagcgccaggcucca

SEQ ID NO: 432763 - RNA, 16 nt, Bordetella pertussis
acagcgcccccagcac

SEQ ID NO: 432764 - RNA, 20 nt, Bordetella pertussis
acagcuugcgcuggcgcgcg

SEQ ID NO: 432765 - RNA, 22 nt, Bordetella pertussis
acagcuugggcauuucccagcc

SEQ ID NO: 432766 - RNA, 20 nt, Bordetella pertussis
acaggccguuguccuggcgc

SEQ ID NO: 432767 - RNA, 22 nt, Bordetella pertussis
acaggccuggcuuggcggccag

SEQ ID NO: 432768 - RNA, 19 nt, Bordetella pertussis
acaggcgcgccagccgcgc

SEQ ID NO: 432769 - RNA, 18 nt, Bordetella pertussis
acaggcgucugcuacacc

SEQ ID NO: 432770 - RNA, 18 nt, Bordetella pertussis
acaggcucacgccuaccu

SEQ ID NO: 432771 - RNA, 15 nt, Bordetella pertussis
acaggcugcugugcc

SEQ ID NO: 432772 - RNA, 21 nt, Bordetella pertussis
acagggccgcgagcaugcgca

SEQ ID NO: 432773 - RNA, 22 nt, Bordetella pertussis
acagggucaaggcgcggccguc

SEQ ID NO: 432774 - RNA, 18 nt, Bordetella pertussis
acagggugccuguccccg

SEQ ID NO: 432775 - RNA, 21 nt, Bordetella pertussis
acaggucggcgcccacgccga

SEQ ID NO: 432776 - RNA, 13 nt, Bordetella pertussis
acaggugcugggu

SEQ ID NO: 432777 - RNA, 21 nt, Bordetella pertussis
acaguucggccagcggcaggc

SEQ ID NO: 432778 - RNA, 19 nt, Bordetella pertussis
acaguuugucggcgaucuu

SEQ ID NO: 432779 - RNA, 15 nt, Bordetella pertussis
acaucauccccagcg

SEQ ID NO: 432780 - RNA, 16 nt, Bordetella pertussis
acaucauccccagcgc

SEQ ID NO: 432781 - RNA, 13 nt, Bordetella pertussis
acauccuggaugu

SEQ ID NO: 432782 - RNA, 12 nt, Bordetella pertussis
acaucgccgcug

SEQ ID NO: 432783 - RNA, 20 nt, Bordetella pertussis
acaucggcagcgaggcgcgg

SEQ ID NO: 432784 - RNA, 20 nt, Bordetella pertussis
acaugacguucuccagcgcc

SEQ ID NO: 432785 - RNA, 16 nt, Bordetella pertussis
acaugcccggccacca

SEQ ID NO: 432786 - RNA, 18 nt, Bordetella pertussis
acaugcucgaugccggcc

SEQ ID NO: 432787 - RNA, 13 nt, Bordetella pertussis
accagcaccagcg

SEQ ID NO: 432788 - RNA, 12 nt, Bordetella pertussis
accagcaccggc

SEQ ID NO: 432789 - RNA, 19 nt, Bordetella pertussis
accagcacgagauguccau

SEQ ID NO: 432790 - RNA, 16 nt, Bordetella pertussis
accagcagccccagcg

SEQ ID NO: 432791 - RNA, 15 nt, Bordetella pertussis
accagcagcgccagg

SEQ ID NO: 432792 - RNA, 17 nt, Bordetella pertussis
accagcaggauggaucc

SEQ ID NO: 432793 - RNA, 13 nt, Bordetella pertussis
accagcauccuca

SEQ ID NO: 432794 - RNA, 19 nt, Bordetella pertussis
accagcauccucacguggc

SEQ ID NO: 432795 - RNA, 13 nt, Bordetella pertussis
accagcccagccc

SEQ ID NO: 432796 - RNA, 16 nt, Bordetella pertussis
accagcccggccgcca

SEQ ID NO: 432797 - RNA, 17 nt, Bordetella pertussis
accagcccggcgcgaca

SEQ ID NO: 432798 - RNA, 24 nt, Bordetella pertussis
accagcgaggcggcaagcggcgug

SEQ ID NO: 432799 - RNA, 19 nt, Bordetella pertussis
accagcgcaccaccagcac

SEQ ID NO: 432800 - RNA, 15 nt, Bordetella pertussis
accagcgccacgccg

SEQ ID NO: 432801 - RNA, 17 nt, Bordetella pertussis
accagcgccaggaacag

SEQ ID NO: 432802 - RNA, 13 nt, Bordetella pertussis
accagcgccugcc

SEQ ID NO: 432803 - RNA, 14 nt, Bordetella pertussis
accagcgccugccg

SEQ ID NO: 432804 - RNA, 19 nt, Bordetella pertussis
accagcgcgaacgccugcc

SEQ ID NO: 432805 - RNA, 17 nt, Bordetella pertussis
accagcgcgccagcaga

SEQ ID NO: 432806 - RNA, 14 nt, Bordetella pertussis
accagcgcgcgccg

SEQ ID NO: 432807 - RNA, 22 nt, Bordetella pertussis
accagcgcggccgucaccgccg

SEQ ID NO: 432808 - RNA, 22 nt, Bordetella pertussis
accagcggcguggcggccaggc

SEQ ID NO: 432809 - RNA, 23 nt, Bordetella pertussis
accagcggcguggcggccaggcc

SEQ ID NO: 432810 - RNA, 18 nt, Bordetella pertussis
accagcgucaccagcagg

SEQ ID NO: 432811 - RNA, 15 nt, Bordetella pertussis
accagcucagcuugg

SEQ ID NO: 432812 - RNA, 13 nt, Bordetella pertussis
accagcugcacca

SEQ ID NO: 432813 - RNA, 15 nt, Bordetella pertussis
accagcugcaccagg

SEQ ID NO: 432814 - RNA, 13 nt, Bordetella pertussis
accagcuuggccu

SEQ ID NO: 432815 - RNA, 18 nt, Bordetella pertussis
accaggaacgccagcagc

SEQ ID NO: 432816 - RNA, 14 nt, Bordetella pertussis
accaggaagcgcgc

SEQ ID NO: 432817 - RNA, 23 nt, Bordetella pertussis
accaggcccacgacgaacaacac

SEQ ID NO: 432818 - RNA, 13 nt, Bordetella pertussis
accaggcccauga

SEQ ID NO: 432819 - RNA, 20 nt, Bordetella pertussis
accaggcccaugaaggcggc

SEQ ID NO: 432820 - RNA, 23 nt, Bordetella pertussis
accaggcccaugaaggcggccag

SEQ ID NO: 432821 - RNA, 23 nt, Bordetella pertussis
accaggccgagaugugcggcgug

SEQ ID NO: 432822 - RNA, 13 nt, Bordetella pertussis
accaggccgccag

SEQ ID NO: 432823 - RNA, 15 nt, Bordetella pertussis
accaggccggccagg

SEQ ID NO: 432824 - RNA, 22 nt, Bordetella pertussis
accaggccugcgggugcgccug

SEQ ID NO: 432825 - RNA, 14 nt, Bordetella pertussis
accaggcuccggcu

SEQ ID NO: 432826 - RNA, 15 nt, Bordetella pertussis
accaggcugcgcgcc

SEQ ID NO: 432827 - RNA, 21 nt, Bordetella pertussis
accaggcuuucgaagccgccc

SEQ ID NO: 432828 - RNA, 20 nt, Bordetella pertussis
accagggagccguucuggca

SEQ ID NO: 432829 - RNA, 18 nt, Bordetella pertussis
accagggcggugggcagc

SEQ ID NO: 432830 - RNA, 20 nt, Bordetella pertussis
accaggggcggcgcggcgcu

SEQ ID NO: 432831 - RNA, 16 nt, Bordetella pertussis
accagguacgucgaga

SEQ ID NO: 432832 - RNA, 15 nt, Bordetella pertussis
accagguagggcagc

SEQ ID NO: 432833 - RNA, 18 nt, Bordetella pertussis
accagguccuggcggccg

SEQ ID NO: 432834 - RNA, 21 nt, Bordetella pertussis
accagguccuggcggccgccc

SEQ ID NO: 432835 - RNA, 23 nt, Bordetella pertussis
accaggucgccguacucgccggu

SEQ ID NO: 432836 - RNA, 16 nt, Bordetella pertussis
accaggucguacagcg

SEQ ID NO: 432837 - RNA, 20 nt, Bordetella pertussis
accaggucguacagcgccug

SEQ ID NO: 432838 - RNA, 21 nt, Bordetella pertussis
accaggucgucguagcgggcg

SEQ ID NO: 432839 - RNA, 15 nt, Bordetella pertussis
accaggugggcgcgc

SEQ ID NO: 432840 - RNA, 21 nt, Bordetella pertussis
accagguuuuccacagccagg

SEQ ID NO: 432841 - RNA, 20 nt, Bordetella pertussis
accagucccgcaccgaccag

SEQ ID NO: 432842 - RNA, 19 nt, Bordetella pertussis
accaguuggcccuucuuca

SEQ ID NO: 432843 - RNA, 13 nt, Bordetella pertussis
accauaucuggca

SEQ ID NO: 432844 - RNA, 16 nt, Bordetella pertussis
accauccuaugagccc

SEQ ID NO: 432845 - RNA, 13 nt, Bordetella pertussis
accaucgcgcacu

SEQ ID NO: 432846 - RNA, 15 nt, Bordetella pertussis
accaucguugccugg

SEQ ID NO: 432847 - RNA, 23 nt, Bordetella pertussis
accaucguugccugggugcuggu

SEQ ID NO: 432848 - RNA, 15 nt, Bordetella pertussis
accaucucccgcagg

SEQ ID NO: 432849 - RNA, 18 nt, Bordetella pertussis
accaugaccaugccggcc

SEQ ID NO: 432850 - RNA, 16 nt, Bordetella pertussis
acccaccuggccacaa

SEQ ID NO: 432851 - RNA, 23 nt, Bordetella pertussis
acccacuucgaaacccuuguagc

SEQ ID NO: 432852 - RNA, 15 nt, Bordetella pertussis
acccagaacccggcc

SEQ ID NO: 432853 - RNA, 22 nt, Bordetella pertussis
acccagccggacccgcgccgca

SEQ ID NO: 432854 - RNA, 16 nt, Bordetella pertussis
acccaggccggcgcca

SEQ ID NO: 432855 - RNA, 20 nt, Bordetella pertussis
acccagguaucggccagcac

SEQ ID NO: 432856 - RNA, 14 nt, Bordetella pertussis
acccauaccagccc

SEQ ID NO: 432857 - RNA, 15 nt, Bordetella pertussis
acccauaccagcccg

SEQ ID NO: 432858 - RNA, 18 nt, Bordetella pertussis
accccgaagcacagaugc

SEQ ID NO: 432859 - RNA, 18 nt, Bordetella pertussis
accccgguguaggcgggc

SEQ ID NO: 432860 - RNA, 19 nt, Bordetella pertussis
accccgguguaggcgggca

SEQ ID NO: 432861 - RNA, 15 nt, Bordetella pertussis
accccguugcagccc

SEQ ID NO: 432862 - RNA, 21 nt, Bordetella pertussis
accccguugcagcccagcgcg

SEQ ID NO: 432863 - RNA, 14 nt, Bordetella pertussis
acccgaugcgccuc

SEQ ID NO: 432864 - RNA, 16 nt, Bordetella pertussis
acccgcaagauuucau

SEQ ID NO: 432865 - RNA, 12 nt, Bordetella pertussis
acccgccgcacc

SEQ ID NO: 432866 - RNA, 19 nt, Bordetella pertussis
acccgccgcaccagccuga

SEQ ID NO: 432867 - RNA, 17 nt, Bordetella pertussis
acccugccgugggacag

SEQ ID NO: 432868 - RNA, 20 nt, Bordetella pertussis
acccugccgugggacaggca

SEQ ID NO: 432869 - RNA, 22 nt, Bordetella pertussis
acccugccgugggacaggcacu

SEQ ID NO: 432870 - RNA, 12 nt, Bordetella pertussis
acccugcccggc

SEQ ID NO: 432871 - RNA, 21 nt, Bordetella pertussis
acccuggccgaacgccgccgc

SEQ ID NO: 432872 - RNA, 14 nt, Bordetella pertussis
acccuguacaagcg

SEQ ID NO: 432873 - RNA, 21 nt, Bordetella pertussis
acccuguacaagcgcacgcug

SEQ ID NO: 432874 - RNA, 22 nt, Bordetella pertussis
acccuguacaagcgcacgcugg

SEQ ID NO: 432875 - RNA, 14 nt, Bordetella pertussis
acccuucgcgcugc

SEQ ID NO: 432876 - RNA, 19 nt, Bordetella pertussis
accgaaaagcccacguagg

SEQ ID NO: 432877 - RNA, 16 nt, Bordetella pertussis
accgaaaugccgcagc

SEQ ID NO: 432878 - RNA, 18 nt, Bordetella pertussis
accgaaaugccgcagcac

SEQ ID NO: 432879 - RNA, 19 nt, Bordetella pertussis
accgaaaugccgcagcacc

SEQ ID NO: 432880 - RNA, 15 nt, Bordetella pertussis
accgaacggccgguc

SEQ ID NO: 432881 - RNA, 20 nt, Bordetella pertussis
accgaacggccggucagccc

SEQ ID NO: 432882 - RNA, 23 nt, Bordetella pertussis
accgaaucgaacuuggcgcgguc

SEQ ID NO: 432883 - RNA, 21 nt, Bordetella pertussis
accgaauuccggcucggaccu

SEQ ID NO: 432884 - RNA, 15 nt, Bordetella pertussis
accgacaagccgguc

SEQ ID NO: 432885 - RNA, 16 nt, Bordetella pertussis
accgacgugcgccgca

SEQ ID NO: 432886 - RNA, 18 nt, Bordetella pertussis
accgagggccggaacagc

SEQ ID NO: 432887 - RNA, 22 nt, Bordetella pertussis
accgagggccggacuggcgcgc

SEQ ID NO: 432888 - RNA, 17 nt, Bordetella pertussis
accgauggugccgggcu

SEQ ID NO: 432889 - RNA, 22 nt, Bordetella pertussis
accgcguaggccuucaccuugc

SEQ ID NO: 432890 - RNA, 21 nt, Bordetella pertussis
accgcgucggccugccagccu

SEQ ID NO: 432891 - RNA, 13 nt, Bordetella pertussis
accgcuucccugg

SEQ ID NO: 432892 - RNA, 18 nt, Bordetella pertussis
accgcuucggucagcugc

SEQ ID NO: 432893 - RNA, 16 nt, Bordetella pertussis
accggaacaccagcaa

SEQ ID NO: 432894 - RNA, 18 nt, Bordetella pertussis
accggaacaccagcaagc

SEQ ID NO: 432895 - RNA, 19 nt, Bordetella pertussis
accggaaucaccgccgcga

SEQ ID NO: 432896 - RNA, 11 nt, Bordetella pertussis
accggcacccg

SEQ ID NO: 432897 - RNA, 18 nt, Bordetella pertussis
accggcaccugggccuuc

SEQ ID NO: 432898 - RNA, 20 nt, Bordetella pertussis
accggcacgccggcggcgcu

SEQ ID NO: 432899 - RNA, 14 nt, Bordetella pertussis
accggcaggccgcg

SEQ ID NO: 432900 - RNA, 19 nt, Bordetella pertussis
accggcaugccguccacgc

SEQ ID NO: 432901 - RNA, 17 nt, Bordetella pertussis
accggcuuggccucggc

SEQ ID NO: 432902 - RNA, 13 nt, Bordetella pertussis
accgggacaggca

SEQ ID NO: 432903 - RNA, 13 nt, Bordetella pertussis
accgguccagaug

SEQ ID NO: 432904 - RNA, 16 nt, Bordetella pertussis
accgguugcagcgcgc

SEQ ID NO: 432905 - RNA, 15 nt, Bordetella pertussis
accguccuugagcgc

SEQ ID NO: 432906 - RNA, 18 nt, Bordetella pertussis
accguccuugagcgccag

SEQ ID NO: 432907 - RNA, 23 nt, Bordetella pertussis
accgucguccucggcacggccag

SEQ ID NO: 432908 - RNA, 21 nt, Bordetella pertussis
accgugauauagaccagcagc

SEQ ID NO: 432909 - RNA, 13 nt, Bordetella pertussis
accgugccgccga

SEQ ID NO: 432910 - RNA, 13 nt, Bordetella pertussis
accguggccacgg

SEQ ID NO: 432911 - RNA, 15 nt, Bordetella pertussis
accuaccucagcaug

SEQ ID NO: 432912 - RNA, 14 nt, Bordetella pertussis
accugcaccgucag

SEQ ID NO: 432913 - RNA, 23 nt, Bordetella pertussis
accugcacgauggcgccggcuuc

SEQ ID NO: 432914 - RNA, 17 nt, Bordetella pertussis
accugcagcaggcgcac

SEQ ID NO: 432915 - RNA, 21 nt, Bordetella pertussis
accugcagcaggcgcaccagc

SEQ ID NO: 432916 - RNA, 20 nt, Bordetella pertussis
accugcagggucagcccgcc

SEQ ID NO: 432917 - RNA, 13 nt, Bordetella pertussis
accugccgcccga

SEQ ID NO: 432918 - RNA, 16 nt, Bordetella pertussis
accugccugccgccug

SEQ ID NO: 432919 - RNA, 23 nt, Bordetella pertussis
accugccugccgccugccaguuc

SEQ ID NO: 432920 - RNA, 16 nt, Bordetella pertussis
accugcgccaggugcu

SEQ ID NO: 432921 - RNA, 17 nt, Bordetella pertussis
accugcgcaugcgccug

SEQ ID NO: 432922 - RNA, 20 nt, Bordetella pertussis
accugcgcgaagcgcugggu

SEQ ID NO: 432923 - RNA, 15 nt, Bordetella pertussis
accugcuccagcgaa

SEQ ID NO: 432924 - RNA, 10 nt, Bordetella pertussis
accugcucga

SEQ ID NO: 432925 - RNA, 23 nt, Bordetella pertussis
accugcuggggguuggccuugcc

SEQ ID NO: 432926 - RNA, 18 nt, Bordetella pertussis
accugcuugcccagcaga

SEQ ID NO: 432927 - RNA, 22 nt, Bordetella pertussis
accuggcccggcaccguccagc

SEQ ID NO: 432928 - RNA, 15 nt, Bordetella pertussis
accuggcgcccggcg

SEQ ID NO: 432929 - RNA, 20 nt, Bordetella pertussis
accuggcugaacaggccuuc

SEQ ID NO: 432930 - RNA, 17 nt, Bordetella pertussis
accuucacgacacgccc

SEQ ID NO: 432931 - RNA, 13 nt, Bordetella pertussis
accuucagcccgg

SEQ ID NO: 432932 - RNA, 19 nt, Bordetella pertussis
accuucucgaugcgcgcca

SEQ ID NO: 432933 - RNA, 22 nt, Bordetella pertussis
accuucugcaaggccugcugca

SEQ ID NO: 432934 - RNA, 14 nt, Bordetella pertussis
accuucugccgcca

SEQ ID NO: 432935 - RNA, 22 nt, Bordetella pertussis
accuuggcggccgacagcuugc

SEQ ID NO: 432936 - RNA, 15 nt, Bordetella pertussis
accuuucugcugcuc

SEQ ID NO: 432937 - RNA, 17 nt, Bordetella pertussis
acgacacgcccagcagg

SEQ ID NO: 432938 - RNA, 18 nt, Bordetella pertussis
acgacacgcccagcaggc

SEQ ID NO: 432939 - RNA, 18 nt, Bordetella pertussis
acgaccaccagcgcacug

SEQ ID NO: 432940 - RNA, 22 nt, Bordetella pertussis
acgaccccgccgugccgggccu

SEQ ID NO: 432941 - RNA, 14 nt, Bordetella pertussis
acgaccugccacug

SEQ ID NO: 432942 - RNA, 20 nt, Bordetella pertussis
acgacgccuggaccggcucc

SEQ ID NO: 432943 - RNA, 15 nt, Bordetella pertussis
acgacggccggggcc

SEQ ID NO: 432944 - RNA, 19 nt, Bordetella pertussis
acgagcaguacacgcgcaa

SEQ ID NO: 432945 - RNA, 13 nt, Bordetella pertussis
acgagcgcagcaa

SEQ ID NO: 432946 - RNA, 14 nt, Bordetella pertussis
acgagcugcagccc

SEQ ID NO: 432947 - RNA, 16 nt, Bordetella pertussis
acgagcugcagcccgg

SEQ ID NO: 432948 - RNA, 11 nt, Bordetella pertussis
acgagugcagg

SEQ ID NO: 432949 - RNA, 13 nt, Bordetella pertussis
acgaucaccgccg

SEQ ID NO: 432950 - RNA, 16 nt, Bordetella pertussis
acgccaucuugcaggc

SEQ ID NO: 432951 - RNA, 18 nt, Bordetella pertussis
acgccauggcggcggcca

SEQ ID NO: 432952 - RNA, 19 nt, Bordetella pertussis
acgcccagcccugcccgca

SEQ ID NO: 432953 - RNA, 17 nt, Bordetella pertussis
acgcccagcgccggcac

SEQ ID NO: 432954 - RNA, 13 nt, Bordetella pertussis
acgcccaggccca

SEQ ID NO: 432955 - RNA, 20 nt, Bordetella pertussis
acgcccaggcccaccgcauc

SEQ ID NO: 432956 - RNA, 23 nt, Bordetella pertussis
acgcccagcugggccacagggcg

SEQ ID NO: 432957 - RNA, 15 nt, Bordetella pertussis
acgcccgccugcagc

SEQ ID NO: 432958 - RNA, 16 nt, Bordetella pertussis
acgcccggugccugcc

SEQ ID NO: 432959 - RNA, 17 nt, Bordetella pertussis
acgcccuggcagcuggc

SEQ ID NO: 432960 - RNA, 12 nt, Bordetella pertussis
acgcccuggccu

SEQ ID NO: 432961 - RNA, 19 nt, Bordetella pertussis
acgcccuggcuggcggccc

SEQ ID NO: 432962 - RNA, 12 nt, Bordetella pertussis
acgccgaagugg

SEQ ID NO: 432963 - RNA, 22 nt, Bordetella pertussis
acgccgaccucuucguugucgc

SEQ ID NO: 432964 - RNA, 15 nt, Bordetella pertussis
acgccgaucgcgcac

SEQ ID NO: 432965 - RNA, 21 nt, Bordetella pertussis
acgccgauugaggccagcacg

SEQ ID NO: 432966 - RNA, 17 nt, Bordetella pertussis
acgccgcccagcgcgug

SEQ ID NO: 432967 - RNA, 21 nt, Bordetella pertussis
acgccgcccagcgcgugggcc

SEQ ID NO: 432968 - RNA, 22 nt, Bordetella pertussis
acgccgcccguccgggcggcgu

SEQ ID NO: 432969 - RNA, 16 nt, Bordetella pertussis
acgccgccgaagggca

SEQ ID NO: 432970 - RNA, 20 nt, Bordetella pertussis
acgccgccgauggcgccacc

SEQ ID NO: 432971 - RNA, 14 nt, Bordetella pertussis
acgccgccuggccc

SEQ ID NO: 432972 - RNA, 17 nt, Bordetella pertussis
acgccgcggugcugggc

SEQ ID NO: 432973 - RNA, 13 nt, Bordetella pertussis
acgccgcugaugu

SEQ ID NO: 432974 - RNA, 17 nt, Bordetella pertussis
acgccggccgccuggcc

SEQ ID NO: 432975 - RNA, 18 nt, Bordetella pertussis
acgccggcgcgccgggcc

SEQ ID NO: 432976 - RNA, 19 nt, Bordetella pertussis
acgccggcggcgugcgccu

SEQ ID NO: 432977 - RNA, 16 nt, Bordetella pertussis
acgccggcgggcaggc

SEQ ID NO: 432978 - RNA, 17 nt, Bordetella pertussis
acgccggcgggcaggcg

SEQ ID NO: 432979 - RNA, 20 nt, Bordetella pertussis
acgccggcgggcaggcucca

SEQ ID NO: 432980 - RNA, 19 nt, Bordetella pertussis
acgccgggcgcggcccggc

SEQ ID NO: 432981 - RNA, 18 nt, Bordetella pertussis
acgccguggcgcaaggca

SEQ ID NO: 432982 - RNA, 19 nt, Bordetella pertussis
acgccugccgcgcccggcg

SEQ ID NO: 432983 - RNA, 15 nt, Bordetella pertussis
acgccuggaccggcu

SEQ ID NO: 432984 - RNA, 15 nt, Bordetella pertussis
acgcgaaccaggcca

SEQ ID NO: 432985 - RNA, 14 nt, Bordetella pertussis
acgcgacagcgcug

SEQ ID NO: 432986 - RNA, 16 nt, Bordetella pertussis
acgcgcaagcggcccc

SEQ ID NO: 432987 - RNA, 18 nt, Bordetella pertussis
acgcgcaccaggccugcc

SEQ ID NO: 432988 - RNA, 15 nt, Bordetella pertussis
acgcgcaaggcgggc

SEQ ID NO: 432989 - RNA, 19 nt, Bordetella pertussis
acgcgcauucgucgcugcc

SEQ ID NO: 432990 - RNA, 22 nt, Bordetella pertussis
acgcgcauucgacaaccacccu

SEQ ID NO: 432991 - RNA, 12 nt, Bordetella pertussis
acgcgccaggcg

SEQ ID NO: 432992 - RNA, 15 nt, Bordetella pertussis
acgcgccgccaggcg

SEQ ID NO: 432993 - RNA, 16 nt, Bordetella pertussis
acgcgccgccaggcgc

SEQ ID NO: 432994 - RNA, 18 nt, Bordetella pertussis
acgcgccgccaggcgcga

SEQ ID NO: 432995 - RNA, 13 nt, Bordetella pertussis
acgcgccggccca

SEQ ID NO: 432996 - RNA, 21 nt, Bordetella pertussis
acgcgcgauccgcgccaggcg

SEQ ID NO: 432997 - RNA, 15 nt, Bordetella pertussis
acgcgcgcaaugcgc

SEQ ID NO: 432998 - RNA, 12 nt, Bordetella pertussis
acgcgcgcgccc

SEQ ID NO: 432999 - RNA, 22 nt, Bordetella pertussis
acgcgcgcgcgcacaggcgcuc

SEQ ID NO: 433000 - RNA, 17 nt, Bordetella pertussis
acgcgcgccggccagcg

SEQ ID NO: 433001 - RNA, 15 nt, Bordetella pertussis
acgcgcuccggcugc

SEQ ID NO: 433002 - RNA, 13 nt, Bordetella pertussis
acgcgcugcugca

SEQ ID NO: 433003 - RNA, 16 nt, Bordetella pertussis
acgcgcuguaggcgcc

SEQ ID NO: 433004 - RNA, 19 nt, Bordetella pertussis
acgcgcuguugcuggccac

SEQ ID NO: 433005 - RNA, 14 nt, Bordetella pertussis
acgcgcuuccagga

SEQ ID NO: 433006 - RNA, 15 nt, Bordetella pertussis
acgcgcuuccaggag

SEQ ID NO: 433007 - RNA, 17 nt, Bordetella pertussis
acgcgcuugaggcuggu

SEQ ID NO: 433008 - RNA, 22 nt, Bordetella pertussis
acgcgcuuuuccccgcccagcg

SEQ ID NO: 433009 - RNA, 19 nt, Bordetella pertussis
acgcggaggagguggcugg

SEQ ID NO: 433010 - RNA, 20 nt, Bordetella pertussis
acgcggaggagguggcuggu

SEQ ID NO: 433011 - RNA, 14 nt, Bordetella pertussis
acgcggccguggag

SEQ ID NO: 433012 - RNA, 21 nt, Bordetella pertussis
acgcggccguggcggccugcg

SEQ ID NO: 433013 - RNA, 15 nt, Bordetella pertussis
acgcggcgcccgcgc

SEQ ID NO: 433014 - RNA, 22 nt, Bordetella pertussis
acgcggcggugcgacugcagga

SEQ ID NO: 433015 - RNA, 22 nt, Bordetella pertussis
acgcgggccggccguuucaggc

SEQ ID NO: 433016 - RNA, 15 nt, Bordetella pertussis
acgcgggcuugcugc

SEQ ID NO: 433017 - RNA, 14 nt, Bordetella pertussis
acgcggggacaggc

SEQ ID NO: 433018 - RNA, 15 nt, Bordetella pertussis
acgcgguccacgccg

SEQ ID NO: 433019 - RNA, 15 nt, Bordetella pertussis
acgcgguccagcccc

SEQ ID NO: 433020 - RNA, 21 nt, Bordetella pertussis
acgcgguggcguuggccugcc

SEQ ID NO: 433021 - RNA, 15 nt, Bordetella pertussis
acgcguaggucaggc

SEQ ID NO: 433022 - RNA, 21 nt, Bordetella pertussis
acgcguuuggcuuaccaggcg

SEQ ID NO: 433023 - RNA, 16 nt, Bordetella pertussis
acgcugcccugcugcu

SEQ ID NO: 433024 - RNA, 14 nt, Bordetella pertussis
acgcugcgcaggcg

SEQ ID NO: 433025 - RNA, 17 nt, Bordetella pertussis
acgcugcgcaggcgcgc

SEQ ID NO: 433026 - RNA, 13 nt, Bordetella pertussis
acgcugcucuugg

SEQ ID NO: 433027 - RNA, 18 nt, Bordetella pertussis
acgcugcugauccucgcc

SEQ ID NO: 433028 - RNA, 22 nt, Bordetella pertussis
acgcuggaaacuaaaucgcggc

SEQ ID NO: 433029 - RNA, 14 nt, Bordetella pertussis
acgcuggagcgcgg

SEQ ID NO: 433030 - RNA, 15 nt, Bordetella pertussis
acgcugggcgaggcg

SEQ ID NO: 433031 - RNA, 15 nt, Bordetella pertussis
acgcugguggccacc

SEQ ID NO: 433032 - RNA, 16 nt, Bordetella pertussis
acgcuguaacaacacg

SEQ ID NO: 433033 - RNA, 17 nt, Bordetella pertussis
acgcuguagaggcgcgg

SEQ ID NO: 433034 - RNA, 21 nt, Bordetella pertussis
acgcuguacugguaccaggcg

SEQ ID NO: 433035 - RNA, 16 nt, Bordetella pertussis
acggcaccagccgggc

SEQ ID NO: 433036 - RNA, 12 nt, Bordetella pertussis
acggcagcagcg

SEQ ID NO: 433037 - RNA, 21 nt, Bordetella pertussis
acggccaagcagcgccugccg

SEQ ID NO: 433038 - RNA, 22 nt, Bordetella pertussis
acggccacgaucaucaggauga

SEQ ID NO: 433039 - RNA, 21 nt, Bordetella pertussis
acggccagcacguagaaagug

SEQ ID NO: 433040 - RNA, 13 nt, Bordetella pertussis
acggccagcacuu

SEQ ID NO: 433041 - RNA, 10 nt, Bordetella pertussis
acggccaggg

SEQ ID NO: 433042 - RNA, 11 nt, Bordetella pertussis
acggccagggg

SEQ ID NO: 433043 - RNA, 16 nt, Bordetella pertussis
acggccaggggcagcu

SEQ ID NO: 433044 - RNA, 22 nt, Bordetella pertussis
acggcccagcucugguccaggc

SEQ ID NO: 433045 - RNA, 15 nt, Bordetella pertussis
acggcccauccaucu

SEQ ID NO: 433046 - RNA, 16 nt, Bordetella pertussis
acggcccgccaggaag

SEQ ID NO: 433047 - RNA, 13 nt, Bordetella pertussis
acggcccuggucu

SEQ ID NO: 433048 - RNA, 16 nt, Bordetella pertussis
acggccgcaugcguga

SEQ ID NO: 433049 - RNA, 15 nt, Bordetella pertussis
acggccgccaccugg

SEQ ID NO: 433050 - RNA, 19 nt, Bordetella pertussis
acggccgccaccugggccg

SEQ ID NO: 433051 - RNA, 22 nt, Bordetella pertussis
acggccgccaccugggccgccu

SEQ ID NO: 433052 - RNA, 11 nt, Bordetella pertussis
acggccgccga

SEQ ID NO: 433053 - RNA, 11 nt, Bordetella pertussis
acggccgccgg

SEQ ID NO: 433054 - RNA, 17 nt, Bordetella pertussis
acggccgcggccggcac

SEQ ID NO: 433055 - RNA, 21 nt, Bordetella pertussis
acggccggcagcgccuugccu

SEQ ID NO: 433056 - RNA, 14 nt, Bordetella pertussis
acggccggccaggc

SEQ ID NO: 433057 - RNA, 16 nt, Bordetella pertussis
acggccggccaggcgc

SEQ ID NO: 433058 - RNA, 14 nt, Bordetella pertussis
acggccggccugca

SEQ ID NO: 433059 - RNA, 12 nt, Bordetella pertussis
acggccggcucc

SEQ ID NO: 433060 - RNA, 23 nt, Bordetella pertussis
acggccggucagcccaggcgggc

SEQ ID NO: 433061 - RNA, 16 nt, Bordetella pertussis
acggccucggccagga

SEQ ID NO: 433062 - RNA, 20 nt, Bordetella pertussis
acggccuucggcggcgcgcu

SEQ ID NO: 433063 - RNA, 18 nt, Bordetella pertussis
acggcgagucugaaaggg

SEQ ID NO: 433064 - RNA, 18 nt, Bordetella pertussis
acggcgaugcugccgucg

SEQ ID NO: 433065 - RNA, 13 nt, Bordetella pertussis
acggcggccaggc

SEQ ID NO: 433066 - RNA, 14 nt, Bordetella pertussis
acggcggccaggcc

SEQ ID NO: 433067 - RNA, 14 nt, Bordetella pertussis
acggcggcaggccg

SEQ ID NO: 433068 - RNA, 13 nt, Bordetella pertussis
acggcggcggcca

SEQ ID NO: 433069 - RNA, 15 nt, Bordetella pertussis
acggcggcggccauc

SEQ ID NO: 433070 - RNA, 14 nt, Bordetella pertussis
acggcgggaccggc

SEQ ID NO: 433071 - RNA, 20 nt, Bordetella pertussis
acggcggugaucugcucgcc

SEQ ID NO: 433072 - RNA, 19 nt, Bordetella pertussis
acggcggugccgcgcaccc

SEQ ID NO: 433073 - RNA, 14 nt, Bordetella pertussis
acggcgucgagcac

SEQ ID NO: 433074 - RNA, 18 nt, Bordetella pertussis
acgggaugcuccagcuug

SEQ ID NO: 433075 - RNA, 18 nt, Bordetella pertussis
acgggcugggccgaggcg

SEQ ID NO: 433076 - RNA, 20 nt, Bordetella pertussis
acgggcugggccgaggcgcc

SEQ ID NO: 433077 - RNA, 23 nt, Bordetella pertussis
acgggcugggccgaggcgccgcc

SEQ ID NO: 433078 - RNA, 22 nt, Bordetella pertussis
acgggcuguucgcgcagcaggc

SEQ ID NO: 433079 - RNA, 13 nt, Bordetella pertussis
acggggaacaggc

SEQ ID NO: 433080 - RNA, 18 nt, Bordetella pertussis
acggggaacaggcgcgcc

SEQ ID NO: 433081 - RNA, 12 nt, Bordetella pertussis
acggggacaggc

SEQ ID NO: 433082 - RNA, 18 nt, Bordetella pertussis
acgggguggccggcgcgc

SEQ ID NO: 433083 - RNA, 19 nt, Bordetella pertussis
acgguaucucagcgcgccg

SEQ ID NO: 433084 - RNA, 17 nt, Bordetella pertussis
acggucgcgagcugcgc

SEQ ID NO: 433085 - RNA, 18 nt, Bordetella pertussis
acggucucguuccagaug

SEQ ID NO: 433086 - RNA, 19 nt, Bordetella pertussis
acgguggugucggcggcca

SEQ ID NO: 433087 - RNA, 21 nt, Bordetella pertussis
acgguggugucggcggccagc

SEQ ID NO: 433088 - RNA, 19 nt, Bordetella pertussis
acgucaaggccugcccggg

SEQ ID NO: 433089 - RNA, 19 nt, Bordetella pertussis
acgucacggaucagccgcu

SEQ ID NO: 433090 - RNA, 12 nt, Bordetella pertussis
acgucaucgugg

SEQ ID NO: 433091 - RNA, 12 nt, Bordetella pertussis
acguccagccag

SEQ ID NO: 433092 - RNA, 21 nt, Bordetella pertussis
acguccagcgccaccagcagc

SEQ ID NO: 433093 - RNA, 19 nt, Bordetella pertussis
acguccgccccauccacgg

SEQ ID NO: 433094 - RNA, 22 nt, Bordetella pertussis
acgucgcccuggauggcggccg

SEQ ID NO: 433095 - RNA, 21 nt, Bordetella pertussis
acgucgccggcguucuucagc

SEQ ID NO: 433096 - RNA, 17 nt, Bordetella pertussis
acgucgcucggccuccc

SEQ ID NO: 433097 - RNA, 20 nt, Bordetella pertussis
acgucggcgauggcccggua

SEQ ID NO: 433098 - RNA, 17 nt, Bordetella pertussis
acgucgucgguggggca

SEQ ID NO: 433099 - RNA, 20 nt, Bordetella pertussis
acguggauggcuuuggcgaa

SEQ ID NO: 433100 - RNA, 19 nt, Bordetella pertussis
acguggcaguccucguugc

SEQ ID NO: 433101 - RNA, 23 nt, Bordetella pertussis
acguggcccgcgugacggccgcc

SEQ ID NO: 433102 - RNA, 20 nt, Bordetella pertussis
acgugguccacgaagcaggu

SEQ ID NO: 433103 - RNA, 14 nt, Bordetella pertussis
acgugucggccacc

SEQ ID NO: 433104 - RNA, 21 nt, Bordetella pertussis
acucaccgccgcccgcaggca

SEQ ID NO: 433105 - RNA, 12 nt, Bordetella pertussis
acuccaggagcu

SEQ ID NO: 433106 - RNA, 23 nt, Bordetella pertussis
acucccacgcucuggagccacca

SEQ ID NO: 433107 - RNA, 17 nt, Bordetella pertussis
acuccggauaccgccgc

SEQ ID NO: 433108 - RNA, 18 nt, Bordetella pertussis
acuccugcaacuggugca

SEQ ID NO: 433109 - RNA, 22 nt, Bordetella pertussis
acucgaugcccagcaccgccac

SEQ ID NO: 433110 - RNA, 15 nt, Bordetella pertussis
acucgccgugcuggg

SEQ ID NO: 433111 - RNA, 15 nt, Bordetella pertussis
acucgcgcucggcca

SEQ ID NO: 433112 - RNA, 15 nt, Bordetella pertussis
acucgcggucugguc

SEQ ID NO: 433113 - RNA, 13 nt, Bordetella pertussis
acucgggcaugcg

SEQ ID NO: 433114 - RNA, 17 nt, Bordetella pertussis
acucgggcaugcgccug

SEQ ID NO: 433115 - RNA, 14 nt, Bordetella pertussis
acucggugcgcgcg

SEQ ID NO: 433116 - RNA, 13 nt, Bordetella pertussis
acucuaguucuau

SEQ ID NO: 433117 - RNA, 18 nt, Bordetella pertussis
acugaacgcguccaggcc

SEQ ID NO: 433118 - RNA, 15 nt, Bordetella pertussis
acugaugcuggucag

SEQ ID NO: 433119 - RNA, 11 nt, Bordetella pertussis
acugccaggcg

SEQ ID NO: 433120 - RNA, 19 nt, Bordetella pertussis
acugccaguaggcgcccca

SEQ ID NO: 433121 - RNA, 12 nt, Bordetella pertussis
acugccccagcg

SEQ ID NO: 433122 - RNA, 16 nt, Bordetella pertussis
acugccccagcggcug

SEQ ID NO: 433123 - RNA, 11 nt, Bordetella pertussis
acugcccgcgc

SEQ ID NO: 433124 - RNA, 23 nt, Bordetella pertussis
acugcccgucuuggcgugguggg

SEQ ID NO: 433125 - RNA, 20 nt, Bordetella pertussis
acugcguucgggacgcagga

SEQ ID NO: 433126 - RNA, 18 nt, Bordetella pertussis
acugcuguacgacagcaa

SEQ ID NO: 433127 - RNA, 12 nt, Bordetella pertussis
acuggccagcaa

SEQ ID NO: 433128 - RNA, 21 nt, Bordetella pertussis
acuggcccaggcgggccaggu

SEQ ID NO: 433129 - RNA, 15 nt, Bordetella pertussis
acuggccgaugguca

SEQ ID NO: 433130 - RNA, 15 nt, Bordetella pertussis
acuggccgcgccgcu

SEQ ID NO: 433131 - RNA, 20 nt, Bordetella pertussis
acuggccuucuucacguagc

SEQ ID NO: 433132 - RNA, 21 nt, Bordetella pertussis
acuggcgagcacccgcaggcg

SEQ ID NO: 433133 - RNA, 19 nt, Bordetella pertussis
acuggcgcgcgcaagccgc

SEQ ID NO: 433134 - RNA, 20 nt, Bordetella pertussis
acuggcgcgcgcaagccgcc

SEQ ID NO: 433135 - RNA, 19 nt, Bordetella pertussis
acuggcgcggcggccaggc

SEQ ID NO: 433136 - RNA, 12 nt, Bordetella pertussis
acuggcucccga

SEQ ID NO: 433137 - RNA, 16 nt, Bordetella pertussis
acuggcuggucaggcg

SEQ ID NO: 433138 - RNA, 19 nt, Bordetella pertussis
acugggacaggcccagccc

SEQ ID NO: 433139 - RNA, 22 nt, Bordetella pertussis
acugggccaaccacgagcugca

SEQ ID NO: 433140 - RNA, 13 nt, Bordetella pertussis
acugggcuugccg

SEQ ID NO: 433141 - RNA, 19 nt, Bordetella pertussis
acugggggacuggcacccg

SEQ ID NO: 433142 - RNA, 12 nt, Bordetella pertussis
acugguacagcg

SEQ ID NO: 433143 - RNA, 17 nt, Bordetella pertussis
acugucgcgccacggcu

SEQ ID NO: 433144 - RNA, 14 nt, Bordetella pertussis
acuugcaggccgcg

SEQ ID NO: 433145 - RNA, 14 nt, Bordetella pertussis
acuugcggguccag

SEQ ID NO: 433146 - RNA, 13 nt, Bordetella pertussis
acuuguaaugaga

SEQ ID NO: 433147 - RNA, 18 nt, Bordetella pertussis
acuuguucuuguugcucu

SEQ ID NO: 433148 - RNA, 20 nt, Bordetella pertussis
acuuucgcgcgcgccugccc

SEQ ID NO: 433149 - RNA, 20 nt, Bordetella pertussis
agaaaaaaagcaagacagca

SEQ ID NO: 433150 - RNA, 17 nt, Bordetella pertussis
agaaaccugaccucgcg

SEQ ID NO: 433151 - RNA, 23 nt, Bordetella pertussis
agaagcccccgcgcugcgcccgc

SEQ ID NO: 433152 - RNA, 18 nt, Bordetella pertussis
agaaguggucgcgcaggc

SEQ ID NO: 433153 - RNA, 12 nt, Bordetella pertussis
agacccuccucg

SEQ ID NO: 433154 - RNA, 22 nt, Bordetella pertussis
agaccggguuuccagcccgugg

SEQ ID NO: 433155 - RNA, 23 nt, Bordetella pertussis
agaccggguuuccagcccgugga

SEQ ID NO: 433156 - RNA, 16 nt, Bordetella pertussis
agaccguagcgcaggc

SEQ ID NO: 433157 - RNA, 14 nt, Bordetella pertussis
agacgaugaagacg

SEQ ID NO: 433158 - RNA, 13 nt, Bordetella pertussis
agacgcgcagcgg

SEQ ID NO: 433159 - RNA, 18 nt, Bordetella pertussis
agacgcgcagcggcaggc

SEQ ID NO: 433160 - RNA, 17 nt, Bordetella pertussis
agacgcggggacaggca

SEQ ID NO: 433161 - RNA, 16 nt, Bordetella pertussis
agacggcgcucggccu

SEQ ID NO: 433162 - RNA, 21 nt, Bordetella pertussis
agacggcgcucggccucgagg

SEQ ID NO: 433163 - RNA, 22 nt, Bordetella pertussis
agacuguucagaaaccugaccu

SEQ ID NO: 433164 - RNA, 12 nt, Bordetella pertussis
agagcuccagcc

SEQ ID NO: 433165 - RNA, 13 nt, Bordetella pertussis
agauaccggcaug

SEQ ID NO: 433166 - RNA, 17 nt, Bordetella pertussis
agauaccgucuuggccg

SEQ ID NO: 433167 - RNA, 16 nt, Bordetella pertussis
agauaggcggccaggc

SEQ ID NO: 433168 - RNA, 16 nt, Bordetella pertussis
agauagucgcggaugc

SEQ ID NO: 433169 - RNA, 21 nt, Bordetella pertussis
agauccaggcggccaccacca

SEQ ID NO: 433170 - RNA, 20 nt, Bordetella pertussis
agauccgcaaguucggcagc

SEQ ID NO: 433171 - RNA, 19 nt, Bordetella pertussis
agauccgguaugccugcca

SEQ ID NO: 433172 - RNA, 22 nt, Bordetella pertussis
agaucgcgccuaccggcgccga

SEQ ID NO: 433173 - RNA, 14 nt, Bordetella pertussis
agaucggcccggcg

SEQ ID NO: 433174 - RNA, 19 nt, Bordetella pertussis
agaucggcgcuggccuggc

SEQ ID NO: 433175 - RNA, 21 nt, Bordetella pertussis
agaucguugaucucgcccagc

SEQ ID NO: 433176 - RNA, 20 nt, Bordetella pertussis
agaucuccggcgccuggccg

SEQ ID NO: 433177 - RNA, 16 nt, Bordetella pertussis
agaugcgggucggcgc

SEQ ID NO: 433178 - RNA, 20 nt, Bordetella pertussis
agauggaaucauuggccagc

SEQ ID NO: 433179 - RNA, 13 nt, Bordetella pertussis
agaugggcggccu

SEQ ID NO: 433180 - RNA, 13 nt, Bordetella pertussis
agaugggcggcga

SEQ ID NO: 433181 - RNA, 13 nt, Bordetella pertussis
agcaagacagcaa

SEQ ID NO: 433182 - RNA, 17 nt, Bordetella pertussis
agcaagcccacaccauc

SEQ ID NO: 433183 - RNA, 13 nt, Bordetella pertussis
agcaagcgcucgg

SEQ ID NO: 433184 - RNA, 16 nt, Bordetella pertussis
agcaagcgcuggaugg

SEQ ID NO: 433185 - RNA, 13 nt, Bordetella pertussis
agcaagcugcugc

SEQ ID NO: 433186 - RNA, 16 nt, Bordetella pertussis
agcaagcugcugcugg

SEQ ID NO: 433187 - RNA, 18 nt, Bordetella pertussis
agcaaggacaaggcgcgu

SEQ ID NO: 433188 - RNA, 22 nt, Bordetella pertussis
agcaaggcggcaaacccggcga

SEQ ID NO: 433189 - RNA, 12 nt, Bordetella pertussis
agcaagggcaga

SEQ ID NO: 433190 - RNA, 21 nt, Bordetella pertussis
agcaagggguccguggcggcc

SEQ ID NO: 433191 - RNA, 15 nt, Bordetella pertussis
agcaauccaucguga

SEQ ID NO: 433192 - RNA, 22 nt, Bordetella pertussis
agcaauccgaggcccguuuugu

SEQ ID NO: 433193 - RNA, 20 nt, Bordetella pertussis
agcaauuaugcguggccgcc

SEQ ID NO: 433194 - RNA, 16 nt, Bordetella pertussis
agcaauucgaccggca

SEQ ID NO: 433195 - RNA, 18 nt, Bordetella pertussis
agcaauugccccagcacg

SEQ ID NO: 433196 - RNA, 22 nt, Bordetella pertussis
agcaauugccggaucagcgccu

SEQ ID NO: 433197 - RNA, 18 nt, Bordetella pertussis
agcacaugcccggccacc

SEQ ID NO: 433198 - RNA, 21 nt, Bordetella pertussis
agcacaugcccggccaccagc

SEQ ID NO: 433199 - RNA, 20 nt, Bordetella pertussis
agcaccacggcggccaggcc

SEQ ID NO: 433200 - RNA, 12 nt, Bordetella pertussis
agcaccagcagc

SEQ ID NO: 433201 - RNA, 13 nt, Bordetella pertussis
agcaccagcagcc

SEQ ID NO: 433202 - RNA, 16 nt, Bordetella pertussis
agcaccagcagcccca

SEQ ID NO: 433203 - RNA, 18 nt, Bordetella pertussis
agcaccagcagccccagc

SEQ ID NO: 433204 - RNA, 13 nt, Bordetella pertussis
agcaccagcaugc

SEQ ID NO: 433205 - RNA, 14 nt, Bordetella pertussis
agcaccaggccgcc

SEQ ID NO: 433206 - RNA, 20 nt, Bordetella pertussis
agcaccaggccgccggccag

SEQ ID NO: 433207 - RNA, 21 nt, Bordetella pertussis
agcaccaggcuuugcgcgcca

SEQ ID NO: 433208 - RNA, 22 nt, Bordetella pertussis
agcaccaggucgaacggauugc

SEQ ID NO: 433209 - RNA, 16 nt, Bordetella pertussis
agcacccgcaggcggc

SEQ ID NO: 433210 - RNA, 22 nt, Bordetella pertussis
agcaccgaugcgccggccuggc

SEQ ID NO: 433211 - RNA, 23 nt, Bordetella pertussis
agcaccgccacgcgguccagccc

SEQ ID NO: 433212 - RNA, 19 nt, Bordetella pertussis
agcaccgccugcugcgccu

SEQ ID NO: 433213 - RNA, 20 nt, Bordetella pertussis
agcaccgcgaccaugcggcc

SEQ ID NO: 433214 - RNA, 13 nt, Bordetella pertussis
agcacgacgacgg

SEQ ID NO: 433215 - RNA, 18 nt, Bordetella pertussis
agcacgacgacggccggc

SEQ ID NO: 433216 - RNA, 14 nt, Bordetella pertussis
agcacgauggggcc

SEQ ID NO: 433217 - RNA, 21 nt, Bordetella pertussis
agcacgccgaucgcgcacagc

SEQ ID NO: 433218 - RNA, 16 nt, Bordetella pertussis
agcacgccgcgcucgu

SEQ ID NO: 433219 - RNA, 14 nt, Bordetella pertussis
agcacgcgcagcuu

SEQ ID NO: 433220 - RNA, 23 nt, Bordetella pertussis
agcacgcgcagcuugcccgcgcg

SEQ ID NO: 433221 - RNA, 12 nt, Bordetella pertussis
agcacgcggcgc

SEQ ID NO: 433222 - RNA, 19 nt, Bordetella pertussis
agcacgcggcgcagcaucu

SEQ ID NO: 433223 - RNA, 18 nt, Bordetella pertussis
agcacggccacggccggc

SEQ ID NO: 433224 - RNA, 19 nt, Bordetella pertussis
agcacggccacggccggca

SEQ ID NO: 433225 - RNA, 22 nt, Bordetella pertussis
agcacggcgcacaccaucagcu

SEQ ID NO: 433226 - RNA, 23 nt, Bordetella pertussis
agcacggcgcacaccaucagcug

SEQ ID NO: 433227 - RNA, 14 nt, Bordetella pertussis
agcacggcgcggcu

SEQ ID NO: 433228 - RNA, 21 nt, Bordetella pertussis
agcagacccgcgcccagcugu

SEQ ID NO: 433229 - RNA, 15 nt, Bordetella pertussis
aaaaccggcgccugg

SEQ ID NO: 433230 - RNA, 21 nt, Bordetella pertussis
agcagcgaggacacgcagcug

SEQ ID NO: 433231 - RNA, 17 nt, Bordetella pertussis
agcagcgcaucgagcuc

SEQ ID NO: 433232 - RNA, 16 nt, Bordetella pertussis
agcaggaacaggcugc

SEQ ID NO: 433233 - RNA, 12 nt, Bordetella pertussis
agcagggccacg

SEQ ID NO: 433234 - RNA, 18 nt, Bordetella pertussis
agcagggccacgcccagg

SEQ ID NO: 433235 - RNA, 21 nt, Bordetella pertussis
agcagggucgagaccagcagc

SEQ ID NO: 433236 - RNA, 23 nt, Bordetella pertussis
agcagggucugcaggccgaaacc

SEQ ID NO: 433237 - RNA, 16 nt, Bordetella pertussis
agcagguccauggcca

SEQ ID NO: 433238 - RNA, 23 nt, Bordetella pertussis
agcagguccauggccagucuggc

SEQ ID NO: 433239 - RNA, 14 nt, Bordetella pertussis
agcaggucggaguc

SEQ ID NO: 433240 - RNA, 14 nt, Bordetella pertussis
agcaguuccacagg

SEQ ID NO: 433241 - RNA, 19 nt, Bordetella pertussis
agcaguucgggguccagca

SEQ ID NO: 433242 - RNA, 16 nt, Bordetella pertussis
agcaguugcagcauga

SEQ ID NO: 433243 - RNA, 22 nt, Bordetella pertussis
agcaguuucugcaccggcgcca

SEQ ID NO: 433244 - RNA, 22 nt, Bordetella pertussis
agcaucccagucgaugcaaccg

SEQ ID NO: 433245 - RNA, 19 nt, Bordetella pertussis
agcauccgcgccaggaugg

SEQ ID NO: 433246 - RNA, 13 nt, Bordetella pertussis
agcaucugcggca

SEQ ID NO: 433247 - RNA, 16 nt, Bordetella pertussis
agcaugugcgcggcgu

SEQ ID NO: 433248 - RNA, 16 nt, Bordetella pertussis
agcaugugcucgggac

SEQ ID NO: 433249 - RNA, 21 nt, Bordetella pertussis
agcaugugcucgggacgcagg

SEQ ID NO: 433250 - RNA, 13 nt, Bordetella pertussis
agccacacgcuga

SEQ ID NO: 433251 - RNA, 17 nt, Bordetella pertussis
agccaccacugcaaggc

SEQ ID NO: 433252 - RNA, 12 nt, Bordetella pertussis
agccacggcccg

SEQ ID NO: 433253 - RNA, 22 nt, Bordetella pertussis
agccacgugaagcgccgcgccu

SEQ ID NO: 433254 - RNA, 24 nt, Bordetella pertussis
agccacgugaagcgccgcgccucg

SEQ ID NO: 433255 - RNA, 21 nt, Bordetella pertussis
agccacugcggcccgagccaa

SEQ ID NO: 433256 - RNA, 11 nt, Bordetella pertussis
agccagccgcu

SEQ ID NO: 433257 - RNA, 15 nt, Bordetella pertussis
agccagccggcggcc

SEQ ID NO: 433258 - RNA, 17 nt, Bordetella pertussis
agccaggcgcccggcgu

SEQ ID NO: 433259 - RNA, 13 nt, Bordetella pertussis
agccaggcggcgu

SEQ ID NO: 433260 - RNA, 14 nt, Bordetella pertussis
agcccgcggccacc

SEQ ID NO: 433261 - RNA, 12 nt, Bordetella pertussis
agcccgcguuca

SEQ ID NO: 433262 - RNA, 21 nt, Bordetella pertussis
agcccgcuggccgaucugcug

SEQ ID NO: 433263 - RNA, 15 nt, Bordetella pertussis
agcccggccagagcc

SEQ ID NO: 433264 - RNA, 15 nt, Bordetella pertussis
agcccggccccaggc

SEQ ID NO: 433265 - RNA, 16 nt, Bordetella pertussis
agcccggcccccagcc

SEQ ID NO: 433266 - RNA, 18 nt, Bordetella pertussis
agcccggcccccagccca

SEQ ID NO: 433267 - RNA, 13 nt, Bordetella pertussis
agcccggccgcca

SEQ ID NO: 433268 - RNA, 22 nt, Bordetella pertussis
agcccucggucgucagcacgcc

SEQ ID NO: 433269 - RNA, 20 nt, Bordetella pertussis
agccgaaguacacggccagc

SEQ ID NO: 433270 - RNA, 23 nt, Bordetella pertussis
agccgaaguacacggccagcacg

SEQ ID NO: 433271 - RNA, 18 nt, Bordetella pertussis
agccgaucagccggccau

SEQ ID NO: 433272 - RNA, 21 nt, Bordetella pertussis
agccgaucagccggccauggc

SEQ ID NO: 433273 - RNA, 19 nt, Bordetella pertussis
agccgauccgcgacgcccu

SEQ ID NO: 433274 - RNA, 15 nt, Bordetella pertussis
agccgaucuggcccu

SEQ ID NO: 433275 - RNA, 17 nt, Bordetella pertussis
agccgaucuggcccuug

SEQ ID NO: 433276 - RNA, 20 nt, Bordetella pertussis
agccgaugaccggccaggcg

SEQ ID NO: 433277 - RNA, 18 nt, Bordetella pertussis
agccgaugccgcuucagg

SEQ ID NO: 433278 - RNA, 19 nt, Bordetella pertussis
agccgaugucgaacagcug

SEQ ID NO: 433279 - RNA, 22 nt, Bordetella pertussis
agccgcaauaccuucagcccgg

SEQ ID NO: 433280 - RNA, 18 nt, Bordetella pertussis
agccgcaagcuggcggcg

SEQ ID NO: 433281 - RNA, 13 nt, Bordetella pertussis
agccgcaccaugc

SEQ ID NO: 433282 - RNA, 15 nt, Bordetella pertussis
agccgcaccaugcgg

SEQ ID NO: 433283 - RNA, 20 nt, Bordetella pertussis
agccgcccggaugggcggcc

SEQ ID NO: 433284 - RNA, 12 nt, Bordetella pertussis
agccgcccggcg

SEQ ID NO: 433285 - RNA, 21 nt, Bordetella pertussis
agccgccgcccuugcgccagu

SEQ ID NO: 433286 - RNA, 21 nt, Bordetella pertussis
agccgccgcgauugcaggugg

SEQ ID NO: 433287 - RNA, 14 nt, Bordetella pertussis
agccgccugagcac

SEQ ID NO: 433288 - RNA, 23 nt, Bordetella pertussis
agccgcgagguauuggccuugcc

SEQ ID NO: 433289 - RNA, 20 nt, Bordetella pertussis
agccgcgccagcgccuccau

SEQ ID NO: 433290 - RNA, 14 nt, Bordetella pertussis
agccgcgccagggc

SEQ ID NO: 433291 - RNA, 15 nt, Bordetella pertussis
agccgcgccugcagc

SEQ ID NO: 433292 - RNA, 16 nt, Bordetella pertussis
agccgcgccugcagca

SEQ ID NO: 433293 - RNA, 20 nt, Bordetella pertussis
agccgcgccugcagcagcgg

SEQ ID NO: 433294 - RNA, 17 nt, Bordetella pertussis
agccgcgcgaccuuguc

SEQ ID NO: 433295 - RNA, 19 nt, Bordetella pertussis
agccgcgcgcaugcgccuu

SEQ ID NO: 433296 - RNA, 14 nt, Bordetella pertussis
agccgcgcgccugc

SEQ ID NO: 433297 - RNA, 18 nt, Bordetella pertussis
agccgcgcgccugcagca

SEQ ID NO: 433298 - RNA, 13 nt, Bordetella pertussis
agccgcggcgccg

SEQ ID NO: 433299 - RNA, 15 nt, Bordetella pertussis
agccgcggcgccgca

SEQ ID NO: 433300 - RNA, 20 nt, Bordetella pertussis
agccgcuccagccaccacug

SEQ ID NO: 433301 - RNA, 21 nt, Bordetella pertussis
agccgcuccagccaccacugc

SEQ ID NO: 433302 - RNA, 12 nt, Bordetella pertussis
agccgcugcaga

SEQ ID NO: 433303 - RNA, 18 nt, Bordetella pertussis
agccgcugcgcgcggccu

SEQ ID NO: 433304 - RNA, 22 nt, Bordetella pertussis
agccgcugcgcgcggccuggcg

SEQ ID NO: 433305 - RNA, 19 nt, Bordetella pertussis
agccgcuugcggccaggcg

SEQ ID NO: 433306 - RNA, 15 nt, Bordetella pertussis
agccggaaugcacca

SEQ ID NO: 433307 - RNA, 13 nt, Bordetella pertussis
agccggacguggg

SEQ ID NO: 433308 - RNA, 17 nt, Bordetella pertussis
agccggagcagucgcgc

SEQ ID NO: 433309 - RNA, 21 nt, Bordetella pertussis
agccggcaagccagggcagga

SEQ ID NO: 433310 - RNA, 17 nt, Bordetella pertussis
agccggcagaucggcgc

SEQ ID NO: 433311 - RNA, 20 nt, Bordetella pertussis
agccggccacgcgcugcagc

SEQ ID NO: 433312 - RNA, 22 nt, Bordetella pertussis
agccggccacgcgcugcagcag

SEQ ID NO: 433313 - RNA, 15 nt, Bordetella pertussis
agccggccauggccc

SEQ ID NO: 433314 - RNA, 17 nt, Bordetella pertussis
agccggccauggccgcc

SEQ ID NO: 433315 - RNA, 19 nt, Bordetella pertussis
agccggcccguuggcaggc

SEQ ID NO: 433316 - RNA, 13 nt, Bordetella pertussis
agccggccuccgg

SEQ ID NO: 433317 - RNA, 18 nt, Bordetella pertussis
agccggccuccggggugc

SEQ ID NO: 433318 - RNA, 16 nt, Bordetella pertussis
agccggccgcgccgcg

SEQ ID NO: 433319 - RNA, 20 nt, Bordetella pertussis
agccggcgcgccauggucuc

SEQ ID NO: 433320 - RNA, 22 nt, Bordetella pertussis
agccggcgggcggcugcccggg

SEQ ID NO: 433321 - RNA, 14 nt, Bordetella pertussis
agccggcggccagc

SEQ ID NO: 433322 - RNA, 20 nt, Bordetella pertussis
agccgggcaccgagccgcag

SEQ ID NO: 433323 - RNA, 22 nt, Bordetella pertussis
agccgggcgccgauccagccca

SEQ ID NO: 433324 - RNA, 17 nt, Bordetella pertussis
agccgggucuggccggc

SEQ ID NO: 433325 - RNA, 17 nt, Bordetella pertussis
agccgguacagccaggc

SEQ ID NO: 433326 - RNA, 17 nt, Bordetella pertussis
agccgguccgccucgca

SEQ ID NO: 433327 - RNA, 23 nt, Bordetella pertussis
agccggugcgcagcaccagcaug

SEQ ID NO: 433328 - RNA, 22 nt, Bordetella pertussis
agccggugcgcggcuugcagcg

SEQ ID NO: 433329 - RNA, 20 nt, Bordetella pertussis
agccguaacaggacagccgc

SEQ ID NO: 433330 - RNA, 16 nt, Bordetella pertussis
agccucgcccuugcgg

SEQ ID NO: 433331 - RNA, 20 nt, Bordetella pertussis
agccucguuggucagcaccu

SEQ ID NO: 433332 - RNA, 21 nt, Bordetella pertussis
agccuucuucugcaucggcau

SEQ ID NO: 433333 - RNA, 18 nt, Bordetella pertussis
agccuugcggcccuugcg

SEQ ID NO: 433334 - RNA, 20 nt, Bordetella pertussis
agccuugcucgcggauuugc

SEQ ID NO: 433335 - RNA, 14 nt, Bordetella pertussis
agcgaacagggcgc

SEQ ID NO: 433336 - RNA, 19 nt, Bordetella pertussis
agcgaaccgaauuccggcu

SEQ ID NO: 433337 - RNA, 19 nt, Bordetella pertussis
agcgaacggcccacgcugu

SEQ ID NO: 433338 - RNA, 15 nt, Bordetella pertussis
agcgacagcacgguc

SEQ ID NO: 433339 - RNA, 13 nt, Bordetella pertussis
agcgacaucgugc

SEQ ID NO: 433340 - RNA, 22 nt, Bordetella pertussis
agcgaccgcggcgguccugcug

SEQ ID NO: 433341 - RNA, 22 nt, Bordetella pertussis
agcgacgacuugaucagggcca

SEQ ID NO: 433342 - RNA, 14 nt, Bordetella pertussis
agcgcaccauggcg

SEQ ID NO: 433343 - RNA, 15 nt, Bordetella pertussis
agcgcacgcaccgcg

SEQ ID NO: 433344 - RNA, 21 nt, Bordetella pertussis
agcgcacgcaccgcgccagcg

SEQ ID NO: 433345 - RNA, 23 nt, Bordetella pertussis
agcgcagcaccggcagauggugc

SEQ ID NO: 433346 - RNA, 14 nt, Bordetella pertussis
agcgcagcaccagg

SEQ ID NO: 433347 - RNA, 15 nt, Bordetella pertussis
agcgcagccacggga

SEQ ID NO: 433348 - RNA, 14 nt, Bordetella pertussis
agcgcagccccguu

SEQ ID NO: 433349 - RNA, 12 nt, Bordetella pertussis
agcgcaggaugg

SEQ ID NO: 433350 - RNA, 15 nt, Bordetella pertussis
agcgcaggcgcuuga

SEQ ID NO: 433351 - RNA, 13 nt, Bordetella pertussis
agcgccaccagca

SEQ ID NO: 433352 - RNA, 15 nt, Bordetella pertussis
agcgccaccagcagc

SEQ ID NO: 433353 - RNA, 21 nt, Bordetella pertussis
agcgcccaggcgaugcccagc

SEQ ID NO: 433354 - RNA, 21 nt, Bordetella pertussis
agcgccgccagcauggcggcc

SEQ ID NO: 433355 - RNA, 17 nt, Bordetella pertussis
agcgccgccauggcggc

SEQ ID NO: 433356 - RNA, 23 nt, Bordetella pertussis
agcgccgccaggccgucgagcac

SEQ ID NO: 433357 - RNA, 16 nt, Bordetella pertussis
agcgccgccgccaugg

SEQ ID NO: 433358 - RNA, 15 nt, Bordetella pertussis
agcgccgccgccggu

SEQ ID NO: 433359 - RNA, 16 nt, Bordetella pertussis
agcgccgcgcgcucgg

SEQ ID NO: 433360 - RNA, 17 nt, Bordetella pertussis
agcgccgcgcgcucgga

SEQ ID NO: 433361 - RNA, 18 nt, Bordetella pertussis
agcgccgcggccacgccc

SEQ ID NO: 433362 - RNA, 18 nt, Bordetella pertussis
agcgccggcacgcugacc

SEQ ID NO: 433363 - RNA, 20 nt, Bordetella pertussis
agcgccggcagccccagcgc

SEQ ID NO: 433364 - RNA, 22 nt, Bordetella pertussis
agcgccggcaugaagcgcagca

SEQ ID NO: 433365 - RNA, 19 nt, Bordetella pertussis
agcgccgggcgccgcgccc

SEQ ID NO: 433366 - RNA, 21 nt, Bordetella pertussis
agcgccgggcgccgcgcccca

SEQ ID NO: 433367 - RNA, 12 nt, Bordetella pertussis
agcgccggggcg

SEQ ID NO: 433368 - RNA, 19 nt, Bordetella pertussis
agcgccgucucgugccccg

SEQ ID NO: 433369 - RNA, 18 nt, Bordetella pertussis
agcgcgacgaagccggaa

SEQ ID NO: 433370 - RNA, 15 nt, Bordetella pertussis
agcgcgcaacuccag

SEQ ID NO: 433371 - RNA, 14 nt, Bordetella pertussis
agcgcgccagcaga

SEQ ID NO: 433372 - RNA, 15 nt, Bordetella pertussis
agcgcgccagcagcg

SEQ ID NO: 433373 - RNA, 20 nt, Bordetella pertussis
agcgcgcggccggccgcgcc

SEQ ID NO: 433374 - RNA, 23 nt, Bordetella pertussis
agcgcgcgggcgauggccacgcg

SEQ ID NO: 433375 - RNA, 20 nt, Bordetella pertussis
agcgcgcguccugcgccagu

SEQ ID NO: 433376 - RNA, 15 nt, Bordetella pertussis
agcgcggcacgcugc

SEQ ID NO: 433377 - RNA, 22 nt, Bordetella pertussis
agcgcggcauagcccaggccgc

SEQ ID NO: 433378 - RNA, 21 nt, Bordetella pertussis
agcgcggcaucggccauggcg

SEQ ID NO: 433379 - RNA, 23 nt, Bordetella pertussis
agcgcggcuugguugucgcgcac

SEQ ID NO: 433380 - RNA, 20 nt, Bordetella pertussis
agcgcgggccgccgcacagc

SEQ ID NO: 433381 - RNA, 22 nt, Bordetella pertussis
agcgcgggccgccgcacagcgu

SEQ ID NO: 433382 - RNA, 15 nt, Bordetella pertussis
agcgcgguggccgcu

SEQ ID NO: 433383 - RNA, 12 nt, Bordetella pertussis
agcgcuccagcg

SEQ ID NO: 433384 - RNA, 13 nt, Bordetella pertussis
agcgcuccagcgu

SEQ ID NO: 433385 - RNA, 22 nt, Bordetella pertussis
agcgcuccagcgucauggccug

SEQ ID NO: 433386 - RNA, 16 nt, Bordetella pertussis
agcgcucggccacgcu

SEQ ID NO: 433387 - RNA, 18 nt, Bordetella pertussis
agcgcucgucggggugga

SEQ ID NO: 433388 - RNA, 13 nt, Bordetella pertussis
agcgcugcgccaa

SEQ ID NO: 433389 - RNA, 20 nt, Bordetella pertussis
agcgcuggcccgucaugggc

SEQ ID NO: 433390 - RNA, 19 nt, Bordetella pertussis
agcgcugggcgccagcagc

SEQ ID NO: 433391 - RNA, 13 nt, Bordetella pertussis
agcgcugguucga

SEQ ID NO: 433392 - RNA, 15 nt, Bordetella pertussis
agcgcuguccaggcc

SEQ ID NO: 433393 - RNA, 24 nt, Bordetella pertussis
agcgcuugccugacgugcgccaca

SEQ ID NO: 433394 - RNA, 15 nt, Bordetella pertussis
agcggaaacgcgcgc

SEQ ID NO: 433395 - RNA, 21 nt, Bordetella pertussis
agcggcaaaguagugccccca

SEQ ID NO: 433396 - RNA, 22 nt, Bordetella pertussis
agcggcaaaguagugcccccac

SEQ ID NO: 433397 - RNA, 13 nt, Bordetella pertussis
agcggcagcagcg

SEQ ID NO: 433398 - RNA, 13 nt, Bordetella pertussis
agcggcagcgcac

SEQ ID NO: 433399 - RNA, 13 nt, Bordetella pertussis
agcggcagcaugg

SEQ ID NO: 433400 - RNA, 14 nt, Bordetella pertussis
agcggcaggcggcu

SEQ ID NO: 433401 - RNA, 18 nt, Bordetella pertussis
agcggcaggcuggccggc

SEQ ID NO: 433402 - RNA, 16 nt, Bordetella pertussis
agcggcaggucgggua

SEQ ID NO: 433403 - RNA, 14 nt, Bordetella pertussis
agcggcgacggcgc

SEQ ID NO: 433404 - RNA, 16 nt, Bordetella pertussis
agcggcgacggcgccu

SEQ ID NO: 433405 - RNA, 20 nt, Bordetella pertussis
agcggcgccggaucggccgg

SEQ ID NO: 433406 - RNA, 19 nt, Bordetella pertussis
agcggucaaugaagggcug

SEQ ID NO: 433407 - RNA, 12 nt, Bordetella pertussis
agcgguccagcu

SEQ ID NO: 433408 - RNA, 20 nt, Bordetella pertussis
agcgguccagcugcgcgcga

SEQ ID NO: 433409 - RNA, 18 nt, Bordetella pertussis
agcgguccggggcgggcg

SEQ ID NO: 433410 - RNA, 14 nt, Bordetella pertussis
agcggugcaggggc

SEQ ID NO: 433411 - RNA, 15 nt, Bordetella pertussis
agcgguggcgggcca

SEQ ID NO: 433412 - RNA, 17 nt, Bordetella pertussis
agcgguggcgggccagc

SEQ ID NO: 433413 - RNA, 15 nt, Bordetella pertussis
agcgguggcggccgu

SEQ ID NO: 433414 - RNA, 23 nt, Bordetella pertussis
agcguauuccccuucucggccgu

SEQ ID NO: 433415 - RNA, 19 nt, Bordetella pertussis
agcgucggcguaaggccgc

SEQ ID NO: 433416 - RNA, 14 nt, Bordetella pertussis
agcgucucgaucac

SEQ ID NO: 433417 - RNA, 19 nt, Bordetella pertussis
agcuccucggccugccggc

SEQ ID NO: 433418 - RNA, 13 nt, Bordetella pertussis
agcuccuugacca

SEQ ID NO: 433419 - RNA, 18 nt, Bordetella pertussis
agcuccuugaccaguucg

SEQ ID NO: 433420 - RNA, 22 nt, Bordetella pertussis
agcucgaccaucauggccaggg

SEQ ID NO: 433421 - RNA, 19 nt, Bordetella pertussis
agcucgaccgucagcaugc

SEQ ID NO: 433422 - RNA, 20 nt, Bordetella pertussis
agcucgauggcuucgcgcac

SEQ ID NO: 433423 - RNA, 18 nt, Bordetella pertussis
agcucgcgccagggcccc

SEQ ID NO: 433424 - RNA, 21 nt, Bordetella pertussis
agcucgcgccagggccccucc

SEQ ID NO: 433425 - RNA, 15 nt, Bordetella pertussis
agcucggugcagccc

SEQ ID NO: 433426 - RNA, 20 nt, Bordetella pertussis
agcucgucggucagcucaag

SEQ ID NO: 433427 - RNA, 19 nt, Bordetella pertussis
agcucguguagggccuggc

SEQ ID NO: 433428 - RNA, 16 nt, Bordetella pertussis
agcucguugaccugcu

SEQ ID NO: 433429 - RNA, 20 nt, Bordetella pertussis
agcucucgaagaagcagccg

SEQ ID NO: 433430 - RNA, 18 nt, Bordetella pertussis
agcucucuccauggcagc

SEQ ID NO: 433431 - RNA, 16 nt, Bordetella pertussis
agcucugguccaggcg

SEQ ID NO: 433432 - RNA, 21 nt, Bordetella pertussis
agcucuuucuguaccagcaug

SEQ ID NO: 433433 - RNA, 18 nt, Bordetella pertussis
agcugaccucgcccaggc

SEQ ID NO: 433434 - RNA, 18 nt, Bordetella pertussis
agcugacgaaacgcgcgu

SEQ ID NO: 433435 - RNA, 18 nt, Bordetella pertussis
agcugagcaccagcagcc

SEQ ID NO: 433436 - RNA, 16 nt, Bordetella pertussis
agcugcacccacacuu

SEQ ID NO: 433437 - RNA, 22 nt, Bordetella pertussis
agcugcgcagcgacucgaacac

SEQ ID NO: 433438 - RNA, 16 nt, Bordetella pertussis
agcuggagaccggguu

SEQ ID NO: 433439 - RNA, 12 nt, Bordetella pertussis
agcuggccagcg

SEQ ID NO: 433440 - RNA, 16 nt, Bordetella pertussis
agcuggccggcgacuu

SEQ ID NO: 433441 - RNA, 18 nt, Bordetella pertussis
agcuggcgcaccaggcug

SEQ ID NO: 433442 - RNA, 13 nt, Bordetella pertussis
agcuggcgccggu

SEQ ID NO: 433443 - RNA, 16 nt, Bordetella pertussis
agcuggcgcgggcggc

SEQ ID NO: 433444 - RNA, 14 nt, Bordetella pertussis
agcuggcgcuuggc

SEQ ID NO: 433445 - RNA, 18 nt, Bordetella pertussis
agcuggcgcuuggccagc

SEQ ID NO: 433446 - RNA, 20 nt, Bordetella pertussis
agcuggcgcuuggccagcug

SEQ ID NO: 433447 - RNA, 20 nt, Bordetella pertussis
agcuggcggcgcagcaccag

SEQ ID NO: 433448 - RNA, 21 nt, Bordetella pertussis
agcuggcggcgcagcaccagg

SEQ ID NO: 433449 - RNA, 23 nt, Bordetella pertussis
agcuggcggcgcagcaccaggcu

SEQ ID NO: 433450 - RNA, 15 nt, Bordetella pertussis
agcuggcggcgcgcu

SEQ ID NO: 433451 - RNA, 13 nt, Bordetella pertussis
agcuggcgcugcu

SEQ ID NO: 433452 - RNA, 16 nt, Bordetella pertussis
agcugggcaugcacga

SEQ ID NO: 433453 - RNA, 19 nt, Bordetella pertussis
agcuucuugaacucggcca

SEQ ID NO: 433454 - RNA, 21 nt, Bordetella pertussis
agcuucuugaacucggccagc

SEQ ID NO: 433455 - RNA, 14 nt, Bordetella pertussis
agcuugaccgccag

SEQ ID NO: 433456 - RNA, 18 nt, Bordetella pertussis
agcuugcgucccaccugc

SEQ ID NO: 433457 - RNA, 14 nt, Bordetella pertussis
agcuuggccaggcu

SEQ ID NO: 433458 - RNA, 21 nt, Bordetella pertussis
agcuuggccaggcugucccag

SEQ ID NO: 433459 - RNA, 21 nt, Bordetella pertussis
agcuuggccugcggaugcagg

SEQ ID NO: 433460 - RNA, 14 nt, Bordetella pertussis
aggaccaggaugau

SEQ ID NO: 433461 - RNA, 16 nt, Bordetella pertussis
aggaccgcgaugcugc

SEQ ID NO: 433462 - RNA, 23 nt, Bordetella pertussis
aggaccgcgccgccgcgcccugg

SEQ ID NO: 433463 - RNA, 18 nt, Bordetella pertussis
aggaccuguggcgcaccc

SEQ ID NO: 433464 - RNA, 23 nt, Bordetella pertussis
aggacgccgaccucggcaccgag

SEQ ID NO: 433465 - RNA, 22 nt, Bordetella pertussis
aggacgccggcgccggcgacgc

SEQ ID NO: 433466 - RNA, 15 nt, Bordetella pertussis
aggacggcagcaccg

SEQ ID NO: 433467 - RNA, 18 nt, Bordetella pertussis
aggacggggaacaggcgc

SEQ ID NO: 433468 - RNA, 14 nt, Bordetella pertussis
aggacguccaggcc

SEQ ID NO: 433469 - RNA, 23 nt, Bordetella pertussis
aggagguggcuggugccaguccc

SEQ ID NO: 433470 - RNA, 20 nt, Bordetella pertussis
aggauccagccaccaugucc

SEQ ID NO: 433471 - RNA, 22 nt, Bordetella pertussis
aggaucccuacgaguaccgccg

SEQ ID NO: 433472 - RNA, 20 nt, Bordetella pertussis
aggaucgucgucaugaugua

SEQ ID NO: 433473 - RNA, 17 nt, Bordetella pertussis
aggaucuggccggcgcu

SEQ ID NO: 433474 - RNA, 22 nt, Bordetella pertussis
aggaugaagaccacguggauga

SEQ ID NO: 433475 - RNA, 15 nt, Bordetella pertussis
aggaugaugcagcac

SEQ ID NO: 433476 - RNA, 16 nt, Bordetella pertussis
aggaugcccgcgggca

SEQ ID NO: 433477 - RNA, 22 nt, Bordetella pertussis
aggaugcccuggguggcggggc

SEQ ID NO: 433478 - RNA, 16 nt, Bordetella pertussis
aggaugcgcgcggcca

SEQ ID NO: 433479 - RNA, 18 nt, Bordetella pertussis
aggaugggcgcuuggccc

SEQ ID NO: 433480 - RNA, 19 nt, Bordetella pertussis
aggaugggcgcuuggcccu

SEQ ID NO: 433481 - RNA, 19 nt, Bordetella pertussis
aggauguucaugaccgccg

SEQ ID NO: 433482 - RNA, 21 nt, Bordetella pertussis
aggcaaagcgcggcugcgggc

SEQ ID NO: 433483 - RNA, 17 nt, Bordetella pertussis
aggcaaaggcccaggca

SEQ ID NO: 433484 - RNA, 20 nt, Bordetella pertussis
aggcacaaggccgaggugga

SEQ ID NO: 433485 - RNA, 14 nt, Bordetella pertussis
aggcagauccgccg

SEQ ID NO: 433486 - RNA, 23 nt, Bordetella pertussis
aggcagcaaccggaacaccagca

SEQ ID NO: 433487 - RNA, 21 nt, Bordetella pertussis
aggcaggcgcgccgggccggc

SEQ ID NO: 433488 - RNA, 17 nt, Bordetella pertussis
aggcaggcgggcccgca

SEQ ID NO: 433489 - RNA, 17 nt, Bordetella pertussis
aggcaggggcuccagga

SEQ ID NO: 433490 - RNA, 18 nt, Bordetella pertussis
aggccagcagcucggcca

SEQ ID NO: 433491 - RNA, 17 nt, Bordetella pertussis
aggccagcgccgcggcc

SEQ ID NO: 433492 - RNA, 16 nt, Bordetella pertussis
aggccagcgugcccag

SEQ ID NO: 433493 - RNA, 17 nt, Bordetella pertussis
aggccagcgugcccagc

SEQ ID NO: 433494 - RNA, 18 nt, Bordetella pertussis
aggccagcgugcccagcg

SEQ ID NO: 433495 - RNA, 14 nt, Bordetella pertussis
aggccaggcucagc

SEQ ID NO: 433496 - RNA, 19 nt, Bordetella pertussis
aggccagggagugcgagga

SEQ ID NO: 433497 - RNA, 12 nt, Bordetella pertussis
aggccaggcccu

SEQ ID NO: 433498 - RNA, 20 nt, Bordetella pertussis
aggccagguucuggucgaac

SEQ ID NO: 433499 - RNA, 16 nt, Bordetella pertussis
aggccaugcugggcca

SEQ ID NO: 433500 - RNA, 17 nt, Bordetella pertussis
aggcccggccgcagggc

SEQ ID NO: 433501 - RNA, 11 nt, Bordetella pertussis
aggcccggcgc

SEQ ID NO: 433502 - RNA, 17 nt, Bordetella pertussis
aggcccuugaucaggcg

SEQ ID NO: 433503 - RNA, 16 nt, Bordetella pertussis
aggccgaaccacagca

SEQ ID NO: 433504 - RNA, 17 nt, Bordetella pertussis
aggccgaaccacagcau

SEQ ID NO: 433505 - RNA, 19 nt, Bordetella pertussis
aggccgaacugggacaggc

SEQ ID NO: 433506 - RNA, 20 nt, Bordetella pertussis
aggccgaacuucagcccggg

SEQ ID NO: 433507 - RNA, 18 nt, Bordetella pertussis
aggccgccgcgcccagca

SEQ ID NO: 433508 - RNA, 21 nt, Bordetella pertussis
aggccgccgcgcccagcagcg

SEQ ID NO: 433509 - RNA, 23 nt, Bordetella pertussis
aggccgccgcgugcgccgggcug

SEQ ID NO: 433510 - RNA, 10 nt, Bordetella pertussis
aggccgccgg

SEQ ID NO: 433511 - RNA, 15 nt, Bordetella pertussis
aggccgccggccacc

SEQ ID NO: 433512 - RNA, 16 nt, Bordetella pertussis
aggccgccggcggcgu

SEQ ID NO: 433513 - RNA, 17 nt, Bordetella pertussis
aggccgcgccacaggcg

SEQ ID NO: 433514 - RNA, 18 nt, Bordetella pertussis
aggccgcgccacaggcgc

SEQ ID NO: 433515 - RNA, 15 nt, Bordetella pertussis
aggccgcgcgcaucc

SEQ ID NO: 433516 - RNA, 17 nt, Bordetella pertussis
aggccgcgcuggugcug

SEQ ID NO: 433517 - RNA, 15 nt, Bordetella pertussis
aggccgcggccaggc

SEQ ID NO: 433518 - RNA, 23 nt, Bordetella pertussis
aggccgcuucgugcggccgcagc

SEQ ID NO: 433519 - RNA, 13 nt, Bordetella pertussis
aggccggccagca

SEQ ID NO: 433520 - RNA, 15 nt, Bordetella pertussis
aggccggccagcaag

SEQ ID NO: 433521 - RNA, 17 nt, Bordetella pertussis
aggccggcccgccccac

SEQ ID NO: 433522 - RNA, 22 nt, Bordetella pertussis
aggccggcgauggacacgauga

SEQ ID NO: 433523 - RNA, 19 nt, Bordetella pertussis
aggccggcgcgcucggccu

SEQ ID NO: 433524 - RNA, 12 nt, Bordetella pertussis
aggcggccaggc

SEQ ID NO: 433525 - RNA, 13 nt, Bordetella pertussis
aggcggccaggcc

SEQ ID NO: 433526 - RNA, 13 nt, Bordetella pertussis
aggcggccaggcu

SEQ ID NO: 433527 - RNA, 23 nt, Bordetella pertussis
aggcggccaggcucugggcggag

SEQ ID NO: 433528 - RNA, 18 nt, Bordetella pertussis
aggcggccagggccugcg

SEQ ID NO: 433529 - RNA, 17 nt, Bordetella pertussis
aggcggccagcaugcug

SEQ ID NO: 433530 - RNA, 23 nt, Bordetella pertussis
aggcggccggcaggccggccagc

SEQ ID NO: 433531 - RNA, 17 nt, Bordetella pertussis
aggcggccgcgggcggc

SEQ ID NO: 433532 - RNA, 22 nt, Bordetella pertussis
aggcggcggccggggccgcccu

SEQ ID NO: 433533 - RNA, 20 nt, Bordetella pertussis
aggcggcguaguucagccac

SEQ ID NO: 433534 - RNA, 17 nt, Bordetella pertussis
aggcggcugcccaccuu

SEQ ID NO: 433535 - RNA, 22 nt, Bordetella pertussis
aggcggcuggugccgacggcgc

SEQ ID NO: 433536 - RNA, 13 nt, Bordetella pertussis
aggcgggacuggc

SEQ ID NO: 433537 - RNA, 17 nt, Bordetella pertussis
aggcgggcaucgcccac

SEQ ID NO: 433538 - RNA, 21 nt, Bordetella pertussis
aggcgggcgcggcauggcgcc

SEQ ID NO: 433539 - RNA, 12 nt, Bordetella pertussis
aggcgggcuggu

SEQ ID NO: 433540 - RNA, 21 nt, Bordetella pertussis
aggcgggguggcacagccgca

SEQ ID NO: 433541 - RNA, 18 nt, Bordetella pertussis
aggcggugcggaggcggc

SEQ ID NO: 433542 - RNA, 15 nt, Bordetella pertussis
aggcgguggccagcg

SEQ ID NO: 433543 - RNA, 15 nt, Bordetella pertussis
aggcguccaggcugc

SEQ ID NO: 433544 - RNA, 15 nt, Bordetella pertussis
aggcgucggccagcg

SEQ ID NO: 433545 - RNA, 17 nt, Bordetella pertussis
aggcgucggccauggcg

SEQ ID NO: 433546 - RNA, 18 nt, Bordetella pertussis
aggcgucggcggcccaca

SEQ ID NO: 433547 - RNA, 15 nt, Bordetella pertussis
aggcgucgggcacgu

SEQ ID NO: 433548 - RNA, 16 nt, Bordetella pertussis
aggcgugccgcgcagg

SEQ ID NO: 433549 - RNA, 16 nt, Bordetella pertussis
aggcgugcgcagcugu

SEQ ID NO: 433550 - RNA, 15 nt, Bordetella pertussis
aggcgugcgcgggcg

SEQ ID NO: 433551 - RNA, 15 nt, Bordetella pertussis
aggcgugcugcaccu

SEQ ID NO: 433552 - RNA, 21 nt, Bordetella pertussis
aggcguucggccacuuccugg

SEQ ID NO: 433553 - RNA, 18 nt, Bordetella pertussis
aggcguugcgccgcaacg

SEQ ID NO: 433554 - RNA, 19 nt, Bordetella pertussis
aggcguugcgccgcaacgc

SEQ ID NO: 433555 - RNA, 18 nt, Bordetella pertussis
aggcguuucgccaggacg

SEQ ID NO: 433556 - RNA, 15 nt, Bordetella pertussis
aggcucagcgggcug

SEQ ID NO: 433557 - RNA, 18 nt, Bordetella pertussis
aggcucaggcggccaggg

SEQ ID NO: 433558 - RNA, 18 nt, Bordetella pertussis
aggcucccgcuggcggca

SEQ ID NO: 433559 - RNA, 13 nt, Bordetella pertussis
aggcucuugacca

SEQ ID NO: 433560 - RNA, 22 nt, Bordetella pertussis
aggcucuuuuucccggcgcgga

SEQ ID NO: 433561 - RNA, 20 nt, Bordetella pertussis
aggcucuuuuucgagccgca

SEQ ID NO: 433562 - RNA, 22 nt, Bordetella pertussis
aggcucuuuuucgagccgcaga

SEQ ID NO: 433563 - RNA, 17 nt, Bordetella pertussis
aggcugaaugccgccgu

SEQ ID NO: 433564 - RNA, 19 nt, Bordetella pertussis
aggcugaaggggcuccccu

SEQ ID NO: 433565 - RNA, 22 nt, Bordetella pertussis
aggcugacgcccggcucgcugu

SEQ ID NO: 433566 - RNA, 19 nt, Bordetella pertussis
aggcugaucacccacagca

SEQ ID NO: 433567 - RNA, 20 nt, Bordetella pertussis
aggcugaucacccacagcag

SEQ ID NO: 433568 - RNA, 19 nt, Bordetella pertussis
aggcugcccuggcccaggc

SEQ ID NO: 433569 - RNA, 12 nt, Bordetella pertussis
aggcugccggcg

SEQ ID NO: 433570 - RNA, 18 nt, Bordetella pertussis
aggcugcgcaggcgccgc

SEQ ID NO: 433571 - RNA, 16 nt, Bordetella pertussis
aggcugcgcgccggcg

SEQ ID NO: 433572 - RNA, 22 nt, Bordetella pertussis
aggcugcgcgucggcaggugca

SEQ ID NO: 433573 - RNA, 17 nt, Bordetella pertussis
aggcugcggcggauuca

SEQ ID NO: 433574 - RNA, 14 nt, Bordetella pertussis
aggcugcugugccu

SEQ ID NO: 433575 - RNA, 17 nt, Bordetella pertussis
aggcuggaagucagccg

SEQ ID NO: 433576 - RNA, 18 nt, Bordetella pertussis
aggcuggacccggagcug

SEQ ID NO: 433577 - RNA, 17 nt, Bordetella pertussis
aggcuggagucgggcug

SEQ ID NO: 433578 - RNA, 18 nt, Bordetella pertussis
aggcuggagucgggcugc

SEQ ID NO: 433579 - RNA, 22 nt, Bordetella pertussis
aggcuggccaccgaagcggcgu

SEQ ID NO: 433580 - RNA, 13 nt, Bordetella pertussis
aggcuggccggcg

SEQ ID NO: 433581 - RNA, 13 nt, Bordetella pertussis
aggcugggagagc

SEQ ID NO: 433582 - RNA, 23 nt, Bordetella pertussis
aggcugggagagccggccacgcg

SEQ ID NO: 433583 - RNA, 21 nt, Bordetella pertussis
aggcugggcgaaacggccagc

SEQ ID NO: 433584 - RNA, 20 nt, Bordetella pertussis
aggcugucccagauggcgcc

SEQ ID NO: 433585 - RNA, 20 nt, Bordetella pertussis
aggcugucgucgucggcacc

SEQ ID NO: 433586 - RNA, 20 nt, Bordetella pertussis
aggcuguggccgcggcccag

SEQ ID NO: 433587 - RNA, 22 nt, Bordetella pertussis
agggcagauugaugcccaugcg

SEQ ID NO: 433588 - RNA, 19 nt, Bordetella pertussis
agggcaggaggcgcgggca

SEQ ID NO: 433589 - RNA, 13 nt, Bordetella pertussis
agggcaugggccc

SEQ ID NO: 433590 - RNA, 21 nt, Bordetella pertussis
agggccggacuggcgcgcacc

SEQ ID NO: 433591 - RNA, 21 nt, Bordetella pertussis
agggccgugcccgagggcgcg

SEQ ID NO: 433592 - RNA, 20 nt, Bordetella pertussis
agggccucgcgggccuuggc

SEQ ID NO: 433593 - RNA, 22 nt, Bordetella pertussis
agggccucgcgggccuuggcca

SEQ ID NO: 433594 - RNA, 13 nt, Bordetella pertussis
agggccuccugca

SEQ ID NO: 433595 - RNA, 19 nt, Bordetella pertussis
agggccugcgggccgggca

SEQ ID NO: 433596 - RNA, 15 nt, Bordetella pertussis
agggccuggaagcug

SEQ ID NO: 433597 - RNA, 19 nt, Bordetella pertussis
agggccuggucagcgccga

SEQ ID NO: 433598 - RNA, 19 nt, Bordetella pertussis
agggcgaacguggccugcu

SEQ ID NO: 433599 - RNA, 16 nt, Bordetella pertussis
agggcgacggcggcgu

SEQ ID NO: 433600 - RNA, 18 nt, Bordetella pertussis
agggcgaucagcaccgcg

SEQ ID NO: 433601 - RNA, 13 nt, Bordetella pertussis
agggcgccgggcg

SEQ ID NO: 433602 - RNA, 14 nt, Bordetella pertussis
agggcgcgccagca

SEQ ID NO: 433603 - RNA, 14 nt, Bordetella pertussis
agggcgcgcagcag

SEQ ID NO: 433604 - RNA, 16 nt, Bordetella pertussis
agggcgcgcagcaggc

SEQ ID NO: 433605 - RNA, 12 nt, Bordetella pertussis
agggcgcggacu

SEQ ID NO: 433606 - RNA, 15 nt, Bordetella pertussis
agggcgcggccaggg

SEQ ID NO: 433607 - RNA, 15 nt, Bordetella pertussis
agggcggaaaacagc

SEQ ID NO: 433608 - RNA, 20 nt, Bordetella pertussis
aggggacggcgcacccgcgg

SEQ ID NO: 433609 - RNA, 23 nt, Bordetella pertussis
aggggaugcgguuuuugaggacc

SEQ ID NO: 433610 - RNA, 17 nt, Bordetella pertussis
aggggauugccgcgcgg

SEQ ID NO: 433611 - RNA, 19 nt, Bordetella pertussis
agggggacuggcaccggca

SEQ ID NO: 433612 - RNA, 14 nt, Bordetella pertussis
agggggcgccccaa

SEQ ID NO: 433613 - RNA, 22 nt, Bordetella pertussis
agggggcgccccaacgcggcca

SEQ ID NO: 433614 - RNA, 21 nt, Bordetella pertussis
agggggcuuuuugccuugggg

SEQ ID NO: 433615 - RNA, 21 nt, Bordetella pertussis
agggggcuuuuuugccuuggg

SEQ ID NO: 433616 - RNA, 14 nt, Bordetella pertussis
aggggggcgguuca

SEQ ID NO: 433617 - RNA, 18 nt, Bordetella pertussis
agggguccguggcggccg

SEQ ID NO: 433618 - RNA, 13 nt, Bordetella pertussis
agggucaaggcgc

SEQ ID NO: 433619 - RNA, 15 nt, Bordetella pertussis
agggucuggcggccg

SEQ ID NO: 433620 - RNA, 15 nt, Bordetella pertussis
agggugucgccgggg

SEQ ID NO: 433621 - RNA, 16 nt, Bordetella pertussis
agggugucggccaggg

SEQ ID NO: 433622 - RNA, 22 nt, Bordetella pertussis
agggugucggccagggcggcga

SEQ ID NO: 433623 - RNA, 21 nt, Bordetella pertussis
aggguuguccgaaccacccgg

SEQ ID NO: 433624 - RNA, 18 nt, Bordetella pertussis
aggguuguggccguggcg

SEQ ID NO: 433625 - RNA, 19 nt, Bordetella pertussis
aggucagcaugaagcugcc

SEQ ID NO: 433626 - RNA, 15 nt, Bordetella pertussis
aggucagcccggcgg

SEQ ID NO: 433627 - RNA, 19 nt, Bordetella pertussis
aggucaggcccacgccgcc

SEQ ID NO: 433628 - RNA, 21 nt, Bordetella pertussis
aggucaggcccacgccgccga

SEQ ID NO: 433629 - RNA, 18 nt, Bordetella pertussis
agguccugcacgcgggcc

SEQ ID NO: 433630 - RNA, 19 nt, Bordetella pertussis
agguccugcacgcgggcca

SEQ ID NO: 433631 - RNA, 13 nt, Bordetella pertussis
agguccugcucgg

SEQ ID NO: 433632 - RNA, 22 nt, Bordetella pertussis
agguccuggcggccgcccagca

SEQ ID NO: 433633 - RNA, 14 nt, Bordetella pertussis
aggucugcacgagg

SEQ ID NO: 433634 - RNA, 17 nt, Bordetella pertussis
aggucugggccagcagg

SEQ ID NO: 433635 - RNA, 18 nt, Bordetella pertussis
aggucugggccagcaggc

SEQ ID NO: 433636 - RNA, 21 nt, Bordetella pertussis
aggucuuggcgugcaggcugg

SEQ ID NO: 433637 - RNA, 16 nt, Bordetella pertussis
aggugaaacagcagcg

SEQ ID NO: 433638 - RNA, 21 nt, Bordetella pertussis
aggugccagccuguugcagga

SEQ ID NO: 433639 - RNA, 15 nt, Bordetella pertussis
aggugccgccggcgc

SEQ ID NO: 433640 - RNA, 20 nt, Bordetella pertussis
aggugccggcggugaugacg

SEQ ID NO: 433641 - RNA, 14 nt, Bordetella pertussis
aggugccuguccca

SEQ ID NO: 433642 - RNA, 21 nt, Bordetella pertussis
aggugccugucccagcgggga

SEQ ID NO: 433643 - RNA, 19 nt, Bordetella pertussis
aggugccuguccccacggg

SEQ ID NO: 433644 - RNA, 21 nt, Bordetella pertussis
aggugccuguccccccauggg

SEQ ID NO: 433645 - RNA, 22 nt, Bordetella pertussis
aggugccuguccccgcggggac

SEQ ID NO: 433646 - RNA, 19 nt, Bordetella pertussis
aggugcgcagccgggcugc

SEQ ID NO: 433647 - RNA, 13 nt, Bordetella pertussis
aggugcgccagca

SEQ ID NO: 433648 - RNA, 15 nt, Bordetella pertussis
aggugcgucacgcac

SEQ ID NO: 433649 - RNA, 22 nt, Bordetella pertussis
aggugcgucacgcacagcaccu

SEQ ID NO: 433650 - RNA, 14 nt, Bordetella pertussis
agguggcggacagg

SEQ ID NO: 433651 - RNA, 15 nt, Bordetella pertussis
agguggcggacaggc

SEQ ID NO: 433652 - RNA, 19 nt, Bordetella pertussis
agguggcggacaggcccuc

SEQ ID NO: 433653 - RNA, 21 nt, Bordetella pertussis
agguggcggacaggcccucgg

SEQ ID NO: 433654 - RNA, 14 nt, Bordetella pertussis
agguggcgugcagc

SEQ ID NO: 433655 - RNA, 12 nt, Bordetella pertussis
aggugggcgcgc

SEQ ID NO: 433656 - RNA, 20 nt, Bordetella pertussis
agguggggcagcaggccggc

SEQ ID NO: 433657 - RNA, 22 nt, Bordetella pertussis
agguggggcagcaggccggcgg

SEQ ID NO: 433658 - RNA, 22 nt, Bordetella pertussis
aggugucgccccccaugccgga

SEQ ID NO: 433659 - RNA, 14 nt, Bordetella pertussis
agguucgccuggcg

SEQ ID NO: 433660 - RNA, 15 nt, Bordetella pertussis
agguucgccuggcgg

SEQ ID NO: 433661 - RNA, 22 nt, Bordetella pertussis
agguucucgauguggcgcuggc

SEQ ID NO: 433662 - RNA, 17 nt, Bordetella pertussis
agguuuuccacagccag

SEQ ID NO: 433663 - RNA, 12 nt, Bordetella pertussis
aguacagcagca

SEQ ID NO: 433664 - RNA, 13 nt, Bordetella pertussis
aguacagcagcag

SEQ ID NO: 433665 - RNA, 14 nt, Bordetella pertussis
aguacagcuugaga

SEQ ID NO: 433666 - RNA, 19 nt, Bordetella pertussis
aguacauauucacagccau

SEQ ID NO: 433667 - RNA, 22 nt, Bordetella pertussis
aguacugcguucgggacgcagg

SEQ ID NO: 433668 - RNA, 19 nt, Bordetella pertussis
aguagaacucgccaggucc

SEQ ID NO: 433669 - RNA, 21 nt, Bordetella pertussis
aguagaaguaggcggccaggc

SEQ ID NO: 433670 - RNA, 22 nt, Bordetella pertussis
aguagaaguaggcggccaggcc

SEQ ID NO: 433671 - RNA, 13 nt, Bordetella pertussis
agucagcccgcgu

SEQ ID NO: 433672 - RNA, 19 nt, Bordetella pertussis
agucagccggugccagucc

SEQ ID NO: 433673 - RNA, 14 nt, Bordetella pertussis
agucaggaaaaucg

SEQ ID NO: 433674 - RNA, 15 nt, Bordetella pertussis
agucauguagcggcc

SEQ ID NO: 433675 - RNA, 11 nt, Bordetella pertussis
aguccagcacc

SEQ ID NO: 433676 - RNA, 20 nt, Bordetella pertussis
aguccccauguggggacagg

SEQ ID NO: 433677 - RNA, 19 nt, Bordetella pertussis
agucccccgcggggacaga

SEQ ID NO: 433678 - RNA, 19 nt, Bordetella pertussis
aguccccugcggggacagg

SEQ ID NO: 433679 - RNA, 23 nt, Bordetella pertussis
aguccccugcggggacaggcacc

SEQ ID NO: 433680 - RNA, 13 nt, Bordetella pertussis
aguccgacaggca

SEQ ID NO: 433681 - RNA, 19 nt, Bordetella pertussis
aguccgaaucuucgaugcg

SEQ ID NO: 433682 - RNA, 18 nt, Bordetella pertussis
aguccugguuggccucgc

SEQ ID NO: 433683 - RNA, 17 nt, Bordetella pertussis
agucgccgcgcccgcgg

SEQ ID NO: 433684 - RNA, 14 nt, Bordetella pertussis
agucgucgaaggcg

SEQ ID NO: 433685 - RNA, 18 nt, Bordetella pertussis
agucgucgauggcccgca

SEQ ID NO: 433686 - RNA, 17 nt, Bordetella pertussis
agucguugccggccagc

SEQ ID NO: 433687 - RNA, 24 nt, Bordetella pertussis
agucguugccggccagcacgggcg

SEQ ID NO: 433688 - RNA, 22 nt, Bordetella pertussis
agucuucuucagcauggagcug

SEQ ID NO: 433689 - RNA, 18 nt, Bordetella pertussis
aguguggcgcaccgcgcu

SEQ ID NO: 433690 - RNA, 16 nt, Bordetella pertussis
aguucagcagcucgca

SEQ ID NO: 433691 - RNA, 14 nt, Bordetella pertussis
aguucauccacagc

SEQ ID NO: 433692 - RNA, 15 nt, Bordetella pertussis
aguucgacgcccaug

SEQ ID NO: 433693 - RNA, 16 nt, Bordetella pertussis
aguucgcgcgccggca

SEQ ID NO: 433694 - RNA, 14 nt, Bordetella pertussis
aguucgcggccggc

SEQ ID NO: 433695 - RNA, 20 nt, Bordetella pertussis
aguugacccauaccagcccg

SEQ ID NO: 433696 - RNA, 14 nt, Bordetella pertussis
aguugacgaugccc

SEQ ID NO: 433697 - RNA, 16 nt, Bordetella pertussis
aguugacgaugcccag

SEQ ID NO: 433698 - RNA, 23 nt, Bordetella pertussis
aguugcgucuccagcgcggcgga

SEQ ID NO: 433699 - RNA, 14 nt, Bordetella pertussis
aguugcuggcggcc

SEQ ID NO: 433700 - RNA, 12 nt, Bordetella pertussis
aguuggccaggg

SEQ ID NO: 433701 - RNA, 19 nt, Bordetella pertussis
aguuggcggcgcagccgcc

SEQ ID NO: 433702 - RNA, 16 nt, Bordetella pertussis
aguugggcgccuugcc

SEQ ID NO: 433703 - RNA, 16 nt, Bordetella pertussis
aguugggcgcgcccag

SEQ ID NO: 433704 - RNA, 21 nt, Bordetella pertussis
aguugggcgcgcccagccccg

SEQ ID NO: 433705 - RNA, 14 nt, Bordetella pertussis
aguugguggcaggc

SEQ ID NO: 433706 - RNA, 18 nt, Bordetella pertussis
auaacgccacuugcaggc

SEQ ID NO: 433707 - RNA, 17 nt, Bordetella pertussis
auaaggcucaccucgcg

SEQ ID NO: 433708 - RNA, 18 nt, Bordetella pertussis
auacaugaguucuggcau

SEQ ID NO: 433709 - RNA, 17 nt, Bordetella pertussis
auacccgcuucgacggc

SEQ ID NO: 433710 - RNA, 18 nt, Bordetella pertussis
auaccgaaggaccaaguc

SEQ ID NO: 433711 - RNA, 15 nt, Bordetella pertussis
auaccgggcugguca

SEQ ID NO: 433712 - RNA, 16 nt, Bordetella pertussis
auaccgggcuggucag

SEQ ID NO: 433713 - RNA, 16 nt, Bordetella pertussis
auaccgucgcgcucga

SEQ ID NO: 433714 - RNA, 12 nt, Bordetella pertussis
auacggccacgc

SEQ ID NO: 433715 - RNA, 14 nt, Bordetella pertussis
auacguccuuuggc

SEQ ID NO: 433716 - RNA, 16 nt, Bordetella pertussis
auacguccuuuggcgu

SEQ ID NO: 433717 - RNA, 13 nt, Bordetella pertussis
auagaccagcagc

SEQ ID NO: 433718 - RNA, 13 nt, Bordetella pertussis
auagcccagcacc

SEQ ID NO: 433719 - RNA, 22 nt, Bordetella pertussis
auagcccagcaccugcaggccg

SEQ ID NO: 433720 - RNA, 17 nt, Bordetella pertussis
auagcccaggccgccgg

SEQ ID NO: 433721 - RNA, 16 nt, Bordetella pertussis
auagcccuugaucagc

SEQ ID NO: 433722 - RNA, 17 nt, Bordetella pertussis
auaggcggcgcaggcca

SEQ ID NO: 433723 - RNA, 19 nt, Bordetella pertussis
auagggccauggcagggcg

SEQ ID NO: 433724 - RNA, 21 nt, Bordetella pertussis
auagguuguauuuguccaggu

SEQ ID NO: 433725 - RNA, 13 nt, Bordetella pertussis
auaguccagcacc

SEQ ID NO: 433726 - RNA, 15 nt, Bordetella pertussis
auauagggccauggc

SEQ ID NO: 433727 - RNA, 18 nt, Bordetella pertussis
auauagggggcauggcgc

SEQ ID NO: 433728 - RNA, 16 nt, Bordetella pertussis
auauccacgccacugg

SEQ ID NO: 433729 - RNA, 21 nt, Bordetella pertussis
auaugggcggccucggccagc

SEQ ID NO: 433730 - RNA, 21 nt, Bordetella pertussis
aucaaaaaggcccuugagcaa

SEQ ID NO: 433731 - RNA, 21 nt, Bordetella pertussis
aucaacuuccagcgcccgcgg

SEQ ID NO: 433732 - RNA, 16 nt, Bordetella pertussis
aucacauaggccggca

SEQ ID NO: 433733 - RNA, 13 nt, Bordetella pertussis
aucaccaccggca

SEQ ID NO: 433734 - RNA, 16 nt, Bordetella pertussis
aucaccacgcccgcgc

SEQ ID NO: 433735 - RNA, 21 nt, Bordetella pertussis
aucaccagcccggcggugacc

SEQ ID NO: 433736 - RNA, 15 nt, Bordetella pertussis
aucacccacagcagc

SEQ ID NO: 433737 - RNA, 16 nt, Bordetella pertussis
aucacccagcggcugg

SEQ ID NO: 433738 - RNA, 18 nt, Bordetella pertussis
aucaccgagugggcggcc

SEQ ID NO: 433739 - RNA, 15 nt, Bordetella pertussis
aucaccugcaggccc

SEQ ID NO: 433740 - RNA, 22 nt, Bordetella pertussis
aucaccugcaggcccaccggca

SEQ ID NO: 433741 - RNA, 20 nt, Bordetella pertussis
aucaccugggccaucgggau

SEQ ID NO: 433742 - RNA, 19 nt, Bordetella pertussis
aucagcaagggccccagca

SEQ ID NO: 433743 - RNA, 21 nt, Bordetella pertussis
aucagcaccacggcggccagg

SEQ ID NO: 433744 - RNA, 23 nt, Bordetella pertussis
aucagcaccacggcggccaggcc

SEQ ID NO: 433745 - RNA, 12 nt, Bordetella pertussis
aucagcaggccc

SEQ ID NO: 433746 - RNA, 19 nt, Bordetella pertussis
aucagccccugccaugccc

SEQ ID NO: 433747 - RNA, 20 nt, Bordetella pertussis
aucagcggauugaccagcgc

SEQ ID NO: 433748 - RNA, 16 nt, Bordetella pertussis
aucagcgugccgccgg

SEQ ID NO: 433749 - RNA, 20 nt, Bordetella pertussis
aucaggaggaacaggaugcg

SEQ ID NO: 433750 - RNA, 20 nt, Bordetella pertussis
aucaggggcucggccaggug

SEQ ID NO: 433751 - RNA, 21 nt, Bordetella pertussis
aucagguccacuucaccgcug

SEQ ID NO: 433752 - RNA, 21 nt, Bordetella pertussis
aucaggucgaccugcuugccc

SEQ ID NO: 433753 - RNA, 15 nt, Bordetella pertussis
aucaggugaaacagc

SEQ ID NO: 433754 - RNA, 13 nt, Bordetella pertussis
aucaggugcaggg

SEQ ID NO: 433755 - RNA, 18 nt, Bordetella pertussis
aucaggugggccgagccc

SEQ ID NO: 433756 - RNA, 15 nt, Bordetella pertussis
aucaugaggcggcgg

SEQ ID NO: 433757 - RNA, 23 nt, Bordetella pertussis
aucaugaugcgcugggccaggcc

SEQ ID NO: 433758 - RNA, 13 nt, Bordetella pertussis
aucauggccaggg

SEQ ID NO: 433759 - RNA, 20 nt, Bordetella pertussis
aucauggcgccgauggcgcc

SEQ ID NO: 433760 - RNA, 19 nt, Bordetella pertussis
aucauggcgucggccacgu

SEQ ID NO: 433761 - RNA, 22 nt, Bordetella pertussis
aucauggucaugcccuccucgg

SEQ ID NO: 433762 - RNA, 17 nt, Bordetella pertussis
auccacgccgccggcca

SEQ ID NO: 433763 - RNA, 20 nt, Bordetella pertussis
auccagcggacgggccaggc

SEQ ID NO: 433764 - RNA, 11 nt, Bordetella pertussis
auccagcugcg

SEQ ID NO: 433765 - RNA, 22 nt, Bordetella pertussis
auccaguugagaaugcccagga

SEQ ID NO: 433766 - RNA, 23 nt, Bordetella pertussis
auccaguugagaaugcccaggau

SEQ ID NO: 433767 - RNA, 14 nt, Bordetella pertussis
aucccaccaucucc

SEQ ID NO: 433768 - RNA, 12 nt, Bordetella pertussis
auccccagcgcc

SEQ ID NO: 433769 - RNA, 19 nt, Bordetella pertussis
auccggcccggugcagccg

SEQ ID NO: 433770 - RNA, 18 nt, Bordetella pertussis
auccgguaugccugccag

SEQ ID NO: 433771 - RNA, 12 nt, Bordetella pertussis
auccggugauca

SEQ ID NO: 433772 - RNA, 15 nt, Bordetella pertussis
auccguaagcgcugg

SEQ ID NO: 433773 - RNA, 14 nt, Bordetella pertussis
auccucaucgugcu

SEQ ID NO: 433774 - RNA, 22 nt, Bordetella pertussis
auccucgggcgacuccagcccg

SEQ ID NO: 433775 - RNA, 21 nt, Bordetella pertussis
auccugaacgccgcgcugccu

SEQ ID NO: 433776 - RNA, 17 nt, Bordetella pertussis
auccugaccaucaucaa

SEQ ID NO: 433777 - RNA, 19 nt, Bordetella pertussis
auccuucacgaaccgcaga

SEQ ID NO: 433778 - RNA, 20 nt, Bordetella pertussis
auccuucacgaaccgcagaa

SEQ ID NO: 433779 - RNA, 17 nt, Bordetella pertussis
aucgagcaggccgccgg

SEQ ID NO: 433780 - RNA, 14 nt, Bordetella pertussis
aucgauggccacga

SEQ ID NO: 433781 - RNA, 16 nt, Bordetella pertussis
aucgauuucucgcugc

SEQ ID NO: 433782 - RNA, 14 nt, Bordetella pertussis
aucgcaucgcggca

SEQ ID NO: 433783 - RNA, 12 nt, Bordetella pertussis
aucgccaugcug

SEQ ID NO: 433784 - RNA, 13 nt, Bordetella pertussis
aucgccaugcugc

SEQ ID NO: 433785 - RNA, 15 nt, Bordetella pertussis
aucgccgccgcccgc

SEQ ID NO: 433786 - RNA, 13 nt, Bordetella pertussis
aucgccgcgggcg

SEQ ID NO: 433787 - RNA, 17 nt, Bordetella pertussis
aucgccgguagcgcugg

SEQ ID NO: 433788 - RNA, 23 nt, Bordetella pertussis
aucgccggugggauaaggcgugc

SEQ ID NO: 433789 - RNA, 20 nt, Bordetella pertussis
aucgccucgacgggauccuc

SEQ ID NO: 433790 - RNA, 17 nt, Bordetella pertussis
aucgcgaugcgcagcag

SEQ ID NO: 433791 - RNA, 16 nt, Bordetella pertussis
aucgcgcagcaccgcc

SEQ ID NO: 433792 - RNA, 14 nt, Bordetella pertussis
aucgucgaccugga

SEQ ID NO: 433793 - RNA, 15 nt, Bordetella pertussis
aucgucgaccuggau

SEQ ID NO: 433794 - RNA, 23 nt, Bordetella pertussis
aucgucgcgcugcgacagcagca

SEQ ID NO: 433795 - RNA, 19 nt, Bordetella pertussis
aucgucggcgccaugcugg

SEQ ID NO: 433796 - RNA, 14 nt, Bordetella pertussis
aucgugcuagaauc

SEQ ID NO: 433797 - RNA, 23 nt, Bordetella pertussis
aucguggcugccccgaugaugga

SEQ ID NO: 433798 - RNA, 16 nt, Bordetella pertussis
aucguggguucgaauc

SEQ ID NO: 433799 - RNA, 18 nt, Bordetella pertussis
aucguuacagcuccuuga

SEQ ID NO: 433800 - RNA, 22 nt, Bordetella pertussis
aucguucccuacccgccgggcg

SEQ ID NO: 433801 - RNA, 21 nt, Bordetella pertussis
aucucccgcaggcccacaaug

SEQ ID NO: 433802 - RNA, 15 nt, Bordetella pertussis
aucuccggauccagc

SEQ ID NO: 433803 - RNA, 16 nt, Bordetella pertussis
aucucggccagcagcg

SEQ ID NO: 433804 - RNA, 19 nt, Bordetella pertussis
aucucggcaucggccacgc

SEQ ID NO: 433805 - RNA, 19 nt, Bordetella pertussis
aucucgggcaggucggcca

SEQ ID NO: 433806 - RNA, 17 nt, Bordetella pertussis
aucucgucgaccgccuc

SEQ ID NO: 433807 - RNA, 22 nt, Bordetella pertussis
aucucguggcccagcaccgccg

SEQ ID NO: 433808 - RNA, 13 nt, Bordetella pertussis
aucugaucaucuu

SEQ ID NO: 433809 - RNA, 22 nt, Bordetella pertussis
aucugcauguacucggccaggc

SEQ ID NO: 433810 - RNA, 23 nt, Bordetella pertussis
aucugcauguacucggccaggcc

SEQ ID NO: 433811 - RNA, 13 nt, Bordetella pertussis
aucugcugggccg

SEQ ID NO: 433812 - RNA, 13 nt, Bordetella pertussis
aucugcuugccgu

SEQ ID NO: 433813 - RNA, 17 nt, Bordetella pertussis
aucugguccugggccgu

SEQ ID NO: 433814 - RNA, 16 nt, Bordetella pertussis
aucugguugagcagca

SEQ ID NO: 433815 - RNA, 21 nt, Bordetella pertussis
aucugguugagcagcaccugg

SEQ ID NO: 433816 - RNA, 22 nt, Bordetella pertussis
aucuguccccgcggggacaggc

SEQ ID NO: 433817 - RNA, 20 nt, Bordetella pertussis
aucuugaugccgcccagcau

SEQ ID NO: 433818 - RNA, 21 nt, Bordetella pertussis
aucuugaugccgcccagcaug

SEQ ID NO: 433819 - RNA, 16 nt, Bordetella pertussis
aucuugaugcggccgu

SEQ ID NO: 433820 - RNA, 22 nt, Bordetella pertussis
aucuugccgaugcggcgcaugc

SEQ ID NO: 433821 - RNA, 16 nt, Bordetella pertussis
aucuugccgccgggca

SEQ ID NO: 433822 - RNA, 16 nt, Bordetella pertussis
aucuugccggccuggc

SEQ ID NO: 433823 - RNA, 18 nt, Bordetella pertussis
aucuugccggccuguucu

SEQ ID NO: 433824 - RNA, 19 nt, Bordetella pertussis
aucuugccggccuguucuu

SEQ ID NO: 433825 - RNA, 13 nt, Bordetella pertussis
aucuugccaggcc

SEQ ID NO: 433826 - RNA, 14 nt, Bordetella pertussis
aucuugccaggccc

SEQ ID NO: 433827 - RNA, 14 nt, Bordetella pertussis
aucuuggccgccac

SEQ ID NO: 433828 - RNA, 22 nt, Bordetella pertussis
augaaaauuauuugguggaggu

SEQ ID NO: 433829 - RNA, 16 nt, Bordetella pertussis
augaccagcggcguga

SEQ ID NO: 433830 - RNA, 19 nt, Bordetella pertussis
augaccgccgccagcagcg

SEQ ID NO: 433831 - RNA, 15 nt, Bordetella pertussis
augaccggccaggcg

SEQ ID NO: 433832 - RNA, 18 nt, Bordetella pertussis
augaccugcgccaggugc

SEQ ID NO: 433833 - RNA, 21 nt, Bordetella pertussis
augaccugcgccaggugcuug

SEQ ID NO: 433834 - RNA, 12 nt, Bordetella pertussis
augaccugggcc

SEQ ID NO: 433835 - RNA, 13 nt, Bordetella pertussis
augacggccagga

SEQ ID NO: 433836 - RNA, 16 nt, Bordetella pertussis
augacggugccgagca

SEQ ID NO: 433837 - RNA, 14 nt, Bordetella pertussis
augagcccgaugcc

SEQ ID NO: 433838 - RNA, 16 nt, Bordetella pertussis
augagcccgaugccgc

SEQ ID NO: 433839 - RNA, 19 nt, Bordetella pertussis
augaugcgcugggccaggc

SEQ ID NO: 433840 - RNA, 20 nt, Bordetella pertussis
augaugcggcgccacgcaga

SEQ ID NO: 433841 - RNA, 21 nt, Bordetella pertussis
augaugcgguugaucagggcc

SEQ ID NO: 433842 - RNA, 16 nt, Bordetella pertussis
augauggaggccagga

SEQ ID NO: 433843 - RNA, 13 nt, Bordetella pertussis
augauggccaggu

SEQ ID NO: 433844 - RNA, 14 nt, Bordetella pertussis
augauggccagguc

SEQ ID NO: 433845 - RNA, 17 nt, Bordetella pertussis
augaugguggggcuggc

SEQ ID NO: 433846 - RNA, 13 nt, Bordetella pertussis
augcaauuucuca

SEQ ID NO: 433847 - RNA, 14 nt, Bordetella pertussis
augcaccaguuuuc

SEQ ID NO: 433848 - RNA, 21 nt, Bordetella pertussis
augcagaacagggugccgccc

SEQ ID NO: 433849 - RNA, 13 nt, Bordetella pertussis
augcagccgcaau

SEQ ID NO: 433850 - RNA, 22 nt, Bordetella pertussis
augccaaucaugcgcugcuggc

SEQ ID NO: 433851 - RNA, 18 nt, Bordetella pertussis
augccaccucgcuugccc

SEQ ID NO: 433852 - RNA, 19 nt, Bordetella pertussis
augccaguuguaguggugu

SEQ ID NO: 433853 - RNA, 15 nt, Bordetella pertussis
augccaugccgggca

SEQ ID NO: 433854 - RNA, 12 nt, Bordetella pertussis
augccgaacagc

SEQ ID NO: 433855 - RNA, 14 nt, Bordetella pertussis
augccgaacagcau

SEQ ID NO: 433856 - RNA, 23 nt, Bordetella pertussis
augccgaacagccagggcagggc

SEQ ID NO: 433857 - RNA, 22 nt, Bordetella pertussis
augccgaucgccgacaggauga

SEQ ID NO: 433858 - RNA, 20 nt, Bordetella pertussis
augccgaugauggccauggc

SEQ ID NO: 433859 - RNA, 16 nt, Bordetella pertussis
augccgcagcaccaca

SEQ ID NO: 433860 - RNA, 18 nt, Bordetella pertussis
augccgccaugcagcugg

SEQ ID NO: 433861 - RNA, 19 nt, Bordetella pertussis
augccgccaugcgccagca

SEQ ID NO: 433862 - RNA, 19 nt, Bordetella pertussis
augccgcccaugccgccgg

SEQ ID NO: 433863 - RNA, 22 nt, Bordetella pertussis
augccgcccaugccgccgggca

SEQ ID NO: 433864 - RNA, 22 nt, Bordetella pertussis
augccgcccgcaaggaccaugc

SEQ ID NO: 433865 - RNA, 15 nt, Bordetella pertussis
augccgcgcaccugg

SEQ ID NO: 433866 - RNA, 14 nt, Bordetella pertussis
augccgcgcccgcc

SEQ ID NO: 433867 - RNA, 20 nt, Bordetella pertussis
augccugucccgcacgcagc

SEQ ID NO: 433868 - RNA, 16 nt, Bordetella pertussis
augcgaaagccggccu

SEQ ID NO: 433869 - RNA, 17 nt, Bordetella pertussis
augcgaaagcggccagc

SEQ ID NO: 433870 - RNA, 21 nt, Bordetella pertussis
augcgacagcgacagccaggc

SEQ ID NO: 433871 - RNA, 17 nt, Bordetella pertussis
augcgacaugagcugcg

SEQ ID NO: 433872 - RNA, 15 nt, Bordetella pertussis
augcgcauggccagc

SEQ ID NO: 433873 - RNA, 21 nt, Bordetella pertussis
augcgccagcaggauguccac

SEQ ID NO: 433874 - RNA, 14 nt, Bordetella pertussis
augcgccaggcgcu

SEQ ID NO: 433875 - RNA, 12 nt, Bordetella pertussis
augcgccaggcu

SEQ ID NO: 433876 - RNA, 22 nt, Bordetella pertussis
augcgcccgaugcucgccggcg

SEQ ID NO: 433877 - RNA, 16 nt, Bordetella pertussis
augcgccggcccggca

SEQ ID NO: 433878 - RNA, 21 nt, Bordetella pertussis
augcgccggcccggcaacauc

SEQ ID NO: 433879 - RNA, 15 nt, Bordetella pertussis
augcgccggccuggc

SEQ ID NO: 433880 - RNA, 17 nt, Bordetella pertussis
augcgccguccucaggc

SEQ ID NO: 433881 - RNA, 18 nt, Bordetella pertussis
augcgccugucccaggcg

SEQ ID NO: 433882 - RNA, 14 nt, Bordetella pertussis
augcgcgaaguggc

SEQ ID NO: 433883 - RNA, 15 nt, Bordetella pertussis
augcgcgaaguggcc

SEQ ID NO: 433884 - RNA, 13 nt, Bordetella pertussis
augcgcgccaggc

SEQ ID NO: 433885 - RNA, 14 nt, Bordetella pertussis
augcgcgccaggcu

SEQ ID NO: 433886 - RNA, 20 nt, Bordetella pertussis
augcgcgccccgucggccgu

SEQ ID NO: 433887 - RNA, 17 nt, Bordetella pertussis
augcgcgccgcucuugg

SEQ ID NO: 433888 - RNA, 18 nt, Bordetella pertussis
augcgcgcgacuuccucg

SEQ ID NO: 433889 - RNA, 18 nt, Bordetella pertussis
augcgcgcgcgggccagc

SEQ ID NO: 433890 - RNA, 13 nt, Bordetella pertussis
augcgcgccagca

SEQ ID NO: 433891 - RNA, 16 nt, Bordetella pertussis
augcgcggggccaggc

SEQ ID NO: 433892 - RNA, 17 nt, Bordetella pertussis
augcgcggggccaggcg

SEQ ID NO: 433893 - RNA, 14 nt, Bordetella pertussis
augcuccagcuugc

SEQ ID NO: 433894 - RNA, 18 nt, Bordetella pertussis
augcucguccaucgccug

SEQ ID NO: 433895 - RNA, 13 nt, Bordetella pertussis
augcugcagcugc

SEQ ID NO: 433896 - RNA, 19 nt, Bordetella pertussis
augcugcagcugcuugccc

SEQ ID NO: 433897 - RNA, 13 nt, Bordetella pertussis
augcugccgggca

SEQ ID NO: 433898 - RNA, 13 nt, Bordetella pertussis
augcugcgacagc

SEQ ID NO: 433899 - RNA, 23 nt, Bordetella pertussis
augcugcgacagcagggccaggc

SEQ ID NO: 433900 - RNA, 15 nt, Bordetella pertussis
augcuugccauaggc

SEQ ID NO: 433901 - RNA, 19 nt, Bordetella pertussis
augcuugccauaggccagc

SEQ ID NO: 433902 - RNA, 14 nt, Bordetella pertussis
auggacgccgccgc

SEQ ID NO: 433903 - RNA, 20 nt, Bordetella pertussis
auggagaccggcgccugcgg

SEQ ID NO: 433904 - RNA, 16 nt, Bordetella pertussis
auggaggggcgcaggc

SEQ ID NO: 433905 - RNA, 17 nt, Bordetella pertussis
auggaggggcgcaggca

SEQ ID NO: 433906 - RNA, 18 nt, Bordetella pertussis
auggagucggucagccug

SEQ ID NO: 433907 - RNA, 19 nt, Bordetella pertussis
auggagucggucagccuga

SEQ ID NO: 433908 - RNA, 18 nt, Bordetella pertussis
auggaguucagcagcucg

SEQ ID NO: 433909 - RNA, 23 nt, Bordetella pertussis
auggcccgccccgggcaggagcg

SEQ ID NO: 433910 - RNA, 18 nt, Bordetella pertussis
auggccgccagcggcugg

SEQ ID NO: 433911 - RNA, 14 nt, Bordetella pertussis
auggccgcccagca

SEQ ID NO: 433912 - RNA, 21 nt, Bordetella pertussis
auggccgcgcggcgccugccu

SEQ ID NO: 433913 - RNA, 16 nt, Bordetella pertussis
auggccggcgcgaacc

SEQ ID NO: 433914 - RNA, 18 nt, Bordetella pertussis
auggccggcguguucagc

SEQ ID NO: 433915 - RNA, 21 nt, Bordetella pertussis
auggccguggcgugcaggccg

SEQ ID NO: 433916 - RNA, 15 nt, Bordetella pertussis
auggcgucggccacg

SEQ ID NO: 433917 - RNA, 18 nt, Bordetella pertussis
auggcgugucuccgggcg

SEQ ID NO: 433918 - RNA, 16 nt, Bordetella pertussis
auggcugcaccugccu

SEQ ID NO: 433919 - RNA, 17 nt, Bordetella pertussis
auggcugcaccugccug

SEQ ID NO: 433920 - RNA, 21 nt, Bordetella pertussis
augggcggcccgcuccaggcg

SEQ ID NO: 433921 - RNA, 21 nt, Bordetella pertussis
augggcggccuagcugugaac

SEQ ID NO: 433922 - RNA, 22 nt, Bordetella pertussis
augggcggccucggccagcugg

SEQ ID NO: 433923 - RNA, 16 nt, Bordetella pertussis
augggcggggccacau

SEQ ID NO: 433924 - RNA, 19 nt, Bordetella pertussis
augggcucgcgcgagccca

SEQ ID NO: 433925 - RNA, 20 nt, Bordetella pertussis
augguagcgguccagcugcg

SEQ ID NO: 433926 - RNA, 13 nt, Bordetella pertussis
auggugccgccgc

SEQ ID NO: 433927 - RNA, 16 nt, Bordetella pertussis
auggugccgccgcccg

SEQ ID NO: 433928 - RNA, 17 nt, Bordetella pertussis
auggugccgccgcccga

SEQ ID NO: 433929 - RNA, 18 nt, Bordetella pertussis
auggugccgcgcaggccc

SEQ ID NO: 433930 - RNA, 17 nt, Bordetella pertussis
augguucggccucgccc

SEQ ID NO: 433931 - RNA, 15 nt, Bordetella pertussis
auguacagcgguucg

SEQ ID NO: 433932 - RNA, 16 nt, Bordetella pertussis
augucgaacagcugca

SEQ ID NO: 433933 - RNA, 23 nt, Bordetella pertussis
augucgaggaccugaccgugcau

SEQ ID NO: 433934 - RNA, 22 nt, Bordetella pertussis
augucgcaggccgcggccaggc

SEQ ID NO: 433935 - RNA, 23 nt, Bordetella pertussis
augucgcaggccgcggccaggcc

SEQ ID NO: 433936 - RNA, 13 nt, Bordetella pertussis
augucgcccaugc

SEQ ID NO: 433937 - RNA, 13 nt, Bordetella pertussis
augucgccgccgc

SEQ ID NO: 433938 - RNA, 19 nt, Bordetella pertussis
augucggugaaggccacgc

SEQ ID NO: 433939 - RNA, 19 nt, Bordetella pertussis
augucgucaucccuugagc

SEQ ID NO: 433940 - RNA, 16 nt, Bordetella pertussis
augucguugcacagca

SEQ ID NO: 433941 - RNA, 12 nt, Bordetella pertussis
augugcagcgca

SEQ ID NO: 433942 - RNA, 22 nt, Bordetella pertussis
augugcagcgcacgguccaggc

SEQ ID NO: 433943 - RNA, 16 nt, Bordetella pertussis
augugcaggccgagga

SEQ ID NO: 433944 - RNA, 18 nt, Bordetella pertussis
augugccaccgcccaggc

SEQ ID NO: 433945 - RNA, 15 nt, Bordetella pertussis
augugcguugccagc

SEQ ID NO: 433946 - RNA, 23 nt, Bordetella pertussis
augugcucgggacgcaggcccau

SEQ ID NO: 433947 - RNA, 23 nt, Bordetella pertussis
auguggcgacgcccagccugccg

SEQ ID NO: 433948 - RNA, 14 nt, Bordetella pertussis
auguggggacaggc

SEQ ID NO: 433949 - RNA, 15 nt, Bordetella pertussis
auguggggacaggca

SEQ ID NO: 433950 - RNA, 14 nt, Bordetella pertussis
auguucuggucucc

SEQ ID NO: 433951 - RNA, 14 nt, Bordetella pertussis
auguugaacugcag

SEQ ID NO: 433952 - RNA, 22 nt, Bordetella pertussis
auguugaacugcaggccgccgg

SEQ ID NO: 433953 - RNA, 14 nt, Bordetella pertussis
auuccucgccgccc

SEQ ID NO: 433954 - RNA, 19 nt, Bordetella pertussis
auuccucgcggcuguccug

SEQ ID NO: 433955 - RNA, 17 nt, Bordetella pertussis
auuccuuucaccggcac

SEQ ID NO: 433956 - RNA, 13 nt, Bordetella pertussis
auucgcgcaccga

SEQ ID NO: 433957 - RNA, 20 nt, Bordetella pertussis
auucggugccuguucccgcc

SEQ ID NO: 433958 - RNA, 16 nt, Bordetella pertussis
auucugcugcaugccg

SEQ ID NO: 433959 - RNA, 13 nt, Bordetella pertussis
auugaugcagcac

SEQ ID NO: 433960 - RNA, 21 nt, Bordetella pertussis
auugcagggugucggccaggg

SEQ ID NO: 433961 - RNA, 20 nt, Bordetella pertussis
auugcccagcaccacgggcu

SEQ ID NO: 433962 - RNA, 13 nt, Bordetella pertussis
auugcccagguug

SEQ ID NO: 433963 - RNA, 17 nt, Bordetella pertussis
auugccggagcagcagc

SEQ ID NO: 433964 - RNA, 18 nt, Bordetella pertussis
auugccggaucagcgccu

SEQ ID NO: 433965 - RNA, 16 nt, Bordetella pertussis
auugcgacgccgccga

SEQ ID NO: 433966 - RNA, 21 nt, Bordetella pertussis
auugcggcccgcggccuuggu

SEQ ID NO: 433967 - RNA, 14 nt, Bordetella pertussis
auugcggugcccuu

SEQ ID NO: 433968 - RNA, 16 nt, Bordetella pertussis
auugcggugcccuugc

SEQ ID NO: 433969 - RNA, 13 nt, Bordetella pertussis
auugcgucagggc

SEQ ID NO: 433970 - RNA, 19 nt, Bordetella pertussis
auuggcuguaucuggccug

SEQ ID NO: 433971 - RNA, 16 nt, Bordetella pertussis
auugggacgccagccc

SEQ ID NO: 433972 - RNA, 14 nt, Bordetella pertussis
auuguccagcggca

SEQ ID NO: 433973 - RNA, 16 nt, Bordetella pertussis
aaaagugaucaccgcc

SEQ ID NO: 433974 - RNA, 21 nt, Bordetella pertussis
auuucaccuaccucagcaugg

SEQ ID NO: 433975 - RNA, 19 nt, Bordetella pertussis
auuuccggaccggugcccu

SEQ ID NO: 433976 - RNA, 15 nt, Bordetella pertussis
auuucgcuggccauc

SEQ ID NO: 433977 - RNA, 20 nt, Bordetella pertussis
auuucggcgcaucggcgcca

SEQ ID NO: 433978 - RNA, 16 nt, Bordetella pertussis
auuucggcgccgccgg

SEQ ID NO: 433979 - RNA, 15 nt, Bordetella pertussis
auuucggcgccgcgc

SEQ ID NO: 433980 - RNA, 23 nt, Bordetella pertussis
auuucgggugaggggccagccug

SEQ ID NO: 433981 - RNA, 15 nt, Bordetella pertussis
auuucuucgccuggc

SEQ ID NO: 433982 - RNA, 21 nt, Bordetella pertussis
auuuuguggagcguucaugca

SEQ ID NO: 433983 - RNA, 14 nt, Bordetella pertussis
caaaacgcaugacc

SEQ ID NO: 433984 - RNA, 16 nt, Bordetella pertussis
caaaagcguuccagca

SEQ ID NO: 433985 - RNA, 21 nt, Bordetella pertussis
caaaauacuuguccgccaccc

SEQ ID NO: 433986 - RNA, 16 nt, Bordetella pertussis
caaagacggcuugacc

SEQ ID NO: 433987 - RNA, 20 nt, Bordetella pertussis
caaagacggcuugaccacgg

SEQ ID NO: 433988 - RNA, 18 nt, Bordetella pertussis
caaagaucugcuggcucg

SEQ ID NO: 433989 - RNA, 13 nt, Bordetella pertussis
caaagccugacgg

SEQ ID NO: 433990 - RNA, 23 nt, Bordetella pertussis
caaagcggguugcggcagcgccg

SEQ ID NO: 433991 - RNA, 13 nt, Bordetella pertussis
caaaggcccaggc

SEQ ID NO: 433992 - RNA, 16 nt, Bordetella pertussis
caaaggcccaggcaau

SEQ ID NO: 433993 - RNA, 14 nt, Bordetella pertussis
caaaguagugcccc

SEQ ID NO: 433994 - RNA, 13 nt, Bordetella pertussis
caaaucaaugaaa

SEQ ID NO: 433995 - RNA, 21 nt, Bordetella pertussis
caacaaaggaaaucgcggcgc

SEQ ID NO: 433996 - RNA, 22 nt, Bordetella pertussis
caacaaaggaaaucgcggcgcu

SEQ ID NO: 433997 - RNA, 20 nt, Bordetella pertussis
caacaccaaccaacaugccg

SEQ ID NO: 433998 - RNA, 15 nt, Bordetella pertussis
caacaucgcccuguc

SEQ ID NO: 433999 - RNA, 15 nt, Bordetella pertussis
caaccagggagccgu

SEQ ID NO: 434000 - RNA, 15 nt, Bordetella pertussis
caaccagggccgcca

SEQ ID NO: 434001 - RNA, 22 nt, Bordetella pertussis
caacccacggcguggcgcgccc

SEQ ID NO: 434002 - RNA, 19 nt, Bordetella pertussis
caacccggcgaggccgccc

SEQ ID NO: 434003 - RNA, 20 nt, Bordetella pertussis
caacccguuccccaucaucu

SEQ ID NO: 434004 - RNA, 17 nt, Bordetella pertussis
caaccggaacaccagca

SEQ ID NO: 434005 - RNA, 15 nt, Bordetella pertussis
caaccgggacaggca

SEQ ID NO: 434006 - RNA, 21 nt, Bordetella pertussis
caaccgucggugaugcucugc

SEQ ID NO: 434007 - RNA, 14 nt, Bordetella pertussis
caaccucgccgcgc

SEQ ID NO: 434008 - RNA, 21 nt, Bordetella pertussis
caacggagaaagaagcccccg

SEQ ID NO: 434009 - RNA, 12 nt, Bordetella pertussis
caacggccacca

SEQ ID NO: 434010 - RNA, 17 nt, Bordetella pertussis
caacggcuggcugggcg

SEQ ID NO: 434011 - RNA, 22 nt, Bordetella pertussis
caacggcuggcugggcgcgccg

SEQ ID NO: 434012 - RNA, 14 nt, Bordetella pertussis
caacgucggcagcc

SEQ ID NO: 434013 - RNA, 15 nt, Bordetella pertussis
caacuuccagcgccc

SEQ ID NO: 434014 - RNA, 12 nt, Bordetella pertussis
caagacagcaag

SEQ ID NO: 434015 - RNA, 15 nt, Bordetella pertussis
caagacaggccgcua

SEQ ID NO: 434016 - RNA, 12 nt, Bordetella pertussis
caagauccagcu

SEQ ID NO: 434017 - RNA, 15 nt, Bordetella pertussis
caagauggcccaggg

SEQ ID NO: 434018 - RNA, 18 nt, Bordetella pertussis
caagauggcccagggcag

SEQ ID NO: 434019 - RNA, 14 nt, Bordetella pertussis
caagccgccgcccu

SEQ ID NO: 434020 - RNA, 16 nt, Bordetella pertussis
caagccguacagcgaa

SEQ ID NO: 434021 - RNA, 21 nt, Bordetella pertussis
caagcgcacgcgcagcacgcu

SEQ ID NO: 434022 - RNA, 15 nt, Bordetella pertussis
caagcguucauggcg

SEQ ID NO: 434023 - RNA, 17 nt, Bordetella pertussis
caagcguucauggcgca

SEQ ID NO: 434024 - RNA, 22 nt, Bordetella pertussis
caagcuccaggaaaaccuccuc

SEQ ID NO: 434025 - RNA, 13 nt, Bordetella pertussis
caagcucgcgcau

SEQ ID NO: 434026 - RNA, 20 nt, Bordetella pertussis
caagcucgcgcaugcagcga

SEQ ID NO: 434027 - RNA, 12 nt, Bordetella pertussis
caagcugcugcu

SEQ ID NO: 434028 - RNA, 22 nt, Bordetella pertussis
caagcugcuggccggccccauc

SEQ ID NO: 434029 - RNA, 19 nt, Bordetella pertussis
caagcuggagaagcgccgc

SEQ ID NO: 434030 - RNA, 20 nt, Bordetella pertussis
caagcuggcggcgcgcggcu

SEQ ID NO: 434031 - RNA, 15 nt, Bordetella pertussis
caaggauuucaccua

SEQ ID NO: 434032 - RNA, 21 nt, Bordetella pertussis
caaggcaugcgccagcgccug

SEQ ID NO: 434033 - RNA, 21 nt, Bordetella pertussis
caagucgaguucggcgcgccc

SEQ ID NO: 434034 - RNA, 17 nt, Bordetella pertussis
caauaucggcacccgca

SEQ ID NO: 434035 - RNA, 19 nt, Bordetella pertussis
caauccccgcuuccugcug

SEQ ID NO: 434036 - RNA, 15 nt, Bordetella pertussis
caaucgaugaagauc

SEQ ID NO: 434037 - RNA, 20 nt, Bordetella pertussis
caaugacauccucgggcgac

SEQ ID NO: 434038 - RNA, 14 nt, Bordetella pertussis
caaugugcugacgg

SEQ ID NO: 434039 - RNA, 15 nt, Bordetella pertussis
caaugugcugacggu

SEQ ID NO: 434040 - RNA, 22 nt, Bordetella pertussis
caauugccagccuuggcccacu

SEQ ID NO: 434041 - RNA, 13 nt, Bordetella pertussis
caauugcgcggcc

SEQ ID NO: 434042 - RNA, 15 nt, Bordetella pertussis
caauugcgugguggc

SEQ ID NO: 434043 - RNA, 23 nt, Bordetella pertussis
caauugcgugguggccuugcugc

SEQ ID NO: 434044 - RNA, 21 nt, Bordetella pertussis
caauugcuugccuguccccac

SEQ ID NO: 434045 - RNA, 23 nt, Bordetella pertussis
caauuucgcggucgggaucaucc

SEQ ID NO: 434046 - RNA, 14 nt, Bordetella pertussis
cacaagaucgcauu

SEQ ID NO: 434047 - RNA, 14 nt, Bordetella pertussis
cacaagcggcccca

SEQ ID NO: 434048 - RNA, 15 nt, Bordetella pertussis
cacaagcggccccag

SEQ ID NO: 434049 - RNA, 14 nt, Bordetella pertussis
cacaagggccccgc

SEQ ID NO: 434050 - RNA, 16 nt, Bordetella pertussis
cacacgaucagcgccc

SEQ ID NO: 434051 - RNA, 18 nt, Bordetella pertussis
cacacgcauuugcagcgg

SEQ ID NO: 434052 - RNA, 15 nt, Bordetella pertussis
cacacgcgcugggcg

SEQ ID NO: 434053 - RNA, 23 nt, Bordetella pertussis
cacacgcucuugcgcgcgccgga

SEQ ID NO: 434054 - RNA, 15 nt, Bordetella pertussis
cacacggucagcaac

SEQ ID NO: 434055 - RNA, 16 nt, Bordetella pertussis
cacacggucagcaacc

SEQ ID NO: 434056 - RNA, 17 nt, Bordetella pertussis
cacacggucagcaaccc

SEQ ID NO: 434057 - RNA, 22 nt, Bordetella pertussis
cacacggucagcaaccccagca

SEQ ID NO: 434058 - RNA, 20 nt, Bordetella pertussis
cacagcaacucuuccccguc

SEQ ID NO: 434059 - RNA, 15 nt, Bordetella pertussis
cacagcagcgcgccg

SEQ ID NO: 434060 - RNA, 23 nt, Bordetella pertussis
cacagcagcgcgccgccgauguu

SEQ ID NO: 434061 - RNA, 21 nt, Bordetella pertussis
cacagcaugaccucggccugc

SEQ ID NO: 434062 - RNA, 22 nt, Bordetella pertussis
cacagcaugcgcuggucgcgca

SEQ ID NO: 434063 - RNA, 15 nt, Bordetella pertussis
cacagccacugcggc

SEQ ID NO: 434064 - RNA, 13 nt, Bordetella pertussis
cacagcggcgcga

SEQ ID NO: 434065 - RNA, 22 nt, Bordetella pertussis
cacagcggcgcgagcgcacagg

SEQ ID NO: 434066 - RNA, 20 nt, Bordetella pertussis
cacagcgugacggcggcgcg

SEQ ID NO: 434067 - RNA, 22 nt, Bordetella pertussis
cacagcgugacggcggcgcgcg

SEQ ID NO: 434068 - RNA, 17 nt, Bordetella pertussis
cacauagcccggcgcga

SEQ ID NO: 434069 - RNA, 14 nt, Bordetella pertussis
cacauaggccggca

SEQ ID NO: 434070 - RNA, 12 nt, Bordetella pertussis
cacauccagcgc

SEQ ID NO: 434071 - RNA, 13 nt, Bordetella pertussis
cacauccagcgcc

SEQ ID NO: 434072 - RNA, 19 nt, Bordetella pertussis
cacauccagcgccagcacc

SEQ ID NO: 434073 - RNA, 21 nt, Bordetella pertussis
cacaucgaaggcaaucagccc

SEQ ID NO: 434074 - RNA, 13 nt, Bordetella pertussis
cacaucgcccgug

SEQ ID NO: 434075 - RNA, 22 nt, Bordetella pertussis
cacaucgcuaugcagcugcgcc

SEQ ID NO: 434076 - RNA, 14 nt, Bordetella pertussis
caccaaccugcugg

SEQ ID NO: 434077 - RNA, 15 nt, Bordetella pertussis
caccaccaccgcccg

SEQ ID NO: 434078 - RNA, 14 nt, Bordetella pertussis
caccaccaccaugu

SEQ ID NO: 434079 - RNA, 19 nt, Bordetella pertussis
caccaccagcaccgccacg

SEQ ID NO: 434080 - RNA, 14 nt, Bordetella pertussis
caccaccagcaccg

SEQ ID NO: 434081 - RNA, 19 nt, Bordetella pertussis
caccaccagcgcggccagc

SEQ ID NO: 434082 - RNA, 13 nt, Bordetella pertussis
caccaccagcggc

SEQ ID NO: 434083 - RNA, 13 nt, Bordetella pertussis
caccaccagcgcg

SEQ ID NO: 434084 - RNA, 19 nt, Bordetella pertussis
caccacgcccaucugccag

SEQ ID NO: 434085 - RNA, 20 nt, Bordetella pertussis
caccacgccuucgagcacca

SEQ ID NO: 434086 - RNA, 20 nt, Bordetella pertussis
caccacgcgcaccagcuugg

SEQ ID NO: 434087 - RNA, 14 nt, Bordetella pertussis
caccacgcgcucca

SEQ ID NO: 434088 - RNA, 19 nt, Bordetella pertussis
caccacggcaucggcgccg

SEQ ID NO: 434089 - RNA, 13 nt, Bordetella pertussis
caccacggccacg

SEQ ID NO: 434090 - RNA, 18 nt, Bordetella pertussis
caccacgucgcggcuggg

SEQ ID NO: 434091 - RNA, 18 nt, Bordetella pertussis
caccacugcaaggcccgc

SEQ ID NO: 434092 - RNA, 23 nt, Bordetella pertussis
caccacugcaaggcccgcccggg

SEQ ID NO: 434093 - RNA, 13 nt, Bordetella pertussis
caccagcaccgcc

SEQ ID NO: 434094 - RNA, 12 nt, Bordetella pertussis
caccagcagccc

SEQ ID NO: 434095 - RNA, 14 nt, Bordetella pertussis
caccagcagcccca

SEQ ID NO: 434096 - RNA, 16 nt, Bordetella pertussis
caccagcagccccagc

SEQ ID NO: 434097 - RNA, 13 nt, Bordetella pertussis
caccagcagcgcc

SEQ ID NO: 434098 - RNA, 17 nt, Bordetella pertussis
caccagcagcgccagga

SEQ ID NO: 434099 - RNA, 20 nt, Bordetella pertussis
caccagcagcgccaggauga

SEQ ID NO: 434100 - RNA, 15 nt, Bordetella pertussis
caccagcaggcggcc

SEQ ID NO: 434101 - RNA, 19 nt, Bordetella pertussis
caccagcgcauugccgccg

SEQ ID NO: 434102 - RNA, 20 nt, Bordetella pertussis
caccagcgcauugccgccgc

SEQ ID NO: 434103 - RNA, 14 nt, Bordetella pertussis
caccagcgccacgc

SEQ ID NO: 434104 - RNA, 14 nt, Bordetella pertussis
caccagcgccagga

SEQ ID NO: 434105 - RNA, 22 nt, Bordetella pertussis
caccagcgccaggaacagcgcc

SEQ ID NO: 434106 - RNA, 14 nt, Bordetella pertussis
caccagcgcgccag

SEQ ID NO: 434107 - RNA, 16 nt, Bordetella pertussis
caccagcgcgccagca

SEQ ID NO: 434108 - RNA, 20 nt, Bordetella pertussis
caccagcgcggccagcaccg

SEQ ID NO: 434109 - RNA, 14 nt, Bordetella pertussis
caccagcggcgccg

SEQ ID NO: 434110 - RNA, 20 nt, Bordetella pertussis
caccagcgucaccagcaggc

SEQ ID NO: 434111 - RNA, 18 nt, Bordetella pertussis
caccaggcugaucaccca

SEQ ID NO: 434112 - RNA, 22 nt, Bordetella pertussis
caccaggcugaucacccacagc

SEQ ID NO: 434113 - RNA, 23 nt, Bordetella pertussis
caccaggcugaucacccacagca

SEQ ID NO: 434114 - RNA, 11 nt, Bordetella pertussis
caccaggcugg

SEQ ID NO: 434115 - RNA, 15 nt, Bordetella pertussis
caccaggcuggggcc

SEQ ID NO: 434116 - RNA, 12 nt, Bordetella pertussis
caccaggcuuuc

SEQ ID NO: 434117 - RNA, 19 nt, Bordetella pertussis
caccaggcuuugcgcgcca

SEQ ID NO: 434118 - RNA, 15 nt, Bordetella pertussis
caccagguugucggc

SEQ ID NO: 434119 - RNA, 18 nt, Bordetella pertussis
caccagguuuuccacagc

SEQ ID NO: 434120 - RNA, 19 nt, Bordetella pertussis
caccagguuuuccacagcc

SEQ ID NO: 434121 - RNA, 14 nt, Bordetella pertussis
cacccagcucagcg

SEQ ID NO: 434122 - RNA, 21 nt, Bordetella pertussis
cacccagggcuugacgcgcgu

SEQ ID NO: 434123 - RNA, 12 nt, Bordetella pertussis
cacccccagcag

SEQ ID NO: 434124 - RNA, 13 nt, Bordetella pertussis
cacccccuuggcu

SEQ ID NO: 434125 - RNA, 16 nt, Bordetella pertussis
caccccgccaccgccc

SEQ ID NO: 434126 - RNA, 13 nt, Bordetella pertussis
caccccgccgcug

SEQ ID NO: 434127 - RNA, 14 nt, Bordetella pertussis
cacccgcaggcggc

SEQ ID NO: 434128 - RNA, 17 nt, Bordetella pertussis
cacccgcaggcggcugg

SEQ ID NO: 434129 - RNA, 12 nt, Bordetella pertussis
cacccgccugga

SEQ ID NO: 434130 - RNA, 17 nt, Bordetella pertussis
cacccggguacguggcc

SEQ ID NO: 434131 - RNA, 23 nt, Bordetella pertussis
cacccggguacguggccccaggc

SEQ ID NO: 434132 - RNA, 20 nt, Bordetella pertussis
cacccgucccugguccagca

SEQ ID NO: 434133 - RNA, 21 nt, Bordetella pertussis
cacccgucccugguccagcag

SEQ ID NO: 434134 - RNA, 16 nt, Bordetella pertussis
cacccugccccauccc

SEQ ID NO: 434135 - RNA, 22 nt, Bordetella pertussis
cacccugccgugggacaggcac

SEQ ID NO: 434136 - RNA, 23 nt, Bordetella pertussis
cacccugccgugggacaggcacu

SEQ ID NO: 434137 - RNA, 14 nt, Bordetella pertussis
caccgacaggaugg

SEQ ID NO: 434138 - RNA, 18 nt, Bordetella pertussis
caccgacggcagccccgg

SEQ ID NO: 434139 - RNA, 12 nt, Bordetella pertussis
caccgacuucuc

SEQ ID NO: 434140 - RNA, 21 nt, Bordetella pertussis
caccgaggccgaguggccgcu

SEQ ID NO: 434141 - RNA, 16 nt, Bordetella pertussis
caccgcaggugccugu

SEQ ID NO: 434142 - RNA, 15 nt, Bordetella pertussis
caccgcaucgcgcag

SEQ ID NO: 434143 - RNA, 18 nt, Bordetella pertussis
caccgcaucgcgcagcgu

SEQ ID NO: 434144 - RNA, 22 nt, Bordetella pertussis
caccgccucgaugucaucgccc

SEQ ID NO: 434145 - RNA, 23 nt, Bordetella pertussis
caccgccugcugcauguccugca

SEQ ID NO: 434146 - RNA, 19 nt, Bordetella pertussis
caccgccugcugcgccugg

SEQ ID NO: 434147 - RNA, 20 nt, Bordetella pertussis
caccgccugcugcgccuggc

SEQ ID NO: 434148 - RNA, 17 nt, Bordetella pertussis
caccgcgaccaugcggc

SEQ ID NO: 434149 - RNA, 16 nt, Bordetella pertussis
caccgcggcggaccac

SEQ ID NO: 434150 - RNA, 23 nt, Bordetella pertussis
caccgcuucuucgucgcgccaga

SEQ ID NO: 434151 - RNA, 14 nt, Bordetella pertussis
caccggcaggccgc

SEQ ID NO: 434152 - RNA, 21 nt, Bordetella pertussis
caccggcaggccgcgcugcca

SEQ ID NO: 434153 - RNA, 14 nt, Bordetella pertussis
caccggcgcgcgca

SEQ ID NO: 434154 - RNA, 17 nt, Bordetella pertussis
caccggcgugagcgcca

SEQ ID NO: 434155 - RNA, 13 nt, Bordetella pertussis
caccgggacaggc

SEQ ID NO: 434156 - RNA, 13 nt, Bordetella pertussis
caccgucacgcgc

SEQ ID NO: 434157 - RNA, 17 nt, Bordetella pertussis
caccgucacgcgcucca

SEQ ID NO: 434158 - RNA, 14 nt, Bordetella pertussis
caccgucgcgcgca

SEQ ID NO: 434159 - RNA, 19 nt, Bordetella pertussis
caccgucgcgcgcacgcgc

SEQ ID NO: 434160 - RNA, 16 nt, Bordetella pertussis
caccguuuuggcaggc

SEQ ID NO: 434161 - RNA, 18 nt, Bordetella pertussis
caccucaggaugcccggg

SEQ ID NO: 434162 - RNA, 16 nt, Bordetella pertussis
caccuccaccgccagc

SEQ ID NO: 434163 - RNA, 20 nt, Bordetella pertussis
caccuccaccgccagcccgg

SEQ ID NO: 434164 - RNA, 15 nt, Bordetella pertussis
caccugcuccagcga

SEQ ID NO: 434165 - RNA, 21 nt, Bordetella pertussis
caccugcugcggcacggccag

SEQ ID NO: 434166 - RNA, 18 nt, Bordetella pertussis
caccugcugcuugaccuu

SEQ ID NO: 434167 - RNA, 19 nt, Bordetella pertussis
caccuggacccgcucgacc

SEQ ID NO: 434168 - RNA, 22 nt, Bordetella pertussis
caccuggccacaagcggcccca

SEQ ID NO: 434169 - RNA, 22 nt, Bordetella pertussis
caccuggcgcccggcggcgcgc

SEQ ID NO: 434170 - RNA, 19 nt, Bordetella pertussis
caccuggcggugcgccgca

SEQ ID NO: 434171 - RNA, 19 nt, Bordetella pertussis
caccugggaggggccggcu

SEQ ID NO: 434172 - RNA, 13 nt, Bordetella pertussis
caccugggccuuc

SEQ ID NO: 434173 - RNA, 16 nt, Bordetella pertussis
caccugguccauggcg

SEQ ID NO: 434174 - RNA, 18 nt, Bordetella pertussis
caccuguucggcggcgcc

SEQ ID NO: 434175 - RNA, 19 nt, Bordetella pertussis
caccuguucggcggcgccc

SEQ ID NO: 434176 - RNA, 20 nt, Bordetella pertussis
caccuguucggcggcgccca

SEQ ID NO: 434177 - RNA, 18 nt, Bordetella pertussis
cacgaauuccucgccgcc

SEQ ID NO: 434178 - RNA, 20 nt, Bordetella pertussis
cacgaauuccucgccgccca

SEQ ID NO: 434179 - RNA, 19 nt, Bordetella pertussis
cacgacacgcccagcaggc

SEQ ID NO: 434180 - RNA, 16 nt, Bordetella pertussis
cacgaccaccagcgca

SEQ ID NO: 434181 - RNA, 14 nt, Bordetella pertussis
cacgaccagcaggc

SEQ ID NO: 434182 - RNA, 18 nt, Bordetella pertussis
cacgagcaguacacgcgc

SEQ ID NO: 434183 - RNA, 20 nt, Bordetella pertussis
cacgaggaccgcgaugcugc

SEQ ID NO: 434184 - RNA, 21 nt, Bordetella pertussis
cacgauccacggccggcgcac

SEQ ID NO: 434185 - RNA, 23 nt, Bordetella pertussis
cacgauccagccguuggcgccca

SEQ ID NO: 434186 - RNA, 21 nt, Bordetella pertussis
cacgaucccgucauggcggca

SEQ ID NO: 434187 - RNA, 16 nt, Bordetella pertussis
cacgaucgcgccggcc

SEQ ID NO: 434188 - RNA, 15 nt, Bordetella pertussis
cacgaucgcggcgcu

SEQ ID NO: 434189 - RNA, 16 nt, Bordetella pertussis
cacgaucuggcgcgcg

SEQ ID NO: 434190 - RNA, 17 nt, Bordetella pertussis
cacgaugaacgcgcgca

SEQ ID NO: 434191 - RNA, 15 nt, Bordetella pertussis
cacgaugcccagggc

SEQ ID NO: 434192 - RNA, 19 nt, Bordetella pertussis
cacgaugauggaggccagg

SEQ ID NO: 434193 - RNA, 19 nt, Bordetella pertussis
cacgaugcgggcaucgccc

SEQ ID NO: 434194 - RNA, 14 nt, Bordetella pertussis
cacgauggcgccca

SEQ ID NO: 434195 - RNA, 15 nt, Bordetella pertussis
cacgauggcgccggc

SEQ ID NO: 434196 - RNA, 16 nt, Bordetella pertussis
cacgauggucagcggc

SEQ ID NO: 434197 - RNA, 20 nt, Bordetella pertussis
cacgaugguguucagguguu

SEQ ID NO: 434198 - RNA, 19 nt, Bordetella pertussis
cacgauguugccgccggcc

SEQ ID NO: 434199 - RNA, 23 nt, Bordetella pertussis
cacgcccggugccugccccugcg

SEQ ID NO: 434200 - RNA, 12 nt, Bordetella pertussis
cacgcccguccc

SEQ ID NO: 434201 - RNA, 17 nt, Bordetella pertussis
cacgccgaugccgcgca

SEQ ID NO: 434202 - RNA, 23 nt, Bordetella pertussis
cacgccgaugccgcgcaccuggg

SEQ ID NO: 434203 - RNA, 16 nt, Bordetella pertussis
cacgccggucgccagc

SEQ ID NO: 434204 - RNA, 16 nt, Bordetella pertussis
cacgccucgccggccc

SEQ ID NO: 434205 - RNA, 21 nt, Bordetella pertussis
cacgccucgccggcccugccg

SEQ ID NO: 434206 - RNA, 15 nt, Bordetella pertussis
cacgccugccgcgcc

SEQ ID NO: 434207 - RNA, 16 nt, Bordetella pertussis
cacgccugccgcgccc

SEQ ID NO: 434208 - RNA, 17 nt, Bordetella pertussis
cacgccugccgcgcccg

SEQ ID NO: 434209 - RNA, 18 nt, Bordetella pertussis
cacgccuucggcgcgcgc

SEQ ID NO: 434210 - RNA, 19 nt, Bordetella pertussis
cacgccuucggcgcgcgcc

SEQ ID NO: 434211 - RNA, 16 nt, Bordetella pertussis
cacgccuugcucgacc

SEQ ID NO: 434212 - RNA, 18 nt, Bordetella pertussis
cacgccuuguucgcgcgc

SEQ ID NO: 434213 - RNA, 23 nt, Bordetella pertussis
cacgcgauggcggcaucuugccu

SEQ ID NO: 434214 - RNA, 19 nt, Bordetella pertussis
cacgcgcaacgccgccacc

SEQ ID NO: 434215 - RNA, 21 nt, Bordetella pertussis
cacgcgcaacgccgccaccag

SEQ ID NO: 434216 - RNA, 15 nt, Bordetella pertussis
cacgcgcgcgccgcc

SEQ ID NO: 434217 - RNA, 19 nt, Bordetella pertussis
cacgcgcgcgggcgcgccg

SEQ ID NO: 434218 - RNA, 17 nt, Bordetella pertussis
cacgcgcgcuggcgccc

SEQ ID NO: 434219 - RNA, 14 nt, Bordetella pertussis
cacgcgcuccagcg

SEQ ID NO: 434220 - RNA, 14 nt, Bordetella pertussis
cacgcgcugcagca

SEQ ID NO: 434221 - RNA, 14 nt, Bordetella pertussis
cacgcggccgcgca

SEQ ID NO: 434222 - RNA, 18 nt, Bordetella pertussis
cacgcggguggugcugcu

SEQ ID NO: 434223 - RNA, 20 nt, Bordetella pertussis
cacgcgguagguagcgcgca

SEQ ID NO: 434224 - RNA, 18 nt, Bordetella pertussis
cacgcggugcaucucggc

SEQ ID NO: 434225 - RNA, 17 nt, Bordetella pertussis
cacgcguucgggcggca

SEQ ID NO: 434226 - RNA, 21 nt, Bordetella pertussis
cacgcucauguugggggcgaa

SEQ ID NO: 434227 - RNA, 15 nt, Bordetella pertussis
cacggagggugcgca

SEQ ID NO: 434228 - RNA, 16 nt, Bordetella pertussis
cacggccugcgcgccg

SEQ ID NO: 434229 - RNA, 15 nt, Bordetella pertussis
cacggcgacuuccag

SEQ ID NO: 434230 - RNA, 19 nt, Bordetella pertussis
cacggcgcacaccaucagc

SEQ ID NO: 434231 - RNA, 12 nt, Bordetella pertussis
cacggcgcgccc

SEQ ID NO: 434232 - RNA, 20 nt, Bordetella pertussis
cacgggaaugaagcgcgaca

SEQ ID NO: 434233 - RNA, 21 nt, Bordetella pertussis
cacgggcgauguugaagccgu

SEQ ID NO: 434234 - RNA, 17 nt, Bordetella pertussis
cacgggcgccugucccc

SEQ ID NO: 434235 - RNA, 18 nt, Bordetella pertussis
cacgggcgccuguccccg

SEQ ID NO: 434236 - RNA, 15 nt, Bordetella pertussis
cacgggcgcugccca

SEQ ID NO: 434237 - RNA, 20 nt, Bordetella pertussis
cacggggacaggcaccucgu

SEQ ID NO: 434238 - RNA, 17 nt, Bordetella pertussis
cacggggacaggcacgc

SEQ ID NO: 434239 - RNA, 17 nt, Bordetella pertussis
cacggggacuggcacgc

SEQ ID NO: 434240 - RNA, 17 nt, Bordetella pertussis
cacggggagcgacccgu

SEQ ID NO: 434241 - RNA, 19 nt, Bordetella pertussis
cacggggagcgacccgugg

SEQ ID NO: 434242 - RNA, 19 nt, Bordetella pertussis
cacggggcugucgcgcgca

SEQ ID NO: 434243 - RNA, 13 nt, Bordetella pertussis
cacguggacaggc

SEQ ID NO: 434244 - RNA, 15 nt, Bordetella pertussis
cacguggacaggcac

SEQ ID NO: 434245 - RNA, 17 nt, Bordetella pertussis
cacguggaccagggacg

SEQ ID NO: 434246 - RNA, 20 nt, Bordetella pertussis
cacgugccagccgaacuggg

SEQ ID NO: 434247 - RNA, 16 nt, Bordetella pertussis
cacgugguccacgaag

SEQ ID NO: 434248 - RNA, 16 nt, Bordetella pertussis
cacguucagcgccggc

SEQ ID NO: 434249 - RNA, 14 nt, Bordetella pertussis
cacuacacucugcc

SEQ ID NO: 434250 - RNA, 15 nt, Bordetella pertussis
cacuacacucugccc

SEQ ID NO: 434251 - RNA, 17 nt, Bordetella pertussis
cacuccauagcgccgcu

SEQ ID NO: 434252 - RNA, 14 nt, Bordetella pertussis
cacucccguaagca

SEQ ID NO: 434253 - RNA, 20 nt, Bordetella pertussis
cacuccggauaccgccgccg

SEQ ID NO: 434254 - RNA, 18 nt, Bordetella pertussis
cacucggugcgcgcgccc

SEQ ID NO: 434255 - RNA, 20 nt, Bordetella pertussis
cacucggugcgcgcgcccac

SEQ ID NO: 434256 - RNA, 20 nt, Bordetella pertussis
cacugaugcuggucagccug

SEQ ID NO: 434257 - RNA, 16 nt, Bordetella pertussis
cacugcaaggcccgcc

SEQ ID NO: 434258 - RNA, 13 nt, Bordetella pertussis
cacugccaggcga

SEQ ID NO: 434259 - RNA, 16 nt, Bordetella pertussis
cacugccaggcgcccc

SEQ ID NO: 434260 - RNA, 17 nt, Bordetella pertussis
cacugccaggcgcccca

SEQ ID NO: 434261 - RNA, 20 nt, Bordetella pertussis
cacugccaguaggcgcccca

SEQ ID NO: 434262 - RNA, 15 nt, Bordetella pertussis
cacugcccgcgccgu

SEQ ID NO: 434263 - RNA, 15 nt, Bordetella pertussis
cacugcguccuugag

SEQ ID NO: 434264 - RNA, 12 nt, Bordetella pertussis
cacuggccagca

SEQ ID NO: 434265 - RNA, 16 nt, Bordetella pertussis
cacuggccuucuucac

SEQ ID NO: 434266 - RNA, 22 nt, Bordetella pertussis
cacuggccuucuucacguagcc

SEQ ID NO: 434267 - RNA, 15 nt, Bordetella pertussis
cacuggcgcggcgcu

SEQ ID NO: 434268 - RNA, 18 nt, Bordetella pertussis
cacuggguggccagcgcc

SEQ ID NO: 434269 - RNA, 21 nt, Bordetella pertussis
cacuggguggccagcgccgcc

SEQ ID NO: 434270 - RNA, 22 nt, Bordetella pertussis
cacuggguggccagcgccgcca

SEQ ID NO: 434271 - RNA, 15 nt, Bordetella pertussis
cacuugagcagcgcc

SEQ ID NO: 434272 - RNA, 16 nt, Bordetella pertussis
cacuugccggccgccc

SEQ ID NO: 434273 - RNA, 20 nt, Bordetella pertussis
cacuugcgaacggccgcccg

SEQ ID NO: 434274 - RNA, 14 nt, Bordetella pertussis
cacuuugaacaguu

SEQ ID NO: 434275 - RNA, 13 nt, Bordetella pertussis
cagaaaggaugcc

SEQ ID NO: 434276 - RNA, 15 nt, Bordetella pertussis
cagaaaggaugcccg

SEQ ID NO: 434277 - RNA, 13 nt, Bordetella pertussis
cagaacaugagcc

SEQ ID NO: 434278 - RNA, 21 nt, Bordetella pertussis
cagaacccggccggcgccggc

SEQ ID NO: 434279 - RNA, 22 nt, Bordetella pertussis
cagaacgcguaggucaggccca

SEQ ID NO: 434280 - RNA, 21 nt, Bordetella pertussis
cagaacggaaacgcccagccc

SEQ ID NO: 434281 - RNA, 20 nt, Bordetella pertussis
cagaaggucugggccagcag

SEQ ID NO: 434282 - RNA, 19 nt, Bordetella pertussis
cagacauugucaagcagcg

SEQ ID NO: 434283 - RNA, 22 nt, Bordetella pertussis
cagacauugucaagcagcgccg

SEQ ID NO: 434284 - RNA, 21 nt, Bordetella pertussis
cagaccaagcgccacagcgcc

SEQ ID NO: 434285 - RNA, 13 nt, Bordetella pertussis
cagacccgcgccc

SEQ ID NO: 434286 - RNA, 14 nt, Bordetella pertussis
cagaccgagcgcgc

SEQ ID NO: 434287 - RNA, 19 nt, Bordetella pertussis
cagaccgagcgcgcccgcu

SEQ ID NO: 434288 - RNA, 23 nt, Bordetella pertussis
cagaccguagcgcaggcgcuuga

SEQ ID NO: 434289 - RNA, 15 nt, Bordetella pertussis
cagaccugcgcgccg

SEQ ID NO: 434290 - RNA, 16 nt, Bordetella pertussis
cagacggccagcgcgc

SEQ ID NO: 434291 - RNA, 17 nt, Bordetella pertussis
cagacggcggcuggacg

SEQ ID NO: 434292 - RNA, 15 nt, Bordetella pertussis
cagacgggcuggaag

SEQ ID NO: 434293 - RNA, 21 nt, Bordetella pertussis
cagauaccgccuuggccguca

SEQ ID NO: 434294 - RNA, 14 nt, Bordetella pertussis
cagauaugccccuc

SEQ ID NO: 434295 - RNA, 14 nt, Bordetella pertussis
cagauccagcgcgg

SEQ ID NO: 434296 - RNA, 16 nt, Bordetella pertussis
cagaucccaggcgcuc

SEQ ID NO: 434297 - RNA, 21 nt, Bordetella pertussis
cagauccgguaugccugccag

SEQ ID NO: 434298 - RNA, 17 nt, Bordetella pertussis
cagauugccgcgcggcg

SEQ ID NO: 434299 - RNA, 23 nt, Bordetella pertussis
cagcaacucuuccccgucggcgg

SEQ ID NO: 434300 - RNA, 12 nt, Bordetella pertussis
cagcaccacauc

SEQ ID NO: 434301 - RNA, 13 nt, Bordetella pertussis
cagcaccagcgcc

SEQ ID NO: 434302 - RNA, 16 nt, Bordetella pertussis
cagcaccagcgccugc

SEQ ID NO: 434303 - RNA, 17 nt, Bordetella pertussis
cagcaccagcgccugcc

SEQ ID NO: 434304 - RNA, 18 nt, Bordetella pertussis
cagcaccaggccgccggc

SEQ ID NO: 434305 - RNA, 19 nt, Bordetella pertussis
cagcaccagggcgcgcagc

SEQ ID NO: 434306 - RNA, 22 nt, Bordetella pertussis
cagcaccaugggcucgugcagc

SEQ ID NO: 434307 - RNA, 13 nt, Bordetella pertussis
cagcaccgacagg

SEQ ID NO: 434308 - RNA, 18 nt, Bordetella pertussis
cagcaccgagcugccgcc

SEQ ID NO: 434309 - RNA, 21 nt, Bordetella pertussis
cagcaccgagcugccgccuuc

SEQ ID NO: 434310 - RNA, 18 nt, Bordetella pertussis
cagcaccgaugcgccggc

SEQ ID NO: 434311 - RNA, 19 nt, Bordetella pertussis
cagcaccgccaccguggcg

SEQ ID NO: 434312 - RNA, 15 nt, Bordetella pertussis
cagcaccgccagcgc

SEQ ID NO: 434313 - RNA, 14 nt, Bordetella pertussis
cagcaccgccgcca

SEQ ID NO: 434314 - RNA, 16 nt, Bordetella pertussis
cagcaccucggcgccc

SEQ ID NO: 434315 - RNA, 22 nt, Bordetella pertussis
cagcaccucggcgcccagcugc

SEQ ID NO: 434316 - RNA, 14 nt, Bordetella pertussis
cagcaccucggcgu

SEQ ID NO: 434317 - RNA, 20 nt, Bordetella pertussis
cagcaccucggggcgcggcc

SEQ ID NO: 434318 - RNA, 19 nt, Bordetella pertussis
cagcaccucgacgcagccu

SEQ ID NO: 434319 - RNA, 21 nt, Bordetella pertussis
cagcaccugcaggccgccggc

SEQ ID NO: 434320 - RNA, 15 nt, Bordetella pertussis
cagcaccugcuugac

SEQ ID NO: 434321 - RNA, 20 nt, Bordetella pertussis
cagcaccugguggcgcuggc

SEQ ID NO: 434322 - RNA, 19 nt, Bordetella pertussis
cagcaccuugaccuggucg

SEQ ID NO: 434323 - RNA, 18 nt, Bordetella pertussis
cagcacgaaccacagggu

SEQ ID NO: 434324 - RNA, 15 nt, Bordetella pertussis
cagcacgaagggcag

SEQ ID NO: 434325 - RNA, 12 nt, Bordetella pertussis
cagcacgcugcg

SEQ ID NO: 434326 - RNA, 18 nt, Bordetella pertussis
cagcacgcugcgcggcgg

SEQ ID NO: 434327 - RNA, 22 nt, Bordetella pertussis
cagcacggcaugucccgaggcg

SEQ ID NO: 434328 - RNA, 15 nt, Bordetella pertussis
cagcacggccgcggc

SEQ ID NO: 434329 - RNA, 22 nt, Bordetella pertussis
cagcacggcgcacaccaucagc

SEQ ID NO: 434330 - RNA, 21 nt, Bordetella pertussis
cagcacggcuugcgcgccugc

SEQ ID NO: 434331 - RNA, 16 nt, Bordetella pertussis
cagcacgggaugcucc

SEQ ID NO: 434332 - RNA, 14 nt, Bordetella pertussis
cagcacgucggcgu

SEQ ID NO: 434333 - RNA, 16 nt, Bordetella pertussis
cagcacgucggcgucg

SEQ ID NO: 434334 - RNA, 19 nt, Bordetella pertussis
cagcacgucguagcgcugc

SEQ ID NO: 434335 - RNA, 19 nt, Bordetella pertussis
cagcagauggcccuugccc

SEQ ID NO: 434336 - RNA, 23 nt, Bordetella pertussis
cagcagauggcccuugcccagcg

SEQ ID NO: 434337 - RNA, 14 nt, Bordetella pertussis
cagcagauggcuuu

SEQ ID NO: 434338 - RNA, 17 nt, Bordetella pertussis
cagcagauucaugggcg

SEQ ID NO: 434339 - RNA, 21 nt, Bordetella pertussis
cagcagauugccgcgcggcgc

SEQ ID NO: 434340 - RNA, 21 nt, Bordetella pertussis
cagcagcaccuucugccgcca

SEQ ID NO: 434341 - RNA, 21 nt, Bordetella pertussis
cagcagcacgaucgcggcgcu

SEQ ID NO: 434342 - RNA, 14 nt, Bordetella pertussis
cagcagcacgccca

SEQ ID NO: 434343 - RNA, 14 nt, Bordetella pertussis
cagcagcacggcca

SEQ ID NO: 434344 - RNA, 13 nt, Bordetella pertussis
cagcagcagcacg

SEQ ID NO: 434345 - RNA, 17 nt, Bordetella pertussis
cagcagcagcacggcca

SEQ ID NO: 434346 - RNA, 15 nt, Bordetella pertussis
cagcagcagcgccgc

SEQ ID NO: 434347 - RNA, 14 nt, Bordetella pertussis
cagcagcagcgagc

SEQ ID NO: 434348 - RNA, 13 nt, Bordetella pertussis
cagcagcaggccc

SEQ ID NO: 434349 - RNA, 16 nt, Bordetella pertussis
cagcagcaggcuggcc

SEQ ID NO: 434350 - RNA, 14 nt, Bordetella pertussis
cagcagcagggcca

SEQ ID NO: 434351 - RNA, 16 nt, Bordetella pertussis
cagcagcagggccagg

SEQ ID NO: 434352 - RNA, 17 nt, Bordetella pertussis
cagcagcaguugcagca

SEQ ID NO: 434353 - RNA, 18 nt, Bordetella pertussis
cagcagcaguugcagcau

SEQ ID NO: 434354 - RNA, 12 nt, Bordetella pertussis
cagcagcaggcu

SEQ ID NO: 434355 - RNA, 17 nt, Bordetella pertussis
cagcagcaugccgcggu

SEQ ID NO: 434356 - RNA, 18 nt, Bordetella pertussis
cagcagcaugcggcccgc

SEQ ID NO: 434357 - RNA, 21 nt, Bordetella pertussis
cagcagcaugcggcccgcgcu

SEQ ID NO: 434358 - RNA, 18 nt, Bordetella pertussis
cagcagcauuucgaugcg

SEQ ID NO: 434359 - RNA, 20 nt, Bordetella pertussis
cagcagcauuucgaugcgca

SEQ ID NO: 434360 - RNA, 17 nt, Bordetella pertussis
cagcagccccagcgucc

SEQ ID NO: 434361 - RNA, 16 nt, Bordetella pertussis
cagcagcccgcuggcc

SEQ ID NO: 434362 - RNA, 16 nt, Bordetella pertussis
cagcagcgacaggacg

SEQ ID NO: 434363 - RNA, 22 nt, Bordetella pertussis
cagcagcgacggccccagcgcc

SEQ ID NO: 434364 - RNA, 17 nt, Bordetella pertussis
cagcagcgagcccgcca

SEQ ID NO: 434365 - RNA, 15 nt, Bordetella pertussis
cagccacugcggccc

SEQ ID NO: 434366 - RNA, 18 nt, Bordetella pertussis
cagccagauaccguccuu

SEQ ID NO: 434367 - RNA, 19 nt, Bordetella pertussis
cagccagauucccccgcac

SEQ ID NO: 434368 - RNA, 24 nt, Bordetella pertussis
cagcccacaagccguacagcgaag

SEQ ID NO: 434369 - RNA, 13 nt, Bordetella pertussis
cagcccaccagcg

SEQ ID NO: 434370 - RNA, 23 nt, Bordetella pertussis
cagcccaccgcgaaccaggccug

SEQ ID NO: 434371 - RNA, 13 nt, Bordetella pertussis
cagcccagcacca

SEQ ID NO: 434372 - RNA, 19 nt, Bordetella pertussis
cagcccagcaccacggcau

SEQ ID NO: 434373 - RNA, 12 nt, Bordetella pertussis
cagcccagcacg

SEQ ID NO: 434374 - RNA, 16 nt, Bordetella pertussis
cagccccaaugugcug

SEQ ID NO: 434375 - RNA, 23 nt, Bordetella pertussis
cagccccaaugugcugacggugc

SEQ ID NO: 434376 - RNA, 14 nt, Bordetella pertussis
cagccccagcgcca

SEQ ID NO: 434377 - RNA, 14 nt, Bordetella pertussis
cagccccagcgccc

SEQ ID NO: 434378 - RNA, 18 nt, Bordetella pertussis
cagccccagcgcccaggc

SEQ ID NO: 434379 - RNA, 11 nt, Bordetella pertussis
cagccccaggc

SEQ ID NO: 434380 - RNA, 12 nt, Bordetella pertussis
cagccccaggcg

SEQ ID NO: 434381 - RNA, 12 nt, Bordetella pertussis
cagcccccugcg

SEQ ID NO: 434382 - RNA, 20 nt, Bordetella pertussis
cagcccccugguacgaucag

SEQ ID NO: 434383 - RNA, 19 nt, Bordetella pertussis
cagccccgggugcaggucc

SEQ ID NO: 434384 - RNA, 23 nt, Bordetella pertussis
cagcccgauaugcagccgcacca

SEQ ID NO: 434385 - RNA, 19 nt, Bordetella pertussis
cagcccgaucgacggccgc

SEQ ID NO: 434386 - RNA, 19 nt, Bordetella pertussis
cagcccgaugcgccaggcc

SEQ ID NO: 434387 - RNA, 16 nt, Bordetella pertussis
cagcccgcccgcgccc

SEQ ID NO: 434388 - RNA, 17 nt, Bordetella pertussis
cagcccgcccgcgccca

SEQ ID NO: 434389 - RNA, 15 nt, Bordetella pertussis
cagcccgccggcgcg

SEQ ID NO: 434390 - RNA, 17 nt, Bordetella pertussis
cagcccgcgcacgcccg

SEQ ID NO: 434391 - RNA, 15 nt, Bordetella pertussis
cagcccgcgcgcguu

SEQ ID NO: 434392 - RNA, 16 nt, Bordetella pertussis
cagcccgcgucgcugu

SEQ ID NO: 434393 - RNA, 14 nt, Bordetella pertussis
cagcccgcuggccg

SEQ ID NO: 434394 - RNA, 24 nt, Bordetella pertussis
cagcccggccagagccuggaagug

SEQ ID NO: 434395 - RNA, 12 nt, Bordetella pertussis
cagcccggcccc

SEQ ID NO: 434396 - RNA, 18 nt, Bordetella pertussis
cagcccggcccccagccc

SEQ ID NO: 434397 - RNA, 14 nt, Bordetella pertussis
cagcccggccgcca

SEQ ID NO: 434398 - RNA, 14 nt, Bordetella pertussis
cagcccggcggcca

SEQ ID NO: 434399 - RNA, 19 nt, Bordetella pertussis
cagcccggcgugcccaggg

SEQ ID NO: 434400 - RNA, 14 nt, Bordetella pertussis
cagccgcuccagcc

SEQ ID NO: 434401 - RNA, 13 nt, Bordetella pertussis
cagccgcuccagg

SEQ ID NO: 434402 - RNA, 14 nt, Bordetella pertussis
cagccgcucggcca

SEQ ID NO: 434403 - RNA, 23 nt, Bordetella pertussis
cagccgcucggccacgcgcugcu

SEQ ID NO: 434404 - RNA, 17 nt, Bordetella pertussis
cagccgcuggcgcgccg

SEQ ID NO: 434405 - RNA, 23 nt, Bordetella pertussis
cagccggggcgagcgcagccgcu

SEQ ID NO: 434406 - RNA, 22 nt, Bordetella pertussis
cagccggguggucgcgcccgcc

SEQ ID NO: 434407 - RNA, 12 nt, Bordetella pertussis
cagccgggugua

SEQ ID NO: 434408 - RNA, 14 nt, Bordetella pertussis
cagccggugccagu

SEQ ID NO: 434409 - RNA, 16 nt, Bordetella pertussis
cagccggugcgcggcu

SEQ ID NO: 434410 - RNA, 17 nt, Bordetella pertussis
cagccgugccgcgcgca

SEQ ID NO: 434411 - RNA, 22 nt, Bordetella pertussis
cagccguucaucagcgcgcgca

SEQ ID NO: 434412 - RNA, 15 nt, Bordetella pertussis
cagccguugaucugg

SEQ ID NO: 434413 - RNA, 16 nt, Bordetella pertussis
cagccguuggcgccca

SEQ ID NO: 434414 - RNA, 23 nt, Bordetella pertussis
cagccuguugcaggaucugguuc

SEQ ID NO: 434415 - RNA, 16 nt, Bordetella pertussis
cagccuugaaagaggc

SEQ ID NO: 434416 - RNA, 15 nt, Bordetella pertussis
cagccuuuccuccug

SEQ ID NO: 434417 - RNA, 20 nt, Bordetella pertussis
cagcgacagccaggccagcg

SEQ ID NO: 434418 - RNA, 13 nt, Bordetella pertussis
cagcgaccgcggc

SEQ ID NO: 434419 - RNA, 23 nt, Bordetella pertussis
cagcgacccgcaaaaccgggccc

SEQ ID NO: 434420 - RNA, 17 nt, Bordetella pertussis
cagcgacgagggcgcca

SEQ ID NO: 434421 - RNA, 22 nt, Bordetella pertussis
cagcgacgcgcgccggcgcucg

SEQ ID NO: 434422 - RNA, 14 nt, Bordetella pertussis
cagcgagagcgcca

SEQ ID NO: 434423 - RNA, 17 nt, Bordetella pertussis
cagcgagaucagcaccg

SEQ ID NO: 434424 - RNA, 14 nt, Bordetella pertussis
cagcgagcccgcca

SEQ ID NO: 434425 - RNA, 20 nt, Bordetella pertussis
cagcgagcccgccaucgcca

SEQ ID NO: 434426 - RNA, 17 nt, Bordetella pertussis
cagcgagccggccagcg

SEQ ID NO: 434427 - RNA, 16 nt, Bordetella pertussis
cagcgagcgaaagccg

SEQ ID NO: 434428 - RNA, 17 nt, Bordetella pertussis
cagcgagcugcgcugcu

SEQ ID NO: 434429 - RNA, 14 nt, Bordetella pertussis
cagcgaggacacgc

SEQ ID NO: 434430 - RNA, 17 nt, Bordetella pertussis
cagcgaggacacgcagc

SEQ ID NO: 434431 - RNA, 20 nt, Bordetella pertussis
cagcgaggccucgugcugcu

SEQ ID NO: 434432 - RNA, 15 nt, Bordetella pertussis
cagcgagguggugac

SEQ ID NO: 434433 - RNA, 23 nt, Bordetella pertussis
cagcgagucgaccaguucggcca

SEQ ID NO: 434434 - RNA, 17 nt, Bordetella pertussis
cagcgcaggaugggcag

SEQ ID NO: 434435 - RNA, 19 nt, Bordetella pertussis
cagcgcauaggacgccacc

SEQ ID NO: 434436 - RNA, 21 nt, Bordetella pertussis
cagcgcauaggacgccaccag

SEQ ID NO: 434437 - RNA, 20 nt, Bordetella pertussis
cagcgcaucgccgcaggcgu

SEQ ID NO: 434438 - RNA, 17 nt, Bordetella pertussis
cagcgcauuggugagca

SEQ ID NO: 434439 - RNA, 13 nt, Bordetella pertussis
cagcgccugcagg

SEQ ID NO: 434440 - RNA, 14 nt, Bordetella pertussis
cagcgccugccgau

SEQ ID NO: 434441 - RNA, 14 nt, Bordetella pertussis
cagcgccugccgcg

SEQ ID NO: 434442 - RNA, 17 nt, Bordetella pertussis
cagcgccugcgcggccu

SEQ ID NO: 434443 - RNA, 16 nt, Bordetella pertussis
cagcgccugcgcggcg

SEQ ID NO: 434444 - RNA, 19 nt, Bordetella pertussis
cagcgccugcucguagcug

SEQ ID NO: 434445 - RNA, 12 nt, Bordetella pertussis
cagcgccuggac

SEQ ID NO: 434446 - RNA, 15 nt, Bordetella pertussis
cagcgccuggaccug

SEQ ID NO: 434447 - RNA, 17 nt, Bordetella pertussis
cagcgccuggcggcugg

SEQ ID NO: 434448 - RNA, 15 nt, Bordetella pertussis
cagcgccuggcgggc

SEQ ID NO: 434449 - RNA, 17 nt, Bordetella pertussis
cagcgccuggcgggccu

SEQ ID NO: 434450 - RNA, 14 nt, Bordetella pertussis
cagcgccugggcgc

SEQ ID NO: 434451 - RNA, 18 nt, Bordetella pertussis
cagcgccugggcgcggau

SEQ ID NO: 434452 - RNA, 21 nt, Bordetella pertussis
cagcgccugggguaggcgcgg

SEQ ID NO: 434453 - RNA, 22 nt, Bordetella pertussis
cagcgccugggguaggcgcggu

SEQ ID NO: 434454 - RNA, 20 nt, Bordetella pertussis
cagcgccuugccgccgugcg

SEQ ID NO: 434455 - RNA, 24 nt, Bordetella pertussis
cagcgccuugccgccgugcgagca

SEQ ID NO: 434456 - RNA, 10 nt, Bordetella pertussis
cagcgcggcc

SEQ ID NO: 434457 - RNA, 17 nt, Bordetella pertussis
cagcgcggccagcaccg

SEQ ID NO: 434458 - RNA, 14 nt, Bordetella pertussis
cagcgcggccaggu

SEQ ID NO: 434459 - RNA, 14 nt, Bordetella pertussis
cagcgcggccggca

SEQ ID NO: 434460 - RNA, 21 nt, Bordetella pertussis
cagcgcggcgaaggcgcggcu

SEQ ID NO: 434461 - RNA, 23 nt, Bordetella pertussis
cagcgcguccugcacguccucga

SEQ ID NO: 434462 - RNA, 16 nt, Bordetella pertussis
cagcgcgucgagcagc

SEQ ID NO: 434463 - RNA, 14 nt, Bordetella pertussis
cagcgcgucggcca

SEQ ID NO: 434464 - RNA, 17 nt, Bordetella pertussis
cagcgcgucggccaggc

SEQ ID NO: 434465 - RNA, 18 nt, Bordetella pertussis
cagcgcgucggcgccgau

SEQ ID NO: 434466 - RNA, 21 nt, Bordetella pertussis
cagcgcgugcagccagcggcc

SEQ ID NO: 434467 - RNA, 19 nt, Bordetella pertussis
cagcgcgugggccagcaac

SEQ ID NO: 434468 - RNA, 23 nt, Bordetella pertussis
cagcgcgugugguuggcgcugcu

SEQ ID NO: 434469 - RNA, 20 nt, Bordetella pertussis
cagcgcuugaguuuggcgaa

SEQ ID NO: 434470 - RNA, 17 nt, Bordetella pertussis
cagcgcuugcacgccau

SEQ ID NO: 434471 - RNA, 23 nt, Bordetella pertussis
cagcggaaguauucgcgcggcga

SEQ ID NO: 434472 - RNA, 16 nt, Bordetella pertussis
cagcggacggcgcgga

SEQ ID NO: 434473 - RNA, 17 nt, Bordetella pertussis
cagcggacgggccaggc

SEQ ID NO: 434474 - RNA, 16 nt, Bordetella pertussis
cagcggacgguagcgc

SEQ ID NO: 434475 - RNA, 23 nt, Bordetella pertussis
cagcggagccgcgcacacauggc

SEQ ID NO: 434476 - RNA, 18 nt, Bordetella pertussis
cagcggagcgacggcaga

SEQ ID NO: 434477 - RNA, 14 nt, Bordetella pertussis
cagcggaucgccgg

SEQ ID NO: 434478 - RNA, 17 nt, Bordetella pertussis
cagcggaucgccgggca

SEQ ID NO: 434479 - RNA, 20 nt, Bordetella pertussis
cagcggaugaugcggcgcca

SEQ ID NO: 434480 - RNA, 15 nt, Bordetella pertussis
cagcggaugccgccc

SEQ ID NO: 434481 - RNA, 14 nt, Bordetella pertussis
cagcggcaaaguag

SEQ ID NO: 434482 - RNA, 22 nt, Bordetella pertussis
cagcggcaaaguagugccccca

SEQ ID NO: 434483 - RNA, 13 nt, Bordetella pertussis
cagcggcagcgca

SEQ ID NO: 434484 - RNA, 15 nt, Bordetella pertussis
cagcggcagcgcgca

SEQ ID NO: 434485 - RNA, 21 nt, Bordetella pertussis
cagcggcagcgcgcaggacaa

SEQ ID NO: 434486 - RNA, 22 nt, Bordetella pertussis
cagcggcaggcccugccgccuc

SEQ ID NO: 434487 - RNA, 23 nt, Bordetella pertussis
cagcggcaggggcucgcgcccga

SEQ ID NO: 434488 - RNA, 23 nt, Bordetella pertussis
cagcggcaucacgccgguguucu

SEQ ID NO: 434489 - RNA, 17 nt, Bordetella pertussis
cagcggccagcgcggcg

SEQ ID NO: 434490 - RNA, 14 nt, Bordetella pertussis
cagcggccgcugcc

SEQ ID NO: 434491 - RNA, 18 nt, Bordetella pertussis
cagcggcgagcaauccgu

SEQ ID NO: 434492 - RNA, 20 nt, Bordetella pertussis
cagcggcgcaccgacagcaa

SEQ ID NO: 434493 - RNA, 15 nt, Bordetella pertussis
cagcggcgccaugcg

SEQ ID NO: 434494 - RNA, 13 nt, Bordetella pertussis
cagcggcgccgga

SEQ ID NO: 434495 - RNA, 14 nt, Bordetella pertussis
cagcggcgcgcgca

SEQ ID NO: 434496 - RNA, 17 nt, Bordetella pertussis
cagcggcgcggcgcgcu

SEQ ID NO: 434497 - RNA, 15 nt, Bordetella pertussis
cagcggcggcacgcg

SEQ ID NO: 434498 - RNA, 20 nt, Bordetella pertussis
cagcggcggcacgcgcgccg

SEQ ID NO: 434499 - RNA, 13 nt, Bordetella pertussis
cagcggcggcgcg

SEQ ID NO: 434500 - RNA, 21 nt, Bordetella pertussis
cagcggcguauaggccacccc

SEQ ID NO: 434501 - RNA, 20 nt, Bordetella pertussis
cagcggcgugaugcccaggc

SEQ ID NO: 434502 - RNA, 23 nt, Bordetella pertussis
cagcggcgugcggcccagccgcu

SEQ ID NO: 434503 - RNA, 21 nt, Bordetella pertussis
cagcggcuccccuggucaggg

SEQ ID NO: 434504 - RNA, 13 nt, Bordetella pertussis
cagcggcucgacg

SEQ ID NO: 434505 - RNA, 19 nt, Bordetella pertussis
cagcgggccgcagcauggc

SEQ ID NO: 434506 - RNA, 13 nt, Bordetella pertussis
cagcgggcugggg

SEQ ID NO: 434507 - RNA, 18 nt, Bordetella pertussis
cagcgggcuggggcaggc

SEQ ID NO: 434508 - RNA, 18 nt, Bordetella pertussis
cagcggggacaggcaccc

SEQ ID NO: 434509 - RNA, 19 nt, Bordetella pertussis
cagcggggacaggcacccc

SEQ ID NO: 434510 - RNA, 20 nt, Bordetella pertussis
cagcggggacaggcgcccgu

SEQ ID NO: 434511 - RNA, 16 nt, Bordetella pertussis
cagcggguugcgcgcc

SEQ ID NO: 434512 - RNA, 17 nt, Bordetella pertussis
cagcggguugcgcgcca

SEQ ID NO: 434513 - RNA, 15 nt, Bordetella pertussis
cagcggugcgcggcg

SEQ ID NO: 434514 - RNA, 19 nt, Bordetella pertussis
cagcgucaauccgccgcca

SEQ ID NO: 434515 - RNA, 17 nt, Bordetella pertussis
cagcgucaccagcaggc

SEQ ID NO: 434516 - RNA, 18 nt, Bordetella pertussis
cagcgucagcugggcaug

SEQ ID NO: 434517 - RNA, 15 nt, Bordetella pertussis
cagcgucaugcgcac

SEQ ID NO: 434518 - RNA, 22 nt, Bordetella pertussis
cagcgucauggccuggcccagc

SEQ ID NO: 434519 - RNA, 23 nt, Bordetella pertussis
cagcgucaugugcugcggcagcc

SEQ ID NO: 434520 - RNA, 12 nt, Bordetella pertussis
cagcgucugcug

SEQ ID NO: 434521 - RNA, 19 nt, Bordetella pertussis
cagcgucugcugguacagc

SEQ ID NO: 434522 - RNA, 17 nt, Bordetella pertussis
cagcgugaccgacaggc

SEQ ID NO: 434523 - RNA, 19 nt, Bordetella pertussis
cagcgugaccgacaggccu

SEQ ID NO: 434524 - RNA, 20 nt, Bordetella pertussis
cagcgugaugcggucggcca

SEQ ID NO: 434525 - RNA, 20 nt, Bordetella pertussis
cagcgugcgccccgccucga

SEQ ID NO: 434526 - RNA, 15 nt, Bordetella pertussis
cagcguggagcugcu

SEQ ID NO: 434527 - RNA, 18 nt, Bordetella pertussis
cagcguggagcugcucac

SEQ ID NO: 434528 - RNA, 13 nt, Bordetella pertussis
cagcguggccacc

SEQ ID NO: 434529 - RNA, 13 nt, Bordetella pertussis
cagcguggccgcc

SEQ ID NO: 434530 - RNA, 14 nt, Bordetella pertussis
cagcguggccgcca

SEQ ID NO: 434531 - RNA, 18 nt, Bordetella pertussis
cagcguggccgccaccag

SEQ ID NO: 434532 - RNA, 19 nt, Bordetella pertussis
cagcguggccgccaccagc

SEQ ID NO: 434533 - RNA, 20 nt, Bordetella pertussis
cagcguguaggcggccggcu

SEQ ID NO: 434534 - RNA, 18 nt, Bordetella pertussis
cagcgugucgaacaccag

SEQ ID NO: 434535 - RNA, 21 nt, Bordetella pertussis
cagcguguggugaaagccgcc

SEQ ID NO: 434536 - RNA, 16 nt, Bordetella pertussis
cagcguucggccaccc

SEQ ID NO: 434537 - RNA, 24 nt, Bordetella pertussis
cagcguuucaccgcuggacgaggc

SEQ ID NO: 434538 - RNA, 23 nt, Bordetella pertussis
cagcucggcgaucugcgcggcgg

SEQ ID NO: 434539 - RNA, 17 nt, Bordetella pertussis
cagcucguccagguugc

SEQ ID NO: 434540 - RNA, 15 nt, Bordetella pertussis
cagcucgucgccgcu

SEQ ID NO: 434541 - RNA, 16 nt, Bordetella pertussis
cagcucgucgccgcug

SEQ ID NO: 434542 - RNA, 23 nt, Bordetella pertussis
cagcucggugcagcccagcacca

SEQ ID NO: 434543 - RNA, 15 nt, Bordetella pertussis
cagcucguggcgcgc

SEQ ID NO: 434544 - RNA, 17 nt, Bordetella pertussis
cagcucguggcgcgccu

SEQ ID NO: 434545 - RNA, 22 nt, Bordetella pertussis
cagcucguggcgcgccuccagc

SEQ ID NO: 434546 - RNA, 16 nt, Bordetella pertussis
cagcugaccucgccca

SEQ ID NO: 434547 - RNA, 17 nt, Bordetella pertussis
cagcugcaugcgcacgg

SEQ ID NO: 434548 - RNA, 21 nt, Bordetella pertussis
cagcugccugagcaccgccgc

SEQ ID NO: 434549 - RNA, 19 nt, Bordetella pertussis
cagcugcgaaagcgcgucg

SEQ ID NO: 434550 - RNA, 15 nt, Bordetella pertussis
cagcugcgccagccc

SEQ ID NO: 434551 - RNA, 20 nt, Bordetella pertussis
cagcugcgcgcgagcggcgg

SEQ ID NO: 434552 - RNA, 19 nt, Bordetella pertussis
cagcugcgcgucgacagca

SEQ ID NO: 434553 - RNA, 20 nt, Bordetella pertussis
cagcugcgcgucgacagcau

SEQ ID NO: 434554 - RNA, 23 nt, Bordetella pertussis
cagcuggaacgcgccgcuggcgu

SEQ ID NO: 434555 - RNA, 17 nt, Bordetella pertussis
cagcuggaagcgcgcca

SEQ ID NO: 434556 - RNA, 23 nt, Bordetella pertussis
cagcuggacuauggccuggaugu

SEQ ID NO: 434557 - RNA, 20 nt, Bordetella pertussis
cagcuggcgcaccaggcugg

SEQ ID NO: 434558 - RNA, 15 nt, Bordetella pertussis
cagcuggcgccccuu

SEQ ID NO: 434559 - RNA, 17 nt, Bordetella pertussis
cagcuggcgcgggcggc

SEQ ID NO: 434560 - RNA, 18 nt, Bordetella pertussis
cagcuggcggcgcagcac

SEQ ID NO: 434561 - RNA, 18 nt, Bordetella pertussis
cagcugggaggcgugcug

SEQ ID NO: 434562 - RNA, 15 nt, Bordetella pertussis
cagcugggcaugcac

SEQ ID NO: 434563 - RNA, 15 nt, Bordetella pertussis
cagcuucuccaugcg

SEQ ID NO: 434564 - RNA, 16 nt, Bordetella pertussis
cagcuucugcgccugc

SEQ ID NO: 434565 - RNA, 22 nt, Bordetella pertussis
cagcuucuggaucaccgccggc

SEQ ID NO: 434566 - RNA, 23 nt, Bordetella pertussis
cagcuuggccaccacgcccaucu

SEQ ID NO: 434567 - RNA, 15 nt, Bordetella pertussis
cagcuuggcgcgccg

SEQ ID NO: 434568 - RNA, 21 nt, Bordetella pertussis
cagcuuggcguacggcugcac

SEQ ID NO: 434569 - RNA, 18 nt, Bordetella pertussis
cagcuugggcauuuccca

SEQ ID NO: 434570 - RNA, 23 nt, Bordetella pertussis
cagcuugggcauuucccagccgu

SEQ ID NO: 434571 - RNA, 21 nt, Bordetella pertussis
cagcuugucgaucgccaccag

SEQ ID NO: 434572 - RNA, 20 nt, Bordetella pertussis
cagcuugucggccgcgcgca

SEQ ID NO: 434573 - RNA, 19 nt, Bordetella pertussis
caggaaaaccggcgccugg

SEQ ID NO: 434574 - RNA, 19 nt, Bordetella pertussis
caggaaaaccuccuccgcg

SEQ ID NO: 434575 - RNA, 21 nt, Bordetella pertussis
caggaaaaucgauacgccggg

SEQ ID NO: 434576 - RNA, 23 nt, Bordetella pertussis
caggaaaaucgauacgccgggcg

SEQ ID NO: 434577 - RNA, 14 nt, Bordetella pertussis
caggaaaagcaggc

SEQ ID NO: 434578 - RNA, 16 nt, Bordetella pertussis
caggaaagaggccagg

SEQ ID NO: 434579 - RNA, 15 nt, Bordetella pertussis
caggaaagcgccgcc

SEQ ID NO: 434580 - RNA, 16 nt, Bordetella pertussis
caggaaagcgccgccg

SEQ ID NO: 434581 - RNA, 16 nt, Bordetella pertussis
caggaacggcauggca

SEQ ID NO: 434582 - RNA, 16 nt, Bordetella pertussis
caggaacucagcgcac

SEQ ID NO: 434583 - RNA, 20 nt, Bordetella pertussis
caggaacucagcgcacugau

SEQ ID NO: 434584 - RNA, 23 nt, Bordetella pertussis
caggaacucgcacacgcgcuggg

SEQ ID NO: 434585 - RNA, 19 nt, Bordetella pertussis
caggaacuccggcggcgca

SEQ ID NO: 434586 - RNA, 14 nt, Bordetella pertussis
caggaagacuuccg

SEQ ID NO: 434587 - RNA, 16 nt, Bordetella pertussis
caggaagcagcccagc

SEQ ID NO: 434588 - RNA, 16 nt, Bordetella pertussis
caggaagcgcgccgcg

SEQ ID NO: 434589 - RNA, 22 nt, Bordetella pertussis
caggaagcgcgccgcgcgcacg

SEQ ID NO: 434590 - RNA, 14 nt, Bordetella pertussis
caggaagcgcgccu

SEQ ID NO: 434591 - RNA, 22 nt, Bordetella pertussis
caggaagcgcuggcccgucaug

SEQ ID NO: 434592 - RNA, 18 nt, Bordetella pertussis
caggaagccugcgcgcga

SEQ ID NO: 434593 - RNA, 16 nt, Bordetella pertussis
caggacaaggcgcgcg

SEQ ID NO: 434594 - RNA, 14 nt, Bordetella pertussis
caggagcucguccc

SEQ ID NO: 434595 - RNA, 15 nt, Bordetella pertussis
caggaggcgcgggca

SEQ ID NO: 434596 - RNA, 13 nt, Bordetella pertussis
caggauccccagc

SEQ ID NO: 434597 - RNA, 14 nt, Bordetella pertussis
caggaugccgccuu

SEQ ID NO: 434598 - RNA, 14 nt, Bordetella pertussis
caggaugcgcaccg

SEQ ID NO: 434599 - RNA, 14 nt, Bordetella pertussis
caggaugcgcgcca

SEQ ID NO: 434600 - RNA, 16 nt, Bordetella pertussis
caggaugcgcgccagg

SEQ ID NO: 434601 - RNA, 21 nt, Bordetella pertussis
caggaugcgcgccaggcuguc

SEQ ID NO: 434602 - RNA, 23 nt, Bordetella pertussis
caggauggccacgaccaccagcg

SEQ ID NO: 434603 - RNA, 19 nt, Bordetella pertussis
caggauggcgaucaggaaa

SEQ ID NO: 434604 - RNA, 13 nt, Bordetella pertussis
caggauggcgcca

SEQ ID NO: 434605 - RNA, 19 nt, Bordetella pertussis
caggauggcgccagcccgc

SEQ ID NO: 434606 - RNA, 18 nt, Bordetella pertussis
caggaugggcagcucgcc

SEQ ID NO: 434607 - RNA, 19 nt, Bordetella pertussis
caggaugggcagcucgccu

SEQ ID NO: 434608 - RNA, 21 nt, Bordetella pertussis
caggaugggcgcuuggcccug

SEQ ID NO: 434609 - RNA, 22 nt, Bordetella pertussis
caggauuccugcgaggacaggg

SEQ ID NO: 434610 - RNA, 16 nt, Bordetella pertussis
caggauuucauggcau

SEQ ID NO: 434611 - RNA, 13 nt, Bordetella pertussis
caggcaaagccug

SEQ ID NO: 434612 - RNA, 18 nt, Bordetella pertussis
caggcaaagccugacggc

SEQ ID NO: 434613 - RNA, 16 nt, Bordetella pertussis
caggcaaaggcccagg

SEQ ID NO: 434614 - RNA, 17 nt, Bordetella pertussis
caggcaaaggcccaggc

SEQ ID NO: 434615 - RNA, 23 nt, Bordetella pertussis
caggcacaccggucuacgccaug

SEQ ID NO: 434616 - RNA, 13 nt, Bordetella pertussis
caggcacaccgug

SEQ ID NO: 434617 - RNA, 15 nt, Bordetella pertussis
caggcacaccgugcc

SEQ ID NO: 434618 - RNA, 16 nt, Bordetella pertussis
caggcacaccgugccg

SEQ ID NO: 434619 - RNA, 20 nt, Bordetella pertussis
caggcacaccgugccgcaga

SEQ ID NO: 434620 - RNA, 16 nt, Bordetella pertussis
caggcacaggaacagc

SEQ ID NO: 434621 - RNA, 14 nt, Bordetella pertussis
caggcacccagggg

SEQ ID NO: 434622 - RNA, 16 nt, Bordetella pertussis
caggcacccccgaccg

SEQ ID NO: 434623 - RNA, 19 nt, Bordetella pertussis
caggcaccccggcgccgcg

SEQ ID NO: 434624 - RNA, 23 nt, Bordetella pertussis
caggcaccccgucguccguccug

SEQ ID NO: 434625 - RNA, 17 nt, Bordetella pertussis
caggcacccgcacgggc

SEQ ID NO: 434626 - RNA, 15 nt, Bordetella pertussis
caggcacccugcccc

SEQ ID NO: 434627 - RNA, 18 nt, Bordetella pertussis
caggcacccugucauacg

SEQ ID NO: 434628 - RNA, 23 nt, Bordetella pertussis
caggcacccugucauacgccaug

SEQ ID NO: 434629 - RNA, 14 nt, Bordetella pertussis
caggcacccuugcc

SEQ ID NO: 434630 - RNA, 20 nt, Bordetella pertussis
caggcacccuugccgcgggu

SEQ ID NO: 434631 - RNA, 21 nt, Bordetella pertussis
caggcaccgccgcacagccaa

SEQ ID NO: 434632 - RNA, 14 nt, Bordetella pertussis
caggcacauugccg

SEQ ID NO: 434633 - RNA, 22 nt, Bordetella pertussis
caggcaccucguucaccccccg

SEQ ID NO: 434634 - RNA, 14 nt, Bordetella pertussis
caggcaccugcgac

SEQ ID NO: 434635 - RNA, 15 nt, Bordetella pertussis
caggcaccuuggccc

SEQ ID NO: 434636 - RNA, 20 nt, Bordetella pertussis
caggcacgacgcgaaccagg

SEQ ID NO: 434637 - RNA, 23 nt, Bordetella pertussis
caggcacgacgcgaaccaggcca

SEQ ID NO: 434638 - RNA, 19 nt, Bordetella pertussis
caggcacuggcgcggcgcu

SEQ ID NO: 434639 - RNA, 20 nt, Bordetella pertussis
caggcagcaaccggaacacc

SEQ ID NO: 434640 - RNA, 19 nt, Bordetella pertussis
caggcagccggccccgcaa

SEQ ID NO: 434641 - RNA, 15 nt, Bordetella pertussis
caggcaggcgggccc

SEQ ID NO: 434642 - RNA, 18 nt, Bordetella pertussis
caggcaguuggcggcgca

SEQ ID NO: 434643 - RNA, 23 nt, Bordetella pertussis
caggcauugaagcuggcgccggu

SEQ ID NO: 434644 - RNA, 19 nt, Bordetella pertussis
caggccgucgagccgggcg

SEQ ID NO: 434645 - RNA, 17 nt, Bordetella pertussis
caggccgucggccaggg

SEQ ID NO: 434646 - RNA, 20 nt, Bordetella pertussis
caggccgucggccaggggca

SEQ ID NO: 434647 - RNA, 18 nt, Bordetella pertussis
caggccgugagcgccgcc

SEQ ID NO: 434648 - RNA, 20 nt, Bordetella pertussis
caggccgugagcgccgccgc

SEQ ID NO: 434649 - RNA, 18 nt, Bordetella pertussis
caggccguuggcgcgccu

SEQ ID NO: 434650 - RNA, 18 nt, Bordetella pertussis
caggccguuguccuggcg

SEQ ID NO: 434651 - RNA, 21 nt, Bordetella pertussis
caggccguuuacuccccagac

SEQ ID NO: 434652 - RNA, 16 nt, Bordetella pertussis
caggcgaaacgccagc

SEQ ID NO: 434653 - RNA, 15 nt, Bordetella pertussis
caggcgagcgccgcg

SEQ ID NO: 434654 - RNA, 23 nt, Bordetella pertussis
caggcgcauauggagccaggcgg

SEQ ID NO: 434655 - RNA, 20 nt, Bordetella pertussis
caggcgcauggugagggcca

SEQ ID NO: 434656 - RNA, 20 nt, Bordetella pertussis
caggcgccagaugcgccgca

SEQ ID NO: 434657 - RNA, 13 nt, Bordetella pertussis
caggcgccccacc

SEQ ID NO: 434658 - RNA, 18 nt, Bordetella pertussis
caggcgccgauccagggc

SEQ ID NO: 434659 - RNA, 20 nt, Bordetella pertussis
caggcgccgcaacaggcagc

SEQ ID NO: 434660 - RNA, 18 nt, Bordetella pertussis
caggcgccgcacgccggu

SEQ ID NO: 434661 - RNA, 21 nt, Bordetella pertussis
caggcgccgccgcccggcaac

SEQ ID NO: 434662 - RNA, 19 nt, Bordetella pertussis
caggcgccgcguccggcgc

SEQ ID NO: 434663 - RNA, 22 nt, Bordetella pertussis
caggcgccuacaguuccaccug

SEQ ID NO: 434664 - RNA, 19 nt, Bordetella pertussis
caggcgccucgcgacggcc

SEQ ID NO: 434665 - RNA, 20 nt, Bordetella pertussis
caggcgccucgcgacggccu

SEQ ID NO: 434666 - RNA, 11 nt, Bordetella pertussis
caggcgccugc

SEQ ID NO: 434667 - RNA, 15 nt, Bordetella pertussis
caggcgccugccccg

SEQ ID NO: 434668 - RNA, 19 nt, Bordetella pertussis
caggcgccugcucacgccc

SEQ ID NO: 434669 - RNA, 22 nt, Bordetella pertussis
caggcgccugcucacgccccgc

SEQ ID NO: 434670 - RNA, 16 nt, Bordetella pertussis
caggcgccgcucagcg

SEQ ID NO: 434671 - RNA, 11 nt, Bordetella pertussis
caggcgccggg

SEQ ID NO: 434672 - RNA, 16 nt, Bordetella pertussis
caggcgccgggccgcu

SEQ ID NO: 434673 - RNA, 19 nt, Bordetella pertussis
caggcgcgagcgccgggcg

SEQ ID NO: 434674 - RNA, 18 nt, Bordetella pertussis
caggcgcgagguggcgcu

SEQ ID NO: 434675 - RNA, 16 nt, Bordetella pertussis
caggcgcgcaggcggg

SEQ ID NO: 434676 - RNA, 22 nt, Bordetella pertussis
caggcgcgcaucgcgcggcaug

SEQ ID NO: 434677 - RNA, 18 nt, Bordetella pertussis
caggcgcgccagccgcug

SEQ ID NO: 434678 - RNA, 18 nt, Bordetella pertussis
caggcgcgccaggggaug

SEQ ID NO: 434679 - RNA, 17 nt, Bordetella pertussis
caggcgcgccauccuga

SEQ ID NO: 434680 - RNA, 18 nt, Bordetella pertussis
caggcgcgccgcgauggc

SEQ ID NO: 434681 - RNA, 13 nt, Bordetella pertussis
caggcgcgcgccu

SEQ ID NO: 434682 - RNA, 13 nt, Bordetella pertussis
caggcgcgcggcc

SEQ ID NO: 434683 - RNA, 15 nt, Bordetella pertussis
caggcgcgcggccuc

SEQ ID NO: 434684 - RNA, 24 nt, Bordetella pertussis
caggcgcgcggcguugcggcgcca

SEQ ID NO: 434685 - RNA, 21 nt, Bordetella pertussis
caggcgcgugaggucgcgcgu

SEQ ID NO: 434686 - RNA, 14 nt, Bordetella pertussis
caggcgcucggcca

SEQ ID NO: 434687 - RNA, 17 nt, Bordetella pertussis
caggcgcucgaggcgcu

SEQ ID NO: 434688 - RNA, 19 nt, Bordetella pertussis
caggcgcucgcgcugcagg

SEQ ID NO: 434689 - RNA, 13 nt, Bordetella pertussis
caggcgcugcagc

SEQ ID NO: 434690 - RNA, 20 nt, Bordetella pertussis
caggcgcugcagcaauccau

SEQ ID NO: 434691 - RNA, 22 nt, Bordetella pertussis
caggcgcugcgcgaaacggccg

SEQ ID NO: 434692 - RNA, 22 nt, Bordetella pertussis
caggcgcuggucgucgcgaaac

SEQ ID NO: 434693 - RNA, 18 nt, Bordetella pertussis
caggcggcaggcgccgcc

SEQ ID NO: 434694 - RNA, 22 nt, Bordetella pertussis
caggcggccaccaccaggccca

SEQ ID NO: 434695 - RNA, 17 nt, Bordetella pertussis
caggcggccagggccug

SEQ ID NO: 434696 - RNA, 20 nt, Bordetella pertussis
caggcggccaucgccgccac

SEQ ID NO: 434697 - RNA, 17 nt, Bordetella pertussis
caggcggccgaccagca

SEQ ID NO: 434698 - RNA, 22 nt, Bordetella pertussis
caggcggcgcaucagcgcgccc

SEQ ID NO: 434699 - RNA, 20 nt, Bordetella pertussis
caggcggcgcucgaaggcgc

SEQ ID NO: 434700 - RNA, 14 nt, Bordetella pertussis
caggcggcggccuc

SEQ ID NO: 434701 - RNA, 21 nt, Bordetella pertussis
caggcggcguaguucagccac

SEQ ID NO: 434702 - RNA, 17 nt, Bordetella pertussis
caggcggcugcccaccu

SEQ ID NO: 434703 - RNA, 20 nt, Bordetella pertussis
caggcggcuuucaugggccu

SEQ ID NO: 434704 - RNA, 22 nt, Bordetella pertussis
caggcggcuuucaugggccugg

SEQ ID NO: 434705 - RNA, 14 nt, Bordetella pertussis
caggcgggcccgca

SEQ ID NO: 434706 - RNA, 15 nt, Bordetella pertussis
caggcgugcgcagcu

SEQ ID NO: 434707 - RNA, 16 nt, Bordetella pertussis
caggcguugcgccgca

SEQ ID NO: 434708 - RNA, 16 nt, Bordetella pertussis
caggcucuggcugacg

SEQ ID NO: 434709 - RNA, 14 nt, Bordetella pertussis
caggcucugggcgg

SEQ ID NO: 434710 - RNA, 23 nt, Bordetella pertussis
caggcucuuuuucgagccgcaga

SEQ ID NO: 434711 - RNA, 15 nt, Bordetella pertussis
caggcugaccagcgc

SEQ ID NO: 434712 - RNA, 20 nt, Bordetella pertussis
caggcugcccuggcccaggc

SEQ ID NO: 434713 - RNA, 12 nt, Bordetella pertussis
caggcugccgcc

SEQ ID NO: 434714 - RNA, 20 nt, Bordetella pertussis
caggcugaucacccacagca

SEQ ID NO: 434715 - RNA, 22 nt, Bordetella pertussis
cagggccugcgggccgggcagg

SEQ ID NO: 434716 - RNA, 15 nt, Bordetella pertussis
cagggcgaaggccag

SEQ ID NO: 434717 - RNA, 19 nt, Bordetella pertussis
cagggcgaaggccagcgcc

SEQ ID NO: 434718 - RNA, 20 nt, Bordetella pertussis
cagggcgaaggccagcgccu

SEQ ID NO: 434719 - RNA, 20 nt, Bordetella pertussis
cagggcgaacguggccugcu

SEQ ID NO: 434720 - RNA, 17 nt, Bordetella pertussis
cagggcgaagcgcgccu

SEQ ID NO: 434721 - RNA, 20 nt, Bordetella pertussis
cagggcgacgucccaggccg

SEQ ID NO: 434722 - RNA, 20 nt, Bordetella pertussis
cagggcgaugaccggcaagc

SEQ ID NO: 434723 - RNA, 22 nt, Bordetella pertussis
cagggcgaugaccggcaagcgc

SEQ ID NO: 434724 - RNA, 17 nt, Bordetella pertussis
cagggcgaugccgcaga

SEQ ID NO: 434725 - RNA, 18 nt, Bordetella pertussis
cagggcgaugcggcggcc

SEQ ID NO: 434726 - RNA, 14 nt, Bordetella pertussis
cagggcgcgcagca

SEQ ID NO: 434727 - RNA, 14 nt, Bordetella pertussis
cagggcgcgccgga

SEQ ID NO: 434728 - RNA, 16 nt, Bordetella pertussis
cagggcgcgccggaac

SEQ ID NO: 434729 - RNA, 17 nt, Bordetella pertussis
cagggcgcgccggaaca

SEQ ID NO: 434730 - RNA, 21 nt, Bordetella pertussis
cagggcgcgccggaacauggc

SEQ ID NO: 434731 - RNA, 12 nt, Bordetella pertussis
cagggcgccgcg

SEQ ID NO: 434732 - RNA, 23 nt, Bordetella pertussis
cagggucaaggcgcggccgucgu

SEQ ID NO: 434733 - RNA, 16 nt, Bordetella pertussis
cagggucagcccgcca

SEQ ID NO: 434734 - RNA, 15 nt, Bordetella pertussis
caggguccagguggc

SEQ ID NO: 434735 - RNA, 19 nt, Bordetella pertussis
cagggucgagaccagcagc

SEQ ID NO: 434736 - RNA, 17 nt, Bordetella pertussis
cagggucucggccacgg

SEQ ID NO: 434737 - RNA, 19 nt, Bordetella pertussis
cagggugaccuggcgcgcg

SEQ ID NO: 434738 - RNA, 19 nt, Bordetella pertussis
cagggugacgggcugggcc

SEQ ID NO: 434739 - RNA, 21 nt, Bordetella pertussis
cagggugagggugaccauguc

SEQ ID NO: 434740 - RNA, 14 nt, Bordetella pertussis
cagggugccgcgcc

SEQ ID NO: 434741 - RNA, 21 nt, Bordetella pertussis
cagggugccuguccccgcagg

SEQ ID NO: 434742 - RNA, 22 nt, Bordetella pertussis
cagggugcuguucaggcgcucg

SEQ ID NO: 434743 - RNA, 23 nt, Bordetella pertussis
caggguggagaauucggcgcgua

SEQ ID NO: 434744 - RNA, 13 nt, Bordetella pertussis
caggguggccagu

SEQ ID NO: 434745 - RNA, 16 nt, Bordetella pertussis
caggguggccaguucc

SEQ ID NO: 434746 - RNA, 14 nt, Bordetella pertussis
caggguggcgccca

SEQ ID NO: 434747 - RNA, 18 nt, Bordetella pertussis
caggguggcgccggccac

SEQ ID NO: 434748 - RNA, 20 nt, Bordetella pertussis
caggguggcgccggccaccg

SEQ ID NO: 434749 - RNA, 16 nt, Bordetella pertussis
caggguggccgcgacu

SEQ ID NO: 434750 - RNA, 14 nt, Bordetella pertussis
cagggugggcacgc

SEQ ID NO: 434751 - RNA, 15 nt, Bordetella pertussis
cagggugggcacgcg

SEQ ID NO: 434752 - RNA, 16 nt, Bordetella pertussis
cagggugguggccucg

SEQ ID NO: 434753 - RNA, 22 nt, Bordetella pertussis
caggguguagaccugcgggccg

SEQ ID NO: 434754 - RNA, 20 nt, Bordetella pertussis
cagggugucgccggggcgca

SEQ ID NO: 434755 - RNA, 17 nt, Bordetella pertussis
cagggugucggccaggg

SEQ ID NO: 434756 - RNA, 20 nt, Bordetella pertussis
caggguguccuggucggcgc

SEQ ID NO: 434757 - RNA, 19 nt, Bordetella pertussis
caggguucggugccugucc

SEQ ID NO: 434758 - RNA, 22 nt, Bordetella pertussis
caggguucggugccuguccccg

SEQ ID NO: 434759 - RNA, 15 nt, Bordetella pertussis
caggguuggcgcgcc

SEQ ID NO: 434760 - RNA, 16 nt, Bordetella pertussis
caggguuggcgcgccg

SEQ ID NO: 434761 - RNA, 21 nt, Bordetella pertussis
caggguuguccgaaccacccg

SEQ ID NO: 434762 - RNA, 16 nt, Bordetella pertussis
cagguacaggccgccg

SEQ ID NO: 434763 - RNA, 18 nt, Bordetella pertussis
cagguacaucauccccag

SEQ ID NO: 434764 - RNA, 17 nt, Bordetella pertussis
cagguacccccagcggc

SEQ ID NO: 434765 - RNA, 23 nt, Bordetella pertussis
cagguacccccagcggcgcaccg

SEQ ID NO: 434766 - RNA, 13 nt, Bordetella pertussis
cagguacccggcu

SEQ ID NO: 434767 - RNA, 16 nt, Bordetella pertussis
cagguagaucagccgc

SEQ ID NO: 434768 - RNA, 15 nt, Bordetella pertussis
cagguaggacggcgc

SEQ ID NO: 434769 - RNA, 15 nt, Bordetella pertussis
cagguaggccggcgc

SEQ ID NO: 434770 - RNA, 15 nt, Bordetella pertussis
cagguaggcgccggu

SEQ ID NO: 434771 - RNA, 15 nt, Bordetella pertussis
cagguagggcagcag

SEQ ID NO: 434772 - RNA, 17 nt, Bordetella pertussis
cagguagggcagcaggu

SEQ ID NO: 434773 - RNA, 23 nt, Bordetella pertussis
cagguagucguucugggagcgcg

SEQ ID NO: 434774 - RNA, 15 nt, Bordetella pertussis
cagguaucggccagc

SEQ ID NO: 434775 - RNA, 13 nt, Bordetella pertussis
cagugcccugacc

SEQ ID NO: 434776 - RNA, 18 nt, Bordetella pertussis
cagugcccugacccgcug

SEQ ID NO: 434777 - RNA, 17 nt, Bordetella pertussis
cagugcgacggaugggc

SEQ ID NO: 434778 - RNA, 18 nt, Bordetella pertussis
cagugcgccggcgcggcg

SEQ ID NO: 434779 - RNA, 18 nt, Bordetella pertussis
cagugcgcgcgcccccag

SEQ ID NO: 434780 - RNA, 18 nt, Bordetella pertussis
cagugcucgggcugcggc

SEQ ID NO: 434781 - RNA, 17 nt, Bordetella pertussis
cagugucuaucauggcc

SEQ ID NO: 434782 - RNA, 14 nt, Bordetella pertussis
cagugucucgacca

SEQ ID NO: 434783 - RNA, 18 nt, Bordetella pertussis
caguucgacgcccaugcg

SEQ ID NO: 434784 - RNA, 20 nt, Bordetella pertussis
caguucgcccggcuccaggc

SEQ ID NO: 434785 - RNA, 22 nt, Bordetella pertussis
caguucgcgcagaucccaggcg

SEQ ID NO: 434786 - RNA, 16 nt, Bordetella pertussis
caguucgcgcaggcgu

SEQ ID NO: 434787 - RNA, 22 nt, Bordetella pertussis
caguucgcgguauucggcgacc

SEQ ID NO: 434788 - RNA, 22 nt, Bordetella pertussis
caguucggucagcgcggcgcac

SEQ ID NO: 434789 - RNA, 21 nt, Bordetella pertussis
caguugaaccgcaacgccagc

SEQ ID NO: 434790 - RNA, 21 nt, Bordetella pertussis
caguugaaucggcgcgagcgu

SEQ ID NO: 434791 - RNA, 20 nt, Bordetella pertussis
caguugacccauaccagccc

SEQ ID NO: 434792 - RNA, 19 nt, Bordetella pertussis
caguugcgggcgcaccugg

SEQ ID NO: 434793 - RNA, 21 nt, Bordetella pertussis
caguugcggggcgcccagcgc

SEQ ID NO: 434794 - RNA, 18 nt, Bordetella pertussis
caguugcgucuccagcgc

SEQ ID NO: 434795 - RNA, 18 nt, Bordetella pertussis
caguuggcccuucuucag

SEQ ID NO: 434796 - RNA, 19 nt, Bordetella pertussis
caguuggcggcgcagccgc

SEQ ID NO: 434797 - RNA, 20 nt, Bordetella pertussis
caguuggcggcgcagccgcc

SEQ ID NO: 434798 - RNA, 15 nt, Bordetella pertussis
caguugggcgcgccc

SEQ ID NO: 434799 - RNA, 21 nt, Bordetella pertussis
caguugggcgcgcccagcccc

SEQ ID NO: 434800 - RNA, 22 nt, Bordetella pertussis
cauaauccguuggugccgaguu

SEQ ID NO: 434801 - RNA, 20 nt, Bordetella pertussis
cauacaacgaguaccugcug

SEQ ID NO: 434802 - RNA, 20 nt, Bordetella pertussis
cauacagcggagccgcgcac

SEQ ID NO: 434803 - RNA, 18 nt, Bordetella pertussis
cauaguccucuacuggcu

SEQ ID NO: 434804 - RNA, 21 nt, Bordetella pertussis
cauaguccucuacuggcugau

SEQ ID NO: 434805 - RNA, 11 nt, Bordetella pertussis
cauauccacgc

SEQ ID NO: 434806 - RNA, 19 nt, Bordetella pertussis
cauauccacgccacuggcc

SEQ ID NO: 434807 - RNA, 18 nt, Bordetella pertussis
cauauccaggcggcgcuc

SEQ ID NO: 434808 - RNA, 13 nt, Bordetella pertussis
cauauucacagcc

SEQ ID NO: 434809 - RNA, 15 nt, Bordetella pertussis
caucaaacgcggcgc

SEQ ID NO: 434810 - RNA, 21 nt, Bordetella pertussis
caucaacgacaaagccuccgc

SEQ ID NO: 434811 - RNA, 13 nt, Bordetella pertussis
caucaacuucauc

SEQ ID NO: 434812 - RNA, 14 nt, Bordetella pertussis
caucaagaugaacg

SEQ ID NO: 434813 - RNA, 15 nt, Bordetella pertussis
caucacgagcagguu

SEQ ID NO: 434814 - RNA, 17 nt, Bordetella pertussis
caucacgccgguguucu

SEQ ID NO: 434815 - RNA, 22 nt, Bordetella pertussis
caucacggugucgaugggcccg

SEQ ID NO: 434816 - RNA, 18 nt, Bordetella pertussis
caucacgggcgccagcag

SEQ ID NO: 434817 - RNA, 13 nt, Bordetella pertussis
caucagcgcgccc

SEQ ID NO: 434818 - RNA, 22 nt, Bordetella pertussis
caucagcgcgcccgcuuccuug

SEQ ID NO: 434819 - RNA, 16 nt, Bordetella pertussis
caucagcgugccgccg

SEQ ID NO: 434820 - RNA, 18 nt, Bordetella pertussis
caucagcgugccgccggc

SEQ ID NO: 434821 - RNA, 21 nt, Bordetella pertussis
caucagcucgaccacggcggc

SEQ ID NO: 434822 - RNA, 22 nt, Bordetella pertussis
caucagcucgaccacggcggcu

SEQ ID NO: 434823 - RNA, 20 nt, Bordetella pertussis
caucagcuuggccaccacgc

SEQ ID NO: 434824 - RNA, 22 nt, Bordetella pertussis
caucaggcccacgaugcgggca

SEQ ID NO: 434825 - RNA, 18 nt, Bordetella pertussis
caucaggggcucggccag

SEQ ID NO: 434826 - RNA, 22 nt, Bordetella pertussis
caucaggggcucggccaggugc

SEQ ID NO: 434827 - RNA, 21 nt, Bordetella pertussis
caucagguccacuucaccgcu

SEQ ID NO: 434828 - RNA, 19 nt, Bordetella pertussis
caucaggucgaccugcuug

SEQ ID NO: 434829 - RNA, 22 nt, Bordetella pertussis
caucaggucgaccugcuugccc

SEQ ID NO: 434830 - RNA, 17 nt, Bordetella pertussis
caucaggugaaacagca

SEQ ID NO: 434831 - RNA, 20 nt, Bordetella pertussis
caucauccccagcgccgcca

SEQ ID NO: 434832 - RNA, 13 nt, Bordetella pertussis
caucaucugggcg

SEQ ID NO: 434833 - RNA, 20 nt, Bordetella pertussis
caucccggcgcucagcgcgc

SEQ ID NO: 434834 - RNA, 19 nt, Bordetella pertussis
caucccuugagcguggcgu

SEQ ID NO: 434835 - RNA, 18 nt, Bordetella pertussis
cauccgacagauggcgcu

SEQ ID NO: 434836 - RNA, 17 nt, Bordetella pertussis
cauccgcgcugcugccg

SEQ ID NO: 434837 - RNA, 22 nt, Bordetella pertussis
cauccggaaacuggcuaaaagg

SEQ ID NO: 434838 - RNA, 20 nt, Bordetella pertussis
cauccucaucgugcucgugc

SEQ ID NO: 434839 - RNA, 21 nt, Bordetella pertussis
cauccucgggcgacuccagcc

SEQ ID NO: 434840 - RNA, 22 nt, Bordetella pertussis
cauccugaugucggccuucugc

SEQ ID NO: 434841 - RNA, 12 nt, Bordetella pertussis
cauccuggaugu

SEQ ID NO: 434842 - RNA, 21 nt, Bordetella pertussis
cauccuggaugugcgcgggcg

SEQ ID NO: 434843 - RNA, 16 nt, Bordetella pertussis
cauccuggccgccgcg

SEQ ID NO: 434844 - RNA, 16 nt, Bordetella pertussis
caucgacagcgcgccc

SEQ ID NO: 434845 - RNA, 21 nt, Bordetella pertussis
caucgacaugcccgccggcac

SEQ ID NO: 434846 - RNA, 22 nt, Bordetella pertussis
caucgacaugcccgccggcacc

SEQ ID NO: 434847 - RNA, 15 nt, Bordetella pertussis
caucgaccaccagcg

SEQ ID NO: 434848 - RNA, 20 nt, Bordetella pertussis
caucgaccacgcgcgcgccg

SEQ ID NO: 434849 - RNA, 21 nt, Bordetella pertussis
caucgaccacgcgcgcgccgc

SEQ ID NO: 434850 - RNA, 16 nt, Bordetella pertussis
caucgaccagcgcacg

SEQ ID NO: 434851 - RNA, 21 nt, Bordetella pertussis
caucgaccgcauagcgcauga

SEQ ID NO: 434852 - RNA, 22 nt, Bordetella pertussis
caucgauaugggcggccucggc

SEQ ID NO: 434853 - RNA, 18 nt, Bordetella pertussis
caucgaucagcgcgccgu

SEQ ID NO: 434854 - RNA, 18 nt, Bordetella pertussis
caucgauuucucgcugcu

SEQ ID NO: 434855 - RNA, 17 nt, Bordetella pertussis
caucgccgccagcuugg

SEQ ID NO: 434856 - RNA, 13 nt, Bordetella pertussis
caucgccgccugc

SEQ ID NO: 434857 - RNA, 17 nt, Bordetella pertussis
caucgccgcugcgcagc

SEQ ID NO: 434858 - RNA, 18 nt, Bordetella pertussis
caucgccgcugcgcagca

SEQ ID NO: 434859 - RNA, 17 nt, Bordetella pertussis
caucgcgauccucgacc

SEQ ID NO: 434860 - RNA, 17 nt, Bordetella pertussis
caucgcgaugcgcagca

SEQ ID NO: 434861 - RNA, 19 nt, Bordetella pertussis
caucgcgccuucggcgcgc

SEQ ID NO: 434862 - RNA, 12 nt, Bordetella pertussis
caucgcgcggca

SEQ ID NO: 434863 - RNA, 19 nt, Bordetella pertussis
caucgcgcugacgaaaugc

SEQ ID NO: 434864 - RNA, 17 nt, Bordetella pertussis
caucgcgcuggcgcgcg

SEQ ID NO: 434865 - RNA, 18 nt, Bordetella pertussis
caucgcgcuggcgcgcga

SEQ ID NO: 434866 - RNA, 14 nt, Bordetella pertussis
caucgcggcagccc

SEQ ID NO: 434867 - RNA, 22 nt, Bordetella pertussis
caucgcggcagcccggcacguc

SEQ ID NO: 434868 - RNA, 18 nt, Bordetella pertussis
caucgcggucaucggcga

SEQ ID NO: 434869 - RNA, 16 nt, Bordetella pertussis
caucgcguccaggccc

SEQ ID NO: 434870 - RNA, 20 nt, Bordetella pertussis
caucgcuaugcagcugcgcc

SEQ ID NO: 434871 - RNA, 23 nt, Bordetella pertussis
caucguauggcggggugccuguc

SEQ ID NO: 434872 - RNA, 14 nt, Bordetella pertussis
caucuacagcgccu

SEQ ID NO: 434873 - RNA, 22 nt, Bordetella pertussis
caucuaccugucgggcggcggc

SEQ ID NO: 434874 - RNA, 16 nt, Bordetella pertussis
caucucccgcaggccc

SEQ ID NO: 434875 - RNA, 22 nt, Bordetella pertussis
caucucgcggcgguaguaccaa

SEQ ID NO: 434876 - RNA, 14 nt, Bordetella pertussis
caucucggccgcgg

SEQ ID NO: 434877 - RNA, 15 nt, Bordetella pertussis
caucugccagggaau

SEQ ID NO: 434878 - RNA, 19 nt, Bordetella pertussis
caucugcggcaccucggcc

SEQ ID NO: 434879 - RNA, 22 nt, Bordetella pertussis
caucuggcccgucaugugcaga

SEQ ID NO: 434880 - RNA, 19 nt, Bordetella pertussis
caucugguugagcagcacc

SEQ ID NO: 434881 - RNA, 19 nt, Bordetella pertussis
caucuguucggcgccgggc

SEQ ID NO: 434882 - RNA, 15 nt, Bordetella pertussis
caucuucgugcuggc

SEQ ID NO: 434883 - RNA, 16 nt, Bordetella pertussis
caucuucgugcuggcc

SEQ ID NO: 434884 - RNA, 18 nt, Bordetella pertussis
caugcucgcgcacagcgc

SEQ ID NO: 434885 - RNA, 20 nt, Bordetella pertussis
caugcucuugaacgccuugc

SEQ ID NO: 434886 - RNA, 16 nt, Bordetella pertussis
caugcugcagcugcuu

SEQ ID NO: 434887 - RNA, 20 nt, Bordetella pertussis
caugcugcagcugcuugccc

SEQ ID NO: 434888 - RNA, 16 nt, Bordetella pertussis
caugcugcgacagcag

SEQ ID NO: 434889 - RNA, 19 nt, Bordetella pertussis
caugcugcgacagcagggc

SEQ ID NO: 434890 - RNA, 19 nt, Bordetella pertussis
caugcugcgcgaggugggc

SEQ ID NO: 434891 - RNA, 14 nt, Bordetella pertussis
caugcuggcccagc

SEQ ID NO: 434892 - RNA, 14 nt, Bordetella pertussis
caugcugggcgggc

SEQ ID NO: 434893 - RNA, 17 nt, Bordetella pertussis
caugcugucgcucauga

SEQ ID NO: 434894 - RNA, 19 nt, Bordetella pertussis
caugcugucgcucaugacc

SEQ ID NO: 434895 - RNA, 15 nt, Bordetella pertussis
cauggaagcggcaga

SEQ ID NO: 434896 - RNA, 17 nt, Bordetella pertussis
cauggacugcaggcgcu

SEQ ID NO: 434897 - RNA, 17 nt, Bordetella pertussis
cauggaucgacugcccc

SEQ ID NO: 434898 - RNA, 11 nt, Bordetella pertussis
cauggcagggc

SEQ ID NO: 434899 - RNA, 12 nt, Bordetella pertussis
cauggcagggcg

SEQ ID NO: 434900 - RNA, 22 nt, Bordetella pertussis
cauggcaguacguacgcccggc

SEQ ID NO: 434901 - RNA, 17 nt, Bordetella pertussis
cauggcaugagcgccuc

SEQ ID NO: 434902 - RNA, 13 nt, Bordetella pertussis
cauggccagggcc

SEQ ID NO: 434903 - RNA, 13 nt, Bordetella pertussis
cauggccagucug

SEQ ID NO: 434904 - RNA, 23 nt, Bordetella pertussis
cauggcgggcgagaucagccacc

SEQ ID NO: 434905 - RNA, 18 nt, Bordetella pertussis
cauggcggugaaggcgcc

SEQ ID NO: 434906 - RNA, 22 nt, Bordetella pertussis
cauggcguagagcagugugccu

SEQ ID NO: 434907 - RNA, 17 nt, Bordetella pertussis
cauggcguaugacaggg

SEQ ID NO: 434908 - RNA, 18 nt, Bordetella pertussis
cauggucucguccacccc

SEQ ID NO: 434909 - RNA, 16 nt, Bordetella pertussis
cauguccaccagccgg

SEQ ID NO: 434910 - RNA, 16 nt, Bordetella pertussis
caugucccgaggcgcc

SEQ ID NO: 434911 - RNA, 11 nt, Bordetella pertussis
caugucccagc

SEQ ID NO: 434912 - RNA, 23 nt, Bordetella pertussis
cauguccgccacgccggccacga

SEQ ID NO: 434913 - RNA, 12 nt, Bordetella pertussis
cauguccuggca

SEQ ID NO: 434914 - RNA, 23 nt, Bordetella pertussis
caugucgcgggugcgggcaaacg

SEQ ID NO: 434915 - RNA, 20 nt, Bordetella pertussis
caugugcugcggcagccagg

SEQ ID NO: 434916 - RNA, 16 nt, Bordetella pertussis
cauguggcgcagcguu

SEQ ID NO: 434917 - RNA, 14 nt, Bordetella pertussis
cauguucacgccca

SEQ ID NO: 434918 - RNA, 14 nt, Bordetella pertussis
cauuagggcccagc

SEQ ID NO: 434919 - RNA, 13 nt, Bordetella pertussis
cauucagcgcugc

SEQ ID NO: 434920 - RNA, 13 nt, Bordetella pertussis
cauucauccagcg

SEQ ID NO: 434921 - RNA, 14 nt, Bordetella pertussis
cauuccgagcgggc

SEQ ID NO: 434922 - RNA, 15 nt, Bordetella pertussis
cauucgcgccugagc

SEQ ID NO: 434923 - RNA, 22 nt, Bordetella pertussis
cauucgguggucugccagucca

SEQ ID NO: 434924 - RNA, 13 nt, Bordetella pertussis
cauugcagggugu

SEQ ID NO: 434925 - RNA, 15 nt, Bordetella pertussis
cauugcccagcacca

SEQ ID NO: 434926 - RNA, 18 nt, Bordetella pertussis
cauugccggagcagcagc

SEQ ID NO: 434927 - RNA, 20 nt, Bordetella pertussis
cauugcgccguugcgggcug

SEQ ID NO: 434928 - RNA, 17 nt, Bordetella pertussis
cauugcggcaccugcug

SEQ ID NO: 434929 - RNA, 19 nt, Bordetella pertussis
cauugcggcaccugcugcu

SEQ ID NO: 434930 - RNA, 20 nt, Bordetella pertussis
cauugcggcaccugcugcuu

SEQ ID NO: 434931 - RNA, 14 nt, Bordetella pertussis
cauugcggcgggcg

SEQ ID NO: 434932 - RNA, 12 nt, Bordetella pertussis
cauuggccagcg

SEQ ID NO: 434933 - RNA, 13 nt, Bordetella pertussis
cauuggccagcgc

SEQ ID NO: 434934 - RNA, 17 nt, Bordetella pertussis
cauuggccgccgccacc

SEQ ID NO: 434935 - RNA, 15 nt, Bordetella pertussis
cauuggcgccgcgcu

SEQ ID NO: 434936 - RNA, 14 nt, Bordetella pertussis
cauuggcggcggcg

SEQ ID NO: 434937 - RNA, 18 nt, Bordetella pertussis
cauuggcggcggcguuca

SEQ ID NO: 434938 - RNA, 18 nt, Bordetella pertussis
cauuggguacgacggccg

SEQ ID NO: 434939 - RNA, 14 nt, Bordetella pertussis
cauuggugcgcaca

SEQ ID NO: 434940 - RNA, 17 nt, Bordetella pertussis
cauugucaagcagcgcc

SEQ ID NO: 434941 - RNA, 20 nt, Bordetella pertussis
cauuuccucgaccagcgcgc

SEQ ID NO: 434942 - RNA, 19 nt, Bordetella pertussis
cauuucgauuucggcggcc

SEQ ID NO: 434943 - RNA, 18 nt, Bordetella pertussis
cauuucggcgccgccggc

SEQ ID NO: 434944 - RNA, 15 nt, Bordetella pertussis
cauuucggcgccgcg

SEQ ID NO: 434945 - RNA, 18 nt, Bordetella pertussis
cauuucguaaagccgcac

SEQ ID NO: 434946 - RNA, 12 nt, Bordetella pertussis
ccaacgaggaca

SEQ ID NO: 434947 - RNA, 18 nt, Bordetella pertussis
ccaacgccaagcugcugg

SEQ ID NO: 434948 - RNA, 15 nt, Bordetella pertussis
ccaacgcggccagcg

SEQ ID NO: 434949 - RNA, 12 nt, Bordetella pertussis
ccaacggcuggc

SEQ ID NO: 434950 - RNA, 12 nt, Bordetella pertussis
ccaacggggccg

SEQ ID NO: 434951 - RNA, 14 nt, Bordetella pertussis
ccaacggggccgcc

SEQ ID NO: 434952 - RNA, 20 nt, Bordetella pertussis
ccaacggugccagucccccu

SEQ ID NO: 434953 - RNA, 21 nt, Bordetella pertussis
ccaagcagaccuaccaggccg

SEQ ID NO: 434954 - RNA, 14 nt, Bordetella pertussis
ccaagcagcgccug

SEQ ID NO: 434955 - RNA, 17 nt, Bordetella pertussis
ccaagcugcgcgaggac

SEQ ID NO: 434956 - RNA, 21 nt, Bordetella pertussis
ccaagcuggagaagcgccgcg

SEQ ID NO: 434957 - RNA, 19 nt, Bordetella pertussis
ccaaggaaagcccggcccc

SEQ ID NO: 434958 - RNA, 19 nt, Bordetella pertussis
ccaaggagucccuucaugc

SEQ ID NO: 434959 - RNA, 15 nt, Bordetella pertussis
ccaaggcaagcagcg

SEQ ID NO: 434960 - RNA, 19 nt, Bordetella pertussis
ccaaggcauuggcgccgcg

SEQ ID NO: 434961 - RNA, 15 nt, Bordetella pertussis
ccaauacgccgccau

SEQ ID NO: 434962 - RNA, 15 nt, Bordetella pertussis
ccaauccgaucagca

SEQ ID NO: 434963 - RNA, 19 nt, Bordetella pertussis
ccaauccgcgaagugccug

SEQ ID NO: 434964 - RNA, 16 nt, Bordetella pertussis
ccaaugugcugacggu

SEQ ID NO: 434965 - RNA, 17 nt, Bordetella pertussis
ccaauugcuugccuguc

SEQ ID NO: 434966 - RNA, 16 nt, Bordetella pertussis
ccacaauugccagccu

SEQ ID NO: 434967 - RNA, 22 nt, Bordetella pertussis
ccacaccagguugucggcgcca

SEQ ID NO: 434968 - RNA, 14 nt, Bordetella pertussis
ccacaccaucaaga

SEQ ID NO: 434969 - RNA, 19 nt, Bordetella pertussis
ccacagcagcgcgccgccg

SEQ ID NO: 434970 - RNA, 19 nt, Bordetella pertussis
ccacagcaugaccucggcc

SEQ ID NO: 434971 - RNA, 13 nt, Bordetella pertussis
ccacagcccggcc

SEQ ID NO: 434972 - RNA, 18 nt, Bordetella pertussis
ccacagcccggcccccag

SEQ ID NO: 434973 - RNA, 21 nt, Bordetella pertussis
ccacagcccggcccccagccc

SEQ ID NO: 434974 - RNA, 15 nt, Bordetella pertussis
ccacagcgcccccag

SEQ ID NO: 434975 - RNA, 20 nt, Bordetella pertussis
ccacagcgugacggcggcgc

SEQ ID NO: 434976 - RNA, 16 nt, Bordetella pertussis
ccacaggaacaggccg

SEQ ID NO: 434977 - RNA, 14 nt, Bordetella pertussis
ccacagggggacug

SEQ ID NO: 434978 - RNA, 20 nt, Bordetella pertussis
ccacagggggacuggcaccc

SEQ ID NO: 434979 - RNA, 15 nt, Bordetella pertussis
ccaccacccaggccc

SEQ ID NO: 434980 - RNA, 14 nt, Bordetella pertussis
ccaccaccgcccgc

SEQ ID NO: 434981 - RNA, 23 nt, Bordetella pertussis
ccaccacugcaaggcccgcccgg

SEQ ID NO: 434982 - RNA, 18 nt, Bordetella pertussis
ccaccagcaccgccacgc

SEQ ID NO: 434983 - RNA, 19 nt, Bordetella pertussis
ccaccagcaccggcagcgu

SEQ ID NO: 434984 - RNA, 15 nt, Bordetella pertussis
ccaccagcagcgcca

SEQ ID NO: 434985 - RNA, 14 nt, Bordetella pertussis
ccaccaggccgccu

SEQ ID NO: 434986 - RNA, 21 nt, Bordetella pertussis
ccaccaggccggccagggcca

SEQ ID NO: 434987 - RNA, 17 nt, Bordetella pertussis
ccaccaggccgucggcc

SEQ ID NO: 434988 - RNA, 15 nt, Bordetella pertussis
ccaccagggccagcu

SEQ ID NO: 434989 - RNA, 18 nt, Bordetella pertussis
ccaccagggccagcuuga

SEQ ID NO: 434990 - RNA, 20 nt, Bordetella pertussis
ccaccagggccagcuugacg

SEQ ID NO: 434991 - RNA, 21 nt, Bordetella pertussis
ccaccaggucguacagcgccu

SEQ ID NO: 434992 - RNA, 21 nt, Bordetella pertussis
ccaccagguagggcagcaggu

SEQ ID NO: 434993 - RNA, 15 nt, Bordetella pertussis
ccaccauccugcccc

SEQ ID NO: 434994 - RNA, 18 nt, Bordetella pertussis
ccaccaugucccuggcca

SEQ ID NO: 434995 - RNA, 16 nt, Bordetella pertussis
ccacccugccgugcag

SEQ ID NO: 434996 - RNA, 18 nt, Bordetella pertussis
ccaccgccacgucauagg

SEQ ID NO: 434997 - RNA, 19 nt, Bordetella pertussis
ccaccgcccccgccgccau

SEQ ID NO: 434998 - RNA, 19 nt, Bordetella pertussis
ccaccgccgaugccgccau

SEQ ID NO: 434999 - RNA, 14 nt, Bordetella pertussis
ccaccgccugugcc

SEQ ID NO: 435000 - RNA, 14 nt, Bordetella pertussis
ccaccgggccggcc

SEQ ID NO: 435001 - RNA, 15 nt, Bordetella pertussis
ccaccgggccggccu

SEQ ID NO: 435002 - RNA, 14 nt, Bordetella pertussis
ccacgaagcaggug

SEQ ID NO: 435003 - RNA, 15 nt, Bordetella pertussis
ccacgaaggcagcac

SEQ ID NO: 435004 - RNA, 22 nt, Bordetella pertussis
ccacgaaggcgaucugcggcgu

SEQ ID NO: 435005 - RNA, 20 nt, Bordetella pertussis
ccacgaauuccucgccgccc

SEQ ID NO: 435006 - RNA, 15 nt, Bordetella pertussis
ccacgagcugcagcc

SEQ ID NO: 435007 - RNA, 22 nt, Bordetella pertussis
ccacgaucauggucaugcccuc

SEQ ID NO: 435008 - RNA, 21 nt, Bordetella pertussis
ccacgauguugcgcaggcugu

SEQ ID NO: 435009 - RNA, 17 nt, Bordetella pertussis
ccacgcccaucugccag

SEQ ID NO: 435010 - RNA, 15 nt, Bordetella pertussis
ccacgcccgcgccga

SEQ ID NO: 435011 - RNA, 23 nt, Bordetella pertussis
ccacgcccgucccgacccccggc

SEQ ID NO: 435012 - RNA, 16 nt, Bordetella pertussis
ccacgccgaugcacag

SEQ ID NO: 435013 - RNA, 19 nt, Bordetella pertussis
ccacgccgaugcacaggua

SEQ ID NO: 435014 - RNA, 23 nt, Bordetella pertussis
ccacgccgccgaaguaguugguc

SEQ ID NO: 435015 - RNA, 17 nt, Bordetella pertussis
ccacgccgccgaccucg

SEQ ID NO: 435016 - RNA, 16 nt, Bordetella pertussis
ccacgccgccggccag

SEQ ID NO: 435017 - RNA, 16 nt, Bordetella pertussis
ccacgccggccgccug

SEQ ID NO: 435018 - RNA, 13 nt, Bordetella pertussis
ccacgccggccgg

SEQ ID NO: 435019 - RNA, 18 nt, Bordetella pertussis
ccacgccggcgcgccggc

SEQ ID NO: 435020 - RNA, 18 nt, Bordetella pertussis
ccacgcgcaacgccgcca

SEQ ID NO: 435021 - RNA, 19 nt, Bordetella pertussis
ccacgcgcaacgccgccac

SEQ ID NO: 435022 - RNA, 18 nt, Bordetella pertussis
ccacgcgcacggccagca

SEQ ID NO: 435023 - RNA, 20 nt, Bordetella pertussis
ccacgcgcgauccgcgccag

SEQ ID NO: 435024 - RNA, 20 nt, Bordetella pertussis
ccacgcgcuguugcuggcca

SEQ ID NO: 435025 - RNA, 22 nt, Bordetella pertussis
ccacgcggccguggcggccugc

SEQ ID NO: 435026 - RNA, 13 nt, Bordetella pertussis
ccacgcgguccag

SEQ ID NO: 435027 - RNA, 13 nt, Bordetella pertussis
ccacgcgguuggg

SEQ ID NO: 435028 - RNA, 15 nt, Bordetella pertussis
ccacgcucuggagcc

SEQ ID NO: 435029 - RNA, 15 nt, Bordetella pertussis
ccacgcugcgcccgc

SEQ ID NO: 435030 - RNA, 15 nt, Bordetella pertussis
ccacgcugggccaga

SEQ ID NO: 435031 - RNA, 16 nt, Bordetella pertussis
ccacgcugggccagac

SEQ ID NO: 435032 - RNA, 21 nt, Bordetella pertussis
ccacggcaaugucgcaggccg

SEQ ID NO: 435033 - RNA, 17 nt, Bordetella pertussis
ccacggcaucggccagc

SEQ ID NO: 435034 - RNA, 18 nt, Bordetella pertussis
ccacggcaucggcgccgc

SEQ ID NO: 435035 - RNA, 12 nt, Bordetella pertussis
ccacggccagca

SEQ ID NO: 435036 - RNA, 16 nt, Bordetella pertussis
ccacggccagcagcac

SEQ ID NO: 435037 - RNA, 13 nt, Bordetella pertussis
ccacggccggcag

SEQ ID NO: 435038 - RNA, 17 nt, Bordetella pertussis
ccacggccggcagcgcc

SEQ ID NO: 435039 - RNA, 15 nt, Bordetella pertussis
ccacggccggcgcac

SEQ ID NO: 435040 - RNA, 16 nt, Bordetella pertussis
ccacggcgauggccga

SEQ ID NO: 435041 - RNA, 21 nt, Bordetella pertussis
ccacggcgccaaagcacagga

SEQ ID NO: 435042 - RNA, 13 nt, Bordetella pertussis
ccacggcgcgccc

SEQ ID NO: 435043 - RNA, 21 nt, Bordetella pertussis
ccacggcgcgcccgcaggcgg

SEQ ID NO: 435044 - RNA, 22 nt, Bordetella pertussis
ccacggcggcuucggccgucag

SEQ ID NO: 435045 - RNA, 20 nt, Bordetella pertussis
ccacggcgggaucgggcagc

SEQ ID NO: 435046 - RNA, 19 nt, Bordetella pertussis
ccacggcggugaccaccag

SEQ ID NO: 435047 - RNA, 22 nt, Bordetella pertussis
ccacggcggugaucugcucgcc

SEQ ID NO: 435048 - RNA, 18 nt, Bordetella pertussis
ccacggcuuuggcguagc

SEQ ID NO: 435049 - RNA, 21 nt, Bordetella pertussis
ccacggcuuuggcguagccgg

SEQ ID NO: 435050 - RNA, 13 nt, Bordetella pertussis
ccacgggaccgcu

SEQ ID NO: 435051 - RNA, 23 nt, Bordetella pertussis
ccacggcuugcgcguaggcgcgc

SEQ ID NO: 435052 - RNA, 16 nt, Bordetella pertussis
ccacggucugcacgcc

SEQ ID NO: 435053 - RNA, 22 nt, Bordetella pertussis
ccacguagguggucagcauggu

SEQ ID NO: 435054 - RNA, 20 nt, Bordetella pertussis
ccacgucauaggcuucgccc

SEQ ID NO: 435055 - RNA, 17 nt, Bordetella pertussis
ccacguccuggggcgcg

SEQ ID NO: 435056 - RNA, 22 nt, Bordetella pertussis
ccacgucgccggcguucuucag

SEQ ID NO: 435057 - RNA, 18 nt, Bordetella pertussis
ccacgucgcggcugggca

SEQ ID NO: 435058 - RNA, 18 nt, Bordetella pertussis
ccacgucggcggccgccu

SEQ ID NO: 435059 - RNA, 19 nt, Bordetella pertussis
ccacgucggucgcuuccag

SEQ ID NO: 435060 - RNA, 15 nt, Bordetella pertussis
ccacgugcugcugga

SEQ ID NO: 435061 - RNA, 17 nt, Bordetella pertussis
ccacgugcugcuggaga

SEQ ID NO: 435062 - RNA, 15 nt, Bordetella pertussis
ccacguggaugaugg

SEQ ID NO: 435063 - RNA, 21 nt, Bordetella pertussis
ccacguugaagcgcagccacg

SEQ ID NO: 435064 - RNA, 18 nt, Bordetella pertussis
ccacguugauccagcgcu

SEQ ID NO: 435065 - RNA, 15 nt, Bordetella pertussis
ccacuacacucugcc

SEQ ID NO: 435066 - RNA, 16 nt, Bordetella pertussis
ccacuacacucugccc

SEQ ID NO: 435067 - RNA, 17 nt, Bordetella pertussis
ccacuaucagcgcguca

SEQ ID NO: 435068 - RNA, 17 nt, Bordetella pertussis
ccacugcaaggcccgcc

SEQ ID NO: 435069 - RNA, 18 nt, Bordetella pertussis
ccacugcaaggcccgccc

SEQ ID NO: 435070 - RNA, 15 nt, Bordetella pertussis
ccagccggcccagca

SEQ ID NO: 435071 - RNA, 13 nt, Bordetella pertussis
ccagccggccgcc

SEQ ID NO: 435072 - RNA, 15 nt, Bordetella pertussis
ccagccggcgcgcca

SEQ ID NO: 435073 - RNA, 14 nt, Bordetella pertussis
ccagccgggcggcc

SEQ ID NO: 435074 - RNA, 18 nt, Bordetella pertussis
ccagccgucggcaugggu

SEQ ID NO: 435075 - RNA, 17 nt, Bordetella pertussis
ccagccguuggcgccca

SEQ ID NO: 435076 - RNA, 14 nt, Bordetella pertussis
ccagccugcccguc

SEQ ID NO: 435077 - RNA, 16 nt, Bordetella pertussis
ccagccugccgcggcc

SEQ ID NO: 435078 - RNA, 19 nt, Bordetella pertussis
ccagccugccgcggccgcc

SEQ ID NO: 435079 - RNA, 22 nt, Bordetella pertussis
ccagccuggcgccaacccgcca

SEQ ID NO: 435080 - RNA, 17 nt, Bordetella pertussis
ccagcgacucggucagc

SEQ ID NO: 435081 - RNA, 18 nt, Bordetella pertussis
ccagcgagaccuugugcg

SEQ ID NO: 435082 - RNA, 18 nt, Bordetella pertussis
ccagcgagcgaaagccgu

SEQ ID NO: 435083 - RNA, 18 nt, Bordetella pertussis
ccagcgcacugagaaagg

SEQ ID NO: 435084 - RNA, 17 nt, Bordetella pertussis
ccagcgcauaggacgcc

SEQ ID NO: 435085 - RNA, 18 nt, Bordetella pertussis
ccagcgcauaggacgcca

SEQ ID NO: 435086 - RNA, 14 nt, Bordetella pertussis
ccagcgcaugccgu

SEQ ID NO: 435087 - RNA, 22 nt, Bordetella pertussis
ccagcgcaugccgucgagcgcg

SEQ ID NO: 435088 - RNA, 22 nt, Bordetella pertussis
ccagcgcauugccgccgcccug

SEQ ID NO: 435089 - RNA, 14 nt, Bordetella pertussis
ccagcgccaccagc

SEQ ID NO: 435090 - RNA, 19 nt, Bordetella pertussis
ccagcgccacgcccuggcg

SEQ ID NO: 435091 - RNA, 23 nt, Bordetella pertussis
ccagcgccacgccggccagcuug

SEQ ID NO: 435092 - RNA, 14 nt, Bordetella pertussis
ccagcgccagcacg

SEQ ID NO: 435093 - RNA, 14 nt, Bordetella pertussis
ccagcgccagcagc

SEQ ID NO: 435094 - RNA, 13 nt, Bordetella pertussis
ccagcgccagcgu

SEQ ID NO: 435095 - RNA, 13 nt, Bordetella pertussis
ccagcgccaggcc

SEQ ID NO: 435096 - RNA, 20 nt, Bordetella pertussis
ccagcgccaugaugucgcgc

SEQ ID NO: 435097 - RNA, 12 nt, Bordetella pertussis
ccagcgccgcca

SEQ ID NO: 435098 - RNA, 23 nt, Bordetella pertussis
ccagcgccgccuucaccggcccc

SEQ ID NO: 435099 - RNA, 19 nt, Bordetella pertussis
ccagcgccgcgucgagcgc

SEQ ID NO: 435100 - RNA, 16 nt, Bordetella pertussis
ccagcgccggcacgcu

SEQ ID NO: 435101 - RNA, 21 nt, Bordetella pertussis
ccagcgccggggucagcgccg

SEQ ID NO: 435102 - RNA, 12 nt, Bordetella pertussis
ccagcgccucca

SEQ ID NO: 435103 - RNA, 20 nt, Bordetella pertussis
ccagcgccugcgcggccucg

SEQ ID NO: 435104 - RNA, 11 nt, Bordetella pertussis
ccagcgccugg

SEQ ID NO: 435105 - RNA, 13 nt, Bordetella pertussis
ccagcgccuggcg

SEQ ID NO: 435106 - RNA, 17 nt, Bordetella pertussis
ccagcgcgaacgccugc

SEQ ID NO: 435107 - RNA, 17 nt, Bordetella pertussis
ccagcgcgacggccucg

SEQ ID NO: 435108 - RNA, 19 nt, Bordetella pertussis
ccagcgcgccgcccaccac

SEQ ID NO: 435109 - RNA, 18 nt, Bordetella pertussis
ccagcgcgccggccaggg

SEQ ID NO: 435110 - RNA, 20 nt, Bordetella pertussis
ccagcgcgccggccagggcc

SEQ ID NO: 435111 - RNA, 21 nt, Bordetella pertussis
ccagcgcgccggccagggcca

SEQ ID NO: 435112 - RNA, 21 nt, Bordetella pertussis
ccagcgcgccugcccaggcca

SEQ ID NO: 435113 - RNA, 18 nt, Bordetella pertussis
ccagcgcgcgaucgccag

SEQ ID NO: 435114 - RNA, 22 nt, Bordetella pertussis
ccagcgcgcgaucgccagcagg

SEQ ID NO: 435115 - RNA, 13 nt, Bordetella pertussis
ccagcgcgcgcca

SEQ ID NO: 435116 - RNA, 18 nt, Bordetella pertussis
ccagcgcgcggcgcagcg

SEQ ID NO: 435117 - RNA, 20 nt, Bordetella pertussis
ccagcgcgcggggcaggccg

SEQ ID NO: 435118 - RNA, 21 nt, Bordetella pertussis
ccagcgcggccacggccugcc

SEQ ID NO: 435119 - RNA, 23 nt, Bordetella pertussis
ccagcgcggccacggccugcccg

SEQ ID NO: 435120 - RNA, 23 nt, Bordetella pertussis
ccagcgcggccagcaccggccgc

SEQ ID NO: 435121 - RNA, 22 nt, Bordetella pertussis
ccagcgcggccgucaccgccgc

SEQ ID NO: 435122 - RNA, 19 nt, Bordetella pertussis
ccagcgcggcuugguuguc

SEQ ID NO: 435123 - RNA, 17 nt, Bordetella pertussis
ccagcgcggcggacugc

SEQ ID NO: 435124 - RNA, 19 nt, Bordetella pertussis
ccagcgcggcggcagcgcg

SEQ ID NO: 435125 - RNA, 13 nt, Bordetella pertussis
ccagcgcggcggg

SEQ ID NO: 435126 - RNA, 19 nt, Bordetella pertussis
ccagcgcgucgagcagcgc

SEQ ID NO: 435127 - RNA, 20 nt, Bordetella pertussis
ccagcgcgucgagcagcgca

SEQ ID NO: 435128 - RNA, 15 nt, Bordetella pertussis
ccagcgcgucggcca

SEQ ID NO: 435129 - RNA, 18 nt, Bordetella pertussis
ccagcgcgucggccagcg

SEQ ID NO: 435130 - RNA, 22 nt, Bordetella pertussis
ccagcgcgucggccagcgccgc

SEQ ID NO: 435131 - RNA, 17 nt, Bordetella pertussis
ccagcgcgugggccagc

SEQ ID NO: 435132 - RNA, 18 nt, Bordetella pertussis
ccagcgcuguccaggccg

SEQ ID NO: 435133 - RNA, 23 nt, Bordetella pertussis
ccagcgcuucgggcagcucgcgc

SEQ ID NO: 435134 - RNA, 18 nt, Bordetella pertussis
ccagcgcuucgugcagcg

SEQ ID NO: 435135 - RNA, 22 nt, Bordetella pertussis
ccagcggaaguauucgcgcggc

SEQ ID NO: 435136 - RNA, 19 nt, Bordetella pertussis
ccagcggacgggccaggcc

SEQ ID NO: 435137 - RNA, 20 nt, Bordetella pertussis
ccagcggacgggccaggccg

SEQ ID NO: 435138 - RNA, 19 nt, Bordetella pertussis
ccagcggaugaugcggcgc

SEQ ID NO: 435139 - RNA, 14 nt, Bordetella pertussis
ccagcggcagcgcg

SEQ ID NO: 435140 - RNA, 13 nt, Bordetella pertussis
ccagcggcaggcu

SEQ ID NO: 435141 - RNA, 14 nt, Bordetella pertussis
ccagcggccgucgc

SEQ ID NO: 435142 - RNA, 18 nt, Bordetella pertussis
ccagcggcgcagccggcc

SEQ ID NO: 435143 - RNA, 23 nt, Bordetella pertussis
ccagcggcgcgacgcgcuugacg

SEQ ID NO: 435144 - RNA, 21 nt, Bordetella pertussis
ccagcggcgugaugcccaggc

SEQ ID NO: 435145 - RNA, 22 nt, Bordetella pertussis
ccagcggcgugaugcccaggcc

SEQ ID NO: 435146 - RNA, 13 nt, Bordetella pertussis
ccagcggcgugcg

SEQ ID NO: 435147 - RNA, 20 nt, Bordetella pertussis
ccagcggcgugcggcccagc

SEQ ID NO: 435148 - RNA, 21 nt, Bordetella pertussis
ccagcggcguggcggccaggc

SEQ ID NO: 435149 - RNA, 21 nt, Bordetella pertussis
ccagcggcugcuugagcagcc

SEQ ID NO: 435150 - RNA, 24 nt, Bordetella pertussis
ccagcggcugcuugagcagccacu

SEQ ID NO: 435151 - RNA, 12 nt, Bordetella pertussis
ccagcggcuggc

SEQ ID NO: 435152 - RNA, 15 nt, Bordetella pertussis
ccagcggcuggcgca

SEQ ID NO: 435153 - RNA, 14 nt, Bordetella pertussis
ccagcgggagccug

SEQ ID NO: 435154 - RNA, 15 nt, Bordetella pertussis
ccagcguaucgccgc

SEQ ID NO: 435155 - RNA, 17 nt, Bordetella pertussis
ccagcguaucgccgccg

SEQ ID NO: 435156 - RNA, 18 nt, Bordetella pertussis
ccagcgucagcugggcau

SEQ ID NO: 435157 - RNA, 16 nt, Bordetella pertussis
ccagcgucaggcuggg

SEQ ID NO: 435158 - RNA, 19 nt, Bordetella pertussis
ccagcgucauggccuggcc

SEQ ID NO: 435159 - RNA, 22 nt, Bordetella pertussis
ccagcgucauggccuggcccag

SEQ ID NO: 435160 - RNA, 21 nt, Bordetella pertussis
ccagcguccaggcggccaucg

SEQ ID NO: 435161 - RNA, 13 nt, Bordetella pertussis
ccagcgucggcgu

SEQ ID NO: 435162 - RNA, 22 nt, Bordetella pertussis
ccagcgucggcguaaggccgcc

SEQ ID NO: 435163 - RNA, 19 nt, Bordetella pertussis
ccagcguggagcugcucac

SEQ ID NO: 435164 - RNA, 19 nt, Bordetella pertussis
ccagcguguagagcaggcc

SEQ ID NO: 435165 - RNA, 14 nt, Bordetella pertussis
ccagcguucggcca

SEQ ID NO: 435166 - RNA, 23 nt, Bordetella pertussis
ccagcguucggccacccggccca

SEQ ID NO: 435167 - RNA, 13 nt, Bordetella pertussis
ccagcucagcuug

SEQ ID NO: 435168 - RNA, 18 nt, Bordetella pertussis
ccagcucagcagcgccag

SEQ ID NO: 435169 - RNA, 16 nt, Bordetella pertussis
ccagcuccaccgggcu

SEQ ID NO: 435170 - RNA, 21 nt, Bordetella pertussis
ccagcuccacgcacaccgccc

SEQ ID NO: 435171 - RNA, 12 nt, Bordetella pertussis
ccagcuccagcg

SEQ ID NO: 435172 - RNA, 15 nt, Bordetella pertussis
ccagcuccccgggcg

SEQ ID NO: 435173 - RNA, 17 nt, Bordetella pertussis
ccagcucgcgcagcagg

SEQ ID NO: 435174 - RNA, 22 nt, Bordetella pertussis
ccagcucgcggcccuggucguc

SEQ ID NO: 435175 - RNA, 20 nt, Bordetella pertussis
ccagcucggccugcggcucg

SEQ ID NO: 435176 - RNA, 21 nt, Bordetella pertussis
ccagcucguccagguugcccg

SEQ ID NO: 435177 - RNA, 15 nt, Bordetella pertussis
ccagcucugcucugu

SEQ ID NO: 435178 - RNA, 16 nt, Bordetella pertussis
ccagcugcaguaugca

SEQ ID NO: 435179 - RNA, 14 nt, Bordetella pertussis
ccagcugcgcagcg

SEQ ID NO: 435180 - RNA, 17 nt, Bordetella pertussis
ccagcugcgcagcgacu

SEQ ID NO: 435181 - RNA, 14 nt, Bordetella pertussis
ccagcugcgccccc

SEQ ID NO: 435182 - RNA, 20 nt, Bordetella pertussis
ccagcugcgcgcgagcggcg

SEQ ID NO: 435183 - RNA, 22 nt, Bordetella pertussis
ccagcugcuucaguuccaggcg

SEQ ID NO: 435184 - RNA, 23 nt, Bordetella pertussis
ccagcugcuucaguuccaggcgg

SEQ ID NO: 435185 - RNA, 15 nt, Bordetella pertussis
ccagcuggcgcacca

SEQ ID NO: 435186 - RNA, 22 nt, Bordetella pertussis
ccagcuggcgcaccaggcuggg

SEQ ID NO: 435187 - RNA, 19 nt, Bordetella pertussis
ccagcuggcgccccuucca

SEQ ID NO: 435188 - RNA, 20 nt, Bordetella pertussis
ccagcuggcgcguggccgcc

SEQ ID NO: 435189 - RNA, 21 nt, Bordetella pertussis
ccagcuggcgcguggccgcca

SEQ ID NO: 435190 - RNA, 15 nt, Bordetella pertussis
ccagcugggaggcgu

SEQ ID NO: 435191 - RNA, 21 nt, Bordetella pertussis
ccagcugggcguuguugcccc

SEQ ID NO: 435192 - RNA, 14 nt, Bordetella pertussis
ccagcuucugcgcc

SEQ ID NO: 435193 - RNA, 20 nt, Bordetella pertussis
ccagcuucugcgccugcugg

SEQ ID NO: 435194 - RNA, 16 nt, Bordetella pertussis
ccagcuugaacaggca

SEQ ID NO: 435195 - RNA, 20 nt, Bordetella pertussis
ccagcuugaccuugagcacg

SEQ ID NO: 435196 - RNA, 13 nt, Bordetella pertussis
ccagcuugcgcgc

SEQ ID NO: 435197 - RNA, 15 nt, Bordetella pertussis
ccagcuugcgcgccg

SEQ ID NO: 435198 - RNA, 15 nt, Bordetella pertussis
ccagcuuggacagcg

SEQ ID NO: 435199 - RNA, 16 nt, Bordetella pertussis
ccaggaaaaccuccuc

SEQ ID NO: 435200 - RNA, 21 nt, Bordetella pertussis
ccaggaaaccgaccugaucgc

SEQ ID NO: 435201 - RNA, 18 nt, Bordetella pertussis
ccaggaaagaggccaggc

SEQ ID NO: 435202 - RNA, 16 nt, Bordetella pertussis
ccaggaaagcgccgcc

SEQ ID NO: 435203 - RNA, 18 nt, Bordetella pertussis
ccaggaacgccagcagca

SEQ ID NO: 435204 - RNA, 18 nt, Bordetella pertussis
ccaggaagaucggcccgg

SEQ ID NO: 435205 - RNA, 18 nt, Bordetella pertussis
ccaggaagagcuggcgcu

SEQ ID NO: 435206 - RNA, 21 nt, Bordetella pertussis
ccaggaagagcuggcgcugcu

SEQ ID NO: 435207 - RNA, 15 nt, Bordetella pertussis
ccaggaagccgugcg

SEQ ID NO: 435208 - RNA, 15 nt, Bordetella pertussis
ccaggaagcgcgccg

SEQ ID NO: 435209 - RNA, 19 nt, Bordetella pertussis
ccaggaagcgggccugccg

SEQ ID NO: 435210 - RNA, 16 nt, Bordetella pertussis
ccaggacgacaggcau

SEQ ID NO: 435211 - RNA, 22 nt, Bordetella pertussis
ccaggacgcgaagaucccgccg

SEQ ID NO: 435212 - RNA, 21 nt, Bordetella pertussis
ccaggacgggaaagcggcgau

SEQ ID NO: 435213 - RNA, 12 nt, Bordetella pertussis
ccaggacggugu

SEQ ID NO: 435214 - RNA, 22 nt, Bordetella pertussis
ccaggacuucgucgaucauggc

SEQ ID NO: 435215 - RNA, 14 nt, Bordetella pertussis
ccaggaucaccgcc

SEQ ID NO: 435216 - RNA, 16 nt, Bordetella pertussis
ccaggaucaccgccgc

SEQ ID NO: 435217 - RNA, 18 nt, Bordetella pertussis
ccaggaucaccgccgcgc

SEQ ID NO: 435218 - RNA, 15 nt, Bordetella pertussis
ccaggauccccagca

SEQ ID NO: 435219 - RNA, 17 nt, Bordetella pertussis
ccaggaucgcggccagc

SEQ ID NO: 435220 - RNA, 18 nt, Bordetella pertussis
ccaggaucgcggccagcc

SEQ ID NO: 435221 - RNA, 21 nt, Bordetella pertussis
ccaggaucgcggccagccggg

SEQ ID NO: 435222 - RNA, 12 nt, Bordetella pertussis
ccaggaugauga

SEQ ID NO: 435223 - RNA, 14 nt, Bordetella pertussis
ccaggaugaugcag

SEQ ID NO: 435224 - RNA, 22 nt, Bordetella pertussis
ccaggaugcccuuggcggcgau

SEQ ID NO: 435225 - RNA, 23 nt, Bordetella pertussis
ccaggaugcgcaccggccagggg

SEQ ID NO: 435226 - RNA, 17 nt, Bordetella pertussis
ccaggauggcgccagcc

SEQ ID NO: 435227 - RNA, 21 nt, Bordetella pertussis
ccaggauggcgccagcccgcc

SEQ ID NO: 435228 - RNA, 19 nt, Bordetella pertussis
ccaggcaaaggcccaggca

SEQ ID NO: 435229 - RNA, 18 nt, Bordetella pertussis
ccaggcaacaaaggaaau

SEQ ID NO: 435230 - RNA, 15 nt, Bordetella pertussis
ccaggcaaugcgcag

SEQ ID NO: 435231 - RNA, 15 nt, Bordetella pertussis
ccaggcagccggccc

SEQ ID NO: 435232 - RNA, 21 nt, Bordetella pertussis
ccaggcaggcgggcccgcauc

SEQ ID NO: 435233 - RNA, 21 nt, Bordetella pertussis
ccaggcauugaagcuggcgcc

SEQ ID NO: 435234 - RNA, 15 nt, Bordetella pertussis
ccaggccacccgccg

SEQ ID NO: 435235 - RNA, 19 nt, Bordetella pertussis
ccaggccagcagcucggcc

SEQ ID NO: 435236 - RNA, 14 nt, Bordetella pertussis
ccaggccagcgccg

SEQ ID NO: 435237 - RNA, 16 nt, Bordetella pertussis
ccaggcccacggcgcc

SEQ ID NO: 435238 - RNA, 12 nt, Bordetella pertussis
ccaggcccaggg

SEQ ID NO: 435239 - RNA, 16 nt, Bordetella pertussis
ccaggcccagggcgau

SEQ ID NO: 435240 - RNA, 13 nt, Bordetella pertussis
ccaggcccaguuc

SEQ ID NO: 435241 - RNA, 14 nt, Bordetella pertussis
ccaggcccaguucg

SEQ ID NO: 435242 - RNA, 12 nt, Bordetella pertussis
ccaggcccaugc

SEQ ID NO: 435243 - RNA, 14 nt, Bordetella pertussis
ccaggcccaugccg

SEQ ID NO: 435244 - RNA, 13 nt, Bordetella pertussis
ccaggccccgccg

SEQ ID NO: 435245 - RNA, 13 nt, Bordetella pertussis
ccaggcccggcag

SEQ ID NO: 435246 - RNA, 12 nt, Bordetella pertussis
ccaggcccggcc

SEQ ID NO: 435247 - RNA, 12 nt, Bordetella pertussis
ccaggcccggcg

SEQ ID NO: 435248 - RNA, 14 nt, Bordetella pertussis
ccaggcccugcgcg

SEQ ID NO: 435249 - RNA, 22 nt, Bordetella pertussis
ccaggcccuggcuggccagccg

SEQ ID NO: 435250 - RNA, 20 nt, Bordetella pertussis
ccaggccgaacuucagcccg

SEQ ID NO: 435251 - RNA, 15 nt, Bordetella pertussis
ccaggccgaucagcg

SEQ ID NO: 435252 - RNA, 21 nt, Bordetella pertussis
ccaggccgaugaauugcgcca

SEQ ID NO: 435253 - RNA, 20 nt, Bordetella pertussis
ccaggccgauggcguccagc

SEQ ID NO: 435254 - RNA, 17 nt, Bordetella pertussis
ccaggccgcccagccgc

SEQ ID NO: 435255 - RNA, 18 nt, Bordetella pertussis
ccaggccgcccagccgcg

SEQ ID NO: 435256 - RNA, 19 nt, Bordetella pertussis
ccaggccgcccagccgcgc

SEQ ID NO: 435257 - RNA, 16 nt, Bordetella pertussis
ccaggccgccggcggc

SEQ ID NO: 435258 - RNA, 14 nt, Bordetella pertussis
ccaggccgcggcgc

SEQ ID NO: 435259 - RNA, 19 nt, Bordetella pertussis
ccaggccggccugcaggcu

SEQ ID NO: 435260 - RNA, 19 nt, Bordetella pertussis
ccaggccggccuuggccau

SEQ ID NO: 435261 - RNA, 16 nt, Bordetella pertussis
ccaggccggcgcgccg

SEQ ID NO: 435262 - RNA, 21 nt, Bordetella pertussis
ccaggccggcgcgccggccca

SEQ ID NO: 435263 - RNA, 23 nt, Bordetella pertussis
ccaggccggggaaacggccaagc

SEQ ID NO: 435264 - RNA, 13 nt, Bordetella pertussis
ccaggccggggcc

SEQ ID NO: 435265 - RNA, 17 nt, Bordetella pertussis
ccaggccggggccgccc

SEQ ID NO: 435266 - RNA, 22 nt, Bordetella pertussis
ccaggccggggccgcccagcac

SEQ ID NO: 435267 - RNA, 16 nt, Bordetella pertussis
ccaggccgggcgagcc

SEQ ID NO: 435268 - RNA, 13 nt, Bordetella pertussis
ccaggccgggcgu

SEQ ID NO: 435269 - RNA, 18 nt, Bordetella pertussis
ccaggccgguggaccagg

SEQ ID NO: 435270 - RNA, 12 nt, Bordetella pertussis
ccaggccgucga

SEQ ID NO: 435271 - RNA, 15 nt, Bordetella pertussis
ccaggccgucggcca

SEQ ID NO: 435272 - RNA, 20 nt, Bordetella pertussis
ccaggccgugagcgccgccg

SEQ ID NO: 435273 - RNA, 16 nt, Bordetella pertussis
ccaggccguggcccag

SEQ ID NO: 435274 - RNA, 17 nt, Bordetella pertussis
ccaggccguggcccagc

SEQ ID NO: 435275 - RNA, 19 nt, Bordetella pertussis
ccaggccguggcccagccg

SEQ ID NO: 435276 - RNA, 16 nt, Bordetella pertussis
ccaggcgagcgccgcg

SEQ ID NO: 435277 - RNA, 20 nt, Bordetella pertussis
ccaggcgaugcccagcgccg

SEQ ID NO: 435278 - RNA, 15 nt, Bordetella pertussis
ccaggcgcagccgcg

SEQ ID NO: 435279 - RNA, 16 nt, Bordetella pertussis
ccaggcgcaguaucug

SEQ ID NO: 435280 - RNA, 22 nt, Bordetella pertussis
ccaggcgcauguccgccacgcc

SEQ ID NO: 435281 - RNA, 18 nt, Bordetella pertussis
ccaggcgccagaugcgcc

SEQ ID NO: 435282 - RNA, 14 nt, Bordetella pertussis
ccaggcgccccacc

SEQ ID NO: 435283 - RNA, 20 nt, Bordetella pertussis
ccaggcgcccgagagcugcg

SEQ ID NO: 435284 - RNA, 13 nt, Bordetella pertussis
ccaggcgccggcg

SEQ ID NO: 435285 - RNA, 16 nt, Bordetella pertussis
ccaggcgccgggccgc

SEQ ID NO: 435286 - RNA, 18 nt, Bordetella pertussis
ccaggcgcgccagccgcu

SEQ ID NO: 435287 - RNA, 11 nt, Bordetella pertussis
ccaggcgcgcg

SEQ ID NO: 435288 - RNA, 21 nt, Bordetella pertussis
ccaggcgcgccgcgauggcgc

SEQ ID NO: 435289 - RNA, 16 nt, Bordetella pertussis
ccaggcgcucagccgu

SEQ ID NO: 435290 - RNA, 15 nt, Bordetella pertussis
ccaggcgcucgcgcg

SEQ ID NO: 435291 - RNA, 21 nt, Bordetella pertussis
ccaggcgcugcgcggucugcg

SEQ ID NO: 435292 - RNA, 13 nt, Bordetella pertussis
ccaggcggaucug

SEQ ID NO: 435293 - RNA, 15 nt, Bordetella pertussis
ccaggcggccaccac

SEQ ID NO: 435294 - RNA, 15 nt, Bordetella pertussis
ccaggcggccaguuc

SEQ ID NO: 435295 - RNA, 18 nt, Bordetella pertussis
ccaggcggccaucgccgc

SEQ ID NO: 435296 - RNA, 19 nt, Bordetella pertussis
ccaggcggccaucgccgcc

SEQ ID NO: 435297 - RNA, 20 nt, Bordetella pertussis
ccaggcggcggcgcggcgcc

SEQ ID NO: 435298 - RNA, 24 nt, Bordetella pertussis
ccaggcggcggugccagcgcaagg

SEQ ID NO: 435299 - RNA, 17 nt, Bordetella pertussis
ccaggcgggcaucgccc

SEQ ID NO: 435300 - RNA, 17 nt, Bordetella pertussis
ccaggcgguacaggccg

SEQ ID NO: 435301 - RNA, 19 nt, Bordetella pertussis
ccaggcguagaccaccugc

SEQ ID NO: 435302 - RNA, 21 nt, Bordetella pertussis
ccaggcguccaggcugccggc

SEQ ID NO: 435303 - RNA, 20 nt, Bordetella pertussis
ccaggcgugaacgccccggc

SEQ ID NO: 435304 - RNA, 22 nt, Bordetella pertussis
ccaggcucuuuuucgagccgca

SEQ ID NO: 435305 - RNA, 13 nt, Bordetella pertussis
ccaggcugaucac

SEQ ID NO: 435306 - RNA, 21 nt, Bordetella pertussis
ccaggcugcccuggcccaggc

SEQ ID NO: 435307 - RNA, 15 nt, Bordetella pertussis
ccaggcugcgcgccg

SEQ ID NO: 435308 - RNA, 17 nt, Bordetella pertussis
ccaggcugcgcgccggc

SEQ ID NO: 435309 - RNA, 13 nt, Bordetella pertussis
ccaggcuggaguc

SEQ ID NO: 435310 - RNA, 22 nt, Bordetella pertussis
ccaggcugucccagauggcgcc

SEQ ID NO: 435311 - RNA, 17 nt, Bordetella pertussis
ccaggcuuugcgcgcca

SEQ ID NO: 435312 - RNA, 21 nt, Bordetella pertussis
ccagggaaggggcggcuucag

SEQ ID NO: 435313 - RNA, 20 nt, Bordetella pertussis
ccagggaccaauacgccgcc

SEQ ID NO: 435314 - RNA, 22 nt, Bordetella pertussis
ccagggaccaauacgccgccau

SEQ ID NO: 435315 - RNA, 15 nt, Bordetella pertussis
ccagggcagggcgcc

SEQ ID NO: 435316 - RNA, 12 nt, Bordetella pertussis
ccagggccaggc

SEQ ID NO: 435317 - RNA, 16 nt, Bordetella pertussis
ccagggccaggccgcc

SEQ ID NO: 435318 - RNA, 22 nt, Bordetella pertussis
ccagggccccuccggcgccgcc

SEQ ID NO: 435319 - RNA, 23 nt, Bordetella pertussis
ccagggccccuccggcgccgccu

SEQ ID NO: 435320 - RNA, 15 nt, Bordetella pertussis
ccagggccgcagcaa

SEQ ID NO: 435321 - RNA, 21 nt, Bordetella pertussis
ccagggccgccgcgcccagcc

SEQ ID NO: 435322 - RNA, 22 nt, Bordetella pertussis
ccagggccgccgcgcccagccg

SEQ ID NO: 435323 - RNA, 11 nt, Bordetella pertussis
ccagggccgcg

SEQ ID NO: 435324 - RNA, 22 nt, Bordetella pertussis
ccagggcgaucagcaccgcggc

SEQ ID NO: 435325 - RNA, 20 nt, Bordetella pertussis
ccagggcgauuucgcugaug

SEQ ID NO: 435326 - RNA, 15 nt, Bordetella pertussis
ccagggcgccgaccg

SEQ ID NO: 435327 - RNA, 22 nt, Bordetella pertussis
ccagggcgccgaccgggccgac

SEQ ID NO: 435328 - RNA, 13 nt, Bordetella pertussis
ccagggcgccgcg

SEQ ID NO: 435329 - RNA, 13 nt, Bordetella pertussis
ccagggcgcgccg

SEQ ID NO: 435330 - RNA, 17 nt, Bordetella pertussis
ccagggcgcgccgcagc

SEQ ID NO: 435331 - RNA, 20 nt, Bordetella pertussis
ccagggcgcgccggaacaug

SEQ ID NO: 435332 - RNA, 18 nt, Bordetella pertussis
ccagggcggugggcagcg

SEQ ID NO: 435333 - RNA, 22 nt, Bordetella pertussis
ccagggcgucggcgacgugaug

SEQ ID NO: 435334 - RNA, 17 nt, Bordetella pertussis
ccagggcuugcggcgcu

SEQ ID NO: 435335 - RNA, 21 nt, Bordetella pertussis
ccaggggacggcgcacccgcg

SEQ ID NO: 435336 - RNA, 21 nt, Bordetella pertussis
ccaggggcagcucggugcagc

SEQ ID NO: 435337 - RNA, 22 nt, Bordetella pertussis
ccaggggccggcgcgccgcgcc

SEQ ID NO: 435338 - RNA, 18 nt, Bordetella pertussis
ccagggggucagggccgc

SEQ ID NO: 435339 - RNA, 23 nt, Bordetella pertussis
ccagguauugcucggcggucagc

SEQ ID NO: 435340 - RNA, 17 nt, Bordetella pertussis
ccagguccacgaugccc

SEQ ID NO: 435341 - RNA, 12 nt, Bordetella pertussis
ccagguccuggc

SEQ ID NO: 435342 - RNA, 14 nt, Bordetella pertussis
ccaggucgcgcacc

SEQ ID NO: 435343 - RNA, 13 nt, Bordetella pertussis
ccaggucggacgc

SEQ ID NO: 435344 - RNA, 12 nt, Bordetella pertussis
ccaggucggcca

SEQ ID NO: 435345 - RNA, 19 nt, Bordetella pertussis
ccaggucggccaccgccgu

SEQ ID NO: 435346 - RNA, 15 nt, Bordetella pertussis
ccaggucggccagcc

SEQ ID NO: 435347 - RNA, 16 nt, Bordetella pertussis
ccaggucggccagccg

SEQ ID NO: 435348 - RNA, 17 nt, Bordetella pertussis
ccaggucggcggccagc

SEQ ID NO: 435349 - RNA, 18 nt, Bordetella pertussis
ccaggucggcggccagcg

SEQ ID NO: 435350 - RNA, 22 nt, Bordetella pertussis
ccaggucguacagcgccugcgc

SEQ ID NO: 435351 - RNA, 16 nt, Bordetella pertussis
ccaggucguugcgcga

SEQ ID NO: 435352 - RNA, 12 nt, Bordetella pertussis
ccaggucuaccc

SEQ ID NO: 435353 - RNA, 16 nt, Bordetella pertussis
ccaggucuacccgcgc

SEQ ID NO: 435354 - RNA, 23 nt, Bordetella pertussis
ccagugcgccggcggcggucagc

SEQ ID NO: 435355 - RNA, 18 nt, Bordetella pertussis
ccaguggugcucccagga

SEQ ID NO: 435356 - RNA, 13 nt, Bordetella pertussis
ccaguucgcgcag

SEQ ID NO: 435357 - RNA, 19 nt, Bordetella pertussis
ccaguucgcgcagauccca

SEQ ID NO: 435358 - RNA, 17 nt, Bordetella pertussis
ccaguucgcgcagcgcc

SEQ ID NO: 435359 - RNA, 17 nt, Bordetella pertussis
ccaguucgcggccggcc

SEQ ID NO: 435360 - RNA, 14 nt, Bordetella pertussis
ccaguucggccgcc

SEQ ID NO: 435361 - RNA, 15 nt, Bordetella pertussis
ccaguucugcagcgu

SEQ ID NO: 435362 - RNA, 21 nt, Bordetella pertussis
ccaguugaaccgcaacgccag

SEQ ID NO: 435363 - RNA, 21 nt, Bordetella pertussis
ccauaaggcuucucgaccagg

SEQ ID NO: 435364 - RNA, 18 nt, Bordetella pertussis
ccaucaacgggccgcugg

SEQ ID NO: 435365 - RNA, 20 nt, Bordetella pertussis
ccaucaccauggccgacagc

SEQ ID NO: 435366 - RNA, 14 nt, Bordetella pertussis
ccaucacgagcagg

SEQ ID NO: 435367 - RNA, 23 nt, Bordetella pertussis
ccaucacggugucgaugggcccg

SEQ ID NO: 435368 - RNA, 17 nt, Bordetella pertussis
ccaucagcucgaccacg

SEQ ID NO: 435369 - RNA, 18 nt, Bordetella pertussis
ccaucaucagcauggcgu

SEQ ID NO: 435370 - RNA, 16 nt, Bordetella pertussis
ccauccuggccgccgc

SEQ ID NO: 435371 - RNA, 16 nt, Bordetella pertussis
ccaucgacgggcggcu

SEQ ID NO: 435372 - RNA, 13 nt, Bordetella pertussis
ccaucguugccug

SEQ ID NO: 435373 - RNA, 18 nt, Bordetella pertussis
ccaucuacgugcuggacc

SEQ ID NO: 435374 - RNA, 22 nt, Bordetella pertussis
ccaucucgucggucaugcccau

SEQ ID NO: 435375 - RNA, 12 nt, Bordetella pertussis
ccaucugcugcg

SEQ ID NO: 435376 - RNA, 15 nt, Bordetella pertussis
ccaucuggaccgcgc

SEQ ID NO: 435377 - RNA, 18 nt, Bordetella pertussis
ccaucuguacggccggcu

SEQ ID NO: 435378 - RNA, 22 nt, Bordetella pertussis
ccaugaggaacggcaccagccg

SEQ ID NO: 435379 - RNA, 21 nt, Bordetella pertussis
ccaugaucaggccgaacuggg

SEQ ID NO: 435380 - RNA, 22 nt, Bordetella pertussis
ccaugaucaggccgaacuggga

SEQ ID NO: 435381 - RNA, 20 nt, Bordetella pertussis
ccaugaucagggccgugccc

SEQ ID NO: 435382 - RNA, 19 nt, Bordetella pertussis
ccaugccuugcgcgacagc

SEQ ID NO: 435383 - RNA, 14 nt, Bordetella pertussis
ccaugcgaugcugc

SEQ ID NO: 435384 - RNA, 18 nt, Bordetella pertussis
ccaugcgcaccaccgccg

SEQ ID NO: 435385 - RNA, 19 nt, Bordetella pertussis
ccaugcgcaccaccgccga

SEQ ID NO: 435386 - RNA, 19 nt, Bordetella pertussis
ccaugcgcacucgaccgcc

SEQ ID NO: 435387 - RNA, 13 nt, Bordetella pertussis
ccaugcgccagca

SEQ ID NO: 435388 - RNA, 19 nt, Bordetella pertussis
ccaugcgcgguugggcgca

SEQ ID NO: 435389 - RNA, 15 nt, Bordetella pertussis
ccaugcgcuggcgca

SEQ ID NO: 435390 - RNA, 20 nt, Bordetella pertussis
ccaugcgggucaggccgccg

SEQ ID NO: 435391 - RNA, 22 nt, Bordetella pertussis
ccaugcggggacaggcacuccg

SEQ ID NO: 435392 - RNA, 21 nt, Bordetella pertussis
ccaugcggggacuggcaccag

SEQ ID NO: 435393 - RNA, 24 nt, Bordetella pertussis
ccaugcugauccuggcauugagca

SEQ ID NO: 435394 - RNA, 13 nt, Bordetella pertussis
ccaugcugggcgg

SEQ ID NO: 435395 - RNA, 19 nt, Bordetella pertussis
ccauucagaccggguuguc

SEQ ID NO: 435396 - RNA, 16 nt, Bordetella pertussis
ccauucauccagcgcg

SEQ ID NO: 435397 - RNA, 14 nt, Bordetella pertussis
ccauugcagggugu

SEQ ID NO: 435398 - RNA, 22 nt, Bordetella pertussis
cccaaaaaaaaaccccgccagg

SEQ ID NO: 435399 - RNA, 21 nt, Bordetella pertussis
cccaacccggcgaggccgccc

SEQ ID NO: 435400 - RNA, 15 nt, Bordetella pertussis
cccaaucgggcagca

SEQ ID NO: 435401 - RNA, 20 nt, Bordetella pertussis
cccaaucgggcagcacgcgc

SEQ ID NO: 435402 - RNA, 16 nt, Bordetella pertussis
cccaaugucaccgacg

SEQ ID NO: 435403 - RNA, 12 nt, Bordetella pertussis
cccacagcgccc

SEQ ID NO: 435404 - RNA, 16 nt, Bordetella pertussis
cccacagcgcccccag

SEQ ID NO: 435405 - RNA, 23 nt, Bordetella pertussis
cccacaggcgcgcggcguugcgg

SEQ ID NO: 435406 - RNA, 17 nt, Bordetella pertussis
cccacauagcggccggc

SEQ ID NO: 435407 - RNA, 18 nt, Bordetella pertussis
cccacauagcggccggcg

SEQ ID NO: 435408 - RNA, 16 nt, Bordetella pertussis
cccacaugccgugcca

SEQ ID NO: 435409 - RNA, 11 nt, Bordetella pertussis
cccaccaccag

SEQ ID NO: 435410 - RNA, 13 nt, Bordetella pertussis
cccaccaccagcg

SEQ ID NO: 435411 - RNA, 15 nt, Bordetella pertussis
cccaccacgccgccc

SEQ ID NO: 435412 - RNA, 18 nt, Bordetella pertussis
cccaccacgccgcccagc

SEQ ID NO: 435413 - RNA, 16 nt, Bordetella pertussis
cccaccagccgggcgg

SEQ ID NO: 435414 - RNA, 15 nt, Bordetella pertussis
cccaccagggccagc

SEQ ID NO: 435415 - RNA, 18 nt, Bordetella pertussis
cccaccagggccagcuug

SEQ ID NO: 435416 - RNA, 13 nt, Bordetella pertussis
cccaccagggugc

SEQ ID NO: 435417 - RNA, 14 nt, Bordetella pertussis
cccaccagccgccc

SEQ ID NO: 435418 - RNA, 19 nt, Bordetella pertussis
cccaccaugagcacgcccc

SEQ ID NO: 435419 - RNA, 14 nt, Bordetella pertussis
cccaccgagacgcu

SEQ ID NO: 435420 - RNA, 12 nt, Bordetella pertussis
cccaccgccgcc

SEQ ID NO: 435421 - RNA, 20 nt, Bordetella pertussis
cccaccgccgcccgccaggc

SEQ ID NO: 435422 - RNA, 15 nt, Bordetella pertussis
cccaccggcaagccu

SEQ ID NO: 435423 - RNA, 14 nt, Bordetella pertussis
cccaccgggacagg

SEQ ID NO: 435424 - RNA, 15 nt, Bordetella pertussis
cccaccgggacaggc

SEQ ID NO: 435425 - RNA, 16 nt, Bordetella pertussis
cccaccgggacaggca

SEQ ID NO: 435426 - RNA, 18 nt, Bordetella pertussis
cccaccgggccggccugc

SEQ ID NO: 435427 - RNA, 22 nt, Bordetella pertussis
cccaccuuccugcuggaccugc

SEQ ID NO: 435428 - RNA, 14 nt, Bordetella pertussis
cccacgaucaccac

SEQ ID NO: 435429 - RNA, 18 nt, Bordetella pertussis
cccacgccgccguagccg

SEQ ID NO: 435430 - RNA, 20 nt, Bordetella pertussis
cccacgccgccguagccgcu

SEQ ID NO: 435431 - RNA, 15 nt, Bordetella pertussis
cccacgccgcugaug

SEQ ID NO: 435432 - RNA, 22 nt, Bordetella pertussis
cccacgccgcugauguggcuga

SEQ ID NO: 435433 - RNA, 21 nt, Bordetella pertussis
cccacgccgcugucgaccucg

SEQ ID NO: 435434 - RNA, 19 nt, Bordetella pertussis
cccacgcugucggggugcc

SEQ ID NO: 435435 - RNA, 15 nt, Bordetella pertussis
cccacggcaucgccg

SEQ ID NO: 435436 - RNA, 17 nt, Bordetella pertussis
cccacggcaucgccgcg

SEQ ID NO: 435437 - RNA, 15 nt, Bordetella pertussis
cccacggccagcacu

SEQ ID NO: 435438 - RNA, 19 nt, Bordetella pertussis
cccacggcguggcgcgccc

SEQ ID NO: 435439 - RNA, 20 nt, Bordetella pertussis
cccacggggacuggcucccg

SEQ ID NO: 435440 - RNA, 14 nt, Bordetella pertussis
cccacguggacagg

SEQ ID NO: 435441 - RNA, 15 nt, Bordetella pertussis
cccacguggacaggc

SEQ ID NO: 435442 - RNA, 20 nt, Bordetella pertussis
cccacucggugcgcgcgccc

SEQ ID NO: 435443 - RNA, 13 nt, Bordetella pertussis
cccacugccaggc

SEQ ID NO: 435444 - RNA, 14 nt, Bordetella pertussis
cccacugccaggcg

SEQ ID NO: 435445 - RNA, 23 nt, Bordetella pertussis
cccacuggaucgccgaucggcaa

SEQ ID NO: 435446 - RNA, 18 nt, Bordetella pertussis
cccacuugagcagcgccu

SEQ ID NO: 435447 - RNA, 19 nt, Bordetella pertussis
cccacuugagcagcgccuu

SEQ ID NO: 435448 - RNA, 17 nt, Bordetella pertussis
cccagaccugcgcgccg

SEQ ID NO: 435449 - RNA, 15 nt, Bordetella pertussis
cccagaucgauccag

SEQ ID NO: 435450 - RNA, 22 nt, Bordetella pertussis
cccagcaggcuuucgcacagcc

SEQ ID NO: 435451 - RNA, 15 nt, Bordetella pertussis
cccagcagguccugc

SEQ ID NO: 435452 - RNA, 17 nt, Bordetella pertussis
cccagcaucugccccag

SEQ ID NO: 435453 - RNA, 16 nt, Bordetella pertussis
cccagccaggcgccag

SEQ ID NO: 435454 - RNA, 13 nt, Bordetella pertussis
cccauucccgccc

SEQ ID NO: 435455 - RNA, 23 nt, Bordetella pertussis
cccauuuccgcuucggacagcag

SEQ ID NO: 435456 - RNA, 23 nt, Bordetella pertussis
ccccacgccgccguagccgcugc

SEQ ID NO: 435457 - RNA, 19 nt, Bordetella pertussis
ccccacggggacaggcacc

SEQ ID NO: 435458 - RNA, 16 nt, Bordetella pertussis
ccccacugggggacug

SEQ ID NO: 435459 - RNA, 12 nt, Bordetella pertussis
ccccagcggcgc

SEQ ID NO: 435460 - RNA, 18 nt, Bordetella pertussis
ccccaggcaggcgggccc

SEQ ID NO: 435461 - RNA, 19 nt, Bordetella pertussis
ccccaggaaaccgaccuga

SEQ ID NO: 435462 - RNA, 23 nt, Bordetella pertussis
ccccaggccagcugcgcccccuc

SEQ ID NO: 435463 - RNA, 13 nt, Bordetella pertussis
ccccagggcgcgc

SEQ ID NO: 435464 - RNA, 14 nt, Bordetella pertussis
ccccaggggacggc

SEQ ID NO: 435465 - RNA, 18 nt, Bordetella pertussis
ccccagguccgccggcac

SEQ ID NO: 435466 - RNA, 15 nt, Bordetella pertussis
ccccaguccaggccg

SEQ ID NO: 435467 - RNA, 18 nt, Bordetella pertussis
ccccaugcgcgguugggc

SEQ ID NO: 435468 - RNA, 21 nt, Bordetella pertussis
ccccaugcggggacaggcacu

SEQ ID NO: 435469 - RNA, 21 nt, Bordetella pertussis
ccccauguggggacaggcacc

SEQ ID NO: 435470 - RNA, 15 nt, Bordetella pertussis
cccccgauccccugc

SEQ ID NO: 435471 - RNA, 17 nt, Bordetella pertussis
cccccgauccccugccc

SEQ ID NO: 435472 - RNA, 19 nt, Bordetella pertussis
cccccgauccccugcccgc

SEQ ID NO: 435473 - RNA, 13 nt, Bordetella pertussis
cccccgccacggc

SEQ ID NO: 435474 - RNA, 20 nt, Bordetella pertussis
cccccgcggggacagauacc

SEQ ID NO: 435475 - RNA, 23 nt, Bordetella pertussis
cccccgcgucggacgcgcgccgc

SEQ ID NO: 435476 - RNA, 19 nt, Bordetella pertussis
ccccgaaacucaccgccgc

SEQ ID NO: 435477 - RNA, 21 nt, Bordetella pertussis
ccccgaaacucaccgccgccc

SEQ ID NO: 435478 - RNA, 16 nt, Bordetella pertussis
ccccgaacggggacug

SEQ ID NO: 435479 - RNA, 22 nt, Bordetella pertussis
ccccgaacggggacuggcacca

SEQ ID NO: 435480 - RNA, 15 nt, Bordetella pertussis
ccccgaaggggacug

SEQ ID NO: 435481 - RNA, 13 nt, Bordetella pertussis
ccccgaagcacag

SEQ ID NO: 435482 - RNA, 13 nt, Bordetella pertussis
ccccgaccgagcc

SEQ ID NO: 435483 - RNA, 15 nt, Bordetella pertussis
ccccgcagggcccgc

SEQ ID NO: 435484 - RNA, 20 nt, Bordetella pertussis
ccccgcauggagaccggcgc

SEQ ID NO: 435485 - RNA, 16 nt, Bordetella pertussis
ccccgcauggggacug

SEQ ID NO: 435486 - RNA, 13 nt, Bordetella pertussis
ccccggccgcccc

SEQ ID NO: 435487 - RNA, 14 nt, Bordetella pertussis
ccccggccgccccc

SEQ ID NO: 435488 - RNA, 18 nt, Bordetella pertussis
ccccggcgcgcagcgccu

SEQ ID NO: 435489 - RNA, 23 nt, Bordetella pertussis
ccccggcgcgcagcgccugcagg

SEQ ID NO: 435490 - RNA, 14 nt, Bordetella pertussis
ccccggcgcggccg

SEQ ID NO: 435491 - RNA, 14 nt, Bordetella pertussis
ccccgggcgcaagc

SEQ ID NO: 435492 - RNA, 22 nt, Bordetella pertussis
ccccgguagucgccggcuucca

SEQ ID NO: 435493 - RNA, 15 nt, Bordetella pertussis
ccccguugcagccca

SEQ ID NO: 435494 - RNA, 23 nt, Bordetella pertussis
ccccguuguugcauucccggacc

SEQ ID NO: 435495 - RNA, 23 nt, Bordetella pertussis
ccccuacgaauccccgcucaggu

SEQ ID NO: 435496 - RNA, 15 nt, Bordetella pertussis
ccccugcgggccgcu

SEQ ID NO: 435497 - RNA, 14 nt, Bordetella pertussis
ccccugcggggaca

SEQ ID NO: 435498 - RNA, 17 nt, Bordetella pertussis
ccccugcggggacaggc

SEQ ID NO: 435499 - RNA, 18 nt, Bordetella pertussis
ccccugcggggacaggca

SEQ ID NO: 435500 - RNA, 23 nt, Bordetella pertussis
cccgaacggggacuggcaccaau

SEQ ID NO: 435501 - RNA, 18 nt, Bordetella pertussis
cccgaagcgcagcaccag

SEQ ID NO: 435502 - RNA, 15 nt, Bordetella pertussis
cccgagaccgcccgc

SEQ ID NO: 435503 - RNA, 20 nt, Bordetella pertussis
cccgagauaggcggccaggc

SEQ ID NO: 435504 - RNA, 20 nt, Bordetella pertussis
cccgauacgacacgccgcgc

SEQ ID NO: 435505 - RNA, 17 nt, Bordetella pertussis
cccgauagccgcgcgcc

SEQ ID NO: 435506 - RNA, 17 nt, Bordetella pertussis
cccgauaugccaaggau

SEQ ID NO: 435507 - RNA, 22 nt, Bordetella pertussis
cccgaucagcaagggccccagc

SEQ ID NO: 435508 - RNA, 19 nt, Bordetella pertussis
cccgaucuccgggagccug

SEQ ID NO: 435509 - RNA, 23 nt, Bordetella pertussis
cccgaucuccgggagccuguccc

SEQ ID NO: 435510 - RNA, 22 nt, Bordetella pertussis
cccgaugacggggcggcgccug

SEQ ID NO: 435511 - RNA, 14 nt, Bordetella pertussis
cccgaugccgccau

SEQ ID NO: 435512 - RNA, 17 nt, Bordetella pertussis
cccgcaaaaccgggccc

SEQ ID NO: 435513 - RNA, 15 nt, Bordetella pertussis
cccgcaggagcaugc

SEQ ID NO: 435514 - RNA, 12 nt, Bordetella pertussis
cccgcagggaca

SEQ ID NO: 435515 - RNA, 14 nt, Bordetella pertussis
cccgcagggacagg

SEQ ID NO: 435516 - RNA, 20 nt, Bordetella pertussis
cccgcaguacccggugcagc

SEQ ID NO: 435517 - RNA, 18 nt, Bordetella pertussis
cccgcauagacgccgacc

SEQ ID NO: 435518 - RNA, 13 nt, Bordetella pertussis
cccgcaucgcgcg

SEQ ID NO: 435519 - RNA, 18 nt, Bordetella pertussis
cccgcaucgcgcgccgcc

SEQ ID NO: 435520 - RNA, 21 nt, Bordetella pertussis
cccgccccauugggacgccag

SEQ ID NO: 435521 - RNA, 23 nt, Bordetella pertussis
cccgcccgacgaggagccggcgg

SEQ ID NO: 435522 - RNA, 20 nt, Bordetella pertussis
cccgcccugacgccugcgcc

SEQ ID NO: 435523 - RNA, 13 nt, Bordetella pertussis
cccgcccugggca

SEQ ID NO: 435524 - RNA, 23 nt, Bordetella pertussis
cccgccgcgaucagcgcggccgc

SEQ ID NO: 435525 - RNA, 14 nt, Bordetella pertussis
cccgccugcagcag

SEQ ID NO: 435526 - RNA, 15 nt, Bordetella pertussis
cccgccugcagcagc

SEQ ID NO: 435527 - RNA, 16 nt, Bordetella pertussis
cccgccugcagcagcg

SEQ ID NO: 435528 - RNA, 13 nt, Bordetella pertussis
cccgccugcgcca

SEQ ID NO: 435529 - RNA, 14 nt, Bordetella pertussis
cccgccugcgccag

SEQ ID NO: 435530 - RNA, 21 nt, Bordetella pertussis
cccgccugcgccagccgcgcc

SEQ ID NO: 435531 - RNA, 18 nt, Bordetella pertussis
cccgccugcgccaggugg

SEQ ID NO: 435532 - RNA, 19 nt, Bordetella pertussis
cccgccuggacggcgagga

SEQ ID NO: 435533 - RNA, 18 nt, Bordetella pertussis
cccgcgaagcagccggcc

SEQ ID NO: 435534 - RNA, 14 nt, Bordetella pertussis
cccgcgagcggcca

SEQ ID NO: 435535 - RNA, 15 nt, Bordetella pertussis
cccgcgagcggccag

SEQ ID NO: 435536 - RNA, 13 nt, Bordetella pertussis
cccgcgcacgccc

SEQ ID NO: 435537 - RNA, 14 nt, Bordetella pertussis
cccgcgcacgcgcu

SEQ ID NO: 435538 - RNA, 21 nt, Bordetella pertussis
cccgcgcccaguuccacgcgg

SEQ ID NO: 435539 - RNA, 14 nt, Bordetella pertussis
cccgcgccgggguu

SEQ ID NO: 435540 - RNA, 12 nt, Bordetella pertussis
cccgcgccucgg

SEQ ID NO: 435541 - RNA, 22 nt, Bordetella pertussis
cccgcgcgguauugcgccaccc

SEQ ID NO: 435542 - RNA, 23 nt, Bordetella pertussis
cccgcgcgguauugcgccacccc

SEQ ID NO: 435543 - RNA, 20 nt, Bordetella pertussis
cccgcgcugccgcugcaggc

SEQ ID NO: 435544 - RNA, 19 nt, Bordetella pertussis
cccgcggaaagcuggcguu

SEQ ID NO: 435545 - RNA, 21 nt, Bordetella pertussis
cccgcggaggugucgccgccc

SEQ ID NO: 435546 - RNA, 18 nt, Bordetella pertussis
cccgcggccaccaggcug

SEQ ID NO: 435547 - RNA, 22 nt, Bordetella pertussis
cccgcggccagggugccccgcc

SEQ ID NO: 435548 - RNA, 11 nt, Bordetella pertussis
cccgcggcgcc

SEQ ID NO: 435549 - RNA, 17 nt, Bordetella pertussis
cccgcggcgcccagcug

SEQ ID NO: 435550 - RNA, 14 nt, Bordetella pertussis
cccgcggcgccccc

SEQ ID NO: 435551 - RNA, 20 nt, Bordetella pertussis
cccgcggggacaggcacccc

SEQ ID NO: 435552 - RNA, 20 nt, Bordetella pertussis
cccgcggggacaggcacccu

SEQ ID NO: 435553 - RNA, 15 nt, Bordetella pertussis
cccgcggguucgccc

SEQ ID NO: 435554 - RNA, 18 nt, Bordetella pertussis
cccgcgucagacgcgcuu

SEQ ID NO: 435555 - RNA, 19 nt, Bordetella pertussis
cccgcgucggacgcgcgcc

SEQ ID NO: 435556 - RNA, 17 nt, Bordetella pertussis
cccgcgucuuggcgggc

SEQ ID NO: 435557 - RNA, 18 nt, Bordetella pertussis
cccgcgucuuggcgggca

SEQ ID NO: 435558 - RNA, 23 nt, Bordetella pertussis
cccgcgucuuggcgggcaccaug

SEQ ID NO: 435559 - RNA, 18 nt, Bordetella pertussis
cccgcgugacggccgcca

SEQ ID NO: 435560 - RNA, 19 nt, Bordetella pertussis
cccgcgugacggccgccac

SEQ ID NO: 435561 - RNA, 23 nt, Bordetella pertussis
cccgcgugacggccgccacgccc

SEQ ID NO: 435562 - RNA, 16 nt, Bordetella pertussis
cccgcgugccuguccc

SEQ ID NO: 435563 - RNA, 21 nt, Bordetella pertussis
cccgcgugcgugccgacgaug

SEQ ID NO: 435564 - RNA, 19 nt, Bordetella pertussis
cccgcguucaggcgcggcu

SEQ ID NO: 435565 - RNA, 21 nt, Bordetella pertussis
cccgcuaugcgggcuugcugc

SEQ ID NO: 435566 - RNA, 23 nt, Bordetella pertussis
cccgcuaugcgggcuugcugccc

SEQ ID NO: 435567 - RNA, 14 nt, Bordetella pertussis
cccgcuccaccagc

SEQ ID NO: 435568 - RNA, 23 nt, Bordetella pertussis
cccgcucggccacgcgcaacgcc

SEQ ID NO: 435569 - RNA, 15 nt, Bordetella pertussis
cccgcugaccggccu

SEQ ID NO: 435570 - RNA, 23 nt, Bordetella pertussis
cccgcugacuuccggggagccug

SEQ ID NO: 435571 - RNA, 23 nt, Bordetella pertussis
cccgcugccgaauucguuggugc

SEQ ID NO: 435572 - RNA, 20 nt, Bordetella pertussis
cccgcuggccgaucugcugg

SEQ ID NO: 435573 - RNA, 20 nt, Bordetella pertussis
cccgcuggccgucgccgccc

SEQ ID NO: 435574 - RNA, 15 nt, Bordetella pertussis
cccgcugggacaggc

SEQ ID NO: 435575 - RNA, 18 nt, Bordetella pertussis
cccgcugggacaggcacu

SEQ ID NO: 435576 - RNA, 12 nt, Bordetella pertussis
cccgcugggcca

SEQ ID NO: 435577 - RNA, 15 nt, Bordetella pertussis
cccgcugggccagca

SEQ ID NO: 435578 - RNA, 22 nt, Bordetella pertussis
cccgcugggggcgguaccgucc

SEQ ID NO: 435579 - RNA, 23 nt, Bordetella pertussis
cccgcuucgacggcuugcgcaua

SEQ ID NO: 435580 - RNA, 15 nt, Bordetella pertussis
cccgcuugggccgcg

SEQ ID NO: 435581 - RNA, 17 nt, Bordetella pertussis
cccgcuugggccgcgcc

SEQ ID NO: 435582 - RNA, 14 nt, Bordetella pertussis
cccgcuuuuuccug

SEQ ID NO: 435583 - RNA, 17 nt, Bordetella pertussis
cccggacaacgcgcgcc

SEQ ID NO: 435584 - RNA, 14 nt, Bordetella pertussis
cccggaccagcagu

SEQ ID NO: 435585 - RNA, 20 nt, Bordetella pertussis
cccggauauggccggcgcgc

SEQ ID NO: 435586 - RNA, 18 nt, Bordetella pertussis
cccggaucauccgggccc

SEQ ID NO: 435587 - RNA, 15 nt, Bordetella pertussis
cccggaucgcacccg

SEQ ID NO: 435588 - RNA, 15 nt, Bordetella pertussis
cccggcaacccgccc

SEQ ID NO: 435589 - RNA, 19 nt, Bordetella pertussis
cccggcaacccgcccacgc

SEQ ID NO: 435590 - RNA, 21 nt, Bordetella pertussis
cccggcaacccgcccacgcgg

SEQ ID NO: 435591 - RNA, 19 nt, Bordetella pertussis
cccggcaccaucgccgccu

SEQ ID NO: 435592 - RNA, 20 nt, Bordetella pertussis
cccggcaccaucgccgccug

SEQ ID NO: 435593 - RNA, 21 nt, Bordetella pertussis
cccggcaccaucgccgccugc

SEQ ID NO: 435594 - RNA, 14 nt, Bordetella pertussis
cccggcacgcgccg

SEQ ID NO: 435595 - RNA, 15 nt, Bordetella pertussis
cccggcagaacagcg

SEQ ID NO: 435596 - RNA, 13 nt, Bordetella pertussis
cccggcagcugac

SEQ ID NO: 435597 - RNA, 22 nt, Bordetella pertussis
cccggccacgggaccgcucagc

SEQ ID NO: 435598 - RNA, 19 nt, Bordetella pertussis
cccggccgaaaccgccgcg

SEQ ID NO: 435599 - RNA, 14 nt, Bordetella pertussis
cccggcccgcgccg

SEQ ID NO: 435600 - RNA, 17 nt, Bordetella pertussis
cccggccgccagcaugg

SEQ ID NO: 435601 - RNA, 13 nt, Bordetella pertussis
cccggccgccccc

SEQ ID NO: 435602 - RNA, 14 nt, Bordetella pertussis
cccggccgcccccg

SEQ ID NO: 435603 - RNA, 14 nt, Bordetella pertussis
cccggccgccgccg

SEQ ID NO: 435604 - RNA, 18 nt, Bordetella pertussis
cccggccgccgccggcaa

SEQ ID NO: 435605 - RNA, 21 nt, Bordetella pertussis
cccggccgccucaccgcgccg

SEQ ID NO: 435606 - RNA, 12 nt, Bordetella pertussis
cccggccggcac

SEQ ID NO: 435607 - RNA, 15 nt, Bordetella pertussis
cccggccggcacggc

SEQ ID NO: 435608 - RNA, 16 nt, Bordetella pertussis
cccggccggccuuccg

SEQ ID NO: 435609 - RNA, 14 nt, Bordetella pertussis
cccggccggcgccg

SEQ ID NO: 435610 - RNA, 18 nt, Bordetella pertussis
cccggccggcgccggcaa

SEQ ID NO: 435611 - RNA, 23 nt, Bordetella pertussis
cccggccucagcggccgcugccg

SEQ ID NO: 435612 - RNA, 17 nt, Bordetella pertussis
cccggccucgcggcgcg

SEQ ID NO: 435613 - RNA, 16 nt, Bordetella pertussis
cccggccugcgcgccg

SEQ ID NO: 435614 - RNA, 20 nt, Bordetella pertussis
cccggccugcgggcgccgcg

SEQ ID NO: 435615 - RNA, 17 nt, Bordetella pertussis
cccggcgaagccggcac

SEQ ID NO: 435616 - RNA, 20 nt, Bordetella pertussis
cccggcgaagccggcacgcc

SEQ ID NO: 435617 - RNA, 21 nt, Bordetella pertussis
cccggcgaagccggcacgccu

SEQ ID NO: 435618 - RNA, 14 nt, Bordetella pertussis
cccggcgaggccgc

SEQ ID NO: 435619 - RNA, 19 nt, Bordetella pertussis
cccggcgaggccgcccgcc

SEQ ID NO: 435620 - RNA, 15 nt, Bordetella pertussis
cccggcgccagccag

SEQ ID NO: 435621 - RNA, 17 nt, Bordetella pertussis
cccggcgccagccagau

SEQ ID NO: 435622 - RNA, 14 nt, Bordetella pertussis
cccggcgccgcguu

SEQ ID NO: 435623 - RNA, 22 nt, Bordetella pertussis
cccggcgccgcguucacgccgg

SEQ ID NO: 435624 - RNA, 12 nt, Bordetella pertussis
cccggcgccgcg

SEQ ID NO: 435625 - RNA, 17 nt, Bordetella pertussis
cccggcgcgacaggcgg

SEQ ID NO: 435626 - RNA, 14 nt, Bordetella pertussis
cccggcgcgcagcg

SEQ ID NO: 435627 - RNA, 18 nt, Bordetella pertussis
cccggcgcgcagcgccug

SEQ ID NO: 435628 - RNA, 19 nt, Bordetella pertussis
cccggcgcgcagcgccugc

SEQ ID NO: 435629 - RNA, 15 nt, Bordetella pertussis
cccggcgcgccaccc

SEQ ID NO: 435630 - RNA, 12 nt, Bordetella pertussis
cccggcgcgccg

SEQ ID NO: 435631 - RNA, 18 nt, Bordetella pertussis
cccggcgcgccggccgcc

SEQ ID NO: 435632 - RNA, 12 nt, Bordetella pertussis
cccggcgcgccu

SEQ ID NO: 435633 - RNA, 21 nt, Bordetella pertussis
cccggcgcgccuucggcaggc

SEQ ID NO: 435634 - RNA, 17 nt, Bordetella pertussis
cccggcgcggacagaug

SEQ ID NO: 435635 - RNA, 13 nt, Bordetella pertussis
cccggcgcggccg

SEQ ID NO: 435636 - RNA, 14 nt, Bordetella pertussis
cccggcgcggcgcg

SEQ ID NO: 435637 - RNA, 19 nt, Bordetella pertussis
cccggcgcggcgcgcgccg

SEQ ID NO: 435638 - RNA, 19 nt, Bordetella pertussis
cccggcgcucagcgcgccg

SEQ ID NO: 435639 - RNA, 23 nt, Bordetella pertussis
cccggcggccaggccggcgcgcc

SEQ ID NO: 435640 - RNA, 12 nt, Bordetella pertussis
cccggcggcgcg

SEQ ID NO: 435641 - RNA, 15 nt, Bordetella pertussis
cccggcggcgcgccg

SEQ ID NO: 435642 - RNA, 12 nt, Bordetella pertussis
cccgggccggcu

SEQ ID NO: 435643 - RNA, 15 nt, Bordetella pertussis
cccgggccgucgccg

SEQ ID NO: 435644 - RNA, 22 nt, Bordetella pertussis
cccgggccgucuacaggcccag

SEQ ID NO: 435645 - RNA, 20 nt, Bordetella pertussis
cccgggcgccugcgccaccu

SEQ ID NO: 435646 - RNA, 11 nt, Bordetella pertussis
cccgggcugcu

SEQ ID NO: 435647 - RNA, 21 nt, Bordetella pertussis
cccgggcuggccgccugcugc

SEQ ID NO: 435648 - RNA, 18 nt, Bordetella pertussis
cccgggggcgccuguccc

SEQ ID NO: 435649 - RNA, 22 nt, Bordetella pertussis
cccgggguuagaguuuuuccuc

SEQ ID NO: 435650 - RNA, 18 nt, Bordetella pertussis
cccgggguucuggcaggu

SEQ ID NO: 435651 - RNA, 22 nt, Bordetella pertussis
cccgggguugggaucgcgccag

SEQ ID NO: 435652 - RNA, 20 nt, Bordetella pertussis
cccguaggcggcccaggcgu

SEQ ID NO: 435653 - RNA, 16 nt, Bordetella pertussis
cccgucggcggcaagc

SEQ ID NO: 435654 - RNA, 14 nt, Bordetella pertussis
cccgucgggacagg

SEQ ID NO: 435655 - RNA, 14 nt, Bordetella pertussis
cccugcagcggcca

SEQ ID NO: 435656 - RNA, 13 nt, Bordetella pertussis
cccugcagggcau

SEQ ID NO: 435657 - RNA, 17 nt, Bordetella pertussis
cccugcaugaccgccgc

SEQ ID NO: 435658 - RNA, 19 nt, Bordetella pertussis
cccugcaugaccgccgcca

SEQ ID NO: 435659 - RNA, 15 nt, Bordetella pertussis
cccugccucagacca

SEQ ID NO: 435660 - RNA, 17 nt, Bordetella pertussis
cccugccgugggacagg

SEQ ID NO: 435661 - RNA, 12 nt, Bordetella pertussis
cccugcgcgccg

SEQ ID NO: 435662 - RNA, 14 nt, Bordetella pertussis
cccugcgcgccgcc

SEQ ID NO: 435663 - RNA, 23 nt, Bordetella pertussis
cccugcgcguacguggcgcggcu

SEQ ID NO: 435664 - RNA, 14 nt, Bordetella pertussis
cccugcggacccag

SEQ ID NO: 435665 - RNA, 18 nt, Bordetella pertussis
cccugcuugcgcggaccu

SEQ ID NO: 435666 - RNA, 18 nt, Bordetella pertussis
cccuggagaucgccgccg

SEQ ID NO: 435667 - RNA, 23 nt, Bordetella pertussis
cccuggaucaggaugggcgcggc

SEQ ID NO: 435668 - RNA, 14 nt, Bordetella pertussis
cccuggcccaggcc

SEQ ID NO: 435669 - RNA, 19 nt, Bordetella pertussis
cccuggccgaacgccgccg

SEQ ID NO: 435670 - RNA, 23 nt, Bordetella pertussis
cccuggccgaacgccgccgcagc

SEQ ID NO: 435671 - RNA, 17 nt, Bordetella pertussis
cccuggcccuggcgggc

SEQ ID NO: 435672 - RNA, 19 nt, Bordetella pertussis
cccuggcgcaggccggcgg

SEQ ID NO: 435673 - RNA, 14 nt, Bordetella pertussis
cccuggcgcgccag

SEQ ID NO: 435674 - RNA, 16 nt, Bordetella pertussis
cccuggcgcugcagcg

SEQ ID NO: 435675 - RNA, 20 nt, Bordetella pertussis
cccuggcguggcgcgcgccg

SEQ ID NO: 435676 - RNA, 18 nt, Bordetella pertussis
cccuggcuggccagccgg

SEQ ID NO: 435677 - RNA, 20 nt, Bordetella pertussis
cccuggcuggccagccggcc

SEQ ID NO: 435678 - RNA, 21 nt, Bordetella pertussis
cccuggcuggccagccggccc

SEQ ID NO: 435679 - RNA, 19 nt, Bordetella pertussis
cccugugggggacaggcac

SEQ ID NO: 435680 - RNA, 22 nt, Bordetella pertussis
cccugugggggacaggcacgcc

SEQ ID NO: 435681 - RNA, 17 nt, Bordetella pertussis
cccuugagcgugggcug

SEQ ID NO: 435682 - RNA, 20 nt, Bordetella pertussis
cccuugagcacggcgcggcu

SEQ ID NO: 435683 - RNA, 16 nt, Bordetella pertussis
cccuugauggccgggc

SEQ ID NO: 435684 - RNA, 11 nt, Bordetella pertussis
cccuugccgca

SEQ ID NO: 435685 - RNA, 14 nt, Bordetella pertussis
cccuugccgcagcg

SEQ ID NO: 435686 - RNA, 11 nt, Bordetella pertussis
cccuugccgcg

SEQ ID NO: 435687 - RNA, 21 nt, Bordetella pertussis
cccuugcgcaaguucaucauc

SEQ ID NO: 435688 - RNA, 14 nt, Bordetella pertussis
cccuugugcugcca

SEQ ID NO: 435689 - RNA, 19 nt, Bordetella pertussis
cccuugugcugccaugccg

SEQ ID NO: 435690 - RNA, 22 nt, Bordetella pertussis
cccuuucauuucggcgccgcgc

SEQ ID NO: 435691 - RNA, 16 nt, Bordetella pertussis
ccgaacaagguccagg

SEQ ID NO: 435692 - RNA, 12 nt, Bordetella pertussis
ccgaacaccagc

SEQ ID NO: 435693 - RNA, 15 nt, Bordetella pertussis
ccgaacaccagcucg

SEQ ID NO: 435694 - RNA, 18 nt, Bordetella pertussis
ccgaacagaaggcgugcg

SEQ ID NO: 435695 - RNA, 19 nt, Bordetella pertussis
ccgaacagcauggcggcgc

SEQ ID NO: 435696 - RNA, 21 nt, Bordetella pertussis
ccgaacagcauggcggcgccc

SEQ ID NO: 435697 - RNA, 18 nt, Bordetella pertussis
ccgaacauauccacgcca

SEQ ID NO: 435698 - RNA, 22 nt, Bordetella pertussis
ccgaacauauccacgccacugg

SEQ ID NO: 435699 - RNA, 14 nt, Bordetella pertussis
ccgaaccacagcau

SEQ ID NO: 435700 - RNA, 12 nt, Bordetella pertussis
ccgaaccacccg

SEQ ID NO: 435701 - RNA, 15 nt, Bordetella pertussis
ccgaaccacccggcc

SEQ ID NO: 435702 - RNA, 14 nt, Bordetella pertussis
ccgaacccugccuc

SEQ ID NO: 435703 - RNA, 20 nt, Bordetella pertussis
ccgaacccugccucagacca

SEQ ID NO: 435704 - RNA, 14 nt, Bordetella pertussis
ccgaaccgcgcagc

SEQ ID NO: 435705 - RNA, 20 nt, Bordetella pertussis
ccgaaccggcaucccugcuu

SEQ ID NO: 435706 - RNA, 13 nt, Bordetella pertussis
ccgaacgaggcgc

SEQ ID NO: 435707 - RNA, 23 nt, Bordetella pertussis
ccgaacugggacaggcccagccc

SEQ ID NO: 435708 - RNA, 21 nt, Bordetella pertussis
ccgaacugucgcgccacggcu

SEQ ID NO: 435709 - RNA, 16 nt, Bordetella pertussis
ccgaagcggcccgggu

SEQ ID NO: 435710 - RNA, 18 nt, Bordetella pertussis
ccgaagcggcccgggugg

SEQ ID NO: 435711 - RNA, 15 nt, Bordetella pertussis
ccgaagcggcguucu

SEQ ID NO: 435712 - RNA, 20 nt, Bordetella pertussis
ccgaaggaccaagucgucgc

SEQ ID NO: 435713 - RNA, 19 nt, Bordetella pertussis
ccgaaggcgcggccgggcu

SEQ ID NO: 435714 - RNA, 13 nt, Bordetella pertussis
ccgaagggcugcg

SEQ ID NO: 435715 - RNA, 14 nt, Bordetella pertussis
ccgaaggguugcag

SEQ ID NO: 435716 - RNA, 20 nt, Bordetella pertussis
ccgaaggucuuggcgugcag

SEQ ID NO: 435717 - RNA, 22 nt, Bordetella pertussis
ccgaaggugggcgaaccgcggc

SEQ ID NO: 435718 - RNA, 19 nt, Bordetella pertussis
ccgaaguacacggccagca

SEQ ID NO: 435719 - RNA, 20 nt, Bordetella pertussis
ccgaaguacacggccagcac

SEQ ID NO: 435720 - RNA, 21 nt, Bordetella pertussis
ccgaaguaguuggucgagcgc

SEQ ID NO: 435721 - RNA, 19 nt, Bordetella pertussis
ccgacgcuguaacaacacg

SEQ ID NO: 435722 - RNA, 17 nt, Bordetella pertussis
ccgacggcauggccggc

SEQ ID NO: 435723 - RNA, 16 nt, Bordetella pertussis
ccgacggcauggcggc

SEQ ID NO: 435724 - RNA, 20 nt, Bordetella pertussis
ccgacggcauggcggccagc

SEQ ID NO: 435725 - RNA, 18 nt, Bordetella pertussis
ccgacggccucggccagg

SEQ ID NO: 435726 - RNA, 19 nt, Bordetella pertussis
ccgacggcgcuggcgagca

SEQ ID NO: 435727 - RNA, 23 nt, Bordetella pertussis
ccgacggcggcgcggcgccagcg

SEQ ID NO: 435728 - RNA, 14 nt, Bordetella pertussis
ccgacggcgcgccc

SEQ ID NO: 435729 - RNA, 13 nt, Bordetella pertussis
ccgacgggcggcu

SEQ ID NO: 435730 - RNA, 15 nt, Bordetella pertussis
ccgacguagucgcgc

SEQ ID NO: 435731 - RNA, 18 nt, Bordetella pertussis
ccgacgugaaagcuccac

SEQ ID NO: 435732 - RNA, 13 nt, Bordetella pertussis
ccgacgugcugcu

SEQ ID NO: 435733 - RNA, 14 nt, Bordetella pertussis
ccgacguggaccgc

SEQ ID NO: 435734 - RNA, 16 nt, Bordetella pertussis
ccgacguggaccgcgc

SEQ ID NO: 435735 - RNA, 16 nt, Bordetella pertussis
ccgagaccgcccgcug

SEQ ID NO: 435736 - RNA, 17 nt, Bordetella pertussis
ccgagacgcugucgcgc

SEQ ID NO: 435737 - RNA, 15 nt, Bordetella pertussis
ccgagacggccgccg

SEQ ID NO: 435738 - RNA, 18 nt, Bordetella pertussis
ccgagagcugcgucuuga

SEQ ID NO: 435739 - RNA, 16 nt, Bordetella pertussis
ccgagauaggcggcca

SEQ ID NO: 435740 - RNA, 21 nt, Bordetella pertussis
ccgagccuggcguagggcugc

SEQ ID NO: 435741 - RNA, 12 nt, Bordetella pertussis
ccgagccggugg

SEQ ID NO: 435742 - RNA, 17 nt, Bordetella pertussis
ccgagcgcaccccggcc

SEQ ID NO: 435743 - RNA, 14 nt, Bordetella pertussis
ccgagcgcgccagc

SEQ ID NO: 435744 - RNA, 15 nt, Bordetella pertussis
ccgagcgcggcaugc

SEQ ID NO: 435745 - RNA, 22 nt, Bordetella pertussis
ccgagcgcggcaugcgcaugcu

SEQ ID NO: 435746 - RNA, 16 nt, Bordetella pertussis
ccgagcgggccagcgc

SEQ ID NO: 435747 - RNA, 17 nt, Bordetella pertussis
ccgaggaucuggccggc

SEQ ID NO: 435748 - RNA, 16 nt, Bordetella pertussis
ccgaggccgaguggcc

SEQ ID NO: 435749 - RNA, 14 nt, Bordetella pertussis
ccgaggccugcugu

SEQ ID NO: 435750 - RNA, 22 nt, Bordetella pertussis
ccgaggccugcugugcgauggc

SEQ ID NO: 435751 - RNA, 21 nt, Bordetella pertussis
ccgaggccuugcucgcccaug

SEQ ID NO: 435752 - RNA, 15 nt, Bordetella pertussis
ccgaggcgccccaga

SEQ ID NO: 435753 - RNA, 12 nt, Bordetella pertussis
ccgaggcgcgca

SEQ ID NO: 435754 - RNA, 14 nt, Bordetella pertussis
ccgaggcgcugccc

SEQ ID NO: 435755 - RNA, 22 nt, Bordetella pertussis
ccgaggcgggcagcauggcgcc

SEQ ID NO: 435756 - RNA, 18 nt, Bordetella pertussis
ccgaggcugcgcgcgcca

SEQ ID NO: 435757 - RNA, 19 nt, Bordetella pertussis
ccgagggccggaacagcgu

SEQ ID NO: 435758 - RNA, 22 nt, Bordetella pertussis
ccgagggccggacuggcgcgca

SEQ ID NO: 435759 - RNA, 15 nt, Bordetella pertussis
ccgagggcgcggcgc

SEQ ID NO: 435760 - RNA, 18 nt, Bordetella pertussis
ccgagggcgcggcgccgc

SEQ ID NO: 435761 - RNA, 19 nt, Bordetella pertussis
ccgagggcgcggcgccgcu

SEQ ID NO: 435762 - RNA, 14 nt, Bordetella pertussis
ccgagggcgcgucc

SEQ ID NO: 435763 - RNA, 15 nt, Bordetella pertussis
ccgagggcgcgucca

SEQ ID NO: 435764 - RNA, 14 nt, Bordetella pertussis
ccgaguagcggcgc

SEQ ID NO: 435765 - RNA, 15 nt, Bordetella pertussis
ccgaguagcggcgca

SEQ ID NO: 435766 - RNA, 21 nt, Bordetella pertussis
ccgagucggcgauggcgcgcg

SEQ ID NO: 435767 - RNA, 18 nt, Bordetella pertussis
ccgaguccuugacgccgc

SEQ ID NO: 435768 - RNA, 20 nt, Bordetella pertussis
ccgaguccuugacgccgccg

SEQ ID NO: 435769 - RNA, 24 nt, Bordetella pertussis
ccgaguggccgcuguucggcgagc

SEQ ID NO: 435770 - RNA, 15 nt, Bordetella pertussis
ccgaguggcgggcca

SEQ ID NO: 435771 - RNA, 18 nt, Bordetella pertussis
ccgaguuuccgcacccgg

SEQ ID NO: 435772 - RNA, 13 nt, Bordetella pertussis
ccgauaccgcaaa

SEQ ID NO: 435773 - RNA, 20 nt, Bordetella pertussis
ccgauacgacacgccgcgcg

SEQ ID NO: 435774 - RNA, 16 nt, Bordetella pertussis
ccgauagcguucgaua

SEQ ID NO: 435775 - RNA, 14 nt, Bordetella pertussis
ccgauagguucgug

SEQ ID NO: 435776 - RNA, 22 nt, Bordetella pertussis
ccgaucaaccugaucguucccu

SEQ ID NO: 435777 - RNA, 12 nt, Bordetella pertussis
ccgauccagcgc

SEQ ID NO: 435778 - RNA, 14 nt, Bordetella pertussis
ccgauccccugccc

SEQ ID NO: 435779 - RNA, 15 nt, Bordetella pertussis
ccgauccccugcccg

SEQ ID NO: 435780 - RNA, 18 nt, Bordetella pertussis
ccgauccgcgacgcccug

SEQ ID NO: 435781 - RNA, 17 nt, Bordetella pertussis
ccgauccgcgggcgggc

SEQ ID NO: 435782 - RNA, 22 nt, Bordetella pertussis
ccgaucgccgacaggaugaaga

SEQ ID NO: 435783 - RNA, 21 nt, Bordetella pertussis
ccgaucgcggcuccagcucag

SEQ ID NO: 435784 - RNA, 16 nt, Bordetella pertussis
ccgaucggcgccgcgc

SEQ ID NO: 435785 - RNA, 18 nt, Bordetella pertussis
ccgaucggcgccgcgcgc

SEQ ID NO: 435786 - RNA, 13 nt, Bordetella pertussis
ccgaucggcgucu

SEQ ID NO: 435787 - RNA, 18 nt, Bordetella pertussis
ccgaucgugcacgcccgc

SEQ ID NO: 435788 - RNA, 16 nt, Bordetella pertussis
ccgaucugcugggccg

SEQ ID NO: 435789 - RNA, 12 nt, Bordetella pertussis
ccgaugaagacg

SEQ ID NO: 435790 - RNA, 15 nt, Bordetella pertussis
ccgaugaccagggcg

SEQ ID NO: 435791 - RNA, 17 nt, Bordetella pertussis
ccgaugaccagggcgcc

SEQ ID NO: 435792 - RNA, 21 nt, Bordetella pertussis
ccgaugaccagggcgccgacc

SEQ ID NO: 435793 - RNA, 13 nt, Bordetella pertussis
ccgaugaccggcc

SEQ ID NO: 435794 - RNA, 17 nt, Bordetella pertussis
ccgaugccgccaucauc

SEQ ID NO: 435795 - RNA, 15 nt, Bordetella pertussis
ccgaugccuuggugg

SEQ ID NO: 435796 - RNA, 13 nt, Bordetella pertussis
ccgaugcgccggc

SEQ ID NO: 435797 - RNA, 17 nt, Bordetella pertussis
ccgaugcgccggccugg

SEQ ID NO: 435798 - RNA, 16 nt, Bordetella pertussis
ccgaugcggcgcaugc

SEQ ID NO: 435799 - RNA, 19 nt, Bordetella pertussis
ccgaugcgguaggcccagc

SEQ ID NO: 435800 - RNA, 19 nt, Bordetella pertussis
ccgaugcgccaggccucgg

SEQ ID NO: 435801 - RNA, 15 nt, Bordetella pertussis
ccgaugcucgccggc

SEQ ID NO: 435802 - RNA, 23 nt, Bordetella pertussis
ccgauggcauggggcaggcgcag

SEQ ID NO: 435803 - RNA, 13 nt, Bordetella pertussis
ccgauggcgcgcg

SEQ ID NO: 435804 - RNA, 18 nt, Bordetella pertussis
ccgauggcguccagcagc

SEQ ID NO: 435805 - RNA, 14 nt, Bordetella pertussis
ccgauggugcgggc

SEQ ID NO: 435806 - RNA, 18 nt, Bordetella pertussis
ccgcaaaucaaugaaaaa

SEQ ID NO: 435807 - RNA, 23 nt, Bordetella pertussis
ccgcaacaggcagcugcgcgucg

SEQ ID NO: 435808 - RNA, 18 nt, Bordetella pertussis
ccgcaacccacccccagc

SEQ ID NO: 435809 - RNA, 16 nt, Bordetella pertussis
ccgcaacccagcagcg

SEQ ID NO: 435810 - RNA, 14 nt, Bordetella pertussis
ccgcaacccgcuuu

SEQ ID NO: 435811 - RNA, 14 nt, Bordetella pertussis
ccgcaacgccgccg

SEQ ID NO: 435812 - RNA, 19 nt, Bordetella pertussis
ccgcaacgccagcaggcga

SEQ ID NO: 435813 - RNA, 16 nt, Bordetella pertussis
ccgcaacgggccggcc

SEQ ID NO: 435814 - RNA, 21 nt, Bordetella pertussis
ccgcaagauuucauggcgucu

SEQ ID NO: 435815 - RNA, 23 nt, Bordetella pertussis
ccgcaagcguacguaccaggccg

SEQ ID NO: 435816 - RNA, 22 nt, Bordetella pertussis
ccgcaagcuggccgaugucgcc

SEQ ID NO: 435817 - RNA, 15 nt, Bordetella pertussis
ccgcaagcuggcggc

SEQ ID NO: 435818 - RNA, 17 nt, Bordetella pertussis
ccgcaagcuggcggcgc

SEQ ID NO: 435819 - RNA, 12 nt, Bordetella pertussis
ccgcaaggaagu

SEQ ID NO: 435820 - RNA, 16 nt, Bordetella pertussis
ccgcaaggaaguggcc

SEQ ID NO: 435821 - RNA, 17 nt, Bordetella pertussis
ccgcaaggggccggcgc

SEQ ID NO: 435822 - RNA, 19 nt, Bordetella pertussis
ccgcaagggggacuggcac

SEQ ID NO: 435823 - RNA, 12 nt, Bordetella pertussis
ccgcaccggagg

SEQ ID NO: 435824 - RNA, 16 nt, Bordetella pertussis
ccgcaccgggcggccc

SEQ ID NO: 435825 - RNA, 23 nt, Bordetella pertussis
ccgcaccggugggagccaguccc

SEQ ID NO: 435826 - RNA, 20 nt, Bordetella pertussis
ccgcacgaucgcgccggccu

SEQ ID NO: 435827 - RNA, 16 nt, Bordetella pertussis
ccgcacgauggcgcgc

SEQ ID NO: 435828 - RNA, 23 nt, Bordetella pertussis
ccgcacgcccgccugcagcagcg

SEQ ID NO: 435829 - RNA, 13 nt, Bordetella pertussis
ccgcacgccgguc

SEQ ID NO: 435830 - RNA, 16 nt, Bordetella pertussis
ccgcacgcgcggcagc

SEQ ID NO: 435831 - RNA, 19 nt, Bordetella pertussis
ccgcacgcgcggcagcgcc

SEQ ID NO: 435832 - RNA, 16 nt, Bordetella pertussis
ccgcacgcggccgcgg

SEQ ID NO: 435833 - RNA, 22 nt, Bordetella pertussis
ccgcacgcggccgcgggccgcu

SEQ ID NO: 435834 - RNA, 21 nt, Bordetella pertussis
ccgcacgcucuacacggccgc

SEQ ID NO: 435835 - RNA, 13 nt, Bordetella pertussis
ccgcacgggcgcc

SEQ ID NO: 435836 - RNA, 14 nt, Bordetella pertussis
ccgcacgggcgccu

SEQ ID NO: 435837 - RNA, 21 nt, Bordetella pertussis
ccgcacgggcgccuguccccg

SEQ ID NO: 435838 - RNA, 15 nt, Bordetella pertussis
ccgcacggggacagg

SEQ ID NO: 435839 - RNA, 17 nt, Bordetella pertussis
ccgcacggggacaggca

SEQ ID NO: 435840 - RNA, 19 nt, Bordetella pertussis
ccgcacggggacaggcacg

SEQ ID NO: 435841 - RNA, 18 nt, Bordetella pertussis
ccgcacggggacuggcac

SEQ ID NO: 435842 - RNA, 19 nt, Bordetella pertussis
ccgcacggggacuggcacc

SEQ ID NO: 435843 - RNA, 14 nt, Bordetella pertussis
ccgcacgggccgac

SEQ ID NO: 435844 - RNA, 14 nt, Bordetella pertussis
ccgcacgguggcgc

SEQ ID NO: 435845 - RNA, 20 nt, Bordetella pertussis
ccgcagcaauugccccagca

SEQ ID NO: 435846 - RNA, 13 nt, Bordetella pertussis
ccgcagcaccaca

SEQ ID NO: 435847 - RNA, 14 nt, Bordetella pertussis
ccgcagcaggcgcu

SEQ ID NO: 435848 - RNA, 15 nt, Bordetella pertussis
ccgcagcaggcgcuc

SEQ ID NO: 435849 - RNA, 21 nt, Bordetella pertussis
ccgcagcaguucggucagcgc

SEQ ID NO: 435850 - RNA, 21 nt, Bordetella pertussis
ccgcagcauggcgccagcugg

SEQ ID NO: 435851 - RNA, 17 nt, Bordetella pertussis
ccgcagcccgcgcgccu

SEQ ID NO: 435852 - RNA, 16 nt, Bordetella pertussis
ccgcagccggcugcaa

SEQ ID NO: 435853 - RNA, 22 nt, Bordetella pertussis
ccgcagccguugaucugguuca

SEQ ID NO: 435854 - RNA, 13 nt, Bordetella pertussis
ccgcagccgucgc

SEQ ID NO: 435855 - RNA, 21 nt, Bordetella pertussis
ccgcagcggcagcgcaccguc

SEQ ID NO: 435856 - RNA, 22 nt, Bordetella pertussis
ccgccugagcacaugcccggcc

SEQ ID NO: 435857 - RNA, 15 nt, Bordetella pertussis
ccgccugcagcagcg

SEQ ID NO: 435858 - RNA, 15 nt, Bordetella pertussis
ccgccugccggccug

SEQ ID NO: 435859 - RNA, 18 nt, Bordetella pertussis
ccgccugcgccagccgcg

SEQ ID NO: 435860 - RNA, 23 nt, Bordetella pertussis
ccgccugcgccaggugggccagg

SEQ ID NO: 435861 - RNA, 23 nt, Bordetella pertussis
ccgccugcggacggcgggcgccc

SEQ ID NO: 435862 - RNA, 15 nt, Bordetella pertussis
ccgccugcguggcgg

SEQ ID NO: 435863 - RNA, 15 nt, Bordetella pertussis
ccgccugcugcaugu

SEQ ID NO: 435864 - RNA, 12 nt, Bordetella pertussis
ccgccugcugcg

SEQ ID NO: 435865 - RNA, 14 nt, Bordetella pertussis
ccgccugcugcgcc

SEQ ID NO: 435866 - RNA, 19 nt, Bordetella pertussis
ccgccuggcuuacaggccc

SEQ ID NO: 435867 - RNA, 22 nt, Bordetella pertussis
ccgccuggcuuucgccgcgggc

SEQ ID NO: 435868 - RNA, 23 nt, Bordetella pertussis
ccgccugguaguaaucgcgcgcc

SEQ ID NO: 435869 - RNA, 20 nt, Bordetella pertussis
ccgccugugccagcuggccc

SEQ ID NO: 435870 - RNA, 12 nt, Bordetella pertussis
ccgccuucuuga

SEQ ID NO: 435871 - RNA, 14 nt, Bordetella pertussis
ccgccuucuugaac

SEQ ID NO: 435872 - RNA, 21 nt, Bordetella pertussis
ccgccuugacgguggccgcgg

SEQ ID NO: 435873 - RNA, 20 nt, Bordetella pertussis
ccgccuugccuugcgcggcc

SEQ ID NO: 435874 - RNA, 14 nt, Bordetella pertussis
ccgcgaaccaggcc

SEQ ID NO: 435875 - RNA, 18 nt, Bordetella pertussis
ccgcgaacgcgccggccc

SEQ ID NO: 435876 - RNA, 17 nt, Bordetella pertussis
ccgcgaagcagccggcc

SEQ ID NO: 435877 - RNA, 21 nt, Bordetella pertussis
ccgcgaagcgcgccagcagcg

SEQ ID NO: 435878 - RNA, 16 nt, Bordetella pertussis
ccgcgaccaccagcac

SEQ ID NO: 435879 - RNA, 17 nt, Bordetella pertussis
ccgcgagcaugcgcagc

SEQ ID NO: 435880 - RNA, 21 nt, Bordetella pertussis
ccgcgagcggccagccugccg

SEQ ID NO: 435881 - RNA, 20 nt, Bordetella pertussis
ccgcgaucagcgcggccgcu

SEQ ID NO: 435882 - RNA, 16 nt, Bordetella pertussis
ccgcgauauccuugcg

SEQ ID NO: 435883 - RNA, 14 nt, Bordetella pertussis
ccgcgaugucgcgc

SEQ ID NO: 435884 - RNA, 16 nt, Bordetella pertussis
ccgcgcaaggccugcu

SEQ ID NO: 435885 - RNA, 14 nt, Bordetella pertussis
ccgcgcaaggcggc

SEQ ID NO: 435886 - RNA, 20 nt, Bordetella pertussis
ccgcgcaaggcggcccggcc

SEQ ID NO: 435887 - RNA, 18 nt, Bordetella pertussis
ccgcgcacacauggcgca

SEQ ID NO: 435888 - RNA, 17 nt, Bordetella pertussis
ccgcgcaccaggcgcgg

SEQ ID NO: 435889 - RNA, 16 nt, Bordetella pertussis
ccgcgcacccaggccc

SEQ ID NO: 435890 - RNA, 20 nt, Bordetella pertussis
ccgcgcaccugcugcggcac

SEQ ID NO: 435891 - RNA, 24 nt, Bordetella pertussis
ccgcgcacgauggggcagccaucc

SEQ ID NO: 435892 - RNA, 23 nt, Bordetella pertussis
ccgcgcacgcacugagcuucgcc

SEQ ID NO: 435893 - RNA, 18 nt, Bordetella pertussis
ccgcgcagaaaccgccac

SEQ ID NO: 435894 - RNA, 20 nt, Bordetella pertussis
ccgcgcagaaaccgccacag

SEQ ID NO: 435895 - RNA, 17 nt, Bordetella pertussis
ccgcgcagcacgcccgc

SEQ ID NO: 435896 - RNA, 16 nt, Bordetella pertussis
ccgcgcagccgacagg

SEQ ID NO: 435897 - RNA, 20 nt, Bordetella pertussis
ccgcgcagccgacaggcgcg

SEQ ID NO: 435898 - RNA, 21 nt, Bordetella pertussis
ccgcgcagccgacaggcgcgc

SEQ ID NO: 435899 - RNA, 17 nt, Bordetella pertussis
ccgcgcagcgucugcgc

SEQ ID NO: 435900 - RNA, 12 nt, Bordetella pertussis
ccgcgcagggca

SEQ ID NO: 435901 - RNA, 16 nt, Bordetella pertussis
ccgcgcaggucggcga

SEQ ID NO: 435902 - RNA, 21 nt, Bordetella pertussis
ccgcgcaugcaagacaggccg

SEQ ID NO: 435903 - RNA, 22 nt, Bordetella pertussis
ccgcgcaugcaagacaggccgc

SEQ ID NO: 435904 - RNA, 17 nt, Bordetella pertussis
ccgcgcauuugccgcgg

SEQ ID NO: 435905 - RNA, 22 nt, Bordetella pertussis
ccgcgcauuugccgcggcgaag

SEQ ID NO: 435906 - RNA, 22 nt, Bordetella pertussis
ccgcgccacacgggcgccugcc

SEQ ID NO: 435907 - RNA, 13 nt, Bordetella pertussis
ccgcgccaccacc

SEQ ID NO: 435908 - RNA, 13 nt, Bordetella pertussis
ccgcgccagcgcc

SEQ ID NO: 435909 - RNA, 18 nt, Bordetella pertussis
ccgcgccagcgccacgcc

SEQ ID NO: 435910 - RNA, 14 nt, Bordetella pertussis
ccgcgccagcgccu

SEQ ID NO: 435911 - RNA, 14 nt, Bordetella pertussis
ccgcgccagggcgc

SEQ ID NO: 435912 - RNA, 19 nt, Bordetella pertussis
ccgcgccagguaggccggc

SEQ ID NO: 435913 - RNA, 22 nt, Bordetella pertussis
ccgcgccaucuaccugucgggc

SEQ ID NO: 435914 - RNA, 15 nt, Bordetella pertussis
ccgcgccagcugcgc

SEQ ID NO: 435915 - RNA, 18 nt, Bordetella pertussis
ccgcgccagcugcgcagc

SEQ ID NO: 435916 - RNA, 16 nt, Bordetella pertussis
ccgcgcccagccgcgc

SEQ ID NO: 435917 - RNA, 13 nt, Bordetella pertussis
ccgcgcccagcgu

SEQ ID NO: 435918 - RNA, 14 nt, Bordetella pertussis
ccgcgcccagcgug

SEQ ID NO: 435919 - RNA, 15 nt, Bordetella pertussis
ccgcgcccagcuguc

SEQ ID NO: 435920 - RNA, 16 nt, Bordetella pertussis
ccgcgcccagcugucc

SEQ ID NO: 435921 - RNA, 13 nt, Bordetella pertussis
ccgcgcccgcccc

SEQ ID NO: 435922 - RNA, 14 nt, Bordetella pertussis
ccgcgcccaggucc

SEQ ID NO: 435923 - RNA, 23 nt, Bordetella pertussis
ccgcgcccagguccugcgccagc

SEQ ID NO: 435924 - RNA, 14 nt, Bordetella pertussis
ccgcgcccgccgcg

SEQ ID NO: 435925 - RNA, 17 nt, Bordetella pertussis
ccgcgcccgccgcgcca

SEQ ID NO: 435926 - RNA, 23 nt, Bordetella pertussis
ccgcgcccgcuugcggccggcgc

SEQ ID NO: 435927 - RNA, 16 nt, Bordetella pertussis
ccgcgcccggccggcc

SEQ ID NO: 435928 - RNA, 12 nt, Bordetella pertussis
ccgcgcccggcg

SEQ ID NO: 435929 - RNA, 20 nt, Bordetella pertussis
ccgcgcccggcggccaggcc

SEQ ID NO: 435930 - RNA, 17 nt, Bordetella pertussis
ccgcgcccuggggcgcg

SEQ ID NO: 435931 - RNA, 18 nt, Bordetella pertussis
ccgcgccgaacgcgcagc

SEQ ID NO: 435932 - RNA, 19 nt, Bordetella pertussis
ccgcgccgaacgcgcagcg

SEQ ID NO: 435933 - RNA, 17 nt, Bordetella pertussis
ccgcgccgaaggcgugc

SEQ ID NO: 435934 - RNA, 22 nt, Bordetella pertussis
ccgcgccgaccacgcugggcca

SEQ ID NO: 435935 - RNA, 19 nt, Bordetella pertussis
ccgcgccgaccggccccac

SEQ ID NO: 435936 - RNA, 18 nt, Bordetella pertussis
ccgcgccgacggcggcgc

SEQ ID NO: 435937 - RNA, 19 nt, Bordetella pertussis
ccgcgccgagcggggccgc

SEQ ID NO: 435938 - RNA, 23 nt, Bordetella pertussis
ccgcgccgaguuuccgcacccgg

SEQ ID NO: 435939 - RNA, 20 nt, Bordetella pertussis
ccgcgccgcccgcggccagc

SEQ ID NO: 435940 - RNA, 16 nt, Bordetella pertussis
ccgcgccgcggcaagc

SEQ ID NO: 435941 - RNA, 23 nt, Bordetella pertussis
ccgcgccgcuggcguccagguug

SEQ ID NO: 435942 - RNA, 16 nt, Bordetella pertussis
ccgcgccggcucccgc

SEQ ID NO: 435943 - RNA, 17 nt, Bordetella pertussis
ccgcgccggggcggcgc

SEQ ID NO: 435944 - RNA, 20 nt, Bordetella pertussis
ccgcgccguaccugcagcag

SEQ ID NO: 435945 - RNA, 16 nt, Bordetella pertussis
ccgcgccugcagcagc

SEQ ID NO: 435946 - RNA, 17 nt, Bordetella pertussis
ccgcgccugcagcagcg

SEQ ID NO: 435947 - RNA, 21 nt, Bordetella pertussis
ccgcgcgacagccgcgccagc

SEQ ID NO: 435948 - RNA, 19 nt, Bordetella pertussis
ccgcgcgauccggcguggu

SEQ ID NO: 435949 - RNA, 20 nt, Bordetella pertussis
ccgcgcgauccuggggcagg

SEQ ID NO: 435950 - RNA, 18 nt, Bordetella pertussis
ccgcgcgagcggcgugcg

SEQ ID NO: 435951 - RNA, 20 nt, Bordetella pertussis
ccgcgcgcacguggaccagg

SEQ ID NO: 435952 - RNA, 20 nt, Bordetella pertussis
ccgcgcgcaucacgcuggcc

SEQ ID NO: 435953 - RNA, 17 nt, Bordetella pertussis
ccgcgcgcauccaggug

SEQ ID NO: 435954 - RNA, 14 nt, Bordetella pertussis
ccgcgcgccgcgcc

SEQ ID NO: 435955 - RNA, 14 nt, Bordetella pertussis
ccgcgcgccggcgc

SEQ ID NO: 435956 - RNA, 22 nt, Bordetella pertussis
ccgcgcgccggcgccggcgcgc

SEQ ID NO: 435957 - RNA, 20 nt, Bordetella pertussis
ccgcgcgccuuacuucuugc

SEQ ID NO: 435958 - RNA, 17 nt, Bordetella pertussis
ccgcgcgcgagcugcgc

SEQ ID NO: 435959 - RNA, 21 nt, Bordetella pertussis
ccgcgcgcgagcugcgcggcu

SEQ ID NO: 435960 - RNA, 15 nt, Bordetella pertussis
ccgcgcgcggccggc

SEQ ID NO: 435961 - RNA, 17 nt, Bordetella pertussis
ccgcgcgcggccggcgc

SEQ ID NO: 435962 - RNA, 18 nt, Bordetella pertussis
ccgcgcgcgggcgcccgc

SEQ ID NO: 435963 - RNA, 20 nt, Bordetella pertussis
ccgcgcgcguauggcggcgc

SEQ ID NO: 435964 - RNA, 16 nt, Bordetella pertussis
ccgcgcgcgucgccgc

SEQ ID NO: 435965 - RNA, 21 nt, Bordetella pertussis
ccgcgcgcgucgccgcuggcc

SEQ ID NO: 435966 - RNA, 22 nt, Bordetella pertussis
ccgcgcgcuggcugugcccgcc

SEQ ID NO: 435967 - RNA, 18 nt, Bordetella pertussis
ccgcgcgcuuucaggugg

SEQ ID NO: 435968 - RNA, 14 nt, Bordetella pertussis
ccgcgcggccagcg

SEQ ID NO: 435969 - RNA, 16 nt, Bordetella pertussis
ccgcgcggcgccugcc

SEQ ID NO: 435970 - RNA, 21 nt, Bordetella pertussis
ccgcgcgguacgcaccgccgc

SEQ ID NO: 435971 - RNA, 16 nt, Bordetella pertussis
ccgcgcgguggccgcc

SEQ ID NO: 435972 - RNA, 18 nt, Bordetella pertussis
ccgcgcgguggccgccgc

SEQ ID NO: 435973 - RNA, 16 nt, Bordetella pertussis
ccgcgcgguucgcaua

SEQ ID NO: 435974 - RNA, 17 nt, Bordetella pertussis
ccgcgcguacgcggcgc

SEQ ID NO: 435975 - RNA, 23 nt, Bordetella pertussis
ccgcgcguaucggcgcgagcgau

SEQ ID NO: 435976 - RNA, 21 nt, Bordetella pertussis
ccgcgcgugcggggcggcagg

SEQ ID NO: 435977 - RNA, 17 nt, Bordetella pertussis
ccgcgcucagcaccagg

SEQ ID NO: 435978 - RNA, 19 nt, Bordetella pertussis
ccgcgcucagcaccaggcc

SEQ ID NO: 435979 - RNA, 16 nt, Bordetella pertussis
ccgcgcucgcccagcc

SEQ ID NO: 435980 - RNA, 17 nt, Bordetella pertussis
ccgcgcugauccuggcu

SEQ ID NO: 435981 - RNA, 21 nt, Bordetella pertussis
ccgcgcugccgcugcaggccc

SEQ ID NO: 435982 - RNA, 15 nt, Bordetella pertussis
ccgcgcugcgcccgc

SEQ ID NO: 435983 - RNA, 16 nt, Bordetella pertussis
ccgcgcugcggucagc

SEQ ID NO: 435984 - RNA, 17 nt, Bordetella pertussis
ccgcgcugcugccgucg

SEQ ID NO: 435985 - RNA, 15 nt, Bordetella pertussis
ccgcgcuggcgcagc

SEQ ID NO: 435986 - RNA, 22 nt, Bordetella pertussis
ccgcgcuggcgcuggccgcccg

SEQ ID NO: 435987 - RNA, 23 nt, Bordetella pertussis
ccgcgcuggcgcuggccgcccgc

SEQ ID NO: 435988 - RNA, 14 nt, Bordetella pertussis
ccgcgcugugcgac

SEQ ID NO: 435989 - RNA, 23 nt, Bordetella pertussis
ccgcgcuguugcuccaggccggc

SEQ ID NO: 435990 - RNA, 17 nt, Bordetella pertussis
ccgcgcuucgucggcgu

SEQ ID NO: 435991 - RNA, 15 nt, Bordetella pertussis
ccgcggaagucgggc

SEQ ID NO: 435992 - RNA, 19 nt, Bordetella pertussis
ccgcggacgccauggcggc

SEQ ID NO: 435993 - RNA, 18 nt, Bordetella pertussis
ccgcggcaggccccggcc

SEQ ID NO: 435994 - RNA, 15 nt, Bordetella pertussis
ccgcggccagccacg

SEQ ID NO: 435995 - RNA, 19 nt, Bordetella pertussis
ccgcggccagcgccgcgcc

SEQ ID NO: 435996 - RNA, 20 nt, Bordetella pertussis
ccgcggccgcggucagccag

SEQ ID NO: 435997 - RNA, 16 nt, Bordetella pertussis
ccgcggccggcacgcc

SEQ ID NO: 435998 - RNA, 17 nt, Bordetella pertussis
ccgcggccugcgcgucc

SEQ ID NO: 435999 - RNA, 19 nt, Bordetella pertussis
ccgcggccuucaccccgcc

SEQ ID NO: 436000 - RNA, 21 nt, Bordetella pertussis
ccgcggcgcagguccaccgcc

SEQ ID NO: 436001 - RNA, 17 nt, Bordetella pertussis
ccgcggcgcccagcugg

SEQ ID NO: 436002 - RNA, 15 nt, Bordetella pertussis
ccgcggcgcccggug

SEQ ID NO: 436003 - RNA, 17 nt, Bordetella pertussis
ccgcggcgcggcccgcc

SEQ ID NO: 436004 - RNA, 18 nt, Bordetella pertussis
ccgcggcgcgcgcggcgc

SEQ ID NO: 436005 - RNA, 16 nt, Bordetella pertussis
ccgcggcggcccgguu

SEQ ID NO: 436006 - RNA, 23 nt, Bordetella pertussis
ccgcggcggcccgguucaaccgg

SEQ ID NO: 436007 - RNA, 18 nt, Bordetella pertussis
ccgcggcguugcggcagc

SEQ ID NO: 436008 - RNA, 19 nt, Bordetella pertussis
ccgcggcuugccgcggcgc

SEQ ID NO: 436009 - RNA, 22 nt, Bordetella pertussis
ccgcgggcggcgccggccgccc

SEQ ID NO: 436010 - RNA, 23 nt, Bordetella pertussis
ccgcgggcugcgacaggcgcagc

SEQ ID NO: 436011 - RNA, 12 nt, Bordetella pertussis
ccgcggggacag

SEQ ID NO: 436012 - RNA, 16 nt, Bordetella pertussis
ccgcggggacaggcac

SEQ ID NO: 436013 - RNA, 18 nt, Bordetella pertussis
ccgcggggacaggcaccg

SEQ ID NO: 436014 - RNA, 14 nt, Bordetella pertussis
ccgcggggcuggcc

SEQ ID NO: 436015 - RNA, 16 nt, Bordetella pertussis
ccgcggggcuggccag

SEQ ID NO: 436016 - RNA, 17 nt, Bordetella pertussis
ccgcggggguggacgcc

SEQ ID NO: 436017 - RNA, 16 nt, Bordetella pertussis
ccgcggguggccgcuc

SEQ ID NO: 436018 - RNA, 17 nt, Bordetella pertussis
ccgcggguggccgcucc

SEQ ID NO: 436019 - RNA, 14 nt, Bordetella pertussis
ccgcggugccgcgc

SEQ ID NO: 436020 - RNA, 15 nt, Bordetella pertussis
ccgcggugccgcgcg

SEQ ID NO: 436021 - RNA, 16 nt, Bordetella pertussis
ccgcguacaacgccgc

SEQ ID NO: 436022 - RNA, 23 nt, Bordetella pertussis
ccgcguacuuccucgaccagccc

SEQ ID NO: 436023 - RNA, 19 nt, Bordetella pertussis
ccgcguaggccuucaccuu

SEQ ID NO: 436024 - RNA, 13 nt, Bordetella pertussis
ccgcguaguuguc

SEQ ID NO: 436025 - RNA, 21 nt, Bordetella pertussis
ccgcguaguugucggcgcaga

SEQ ID NO: 436026 - RNA, 15 nt, Bordetella pertussis
ccgcgucagacgcgc

SEQ ID NO: 436027 - RNA, 17 nt, Bordetella pertussis
ccgcguccggcgcccgc

SEQ ID NO: 436028 - RNA, 15 nt, Bordetella pertussis
ccgcguccucggccu

SEQ ID NO: 436029 - RNA, 18 nt, Bordetella pertussis
ccgcgucgaucagcgcgg

SEQ ID NO: 436030 - RNA, 18 nt, Bordetella pertussis
ccgcgucgauccggcagc

SEQ ID NO: 436031 - RNA, 17 nt, Bordetella pertussis
ccgcgucggacgcgcgc

SEQ ID NO: 436032 - RNA, 15 nt, Bordetella pertussis
ccgcgucggccgcgu

SEQ ID NO: 436033 - RNA, 12 nt, Bordetella pertussis
ccgcgucggccu

SEQ ID NO: 436034 - RNA, 15 nt, Bordetella pertussis
ccgcgucggccugcc

SEQ ID NO: 436035 - RNA, 12 nt, Bordetella pertussis
ccgcgucggcga

SEQ ID NO: 436036 - RNA, 20 nt, Bordetella pertussis
ccgcgucggcgaagcugucc

SEQ ID NO: 436037 - RNA, 17 nt, Bordetella pertussis
ccgcgucguucaucgcc

SEQ ID NO: 436038 - RNA, 17 nt, Bordetella pertussis
ccgcgucgguggccagc

SEQ ID NO: 436039 - RNA, 23 nt, Bordetella pertussis
ccgcgucuucggcgcggcgggcu

SEQ ID NO: 436040 - RNA, 15 nt, Bordetella pertussis
ccgcgugacggccgc

SEQ ID NO: 436041 - RNA, 15 nt, Bordetella pertussis
ccgcguggccgcgcu

SEQ ID NO: 436042 - RNA, 16 nt, Bordetella pertussis
ccgcguucaggcgcgg

SEQ ID NO: 436043 - RNA, 16 nt, Bordetella pertussis
ccgcuaccaggcgcgc

SEQ ID NO: 436044 - RNA, 18 nt, Bordetella pertussis
ccgcuacgcgggcuugcu

SEQ ID NO: 436045 - RNA, 20 nt, Bordetella pertussis
ccgcuacgcgggcuugcugc

SEQ ID NO: 436046 - RNA, 22 nt, Bordetella pertussis
ccgcuacgcgggcuugcugccc

SEQ ID NO: 436047 - RNA, 18 nt, Bordetella pertussis
ccgcuaugcgggcuugcu

SEQ ID NO: 436048 - RNA, 23 nt, Bordetella pertussis
ccgcucaauucggccugacgggc

SEQ ID NO: 436049 - RNA, 22 nt, Bordetella pertussis
ccgcuccaccagcaccggcagc

SEQ ID NO: 436050 - RNA, 15 nt, Bordetella pertussis
ccgcuccaggcggcc

SEQ ID NO: 436051 - RNA, 17 nt, Bordetella pertussis
ccgcuccaggcggccag

SEQ ID NO: 436052 - RNA, 21 nt, Bordetella pertussis
ccgcuccaggcggccaguucg

SEQ ID NO: 436053 - RNA, 22 nt, Bordetella pertussis
ccgcuccauguaaaaacccggc

SEQ ID NO: 436054 - RNA, 19 nt, Bordetella pertussis
ccgcucgaggccaggcuga

SEQ ID NO: 436055 - RNA, 19 nt, Bordetella pertussis
ccgcucguaguguuccugg

SEQ ID NO: 436056 - RNA, 13 nt, Bordetella pertussis
ccgcugaccggcc

SEQ ID NO: 436057 - RNA, 14 nt, Bordetella pertussis
ccgcugaccggccu

SEQ ID NO: 436058 - RNA, 17 nt, Bordetella pertussis
ccgcugaccggcggcac

SEQ ID NO: 436059 - RNA, 22 nt, Bordetella pertussis
ccgcugaccuggugugccuguc

SEQ ID NO: 436060 - RNA, 15 nt, Bordetella pertussis
ccgcugauggcgguc

SEQ ID NO: 436061 - RNA, 19 nt, Bordetella pertussis
ccgcugauggcggucacca

SEQ ID NO: 436062 - RNA, 15 nt, Bordetella pertussis
ccgcugcagcacgca

SEQ ID NO: 436063 - RNA, 11 nt, Bordetella pertussis
ccgcugcagau

SEQ ID NO: 436064 - RNA, 12 nt, Bordetella pertussis
ccgcugcauggg

SEQ ID NO: 436065 - RNA, 13 nt, Bordetella pertussis
ccgcugccgcgcg

SEQ ID NO: 436066 - RNA, 22 nt, Bordetella pertussis
ccgcugcgaaaaagcccgcgcc

SEQ ID NO: 436067 - RNA, 17 nt, Bordetella pertussis
ccgcugcgacccuuuca

SEQ ID NO: 436068 - RNA, 15 nt, Bordetella pertussis
ccgcugcgcggucac

SEQ ID NO: 436069 - RNA, 20 nt, Bordetella pertussis
ccgcugcgcuugaccgccuc

SEQ ID NO: 436070 - RNA, 21 nt, Bordetella pertussis
ccgcugcgggaggugccgcag

SEQ ID NO: 436071 - RNA, 12 nt, Bordetella pertussis
ccgcuggccagc

SEQ ID NO: 436072 - RNA, 13 nt, Bordetella pertussis
ccgcuggccaggc

SEQ ID NO: 436073 - RNA, 22 nt, Bordetella pertussis
ccgcuggcgaucacggccaacc

SEQ ID NO: 436074 - RNA, 18 nt, Bordetella pertussis
ccgcuggcgaucaggccg

SEQ ID NO: 436075 - RNA, 20 nt, Bordetella pertussis
ccgcuggcgaucaggccgcc

SEQ ID NO: 436076 - RNA, 21 nt, Bordetella pertussis
ccgcuggcgaucaggccgccc

SEQ ID NO: 436077 - RNA, 23 nt, Bordetella pertussis
ccgcuggcgaucaggccgcccca

SEQ ID NO: 436078 - RNA, 20 nt, Bordetella pertussis
ccgcuggcgcgccgccucgc

SEQ ID NO: 436079 - RNA, 23 nt, Bordetella pertussis
ccgcuggcggccgcgggcgugcu

SEQ ID NO: 436080 - RNA, 15 nt, Bordetella pertussis
ccgcuggcgucgcgc

SEQ ID NO: 436081 - RNA, 16 nt, Bordetella pertussis
ccgcugggacaggcac

SEQ ID NO: 436082 - RNA, 13 nt, Bordetella pertussis
ccgcugggccagc

SEQ ID NO: 436083 - RNA, 23 nt, Bordetella pertussis
ccgcugggggcgguaccguccug

SEQ ID NO: 436084 - RNA, 17 nt, Bordetella pertussis
ccgcuggucaccgcccc

SEQ ID NO: 436085 - RNA, 18 nt, Bordetella pertussis
ccgcuggucaccgccccg

SEQ ID NO: 436086 - RNA, 23 nt, Bordetella pertussis
ccgcuggucgugaugaacgagga

SEQ ID NO: 436087 - RNA, 18 nt, Bordetella pertussis
ccgcuggugaucugcugc

SEQ ID NO: 436088 - RNA, 19 nt, Bordetella pertussis
ccgcuggugaucugcugcg

SEQ ID NO: 436089 - RNA, 14 nt, Bordetella pertussis
ccgcuucggcggcc

SEQ ID NO: 436090 - RNA, 14 nt, Bordetella pertussis
ccgcuucgggccgg

SEQ ID NO: 436091 - RNA, 20 nt, Bordetella pertussis
ccgcuucgggccggauggcc

SEQ ID NO: 436092 - RNA, 17 nt, Bordetella pertussis
ccgcuucgucgggcagc

SEQ ID NO: 436093 - RNA, 17 nt, Bordetella pertussis
ccgcuucgugcggccgc

SEQ ID NO: 436094 - RNA, 13 nt, Bordetella pertussis
ccggaacaccagc

SEQ ID NO: 436095 - RNA, 17 nt, Bordetella pertussis
ccggaacaccagcaagc

SEQ ID NO: 436096 - RNA, 23 nt, Bordetella pertussis
ccggaacagcguccagccgcccg

SEQ ID NO: 436097 - RNA, 14 nt, Bordetella pertussis
ccggaauccacagc

SEQ ID NO: 436098 - RNA, 22 nt, Bordetella pertussis
ccggacggcgccuugacgcugc

SEQ ID NO: 436099 - RNA, 23 nt, Bordetella pertussis
ccggacggguaucgucgaccugg

SEQ ID NO: 436100 - RNA, 23 nt, Bordetella pertussis
ccggacugaacgcguccaggccc

SEQ ID NO: 436101 - RNA, 22 nt, Bordetella pertussis
ccggacuggauauggcgccgca

SEQ ID NO: 436102 - RNA, 15 nt, Bordetella pertussis
ccggacuggcgcgca

SEQ ID NO: 436103 - RNA, 15 nt, Bordetella pertussis
ccggagcagcagcgg

SEQ ID NO: 436104 - RNA, 16 nt, Bordetella pertussis
ccggagcagucgcgca

SEQ ID NO: 436105 - RNA, 12 nt, Bordetella pertussis
ccggagcggcuc

SEQ ID NO: 436106 - RNA, 14 nt, Bordetella pertussis
ccggaggccgccca

SEQ ID NO: 436107 - RNA, 14 nt, Bordetella pertussis
ccggaggucggcgc

SEQ ID NO: 436108 - RNA, 16 nt, Bordetella pertussis
ccggauaccgccgccg

SEQ ID NO: 436109 - RNA, 17 nt, Bordetella pertussis
ccggauaccgccgccgc

SEQ ID NO: 436110 - RNA, 12 nt, Bordetella pertussis
ccggccaccagc

SEQ ID NO: 436111 - RNA, 15 nt, Bordetella pertussis
ccggccaccagcggc

SEQ ID NO: 436112 - RNA, 14 nt, Bordetella pertussis
ccggccaccgccug

SEQ ID NO: 436113 - RNA, 21 nt, Bordetella pertussis
ccggccacgcgcugcagcagc

SEQ ID NO: 436114 - RNA, 22 nt, Bordetella pertussis
ccggccacgcgcugcagcagca

SEQ ID NO: 436115 - RNA, 18 nt, Bordetella pertussis
ccggccacggccgggccu

SEQ ID NO: 436116 - RNA, 15 nt, Bordetella pertussis
ccggccauggccgcc

SEQ ID NO: 436117 - RNA, 18 nt, Bordetella pertussis
ccggcccagcaugccgau

SEQ ID NO: 436118 - RNA, 18 nt, Bordetella pertussis
ccggcccagcgccaucgg

SEQ ID NO: 436119 - RNA, 13 nt, Bordetella pertussis
ccggcccaggccg

SEQ ID NO: 436120 - RNA, 17 nt, Bordetella pertussis
ccggcccaguccagggu

SEQ ID NO: 436121 - RNA, 22 nt, Bordetella pertussis
ccggcccaucuguacggccggc

SEQ ID NO: 436122 - RNA, 14 nt, Bordetella pertussis
ccggccccaggccg

SEQ ID NO: 436123 - RNA, 15 nt, Bordetella pertussis
ccggccgacaggugg

SEQ ID NO: 436124 - RNA, 15 nt, Bordetella pertussis
ccggccgaccggcgc

SEQ ID NO: 436125 - RNA, 17 nt, Bordetella pertussis
ccggccgauagccgcgg

SEQ ID NO: 436126 - RNA, 19 nt, Bordetella pertussis
ccggccgccauggccggcg

SEQ ID NO: 436127 - RNA, 15 nt, Bordetella pertussis
ccggccgcccaggcg

SEQ ID NO: 436128 - RNA, 20 nt, Bordetella pertussis
ccggccgccucaccgcgccg

SEQ ID NO: 436129 - RNA, 16 nt, Bordetella pertussis
ccggccgccuccaggc

SEQ ID NO: 436130 - RNA, 15 nt, Bordetella pertussis
ccggccgccuggccc

SEQ ID NO: 436131 - RNA, 22 nt, Bordetella pertussis
ccggccgcggggcuggccagcu

SEQ ID NO: 436132 - RNA, 16 nt, Bordetella pertussis
ccggccucagcggccg

SEQ ID NO: 436133 - RNA, 13 nt, Bordetella pertussis
ccggccucccgga

SEQ ID NO: 436134 - RNA, 17 nt, Bordetella pertussis
ccggccugcaggugccg

SEQ ID NO: 436135 - RNA, 21 nt, Bordetella pertussis
ccggccugcaggugccgccgg

SEQ ID NO: 436136 - RNA, 20 nt, Bordetella pertussis
ccggccugcgggcgccgcgg

SEQ ID NO: 436137 - RNA, 21 nt, Bordetella pertussis
ccggccugcucgccggccagc

SEQ ID NO: 436138 - RNA, 15 nt, Bordetella pertussis
ccggccugcugcagc

SEQ ID NO: 436139 - RNA, 22 nt, Bordetella pertussis
ccggccugcaaugcggccaggc

SEQ ID NO: 436140 - RNA, 15 nt, Bordetella pertussis
ccggccuggcgcgcg

SEQ ID NO: 436141 - RNA, 14 nt, Bordetella pertussis
ccggccuggcgggc

SEQ ID NO: 436142 - RNA, 19 nt, Bordetella pertussis
ccggcgaccgacggcaucg

SEQ ID NO: 436143 - RNA, 22 nt, Bordetella pertussis
ccggcgacgccgcggugcuggg

SEQ ID NO: 436144 - RNA, 15 nt, Bordetella pertussis
ccggcgacguggcgc

SEQ ID NO: 436145 - RNA, 18 nt, Bordetella pertussis
ccggcgacguggugugcg

SEQ ID NO: 436146 - RNA, 20 nt, Bordetella pertussis
ccggcgagaacgcggccgcg

SEQ ID NO: 436147 - RNA, 22 nt, Bordetella pertussis
ccggcgagacgucggcgauggc

SEQ ID NO: 436148 - RNA, 17 nt, Bordetella pertussis
ccggcgaggccgcccgc

SEQ ID NO: 436149 - RNA, 21 nt, Bordetella pertussis
ccggcgaggccgcccgccccg

SEQ ID NO: 436150 - RNA, 12 nt, Bordetella pertussis
ccggcgcaugcu

SEQ ID NO: 436151 - RNA, 13 nt, Bordetella pertussis
ccggcgccacccc

SEQ ID NO: 436152 - RNA, 14 nt, Bordetella pertussis
ccggcgcccccagc

SEQ ID NO: 436153 - RNA, 22 nt, Bordetella pertussis
ccggcgcccucuuucgccgcgc

SEQ ID NO: 436154 - RNA, 12 nt, Bordetella pertussis
ccggcgccgccg

SEQ ID NO: 436155 - RNA, 16 nt, Bordetella pertussis
ccggcgccggcgcgcc

SEQ ID NO: 436156 - RNA, 13 nt, Bordetella pertussis
ccggcgccugggg

SEQ ID NO: 436157 - RNA, 18 nt, Bordetella pertussis
ccggcgccuuggccuggg

SEQ ID NO: 436158 - RNA, 20 nt, Bordetella pertussis
ccggcgcgaaccccuccggc

SEQ ID NO: 436159 - RNA, 16 nt, Bordetella pertussis
ccggcgcgaccgccuc

SEQ ID NO: 436160 - RNA, 20 nt, Bordetella pertussis
ccggcgcgaguaucccuacc

SEQ ID NO: 436161 - RNA, 23 nt, Bordetella pertussis
ccggcgcgauggucaccacccgc

SEQ ID NO: 436162 - RNA, 19 nt, Bordetella pertussis
ccggcgcgcaaaccgacgc

SEQ ID NO: 436163 - RNA, 18 nt, Bordetella pertussis
ccggcgcgcagcgccugc

SEQ ID NO: 436164 - RNA, 17 nt, Bordetella pertussis
ccggcgcgcauccggug

SEQ ID NO: 436165 - RNA, 14 nt, Bordetella pertussis
ccggcgcgccaccc

SEQ ID NO: 436166 - RNA, 11 nt, Bordetella pertussis
ccggcgcgccc

SEQ ID NO: 436167 - RNA, 16 nt, Bordetella pertussis
ccggcgcgcccagggg

SEQ ID NO: 436168 - RNA, 16 nt, Bordetella pertussis
ccggcgcgccgcccgc

SEQ ID NO: 436169 - RNA, 19 nt, Bordetella pertussis
ccggcgcgccgcgccgccc

SEQ ID NO: 436170 - RNA, 11 nt, Bordetella pertussis
ccggcgcgccu

SEQ ID NO: 436171 - RNA, 22 nt, Bordetella pertussis
ccggcgcgccuggcgcgcccac

SEQ ID NO: 436172 - RNA, 23 nt, Bordetella pertussis
ccggcgcgcgcaugcccgaccgc

SEQ ID NO: 436173 - RNA, 14 nt, Bordetella pertussis
ccggcgcggacaga

SEQ ID NO: 436174 - RNA, 12 nt, Bordetella pertussis
ccggcgcggcgc

SEQ ID NO: 436175 - RNA, 16 nt, Bordetella pertussis
ccggcgcggcgcgcgc

SEQ ID NO: 436176 - RNA, 19 nt, Bordetella pertussis
ccggcgcgguauggccgcc

SEQ ID NO: 436177 - RNA, 22 nt, Bordetella pertussis
ccggcgcgguauggccgcccag

SEQ ID NO: 436178 - RNA, 14 nt, Bordetella pertussis
ccggcgcgggcgca

SEQ ID NO: 436179 - RNA, 17 nt, Bordetella pertussis
ccggcgcucgccccggc

SEQ ID NO: 436180 - RNA, 13 nt, Bordetella pertussis
ccggcgcucgcgc

SEQ ID NO: 436181 - RNA, 23 nt, Bordetella pertussis
ccggcgcucgcgcaccgcauggg

SEQ ID NO: 436182 - RNA, 22 nt, Bordetella pertussis
ccggcggcaaaaaaaaccgcgc

SEQ ID NO: 436183 - RNA, 22 nt, Bordetella pertussis
ccggcggaucacccagcggcug

SEQ ID NO: 436184 - RNA, 13 nt, Bordetella pertussis
ccggcggcacgcu

SEQ ID NO: 436185 - RNA, 19 nt, Bordetella pertussis
ccggcggcacggccggccu

SEQ ID NO: 436186 - RNA, 12 nt, Bordetella pertussis
ccggcggcagcc

SEQ ID NO: 436187 - RNA, 22 nt, Bordetella pertussis
ccggcggcaugcgccagccagc

SEQ ID NO: 436188 - RNA, 20 nt, Bordetella pertussis
ccggcggccagcgcgccgcc

SEQ ID NO: 436189 - RNA, 22 nt, Bordetella pertussis
ccggcggccaggccggcgcgcc

SEQ ID NO: 436190 - RNA, 16 nt, Bordetella pertussis
aaaccggugaucagca

SEQ ID NO: 436191 - RNA, 13 nt, Bordetella pertussis
ccggcucggaccu

SEQ ID NO: 436192 - RNA, 19 nt, Bordetella pertussis
ccggcucguacggcgucgg

SEQ ID NO: 436193 - RNA, 21 nt, Bordetella pertussis
ccggcucguacggcgucgggc

SEQ ID NO: 436194 - RNA, 12 nt, Bordetella pertussis
ccggcucuucca

SEQ ID NO: 436195 - RNA, 22 nt, Bordetella pertussis
ccggcuugcgcaagccggccgc

SEQ ID NO: 436196 - RNA, 17 nt, Bordetella pertussis
ccggcuugggcgugccc

SEQ ID NO: 436197 - RNA, 17 nt, Bordetella pertussis
ccggcuuggccucggcc

SEQ ID NO: 436198 - RNA, 16 nt, Bordetella pertussis
ccggcuuucagcgccg

SEQ ID NO: 436199 - RNA, 21 nt, Bordetella pertussis
ccgggaaaaagagccuguccc

SEQ ID NO: 436200 - RNA, 23 nt, Bordetella pertussis
ccgggaaaaagagccuguccccg

SEQ ID NO: 436201 - RNA, 18 nt, Bordetella pertussis
ccgggaaguccgccgcgu

SEQ ID NO: 436202 - RNA, 18 nt, Bordetella pertussis
ccgggacaggcaccccgu

SEQ ID NO: 436203 - RNA, 22 nt, Bordetella pertussis
ccgggacaggcacccgcgcgca

SEQ ID NO: 436204 - RNA, 24 nt, Bordetella pertussis
ccgggacaggcacccgcgcgcagc

SEQ ID NO: 436205 - RNA, 16 nt, Bordetella pertussis
ccgggaccuuggcggc

SEQ ID NO: 436206 - RNA, 17 nt, Bordetella pertussis
ccgggaccuuggcggcu

SEQ ID NO: 436207 - RNA, 18 nt, Bordetella pertussis
ccgggauccacgccgccg

SEQ ID NO: 436208 - RNA, 19 nt, Bordetella pertussis
ccgggauccacgccgccgg

SEQ ID NO: 436209 - RNA, 21 nt, Bordetella pertussis
ccgggaucugcgagccuucgg

SEQ ID NO: 436210 - RNA, 18 nt, Bordetella pertussis
aaaccucgaugaacgacc

SEQ ID NO: 436211 - RNA, 14 nt, Bordetella pertussis
ccgggccgacgcgc

SEQ ID NO: 436212 - RNA, 18 nt, Bordetella pertussis
ccgggccgacgcgcccgg

SEQ ID NO: 436213 - RNA, 24 nt, Bordetella pertussis
ccgggccgacgcgcccgggcugau

SEQ ID NO: 436214 - RNA, 16 nt, Bordetella pertussis
ccgggccgaccaggcc

SEQ ID NO: 436215 - RNA, 12 nt, Bordetella pertussis
ccgggccgcgcc

SEQ ID NO: 436216 - RNA, 15 nt, Bordetella pertussis
ccgggccggcgggca

SEQ ID NO: 436217 - RNA, 16 nt, Bordetella pertussis
ccgggccggcgggcgu

SEQ ID NO: 436218 - RNA, 23 nt, Bordetella pertussis
ccgggccgguuucggccugcagg

SEQ ID NO: 436219 - RNA, 15 nt, Bordetella pertussis
ccgggccgucgccgc

SEQ ID NO: 436220 - RNA, 19 nt, Bordetella pertussis
ccgggccgucuacaggccc

SEQ ID NO: 436221 - RNA, 23 nt, Bordetella pertussis
ccgggccguggcgauccagggcc

SEQ ID NO: 436222 - RNA, 20 nt, Bordetella pertussis
ccgggccuagcccggcgcca

SEQ ID NO: 436223 - RNA, 16 nt, Bordetella pertussis
ccgggcgccggcggca

SEQ ID NO: 436224 - RNA, 18 nt, Bordetella pertussis
ccgggcgcgcugcccagc

SEQ ID NO: 436225 - RNA, 20 nt, Bordetella pertussis
ccgggcgcgcugcccagcca

SEQ ID NO: 436226 - RNA, 17 nt, Bordetella pertussis
ccgggcgcggccgccgc

SEQ ID NO: 436227 - RNA, 23 nt, Bordetella pertussis
ccgggcgcgucaguugggcgcgc

SEQ ID NO: 436228 - RNA, 24 nt, Bordetella pertussis
ccgggcgcgucaguugggcgcgcc

SEQ ID NO: 436229 - RNA, 13 nt, Bordetella pertussis
ccgggcgcugcgc

SEQ ID NO: 436230 - RNA, 23 nt, Bordetella pertussis
ccgggcgcuugccguagcgcgug

SEQ ID NO: 436231 - RNA, 18 nt, Bordetella pertussis
ccgggcggaucgccgaag

SEQ ID NO: 436232 - RNA, 13 nt, Bordetella pertussis
ccgggcggcccgg

SEQ ID NO: 436233 - RNA, 17 nt, Bordetella pertussis
ccgggcggcccggcgga

SEQ ID NO: 436234 - RNA, 19 nt, Bordetella pertussis
ccgggcggcgcgggcggcu

SEQ ID NO: 436235 - RNA, 16 nt, Bordetella pertussis
ccgggcugccggcagc

SEQ ID NO: 436236 - RNA, 20 nt, Bordetella pertussis
ccgggcugcugcacgcgcgc

SEQ ID NO: 436237 - RNA, 15 nt, Bordetella pertussis
ccgggcuggucagcc

SEQ ID NO: 436238 - RNA, 20 nt, Bordetella pertussis
ccgggcuggugcgccgugcc

SEQ ID NO: 436239 - RNA, 18 nt, Bordetella pertussis
ccggggagccugccccga

SEQ ID NO: 436240 - RNA, 19 nt, Bordetella pertussis
ccggggcacccaggcgggc

SEQ ID NO: 436241 - RNA, 20 nt, Bordetella pertussis
ccggggcacccaggcgggcu

SEQ ID NO: 436242 - RNA, 19 nt, Bordetella pertussis
ccggggcaggaagccggcc

SEQ ID NO: 436243 - RNA, 13 nt, Bordetella pertussis
ccggggcagggcg

SEQ ID NO: 436244 - RNA, 15 nt, Bordetella pertussis
ccggggccauggcag

SEQ ID NO: 436245 - RNA, 13 nt, Bordetella pertussis
ccggggccgccca

SEQ ID NO: 436246 - RNA, 16 nt, Bordetella pertussis
ccggggccgcccugcc

SEQ ID NO: 436247 - RNA, 16 nt, Bordetella pertussis
ccggggcgagcgcagc

SEQ ID NO: 436248 - RNA, 18 nt, Bordetella pertussis
ccggggcgagcgcagccg

SEQ ID NO: 436249 - RNA, 20 nt, Bordetella pertussis
ccggggcgccggugucggcc

SEQ ID NO: 436250 - RNA, 16 nt, Bordetella pertussis
ccggggcggcgcagca

SEQ ID NO: 436251 - RNA, 15 nt, Bordetella pertussis
ccggggcgucgucgc

SEQ ID NO: 436252 - RNA, 16 nt, Bordetella pertussis
ccggggcguggccgca

SEQ ID NO: 436253 - RNA, 16 nt, Bordetella pertussis
ccggggggcgcacgcc

SEQ ID NO: 436254 - RNA, 21 nt, Bordetella pertussis
ccggggggcgcacgccgcgcc

SEQ ID NO: 436255 - RNA, 18 nt, Bordetella pertussis
ccggggucuugccgcgca

SEQ ID NO: 436256 - RNA, 19 nt, Bordetella pertussis
ccgggguugccaagauggc

SEQ ID NO: 436257 - RNA, 13 nt, Bordetella pertussis
ccgguccaggccg

SEQ ID NO: 436258 - RNA, 23 nt, Bordetella pertussis
ccggucuacgccaugagcgcuug

SEQ ID NO: 436259 - RNA, 22 nt, Bordetella pertussis
ccggucuaugucgaggaccuga

SEQ ID NO: 436260 - RNA, 15 nt, Bordetella pertussis
ccggucuccagcgcg

SEQ ID NO: 436261 - RNA, 19 nt, Bordetella pertussis
ccggucuccagcgcgucgg

SEQ ID NO: 436262 - RNA, 16 nt, Bordetella pertussis
ccggucuggucggcga

SEQ ID NO: 436263 - RNA, 15 nt, Bordetella pertussis
ccggugaccgccagc

SEQ ID NO: 436264 - RNA, 16 nt, Bordetella pertussis
ccggugagauccagcg

SEQ ID NO: 436265 - RNA, 21 nt, Bordetella pertussis
ccggugcgauagcgccgcgca

SEQ ID NO: 436266 - RNA, 13 nt, Bordetella pertussis
ccggugcgcagca

SEQ ID NO: 436267 - RNA, 17 nt, Bordetella pertussis
ccggugcgcgcagggcg

SEQ ID NO: 436268 - RNA, 23 nt, Bordetella pertussis
ccgguggguguggccaugcacca

SEQ ID NO: 436269 - RNA, 21 nt, Bordetella pertussis
ccgguggugcugcugggcgcc

SEQ ID NO: 436270 - RNA, 19 nt, Bordetella pertussis
ccgguggugcugggcggcg

SEQ ID NO: 436271 - RNA, 15 nt, Bordetella pertussis
ccgguguaggcgggc

SEQ ID NO: 436272 - RNA, 16 nt, Bordetella pertussis
ccgguguaggcgggca

SEQ ID NO: 436273 - RNA, 16 nt, Bordetella pertussis
ccggugucggggccgg

SEQ ID NO: 436274 - RNA, 22 nt, Bordetella pertussis
ccggugucggggccgggccggc

SEQ ID NO: 436275 - RNA, 20 nt, Bordetella pertussis
ccgguuuuuuugcgccgcua

SEQ ID NO: 436276 - RNA, 13 nt, Bordetella pertussis
ccguaaccggcca

SEQ ID NO: 436277 - RNA, 14 nt, Bordetella pertussis
ccguaagcgcugga

SEQ ID NO: 436278 - RNA, 17 nt, Bordetella pertussis
ccguagcgcgccagccg

SEQ ID NO: 436279 - RNA, 21 nt, Bordetella pertussis
ccguagcgcguggccagcacg

SEQ ID NO: 436280 - RNA, 21 nt, Bordetella pertussis
ccguagcgguccggggcgggc

SEQ ID NO: 436281 - RNA, 20 nt, Bordetella pertussis
ccguaggacagccccagcag

SEQ ID NO: 436282 - RNA, 22 nt, Bordetella pertussis
ccguaguucggcgggaucugca

SEQ ID NO: 436283 - RNA, 22 nt, Bordetella pertussis
ccguaucgcggccgagcuccuc

SEQ ID NO: 436284 - RNA, 15 nt, Bordetella pertussis
ccguauggccguugg

SEQ ID NO: 436285 - RNA, 22 nt, Bordetella pertussis
ccgucaacagcauggacgagcu

SEQ ID NO: 436286 - RNA, 16 nt, Bordetella pertussis
ccgucaacgcccaggu

SEQ ID NO: 436287 - RNA, 13 nt, Bordetella pertussis
ccgucaccgccgc

SEQ ID NO: 436288 - RNA, 15 nt, Bordetella pertussis
ccgucaccgccgccg

SEQ ID NO: 436289 - RNA, 15 nt, Bordetella pertussis
ccgucagcacggucg

SEQ ID NO: 436290 - RNA, 19 nt, Bordetella pertussis
ccgucagcacggucggcgc

SEQ ID NO: 436291 - RNA, 12 nt, Bordetella pertussis
ccgucagcagca

SEQ ID NO: 436292 - RNA, 13 nt, Bordetella pertussis
ccgucagcggcgc

SEQ ID NO: 436293 - RNA, 23 nt, Bordetella pertussis
ccgucagcggcgcgcccaccagg

SEQ ID NO: 436294 - RNA, 17 nt, Bordetella pertussis
ccgucagcucgaucagg

SEQ ID NO: 436295 - RNA, 15 nt, Bordetella pertussis
ccgucauggcggucu

SEQ ID NO: 436296 - RNA, 12 nt, Bordetella pertussis
ccguccacgccg

SEQ ID NO: 436297 - RNA, 17 nt, Bordetella pertussis
ccguccacgccgcgcgc

SEQ ID NO: 436298 - RNA, 21 nt, Bordetella pertussis
ccguccacggccugcgcgccg

SEQ ID NO: 436299 - RNA, 19 nt, Bordetella pertussis
ccguccaggcgccgcacgc

SEQ ID NO: 436300 - RNA, 18 nt, Bordetella pertussis
ccgucccgacccccggcc

SEQ ID NO: 436301 - RNA, 21 nt, Bordetella pertussis
ccgucccgacccccggcccgc

SEQ ID NO: 436302 - RNA, 17 nt, Bordetella pertussis
ccgucccugguccagca

SEQ ID NO: 436303 - RNA, 19 nt, Bordetella pertussis
ccgucccugguccagcagc

SEQ ID NO: 436304 - RNA, 16 nt, Bordetella pertussis
ccguccgccaggacgg

SEQ ID NO: 436305 - RNA, 13 nt, Bordetella pertussis
ccguccgggccgg

SEQ ID NO: 436306 - RNA, 19 nt, Bordetella pertussis
ccguccgugagugcagcgc

SEQ ID NO: 436307 - RNA, 17 nt, Bordetella pertussis
ccguccugcugcggcac

SEQ ID NO: 436308 - RNA, 22 nt, Bordetella pertussis
ccguccuggcgaccggcggcac

SEQ ID NO: 436309 - RNA, 21 nt, Bordetella pertussis
ccguccuggugcacgccgaug

SEQ ID NO: 436310 - RNA, 20 nt, Bordetella pertussis
ccguccuuggcguccggccc

SEQ ID NO: 436311 - RNA, 21 nt, Bordetella pertussis
ccguccuuggcguccggcccc

SEQ ID NO: 436312 - RNA, 16 nt, Bordetella pertussis
ccguccuugugccagg

SEQ ID NO: 436313 - RNA, 16 nt, Bordetella pertussis
ccgucgaagccggcgc

SEQ ID NO: 436314 - RNA, 14 nt, Bordetella pertussis
ccgucgccagggcg

SEQ ID NO: 436315 - RNA, 16 nt, Bordetella pertussis
ccgucgcccuggcggc

SEQ ID NO: 436316 - RNA, 13 nt, Bordetella pertussis
ccgucggccgucu

SEQ ID NO: 436317 - RNA, 22 nt, Bordetella pertussis
ccgucggccuggaacauggccc

SEQ ID NO: 436318 - RNA, 18 nt, Bordetella pertussis
ccgucggcgcuggcgcgc

SEQ ID NO: 436319 - RNA, 19 nt, Bordetella pertussis
ccgucggcgcuggcgcgcu

SEQ ID NO: 436320 - RNA, 12 nt, Bordetella pertussis
ccgucgggcagg

SEQ ID NO: 436321 - RNA, 21 nt, Bordetella pertussis
ccgucgggggccggcucgccc

SEQ ID NO: 436322 - RNA, 16 nt, Bordetella pertussis
ccgucugugcgccccg

SEQ ID NO: 436323 - RNA, 19 nt, Bordetella pertussis
ccgucuuggcguggugggc

SEQ ID NO: 436324 - RNA, 15 nt, Bordetella pertussis
ccgugagcgccgccg

SEQ ID NO: 436325 - RNA, 22 nt, Bordetella pertussis
ccgugaucggcgcaaccggccc

SEQ ID NO: 436326 - RNA, 21 nt, Bordetella pertussis
ccgugaucuugaugccgccca

SEQ ID NO: 436327 - RNA, 16 nt, Bordetella pertussis
ccgugccgcagauguc

SEQ ID NO: 436328 - RNA, 22 nt, Bordetella pertussis
ccgugccgcggcgcggcccgcc

SEQ ID NO: 436329 - RNA, 13 nt, Bordetella pertussis
ccgugccggcgua

SEQ ID NO: 436330 - RNA, 20 nt, Bordetella pertussis
ccgugccucaacuggccggc

SEQ ID NO: 436331 - RNA, 18 nt, Bordetella pertussis
ccgugcgaggcgaacagg

SEQ ID NO: 436332 - RNA, 20 nt, Bordetella pertussis
ccgugcgcgggcgcggcagg

SEQ ID NO: 436333 - RNA, 14 nt, Bordetella pertussis
ccgugcgcgcccga

SEQ ID NO: 436334 - RNA, 23 nt, Bordetella pertussis
ccgugcggcgcgcacgggcgagg

SEQ ID NO: 436335 - RNA, 17 nt, Bordetella pertussis
ccgugcgggccugcagu

SEQ ID NO: 436336 - RNA, 19 nt, Bordetella pertussis
ccuauguaggcgccgcgcc

SEQ ID NO: 436337 - RNA, 15 nt, Bordetella pertussis
ccucaaccuucucga

SEQ ID NO: 436338 - RNA, 17 nt, Bordetella pertussis
ccucaaccuucucgaug

SEQ ID NO: 436339 - RNA, 13 nt, Bordetella pertussis
ccucaggccggcg

SEQ ID NO: 436340 - RNA, 17 nt, Bordetella pertussis
ccucaguccagcuggcc

SEQ ID NO: 436341 - RNA, 20 nt, Bordetella pertussis
ccucaugcgggacaggcgcc

SEQ ID NO: 436342 - RNA, 11 nt, Bordetella pertussis
ccuccagcagg

SEQ ID NO: 436343 - RNA, 22 nt, Bordetella pertussis
ccuccagcaucgccgccagcuu

SEQ ID NO: 436344 - RNA, 22 nt, Bordetella pertussis
ccucccgucgucguccacgccc

SEQ ID NO: 436345 - RNA, 17 nt, Bordetella pertussis
ccuccgacaggcgccgc

SEQ ID NO: 436346 - RNA, 19 nt, Bordetella pertussis
ccuccgacaggcgccgcaa

SEQ ID NO: 436347 - RNA, 22 nt, Bordetella pertussis
ccuccucggccaggucgcgcau

SEQ ID NO: 436348 - RNA, 11 nt, Bordetella pertussis
ccuccugcagc

SEQ ID NO: 436349 - RNA, 15 nt, Bordetella pertussis
ccucgccagcggcag

SEQ ID NO: 436350 - RNA, 14 nt, Bordetella pertussis
ccucgcccagcggc

SEQ ID NO: 436351 - RNA, 16 nt, Bordetella pertussis
ccucgcccagcggcgc

SEQ ID NO: 436352 - RNA, 18 nt, Bordetella pertussis
ccucgcccagcggcgccg

SEQ ID NO: 436353 - RNA, 17 nt, Bordetella pertussis
ccucgcccgaccugcug

SEQ ID NO: 436354 - RNA, 18 nt, Bordetella pertussis
ccucgcccgaccugcugg

SEQ ID NO: 436355 - RNA, 20 nt, Bordetella pertussis
ccucgcccgaucggccggcc

SEQ ID NO: 436356 - RNA, 14 nt, Bordetella pertussis
ccucgcgcugcagc

SEQ ID NO: 436357 - RNA, 15 nt, Bordetella pertussis
ccucgcgcugcagca

SEQ ID NO: 436358 - RNA, 17 nt, Bordetella pertussis
ccucgcgcucgagcgcg

SEQ ID NO: 436359 - RNA, 20 nt, Bordetella pertussis
ccucgcggcgcagcaugagc

SEQ ID NO: 436360 - RNA, 21 nt, Bordetella pertussis
ccucgcgggccuuggccagca

SEQ ID NO: 436361 - RNA, 22 nt, Bordetella pertussis
ccucgcgggccuuggccagcag

SEQ ID NO: 436362 - RNA, 18 nt, Bordetella pertussis
ccucggccagcugggcca

SEQ ID NO: 436363 - RNA, 17 nt, Bordetella pertussis
ccucggccaggucgcgc

SEQ ID NO: 436364 - RNA, 12 nt, Bordetella pertussis
ccucggccggca

SEQ ID NO: 436365 - RNA, 11 nt, Bordetella pertussis
ccucggccugg

SEQ ID NO: 436366 - RNA, 17 nt, Bordetella pertussis
ccucggccuggccccag

SEQ ID NO: 436367 - RNA, 20 nt, Bordetella pertussis
ccucgggugccuguccccac

SEQ ID NO: 436368 - RNA, 18 nt, Bordetella pertussis
ccucggucaggguggaga

SEQ ID NO: 436369 - RNA, 19 nt, Bordetella pertussis
ccucggucgucagcacgcc

SEQ ID NO: 436370 - RNA, 15 nt, Bordetella pertussis
ccucggucucgugcg

SEQ ID NO: 436371 - RNA, 20 nt, Bordetella pertussis
ccucggucugcuucauccag

SEQ ID NO: 436372 - RNA, 15 nt, Bordetella pertussis
ccucgguccagcgga

SEQ ID NO: 436373 - RNA, 16 nt, Bordetella pertussis
ccucguaaguggcggc

SEQ ID NO: 436374 - RNA, 21 nt, Bordetella pertussis
ccucguaguguucgauggcgg

SEQ ID NO: 436375 - RNA, 23 nt, Bordetella pertussis
ccucguccguuucgucggcgcgc

SEQ ID NO: 436376 - RNA, 15 nt, Bordetella pertussis
ccucguccugcaggc

SEQ ID NO: 436377 - RNA, 20 nt, Bordetella pertussis
ccucguccugcaggcggcgc

SEQ ID NO: 436378 - RNA, 16 nt, Bordetella pertussis
ccucgucgaccacgcc

SEQ ID NO: 436379 - RNA, 17 nt, Bordetella pertussis
ccucgucgcgcaacgcc

SEQ ID NO: 436380 - RNA, 15 nt, Bordetella pertussis
ccucgucgcggaagc

SEQ ID NO: 436381 - RNA, 19 nt, Bordetella pertussis
ccucgucggcgaagccuug

SEQ ID NO: 436382 - RNA, 21 nt, Bordetella pertussis
ccucgugaucgaccgccagca

SEQ ID NO: 436383 - RNA, 14 nt, Bordetella pertussis
ccucgugcugcugc

SEQ ID NO: 436384 - RNA, 15 nt, Bordetella pertussis
ccucgugcugcugca

SEQ ID NO: 436385 - RNA, 18 nt, Bordetella pertussis
ccucgugcugcugcaggc

SEQ ID NO: 436386 - RNA, 20 nt, Bordetella pertussis
ccucgugcugcugcaggcgc

SEQ ID NO: 436387 - RNA, 14 nt, Bordetella pertussis
ccucguuggucagc

SEQ ID NO: 436388 - RNA, 22 nt, Bordetella pertussis
ccucuccacuggccuucuucac

SEQ ID NO: 436389 - RNA, 16 nt, Bordetella pertussis
ccucuucggcggccag

SEQ ID NO: 436390 - RNA, 17 nt, Bordetella pertussis
ccucuuuccccuccccu

SEQ ID NO: 436391 - RNA, 23 nt, Bordetella pertussis
ccugaacaccggcgcgccuggcg

SEQ ID NO: 436392 - RNA, 20 nt, Bordetella pertussis
ccugaacgacgguacaccug

SEQ ID NO: 436393 - RNA, 18 nt, Bordetella pertussis
ccugaacgccgggccgug

SEQ ID NO: 436394 - RNA, 14 nt, Bordetella pertussis
ccugaacguggcgu

SEQ ID NO: 436395 - RNA, 17 nt, Bordetella pertussis
ccugaaucgcccgggcg

SEQ ID NO: 436396 - RNA, 19 nt, Bordetella pertussis
ccugaaucgcccgggcgcc

SEQ ID NO: 436397 - RNA, 18 nt, Bordetella pertussis
ccugaccaucaucaacuu

SEQ ID NO: 436398 - RNA, 12 nt, Bordetella pertussis
ccugaccggcgg

SEQ ID NO: 436399 - RNA, 22 nt, Bordetella pertussis
ccugaccggcggcgcucaucau

SEQ ID NO: 436400 - RNA, 16 nt, Bordetella pertussis
ccugaccguccauggc

SEQ ID NO: 436401 - RNA, 18 nt, Bordetella pertussis
ccugacgcgcaagcggcc

SEQ ID NO: 436402 - RNA, 21 nt, Bordetella pertussis
ccugacgcgcaagcggcccca

SEQ ID NO: 436403 - RNA, 22 nt, Bordetella pertussis
ccugacggcuacacccugcucu

SEQ ID NO: 436404 - RNA, 17 nt, Bordetella pertussis
ccugagcaccgccgcgu

SEQ ID NO: 436405 - RNA, 15 nt, Bordetella pertussis
ccugagcugccaggc

SEQ ID NO: 436406 - RNA, 12 nt, Bordetella pertussis
ccugaggccagg

SEQ ID NO: 436407 - RNA, 14 nt, Bordetella pertussis
ccugaggccaggcc

SEQ ID NO: 436408 - RNA, 15 nt, Bordetella pertussis
ccugaucgaggagcu

SEQ ID NO: 436409 - RNA, 21 nt, Bordetella pertussis
ccugaucgaggagcugcugug

SEQ ID NO: 436410 - RNA, 17 nt, Bordetella pertussis
ccugaucgcgcagcgcc

SEQ ID NO: 436411 - RNA, 22 nt, Bordetella pertussis
ccugaucgcgcagcgccuggcc

SEQ ID NO: 436412 - RNA, 22 nt, Bordetella pertussis
ccugaucggggccaagauccag

SEQ ID NO: 436413 - RNA, 15 nt, Bordetella pertussis
ccugaugccuguccc

SEQ ID NO: 436414 - RNA, 15 nt, Bordetella pertussis
ccugauucacaggcc

SEQ ID NO: 436415 - RNA, 16 nt, Bordetella pertussis
ccugauucccaggccc

SEQ ID NO: 436416 - RNA, 17 nt, Bordetella pertussis
ccugcaaaaaacaagcu

SEQ ID NO: 436417 - RNA, 15 nt, Bordetella pertussis
ccugcaaggccggcg

SEQ ID NO: 436418 - RNA, 16 nt, Bordetella pertussis
ccugcaaggccggcgg

SEQ ID NO: 436419 - RNA, 13 nt, Bordetella pertussis
ccugcaaugcggc

SEQ ID NO: 436420 - RNA, 16 nt, Bordetella pertussis
ccugcaaugcggccag

SEQ ID NO: 436421 - RNA, 19 nt, Bordetella pertussis
ccugcagaccagcaccggc

SEQ ID NO: 436422 - RNA, 17 nt, Bordetella pertussis
ccugcagcacgcuggcc

SEQ ID NO: 436423 - RNA, 18 nt, Bordetella pertussis
ccugcagcagcguggccg

SEQ ID NO: 436424 - RNA, 20 nt, Bordetella pertussis
ccugcagcagcguggccgcc

SEQ ID NO: 436425 - RNA, 22 nt, Bordetella pertussis
ccugcagcagcguggccgccac

SEQ ID NO: 436426 - RNA, 23 nt, Bordetella pertussis
ccugcagcagcguggccgccacc

SEQ ID NO: 436427 - RNA, 13 nt, Bordetella pertussis
ccugcagcaggcg

SEQ ID NO: 436428 - RNA, 19 nt, Bordetella pertussis
ccugcagcaggucggucgc

SEQ ID NO: 436429 - RNA, 23 nt, Bordetella pertussis
ccugcagcaugaccgacaggcgg

SEQ ID NO: 436430 - RNA, 16 nt, Bordetella pertussis
ccugcagcgccgccug

SEQ ID NO: 436431 - RNA, 19 nt, Bordetella pertussis
ccugcagcggccaguccac

SEQ ID NO: 436432 - RNA, 17 nt, Bordetella pertussis
ccugcaggaaggccgcc

SEQ ID NO: 436433 - RNA, 19 nt, Bordetella pertussis
ccugcaggaaggccgccgc

SEQ ID NO: 436434 - RNA, 15 nt, Bordetella pertussis
ccugcaggcccagca

SEQ ID NO: 436435 - RNA, 12 nt, Bordetella pertussis
ccugcaggccgc

SEQ ID NO: 436436 - RNA, 14 nt, Bordetella pertussis
ccugcaggccgccg

SEQ ID NO: 436437 - RNA, 20 nt, Bordetella pertussis
ccugcaggccgccggccagc

SEQ ID NO: 436438 - RNA, 12 nt, Bordetella pertussis
ccugcaugccau

SEQ ID NO: 436439 - RNA, 16 nt, Bordetella pertussis
ccugcauguccagcgg

SEQ ID NO: 436440 - RNA, 17 nt, Bordetella pertussis
ccugcauguccagcggc

SEQ ID NO: 436441 - RNA, 15 nt, Bordetella pertussis
ccugccaagcgccgc

SEQ ID NO: 436442 - RNA, 19 nt, Bordetella pertussis
ccugccaccagcgcgccag

SEQ ID NO: 436443 - RNA, 20 nt, Bordetella pertussis
ccugccaccagcgcgccagc

SEQ ID NO: 436444 - RNA, 19 nt, Bordetella pertussis
ccugccgaucgugcacgcc

SEQ ID NO: 436445 - RNA, 19 nt, Bordetella pertussis
ccugccgcaucccgccccc

SEQ ID NO: 436446 - RNA, 15 nt, Bordetella pertussis
ccugccgcgcccggc

SEQ ID NO: 436447 - RNA, 17 nt, Bordetella pertussis
ccugccgcgcccggcgg

SEQ ID NO: 436448 - RNA, 23 nt, Bordetella pertussis
ccugccgcgcccggcggccaggc

SEQ ID NO: 436449 - RNA, 15 nt, Bordetella pertussis
ccugccgcggccgcc

SEQ ID NO: 436450 - RNA, 18 nt, Bordetella pertussis
ccugccgcggccgccccc

SEQ ID NO: 436451 - RNA, 14 nt, Bordetella pertussis
ccugccgcgugccc

SEQ ID NO: 436452 - RNA, 20 nt, Bordetella pertussis
ccugccgcgccgaccggccc

SEQ ID NO: 436453 - RNA, 14 nt, Bordetella pertussis
ccugccggcggccu

SEQ ID NO: 436454 - RNA, 13 nt, Bordetella pertussis
ccugcgccaccag

SEQ ID NO: 436455 - RNA, 14 nt, Bordetella pertussis
ccugcgccaccagc

SEQ ID NO: 436456 - RNA, 19 nt, Bordetella pertussis
ccugcgccacguccagcac

SEQ ID NO: 436457 - RNA, 14 nt, Bordetella pertussis
ccugcgccagcgcc

SEQ ID NO: 436458 - RNA, 21 nt, Bordetella pertussis
ccugcgccagcgccucgcgcu

SEQ ID NO: 436459 - RNA, 15 nt, Bordetella pertussis
ccugcgccagcucca

SEQ ID NO: 436460 - RNA, 21 nt, Bordetella pertussis
ccugcgccagcuccagccgca

SEQ ID NO: 436461 - RNA, 14 nt, Bordetella pertussis
ccugcgccaggugc

SEQ ID NO: 436462 - RNA, 12 nt, Bordetella pertussis
ccugcgccgccg

SEQ ID NO: 436463 - RNA, 17 nt, Bordetella pertussis
ccugcgccgcuuccggc

SEQ ID NO: 436464 - RNA, 20 nt, Bordetella pertussis
ccugcgccgggcgcggccag

SEQ ID NO: 436465 - RNA, 16 nt, Bordetella pertussis
ccugcgccgucugcgc

SEQ ID NO: 436466 - RNA, 20 nt, Bordetella pertussis
ccugcgccgucugcgccgcc

SEQ ID NO: 436467 - RNA, 18 nt, Bordetella pertussis
ccugcgcgaagcgcuggg

SEQ ID NO: 436468 - RNA, 21 nt, Bordetella pertussis
ccugcgcgccgaccaggucgg

SEQ ID NO: 436469 - RNA, 13 nt, Bordetella pertussis
ccugcgcgccgcc

SEQ ID NO: 436470 - RNA, 14 nt, Bordetella pertussis
ccugcgcgccgccu

SEQ ID NO: 436471 - RNA, 15 nt, Bordetella pertussis
ccugcgcgccgccuc

SEQ ID NO: 436472 - RNA, 15 nt, Bordetella pertussis
ccugcgcgccggguu

SEQ ID NO: 436473 - RNA, 15 nt, Bordetella pertussis
ccugcgcgcgcuggg

SEQ ID NO: 436474 - RNA, 18 nt, Bordetella pertussis
ccugcgcguacguggcgc

SEQ ID NO: 436475 - RNA, 16 nt, Bordetella pertussis
ccugcgcgucccggua

SEQ ID NO: 436476 - RNA, 16 nt, Bordetella pertussis
ccugcgcgaccgccgc

SEQ ID NO: 436477 - RNA, 19 nt, Bordetella pertussis
ccugcgcugcauacgccgc

SEQ ID NO: 436478 - RNA, 23 nt, Bordetella pertussis
ccugcggacccaguucggccgcc

SEQ ID NO: 436479 - RNA, 22 nt, Bordetella pertussis
ccugcggacggcgggcgccccg

SEQ ID NO: 436480 - RNA, 19 nt, Bordetella pertussis
ccugcgucaguugaagacg

SEQ ID NO: 436481 - RNA, 14 nt, Bordetella pertussis
ccugcguccagccg

SEQ ID NO: 436482 - RNA, 14 nt, Bordetella pertussis
ccugcgucguugcc

SEQ ID NO: 436483 - RNA, 14 nt, Bordetella pertussis
ccugcgucugcgug

SEQ ID NO: 436484 - RNA, 15 nt, Bordetella pertussis
ccugcguggccgcgu

SEQ ID NO: 436485 - RNA, 20 nt, Bordetella pertussis
ccugcguggcgggccgcgcc

SEQ ID NO: 436486 - RNA, 16 nt, Bordetella pertussis
ccugcgugucaggcgg

SEQ ID NO: 436487 - RNA, 19 nt, Bordetella pertussis
ccugcuaagggaguaugug

SEQ ID NO: 436488 - RNA, 21 nt, Bordetella pertussis
ccugcucgccggccagcgcgg

SEQ ID NO: 436489 - RNA, 23 nt, Bordetella pertussis
ccugcucggugcucuggcccgcc

SEQ ID NO: 436490 - RNA, 19 nt, Bordetella pertussis
ccugcucgggcgccucguc

SEQ ID NO: 436491 - RNA, 15 nt, Bordetella pertussis
ccugcugcagcacac

SEQ ID NO: 436492 - RNA, 13 nt, Bordetella pertussis
ccugcugcagcgu

SEQ ID NO: 436493 - RNA, 19 nt, Bordetella pertussis
ccugggugccuguccccga

SEQ ID NO: 436494 - RNA, 17 nt, Bordetella pertussis
ccugggugcugccgccg

SEQ ID NO: 436495 - RNA, 15 nt, Bordetella pertussis
ccuggguggccagcu

SEQ ID NO: 436496 - RNA, 17 nt, Bordetella pertussis
ccuggguggccagcugc

SEQ ID NO: 436497 - RNA, 16 nt, Bordetella pertussis
ccugguaagaaaccug

SEQ ID NO: 436498 - RNA, 15 nt, Bordetella pertussis
ccugguaggcgagca

SEQ ID NO: 436499 - RNA, 17 nt, Bordetella pertussis
ccugguaucccucgccc

SEQ ID NO: 436500 - RNA, 12 nt, Bordetella pertussis
ccuggucacccg

SEQ ID NO: 436501 - RNA, 14 nt, Bordetella pertussis
ccuggucagcgccg

SEQ ID NO: 436502 - RNA, 9 nt, Bordetella pertussis
ccuggucau

SEQ ID NO: 436503 - RNA, 18 nt, Bordetella pertussis
ccuggucaucgccaugcu

SEQ ID NO: 436504 - RNA, 16 nt, Bordetella pertussis
ccuggucaugacgggc

SEQ ID NO: 436505 - RNA, 16 nt, Bordetella pertussis
ccugguccagcagcgu

SEQ ID NO: 436506 - RNA, 20 nt, Bordetella pertussis
ccugguccgccgcgaccacc

SEQ ID NO: 436507 - RNA, 14 nt, Bordetella pertussis
ccuggucgacgccg

SEQ ID NO: 436508 - RNA, 17 nt, Bordetella pertussis
ccugguucaggcgagcg

SEQ ID NO: 436509 - RNA, 20 nt, Bordetella pertussis
ccugguugccgaggacggua

SEQ ID NO: 436510 - RNA, 15 nt, Bordetella pertussis
ccugguuggccgccu

SEQ ID NO: 436511 - RNA, 15 nt, Bordetella pertussis
ccuguaugccguagg

SEQ ID NO: 436512 - RNA, 15 nt, Bordetella pertussis
ccuguccccacaggg

SEQ ID NO: 436513 - RNA, 16 nt, Bordetella pertussis
ccuguccccacauggg

SEQ ID NO: 436514 - RNA, 15 nt, Bordetella pertussis
ccuguccccacgggg

SEQ ID NO: 436515 - RNA, 16 nt, Bordetella pertussis
ccuguccccacugggg

SEQ ID NO: 436516 - RNA, 12 nt, Bordetella pertussis
ccuguccccgaa

SEQ ID NO: 436517 - RNA, 18 nt, Bordetella pertussis
ccuguccccgaacgggga

SEQ ID NO: 436518 - RNA, 22 nt, Bordetella pertussis
ccuguccccgcaagggggacug

SEQ ID NO: 436519 - RNA, 17 nt, Bordetella pertussis
ccuguccccgcacgggg

SEQ ID NO: 436520 - RNA, 21 nt, Bordetella pertussis
ccuguccccgcacggggacug

SEQ ID NO: 436521 - RNA, 12 nt, Bordetella pertussis
ccuguccccgcu

SEQ ID NO: 436522 - RNA, 15 nt, Bordetella pertussis
ccuguccccgcuggg

SEQ ID NO: 436523 - RNA, 17 nt, Bordetella pertussis
ccuguccccgcugggac

SEQ ID NO: 436524 - RNA, 13 nt, Bordetella pertussis
ccuguccccgucg

SEQ ID NO: 436525 - RNA, 20 nt, Bordetella pertussis
ccuguccauauauauagggc

SEQ ID NO: 436526 - RNA, 13 nt, Bordetella pertussis
ccugucccugccg

SEQ ID NO: 436527 - RNA, 22 nt, Bordetella pertussis
ccugucggugaugauccugcug

SEQ ID NO: 436528 - RNA, 23 nt, Bordetella pertussis
ccugucggugaugauccugcugg

SEQ ID NO: 436529 - RNA, 15 nt, Bordetella pertussis
ccugugccagcuggc

SEQ ID NO: 436530 - RNA, 17 nt, Bordetella pertussis
ccugugccagcuggccc

SEQ ID NO: 436531 - RNA, 18 nt, Bordetella pertussis
ccugugggggacaggcac

SEQ ID NO: 436532 - RNA, 18 nt, Bordetella pertussis
ccuguucgccaaucugcc

SEQ ID NO: 436533 - RNA, 20 nt, Bordetella pertussis
ccuguucgccaaucugccgc

SEQ ID NO: 436534 - RNA, 21 nt, Bordetella pertussis
ccuguucgcgcaauugcuucu

SEQ ID NO: 436535 - RNA, 23 nt, Bordetella pertussis
ccuguucgcggugucgcaccgca

SEQ ID NO: 436536 - RNA, 19 nt, Bordetella pertussis
ccuguucggccgggaccuu

SEQ ID NO: 436537 - RNA, 22 nt, Bordetella pertussis
ccuucaugaucuggccgaccag

SEQ ID NO: 436538 - RNA, 16 nt, Bordetella pertussis
ccuucggcggcgggcu

SEQ ID NO: 436539 - RNA, 12 nt, Bordetella pertussis
ccuucguggcgc

SEQ ID NO: 436540 - RNA, 14 nt, Bordetella pertussis
ccuucuacccgcuc

SEQ ID NO: 436541 - RNA, 14 nt, Bordetella pertussis
ccuucugccgccag

SEQ ID NO: 436542 - RNA, 21 nt, Bordetella pertussis
ccuugagggcgcgggccagcu

SEQ ID NO: 436543 - RNA, 24 nt, Bordetella pertussis
ccuugauguauggcugcaccugcc

SEQ ID NO: 436544 - RNA, 16 nt, Bordetella pertussis
ccuugcaugcgccgca

SEQ ID NO: 436545 - RNA, 14 nt, Bordetella pertussis
ccuugccauccagc

SEQ ID NO: 436546 - RNA, 14 nt, Bordetella pertussis
ccuugcccagcagc

SEQ ID NO: 436547 - RNA, 23 nt, Bordetella pertussis
ccuugcccagcagcuccucggcc

SEQ ID NO: 436548 - RNA, 14 nt, Bordetella pertussis
ccuugcccaggcug

SEQ ID NO: 436549 - RNA, 15 nt, Bordetella pertussis
ccuugcccaggcugg

SEQ ID NO: 436550 - RNA, 18 nt, Bordetella pertussis
ccuugccgauccagcgcc

SEQ ID NO: 436551 - RNA, 14 nt, Bordetella pertussis
ccuugccgccgccg

SEQ ID NO: 436552 - RNA, 18 nt, Bordetella pertussis
ccuugccgccgccgcgcg

SEQ ID NO: 436553 - RNA, 16 nt, Bordetella pertussis
ccuugccgccgcgcag

SEQ ID NO: 436554 - RNA, 21 nt, Bordetella pertussis
ccuugccgccuucccaggcga

SEQ ID NO: 436555 - RNA, 23 nt, Bordetella pertussis
ccuugccgguggacggccagcag

SEQ ID NO: 436556 - RNA, 23 nt, Bordetella pertussis
ccuugccguaggguucgccgcug

SEQ ID NO: 436557 - RNA, 21 nt, Bordetella pertussis
ccuugccguugagcacggugu

SEQ ID NO: 436558 - RNA, 19 nt, Bordetella pertussis
ccuugccugcaaaaaacaa

SEQ ID NO: 436559 - RNA, 18 nt, Bordetella pertussis
ccuugcgcgaaggccgcc

SEQ ID NO: 436560 - RNA, 20 nt, Bordetella pertussis
ccuugcgcgaaggccgcccc

SEQ ID NO: 436561 - RNA, 22 nt, Bordetella pertussis
ccuugcgcgacagcaggccggu

SEQ ID NO: 436562 - RNA, 20 nt, Bordetella pertussis
ccuugcgcggccacccugcc

SEQ ID NO: 436563 - RNA, 14 nt, Bordetella pertussis
ccuugcgcggccag

SEQ ID NO: 436564 - RNA, 16 nt, Bordetella pertussis
ccuugcgcggcgagcg

SEQ ID NO: 436565 - RNA, 23 nt, Bordetella pertussis
ccuugcgcggcgagcgccgccag

SEQ ID NO: 436566 - RNA, 19 nt, Bordetella pertussis
ccuugcgcucgcccagcac

SEQ ID NO: 436567 - RNA, 21 nt, Bordetella pertussis
ccuugcgcuuuuuucuccagc

SEQ ID NO: 436568 - RNA, 16 nt, Bordetella pertussis
ccuugcggccgcgcac

SEQ ID NO: 436569 - RNA, 14 nt, Bordetella pertussis
ccuugcggccgccg

SEQ ID NO: 436570 - RNA, 16 nt, Bordetella pertussis
ccuuggcggccgacag

SEQ ID NO: 436571 - RNA, 17 nt, Bordetella pertussis
ccuuggcguccggcccc

SEQ ID NO: 436572 - RNA, 17 nt, Bordetella pertussis
ccuuggcuugcagcgcc

SEQ ID NO: 436573 - RNA, 23 nt, Bordetella pertussis
ccuugggcucgucgacgcggccg

SEQ ID NO: 436574 - RNA, 19 nt, Bordetella pertussis
ccuuggucaccgagaggaa

SEQ ID NO: 436575 - RNA, 23 nt, Bordetella pertussis
ccuuggugggauccucgcugccg

SEQ ID NO: 436576 - RNA, 17 nt, Bordetella pertussis
ccuuggucgcgaccucg

SEQ ID NO: 436577 - RNA, 22 nt, Bordetella pertussis
ccuuggucggguccagcacgcc

SEQ ID NO: 436578 - RNA, 14 nt, Bordetella pertussis
ccuuuuuccuugcg

SEQ ID NO: 436579 - RNA, 20 nt, Bordetella pertussis
cgaaaaagcccgcgccacca

SEQ ID NO: 436580 - RNA, 20 nt, Bordetella pertussis
cgaaacccgcugggccagca

SEQ ID NO: 436581 - RNA, 21 nt, Bordetella pertussis
cgaaacccucccacgaccugc

SEQ ID NO: 436582 - RNA, 17 nt, Bordetella pertussis
cgaaacgcgcagcaccg

SEQ ID NO: 436583 - RNA, 14 nt, Bordetella pertussis
cgaaacgcgcgucc

SEQ ID NO: 436584 - RNA, 16 nt, Bordetella pertussis
cgaaacggccgggucc

SEQ ID NO: 436585 - RNA, 17 nt, Bordetella pertussis
cgaaagccagcgccugc

SEQ ID NO: 436586 - RNA, 15 nt, Bordetella pertussis
cgaaagcggcaaagc

SEQ ID NO: 436587 - RNA, 22 nt, Bordetella pertussis
cgaaagcggcgugugcccagca

SEQ ID NO: 436588 - RNA, 17 nt, Bordetella pertussis
cgaaaugcccagcgagc

SEQ ID NO: 436589 - RNA, 20 nt, Bordetella pertussis
cgaaaugguguacagccgcc

SEQ ID NO: 436590 - RNA, 15 nt, Bordetella pertussis
cgaacaacacgauga

SEQ ID NO: 436591 - RNA, 15 nt, Bordetella pertussis
cgaacaacagcgccu

SEQ ID NO: 436592 - RNA, 14 nt, Bordetella pertussis
cgaacacgcgcgcc

SEQ ID NO: 436593 - RNA, 21 nt, Bordetella pertussis
cgaacacgcgcgccgcgggcu

SEQ ID NO: 436594 - RNA, 22 nt, Bordetella pertussis
cgaacagccagggcagggcgcc

SEQ ID NO: 436595 - RNA, 15 nt, Bordetella pertussis
cgaacagcugcagcg

SEQ ID NO: 436596 - RNA, 14 nt, Bordetella pertussis
cgaacaggccgccg

SEQ ID NO: 436597 - RNA, 15 nt, Bordetella pertussis
cgaaccagcgcacca

SEQ ID NO: 436598 - RNA, 16 nt, Bordetella pertussis
cgaaccaggccaccgc

SEQ ID NO: 436599 - RNA, 23 nt, Bordetella pertussis
cgaaccaggccugcgggugcgcc

SEQ ID NO: 436600 - RNA, 18 nt, Bordetella pertussis
cgaacccaugcaguagcg

SEQ ID NO: 436601 - RNA, 15 nt, Bordetella pertussis
cgaacgcccggccca

SEQ ID NO: 436602 - RNA, 14 nt, Bordetella pertussis
cgaacgccugccag

SEQ ID NO: 436603 - RNA, 13 nt, Bordetella pertussis
cgaacgcgccggc

SEQ ID NO: 436604 - RNA, 18 nt, Bordetella pertussis
cgaacgcgugcaccagcc

SEQ ID NO: 436605 - RNA, 16 nt, Bordetella pertussis
cgaacggcagcagcgc

SEQ ID NO: 436606 - RNA, 23 nt, Bordetella pertussis
cgaagaggagcugcacaaggucc

SEQ ID NO: 436607 - RNA, 17 nt, Bordetella pertussis
cgaagaucaacaaggcg

SEQ ID NO: 436608 - RNA, 11 nt, Bordetella pertussis
cgaagaucucg

SEQ ID NO: 436609 - RNA, 18 nt, Bordetella pertussis
cgaagccgaguggcgggc

SEQ ID NO: 436610 - RNA, 15 nt, Bordetella pertussis
cgaagccgggcggcg

SEQ ID NO: 436611 - RNA, 17 nt, Bordetella pertussis
cgaagccuaggcugcag

SEQ ID NO: 436612 - RNA, 22 nt, Bordetella pertussis
cgaagccuaggcugcagccagu

SEQ ID NO: 436613 - RNA, 17 nt, Bordetella pertussis
cgaagccuugcgcggcc

SEQ ID NO: 436614 - RNA, 16 nt, Bordetella pertussis
cgaagcgagugcgccc

SEQ ID NO: 436615 - RNA, 14 nt, Bordetella pertussis
cgaagcgcucgucc

SEQ ID NO: 436616 - RNA, 19 nt, Bordetella pertussis
cgaagcggaugcgccgccc

SEQ ID NO: 436617 - RNA, 19 nt, Bordetella pertussis
cgaagcggcccgggugggc

SEQ ID NO: 436618 - RNA, 20 nt, Bordetella pertussis
cgaagcggcguucugcagcg

SEQ ID NO: 436619 - RNA, 15 nt, Bordetella pertussis
cgaaggcgccggcca

SEQ ID NO: 436620 - RNA, 20 nt, Bordetella pertussis
cgaaggcgccggccaggccc

SEQ ID NO: 436621 - RNA, 13 nt, Bordetella pertussis
cgaaggcgcgcuc

SEQ ID NO: 436622 - RNA, 16 nt, Bordetella pertussis
cgaaggcggcgccggu

SEQ ID NO: 436623 - RNA, 13 nt, Bordetella pertussis
cgaagggcagcag

SEQ ID NO: 436624 - RNA, 21 nt, Bordetella pertussis
cgaagggcugcgugcgggaca

SEQ ID NO: 436625 - RNA, 22 nt, Bordetella pertussis
cgaaggucuuggcgugcaggcu

SEQ ID NO: 436626 - RNA, 15 nt, Bordetella pertussis
cgaagguggcacauc

SEQ ID NO: 436627 - RNA, 21 nt, Bordetella pertussis
cgaagguguugaccacgcccu

SEQ ID NO: 436628 - RNA, 14 nt, Bordetella pertussis
cgaaguacacggcc

SEQ ID NO: 436629 - RNA, 17 nt, Bordetella pertussis
cgaaguccgcgcgcagc

SEQ ID NO: 436630 - RNA, 23 nt, Bordetella pertussis
cgacgucggccucgcgcagggcg

SEQ ID NO: 436631 - RNA, 21 nt, Bordetella pertussis
cgacgucguagugcgcgccgc

SEQ ID NO: 436632 - RNA, 14 nt, Bordetella pertussis
cgacgugcgccgca

SEQ ID NO: 436633 - RNA, 19 nt, Bordetella pertussis
cgacguuaugcucgcgcau

SEQ ID NO: 436634 - RNA, 23 nt, Bordetella pertussis
cgacguugcgcgacaggcccgcg

SEQ ID NO: 436635 - RNA, 21 nt, Bordetella pertussis
cgacguuggcgaaugccuggu

SEQ ID NO: 436636 - RNA, 14 nt, Bordetella pertussis
cgacucgaagaagu

SEQ ID NO: 436637 - RNA, 17 nt, Bordetella pertussis
cgacugcagcaggcugg

SEQ ID NO: 436638 - RNA, 14 nt, Bordetella pertussis
cgacugccccaugg

SEQ ID NO: 436639 - RNA, 15 nt, Bordetella pertussis
cgacuucggcggccu

SEQ ID NO: 436640 - RNA, 14 nt, Bordetella pertussis
cgacuugaucaggg

SEQ ID NO: 436641 - RNA, 23 nt, Bordetella pertussis
cgacuuggccugguuggccgccu

SEQ ID NO: 436642 - RNA, 21 nt, Bordetella pertussis
cgagaaaccgauggugccggg

SEQ ID NO: 436643 - RNA, 13 nt, Bordetella pertussis
cgagaacagccac

SEQ ID NO: 436644 - RNA, 15 nt, Bordetella pertussis
cgagacaggcgcgcc

SEQ ID NO: 436645 - RNA, 13 nt, Bordetella pertussis
cgagaccagcagc

SEQ ID NO: 436646 - RNA, 14 nt, Bordetella pertussis
cgagaccagcagcg

SEQ ID NO: 436647 - RNA, 20 nt, Bordetella pertussis
cgagaccguggaaaccgcgu

SEQ ID NO: 436648 - RNA, 19 nt, Bordetella pertussis
cgagaccuugugcggcagg

SEQ ID NO: 436649 - RNA, 20 nt, Bordetella pertussis
cgagacgaaggcgccggcca

SEQ ID NO: 436650 - RNA, 19 nt, Bordetella pertussis
cgagagccugggcgcgcgc

SEQ ID NO: 436651 - RNA, 18 nt, Bordetella pertussis
cgagagcgccacgccagc

SEQ ID NO: 436652 - RNA, 15 nt, Bordetella pertussis
cgagauaggcggcca

SEQ ID NO: 436653 - RNA, 18 nt, Bordetella pertussis
cgagauaggcggccaggc

SEQ ID NO: 436654 - RNA, 20 nt, Bordetella pertussis
cgagauaggcggccaggcuc

SEQ ID NO: 436655 - RNA, 14 nt, Bordetella pertussis
cgagaucagccacc

SEQ ID NO: 436656 - RNA, 13 nt, Bordetella pertussis
cgagauccgccgg

SEQ ID NO: 436657 - RNA, 24 nt, Bordetella pertussis
cgagauggccuuuuccaggcgugc

SEQ ID NO: 436658 - RNA, 17 nt, Bordetella pertussis
cgagcaagggccagaca

SEQ ID NO: 436659 - RNA, 19 nt, Bordetella pertussis
cgagcaauccgucaggcag

SEQ ID NO: 436660 - RNA, 20 nt, Bordetella pertussis
cgagcaauccgucaggcagc

SEQ ID NO: 436661 - RNA, 17 nt, Bordetella pertussis
cgagcaccaugccgggg

SEQ ID NO: 436662 - RNA, 24 nt, Bordetella pertussis
cgagcacccgcaggcggcuggugc

SEQ ID NO: 436663 - RNA, 14 nt, Bordetella pertussis
cgagcaccgccucg

SEQ ID NO: 436664 - RNA, 14 nt, Bordetella pertussis
cgagcaggccgccg

SEQ ID NO: 436665 - RNA, 14 nt, Bordetella pertussis
cgagcaggccggcg

SEQ ID NO: 436666 - RNA, 17 nt, Bordetella pertussis
cgagcaggcgcaggccg

SEQ ID NO: 436667 - RNA, 14 nt, Bordetella pertussis
cgagcaggcgcgcg

SEQ ID NO: 436668 - RNA, 20 nt, Bordetella pertussis
cgagcaguacacgcgcaaca

SEQ ID NO: 436669 - RNA, 20 nt, Bordetella pertussis
cgagcaucuggcgcauggcc

SEQ ID NO: 436670 - RNA, 15 nt, Bordetella pertussis
cgagcaugcgggcca

SEQ ID NO: 436671 - RNA, 16 nt, Bordetella pertussis
cgagcccaucaggugg

SEQ ID NO: 436672 - RNA, 18 nt, Bordetella pertussis
cgagcccgggcgugccug

SEQ ID NO: 436673 - RNA, 21 nt, Bordetella pertussis
cgagcccgggcgugccugcuu

SEQ ID NO: 436674 - RNA, 15 nt, Bordetella pertussis
cgagccgcagaacag

SEQ ID NO: 436675 - RNA, 17 nt, Bordetella pertussis
cgagccgcagaacagca

SEQ ID NO: 436676 - RNA, 18 nt, Bordetella pertussis
cgagccgccgcccuugcg

SEQ ID NO: 436677 - RNA, 20 nt, Bordetella pertussis
cgagccgcugucgcaggcgc

SEQ ID NO: 436678 - RNA, 12 nt, Bordetella pertussis
cgagccggccgc

SEQ ID NO: 436679 - RNA, 16 nt, Bordetella pertussis
cgagccggccgcgccc

SEQ ID NO: 436680 - RNA, 13 nt, Bordetella pertussis
cgagccgggcgcc

SEQ ID NO: 436681 - RNA, 17 nt, Bordetella pertussis
cgagccgguacagccag

SEQ ID NO: 436682 - RNA, 22 nt, Bordetella pertussis
cgagccgguccgccucgcacag

SEQ ID NO: 436683 - RNA, 13 nt, Bordetella pertussis
cgagccggugggc

SEQ ID NO: 436684 - RNA, 19 nt, Bordetella pertussis
cgagccuaugaagacgcgc

SEQ ID NO: 436685 - RNA, 24 nt, Bordetella pertussis
cgagccuaugaagacgcgcucgcc

SEQ ID NO: 436686 - RNA, 14 nt, Bordetella pertussis
cgagcgaugcccug

SEQ ID NO: 436687 - RNA, 18 nt, Bordetella pertussis
cgagcgcaagcaccgccu

SEQ ID NO: 436688 - RNA, 13 nt, Bordetella pertussis
cgagcgcagcaag

SEQ ID NO: 436689 - RNA, 23 nt, Bordetella pertussis
cgagcgcagcaagcugcugcugg

SEQ ID NO: 436690 - RNA, 19 nt, Bordetella pertussis
cgagcgccgaaccuuccuc

SEQ ID NO: 436691 - RNA, 18 nt, Bordetella pertussis
aaacgcgcagcaccggcg

SEQ ID NO: 436692 - RNA, 15 nt, Bordetella pertussis
cgagcgccgcgcucc

SEQ ID NO: 436693 - RNA, 20 nt, Bordetella pertussis
cgagcgcgaaauccagcgcg

SEQ ID NO: 436694 - RNA, 18 nt, Bordetella pertussis
cgagcgcgacagcaccaa

SEQ ID NO: 436695 - RNA, 15 nt, Bordetella pertussis
cgagcgccugcagcg

SEQ ID NO: 436696 - RNA, 16 nt, Bordetella pertussis
cgagcgcgccagcacg

SEQ ID NO: 436697 - RNA, 15 nt, Bordetella pertussis
cgagcgcggcauagc

SEQ ID NO: 436698 - RNA, 16 nt, Bordetella pertussis
cgagcgcggcgcgcgc

SEQ ID NO: 436699 - RNA, 23 nt, Bordetella pertussis
cgagcgcggcgggugccgcgaga

SEQ ID NO: 436700 - RNA, 22 nt, Bordetella pertussis
cgagcgcggcgauacgcgccgc

SEQ ID NO: 436701 - RNA, 17 nt, Bordetella pertussis
cgagcgcgguggccgcu

SEQ ID NO: 436702 - RNA, 21 nt, Bordetella pertussis
cgagcgcguggaaccgccgcu

SEQ ID NO: 436703 - RNA, 22 nt, Bordetella pertussis
cgagcgcguggaaccgccgcuu

SEQ ID NO: 436704 - RNA, 13 nt, Bordetella pertussis
cgagcgcucccgc

SEQ ID NO: 436705 - RNA, 20 nt, Bordetella pertussis
cgagcgcucgcucacggggc

SEQ ID NO: 436706 - RNA, 22 nt, Bordetella pertussis
cgagcgcucgcucacggggcug

SEQ ID NO: 436707 - RNA, 11 nt, Bordetella pertussis
cgagcgcugcg

SEQ ID NO: 436708 - RNA, 12 nt, Bordetella pertussis
cgagcggcagca

SEQ ID NO: 436709 - RNA, 15 nt, Bordetella pertussis
cgagcggcagcagcg

SEQ ID NO: 436710 - RNA, 14 nt, Bordetella pertussis
cgagcggccagccu

SEQ ID NO: 436711 - RNA, 15 nt, Bordetella pertussis
cgagcgggcaugggc

SEQ ID NO: 436712 - RNA, 13 nt, Bordetella pertussis
cgagcgggccggu

SEQ ID NO: 436713 - RNA, 21 nt, Bordetella pertussis
cgagcgggugaugcugcagcg

SEQ ID NO: 436714 - RNA, 14 nt, Bordetella pertussis
cgagcucaccgacu

SEQ ID NO: 436715 - RNA, 22 nt, Bordetella pertussis
cgagcucgucggucagcucaag

SEQ ID NO: 436716 - RNA, 16 nt, Bordetella pertussis
cgagcugcagcccggc

SEQ ID NO: 436717 - RNA, 16 nt, Bordetella pertussis
cgagcuggcuggccag

SEQ ID NO: 436718 - RNA, 17 nt, Bordetella pertussis
cgagcuggcuggccagc

SEQ ID NO: 436719 - RNA, 22 nt, Bordetella pertussis
cgagcuggugauggugucgaag

SEQ ID NO: 436720 - RNA, 16 nt, Bordetella pertussis
cgaggaaggcccgcgu

SEQ ID NO: 436721 - RNA, 16 nt, Bordetella pertussis
cgaggacaggggccuc

SEQ ID NO: 436722 - RNA, 21 nt, Bordetella pertussis
cgaggacgaccuugcuggacc

SEQ ID NO: 436723 - RNA, 20 nt, Bordetella pertussis
cgaggagccggcgggcggcu

SEQ ID NO: 436724 - RNA, 23 nt, Bordetella pertussis
cgaggagccggcgggcggcugcc

SEQ ID NO: 436725 - RNA, 14 nt, Bordetella pertussis
cgaggagcugcugu

SEQ ID NO: 436726 - RNA, 16 nt, Bordetella pertussis
cgaggaggugcgccgc

SEQ ID NO: 436727 - RNA, 18 nt, Bordetella pertussis
cgaggaucaaggcccgga

SEQ ID NO: 436728 - RNA, 15 nt, Bordetella pertussis
cgaggcaaucagccc

SEQ ID NO: 436729 - RNA, 22 nt, Bordetella pertussis
cgaggcagaaguggucgcgcag

SEQ ID NO: 436730 - RNA, 11 nt, Bordetella pertussis
cgaggccaggc

SEQ ID NO: 436731 - RNA, 16 nt, Bordetella pertussis
cgaggcccggccugcg

SEQ ID NO: 436732 - RNA, 19 nt, Bordetella pertussis
cgaggccgcccgccccggc

SEQ ID NO: 436733 - RNA, 16 nt, Bordetella pertussis
cgaggccuugcucgcc

SEQ ID NO: 436734 - RNA, 18 nt, Bordetella pertussis
cgaggcgaacaggcacag

SEQ ID NO: 436735 - RNA, 19 nt, Bordetella pertussis
cgaggcgauggucggccgg

SEQ ID NO: 436736 - RNA, 22 nt, Bordetella pertussis
cgaggcgcagcgcagcuucuau

SEQ ID NO: 436737 - RNA, 23 nt, Bordetella pertussis
cgaggcgccccagagcaccgaga

SEQ ID NO: 436738 - RNA, 16 nt, Bordetella pertussis
cgaggcgcgcagcacg

SEQ ID NO: 436739 - RNA, 12 nt, Bordetella pertussis
cgaggcgcugcc

SEQ ID NO: 436740 - RNA, 19 nt, Bordetella pertussis
cgaggcggcggccggggcc

SEQ ID NO: 436741 - RNA, 14 nt, Bordetella pertussis
cgaggcgggcagca

SEQ ID NO: 436742 - RNA, 16 nt, Bordetella pertussis
cgaggcugcgcgcgcc

SEQ ID NO: 436743 - RNA, 13 nt, Bordetella pertussis
cgaggcuggcgcc

SEQ ID NO: 436744 - RNA, 21 nt, Bordetella pertussis
cgaggcuuuuuuucgccgggc

SEQ ID NO: 436745 - RNA, 13 nt, Bordetella pertussis
cgagggccgcgcg

SEQ ID NO: 436746 - RNA, 13 nt, Bordetella pertussis
cgagggcgcggcg

SEQ ID NO: 436747 - RNA, 23 nt, Bordetella pertussis
cgagggcgcggcgccgcuggcca

SEQ ID NO: 436748 - RNA, 18 nt, Bordetella pertussis
cgagggcgcguccaagca

SEQ ID NO: 436749 - RNA, 20 nt, Bordetella pertussis
cgagggcgucaucggcgcgc

SEQ ID NO: 436750 - RNA, 21 nt, Bordetella pertussis
cgagggcgucaucggcgcgca

SEQ ID NO: 436751 - RNA, 18 nt, Bordetella pertussis
cgagggcucgaccgccgc

SEQ ID NO: 436752 - RNA, 19 nt, Bordetella pertussis
cgagggcucgaccgccgcc

SEQ ID NO: 436753 - RNA, 20 nt, Bordetella pertussis
cgagggcucgaccgccgcca

SEQ ID NO: 436754 - RNA, 17 nt, Bordetella pertussis
cgagggcugcccucgcc

SEQ ID NO: 436755 - RNA, 22 nt, Bordetella pertussis
cgaggucagcaugaagcugccc

SEQ ID NO: 436756 - RNA, 14 nt, Bordetella pertussis
cgaggucagcccgg

SEQ ID NO: 436757 - RNA, 12 nt, Bordetella pertussis
cgagguccaggc

SEQ ID NO: 436758 - RNA, 16 nt, Bordetella pertussis
cgaggucggcggucca

SEQ ID NO: 436759 - RNA, 22 nt, Bordetella pertussis
cgagguguagaacucggccgca

SEQ ID NO: 436760 - RNA, 23 nt, Bordetella pertussis
cgagguugcaggccaggcucagc

SEQ ID NO: 436761 - RNA, 21 nt, Bordetella pertussis
cgaguacauauucacagccau

SEQ ID NO: 436762 - RNA, 15 nt, Bordetella pertussis
cgaguaccgccgccu

SEQ ID NO: 436763 - RNA, 22 nt, Bordetella pertussis
cgaguccugguugccgaagggu

SEQ ID NO: 436764 - RNA, 19 nt, Bordetella pertussis
cgagucggcgauggcgcgc

SEQ ID NO: 436765 - RNA, 15 nt, Bordetella pertussis
cgaguucggcgcgcc

SEQ ID NO: 436766 - RNA, 16 nt, Bordetella pertussis
cgaguucggcgcgccc

SEQ ID NO: 436767 - RNA, 21 nt, Bordetella pertussis
cgaguucgucgucgccaccgc

SEQ ID NO: 436768 - RNA, 17 nt, Bordetella pertussis
cgauaccacgcgcggcg

SEQ ID NO: 436769 - RNA, 15 nt, Bordetella pertussis
cgauagccgcggcgc

SEQ ID NO: 436770 - RNA, 14 nt, Bordetella pertussis
cgauagcgcuccag

SEQ ID NO: 436771 - RNA, 15 nt, Bordetella pertussis
cgauagcgcuccagc

SEQ ID NO: 436772 - RNA, 16 nt, Bordetella pertussis
cgauaugcagcaccgg

SEQ ID NO: 436773 - RNA, 14 nt, Bordetella pertussis
cgauaugggcggcc

SEQ ID NO: 436774 - RNA, 19 nt, Bordetella pertussis
cgaugaugagcgcgccgcc

SEQ ID NO: 436775 - RNA, 20 nt, Bordetella pertussis
cgaugaugagcgcgccgccg

SEQ ID NO: 436776 - RNA, 20 nt, Bordetella pertussis
cgaugauggauucgcgccgg

SEQ ID NO: 436777 - RNA, 15 nt, Bordetella pertussis
cgaugccggccagca

SEQ ID NO: 436778 - RNA, 18 nt, Bordetella pertussis
cgaugccggccagcagcg

SEQ ID NO: 436779 - RNA, 19 nt, Bordetella pertussis
cgaugccggcguggcgcgc

SEQ ID NO: 436780 - RNA, 17 nt, Bordetella pertussis
cgaugccguacuuggcg

SEQ ID NO: 436781 - RNA, 12 nt, Bordetella pertussis
cgaugccgucga

SEQ ID NO: 436782 - RNA, 17 nt, Bordetella pertussis
cgaugcgcacgcccaga

SEQ ID NO: 436783 - RNA, 15 nt, Bordetella pertussis
cgaugcgccaggcgc

SEQ ID NO: 436784 - RNA, 16 nt, Bordetella pertussis
cgaugcgccgcaccag

SEQ ID NO: 436785 - RNA, 15 nt, Bordetella pertussis
cgaugcgcgaagcgc

SEQ ID NO: 436786 - RNA, 20 nt, Bordetella pertussis
cgaugcgcgcgugcagcgcc

SEQ ID NO: 436787 - RNA, 15 nt, Bordetella pertussis
cgaugcgcggcccgg

SEQ ID NO: 436788 - RNA, 20 nt, Bordetella pertussis
cgaugcgggccacgccggcc

SEQ ID NO: 436789 - RNA, 16 nt, Bordetella pertussis
cgaugcgggccuggau

SEQ ID NO: 436790 - RNA, 18 nt, Bordetella pertussis
cgaugcgucaggggcaug

SEQ ID NO: 436791 - RNA, 22 nt, Bordetella pertussis
cgaugcguucgcccgugccgca

SEQ ID NO: 436792 - RNA, 15 nt, Bordetella pertussis
cgaugcugaccaccg

SEQ ID NO: 436793 - RNA, 16 nt, Bordetella pertussis
cgauggcggugguggg

SEQ ID NO: 436794 - RNA, 17 nt, Bordetella pertussis
cgauggcgguggugggc

SEQ ID NO: 436795 - RNA, 23 nt, Bordetella pertussis
cgauggcgggguuggccgccagg

SEQ ID NO: 436796 - RNA, 19 nt, Bordetella pertussis
cgauggcguacagcagggu

SEQ ID NO: 436797 - RNA, 16 nt, Bordetella pertussis
cgauggcguccagcag

SEQ ID NO: 436798 - RNA, 16 nt, Bordetella pertussis
cgauggcuucgcgcac

SEQ ID NO: 436799 - RNA, 15 nt, Bordetella pertussis
cgauggggccgucgc

SEQ ID NO: 436800 - RNA, 15 nt, Bordetella pertussis
cgauggucaccaccc

SEQ ID NO: 436801 - RNA, 17 nt, Bordetella pertussis
cgauggucaccacccgc

SEQ ID NO: 436802 - RNA, 19 nt, Bordetella pertussis
cgauggucaccacccgcac

SEQ ID NO: 436803 - RNA, 18 nt, Bordetella pertussis
cgauguccuucucuucgc

SEQ ID NO: 436804 - RNA, 24 nt, Bordetella pertussis
cgaugucgaacagcugcagcgacu

SEQ ID NO: 436805 - RNA, 14 nt, Bordetella pertussis
cgaugucgccgccg

SEQ ID NO: 436806 - RNA, 22 nt, Bordetella pertussis
cgaugucguacacaugcuugcc

SEQ ID NO: 436807 - RNA, 20 nt, Bordetella pertussis
cgaugucguccagcuccagg

SEQ ID NO: 436808 - RNA, 22 nt, Bordetella pertussis
cgauguucaggccaugcugggc

SEQ ID NO: 436809 - RNA, 15 nt, Bordetella pertussis
cgauguugccgccgg

SEQ ID NO: 436810 - RNA, 17 nt, Bordetella pertussis
cgauugaccagcaccag

SEQ ID NO: 436811 - RNA, 23 nt, Bordetella pertussis
cgauugcagguggccagcccggu

SEQ ID NO: 436812 - RNA, 16 nt, Bordetella pertussis
cgauuugccgcagccc

SEQ ID NO: 436813 - RNA, 19 nt, Bordetella pertussis
cgauuugccgcagcccgcg

SEQ ID NO: 436814 - RNA, 12 nt, Bordetella pertussis
cgcaacaggucg

SEQ ID NO: 436815 - RNA, 14 nt, Bordetella pertussis
cgcaacccagcagc

SEQ ID NO: 436816 - RNA, 15 nt, Bordetella pertussis
cgcaacccagcagcg

SEQ ID NO: 436817 - RNA, 18 nt, Bordetella pertussis
cgcaacccgcuuuuuccu

SEQ ID NO: 436818 - RNA, 21 nt, Bordetella pertussis
cgcaaccggucggccggcagc

SEQ ID NO: 436819 - RNA, 15 nt, Bordetella pertussis
cgcaacgccagcagg

SEQ ID NO: 436820 - RNA, 13 nt, Bordetella pertussis
cgcaacgccgccc

SEQ ID NO: 436821 - RNA, 15 nt, Bordetella pertussis
cgcaacgccgggccg

SEQ ID NO: 436822 - RNA, 23 nt, Bordetella pertussis
cgcaacgcgcgcgcgcacaggcg

SEQ ID NO: 436823 - RNA, 23 nt, Bordetella pertussis
cgcacaaagcggguugcggcagc

SEQ ID NO: 436824 - RNA, 13 nt, Bordetella pertussis
cgcacacaccgcg

SEQ ID NO: 436825 - RNA, 17 nt, Bordetella pertussis
cgcacacaccgcgucau

SEQ ID NO: 436826 - RNA, 18 nt, Bordetella pertussis
cgcacacgcgcugggcgu

SEQ ID NO: 436827 - RNA, 23 nt, Bordetella pertussis
cgcacacgcgcugggcguggcgc

SEQ ID NO: 436828 - RNA, 20 nt, Bordetella pertussis
cgcacacuggccagcaagcg

SEQ ID NO: 436829 - RNA, 22 nt, Bordetella pertussis
cgcacagcgcgcaacuccagca

SEQ ID NO: 436830 - RNA, 15 nt, Bordetella pertussis
cgcacagcgcggcga

SEQ ID NO: 436831 - RNA, 20 nt, Bordetella pertussis
cgcacaggcggcgccggcac

SEQ ID NO: 436832 - RNA, 23 nt, Bordetella pertussis
cgcacaucaggucgaccugcuug

SEQ ID NO: 436833 - RNA, 19 nt, Bordetella pertussis
cgcacauacaaggcgcggc

SEQ ID NO: 436834 - RNA, 17 nt, Bordetella pertussis
cgcacaugaugcccagc

SEQ ID NO: 436835 - RNA, 21 nt, Bordetella pertussis
cgcaccaaucuugccaggccc

SEQ ID NO: 436836 - RNA, 14 nt, Bordetella pertussis
cgcaccaccgccga

SEQ ID NO: 436837 - RNA, 14 nt, Bordetella pertussis
cgcaccaccuggcu

SEQ ID NO: 436838 - RNA, 12 nt, Bordetella pertussis
cgcaccagccug

SEQ ID NO: 436839 - RNA, 22 nt, Bordetella pertussis
cgcaccagcgcgccgaucacca

SEQ ID NO: 436840 - RNA, 17 nt, Bordetella pertussis
cgcaccagcccgcccgc

SEQ ID NO: 436841 - RNA, 18 nt, Bordetella pertussis
cgcaccugaacaccggcg

SEQ ID NO: 436842 - RNA, 13 nt, Bordetella pertussis
cgcaccugggagg

SEQ ID NO: 436843 - RNA, 12 nt, Bordetella pertussis
cgcaccugggcg

SEQ ID NO: 436844 - RNA, 23 nt, Bordetella pertussis
cgcaccugcugcggcacggccag

SEQ ID NO: 436845 - RNA, 19 nt, Bordetella pertussis
cgcaccuguucggcggcgc

SEQ ID NO: 436846 - RNA, 21 nt, Bordetella pertussis
cgcaccuuucugcugcucgcg

SEQ ID NO: 436847 - RNA, 16 nt, Bordetella pertussis
cgcacgaccaccagcg

SEQ ID NO: 436848 - RNA, 13 nt, Bordetella pertussis
cgcacgcaccgcg

SEQ ID NO: 436849 - RNA, 15 nt, Bordetella pertussis
cgcacgauggggccg

SEQ ID NO: 436850 - RNA, 22 nt, Bordetella pertussis
cgcacgcccgccugcagcagcg

SEQ ID NO: 436851 - RNA, 13 nt, Bordetella pertussis
cgcacgccgggcg

SEQ ID NO: 436852 - RNA, 18 nt, Bordetella pertussis
cgcacgccggucgccagc

SEQ ID NO: 436853 - RNA, 14 nt, Bordetella pertussis
cgcacgcgcagcac

SEQ ID NO: 436854 - RNA, 16 nt, Bordetella pertussis
cgcacgcgcuugcucg

SEQ ID NO: 436855 - RNA, 17 nt, Bordetella pertussis
cgcacgugacgccggcg

SEQ ID NO: 436856 - RNA, 22 nt, Bordetella pertussis
cgcacguugagauccaggaacu

SEQ ID NO: 436857 - RNA, 23 nt, Bordetella pertussis
cgcacucgaccgccgggacaggc

SEQ ID NO: 436858 - RNA, 18 nt, Bordetella pertussis
cgcagaaaccgccacagc

SEQ ID NO: 436859 - RNA, 24 nt, Bordetella pertussis
cgcagaaaccgccacagcgccgcg

SEQ ID NO: 436860 - RNA, 21 nt, Bordetella pertussis
cgcagaaauggaugcgcgccc

SEQ ID NO: 436861 - RNA, 14 nt, Bordetella pertussis
cgcagaacagcagc

SEQ ID NO: 436862 - RNA, 15 nt, Bordetella pertussis
cgcagaacagcagcg

SEQ ID NO: 436863 - RNA, 16 nt, Bordetella pertussis
cgcagaagcagccgcg

SEQ ID NO: 436864 - RNA, 14 nt, Bordetella pertussis
cgcagaucccaggc

SEQ ID NO: 436865 - RNA, 17 nt, Bordetella pertussis
cgcagauggccagcagc

SEQ ID NO: 436866 - RNA, 18 nt, Bordetella pertussis
cgcagauggccagcagcg

SEQ ID NO: 436867 - RNA, 16 nt, Bordetella pertussis
cgcagauuuccagcgc

SEQ ID NO: 436868 - RNA, 20 nt, Bordetella pertussis
cgcagauuuccagcgcgucc

SEQ ID NO: 436869 - RNA, 14 nt, Bordetella pertussis
cgcagcggcggcgc

SEQ ID NO: 436870 - RNA, 15 nt, Bordetella pertussis
cgcagcgggcccguc

SEQ ID NO: 436871 - RNA, 20 nt, Bordetella pertussis
cgcagcggggacaggcgccc

SEQ ID NO: 436872 - RNA, 23 nt, Bordetella pertussis
cgcagcgugaccgacaggccugg

SEQ ID NO: 436873 - RNA, 21 nt, Bordetella pertussis
cgcagcguuacgcgaccagcu

SEQ ID NO: 436874 - RNA, 20 nt, Bordetella pertussis
cgcaggaugcgcuggccggc

SEQ ID NO: 436875 - RNA, 21 nt, Bordetella pertussis
cgcaggcauugcgccagccgu

SEQ ID NO: 436876 - RNA, 16 nt, Bordetella pertussis
cgcaggccagcccgcg

SEQ ID NO: 436877 - RNA, 12 nt, Bordetella pertussis
cgcaggccagcg

SEQ ID NO: 436878 - RNA, 13 nt, Bordetella pertussis
cgcaggccagcgc

SEQ ID NO: 436879 - RNA, 15 nt, Bordetella pertussis
cgcaggccagcgccg

SEQ ID NO: 436880 - RNA, 15 nt, Bordetella pertussis
cgcaggccgcgcgca

SEQ ID NO: 436881 - RNA, 15 nt, Bordetella pertussis
cgcaggccgcggcca

SEQ ID NO: 436882 - RNA, 15 nt, Bordetella pertussis
cgcaggccugcugca

SEQ ID NO: 436883 - RNA, 15 nt, Bordetella pertussis
cgcaggcgcgcgccu

SEQ ID NO: 436884 - RNA, 14 nt, Bordetella pertussis
cgcaggcggcggcc

SEQ ID NO: 436885 - RNA, 23 nt, Bordetella pertussis
cgcaggcggcggccuccagcagg

SEQ ID NO: 436886 - RNA, 14 nt, Bordetella pertussis
cgcaggcgggccuc

SEQ ID NO: 436887 - RNA, 13 nt, Bordetella pertussis
cgcaggcgugccc

SEQ ID NO: 436888 - RNA, 20 nt, Bordetella pertussis
cgcaggcgugcgcgggcgcc

SEQ ID NO: 436889 - RNA, 14 nt, Bordetella pertussis
cgcagggacaggcu

SEQ ID NO: 436890 - RNA, 17 nt, Bordetella pertussis
cgcagggcauacaugag

SEQ ID NO: 436891 - RNA, 21 nt, Bordetella pertussis
aaacggauugccgccgcgcag

SEQ ID NO: 436892 - RNA, 13 nt, Bordetella pertussis
aaacggccaagca

SEQ ID NO: 436893 - RNA, 23 nt, Bordetella pertussis
aaacgggggcaggccgcgguggu

SEQ ID NO: 436894 - RNA, 16 nt, Bordetella pertussis
cgcauacggacgagcg

SEQ ID NO: 436895 - RNA, 19 nt, Bordetella pertussis
cgcauaggacgccaccagu

SEQ ID NO: 436896 - RNA, 19 nt, Bordetella pertussis
cgcauauggagccaggcgg

SEQ ID NO: 436897 - RNA, 15 nt, Bordetella pertussis
cgcauauccaggcgg

SEQ ID NO: 436898 - RNA, 21 nt, Bordetella pertussis
cgcaucagcgcgcccgcuucc

SEQ ID NO: 436899 - RNA, 16 nt, Bordetella pertussis
cgcaucgacagcgcgc

SEQ ID NO: 436900 - RNA, 17 nt, Bordetella pertussis
cgcaucgaucagcgcgc

SEQ ID NO: 436901 - RNA, 22 nt, Bordetella pertussis
cgcaucgaucagcgcgccgucg

SEQ ID NO: 436902 - RNA, 20 nt, Bordetella pertussis
cgcaucgaucucggccucgg

SEQ ID NO: 436903 - RNA, 14 nt, Bordetella pertussis
cgcaucgcgcgccg

SEQ ID NO: 436904 - RNA, 21 nt, Bordetella pertussis
cgcaucgcgcgcgccggcauc

SEQ ID NO: 436905 - RNA, 16 nt, Bordetella pertussis
cgcaucggcguaccag

SEQ ID NO: 436906 - RNA, 21 nt, Bordetella pertussis
cgcaugaccugcgacagcacc

SEQ ID NO: 436907 - RNA, 22 nt, Bordetella pertussis
cgcaugacggcgucgagcacgc

SEQ ID NO: 436908 - RNA, 15 nt, Bordetella pertussis
cgcaugagccggcag

SEQ ID NO: 436909 - RNA, 20 nt, Bordetella pertussis
cgcaugauggccggccugcc

SEQ ID NO: 436910 - RNA, 23 nt, Bordetella pertussis
cgcaugauuccugucgcgcugcu

SEQ ID NO: 436911 - RNA, 15 nt, Bordetella pertussis
cgcaugccagcuugc

SEQ ID NO: 436912 - RNA, 19 nt, Bordetella pertussis
cgcaugcggcacaaccugg

SEQ ID NO: 436913 - RNA, 14 nt, Bordetella pertussis
cgcaugcggcggcu

SEQ ID NO: 436914 - RNA, 14 nt, Bordetella pertussis
cgcaugcgugcgca

SEQ ID NO: 436915 - RNA, 14 nt, Bordetella pertussis
cgcaugcugcgcga

SEQ ID NO: 436916 - RNA, 18 nt, Bordetella pertussis
cgcauggccagcgcgcag

SEQ ID NO: 436917 - RNA, 16 nt, Bordetella pertussis
cgcauggccggcgugu

SEQ ID NO: 436918 - RNA, 14 nt, Bordetella pertussis
cgcaugggccaggc

SEQ ID NO: 436919 - RNA, 15 nt, Bordetella pertussis
cgcaugggcgcgccc

SEQ ID NO: 436920 - RNA, 19 nt, Bordetella pertussis
cgcaugggcgcgcccggcg

SEQ ID NO: 436921 - RNA, 15 nt, Bordetella pertussis
cgcaugucagcgccu

SEQ ID NO: 436922 - RNA, 17 nt, Bordetella pertussis
cgcaugucagcgccugg

SEQ ID NO: 436923 - RNA, 17 nt, Bordetella pertussis
cgcaugguggcgcaggc

SEQ ID NO: 436924 - RNA, 16 nt, Bordetella pertussis
cgcauuagaucagaaa

SEQ ID NO: 436925 - RNA, 13 nt, Bordetella pertussis
cgcauugccgucg

SEQ ID NO: 436926 - RNA, 14 nt, Bordetella pertussis
cgcauuggccgccg

SEQ ID NO: 436927 - RNA, 17 nt, Bordetella pertussis
cgcauuggccgccgcca

SEQ ID NO: 436928 - RNA, 20 nt, Bordetella pertussis
cgcauuucucggccugggcg

SEQ ID NO: 436929 - RNA, 22 nt, Bordetella pertussis
cgccaacgcacaagggccccgc

SEQ ID NO: 436930 - RNA, 14 nt, Bordetella pertussis
cgccaacgcggcgc

SEQ ID NO: 436931 - RNA, 18 nt, Bordetella pertussis
cgccaacggugccagucc

SEQ ID NO: 436932 - RNA, 15 nt, Bordetella pertussis
cgccaacgucggcag

SEQ ID NO: 436933 - RNA, 15 nt, Bordetella pertussis
cgccaagaccgcggc

SEQ ID NO: 436934 - RNA, 17 nt, Bordetella pertussis
cgccaagaccgcggccg

SEQ ID NO: 436935 - RNA, 19 nt, Bordetella pertussis
cgccaagaccgcggccgcg

SEQ ID NO: 436936 - RNA, 21 nt, Bordetella pertussis
cgccaagaccgcggccgcgcu

SEQ ID NO: 436937 - RNA, 15 nt, Bordetella pertussis
cgccaagggcgcgcc

SEQ ID NO: 436938 - RNA, 23 nt, Bordetella pertussis
cgccaauugcuugccugucccca

SEQ ID NO: 436939 - RNA, 18 nt, Bordetella pertussis
cgccacaccgcugcggga

SEQ ID NO: 436940 - RNA, 22 nt, Bordetella pertussis
cgccacagauuggccaccaggg

SEQ ID NO: 436941 - RNA, 18 nt, Bordetella pertussis
cgccacagcaugaccucg

SEQ ID NO: 436942 - RNA, 23 nt, Bordetella pertussis
cgccacagcaugaccucggccug

SEQ ID NO: 436943 - RNA, 20 nt, Bordetella pertussis
cgccacagcgccaucgcgcg

SEQ ID NO: 436944 - RNA, 13 nt, Bordetella pertussis
cgccacagcgccg

SEQ ID NO: 436945 - RNA, 15 nt, Bordetella pertussis
cgccacagcgccgcg

SEQ ID NO: 436946 - RNA, 17 nt, Bordetella pertussis
cgccacagcgccgcggc

SEQ ID NO: 436947 - RNA, 19 nt, Bordetella pertussis
cgccacaggugcgcggcgc

SEQ ID NO: 436948 - RNA, 17 nt, Bordetella pertussis
cgccaccaccggcacgc

SEQ ID NO: 436949 - RNA, 20 nt, Bordetella pertussis
cgccaccaccucggccucgc

SEQ ID NO: 436950 - RNA, 22 nt, Bordetella pertussis
cgccaccaccucggugccgugg

SEQ ID NO: 436951 - RNA, 14 nt, Bordetella pertussis
cgccaccccgccgc

SEQ ID NO: 436952 - RNA, 18 nt, Bordetella pertussis
cgccaccccgccgcugaa

SEQ ID NO: 436953 - RNA, 13 nt, Bordetella pertussis
cgccaccgccaga

SEQ ID NO: 436954 - RNA, 16 nt, Bordetella pertussis
cgccaccgcgccgccc

SEQ ID NO: 436955 - RNA, 19 nt, Bordetella pertussis
cgccaccgugauggcgcgg

SEQ ID NO: 436956 - RNA, 17 nt, Bordetella pertussis
cgccacgcccgucccga

SEQ ID NO: 436957 - RNA, 13 nt, Bordetella pertussis
cgccacgccggcc

SEQ ID NO: 436958 - RNA, 14 nt, Bordetella pertussis
cgccacgccggcca

SEQ ID NO: 436959 - RNA, 19 nt, Bordetella pertussis
cgccacgcgggccggccgu

SEQ ID NO: 436960 - RNA, 17 nt, Bordetella pertussis
cgccacgcgguccagcc

SEQ ID NO: 436961 - RNA, 19 nt, Bordetella pertussis
cgccacgcgguccagcccc

SEQ ID NO: 436962 - RNA, 23 nt, Bordetella pertussis
cgccacgcuguuuucggccgacu

SEQ ID NO: 436963 - RNA, 24 nt, Bordetella pertussis
cgccacgcuggccgcgcuggcggc

SEQ ID NO: 436964 - RNA, 21 nt, Bordetella pertussis
cgccacggcaggcgccugccc

SEQ ID NO: 436965 - RNA, 15 nt, Bordetella pertussis
cgccacggcgcccga

SEQ ID NO: 436966 - RNA, 18 nt, Bordetella pertussis
cgccacggcgcccgaggc

SEQ ID NO: 436967 - RNA, 20 nt, Bordetella pertussis
cgccacggcgucgccggcca

SEQ ID NO: 436968 - RNA, 13 nt, Bordetella pertussis
cgccacggcuucg

SEQ ID NO: 436969 - RNA, 18 nt, Bordetella pertussis
cgccaucgucguagcgcc

SEQ ID NO: 436970 - RNA, 19 nt, Bordetella pertussis
cgccaucuugcaggcgcca

SEQ ID NO: 436971 - RNA, 14 nt, Bordetella pertussis
cgccaucucgcgcg

SEQ ID NO: 436972 - RNA, 22 nt, Bordetella pertussis
cgccaugaacgcuugacggcca

SEQ ID NO: 436973 - RNA, 14 nt, Bordetella pertussis
cgccaugaccacgu

SEQ ID NO: 436974 - RNA, 16 nt, Bordetella pertussis
cgccaugagcgcuuga

SEQ ID NO: 436975 - RNA, 20 nt, Bordetella pertussis
cgccaugaugucgcgcgccu

SEQ ID NO: 436976 - RNA, 22 nt, Bordetella pertussis
cgccaugaugucgcgcgccugc

SEQ ID NO: 436977 - RNA, 23 nt, Bordetella pertussis
cgccaugcaacacgaccagcagg

SEQ ID NO: 436978 - RNA, 17 nt, Bordetella pertussis
cgccaugcagcuggaug

SEQ ID NO: 436979 - RNA, 16 nt, Bordetella pertussis
cgccaugccggccccg

SEQ ID NO: 436980 - RNA, 17 nt, Bordetella pertussis
cgccaugcgcaccaccg

SEQ ID NO: 436981 - RNA, 17 nt, Bordetella pertussis
cgccaugcgccagcagg

SEQ ID NO: 436982 - RNA, 15 nt, Bordetella pertussis
cgccaugcggcuggc

SEQ ID NO: 436983 - RNA, 18 nt, Bordetella pertussis
cgccaugcggcuggccga

SEQ ID NO: 436984 - RNA, 13 nt, Bordetella pertussis
cgccauggacgcc

SEQ ID NO: 436985 - RNA, 22 nt, Bordetella pertussis
cgccauggaggcgcagcgcggc

SEQ ID NO: 436986 - RNA, 15 nt, Bordetella pertussis
cgccauggcggcggc

SEQ ID NO: 436987 - RNA, 16 nt, Bordetella pertussis
cgccauggcggcggcc

SEQ ID NO: 436988 - RNA, 19 nt, Bordetella pertussis
cgccauggcggcggccacg

SEQ ID NO: 436989 - RNA, 23 nt, Bordetella pertussis
cgccauggucucccccucggccu

SEQ ID NO: 436990 - RNA, 23 nt, Bordetella pertussis
cgccauggugaacggccccgcca

SEQ ID NO: 436991 - RNA, 22 nt, Bordetella pertussis
cgccauggugccgcgcaggccc

SEQ ID NO: 436992 - RNA, 15 nt, Bordetella pertussis
cgccauggccggcgu

SEQ ID NO: 436993 - RNA, 20 nt, Bordetella pertussis
cgccaugugcgccgcgccgu

SEQ ID NO: 436994 - RNA, 21 nt, Bordetella pertussis
cgccaugugcguugccagccc

SEQ ID NO: 436995 - RNA, 13 nt, Bordetella pertussis
cgcccacauggcg

SEQ ID NO: 436996 - RNA, 17 nt, Bordetella pertussis
cgcccacauagaccggc

SEQ ID NO: 436997 - RNA, 21 nt, Bordetella pertussis
cgcccacauagcggccggcgc

SEQ ID NO: 436998 - RNA, 13 nt, Bordetella pertussis
cgcccaccaccag

SEQ ID NO: 436999 - RNA, 14 nt, Bordetella pertussis
cgcccaccaccagc

SEQ ID NO: 437000 - RNA, 19 nt, Bordetella pertussis
cgcccaccaccagcgcggc

SEQ ID NO: 437001 - RNA, 17 nt, Bordetella pertussis
cgcccaccaccagcggc

SEQ ID NO: 437002 - RNA, 21 nt, Bordetella pertussis
cgcccaccaccagcggcgugc

SEQ ID NO: 437003 - RNA, 20 nt, Bordetella pertussis
cgcccaccacgccgcccagc

SEQ ID NO: 437004 - RNA, 11 nt, Bordetella pertussis
cgcccagcagg

SEQ ID NO: 437005 - RNA, 23 nt, Bordetella pertussis
cgcccagcaggcuuucgcacagc

SEQ ID NO: 437006 - RNA, 17 nt, Bordetella pertussis
cgcccagcagcgccacc

SEQ ID NO: 437007 - RNA, 13 nt, Bordetella pertussis
cgcccagccccgc

SEQ ID NO: 437008 - RNA, 18 nt, Bordetella pertussis
cgcccagccccgcggccg

SEQ ID NO: 437009 - RNA, 20 nt, Bordetella pertussis
cgcccagccccgcggccgcg

SEQ ID NO: 437010 - RNA, 14 nt, Bordetella pertussis
cgcccagccgcagc

SEQ ID NO: 437011 - RNA, 14 nt, Bordetella pertussis
cgcccagccgccug

SEQ ID NO: 437012 - RNA, 15 nt, Bordetella pertussis
cgcccagccgccuga

SEQ ID NO: 437013 - RNA, 14 nt, Bordetella pertussis
cgcccagccggccg

SEQ ID NO: 437014 - RNA, 15 nt, Bordetella pertussis
cgcccagccggccga

SEQ ID NO: 437015 - RNA, 16 nt, Bordetella pertussis
cgcccagccggccgau

SEQ ID NO: 437016 - RNA, 12 nt, Bordetella pertussis
cgcccagcgagc

SEQ ID NO: 437017 - RNA, 15 nt, Bordetella pertussis
cgcccagcgagccgg

SEQ ID NO: 437018 - RNA, 16 nt, Bordetella pertussis
cgcccagcgagccggc

SEQ ID NO: 437019 - RNA, 17 nt, Bordetella pertussis
cgcccagcgagccggcc

SEQ ID NO: 437020 - RNA, 18 nt, Bordetella pertussis
cgcccagcgagccggcca

SEQ ID NO: 437021 - RNA, 20 nt, Bordetella pertussis
cgcccaggcgaugcccagcg

SEQ ID NO: 437022 - RNA, 22 nt, Bordetella pertussis
cgcccaggcgaugcccagcgcc

SEQ ID NO: 437023 - RNA, 16 nt, Bordetella pertussis
cgcccaggcgcagccc

SEQ ID NO: 437024 - RNA, 23 nt, Bordetella pertussis
cgcccaggcgcagccgcgcgccu

SEQ ID NO: 437025 - RNA, 17 nt, Bordetella pertussis
cgcccaggggccggcgc

SEQ ID NO: 437026 - RNA, 19 nt, Bordetella pertussis
cgcccagggucggaugcgg

SEQ ID NO: 437027 - RNA, 12 nt, Bordetella pertussis
cgcccagguaca

SEQ ID NO: 437028 - RNA, 22 nt, Bordetella pertussis
cgcccagguccgaaccgaccgc

SEQ ID NO: 437029 - RNA, 18 nt, Bordetella pertussis
cgcccagguugcggccgc

SEQ ID NO: 437030 - RNA, 20 nt, Bordetella pertussis
cgcccagguugcggccgcca

SEQ ID NO: 437031 - RNA, 24 nt, Bordetella pertussis
cgcccaguuccacgcggccguggc

SEQ ID NO: 437032 - RNA, 20 nt, Bordetella pertussis
cgcccauuccgagcgggccc

SEQ ID NO: 437033 - RNA, 15 nt, Bordetella pertussis
cgcccauugcggcgg

SEQ ID NO: 437034 - RNA, 18 nt, Bordetella pertussis
cgccccaacgcggccagc

SEQ ID NO: 437035 - RNA, 13 nt, Bordetella pertussis
cgccccacccggg

SEQ ID NO: 437036 - RNA, 23 nt, Bordetella pertussis
cgccccacgagaagccgaugucg

SEQ ID NO: 437037 - RNA, 14 nt, Bordetella pertussis
cgccccgacgcgcu

SEQ ID NO: 437038 - RNA, 18 nt, Bordetella pertussis
cgccccgaucggcgccgc

SEQ ID NO: 437039 - RNA, 12 nt, Bordetella pertussis
cgccccgcccuc

SEQ ID NO: 437040 - RNA, 14 nt, Bordetella pertussis
cgccccgcuggccg

SEQ ID NO: 437041 - RNA, 23 nt, Bordetella pertussis
cgccccgcuggccgucgccgccc

SEQ ID NO: 437042 - RNA, 17 nt, Bordetella pertussis
cgcccgacagcacgccc

SEQ ID NO: 437043 - RNA, 19 nt, Bordetella pertussis
cgcccgacggcgcgcccgc

SEQ ID NO: 437044 - RNA, 19 nt, Bordetella pertussis
cgcccgagcuggccggcga

SEQ ID NO: 437045 - RNA, 20 nt, Bordetella pertussis
cgcccgaugcucgccggcgc

SEQ ID NO: 437046 - RNA, 21 nt, Bordetella pertussis
cgcccgcaacgggccggccgc

SEQ ID NO: 437047 - RNA, 22 nt, Bordetella pertussis
cgcccgcaggcauugcgccagc

SEQ ID NO: 437048 - RNA, 19 nt, Bordetella pertussis
cgcccgcauggaccgccgc

SEQ ID NO: 437049 - RNA, 21 nt, Bordetella pertussis
cgcccgcaugucccagcgcuc

SEQ ID NO: 437050 - RNA, 14 nt, Bordetella pertussis
cgcccgccaccagg

SEQ ID NO: 437051 - RNA, 15 nt, Bordetella pertussis
cgcccgcccgcugac

SEQ ID NO: 437052 - RNA, 15 nt, Bordetella pertussis
cgcccgcccugggca

SEQ ID NO: 437053 - RNA, 13 nt, Bordetella pertussis
cgcccgccgccug

SEQ ID NO: 437054 - RNA, 16 nt, Bordetella pertussis
cgcccgccgccugcgc

SEQ ID NO: 437055 - RNA, 15 nt, Bordetella pertussis
cgcccgccgggccgu

SEQ ID NO: 437056 - RNA, 17 nt, Bordetella pertussis
cgcccgcugaccggccu

SEQ ID NO: 437057 - RNA, 16 nt, Bordetella pertussis
cgcccgcuugggccgc

SEQ ID NO: 437058 - RNA, 16 nt, Bordetella pertussis
cgcccggaugggcggc

SEQ ID NO: 437059 - RNA, 18 nt, Bordetella pertussis
cgcccggaugggcggccu

SEQ ID NO: 437060 - RNA, 16 nt, Bordetella pertussis
cgcccggcaacccgcc

SEQ ID NO: 437061 - RNA, 23 nt, Bordetella pertussis
cgcccggcaugggcgugccgcgc

SEQ ID NO: 437062 - RNA, 13 nt, Bordetella pertussis
cgcccgggccggc

SEQ ID NO: 437063 - RNA, 12 nt, Bordetella pertussis
cgcccgggcggc

SEQ ID NO: 437064 - RNA, 13 nt, Bordetella pertussis
cgcccggggcggc

SEQ ID NO: 437065 - RNA, 14 nt, Bordetella pertussis
cgcccgggcugauc

SEQ ID NO: 437066 - RNA, 14 nt, Bordetella pertussis
cgcccgggcugccg

SEQ ID NO: 437067 - RNA, 23 nt, Bordetella pertussis
cgcccggguuggcguccaggcgc

SEQ ID NO: 437068 - RNA, 23 nt, Bordetella pertussis
cgcccggugccugccccugcggg

SEQ ID NO: 437069 - RNA, 13 nt, Bordetella pertussis
cgcccucgcgcca

SEQ ID NO: 437070 - RNA, 15 nt, Bordetella pertussis
cgcccucgcgccacc

SEQ ID NO: 437071 - RNA, 17 nt, Bordetella pertussis
cgcccugcucgaucugg

SEQ ID NO: 437072 - RNA, 17 nt, Bordetella pertussis
cgcccugcucgcgcagc

SEQ ID NO: 437073 - RNA, 16 nt, Bordetella pertussis
cgcccuggcagcuggc

SEQ ID NO: 437074 - RNA, 15 nt, Bordetella pertussis
cgcccuggaucaggg

SEQ ID NO: 437075 - RNA, 23 nt, Bordetella pertussis
cgcccuggccuucgaccugcccg

SEQ ID NO: 437076 - RNA, 16 nt, Bordetella pertussis
cgcccuggcgcagggc

SEQ ID NO: 437077 - RNA, 19 nt, Bordetella pertussis
cgcccuggcgccgcggccg

SEQ ID NO: 437078 - RNA, 16 nt, Bordetella pertussis
cgcccuggcgcgaggc

SEQ ID NO: 437079 - RNA, 15 nt, Bordetella pertussis
cgcccuggcggcggu

SEQ ID NO: 437080 - RNA, 23 nt, Bordetella pertussis
cgcccuggggcgcgguccggauc

SEQ ID NO: 437081 - RNA, 17 nt, Bordetella pertussis
cgcccuggucaucgcca

SEQ ID NO: 437082 - RNA, 16 nt, Bordetella pertussis
cgcccuggcuggcggc

SEQ ID NO: 437083 - RNA, 17 nt, Bordetella pertussis
cgccgaacugccggcgc

SEQ ID NO: 437084 - RNA, 18 nt, Bordetella pertussis
cgccgaacugccggcgcg

SEQ ID NO: 437085 - RNA, 17 nt, Bordetella pertussis
cgccgaaggcggcgccg

SEQ ID NO: 437086 - RNA, 19 nt, Bordetella pertussis
cgccgaaggcggcgccggu

SEQ ID NO: 437087 - RNA, 19 nt, Bordetella pertussis
cgccgaaggcgugcugaac

SEQ ID NO: 437088 - RNA, 18 nt, Bordetella pertussis
cgccgaaguugcggccgu

SEQ ID NO: 437089 - RNA, 19 nt, Bordetella pertussis
cgccgaauugcuggagcgc

SEQ ID NO: 437090 - RNA, 23 nt, Bordetella pertussis
cgccgacaacggcgugcugcggc

SEQ ID NO: 437091 - RNA, 14 nt, Bordetella pertussis
cgccgaccggcccc

SEQ ID NO: 437092 - RNA, 15 nt, Bordetella pertussis
cgccgaccgggccga

SEQ ID NO: 437093 - RNA, 23 nt, Bordetella pertussis
cgccgaccucggcaccgaggccg

SEQ ID NO: 437094 - RNA, 18 nt, Bordetella pertussis
cgccgaccuggcgcccga

SEQ ID NO: 437095 - RNA, 21 nt, Bordetella pertussis
cgccgacgauaucgcgaaagc

SEQ ID NO: 437096 - RNA, 18 nt, Bordetella pertussis
cgccgacgaugccgccca

SEQ ID NO: 437097 - RNA, 14 nt, Bordetella pertussis
cgccgacgaugcgg

SEQ ID NO: 437098 - RNA, 21 nt, Bordetella pertussis
cgccgacgaugucgccgccgc

SEQ ID NO: 437099 - RNA, 15 nt, Bordetella pertussis
cgccgacgccgccac

SEQ ID NO: 437100 - RNA, 14 nt, Bordetella pertussis
cgccgagccgggcc

SEQ ID NO: 437101 - RNA, 17 nt, Bordetella pertussis
cgccgagggccgcgcga

SEQ ID NO: 437102 - RNA, 18 nt, Bordetella pertussis
cgccgagggccgcgcgau

SEQ ID NO: 437103 - RNA, 22 nt, Bordetella pertussis
cgccgaggaucuggccggcgcu

SEQ ID NO: 437104 - RNA, 21 nt, Bordetella pertussis
cgccgaguuuccgcacccggu

SEQ ID NO: 437105 - RNA, 16 nt, Bordetella pertussis
cgccgauaccacgcgc

SEQ ID NO: 437106 - RNA, 21 nt, Bordetella pertussis
cgccgcacgggcgccuguccc

SEQ ID NO: 437107 - RNA, 14 nt, Bordetella pertussis
cgccgcaggcuaug

SEQ ID NO: 437108 - RNA, 18 nt, Bordetella pertussis
cgccgcagugcgcgcgcc

SEQ ID NO: 437109 - RNA, 21 nt, Bordetella pertussis
cgccgcauaccuuggcgccca

SEQ ID NO: 437110 - RNA, 15 nt, Bordetella pertussis
cgccgcaugcggcgg

SEQ ID NO: 437111 - RNA, 17 nt, Bordetella pertussis
cgccgcaugcggcggcu

SEQ ID NO: 437112 - RNA, 21 nt, Bordetella pertussis
cgccgcaugggcgcgcccggc

SEQ ID NO: 437113 - RNA, 23 nt, Bordetella pertussis
cgccgcauuuccucgaccagcgc

SEQ ID NO: 437114 - RNA, 13 nt, Bordetella pertussis
cgccgccaccagc

SEQ ID NO: 437115 - RNA, 22 nt, Bordetella pertussis
cgccgccauggugccgcgcagg

SEQ ID NO: 437116 - RNA, 17 nt, Bordetella pertussis
cgccgcccaccaccagc

SEQ ID NO: 437117 - RNA, 13 nt, Bordetella pertussis
cgccgcccacggc

SEQ ID NO: 437118 - RNA, 18 nt, Bordetella pertussis
cgccgcccagccggccga

SEQ ID NO: 437119 - RNA, 17 nt, Bordetella pertussis
cgccgcccccgcccagc

SEQ ID NO: 437120 - RNA, 22 nt, Bordetella pertussis
cgccgcccaugcgcauggccag

SEQ ID NO: 437121 - RNA, 13 nt, Bordetella pertussis
cgccgccccguca

SEQ ID NO: 437122 - RNA, 14 nt, Bordetella pertussis
cgccgcccgcaggc

SEQ ID NO: 437123 - RNA, 23 nt, Bordetella pertussis
cgccgccggcagggccagcgcca

SEQ ID NO: 437124 - RNA, 14 nt, Bordetella pertussis
cgccgccggccagc

SEQ ID NO: 437125 - RNA, 15 nt, Bordetella pertussis
cgccgccggccagcu

SEQ ID NO: 437126 - RNA, 13 nt, Bordetella pertussis
cgccgccggccca

SEQ ID NO: 437127 - RNA, 15 nt, Bordetella pertussis
cgccgccggcccgcc

SEQ ID NO: 437128 - RNA, 17 nt, Bordetella pertussis
cgccgccggcccgccac

SEQ ID NO: 437129 - RNA, 14 nt, Bordetella pertussis
cgccgccggccugc

SEQ ID NO: 437130 - RNA, 15 nt, Bordetella pertussis
cgccgccggccugcu

SEQ ID NO: 437131 - RNA, 13 nt, Bordetella pertussis
cgccgccggcgcg

SEQ ID NO: 437132 - RNA, 13 nt, Bordetella pertussis
cgccgccggcgga

SEQ ID NO: 437133 - RNA, 14 nt, Bordetella pertussis
cgccgccgggccug

SEQ ID NO: 437134 - RNA, 15 nt, Bordetella pertussis
cgccgccgggccugc

SEQ ID NO: 437135 - RNA, 16 nt, Bordetella pertussis
cgccgccgggccugcc

SEQ ID NO: 437136 - RNA, 19 nt, Bordetella pertussis
cgccgccggcgucgcucag

SEQ ID NO: 437137 - RNA, 18 nt, Bordetella pertussis
cgccgccgggcgcgcgcc

SEQ ID NO: 437138 - RNA, 23 nt, Bordetella pertussis
cgccgccguaggacagccccagc

SEQ ID NO: 437139 - RNA, 19 nt, Bordetella pertussis
cgccgccguuuucgcccgc

SEQ ID NO: 437140 - RNA, 16 nt, Bordetella pertussis
cgccgccucagcccgc

SEQ ID NO: 437141 - RNA, 14 nt, Bordetella pertussis
cgccgccucaggcc

SEQ ID NO: 437142 - RNA, 17 nt, Bordetella pertussis
cgccgccucaggccggc

SEQ ID NO: 437143 - RNA, 18 nt, Bordetella pertussis
cgccgccucgaccggcga

SEQ ID NO: 437144 - RNA, 14 nt, Bordetella pertussis
cgccgccucgcgcu

SEQ ID NO: 437145 - RNA, 14 nt, Bordetella pertussis
cgccgccuggcccg

SEQ ID NO: 437146 - RNA, 18 nt, Bordetella pertussis
cgccgccuucaccggccc

SEQ ID NO: 437147 - RNA, 18 nt, Bordetella pertussis
cgccgccuuggacgcgcu

SEQ ID NO: 437148 - RNA, 23 nt, Bordetella pertussis
cgccgcgacacaaggcggccgcg

SEQ ID NO: 437149 - RNA, 16 nt, Bordetella pertussis
cgccgcgaccaccagc

SEQ ID NO: 437150 - RNA, 20 nt, Bordetella pertussis
cgccgcgaccaccagcacca

SEQ ID NO: 437151 - RNA, 22 nt, Bordetella pertussis
cgccgcgaucagcgcggccgcu

SEQ ID NO: 437152 - RNA, 19 nt, Bordetella pertussis
cgccgcgauggcgccggcc

SEQ ID NO: 437153 - RNA, 22 nt, Bordetella pertussis
cgccgcgauggcgccggccagc

SEQ ID NO: 437154 - RNA, 11 nt, Bordetella pertussis
cgccgcgcacg

SEQ ID NO: 437155 - RNA, 13 nt, Bordetella pertussis
cgccgcgcacggg

SEQ ID NO: 437156 - RNA, 23 nt, Bordetella pertussis
cgccgcgccagguaggccggcgc

SEQ ID NO: 437157 - RNA, 20 nt, Bordetella pertussis
cgccgcgcccagcagcgcca

SEQ ID NO: 437158 - RNA, 16 nt, Bordetella pertussis
cgccgcgcccagccgc

SEQ ID NO: 437159 - RNA, 15 nt, Bordetella pertussis
cgccgcgcccgcccc

SEQ ID NO: 437160 - RNA, 17 nt, Bordetella pertussis
cgccgcgcccgcccccu

SEQ ID NO: 437161 - RNA, 16 nt, Bordetella pertussis
cgccgcgcccggccgg

SEQ ID NO: 437162 - RNA, 19 nt, Bordetella pertussis
cgccgcgcccggccggccc

SEQ ID NO: 437163 - RNA, 19 nt, Bordetella pertussis
cgccgcgccgaacgcgcag

SEQ ID NO: 437164 - RNA, 13 nt, Bordetella pertussis
cgccgcgccgaag

SEQ ID NO: 437165 - RNA, 13 nt, Bordetella pertussis
cgccgcgccgccc

SEQ ID NO: 437166 - RNA, 16 nt, Bordetella pertussis
cgccgcgccgccgccu

SEQ ID NO: 437167 - RNA, 15 nt, Bordetella pertussis
cgccgcgccgcccgc

SEQ ID NO: 437168 - RNA, 14 nt, Bordetella pertussis
cgccgcgccggcgc

SEQ ID NO: 437169 - RNA, 15 nt, Bordetella pertussis
cgccgcgccggcgcg

SEQ ID NO: 437170 - RNA, 18 nt, Bordetella pertussis
cgccgcgccggcgcgcga

SEQ ID NO: 437171 - RNA, 16 nt, Bordetella pertussis
cgccgcgccuugcccg

SEQ ID NO: 437172 - RNA, 19 nt, Bordetella pertussis
cgccgcgcgacagccgcgc

SEQ ID NO: 437173 - RNA, 20 nt, Bordetella pertussis
cgccgcgcgacagccgcgcc

SEQ ID NO: 437174 - RNA, 23 nt, Bordetella pertussis
cgccgcgcgacagccgcgccagc

SEQ ID NO: 437175 - RNA, 14 nt, Bordetella pertussis
cgccgcgcgccgcg

SEQ ID NO: 437176 - RNA, 21 nt, Bordetella pertussis
cgccgcgccuucgaggccggc

SEQ ID NO: 437177 - RNA, 13 nt, Bordetella pertussis
cgccgcgcgcggc

SEQ ID NO: 437178 - RNA, 19 nt, Bordetella pertussis
cgccgcgcgcggccccggc

SEQ ID NO: 437179 - RNA, 16 nt, Bordetella pertussis
cgccgcgcucgcgcca

SEQ ID NO: 437180 - RNA, 21 nt, Bordetella pertussis
cgccgcgcucgcgccaggccc

SEQ ID NO: 437181 - RNA, 15 nt, Bordetella pertussis
cgccgcgcugccuga

SEQ ID NO: 437182 - RNA, 14 nt, Bordetella pertussis
cgccgcgcugugcg

SEQ ID NO: 437183 - RNA, 16 nt, Bordetella pertussis
cgccgcggcacggggc

SEQ ID NO: 437184 - RNA, 19 nt, Bordetella pertussis
cgccgcggcaggccccggc

SEQ ID NO: 437185 - RNA, 23 nt, Bordetella pertussis
cgccgcggcaggccccggcccgg

SEQ ID NO: 437186 - RNA, 21 nt, Bordetella pertussis
cgccgcggccagcgccgcgcc

SEQ ID NO: 437187 - RNA, 15 nt, Bordetella pertussis
cgccgcggccuggcc

SEQ ID NO: 437188 - RNA, 14 nt, Bordetella pertussis
cgccgcggccggcg

SEQ ID NO: 437189 - RNA, 20 nt, Bordetella pertussis
cgccgcggcgaugccggcca

SEQ ID NO: 437190 - RNA, 22 nt, Bordetella pertussis
cgccgcggcgaugccggccagc

SEQ ID NO: 437191 - RNA, 13 nt, Bordetella pertussis
cgccgcggcgcuu

SEQ ID NO: 437192 - RNA, 22 nt, Bordetella pertussis
cgccgcgggcaaagcccagcaa

SEQ ID NO: 437193 - RNA, 14 nt, Bordetella pertussis
cgccgcgggccugc

SEQ ID NO: 437194 - RNA, 13 nt, Bordetella pertussis
cgccgcgggcgcc

SEQ ID NO: 437195 - RNA, 16 nt, Bordetella pertussis
cgccgcgggcgccgcg

SEQ ID NO: 437196 - RNA, 17 nt, Bordetella pertussis
cgccgcguccgcccgcu

SEQ ID NO: 437197 - RNA, 23 nt, Bordetella pertussis
cgccgcgucgagcgcgacgcgcu

SEQ ID NO: 437198 - RNA, 23 nt, Bordetella pertussis
cgccgcguggcggcgcagcgccc

SEQ ID NO: 437199 - RNA, 23 nt, Bordetella pertussis
cgccgcgugguggcgcagauggg

SEQ ID NO: 437200 - RNA, 20 nt, Bordetella pertussis
cgccgcguucacgccggcgc

SEQ ID NO: 437201 - RNA, 15 nt, Bordetella pertussis
cgccgcucagcgcgg

SEQ ID NO: 437202 - RNA, 12 nt, Bordetella pertussis
cgccgcuccggc

SEQ ID NO: 437203 - RNA, 14 nt, Bordetella pertussis
cgccgcuccggcau

SEQ ID NO: 437204 - RNA, 12 nt, Bordetella pertussis
cgccgcucgacg

SEQ ID NO: 437205 - RNA, 14 nt, Bordetella pertussis
cgccgcucgucccc

SEQ ID NO: 437206 - RNA, 15 nt, Bordetella pertussis
cgccgcucguccccc

SEQ ID NO: 437207 - RNA, 13 nt, Bordetella pertussis
cgccgcucuuggc

SEQ ID NO: 437208 - RNA, 16 nt, Bordetella pertussis
cgccgcugccggccga

SEQ ID NO: 437209 - RNA, 22 nt, Bordetella pertussis
cgccgcugcgaaaaagcccgcg

SEQ ID NO: 437210 - RNA, 23 nt, Bordetella pertussis
cgccgcugcgaaaaagcccgcgc

SEQ ID NO: 437211 - RNA, 14 nt, Bordetella pertussis
cgccgcugcgcagc

SEQ ID NO: 437212 - RNA, 16 nt, Bordetella pertussis
cgccgcugcgcagcag

SEQ ID NO: 437213 - RNA, 17 nt, Bordetella pertussis
cgccgcugcgcagcagc

SEQ ID NO: 437214 - RNA, 15 nt, Bordetella pertussis
cgccgcuggccacgu

SEQ ID NO: 437215 - RNA, 17 nt, Bordetella pertussis
cgccgcuggccagccgc

SEQ ID NO: 437216 - RNA, 17 nt, Bordetella pertussis
cgccgcuggcggccgcg

SEQ ID NO: 437217 - RNA, 21 nt, Bordetella pertussis
cgccgcugucggucagcacuu

SEQ ID NO: 437218 - RNA, 22 nt, Bordetella pertussis
cgccgcuguggacgccgccggc

SEQ ID NO: 437219 - RNA, 15 nt, Bordetella pertussis
cgccgcuuucucccg

SEQ ID NO: 437220 - RNA, 19 nt, Bordetella pertussis
cgccggacugggcgucgcu

SEQ ID NO: 437221 - RNA, 13 nt, Bordetella pertussis
cgccggaggcgcg

SEQ ID NO: 437222 - RNA, 16 nt, Bordetella pertussis
cgccggaggcgcgcag

SEQ ID NO: 437223 - RNA, 17 nt, Bordetella pertussis
cgccggaucggccggca

SEQ ID NO: 437224 - RNA, 12 nt, Bordetella pertussis
cgccggcaaacc

SEQ ID NO: 437225 - RNA, 16 nt, Bordetella pertussis
cgccggcaaacccggc

SEQ ID NO: 437226 - RNA, 13 nt, Bordetella pertussis
cgccggcacccgg

SEQ ID NO: 437227 - RNA, 14 nt, Bordetella pertussis
cgccggcacccggc

SEQ ID NO: 437228 - RNA, 21 nt, Bordetella pertussis
cgccggcaggcgcgccagccc

SEQ ID NO: 437229 - RNA, 17 nt, Bordetella pertussis
cgccggcaucggcggcu

SEQ ID NO: 437230 - RNA, 20 nt, Bordetella pertussis
cgccggcaugaagcgcagca

SEQ ID NO: 437231 - RNA, 12 nt, Bordetella pertussis
cgccggccacca

SEQ ID NO: 437232 - RNA, 14 nt, Bordetella pertussis
cgccggccaccagc

SEQ ID NO: 437233 - RNA, 13 nt, Bordetella pertussis
cgccggccagcgc

SEQ ID NO: 437234 - RNA, 17 nt, Bordetella pertussis
cgccggccagcgcggca

SEQ ID NO: 437235 - RNA, 18 nt, Bordetella pertussis
cgccggccagcgcggcau

SEQ ID NO: 437236 - RNA, 14 nt, Bordetella pertussis
cgccggccagcggc

SEQ ID NO: 437237 - RNA, 14 nt, Bordetella pertussis
cgccggccagcugc

SEQ ID NO: 437238 - RNA, 15 nt, Bordetella pertussis
cgccggccaggauga

SEQ ID NO: 437239 - RNA, 12 nt, Bordetella pertussis
cgccggccaggg

SEQ ID NO: 437240 - RNA, 19 nt, Bordetella pertussis
cgccggccagggccaccac

SEQ ID NO: 437241 - RNA, 23 nt, Bordetella pertussis
cgccggccagggcgaugcggcgg

SEQ ID NO: 437242 - RNA, 20 nt, Bordetella pertussis
cgccggccaggucggcggcc

SEQ ID NO: 437243 - RNA, 23 nt, Bordetella pertussis
cgccggccaggucggcggccagc

SEQ ID NO: 437244 - RNA, 19 nt, Bordetella pertussis
cgccggccaguggcgcggc

SEQ ID NO: 437245 - RNA, 13 nt, Bordetella pertussis
cgccggcccagga

SEQ ID NO: 437246 - RNA, 11 nt, Bordetella pertussis
cgccggcccgc

SEQ ID NO: 437247 - RNA, 14 nt, Bordetella pertussis
cgccggccgccagc

SEQ ID NO: 437248 - RNA, 15 nt, Bordetella pertussis
cgccggccgccagca

SEQ ID NO: 437249 - RNA, 14 nt, Bordetella pertussis
cgccggccgcccgc

SEQ ID NO: 437250 - RNA, 17 nt, Bordetella pertussis
cgccggccgccuggccc

SEQ ID NO: 437251 - RNA, 15 nt, Bordetella pertussis
cgccggccgcgcgcg

SEQ ID NO: 437252 - RNA, 18 nt, Bordetella pertussis
cgccggccgcgcgcgcca

SEQ ID NO: 437253 - RNA, 16 nt, Bordetella pertussis
cgccggcccggcaaca

SEQ ID NO: 437254 - RNA, 17 nt, Bordetella pertussis
cgccggcccugccgccc

SEQ ID NO: 437255 - RNA, 16 nt, Bordetella pertussis
cgccggccgcggggcu

SEQ ID NO: 437256 - RNA, 14 nt, Bordetella pertussis
cgccggccgguggg

SEQ ID NO: 437257 - RNA, 15 nt, Bordetella pertussis
cgccggccuccagca

SEQ ID NO: 437258 - RNA, 16 nt, Bordetella pertussis
cgccggccugcgccag

SEQ ID NO: 437259 - RNA, 16 nt, Bordetella pertussis
cgccggccuggcgcgc

SEQ ID NO: 437260 - RNA, 14 nt, Bordetella pertussis
cgccggccugggcg

SEQ ID NO: 437261 - RNA, 19 nt, Bordetella pertussis
cgccggcgcaacgggccga

SEQ ID NO: 437262 - RNA, 16 nt, Bordetella pertussis
cgccggcgcccccagc

SEQ ID NO: 437263 - RNA, 13 nt, Bordetella pertussis
cgccggcgccgcc

SEQ ID NO: 437264 - RNA, 13 nt, Bordetella pertussis
cgccggcgcgcag

SEQ ID NO: 437265 - RNA, 14 nt, Bordetella pertussis
cgccggcgcgccgc

SEQ ID NO: 437266 - RNA, 16 nt, Bordetella pertussis
cgccggcgcgccggcc

SEQ ID NO: 437267 - RNA, 18 nt, Bordetella pertussis
cgccggcgcgccggccgc

SEQ ID NO: 437268 - RNA, 23 nt, Bordetella pertussis
cgccggcgcgcgaucucgggcag

SEQ ID NO: 437269 - RNA, 19 nt, Bordetella pertussis
cgccggcgcgcgcgcgccg

SEQ ID NO: 437270 - RNA, 20 nt, Bordetella pertussis
cgccggcggcaccgcgcagc

SEQ ID NO: 437271 - RNA, 11 nt, Bordetella pertussis
cgccggcggcc

SEQ ID NO: 437272 - RNA, 14 nt, Bordetella pertussis
cgccggcggccucc

SEQ ID NO: 437273 - RNA, 17 nt, Bordetella pertussis
cgccggcggccuggacc

SEQ ID NO: 437274 - RNA, 13 nt, Bordetella pertussis
cgccggcggcgcu

SEQ ID NO: 437275 - RNA, 15 nt, Bordetella pertussis
cgccggcgggcaggc

SEQ ID NO: 437276 - RNA, 17 nt, Bordetella pertussis
cgccggcucaggccagc

SEQ ID NO: 437277 - RNA, 15 nt, Bordetella pertussis
cgccggcucccgcgc

SEQ ID NO: 437278 - RNA, 24 nt, Bordetella pertussis
cgccggcuccgauagcggcgccgc

SEQ ID NO: 437279 - RNA, 15 nt, Bordetella pertussis
cgccggcuggcaugc

SEQ ID NO: 437280 - RNA, 17 nt, Bordetella pertussis
cgccggcugggcguucu

SEQ ID NO: 437281 - RNA, 17 nt, Bordetella pertussis
cgccggcuuccagcagc

SEQ ID NO: 437282 - RNA, 19 nt, Bordetella pertussis
cgccgggcagcgggccgca

SEQ ID NO: 437283 - RNA, 14 nt, Bordetella pertussis
cgccgggccgcgcc

SEQ ID NO: 437284 - RNA, 17 nt, Bordetella pertussis
cgccgggccggcgggca

SEQ ID NO: 437285 - RNA, 17 nt, Bordetella pertussis
cgccgggccuagcccgg

SEQ ID NO: 437286 - RNA, 17 nt, Bordetella pertussis
cgccgggcgccgcgccc

SEQ ID NO: 437287 - RNA, 13 nt, Bordetella pertussis
cgccgggcgcgcc

SEQ ID NO: 437288 - RNA, 18 nt, Bordetella pertussis
cgccgggcgcgccggcgg

SEQ ID NO: 437289 - RNA, 22 nt, Bordetella pertussis
cgccgggcgcgcgccggcggcc

SEQ ID NO: 437290 - RNA, 13 nt, Bordetella pertussis
cgccgggcgcgcu

SEQ ID NO: 437291 - RNA, 17 nt, Bordetella pertussis
cgccgggcgcgcugccc

SEQ ID NO: 437292 - RNA, 18 nt, Bordetella pertussis
cgccgggcgcggccaggc

SEQ ID NO: 437293 - RNA, 16 nt, Bordetella pertussis
cgccgggcggcgccgu

SEQ ID NO: 437294 - RNA, 14 nt, Bordetella pertussis
cgccgggccggcgg

SEQ ID NO: 437295 - RNA, 17 nt, Bordetella pertussis
cgccgggcgucuguauc

SEQ ID NO: 437296 - RNA, 21 nt, Bordetella pertussis
cgccgggcuccucgcccgacc

SEQ ID NO: 437297 - RNA, 21 nt, Bordetella pertussis
cgccgggcuggauccggcgcu

SEQ ID NO: 437298 - RNA, 23 nt, Bordetella pertussis
cgccgggcuggugcgccgugccc

SEQ ID NO: 437299 - RNA, 16 nt, Bordetella pertussis
cgccgguccagcgccc

SEQ ID NO: 437300 - RNA, 22 nt, Bordetella pertussis
cgccgguccgacgguagccggg

SEQ ID NO: 437301 - RNA, 15 nt, Bordetella pertussis
cgccggucgcggcgu

SEQ ID NO: 437302 - RNA, 14 nt, Bordetella pertussis
cgccggucggccgc

SEQ ID NO: 437303 - RNA, 17 nt, Bordetella pertussis
cgccggucggccgcucc

SEQ ID NO: 437304 - RNA, 22 nt, Bordetella pertussis
cgccggugauguacgcaucggc

SEQ ID NO: 437305 - RNA, 14 nt, Bordetella pertussis
cgccguacagccgc

SEQ ID NO: 437306 - RNA, 15 nt, Bordetella pertussis
cgccguacagccgcg

SEQ ID NO: 437307 - RNA, 16 nt, Bordetella pertussis
cgccguaccccagcau

SEQ ID NO: 437308 - RNA, 15 nt, Bordetella pertussis
cgccguacucgccgg

SEQ ID NO: 437309 - RNA, 22 nt, Bordetella pertussis
cgccguaggacagccccagcag

SEQ ID NO: 437310 - RNA, 17 nt, Bordetella pertussis
cgccgucgaagccggcg

SEQ ID NO: 437311 - RNA, 18 nt, Bordetella pertussis
cgccgucgacgucgguga

SEQ ID NO: 437312 - RNA, 22 nt, Bordetella pertussis
cgccgucgagcaucccggcgcu

SEQ ID NO: 437313 - RNA, 21 nt, Bordetella pertussis
cgccgucgauguagagggucu

SEQ ID NO: 437314 - RNA, 19 nt, Bordetella pertussis
cgccgucgcgcuguuccag

SEQ ID NO: 437315 - RNA, 24 nt, Bordetella pertussis
cgccgucgggggccggcucgcccc

SEQ ID NO: 437316 - RNA, 22 nt, Bordetella pertussis
cgccugcgccggguccggccgc

SEQ ID NO: 437317 - RNA, 17 nt, Bordetella pertussis
cgccugcgcgccgccuc

SEQ ID NO: 437318 - RNA, 16 nt, Bordetella pertussis
cgccgucugcgccgcc

SEQ ID NO: 437319 - RNA, 20 nt, Bordetella pertussis
cgccgucugugcgccccgcu

SEQ ID NO: 437320 - RNA, 14 nt, Bordetella pertussis
cgccugcggacggc

SEQ ID NO: 437321 - RNA, 11 nt, Bordetella pertussis
cgccugcggca

SEQ ID NO: 437322 - RNA, 23 nt, Bordetella pertussis
cgccugcguggcgggccgcgccg

SEQ ID NO: 437323 - RNA, 17 nt, Bordetella pertussis
cgccugcucacgccccg

SEQ ID NO: 437324 - RNA, 18 nt, Bordetella pertussis
cgccugcugggccgcgcu

SEQ ID NO: 437325 - RNA, 19 nt, Bordetella pertussis
cgccuggucgacgccggcg

SEQ ID NO: 437326 - RNA, 14 nt, Bordetella pertussis
cgccuggucgcgcg

SEQ ID NO: 437327 - RNA, 17 nt, Bordetella pertussis
cgccuguaucagcgccu

SEQ ID NO: 437328 - RNA, 19 nt, Bordetella pertussis
cgccuguaucagcgccugc

SEQ ID NO: 437329 - RNA, 21 nt, Bordetella pertussis
cgccuguaucagcgccugcag

SEQ ID NO: 437330 - RNA, 19 nt, Bordetella pertussis
cgccugugccagcuggccc

SEQ ID NO: 437331 - RNA, 21 nt, Bordetella pertussis
cgccuuacgcggcgcgcgccu

SEQ ID NO: 437332 - RNA, 20 nt, Bordetella pertussis
cgccuucggcgcgcacgcuc

SEQ ID NO: 437333 - RNA, 17 nt, Bordetella pertussis
cgccuucggcgcggcgg

SEQ ID NO: 437334 - RNA, 16 nt, Bordetella pertussis
cgccuucgucgcgcac

SEQ ID NO: 437335 - RNA, 16 nt, Bordetella pertussis
cgccuugacgcugcuc

SEQ ID NO: 437336 - RNA, 23 nt, Bordetella pertussis
cgccuugacgguggccgcggcgu

SEQ ID NO: 437337 - RNA, 13 nt, Bordetella pertussis
cgccuugcccggg

SEQ ID NO: 437338 - RNA, 20 nt, Bordetella pertussis
cgccuugccuugcgcggcca

SEQ ID NO: 437339 - RNA, 15 nt, Bordetella pertussis
cgcgaaagcacgcca

SEQ ID NO: 437340 - RNA, 14 nt, Bordetella pertussis
cgcgaagcgcgcca

SEQ ID NO: 437341 - RNA, 20 nt, Bordetella pertussis
cgcgaagcgcgccagcagcg

SEQ ID NO: 437342 - RNA, 13 nt, Bordetella pertussis
cgcgaagccgccc

SEQ ID NO: 437343 - RNA, 21 nt, Bordetella pertussis
cgcgaaggccgccccccuacg

SEQ ID NO: 437344 - RNA, 23 nt, Bordetella pertussis
cgcgacccgauagccgcgcgccu

SEQ ID NO: 437345 - RNA, 14 nt, Bordetella pertussis
cgcgaccgccgccu

SEQ ID NO: 437346 - RNA, 15 nt, Bordetella pertussis
cgcgaccgccgccuu

SEQ ID NO: 437347 - RNA, 12 nt, Bordetella pertussis
cgcgaccgccgc

SEQ ID NO: 437348 - RNA, 16 nt, Bordetella pertussis
cgcgaccgcgcggcgc

SEQ ID NO: 437349 - RNA, 13 nt, Bordetella pertussis
cgcgaccuugucu

SEQ ID NO: 437350 - RNA, 14 nt, Bordetella pertussis
cgcgacgaccccgc

SEQ ID NO: 437351 - RNA, 18 nt, Bordetella pertussis
cgcgacuggcccaggcgg

SEQ ID NO: 437352 - RNA, 19 nt, Bordetella pertussis
cgcgacuuccucgacccgc

SEQ ID NO: 437353 - RNA, 15 nt, Bordetella pertussis
cgcgagaccagcgga

SEQ ID NO: 437354 - RNA, 17 nt, Bordetella pertussis
cgcgagcaugcgcagcg

SEQ ID NO: 437355 - RNA, 17 nt, Bordetella pertussis
cgcgagccgcccacggg

SEQ ID NO: 437356 - RNA, 13 nt, Bordetella pertussis
cgcgaucaccgag

SEQ ID NO: 437357 - RNA, 23 nt, Bordetella pertussis
cgcgaucaccgagugggcggccu

SEQ ID NO: 437358 - RNA, 18 nt, Bordetella pertussis
cgcgauccuucgcggccg

SEQ ID NO: 437359 - RNA, 24 nt, Bordetella pertussis
cgcgaugcaugaaccgcagcgcca

SEQ ID NO: 437360 - RNA, 15 nt, Bordetella pertussis
cgcgaugcccgcgca

SEQ ID NO: 437361 - RNA, 14 nt, Bordetella pertussis
cgcgaugcgcagca

SEQ ID NO: 437362 - RNA, 16 nt, Bordetella pertussis
cgcgaugcgcagcagc

SEQ ID NO: 437363 - RNA, 14 nt, Bordetella pertussis
cgcgaugcgcgcgc

SEQ ID NO: 437364 - RNA, 20 nt, Bordetella pertussis
cgcgaugcgcgcgcgggcca

SEQ ID NO: 437365 - RNA, 22 nt, Bordetella pertussis
cgcgaugcgcgcgugcagcgcc

SEQ ID NO: 437366 - RNA, 14 nt, Bordetella pertussis
cgcgaugcgcggcc

SEQ ID NO: 437367 - RNA, 19 nt, Bordetella pertussis
cgcgaugcgcggcccggcc

SEQ ID NO: 437368 - RNA, 14 nt, Bordetella pertussis
cgcgaugcgucagg

SEQ ID NO: 437369 - RNA, 16 nt, Bordetella pertussis
cgcgauggcgccggcc

SEQ ID NO: 437370 - RNA, 20 nt, Bordetella pertussis
cgcgauggcgccggccagcg

SEQ ID NO: 437371 - RNA, 21 nt, Bordetella pertussis
cgcgauggcgccggccagcgc

SEQ ID NO: 437372 - RNA, 17 nt, Bordetella pertussis
cgcgauguccagcucca

SEQ ID NO: 437373 - RNA, 17 nt, Bordetella pertussis
cgcgaugucgcgcgcgc

SEQ ID NO: 437374 - RNA, 19 nt, Bordetella pertussis
cgcgauucccuggcgcgcc

SEQ ID NO: 437375 - RNA, 21 nt, Bordetella pertussis
cgcgauugaguucgcgcgccg

SEQ ID NO: 437376 - RNA, 21 nt, Bordetella pertussis
cgcgauuuccuugcgccgccc

SEQ ID NO: 437377 - RNA, 18 nt, Bordetella pertussis
cgcgauuucguccggggu

SEQ ID NO: 437378 - RNA, 22 nt, Bordetella pertussis
cgcgcaaaccgacgcggccagc

SEQ ID NO: 437379 - RNA, 20 nt, Bordetella pertussis
cgcgcaaccaggggcggcgc

SEQ ID NO: 437380 - RNA, 15 nt, Bordetella pertussis
cgcgcaacgccgcca

SEQ ID NO: 437381 - RNA, 20 nt, Bordetella pertussis
cgcgcaacgccgccaccagg

SEQ ID NO: 437382 - RNA, 17 nt, Bordetella pertussis
cgcgcaccgccugcugc

SEQ ID NO: 437383 - RNA, 13 nt, Bordetella pertussis
cgcgcaccugggc

SEQ ID NO: 437384 - RNA, 21 nt, Bordetella pertussis
cgcgcacgcgcucgggcagcu

SEQ ID NO: 437385 - RNA, 17 nt, Bordetella pertussis
cgcgcacgcuggcaucg

SEQ ID NO: 437386 - RNA, 14 nt, Bordetella pertussis
cgcgcacgcugggc

SEQ ID NO: 437387 - RNA, 14 nt, Bordetella pertussis
cgcgcacgggcgcc

SEQ ID NO: 437388 - RNA, 21 nt, Bordetella pertussis
cgcgcacguggaccagggacg

SEQ ID NO: 437389 - RNA, 19 nt, Bordetella pertussis
cgcgcacggugcgcacgau

SEQ ID NO: 437390 - RNA, 13 nt, Bordetella pertussis
cgcgcagacgcgc

SEQ ID NO: 437391 - RNA, 21 nt, Bordetella pertussis
cgcgcagacgcgcucaggcgg

SEQ ID NO: 437392 - RNA, 14 nt, Bordetella pertussis
cgcgcagcugccug

SEQ ID NO: 437393 - RNA, 14 nt, Bordetella pertussis
cgcgcaggcccuug

SEQ ID NO: 437394 - RNA, 13 nt, Bordetella pertussis
cgcgcaggccucg

SEQ ID NO: 437395 - RNA, 19 nt, Bordetella pertussis
cgcgcagggcggccggcac

SEQ ID NO: 437396 - RNA, 20 nt, Bordetella pertussis
cgcgcaggugugccagccgc

SEQ ID NO: 437397 - RNA, 21 nt, Bordetella pertussis
cgcgcaggugugccagccgcu

SEQ ID NO: 437398 - RNA, 17 nt, Bordetella pertussis
cgcgcaggguggcaucg

SEQ ID NO: 437399 - RNA, 23 nt, Bordetella pertussis
cgcgcauuucgaccugcgcaccg

SEQ ID NO: 437400 - RNA, 19 nt, Bordetella pertussis
cgcgccaagggcgugcgcu

SEQ ID NO: 437401 - RNA, 21 nt, Bordetella pertussis
cgcgccaaucagauggcgcag

SEQ ID NO: 437402 - RNA, 22 nt, Bordetella pertussis
cgcgccaaucagauggcgcagc

SEQ ID NO: 437403 - RNA, 16 nt, Bordetella pertussis
cgcgccauugccacgg

SEQ ID NO: 437404 - RNA, 12 nt, Bordetella pertussis
cgcgcccagccg

SEQ ID NO: 437405 - RNA, 14 nt, Bordetella pertussis
cgcgcccagcgcgc

SEQ ID NO: 437406 - RNA, 14 nt, Bordetella pertussis
cgcgcccagcuguc

SEQ ID NO: 437407 - RNA, 22 nt, Bordetella pertussis
cgcgcccagcuugaugccgccg

SEQ ID NO: 437408 - RNA, 21 nt, Bordetella pertussis
cgcgcccaggggccggcgcgc

SEQ ID NO: 437409 - RNA, 22 nt, Bordetella pertussis
cgcgcccagguccugcgccagc

SEQ ID NO: 437410 - RNA, 15 nt, Bordetella pertussis
cgcgcccccacgccg

SEQ ID NO: 437411 - RNA, 19 nt, Bordetella pertussis
cgcgcccgaggcgcgcagc

SEQ ID NO: 437412 - RNA, 19 nt, Bordetella pertussis
cgcgcccgcaggcggcggc

SEQ ID NO: 437413 - RNA, 15 nt, Bordetella pertussis
cgcgcccgccgcguc

SEQ ID NO: 437414 - RNA, 12 nt, Bordetella pertussis
cgcgcccgccgu

SEQ ID NO: 437415 - RNA, 15 nt, Bordetella pertussis
cgcgcccggcgcgcc

SEQ ID NO: 437416 - RNA, 14 nt, Bordetella pertussis
cgcgcccggcggcc

SEQ ID NO: 437417 - RNA, 15 nt, Bordetella pertussis
cgcgcccuggcgcgg

SEQ ID NO: 437418 - RNA, 24 nt, Bordetella pertussis
cgcgcccucguugacgccgacgau

SEQ ID NO: 437419 - RNA, 18 nt, Bordetella pertussis
cgcgccgcccacgccgcu

SEQ ID NO: 437420 - RNA, 15 nt, Bordetella pertussis
cgcgccgcccccgcc

SEQ ID NO: 437421 - RNA, 13 nt, Bordetella pertussis
cgcgccgcccgcu

SEQ ID NO: 437422 - RNA, 15 nt, Bordetella pertussis
cgcgccgcccgggcc

SEQ ID NO: 437423 - RNA, 13 nt, Bordetella pertussis
cgcgccgccggcc

SEQ ID NO: 437424 - RNA, 19 nt, Bordetella pertussis
cgcgccgccggccagccug

SEQ ID NO: 437425 - RNA, 14 nt, Bordetella pertussis
cgcgccgccgggcc

SEQ ID NO: 437426 - RNA, 20 nt, Bordetella pertussis
cgcgccgccgggccugcccg

SEQ ID NO: 437427 - RNA, 21 nt, Bordetella pertussis
cgcgccgccggugcaccaggc

SEQ ID NO: 437428 - RNA, 15 nt, Bordetella pertussis
cgcgccgccuggccc

SEQ ID NO: 437429 - RNA, 15 nt, Bordetella pertussis
cgcgccgcgccgccc

SEQ ID NO: 437430 - RNA, 16 nt, Bordetella pertussis
cgcgccgcgccgcccc

SEQ ID NO: 437431 - RNA, 13 nt, Bordetella pertussis
cgcgccgcgcgcg

SEQ ID NO: 437432 - RNA, 15 nt, Bordetella pertussis
cgcgccgcgcgcggc

SEQ ID NO: 437433 - RNA, 13 nt, Bordetella pertussis
cgcgccgcgcugc

SEQ ID NO: 437434 - RNA, 14 nt, Bordetella pertussis
cgcgccgcgccggg

SEQ ID NO: 437435 - RNA, 12 nt, Bordetella pertussis
cgcgccgcgccu

SEQ ID NO: 437436 - RNA, 13 nt, Bordetella pertussis
cgcgccgcggcgg

SEQ ID NO: 437437 - RNA, 12 nt, Bordetella pertussis
cgcgccgcgggc

SEQ ID NO: 437438 - RNA, 22 nt, Bordetella pertussis
cgcgccgcguugcagccacagg

SEQ ID NO: 437439 - RNA, 18 nt, Bordetella pertussis
cgcgccgguggccagcag

SEQ ID NO: 437440 - RNA, 22 nt, Bordetella pertussis
cgcgccguacagccgcggcaga

SEQ ID NO: 437441 - RNA, 16 nt, Bordetella pertussis
cgcgccguaccccagc

SEQ ID NO: 437442 - RNA, 14 nt, Bordetella pertussis
cgcgccgucggcgu

SEQ ID NO: 437443 - RNA, 15 nt, Bordetella pertussis
cgcgccuccagcucc

SEQ ID NO: 437444 - RNA, 14 nt, Bordetella pertussis
cgcgccucgaugau

SEQ ID NO: 437445 - RNA, 17 nt, Bordetella pertussis
cgcgccucggcgcgcgc

SEQ ID NO: 437446 - RNA, 14 nt, Bordetella pertussis
cgcgcgcccccagc

SEQ ID NO: 437447 - RNA, 15 nt, Bordetella pertussis
cgcgcgcccccagcg

SEQ ID NO: 437448 - RNA, 19 nt, Bordetella pertussis
cgcgcgcccccagcgccgu

SEQ ID NO: 437449 - RNA, 19 nt, Bordetella pertussis
cgcgccugagcugccaggc

SEQ ID NO: 437450 - RNA, 22 nt, Bordetella pertussis
cgcgcgccgcgccggggcggcu

SEQ ID NO: 437451 - RNA, 13 nt, Bordetella pertussis
cgcgcgccggcca

SEQ ID NO: 437452 - RNA, 15 nt, Bordetella pertussis
cgcgcgccggcgccg

SEQ ID NO: 437453 - RNA, 15 nt, Bordetella pertussis
cgcgcgccggcucga

SEQ ID NO: 437454 - RNA, 14 nt, Bordetella pertussis
cgcgcgccugcaug

SEQ ID NO: 437455 - RNA, 19 nt, Bordetella pertussis
cgcgcgccugcgcgccgcc

SEQ ID NO: 437456 - RNA, 13 nt, Bordetella pertussis
cgcgcgcgcacag

SEQ ID NO: 437457 - RNA, 15 nt, Bordetella pertussis
cgcgcgcgccgccua

SEQ ID NO: 437458 - RNA, 15 nt, Bordetella pertussis
cgcgcgcgccggcau

SEQ ID NO: 437459 - RNA, 15 nt, Bordetella pertussis
cgcgcgcgcgccgca

SEQ ID NO: 437460 - RNA, 15 nt, Bordetella pertussis
cgcgcgcgcgcgggc

SEQ ID NO: 437461 - RNA, 15 nt, Bordetella pertussis
cgcgcgcggccggca

SEQ ID NO: 437462 - RNA, 15 nt, Bordetella pertussis
cgcgcgcggccggcg

SEQ ID NO: 437463 - RNA, 12 nt, Bordetella pertussis
cgcgcgcggcgc

SEQ ID NO: 437464 - RNA, 19 nt, Bordetella pertussis
cgcgcgcggcgccgcgcgu

SEQ ID NO: 437465 - RNA, 15 nt, Bordetella pertussis
cgcgcgcgggcgccc

SEQ ID NO: 437466 - RNA, 21 nt, Bordetella pertussis
cgcgcgcggugucgccgccgc

SEQ ID NO: 437467 - RNA, 15 nt, Bordetella pertussis
cgcgcgcucaacgaa

SEQ ID NO: 437468 - RNA, 21 nt, Bordetella pertussis
cgcgcgcuucaggcgccgcag

SEQ ID NO: 437469 - RNA, 22 nt, Bordetella pertussis
cgcgcgcuuccucgaccagguc

SEQ ID NO: 437470 - RNA, 18 nt, Bordetella pertussis
cgcgcuggugcuggccga

SEQ ID NO: 437471 - RNA, 20 nt, Bordetella pertussis
cgcgcuguaggcgccggcgc

SEQ ID NO: 437472 - RNA, 21 nt, Bordetella pertussis
cgcgcuguucgggcgcggugc

SEQ ID NO: 437473 - RNA, 14 nt, Bordetella pertussis
cgcgcuucaggcgc

SEQ ID NO: 437474 - RNA, 13 nt, Bordetella pertussis
cgcgcuuccagga

SEQ ID NO: 437475 - RNA, 15 nt, Bordetella pertussis
cgcgcuucgagccgg

SEQ ID NO: 437476 - RNA, 18 nt, Bordetella pertussis
cgcgcuucucggugcgcc

SEQ ID NO: 437477 - RNA, 21 nt, Bordetella pertussis
cgcgcuucucggugcgccgcc

SEQ ID NO: 437478 - RNA, 23 nt, Bordetella pertussis
cgcgcuugagcggcucgccuccc

SEQ ID NO: 437479 - RNA, 16 nt, Bordetella pertussis
cgcgcuugaggcuggu

SEQ ID NO: 437480 - RNA, 20 nt, Bordetella pertussis
cgcgcuucuuggcgaccagg

SEQ ID NO: 437481 - RNA, 22 nt, Bordetella pertussis
cgcggacgccauggcggcggcc

SEQ ID NO: 437482 - RNA, 16 nt, Bordetella pertussis
cgcggcacguccgaga

SEQ ID NO: 437483 - RNA, 20 nt, Bordetella pertussis
cgcggcacguugucgagcag

SEQ ID NO: 437484 - RNA, 18 nt, Bordetella pertussis
cgcggcacugaugcuggu

SEQ ID NO: 437485 - RNA, 13 nt, Bordetella pertussis
cgcggcagccugg

SEQ ID NO: 437486 - RNA, 13 nt, Bordetella pertussis
cgcggcagcgccg

SEQ ID NO: 437487 - RNA, 18 nt, Bordetella pertussis
cgcggcaggccccggccc

SEQ ID NO: 437488 - RNA, 12 nt, Bordetella pertussis
cgcggcaggcgg

SEQ ID NO: 437489 - RNA, 22 nt, Bordetella pertussis
cgcggcauacgccgauggcgcg

SEQ ID NO: 437490 - RNA, 17 nt, Bordetella pertussis
cgcggcauagcccaggc

SEQ ID NO: 437491 - RNA, 20 nt, Bordetella pertussis
cgcggcauagcccaggccgc

SEQ ID NO: 437492 - RNA, 23 nt, Bordetella pertussis
cgcggcauagcccaggccgccgg

SEQ ID NO: 437493 - RNA, 16 nt, Bordetella pertussis
cgcggcauggcgccgc

SEQ ID NO: 437494 - RNA, 23 nt, Bordetella pertussis
cgcggcauggcgccgcgccgccg

SEQ ID NO: 437495 - RNA, 17 nt, Bordetella pertussis
cgcggccacgcccaagu

SEQ ID NO: 437496 - RNA, 17 nt, Bordetella pertussis
cgcggccacggccugcc

SEQ ID NO: 437497 - RNA, 13 nt, Bordetella pertussis
cgcggccagcacc

SEQ ID NO: 437498 - RNA, 18 nt, Bordetella pertussis
cgcggccagcaccggccc

SEQ ID NO: 437499 - RNA, 19 nt, Bordetella pertussis
cgcggccagcaccggccgc

SEQ ID NO: 437500 - RNA, 22 nt, Bordetella pertussis
cgcggccagcaccggccgccgc

SEQ ID NO: 437501 - RNA, 14 nt, Bordetella pertussis
cgcggccagcagcg

SEQ ID NO: 437502 - RNA, 23 nt, Bordetella pertussis
cgcggccagccacgccggcgcgc

SEQ ID NO: 437503 - RNA, 13 nt, Bordetella pertussis
cgcggccagcggc

SEQ ID NO: 437504 - RNA, 14 nt, Bordetella pertussis
cgcggccagcggca

SEQ ID NO: 437505 - RNA, 21 nt, Bordetella pertussis
cgcggccagcgcgucgagcag

SEQ ID NO: 437506 - RNA, 22 nt, Bordetella pertussis
cgcggccagggcugcggcggga

SEQ ID NO: 437507 - RNA, 14 nt, Bordetella pertussis
cgcggccaggguca

SEQ ID NO: 437508 - RNA, 17 nt, Bordetella pertussis
cgcggccauguccagca

SEQ ID NO: 437509 - RNA, 18 nt, Bordetella pertussis
cgcggccggccgcgccca

SEQ ID NO: 437510 - RNA, 16 nt, Bordetella pertussis
cgcggccggccugcuu

SEQ ID NO: 437511 - RNA, 16 nt, Bordetella pertussis
cgcggccggcgcgccg

SEQ ID NO: 437512 - RNA, 14 nt, Bordetella pertussis
cgcggccggcggcg

SEQ ID NO: 437513 - RNA, 23 nt, Bordetella pertussis
cgcggccguuggcgauggcgcgg

SEQ ID NO: 437514 - RNA, 19 nt, Bordetella pertussis
cgcggccgucaccgccgcc

SEQ ID NO: 437515 - RNA, 17 nt, Bordetella pertussis
cgcggccucgccggccu

SEQ ID NO: 437516 - RNA, 13 nt, Bordetella pertussis
cgcggccuggccg

SEQ ID NO: 437517 - RNA, 19 nt, Bordetella pertussis
cgcggccugggcggcgcgc

SEQ ID NO: 437518 - RNA, 15 nt, Bordetella pertussis
cgcggccuguccaua

SEQ ID NO: 437519 - RNA, 18 nt, Bordetella pertussis
cgcggcgaaggcgcggcu

SEQ ID NO: 437520 - RNA, 20 nt, Bordetella pertussis
cgcggcgaaggcgcggcugc

SEQ ID NO: 437521 - RNA, 22 nt, Bordetella pertussis
cgcggcggccaugcccaggccc

SEQ ID NO: 437522 - RNA, 13 nt, Bordetella pertussis
cgcggcgggccgg

SEQ ID NO: 437523 - RNA, 13 nt, Bordetella pertussis
cgcggcgggcgau

SEQ ID NO: 437524 - RNA, 13 nt, Bordetella pertussis
cgcggcgggcgcu

SEQ ID NO: 437525 - RNA, 13 nt, Bordetella pertussis
cgcggcgggcggc

SEQ ID NO: 437526 - RNA, 18 nt, Bordetella pertussis
cgcggcgggcucagcccg

SEQ ID NO: 437527 - RNA, 17 nt, Bordetella pertussis
cgcggcgggugccgcga

SEQ ID NO: 437528 - RNA, 18 nt, Bordetella pertussis
cgcggcgguccucgccgg

SEQ ID NO: 437529 - RNA, 16 nt, Bordetella pertussis
cgcggcgguccugcug

SEQ ID NO: 437530 - RNA, 16 nt, Bordetella pertussis
cgcggcggugccgccc

SEQ ID NO: 437531 - RNA, 18 nt, Bordetella pertussis
cgcggcgguuucggccgg

SEQ ID NO: 437532 - RNA, 13 nt, Bordetella pertussis
cgcggcugcgggc

SEQ ID NO: 437533 - RNA, 15 nt, Bordetella pertussis
cgcggcugcgggccg

SEQ ID NO: 437534 - RNA, 21 nt, Bordetella pertussis
cgcggcugggucggcgugacg

SEQ ID NO: 437535 - RNA, 20 nt, Bordetella pertussis
cgcggcugguggugccgcgc

SEQ ID NO: 437536 - RNA, 15 nt, Bordetella pertussis
cgcggcuguccuggc

SEQ ID NO: 437537 - RNA, 22 nt, Bordetella pertussis
cgcggcuugcagcggacggcgc

SEQ ID NO: 437538 - RNA, 21 nt, Bordetella pertussis
cgcggcuugguugucgcgcac

SEQ ID NO: 437539 - RNA, 18 nt, Bordetella pertussis
cgcgggcgcugacgccga

SEQ ID NO: 437540 - RNA, 19 nt, Bordetella pertussis
cgcgggcggcgccggccgc

SEQ ID NO: 437541 - RNA, 13 nt, Bordetella pertussis
cgcgggcggcgcg

SEQ ID NO: 437542 - RNA, 16 nt, Bordetella pertussis
cgcgggcggcgcgccc

SEQ ID NO: 437543 - RNA, 23 nt, Bordetella pertussis
cgcgggcggcgcgcccagcggca

SEQ ID NO: 437544 - RNA, 12 nt, Bordetella pertussis
cgcgggcggccc

SEQ ID NO: 437545 - RNA, 20 nt, Bordetella pertussis
cgcgggcggcuaggcgcagc

SEQ ID NO: 437546 - RNA, 21 nt, Bordetella pertussis
cgcgggcggcuaggcgcagca

SEQ ID NO: 437547 - RNA, 13 nt, Bordetella pertussis
cgcgggcgggccg

SEQ ID NO: 437548 - RNA, 16 nt, Bordetella pertussis
cgcggggacaggcaca

SEQ ID NO: 437549 - RNA, 19 nt, Bordetella pertussis
cgcggggacaggcacccau

SEQ ID NO: 437550 - RNA, 18 nt, Bordetella pertussis
cgcggggacaggcacccu

SEQ ID NO: 437551 - RNA, 17 nt, Bordetella pertussis
cgcggggacaggcaccu

SEQ ID NO: 437552 - RNA, 17 nt, Bordetella pertussis
cgcgggcuugcugcccc

SEQ ID NO: 437553 - RNA, 19 nt, Bordetella pertussis
cgcgggcuugcugcccccc

SEQ ID NO: 437554 - RNA, 23 nt, Bordetella pertussis
cgcggggauggcuuccugcggca

SEQ ID NO: 437555 - RNA, 13 nt, Bordetella pertussis
cgcggggcccuug

SEQ ID NO: 437556 - RNA, 16 nt, Bordetella pertussis
cgcggggccgguccgc

SEQ ID NO: 437557 - RNA, 23 nt, Bordetella pertussis
cgcgggggauagacccuccucgc

SEQ ID NO: 437558 - RNA, 17 nt, Bordetella pertussis
cgcgggggugcgcgaca

SEQ ID NO: 437559 - RNA, 16 nt, Bordetella pertussis
cgcggguaggcaaagc

SEQ ID NO: 437560 - RNA, 21 nt, Bordetella pertussis
cgcggguauucgaaggcagca

SEQ ID NO: 437561 - RNA, 18 nt, Bordetella pertussis
cgcggguccggcgugcca

SEQ ID NO: 437562 - RNA, 13 nt, Bordetella pertussis
cgcgggugcgcag

SEQ ID NO: 437563 - RNA, 20 nt, Bordetella pertussis
cgcggguggccgcuccagag

SEQ ID NO: 437564 - RNA, 16 nt, Bordetella pertussis
cgcggguggugcugcu

SEQ ID NO: 437565 - RNA, 17 nt, Bordetella pertussis
cgcgggugucgcucccc

SEQ ID NO: 437566 - RNA, 17 nt, Bordetella pertussis
cgcggguucgacgccgg

SEQ ID NO: 437567 - RNA, 23 nt, Bordetella pertussis
cgcggguucgacgccggcagcga

SEQ ID NO: 437568 - RNA, 24 nt, Bordetella pertussis
cgcggguuggucgucagcgccgcg

SEQ ID NO: 437569 - RNA, 17 nt, Bordetella pertussis
cgcgguaaugacgcagc

SEQ ID NO: 437570 - RNA, 19 nt, Bordetella pertussis
cgcgguaaugacgcagccg

SEQ ID NO: 437571 - RNA, 16 nt, Bordetella pertussis
cgcgguacgcaccgcc

SEQ ID NO: 437572 - RNA, 18 nt, Bordetella pertussis
cgcgguagguagcgcgca

SEQ ID NO: 437573 - RNA, 19 nt, Bordetella pertussis
cgcgguagguagcgcgcag

SEQ ID NO: 437574 - RNA, 20 nt, Bordetella pertussis
cgcgguagguagcgcgcagc

SEQ ID NO: 437575 - RNA, 23 nt, Bordetella pertussis
cgcgguauugcgccaccccgccg

SEQ ID NO: 437576 - RNA, 17 nt, Bordetella pertussis
cgcggucaucggcgacg

SEQ ID NO: 437577 - RNA, 20 nt, Bordetella pertussis
cgcgguccaccucgucgucc

SEQ ID NO: 437578 - RNA, 20 nt, Bordetella pertussis
cgcgguccacgcccuggcug

SEQ ID NO: 437579 - RNA, 14 nt, Bordetella pertussis
cgcgguccagcacc

SEQ ID NO: 437580 - RNA, 20 nt, Bordetella pertussis
cgcgguccagcaccagggcg

SEQ ID NO: 437581 - RNA, 16 nt, Bordetella pertussis
cgcgguccagccccug

SEQ ID NO: 437582 - RNA, 16 nt, Bordetella pertussis
cgcgguccacgcgggc

SEQ ID NO: 437583 - RNA, 14 nt, Bordetella pertussis
cgcgguccauggug

SEQ ID NO: 437584 - RNA, 21 nt, Bordetella pertussis
cgcgguccgcagcgcucgcac

SEQ ID NO: 437585 - RNA, 20 nt, Bordetella pertussis
cgcgguccugaccggcggcg

SEQ ID NO: 437586 - RNA, 23 nt, Bordetella pertussis
cgcggucgcagacgaugaagacg

SEQ ID NO: 437587 - RNA, 14 nt, Bordetella pertussis
cgcggucggcgggc

SEQ ID NO: 437588 - RNA, 23 nt, Bordetella pertussis
cgcggucguagcguucgccgucg

SEQ ID NO: 437589 - RNA, 22 nt, Bordetella pertussis
cgcggugcaagcggccggccug

SEQ ID NO: 437590 - RNA, 16 nt, Bordetella pertussis
cgcggugccugugccc

SEQ ID NO: 437591 - RNA, 16 nt, Bordetella pertussis
cgcggugcgccacgau

SEQ ID NO: 437592 - RNA, 22 nt, Bordetella pertussis
cgcggugcgggugggcgcgccg

SEQ ID NO: 437593 - RNA, 15 nt, Bordetella pertussis
cgcggugcugggcuu

SEQ ID NO: 437594 - RNA, 22 nt, Bordetella pertussis
cgcgguggccgcuucggcggcc

SEQ ID NO: 437595 - RNA, 15 nt, Bordetella pertussis
cgcgguggcgggcgu

SEQ ID NO: 437596 - RNA, 20 nt, Bordetella pertussis
cgcgguggcgggcgugcgga

SEQ ID NO: 437597 - RNA, 16 nt, Bordetella pertussis
cgcggugucgccgccg

SEQ ID NO: 437598 - RNA, 18 nt, Bordetella pertussis
cgcgguucaggcuugcag

SEQ ID NO: 437599 - RNA, 18 nt, Bordetella pertussis
cgcgguugcgguucuggg

SEQ ID NO: 437600 - RNA, 15 nt, Bordetella pertussis
cgcgguugagcgcca

SEQ ID NO: 437601 - RNA, 23 nt, Bordetella pertussis
cgcgguugguuugcggcgcgacc

SEQ ID NO: 437602 - RNA, 14 nt, Bordetella pertussis
cgcguagcccaugu

SEQ ID NO: 437603 - RNA, 15 nt, Bordetella pertussis
cgcguaggcgcgcgc

SEQ ID NO: 437604 - RNA, 16 nt, Bordetella pertussis
cgcguaggcgcgcgca

SEQ ID NO: 437605 - RNA, 18 nt, Bordetella pertussis
cgcguaguugucggcgca

SEQ ID NO: 437606 - RNA, 21 nt, Bordetella pertussis
cgcguauccagcaucaccagc

SEQ ID NO: 437607 - RNA, 16 nt, Bordetella pertussis
cgcguaugcggcagca

SEQ ID NO: 437608 - RNA, 12 nt, Bordetella pertussis
cgcgucaagggg

SEQ ID NO: 437609 - RNA, 14 nt, Bordetella pertussis
cgcguccggcgccc

SEQ ID NO: 437610 - RNA, 16 nt, Bordetella pertussis
cgcguccggcgcccgc

SEQ ID NO: 437611 - RNA, 19 nt, Bordetella pertussis
cgcguccggcgcccgccgc

SEQ ID NO: 437612 - RNA, 21 nt, Bordetella pertussis
cgcguccggcgcccgccgccg

SEQ ID NO: 437613 - RNA, 15 nt, Bordetella pertussis
cgcguccgcccgcuc

SEQ ID NO: 437614 - RNA, 16 nt, Bordetella pertussis
cgcguccucggccagc

SEQ ID NO: 437615 - RNA, 14 nt, Bordetella pertussis
cgcguccucggccu

SEQ ID NO: 437616 - RNA, 22 nt, Bordetella pertussis
cgcguccugccaguugccgccg

SEQ ID NO: 437617 - RNA, 23 nt, Bordetella pertussis
cgcguccugccaguugccgccgc

SEQ ID NO: 437618 - RNA, 20 nt, Bordetella pertussis
cgcguccugcgccaguugcg

SEQ ID NO: 437619 - RNA, 13 nt, Bordetella pertussis
cgcguccuggcgc

SEQ ID NO: 437620 - RNA, 21 nt, Bordetella pertussis
cgcguccugggccgagcgcgc

SEQ ID NO: 437621 - RNA, 18 nt, Bordetella pertussis
cgcguccuucgucggcgg

SEQ ID NO: 437622 - RNA, 13 nt, Bordetella pertussis
cgcgucggcgcgc

SEQ ID NO: 437623 - RNA, 16 nt, Bordetella pertussis
cgcgucuccagcgccg

SEQ ID NO: 437624 - RNA, 21 nt, Bordetella pertussis
cgcgucuccagcgccggcagc

SEQ ID NO: 437625 - RNA, 15 nt, Bordetella pertussis
cgcgucugggccgag

SEQ ID NO: 437626 - RNA, 17 nt, Bordetella pertussis
cgcgugaauaccgcgca

SEQ ID NO: 437627 - RNA, 13 nt, Bordetella pertussis
cgcguggccggcg

SEQ ID NO: 437628 - RNA, 14 nt, Bordetella pertussis
cgcguggcgcgcca

SEQ ID NO: 437629 - RNA, 14 nt, Bordetella pertussis
cgcguggcggcgca

SEQ ID NO: 437630 - RNA, 20 nt, Bordetella pertussis
cgcgugggcacccggccgcu

SEQ ID NO: 437631 - RNA, 13 nt, Bordetella pertussis
cgcgugggccagu

SEQ ID NO: 437632 - RNA, 16 nt, Bordetella pertussis
cgcgugggcggcggca

SEQ ID NO: 437633 - RNA, 20 nt, Bordetella pertussis
cgcguucaggucgccguucu

SEQ ID NO: 437634 - RNA, 14 nt, Bordetella pertussis
cgcguuccggccgc

SEQ ID NO: 437635 - RNA, 22 nt, Bordetella pertussis
cgcuaaggagaauccgcaggcg

SEQ ID NO: 437636 - RNA, 18 nt, Bordetella pertussis
cgcuacagggugccgcgc

SEQ ID NO: 437637 - RNA, 16 nt, Bordetella pertussis
cgcuaccccggcagcg

SEQ ID NO: 437638 - RNA, 17 nt, Bordetella pertussis
cgcuaccccggcagcgu

SEQ ID NO: 437639 - RNA, 23 nt, Bordetella pertussis
cgcuacccugcccauucccgccc

SEQ ID NO: 437640 - RNA, 21 nt, Bordetella pertussis
cgcuugucgaugacgcgccgc

SEQ ID NO: 437641 - RNA, 14 nt, Bordetella pertussis
cgcuuuuccccgcc

SEQ ID NO: 437642 - RNA, 14 nt, Bordetella pertussis
cgcuuuuuccugcu

SEQ ID NO: 437643 - RNA, 22 nt, Bordetella pertussis
cggaaacuggcuaaaaggaaau

SEQ ID NO: 437644 - RNA, 18 nt, Bordetella pertussis
cggaaauccguaguccag

SEQ ID NO: 437645 - RNA, 16 nt, Bordetella pertussis
cggaacgugccgucgg

SEQ ID NO: 437646 - RNA, 19 nt, Bordetella pertussis
cggaagacauggcgcgcgc

SEQ ID NO: 437647 - RNA, 16 nt, Bordetella pertussis
cggaagucgggcacca

SEQ ID NO: 437648 - RNA, 18 nt, Bordetella pertussis
cggaauggucaagcggcu

SEQ ID NO: 437649 - RNA, 19 nt, Bordetella pertussis
cggaauuggcggcgaucuc

SEQ ID NO: 437650 - RNA, 16 nt, Bordetella pertussis
cggacagggccccggc

SEQ ID NO: 437651 - RNA, 17 nt, Bordetella pertussis
cggacaggucggcgccc

SEQ ID NO: 437652 - RNA, 17 nt, Bordetella pertussis
cggacccaggccucggc

SEQ ID NO: 437653 - RNA, 15 nt, Bordetella pertussis
cggaccggugcccuc

SEQ ID NO: 437654 - RNA, 15 nt, Bordetella pertussis
cggacgaagccuagg

SEQ ID NO: 437655 - RNA, 20 nt, Bordetella pertussis
cggaccuugcgaggcccggc

SEQ ID NO: 437656 - RNA, 20 nt, Bordetella pertussis
cggacgagacaggcgcgcca

SEQ ID NO: 437657 - RNA, 15 nt, Bordetella pertussis
cggacgagcgcagca

SEQ ID NO: 437658 - RNA, 20 nt, Bordetella pertussis
cggacgcaaaaacgcccggc

SEQ ID NO: 437659 - RNA, 14 nt, Bordetella pertussis
cggacgccagcccu

SEQ ID NO: 437660 - RNA, 15 nt, Bordetella pertussis
cggacgcccugaacu

SEQ ID NO: 437661 - RNA, 15 nt, Bordetella pertussis
cggacgccgacuggg

SEQ ID NO: 437662 - RNA, 19 nt, Bordetella pertussis
cggacgccauggcggcggc

SEQ ID NO: 437663 - RNA, 14 nt, Bordetella pertussis
cggacgccuggcgc

SEQ ID NO: 437664 - RNA, 13 nt, Bordetella pertussis
cggacgcgcgccg

SEQ ID NO: 437665 - RNA, 23 nt, Bordetella pertussis
cggacggcgcggaucgugcgcca

SEQ ID NO: 437666 - RNA, 16 nt, Bordetella pertussis
cggacggcgggcgccc

SEQ ID NO: 437667 - RNA, 14 nt, Bordetella pertussis
cggacgggccaggc

SEQ ID NO: 437668 - RNA, 19 nt, Bordetella pertussis
cggacggguaucgucgacc

SEQ ID NO: 437669 - RNA, 20 nt, Bordetella pertussis
cggagaaaucgccgccggcg

SEQ ID NO: 437670 - RNA, 16 nt, Bordetella pertussis
cggagccaguccccgc

SEQ ID NO: 437671 - RNA, 19 nt, Bordetella pertussis
cggagccaguccccgcagg

SEQ ID NO: 437672 - RNA, 12 nt, Bordetella pertussis
cggagccgcgca

SEQ ID NO: 437673 - RNA, 13 nt, Bordetella pertussis
cggagccgcgcac

SEQ ID NO: 437674 - RNA, 21 nt, Bordetella pertussis
cggagccgcgcacacauggcg

SEQ ID NO: 437675 - RNA, 20 nt, Bordetella pertussis
cggagcggcucuggaucgug

SEQ ID NO: 437676 - RNA, 21 nt, Bordetella pertussis
cggaggcggccgcgggcggcg

SEQ ID NO: 437677 - RNA, 14 nt, Bordetella pertussis
cggagggcuccagg

SEQ ID NO: 437678 - RNA, 16 nt, Bordetella pertussis
cggagguaugcacgac

SEQ ID NO: 437679 - RNA, 14 nt, Bordetella pertussis
cggaggucggcgca

SEQ ID NO: 437680 - RNA, 18 nt, Bordetella pertussis
cggagucggcgccgcgca

SEQ ID NO: 437681 - RNA, 19 nt, Bordetella pertussis
cggauacgaaaccaggccg

SEQ ID NO: 437682 - RNA, 20 nt, Bordetella pertussis
cggauauucgucggccgccg

SEQ ID NO: 437683 - RNA, 20 nt, Bordetella pertussis
cggaucaagcggcccgcgcc

SEQ ID NO: 437684 - RNA, 14 nt, Bordetella pertussis
cggaucgagcgcgg

SEQ ID NO: 437685 - RNA, 20 nt, Bordetella pertussis
cggaucgccgguagcgcugg

SEQ ID NO: 437686 - RNA, 22 nt, Bordetella pertussis
cggaucgccgguagcgcugggc

SEQ ID NO: 437687 - RNA, 17 nt, Bordetella pertussis
cggaucgcggcgcggcu

SEQ ID NO: 437688 - RNA, 16 nt, Bordetella pertussis
cggaucgugcgccacu

SEQ ID NO: 437689 - RNA, 17 nt, Bordetella pertussis
cggaugaagggcuggcc

SEQ ID NO: 437690 - RNA, 19 nt, Bordetella pertussis
cggaugaccugcgccaggu

SEQ ID NO: 437691 - RNA, 15 nt, Bordetella pertussis
cggaugaucgcgcag

SEQ ID NO: 437692 - RNA, 22 nt, Bordetella pertussis
cggaugaugcggcgccacgcag

SEQ ID NO: 437693 - RNA, 14 nt, Bordetella pertussis
cggaugcagcagcg

SEQ ID NO: 437694 - RNA, 21 nt, Bordetella pertussis
cggaugccgcccgugcagaag

SEQ ID NO: 437695 - RNA, 16 nt, Bordetella pertussis
cggaugccgucuuggc

SEQ ID NO: 437696 - RNA, 17 nt, Bordetella pertussis
cggaugcuugcggggca

SEQ ID NO: 437697 - RNA, 19 nt, Bordetella pertussis
cggauggcuuccugcaccu

SEQ ID NO: 437698 - RNA, 22 nt, Bordetella pertussis
cggaugguagaugcgcgcgacc

SEQ ID NO: 437699 - RNA, 17 nt, Bordetella pertussis
cggauggucgugcggca

SEQ ID NO: 437700 - RNA, 13 nt, Bordetella pertussis
cggauucccagcu

SEQ ID NO: 437701 - RNA, 15 nt, Bordetella pertussis
cggauugaccagcgc

SEQ ID NO: 437702 - RNA, 19 nt, Bordetella pertussis
cggauugaccagcgcggcc

SEQ ID NO: 437703 - RNA, 19 nt, Bordetella pertussis
cggauuguuuaucaggcag

SEQ ID NO: 437704 - RNA, 18 nt, Bordetella pertussis
cggauuugcuucaggucg

SEQ ID NO: 437705 - RNA, 21 nt, Bordetella pertussis
cggcaaaaaaaaccgcgcgcc

SEQ ID NO: 437706 - RNA, 13 nt, Bordetella pertussis
cggcaaaacggug

SEQ ID NO: 437707 - RNA, 17 nt, Bordetella pertussis
cggcaaacccggcaauc

SEQ ID NO: 437708 - RNA, 14 nt, Bordetella pertussis
cggcaaacccggcg

SEQ ID NO: 437709 - RNA, 18 nt, Bordetella pertussis
cggcaaacggcuggacgu

SEQ ID NO: 437710 - RNA, 15 nt, Bordetella pertussis
cggcaaagaucaccu

SEQ ID NO: 437711 - RNA, 21 nt, Bordetella pertussis
cggcaaagccgcugcgcuggc

SEQ ID NO: 437712 - RNA, 19 nt, Bordetella pertussis
cggcaacaucuccaccagc

SEQ ID NO: 437713 - RNA, 14 nt, Bordetella pertussis
cggcaacccgccca

SEQ ID NO: 437714 - RNA, 22 nt, Bordetella pertussis
cggcaacccgcccacgcggcgc

SEQ ID NO: 437715 - RNA, 17 nt, Bordetella pertussis
cggcaaccgucgccagc

SEQ ID NO: 437716 - RNA, 14 nt, Bordetella pertussis
cggcaagacggcgc

SEQ ID NO: 437717 - RNA, 14 nt, Bordetella pertussis
cggcaagaugccgg

SEQ ID NO: 437718 - RNA, 17 nt, Bordetella pertussis
cggcaagaugccggccu

SEQ ID NO: 437719 - RNA, 13 nt, Bordetella pertussis
cggcaagccgcgg

SEQ ID NO: 437720 - RNA, 14 nt, Bordetella pertussis
cggcaagccgcggc

SEQ ID NO: 437721 - RNA, 13 nt, Bordetella pertussis
cggcaagccuugc

SEQ ID NO: 437722 - RNA, 18 nt, Bordetella pertussis
cggcaagccuugcggccc

SEQ ID NO: 437723 - RNA, 23 nt, Bordetella pertussis
cggcaagccuugcggcccuugcg

SEQ ID NO: 437724 - RNA, 15 nt, Bordetella pertussis
cggcaagcgcucgcc

SEQ ID NO: 437725 - RNA, 21 nt, Bordetella pertussis
cggcaagcgcucgccggcgcg

SEQ ID NO: 437726 - RNA, 16 nt, Bordetella pertussis
cggcaaggggccagcc

SEQ ID NO: 437727 - RNA, 21 nt, Bordetella pertussis
cggcaaggggccagccuggcg

SEQ ID NO: 437728 - RNA, 14 nt, Bordetella pertussis
cggcaagucgacgc

SEQ ID NO: 437729 - RNA, 23 nt, Bordetella pertussis
cggcaaguucgcugccgggaucc

SEQ ID NO: 437730 - RNA, 20 nt, Bordetella pertussis
cggcaaucuugccgccgggc

SEQ ID NO: 437731 - RNA, 21 nt, Bordetella pertussis
cggcaaugacauccucgggcg

SEQ ID NO: 437732 - RNA, 24 nt, Bordetella pertussis
cggcaaugacauccucgggcgacu

SEQ ID NO: 437733 - RNA, 23 nt, Bordetella pertussis
cggcaauguccggggcgcuugcc

SEQ ID NO: 437734 - RNA, 21 nt, Bordetella pertussis
cggcaaugucgcaggccgcgg

SEQ ID NO: 437735 - RNA, 15 nt, Bordetella pertussis
cggcacaaccuggcg

SEQ ID NO: 437736 - RNA, 16 nt, Bordetella pertussis
cggcacaaccuggcgc

SEQ ID NO: 437737 - RNA, 18 nt, Bordetella pertussis
cggcaccacgaccggcuc

SEQ ID NO: 437738 - RNA, 13 nt, Bordetella pertussis
cggcaccagcagg

SEQ ID NO: 437739 - RNA, 14 nt, Bordetella pertussis
cggcaccagcgcca

SEQ ID NO: 437740 - RNA, 15 nt, Bordetella pertussis
cggcaccaggauccc

SEQ ID NO: 437741 - RNA, 19 nt, Bordetella pertussis
cggcaccaucgccgccugc

SEQ ID NO: 437742 - RNA, 20 nt, Bordetella pertussis
cggcaccaugcgcaccaggc

SEQ ID NO: 437743 - RNA, 13 nt, Bordetella pertussis
cggcaccggcagc

SEQ ID NO: 437744 - RNA, 19 nt, Bordetella pertussis
cggcaccucggccggggcg

SEQ ID NO: 437745 - RNA, 20 nt, Bordetella pertussis
cggcaccucggcgccgcggc

SEQ ID NO: 437746 - RNA, 22 nt, Bordetella pertussis
cggcaccuucuuccaggcgccc

SEQ ID NO: 437747 - RNA, 17 nt, Bordetella pertussis
cggcacgguuuccaggu

SEQ ID NO: 437748 - RNA, 15 nt, Bordetella pertussis
cggcacguaccaggc

SEQ ID NO: 437749 - RNA, 21 nt, Bordetella pertussis
cggcacguaccaggcgcugac

SEQ ID NO: 437750 - RNA, 13 nt, Bordetella pertussis
cggcacgucgcgc

SEQ ID NO: 437751 - RNA, 15 nt, Bordetella pertussis
cggcacugaugcugg

SEQ ID NO: 437752 - RNA, 15 nt, Bordetella pertussis
cggcagaucuccgga

SEQ ID NO: 437753 - RNA, 21 nt, Bordetella pertussis
cggcagaugaucuacgcgcgc

SEQ ID NO: 437754 - RNA, 23 nt, Bordetella pertussis
cggcagaugaucuacgcgcgcgc

SEQ ID NO: 437755 - RNA, 15 nt, Bordetella pertussis
cggcagcagcgcgcc

SEQ ID NO: 437756 - RNA, 16 nt, Bordetella pertussis
cggcagcagcgcgccg

SEQ ID NO: 437757 - RNA, 15 nt, Bordetella pertussis
cggcagcagggccac

SEQ ID NO: 437758 - RNA, 17 nt, Bordetella pertussis
cggcagcagggccacgc

SEQ ID NO: 437759 - RNA, 19 nt, Bordetella pertussis
cggcagcagggccacgccc

SEQ ID NO: 437760 - RNA, 15 nt, Bordetella pertussis
cggcauugcccaggu

SEQ ID NO: 437761 - RNA, 22 nt, Bordetella pertussis
cggcauuucgcauaccggccgc

SEQ ID NO: 437762 - RNA, 13 nt, Bordetella pertussis
cggccaccgccgu

SEQ ID NO: 437763 - RNA, 20 nt, Bordetella pertussis
cggccaccgcguugagcgcc

SEQ ID NO: 437764 - RNA, 21 nt, Bordetella pertussis
cggccaccucuucagcccggc

SEQ ID NO: 437765 - RNA, 16 nt, Bordetella pertussis
cggccacgaccggcuc

SEQ ID NO: 437766 - RNA, 16 nt, Bordetella pertussis
cggccacgcgccgccc

SEQ ID NO: 437767 - RNA, 18 nt, Bordetella pertussis
cggccacgcgccgcccgg

SEQ ID NO: 437768 - RNA, 19 nt, Bordetella pertussis
cggccacgcgccgcccggg

SEQ ID NO: 437769 - RNA, 21 nt, Bordetella pertussis
cggccacggccggcagcgccu

SEQ ID NO: 437770 - RNA, 20 nt, Bordetella pertussis
cggccacggccugcccgggc

SEQ ID NO: 437771 - RNA, 23 nt, Bordetella pertussis
cggccacggcggugaccaccagg

SEQ ID NO: 437772 - RNA, 14 nt, Bordetella pertussis
cggccacgcgcugc

SEQ ID NO: 437773 - RNA, 15 nt, Bordetella pertussis
cggccacgcgcugca

SEQ ID NO: 437774 - RNA, 14 nt, Bordetella pertussis
cggccacgggaccg

SEQ ID NO: 437775 - RNA, 17 nt, Bordetella pertussis
cggccacgucgcccaca

SEQ ID NO: 437776 - RNA, 15 nt, Bordetella pertussis
cggccacgucggcgg

SEQ ID NO: 437777 - RNA, 20 nt, Bordetella pertussis
cggccacgucggcggccgcc

SEQ ID NO: 437778 - RNA, 17 nt, Bordetella pertussis
cggccacgucggucgcu

SEQ ID NO: 437779 - RNA, 17 nt, Bordetella pertussis
cggccacuuucgcgcgc

SEQ ID NO: 437780 - RNA, 20 nt, Bordetella pertussis
cggccacuuucgcgcgcgcc

SEQ ID NO: 437781 - RNA, 21 nt, Bordetella pertussis
cggccacuuucgcgcgcgccu

SEQ ID NO: 437782 - RNA, 23 nt, Bordetella pertussis
cggccacuuucgcgcgcgccugc

SEQ ID NO: 437783 - RNA, 17 nt, Bordetella pertussis
cggccagcaagcgcgcc

SEQ ID NO: 437784 - RNA, 14 nt, Bordetella pertussis
cggccagcaccggc

SEQ ID NO: 437785 - RNA, 16 nt, Bordetella pertussis
cggccagcaccggccc

SEQ ID NO: 437786 - RNA, 11 nt, Bordetella pertussis
cggccagcagc

SEQ ID NO: 437787 - RNA, 13 nt, Bordetella pertussis
cggccagcagcac

SEQ ID NO: 437788 - RNA, 14 nt, Bordetella pertussis
cggccagccugccg

SEQ ID NO: 437789 - RNA, 16 nt, Bordetella pertussis
cggccagccugccgcg

SEQ ID NO: 437790 - RNA, 18 nt, Bordetella pertussis
cggccagccugccgcggc

SEQ ID NO: 437791 - RNA, 23 nt, Bordetella pertussis
cggccagccugccgcggccgccc

SEQ ID NO: 437792 - RNA, 15 nt, Bordetella pertussis
cggccagccugugcg

SEQ ID NO: 437793 - RNA, 18 nt, Bordetella pertussis
cggccagccugugcgcca

SEQ ID NO: 437794 - RNA, 17 nt, Bordetella pertussis
cggccagcgccgcgccg

SEQ ID NO: 437795 - RNA, 14 nt, Bordetella pertussis
cggccagcgccugg

SEQ ID NO: 437796 - RNA, 17 nt, Bordetella pertussis
cggccagcgccugggcg

SEQ ID NO: 437797 - RNA, 16 nt, Bordetella pertussis
cggccagcgcgcgcca

SEQ ID NO: 437798 - RNA, 16 nt, Bordetella pertussis
cggccagcgcgcggcc

SEQ ID NO: 437799 - RNA, 17 nt, Bordetella pertussis
cggccagcgcgcggcgc

SEQ ID NO: 437800 - RNA, 14 nt, Bordetella pertussis
cggccagcgcgcgu

SEQ ID NO: 437801 - RNA, 15 nt, Bordetella pertussis
cggccagcgcggcau

SEQ ID NO: 437802 - RNA, 16 nt, Bordetella pertussis
cggccagggcugcggc

SEQ ID NO: 437803 - RNA, 19 nt, Bordetella pertussis
cggccagggcugcggcggg

SEQ ID NO: 437804 - RNA, 20 nt, Bordetella pertussis
cggccaggggcagcucggug

SEQ ID NO: 437805 - RNA, 17 nt, Bordetella pertussis
cggccagggucaggggc

SEQ ID NO: 437806 - RNA, 21 nt, Bordetella pertussis
cggccagggucaggggcaggu

SEQ ID NO: 437807 - RNA, 14 nt, Bordetella pertussis
cggccaggggcgcu

SEQ ID NO: 437808 - RNA, 15 nt, Bordetella pertussis
cggccaggggcgcug

SEQ ID NO: 437809 - RNA, 18 nt, Bordetella pertussis
cggccaggggcgcugguc

SEQ ID NO: 437810 - RNA, 15 nt, Bordetella pertussis
cggccaggucggcgu

SEQ ID NO: 437811 - RNA, 17 nt, Bordetella pertussis
cggccaggucggcgucg

SEQ ID NO: 437812 - RNA, 20 nt, Bordetella pertussis
cggccaguacgucggacagg

SEQ ID NO: 437813 - RNA, 16 nt, Bordetella pertussis
cggcccaaggccccgc

SEQ ID NO: 437814 - RNA, 16 nt, Bordetella pertussis
cggcccacagcgcccc

SEQ ID NO: 437815 - RNA, 18 nt, Bordetella pertussis
cggcccacggccagcacu

SEQ ID NO: 437816 - RNA, 19 nt, Bordetella pertussis
cggcccagcacgccgcgcu

SEQ ID NO: 437817 - RNA, 17 nt, Bordetella pertussis
cggcccagcgcggcggc

SEQ ID NO: 437818 - RNA, 16 nt, Bordetella pertussis
cggcccagcguggcgg

SEQ ID NO: 437819 - RNA, 20 nt, Bordetella pertussis
cggcccaggauggcgccagc

SEQ ID NO: 437820 - RNA, 20 nt, Bordetella pertussis
cggccccgcaaggggccggc

SEQ ID NO: 437821 - RNA, 13 nt, Bordetella pertussis
cggccccgccagg

SEQ ID NO: 437822 - RNA, 20 nt, Bordetella pertussis
cggccccgccagggcggggc

SEQ ID NO: 437823 - RNA, 20 nt, Bordetella pertussis
cggcccgccacgcaggcggg

SEQ ID NO: 437824 - RNA, 15 nt, Bordetella pertussis
cggcccgccagggcg

SEQ ID NO: 437825 - RNA, 14 nt, Bordetella pertussis
cggcccgcgccagc

SEQ ID NO: 437826 - RNA, 17 nt, Bordetella pertussis
cggcccgcgccagcgcc

SEQ ID NO: 437827 - RNA, 18 nt, Bordetella pertussis
cggcccgcgccagcgcca

SEQ ID NO: 437828 - RNA, 12 nt, Bordetella pertussis
cggcccgcgcug

SEQ ID NO: 437829 - RNA, 20 nt, Bordetella pertussis
cggcccggaauaccgccagc

SEQ ID NO: 437830 - RNA, 22 nt, Bordetella pertussis
cggcccggaauaccgccagcuc

SEQ ID NO: 437831 - RNA, 17 nt, Bordetella pertussis
cggcccgggcguggcgu

SEQ ID NO: 437832 - RNA, 17 nt, Bordetella pertussis
cggcccgggugggcggc

SEQ ID NO: 437833 - RNA, 20 nt, Bordetella pertussis
cggcccggugcagccgccgc

SEQ ID NO: 437834 - RNA, 16 nt, Bordetella pertussis
cggcccgugccacggc

SEQ ID NO: 437835 - RNA, 21 nt, Bordetella pertussis
cggcccgugcgcaacgcgcgc

SEQ ID NO: 437836 - RNA, 23 nt, Bordetella pertussis
cggcccgugcgcaacgcgcgcgc

SEQ ID NO: 437837 - RNA, 21 nt, Bordetella pertussis
cggcccguuccacaggcgaug

SEQ ID NO: 437838 - RNA, 18 nt, Bordetella pertussis
cggcccguuggcaggcca

SEQ ID NO: 437839 - RNA, 18 nt, Bordetella pertussis
cggcccugccgcccuggc

SEQ ID NO: 437840 - RNA, 19 nt, Bordetella pertussis
cggcccugggccagccagc

SEQ ID NO: 437841 - RNA, 22 nt, Bordetella pertussis
cggcccugggccagccagcgcc

SEQ ID NO: 437842 - RNA, 23 nt, Bordetella pertussis
cggcccugggccagccagcgccg

SEQ ID NO: 437843 - RNA, 16 nt, Bordetella pertussis
cggcccuugcgcgaag

SEQ ID NO: 437844 - RNA, 21 nt, Bordetella pertussis
cggccgaaaccgccgcggcuu

SEQ ID NO: 437845 - RNA, 17 nt, Bordetella pertussis
cggccgaaccgcgcagc

SEQ ID NO: 437846 - RNA, 20 nt, Bordetella pertussis
cggccgacccgcggcccuug

SEQ ID NO: 437847 - RNA, 21 nt, Bordetella pertussis
cggccgacgggcggcugcugg

SEQ ID NO: 437848 - RNA, 19 nt, Bordetella pertussis
cggccgacguggaccgcgc

SEQ ID NO: 437849 - RNA, 20 nt, Bordetella pertussis
cggccgagaacgccgucggg

SEQ ID NO: 437850 - RNA, 15 nt, Bordetella pertussis
cggccgagcgggcca

SEQ ID NO: 437851 - RNA, 14 nt, Bordetella pertussis
cggccgagcuccuc

SEQ ID NO: 437852 - RNA, 20 nt, Bordetella pertussis
cggccgaggccagcgugccc

SEQ ID NO: 437853 - RNA, 23 nt, Bordetella pertussis
cggccgauagccgugaccugcuc

SEQ ID NO: 437854 - RNA, 20 nt, Bordetella pertussis
cggccgaugacaucgccgcu

SEQ ID NO: 437855 - RNA, 19 nt, Bordetella pertussis
cggccgauguuuuccuggg

SEQ ID NO: 437856 - RNA, 18 nt, Bordetella pertussis
cggccgcaagcuggccga

SEQ ID NO: 437857 - RNA, 12 nt, Bordetella pertussis
cggccgcagcag

SEQ ID NO: 437858 - RNA, 15 nt, Bordetella pertussis
cggccgcgcggccgu

SEQ ID NO: 437859 - RNA, 18 nt, Bordetella pertussis
cggccgcgcgcgccaugu

SEQ ID NO: 437860 - RNA, 14 nt, Bordetella pertussis
cggccgcgggcagc

SEQ ID NO: 437861 - RNA, 15 nt, Bordetella pertussis
cggccgcgggcagca

SEQ ID NO: 437862 - RNA, 14 nt, Bordetella pertussis
cggccgcgggccgc

SEQ ID NO: 437863 - RNA, 14 nt, Bordetella pertussis
cggccgcgggcggc

SEQ ID NO: 437864 - RNA, 17 nt, Bordetella pertussis
cggccgcgggcgugcug

SEQ ID NO: 437865 - RNA, 18 nt, Bordetella pertussis
cggccgcgggcgugcugg

SEQ ID NO: 437866 - RNA, 18 nt, Bordetella pertussis
cggccgcggguggccgcu

SEQ ID NO: 437867 - RNA, 19 nt, Bordetella pertussis
cggccgcggguggccgcuc

SEQ ID NO: 437868 - RNA, 17 nt, Bordetella pertussis
cggccgcggucagccag

SEQ ID NO: 437869 - RNA, 21 nt, Bordetella pertussis
cggccgcggggcuggccagcu

SEQ ID NO: 437870 - RNA, 23 nt, Bordetella pertussis
cggccgcggggcuggccagcugg

SEQ ID NO: 437871 - RNA, 18 nt, Bordetella pertussis
cggccgcguggccgcgcu

SEQ ID NO: 437872 - RNA, 21 nt, Bordetella pertussis
cggccgcguggccgcgcugcu

SEQ ID NO: 437873 - RNA, 14 nt, Bordetella pertussis
cggccgcgucggcc

SEQ ID NO: 437874 - RNA, 16 nt, Bordetella pertussis
cggccggccgggccgc

SEQ ID NO: 437875 - RNA, 15 nt, Bordetella pertussis
cggccggccugcggg

SEQ ID NO: 437876 - RNA, 13 nt, Bordetella pertussis
cggccggccaggc

SEQ ID NO: 437877 - RNA, 12 nt, Bordetella pertussis
cggccggcgcgc

SEQ ID NO: 437878 - RNA, 14 nt, Bordetella pertussis
cggccggcgcgccg

SEQ ID NO: 437879 - RNA, 18 nt, Bordetella pertussis
cggccggcgcgccggccu

SEQ ID NO: 437880 - RNA, 14 nt, Bordetella pertussis
cggccggcgcgcgc

SEQ ID NO: 437881 - RNA, 15 nt, Bordetella pertussis
cggccggcgcgugcu

SEQ ID NO: 437882 - RNA, 19 nt, Bordetella pertussis
cggccggcugcaccagcgc

SEQ ID NO: 437883 - RNA, 16 nt, Bordetella pertussis
cggccgggaaggcggg

SEQ ID NO: 437884 - RNA, 17 nt, Bordetella pertussis
cggccgggaccuuggcg

SEQ ID NO: 437885 - RNA, 16 nt, Bordetella pertussis
cggccgggagccuguc

SEQ ID NO: 437886 - RNA, 22 nt, Bordetella pertussis
cggccgggcaguucgggcacgc

SEQ ID NO: 437887 - RNA, 16 nt, Bordetella pertussis
cggccgggcgcccagc

SEQ ID NO: 437888 - RNA, 16 nt, Bordetella pertussis
cggccgggcgcggcgc

SEQ ID NO: 437889 - RNA, 18 nt, Bordetella pertussis
cggccgggcgcggcgccc

SEQ ID NO: 437890 - RNA, 20 nt, Bordetella pertussis
cggccgggcgcggcgcccgc

SEQ ID NO: 437891 - RNA, 17 nt, Bordetella pertussis
cggccggggcccgcggg

SEQ ID NO: 437892 - RNA, 15 nt, Bordetella pertussis
cggccggggccgccc

SEQ ID NO: 437893 - RNA, 17 nt, Bordetella pertussis
cggccggggccgcccug

SEQ ID NO: 437894 - RNA, 21 nt, Bordetella pertussis
cggccggggccgcccugccua

SEQ ID NO: 437895 - RNA, 22 nt, Bordetella pertussis
cggccggggucuugccgcgcag

SEQ ID NO: 437896 - RNA, 14 nt, Bordetella pertussis
cggccgggucggcc

SEQ ID NO: 437897 - RNA, 15 nt, Bordetella pertussis
cggccgggucggccu

SEQ ID NO: 437898 - RNA, 21 nt, Bordetella pertussis
cggccggucagcccaggcggg

SEQ ID NO: 437899 - RNA, 13 nt, Bordetella pertussis
cggccggucaggg

SEQ ID NO: 437900 - RNA, 14 nt, Bordetella pertussis
cggccguugcucca

SEQ ID NO: 437901 - RNA, 15 nt, Bordetella pertussis
cggccguuucaggcc

SEQ ID NO: 437902 - RNA, 22 nt, Bordetella pertussis
cggccguuucaggccugcggcg

SEQ ID NO: 437903 - RNA, 20 nt, Bordetella pertussis
cggccuaugugcaggccacc

SEQ ID NO: 437904 - RNA, 17 nt, Bordetella pertussis
cggccucagcggccgcu

SEQ ID NO: 437905 - RNA, 17 nt, Bordetella pertussis
cggccucaucgagcgcc

SEQ ID NO: 437906 - RNA, 19 nt, Bordetella pertussis
cggccucccgccgcccggc

SEQ ID NO: 437907 - RNA, 14 nt, Bordetella pertussis
cggccuccgcgcac

SEQ ID NO: 437908 - RNA, 21 nt, Bordetella pertussis
cggccugcuuggcagccuugg

SEQ ID NO: 437909 - RNA, 17 nt, Bordetella pertussis
cggccuggaacauggcc

SEQ ID NO: 437910 - RNA, 13 nt, Bordetella pertussis
cggccuggaccug

SEQ ID NO: 437911 - RNA, 12 nt, Bordetella pertussis
cggccuggcccc

SEQ ID NO: 437912 - RNA, 16 nt, Bordetella pertussis
cggccuggccgcgcgc

SEQ ID NO: 437913 - RNA, 17 nt, Bordetella pertussis
cggccuggccgcgcgcc

SEQ ID NO: 437914 - RNA, 16 nt, Bordetella pertussis
cggccuggcgcgcauc

SEQ ID NO: 437915 - RNA, 16 nt, Bordetella pertussis
cggccuggcgcgcggc

SEQ ID NO: 437916 - RNA, 17 nt, Bordetella pertussis
cggccuggcgcgcggcc

SEQ ID NO: 437917 - RNA, 15 nt, Bordetella pertussis
cggccuggcgggccg

SEQ ID NO: 437918 - RNA, 19 nt, Bordetella pertussis
cggccuggcgggccgaggc

SEQ ID NO: 437919 - RNA, 20 nt, Bordetella pertussis
cggccugggcgcgaugggcc

SEQ ID NO: 437920 - RNA, 15 nt, Bordetella pertussis
cggccugggaggcgc

SEQ ID NO: 437921 - RNA, 23 nt, Bordetella pertussis
cggccuggucaugacgggcggcg

SEQ ID NO: 437922 - RNA, 13 nt, Bordetella pertussis
cggccuucgccgg

SEQ ID NO: 437923 - RNA, 15 nt, Bordetella pertussis
cggccuucugcgcca

SEQ ID NO: 437924 - RNA, 17 nt, Bordetella pertussis
cggccuucugcgccagc

SEQ ID NO: 437925 - RNA, 15 nt, Bordetella pertussis
cggccuugccggcca

SEQ ID NO: 437926 - RNA, 15 nt, Bordetella pertussis
cggccuugccggugg

SEQ ID NO: 437927 - RNA, 22 nt, Bordetella pertussis
cggccuugcgggccggcugggc

SEQ ID NO: 437928 - RNA, 21 nt, Bordetella pertussis
cggccuuggccauguccuggc

SEQ ID NO: 437929 - RNA, 16 nt, Bordetella pertussis
cggccuuggccgcagc

SEQ ID NO: 437930 - RNA, 22 nt, Bordetella pertussis
cggccuuggccuuggcggcccc

SEQ ID NO: 437931 - RNA, 18 nt, Bordetella pertussis
cggccuugggcgcggcgg

SEQ ID NO: 437932 - RNA, 19 nt, Bordetella pertussis
cggccuugggcgcggcggc

SEQ ID NO: 437933 - RNA, 15 nt, Bordetella pertussis
cggcgaagccgcagc

SEQ ID NO: 437934 - RNA, 23 nt, Bordetella pertussis
cggcgaagccgcagcggcagcgc

SEQ ID NO: 437935 - RNA, 19 nt, Bordetella pertussis
cggcgaagccuucuucugc

SEQ ID NO: 437936 - RNA, 24 nt, Bordetella pertussis
cggcgaagccuugcgcggccagca

SEQ ID NO: 437937 - RNA, 19 nt, Bordetella pertussis
cggcgaaguccugcaugcc

SEQ ID NO: 437938 - RNA, 16 nt, Bordetella pertussis
cggcgaccgugcgcca

SEQ ID NO: 437939 - RNA, 18 nt, Bordetella pertussis
cggcgacgaacccgggcg

SEQ ID NO: 437940 - RNA, 15 nt, Bordetella pertussis
cggcgacgcagcacg

SEQ ID NO: 437941 - RNA, 17 nt, Bordetella pertussis
cggcgacggcgucggcc

SEQ ID NO: 437942 - RNA, 20 nt, Bordetella pertussis
cggcgacggcgucggccugg

SEQ ID NO: 437943 - RNA, 13 nt, Bordetella pertussis
cggcgacggucag

SEQ ID NO: 437944 - RNA, 15 nt, Bordetella pertussis
cggcgauggcccggu

SEQ ID NO: 437945 - RNA, 16 nt, Bordetella pertussis
cggcgauggcgcgcgc

SEQ ID NO: 437946 - RNA, 18 nt, Bordetella pertussis
cggcgauggcgcgcgcca

SEQ ID NO: 437947 - RNA, 20 nt, Bordetella pertussis
cggcgauggucugggugacg

SEQ ID NO: 437948 - RNA, 14 nt, Bordetella pertussis
cggcgauguggcgc

SEQ ID NO: 437949 - RNA, 15 nt, Bordetella pertussis
cggcgcaacccggcc

SEQ ID NO: 437950 - RNA, 17 nt, Bordetella pertussis
cggcgccacugccaggc

SEQ ID NO: 437951 - RNA, 13 nt, Bordetella pertussis
cggcgccagccag

SEQ ID NO: 437952 - RNA, 14 nt, Bordetella pertussis
cggcgccagccaga

SEQ ID NO: 437953 - RNA, 15 nt, Bordetella pertussis
cggcgccagccagau

SEQ ID NO: 437954 - RNA, 14 nt, Bordetella pertussis
cggcgccagccgcu

SEQ ID NO: 437955 - RNA, 15 nt, Bordetella pertussis
cggcgccagccgcuc

SEQ ID NO: 437956 - RNA, 13 nt, Bordetella pertussis
cggcgccagccgc

SEQ ID NO: 437957 - RNA, 16 nt, Bordetella pertussis
cggcgccagcgccccg

SEQ ID NO: 437958 - RNA, 14 nt, Bordetella pertussis
cggcgccagcuggg

SEQ ID NO: 437959 - RNA, 19 nt, Bordetella pertussis
cggcgccaguagcgccggc

SEQ ID NO: 437960 - RNA, 18 nt, Bordetella pertussis
cggcgccaugccgcgccc

SEQ ID NO: 437961 - RNA, 20 nt, Bordetella pertussis
cggcgccaugccgcgcccgc

SEQ ID NO: 437962 - RNA, 15 nt, Bordetella pertussis
cggcgccaugccggg

SEQ ID NO: 437963 - RNA, 17 nt, Bordetella pertussis
cggcgccaugcgcacca

SEQ ID NO: 437964 - RNA, 20 nt, Bordetella pertussis
cggcgccaugcgcaccaccg

SEQ ID NO: 437965 - RNA, 18 nt, Bordetella pertussis
cggcgccaugaucgccgg

SEQ ID NO: 437966 - RNA, 20 nt, Bordetella pertussis
cggcgcccggugcgcgcagg

SEQ ID NO: 437967 - RNA, 22 nt, Bordetella pertussis
cggcgcccggugcgcgcagggc

SEQ ID NO: 437968 - RNA, 18 nt, Bordetella pertussis
cggcgccgaccagguauc

SEQ ID NO: 437969 - RNA, 20 nt, Human
gccguccccagagcuacagg

SEQ ID NO: 437970 - RNA, 22 nt, Human
gcuagaauuugauaugugaaca

SEQ ID NO: 437971 - RNA, 19 nt, Human
guuuggacaaaauggaaua

SEQ ID NO: 437972 - RNA, 15 nt, Human
ugcaguucugaagaa

SEQ ID NO: 437973 - RNA, 21 nt, Human
uguuggacgagaaaacaauaa

SEQ ID NO: 437974 - RNA, 13 nt, Human
uugaucagcuuau

SEQ ID NO: 437975 - RNA, 16 nt, Human
uugcaagccagauuuu

SEQ ID NO: 437976 - RNA, 15 nt, Human
ccgguccuugcugca

SEQ ID NO: 437977 - RNA, 15 nt, Human
cgguccuugcugcac

SEQ ID NO: 437978 - RNA, 18 nt, Human
cucauggaauuggagcuc

SEQ ID NO: 437979 - RNA, 14 nt, Human
gaugcaguuguugc

SEQ ID NO: 437980 - RNA, 13 nt, Human
gaugcccacggcu

SEQ ID NO: 437981 - RNA, 17 nt, Human
gcaaauugucacaggac

SEQ ID NO: 437982 - RNA, 15 nt, Human
gccccaucugguccu

SEQ ID NO: 437983 - RNA, 17 nt, Human
aaccacaagacugcaca

SEQ ID NO: 437984 - RNA, 20 nt, Human
aagcacagugaucaaguuau

SEQ ID NO: 437985 - RNA, 17 nt, Human
acaagacugcacaucaa

SEQ ID NO: 437986 - RNA, 15 nt, Human
acggcuggagcugcc

SEQ ID NO: 437987 - RNA, 15 nt, Human
acuguccauucuucc

SEQ ID NO: 437988 - RNA, 13 nt, Human
agcacagccucuu

SEQ ID NO: 437989 - RNA, 17 nt, Human
aggguacacugccuucu

SEQ ID NO: 437990 - RNA, 21 nt, Human
agucaggaaagagaacuucca

SEQ ID NO: 437991 - RNA, 16 nt, Human
cagagcuacaggcccc

SEQ ID NO: 437992 - RNA, 21 nt, Human
ccacuuuccaauaaagaguuc

SEQ ID NO: 437993 - RNA, 23 nt, Human
ccguguguagguagaucuggucu

SEQ ID NO: 437994 - RNA, 18 nt, Human
ccuaagucccugcugccc

SEQ ID NO: 437995 - RNA, 18 nt, Human
gaagaugguaccaccagu

SEQ ID NO: 437996 - RNA, 13 nt, Human
gcccacggcugga

SEQ ID NO: 437997 - RNA, 19 nt, Human
gcccacggcuggagcugcc

SEQ ID NO: 437998 - RNA, 13 nt, Human
gcugaugcaguug

SEQ ID NO: 437999 - RNA, 11 nt, Human
ggagcugccuc

SEQ ID NO: 438000 - RNA, 12 nt, Human
ggaugcccacgg

SEQ ID NO: 438001 - RNA, 16 nt, Human
ucccauucaggaugcc

SEQ ID NO: 438002 - RNA, 19 nt, Human
ugagagacacacugaagaa

SEQ ID NO: 438003 - RNA, 19 nt, Human
cccauucaggaugcccacg

SEQ ID NO: 438004 - RNA, 22 nt, Human
ggagcugccucucucauccacu

SEQ ID NO: 438005 - RNA, 14 nt, Human
gggagcuuuuguag

SEQ ID NO: 438006 - RNA, 16 nt, Human
gguccuaagucccugc

SEQ ID NO: 438007 - RNA, 19 nt, Human
gguccuaagucccugcugc

SEQ ID NO: 438008 - RNA, 23 nt, Human
guccauucuuccucccauucagg

SEQ ID NO: 438009 - RNA, 20 nt, Human
guccuaagucccugcugccc

SEQ ID NO: 438010 - RNA, 22 nt, Human
uacaucccuuaccugggaaagg

SEQ ID NO: 438011 - RNA, 23 nt, Human
uauuuacaaaugggaaacaaaag

SEQ ID NO: 438012 - RNA, 15 nt, Human
uccccuucccacacu

SEQ ID NO: 438013 - RNA, 17 nt, Human
uccuaagucccugcugc

SEQ ID NO: 438014 - RNA, 12 nt, Human
ucgugggacagu

SEQ ID NO: 438015 - RNA, 18 nt, Human
ucuuucacaggggacagg

SEQ ID NO: 438016 - RNA, 18 nt, Human
uguuaaaacugggacagg

SEQ ID NO: 438017 - RNA, 16 nt, Human
aauuaagagagucuau

SEQ ID NO: 438018 - RNA, 16 nt, Human
aauuaguuuuauaugc

SEQ ID NO: 438019 - RNA, 23 nt, Human
agaaacacaacuauauuguuugc

SEQ ID NO: 438020 - RNA, 14 nt, Human
aagucccugcugcc

SEQ ID NO: 438021 - RNA, 15 nt, Human
accaggggccaugaa

SEQ ID NO: 438022 - RNA, 23 nt, Human
accagucugacuguuuccaucaa

SEQ ID NO: 438023 - RNA, 14 nt, Human
agccagauuuuccu

SEQ ID NO: 438024 - RNA, 15 nt, Human
aggacagcccuucuu

SEQ ID NO: 438025 - RNA, 18 nt, Human
auccuugaagauuuacca

SEQ ID NO: 438026 - RNA, 15 nt, Human
aucuauauuuuacau

SEQ ID NO: 438027 - RNA, 15 nt, Human
auuggaaaggcagcu

SEQ ID NO: 438028 - RNA, 13 nt, Human
caccugugccguc

SEQ ID NO: 438029 - RNA, 16 nt, Human
caggccccaucugguc

SEQ ID NO: 438030 - RNA, 17 nt, Human
caggccccaucuggucc

SEQ ID NO: 438031 - RNA, 21 nt, Human
gaaagugacaagcucacagac

SEQ ID NO: 438032 - RNA, 23 nt, Human
gcacagccucuuagaugcaguuc

SEQ ID NO: 438033 - RNA, 19 nt, Human
gcaguuguugcccacagcu

SEQ ID NO: 438034 - RNA, 20 nt, Human
ggguagcauuuguguugaag

SEQ ID NO: 438035 - RNA, 16 nt, Human
ucauggaauuggagcu

SEQ ID NO: 438036 - RNA, 20 nt, Human
agccgguccuugcugcaccu

SEQ ID NO: 438037 - RNA, 12 nt, Human
agcuacaggccc

SEQ ID NO: 438038 - RNA, 20 nt, Human
agcugccucucucauccacu

SEQ ID NO: 438039 - RNA, 16 nt, Human
agucccugcugcccuu

SEQ ID NO: 438040 - RNA, 20 nt, Human
aucaggguuaguauugucca

SEQ ID NO: 438041 - RNA, 18 nt, Human
auucaaauguauuacagu

SEQ ID NO: 438042 - RNA, 14 nt, Human
auucaaaugucuau

SEQ ID NO: 438043 - RNA, 22 nt, Human
cagugaaagaaaauaacaauaa

SEQ ID NO: 438044 - RNA, 20 nt, Human
cagugcaaauacucuggucc

SEQ ID NO: 438045 - RNA, 13 nt, Human
ccagagcuacagg

SEQ ID NO: 438046 - RNA, 17 nt, Human
ccagagcuacaggcccc

SEQ ID NO: 438047 - RNA, 20 nt, Human
ccauucaggaugcccacggc

SEQ ID NO: 438048 - RNA, 15 nt, Human
aaaaaauaacaauga

SEQ ID NO: 438049 - RNA, 18 nt, Human
guuuaugguuguauuauu

SEQ ID NO: 438050 - RNA, 15 nt, Human
uugcucauggaauug

SEQ ID NO: 438051 - RNA, 16 nt, Human
aaaugggaaacaaaag

SEQ ID NO: 438052 - RNA, 23 nt, Human
uaaaagacagugaaagaaaauaa

SEQ ID NO: 438053 - RNA, 21 nt, Human
acucuuauaucuauauuuuac

SEQ ID NO: 438054 - RNA, 21 nt, Human
cauuuucuucucacauuuaua

SEQ ID NO: 438055 - RNA, 18 nt, Human
gccguccccagagcuaca

SEQ ID NO: 438056 - RNA, 14 nt, Human
uaaccucuaaauuc

SEQ ID NO: 438057 - RNA, 24 nt, Human
cauaugaaaaggcuaagcuucacu

SEQ ID NO: 438058 - RNA, 15 nt, Human
gaauuuaaauagcuu

SEQ ID NO: 438059 - RNA, 13 nt, Human
uaggacugaauua

SEQ ID NO: 438060 - RNA, 19 nt, Human
auaaaagacaaggaaaaaa

SEQ ID NO: 438061 - RNA, 19 nt, Human
aauuugauaugugaacagu

SEQ ID NO: 438062 - RNA, 22 nt, Human
gaauuaaguuuuuuuuuaaaaa

SEQ ID NO: 438063 - RNA, 22 nt, Human
uuuauggcacuaguauuucuau

SEQ ID NO: 438064 - RNA, 16 nt, Human
uguguaagacaaaaag

SEQ ID NO: 438065 - RNA, 17 nt, Human
cauuuguauaaaauaau

SEQ ID NO: 438066 - RNA, 13 nt, Human
uuuaaaaaagaaa

SEQ ID NO: 438067 - RNA, 15 nt, Human
ugcuucuguuuuaua

SEQ ID NO: 438068 - RNA, 22 nt, Human
aaacuuuuggaagguauuuaau

SEQ ID NO: 438069 - RNA, 18 nt, Human
acugugugcuaaaacaag

SEQ ID NO: 438070 - RNA, 20 nt, Human
agccgguccuugcugcaccu

SEQ ID NO: 438071 - RNA, 14 nt, Human
cucugccucagaaa

SEQ ID NO: 438072 - RNA, 15 nt, Human
agguauuuaauaggu

SEQ ID NO: 438073 - RNA, 15 nt, Human
aaaaauaacaaugaa

SEQ ID NO: 438074 - RNA, 21 nt, Human
aguuguugcccacagcuguau

SEQ ID NO: 438075 - RNA, 18 nt, Human
ccaaccuggaguugaaaa

SEQ ID NO: 438076 - RNA, 18 nt, Human
aagaccucauuuugaagg

SEQ ID NO: 438077 - RNA, 23 nt, Human
ucuaggacugaauuaugaaacuu

SEQ ID NO: 438078 - RNA, 19 nt, Human
auuuucaugcuguucauga

SEQ ID NO: 438079 - RNA, 22 nt, Human
agaaaacaauaacgauaaaaga

SEQ ID NO: 438080 - RNA, 15 nt, Human
augguuguauuauuu

SEQ ID NO: 438081 - RNA, 11 nt, Human
caauaaaagac

SEQ ID NO: 438082 - RNA, 16 nt, Human
auaucuauauuuuaca

SEQ ID NO: 438083 - RNA, 14 nt, Human
ccuugaugaagaag

SEQ ID NO: 438084 - RNA, 17 nt, Human
agucugacuguuuccau

SEQ ID NO: 438085 - RNA, 14 nt, Human
aaaggaauuuaaaa

SEQ ID NO: 438086 - RNA, 15 nt, Human
uuagugaaauauuau

SEQ ID NO: 438087 - RNA, 15 nt, Human
ccagauccuggaaau

SEQ ID NO: 438088 - RNA, 13 nt, Human
aggcuagauguau

SEQ ID NO: 438089 - RNA, 14 nt, Human
auuuauguuuaauu

SEQ ID NO: 438090 - RNA, 16 nt, Human
gucucucacuuguuuu

SEQ ID NO: 438091 - RNA, 17 nt, Human
ugaaauauuauuuuaua

SEQ ID NO: 438092 - RNA, 13 nt, Human
ugauuauauguca

SEQ ID NO: 438093 - RNA, 20 nt, Human
aagaugguaccaccagucug

SEQ ID NO: 438094 - RNA, 15 nt, Human
caaaauggaauacuc

SEQ ID NO: 438095 - RNA, 20 nt, Human
aagacagugaaagaaaauaa

SEQ ID NO: 438096 - RNA, 17 nt, Human
aauaacaauaaaagaca

SEQ ID NO: 438097 - RNA, 22 nt, Human
ccacacuguccauucuuccucc

SEQ ID NO: 438098 - RNA, 15 nt, Human
uugaagcacagugau

SEQ ID NO: 438099 - RNA, 16 nt, Human
uagcuacuaauuuuaa

SEQ ID NO: 438100 - RNA, 14 nt, Human
aaaagaaacauuug

SEQ ID NO: 438101 - RNA, 22 nt, Human
uauuucuaugaaauauuauguu

SEQ ID NO: 438102 - RNA, 15 nt, Human
cagaauucauucacu

SEQ ID NO: 438103 - RNA, 14 nt, Human
guuccuucugcucc

SEQ ID NO: 438104 - RNA, 17 nt, Human
gaagauacugaaauaaa

SEQ ID NO: 438105 - RNA, 21 nt, Human
aaaugucuugcuugauuguau

SEQ ID NO: 438106 - RNA, 14 nt, Human
aagagugaaggauu

SEQ ID NO: 438107 - RNA, 21 nt, Human
aagucuuucacauuuaaauaa

SEQ ID NO: 438108 - RNA, 14 nt, Human
aauauaaauaaaaa

SEQ ID NO: 438109 - RNA, 13 nt, Human
ugggcauucaaau

SEQ ID NO: 438110 - RNA, 21 nt, Human
cugauauuggacaguaaaauc

SEQ ID NO: 438111 - RNA, 15 nt, Human
cuaguaauuggaaag

SEQ ID NO: 438112 - RNA, 23 nt, Human
cuuuccaauaaagaguuccuucu

SEQ ID NO: 438113 - RNA, 14 nt, Human
uaugaauuacauuu

SEQ ID NO: 438114 - RNA, 20 nt, Human
aauuuuuucucuaggaaaua

SEQ ID NO: 438115 - RNA, 19 nt, Human
auaaaagacagugaaagaa

SEQ ID NO: 438116 - RNA, 17 nt, Human
ucucacuuguuuuauuu

SEQ ID NO: 438117 - RNA, 13 nt, Human
cuaugaaauauua

SEQ ID NO: 438118 - RNA, 14 nt, Human
cacuguccauucuu

SEQ ID NO: 438119 - RNA, 20 nt, Human
ugcugcccuuccccuuccca

SEQ ID NO: 438120 - RNA, 16 nt, Human
uaaaagacaaggaaaa

SEQ ID NO: 438121 - RNA, 22 nt, Human
cacuaguauuucuaugaaauau

SEQ ID NO: 438122 - RNA, 20 nt, Human
guauuauuuuuuaaaaaaau

SEQ ID NO: 438123 - RNA, 22 nt, Human
auucaaugccccugaauuuaaa

SEQ ID NO: 438124 - RNA, 21 nt, Human
uuuucaggcuagauguaugua

SEQ ID NO: 438125 - RNA, 12 nt, Human
auucugaaagca

SEQ ID NO: 438126 - RNA, 21 nt, Human
gcacuguggguagacacacau

SEQ ID NO: 438127 - RNA, 18 nt, Human
auaauccuaaacauauga

SEQ ID NO: 438128 - RNA, 21 nt, Human
agcauuuguguugaagagguu

SEQ ID NO: 438129 - RNA, 20 nt, Human
aagggcuguuauaaucuuuc

SEQ ID NO: 438130 - RNA, 16 nt, Human
uaaaggaauuuaaaaa

SEQ ID NO: 438131 - RNA, 16 nt, Human
uaaaauccauacauuu

SEQ ID NO: 438132 - RNA, 18 nt, Human
cauggaauuggagcucgu

SEQ ID NO: 438133 - RNA, 19 nt, Human
cauuguugucugcaacucu

SEQ ID NO: 438134 - RNA, 12 nt, Human
cugcccuucccc

SEQ ID NO: 438135 - RNA, 17 nt, Human
uuaauaauuuuuaauua

SEQ ID NO: 438136 - RNA, 18 nt, Human
gaagcaaaauuuuuucuc

SEQ ID NO: 438137 - RNA, 19 nt, Human
gucccugcugcccuucccc

SEQ ID NO: 438138 - RNA, 22 nt, Human
agucuuucacauuuaaauaaag

SEQ ID NO: 438139 - RNA, 14 nt, Human
ccaaauauaaauaa

SEQ ID NO: 438140 - RNA, 22 nt, Human
aaacauguuuaucguauuugau

SEQ ID NO: 438141 - RNA, 12 nt, Human
acugaaaucaua

SEQ ID NO: 438142 - RNA, 23 nt, Human
ugucaauucuugccaaauauaaa

SEQ ID NO: 438143 - RNA, 22 nt, Human
agcagcauaaauguugacaugg

SEQ ID NO: 438144 - RNA, 17 nt, Human
uaacugauuuguaacaa

SEQ ID NO: 438145 - RNA, 13 nt, Human
cacauuuaaauaa

SEQ ID NO: 438146 - RNA, 13 nt, Human
uucuauaauuuaa

SEQ ID NO: 438147 - RNA, 14 nt, Human
uauuuauuuuaaua

SEQ ID NO: 438148 - RNA, 13 nt, Human
gaugcccacggcu

SEQ ID NO: 438149 - RNA, 22 nt, Human
uaaaacaagcacuaaacaaaga

SEQ ID NO: 438150 - RNA, 18 nt, Human
uauuuucuauaauuuaaa

SEQ ID NO: 438151 - RNA, 15 nt, Human
aaugauuaugaauua

SEQ ID NO: 438152 - RNA, 17 nt, Human
cucucauccacuuucca

SEQ ID NO: 438153 - RNA, 17 nt, Human
aaucuuauaauuuaaaa

SEQ ID NO: 438154 - RNA, 23 nt, Human
cuugauaaauggcuuccuggcaa

SEQ ID NO: 438155 - RNA, 13 nt, Human
agaaguaaaaaca

SEQ ID NO: 438156 - RNA, 21 nt, Human
gaauuuaaauagcuuuuuucu

SEQ ID NO: 438157 - RNA, 13 nt, Human
aaaauaacaauga

SEQ ID NO: 438158 - RNA, 16 nt, Human
auaugauucaaauguc

SEQ ID NO: 438159 - RNA, 17 nt, Human
aguauuucuaugaaaua

SEQ ID NO: 438160 - RNA, 17 nt, Human
uucucuaggaaauauuu

SEQ ID NO: 438161 - RNA, 16 nt, Human
ugaauuaguuuuauau

SEQ ID NO: 438162 - RNA, 20 nt, Human
auaacaaugcuguauuuuaa

SEQ ID NO: 438163 - RNA, 20 nt, Human
accucauggaauuggagcuc

SEQ ID NO: 438164 - RNA, 17 nt, Human
ucuuucacauuuaaaua

SEQ ID NO: 438165 - RNA, 15 nt, Human
cucaacaaacauaau

SEQ ID NO: 438166 - RNA, 20 nt, Human
ucucacuuguuuuauuuaac

SEQ ID NO: 438167 - RNA, 22 nt, Human
aauaugccccauucaacaucua

SEQ ID NO: 438168 - RNA, 22 nt, Human
caaugcuguauuuuaaaagaau

SEQ ID NO: 438169 - RNA, 20 nt, Human
gauuauauauauuuuuuucu

SEQ ID NO: 438170 - RNA, 17 nt, Human
acaaaugggaaacaaaa

SEQ ID NO: 438171 - RNA, 14 nt, Human
uuauaucuauauuu

SEQ ID NO: 438172 - RNA, 13 nt, Human
caauaaagaguuc

SEQ ID NO: 438173 - RNA, 20 nt, Human
gaaacaagucagucauucag

SEQ ID NO: 438174 - RNA, 15 nt, Human
aaucucaauauuuca

SEQ ID NO: 438175 - RNA, 16 nt, Human
aagcuacuuauuguag

SEQ ID NO: 438176 - RNA, 19 nt, Human
aguauuucuaugaaauauu

SEQ ID NO: 438177 - RNA, 22 nt, Human
cacuguccauucuuccucccau

SEQ ID NO: 438178 - RNA, 12 nt, Human
auucuuccuccc

SEQ ID NO: 438179 - RNA, 17 nt, Human
uccgucaacucauauuu

SEQ ID NO: 438180 - RNA, 13 nt, Human
agcugccucucuc

SEQ ID NO: 438181 - RNA, 20 nt, Human
aauuaaguuuuuuuuuaaaa

SEQ ID NO: 438182 - RNA, 16 nt, Human
aacaauaaaagacaag

SEQ ID NO: 438183 - RNA, 19 nt, Human
auuauuuuuuaaaaaaauu

SEQ ID NO: 438184 - RNA, 15 nt, Human
auaauccuaaacaua

SEQ ID NO: 438185 - RNA, 20 nt, Human
ucaagucuuucacauuuaaa

SEQ ID NO: 438186 - RNA, 17 nt, Human
caaacauauauaacaau

SEQ ID NO: 438187 - RNA, 16 nt, Human
aauuuaguauuuuguu

SEQ ID NO: 438188 - RNA, 15 nt, Human
auaaauaaaaauaau

SEQ ID NO: 438189 - RNA, 21 nt, Human
agggugauauuaaccaggggc

SEQ ID NO: 438190 - RNA, 20 nt, Human
uaaaagacaaggaaaaaaua

SEQ ID NO: 438191 - RNA, 20 nt, Human
agccuuuuuuugaaaaaaag

SEQ ID NO: 438192 - RNA, 22 nt, Human
caccagucugacuguuuccauc

SEQ ID NO: 438193 - RNA, 19 nt, Human
cucucacuuguuuuauuua

SEQ ID NO: 438194 - RNA, 14 nt, Human
agcugccucucuca

SEQ ID NO: 438195 - RNA, 22 nt, Human
uguuucagugcacuaaugugua

SEQ ID NO: 438196 - RNA, 13 nt, Human
uauuuauuuuaau

SEQ ID NO: 438197 - RNA, 21 nt, Human
aauuaaguuuuuuuuuaaaaa

SEQ ID NO: 438198 - RNA, 19 nt, Human
uuucaugcuguucaugaaa

SEQ ID NO: 438199 - RNA, 20 nt, Human
agcuacuaauuuuaaaaugu

SEQ ID NO: 438200 - RNA, 19 nt, Human
uaaccucuaaauucuuuca

SEQ ID NO: 438201 - RNA, 17 nt, Human
ugaaaaucuuauaauuu

SEQ ID NO: 438202 - RNA, 22 nt, Human
aagaauuucuaggacugaauua

SEQ ID NO: 438203 - RNA, 23 nt, Human
aauaauccucaguuuuugugaaa

SEQ ID NO: 438204 - RNA, 22 nt, Human
acagaaaaguugaauuuuacau

SEQ ID NO: 438205 - RNA, 15 nt, Human
uggacgagaaaacaa

SEQ ID NO: 438206 - RNA, 17 nt, Human
uucugagcauuuaauau

SEQ ID NO: 438207 - RNA, 17 nt, Human
uuauauuugaaauauug

SEQ ID NO: 438208 - RNA, 23 nt, Human
cuacacgagauacagaauuuuau

SEQ ID NO: 438209 - RNA, 19 nt, Human
uuauggcacuaguauuucu

SEQ ID NO: 438210 - RNA, 22 nt, Human
cacuuccaagagccuuuuuuug

SEQ ID NO: 438211 - RNA, 12 nt, Human
cucauggaauug

SEQ ID NO: 438212 - RNA, 19 nt, Human
ggaaaaaauaacaaugaaa

SEQ ID NO: 438213 - RNA, 14 nt, Human
cuggaaaucagggu

SEQ ID NO: 438214 - RNA, 16 nt, Human
cugagcauuuaauaug

SEQ ID NO: 438215 - RNA, 23 nt, Human
ggcuaagcuucacuguaaaauaa

SEQ ID NO: 438216 - RNA, 16 nt, Human
gacaaggaaaaaauaa

SEQ ID NO: 438217 - RNA, 18 nt, Human
acugccuucucaacucca

SEQ ID NO: 438218 - RNA, 15 nt, Human
aauucugaaagcaac

SEQ ID NO: 438219 - RNA, 21 nt, Human
aggcucuuuugggauuuuuga

SEQ ID NO: 438220 - RNA, 20 nt, Human
ucauucacucaacaaacaua

SEQ ID NO: 438221 - RNA, 18 nt, Human
uaaaauccauacauuugu

SEQ ID NO: 438222 - RNA, 16 nt, Human
uuucuauaauuuaaau

SEQ ID NO: 438223 - RNA, 17 nt, Human
uggacaaaauggaauac

SEQ ID NO: 438224 - RNA, 15 nt, Human
auagaaguaaaaaca

SEQ ID NO: 438225 - RNA, 17 nt, Human
aauucuugccaaauaua

SEQ ID NO: 438226 - RNA, 23 nt, Human
uauguuaaaacugggacagggga

SEQ ID NO: 438227 - RNA, 16 nt, Human
auccaaugaaaugagu

SEQ ID NO: 438228 - RNA, 14 nt, Human
cuaagucuuauaua

SEQ ID NO: 438229 - RNA, 17 nt, Human
ugcuguucaugaaagau

SEQ ID NO: 438230 - RNA, 16 nt, Human
gagcucgugggacagu

SEQ ID NO: 438231 - RNA, 15 nt, Human
acaaaugggaaacaa

SEQ ID NO: 438232 - RNA, 22 nt, Human
ugaagcaaaauuuuuucucuag

SEQ ID NO: 438233 - RNA, 23 nt, Human
cacauuggaaacaagucagucau

SEQ ID NO: 438234 - RNA, 19 nt, Human
aaauaugccccauucaaca

SEQ ID NO: 438235 - RNA, 21 nt, Human
gauaaaagacagugaaagaaa

SEQ ID NO: 438236 - RNA, 18 nt, Human
auuuauuacuguaagaaa

SEQ ID NO: 438237 - RNA, 19 nt, Human
cucugccucagaaaacaag

SEQ ID NO: 438238 - RNA, 20 nt, Human
aaaagacagugaaagaaaau

SEQ ID NO: 438239 - RNA, 22 nt, Human
caagcacuaaacaaagagugaa

SEQ ID NO: 438240 - RNA, 22 nt, Human
uaaaauaauuuuuauauuugaa

SEQ ID NO: 438241 - RNA, 15 nt, Human
auuugguaaggggaa

SEQ ID NO: 438242 - RNA, 20 nt, Human
cuguccauucuuccucccau

SEQ ID NO: 438243 - RNA, 15 nt, Human
ugaaauuguauuaca

SEQ ID NO: 438244 - RNA, 23 nt, Human
gauauuaaccaggggccaugaau

SEQ ID NO: 438245 - RNA, 15 nt, Human
guccauucuuccucc

SEQ ID NO: 438246 - RNA, 17 nt, Human
caauaacgauaaaagac

SEQ ID NO: 438247 - RNA, 19 nt, Human
cucuaaauucuuucauuuu

SEQ ID NO: 438248 - RNA, 23 nt, Human
gaaugagagacacacugaagaag

SEQ ID NO: 438249 - RNA, 19 nt, Human
cuagaguuuagcuggaaaa

SEQ ID NO: 438250 - RNA, 19 nt, Human
cugguccuaagucccugcu

SEQ ID NO: 438251 - RNA, 16 nt, Human
uaaauaaaaauaaucc

SEQ ID NO: 438252 - RNA, 14 nt, Human
uauaaauaaaaaua

SEQ ID NO: 438253 - RNA, 18 nt, Human
auuuguauaaaauaauuu

SEQ ID NO: 438254 - RNA, 20 nt, Human
accugauuucugagcauuua

SEQ ID NO: 438255 - RNA, 14 nt, Human
auccaaugaaauga

SEQ ID NO: 438256 - RNA, 16 nt, Human
gccucucucauccacu

SEQ ID NO: 438257 - RNA, 23 nt, Human
uccagguagaggguguguaagua

SEQ ID NO: 438258 - RNA, 14 nt, Human
uaauccuaaacaua

SEQ ID NO: 438259 - RNA, 14 nt, Human
uucuaugaaauauu

SEQ ID NO: 438260 - RNA, 17 nt, Human
cccugcugcccuucccc

SEQ ID NO: 438261 - RNA, 16 nt, Human
agguacuucaaauccu

SEQ ID NO: 438262 - RNA, 12 nt, Human
cuugguuuuaau

SEQ ID NO: 438263 - RNA, 19 nt, Human
uauacugugugcuaaaaca

SEQ ID NO: 438264 - RNA, 18 nt, Human
cagauaugauucaaaugu

SEQ ID NO: 438265 - RNA, 20 nt, Human
auuuugugauugauuauaug

SEQ ID NO: 438266 - RNA, 21 nt, Human
ucauucagauaugauucaaau

SEQ ID NO: 438267 - RNA, 18 nt, Human
ggaaacaagucagucauu

SEQ ID NO: 438268 - RNA, 23 nt, Human
uggcuugaguuuaaauuguaaua

SEQ ID NO: 438269 - RNA, 21 nt, Human
gaaaugaguuuuucuuuucau

SEQ ID NO: 438270 - RNA, 13 nt, Human
gguuuuaaagcuu

SEQ ID NO: 438271 - RNA, 21 nt, Human
uauaaaauaauuuuuauauuu

SEQ ID NO: 438272 - RNA, 20 nt, Human
agcuucacuguaaaauaaua

SEQ ID NO: 438273 - RNA, 18 nt, Human
uauagcuacuaauuuuaa

SEQ ID NO: 438274 - RNA, 21 nt, Human
augaauacuuuauaaaggauu

SEQ ID NO: 438275 - RNA, 18 nt, Human
cuccauuuuuagugaaau

SEQ ID NO: 438276 - RNA, 21 nt, Human
agccgguccuugcugcaccug

SEQ ID NO: 438277 - RNA, 15 nt, Human
uuugauaugugaaca

SEQ ID NO: 438278 - RNA, 19 nt, Human
uguccauucuuccucccau

SEQ ID NO: 438279 - RNA, 20 nt, Human
aaugaauacuuuauaaagga

SEQ ID NO: 438280 - RNA, 21 nt, Human
cuaagcuucacuguaaaauaa

SEQ ID NO: 438281 - RNA, 14 nt, Human
aauauuuauuuuaa

SEQ ID NO: 438282 - RNA, 20 nt, Human
cuaaaugucaaucagccuag

SEQ ID NO: 438283 - RNA, 15 nt, Human
uagggugauauuaac

SEQ ID NO: 438284 - RNA, 14 nt, Human
aacgucuuaaauau

SEQ ID NO: 438285 - RNA, 21 nt, Human
aaacgaggauugggaaaaagu

SEQ ID NO: 438286 - RNA, 16 nt, Human
gccaugugcuaguaau

SEQ ID NO: 438287 - RNA, 20 nt, Human
uguaaaggaauuuaaaaauc

SEQ ID NO: 438288 - RNA, 14 nt, Human
auagguuuggacaa

SEQ ID NO: 438289 - RNA, 17 nt, Human
augcccacggcuggagc

SEQ ID NO: 438290 - RNA, 14 nt, Human
auccuugaagauuu

SEQ ID NO: 438291 - RNA, 17 nt, Human
cugccucagaaaacaag

SEQ ID NO: 438292 - RNA, 14 nt, Human
uugggaaaaaguaa

SEQ ID NO: 438293 - RNA, 18 nt, Human
uaauagguuuggacaaaa

SEQ ID NO: 438294 - RNA, 15 nt, Human
auauugacuuuuuau

SEQ ID NO: 438295 - RNA, 12 nt, Human
aauacuuuauaa

SEQ ID NO: 438296 - RNA, 21 nt, Human
gguccuugcugcaccugugcc

SEQ ID NO: 438297 - RNA, 14 nt, Human
gauaaaagacagug

SEQ ID NO: 438298 - RNA, 14 nt, Human
ucuauaauuuaaau

SEQ ID NO: 438299 - RNA, 18 nt, Human
cugaaggguaauuauaua

SEQ ID NO: 438300 - RNA, 13 nt, Human
ugaaauuguauua

SEQ ID NO: 438301 - RNA, 22 nt, Human
cauaaauguugacaugggacau

SEQ ID NO: 438302 - RNA, 16 nt, Human
aagcauuuagauguau

SEQ ID NO: 438303 - RNA, 17 nt, Human
aguugauaaguacauga

SEQ ID NO: 438304 - RNA, 21 nt, Human
uuauagcuacuaauuuuaaaa

SEQ ID NO: 438305 - RNA, 17 nt, Human
ggcuggagcugccucuc

SEQ ID NO: 438306 - RNA, 21 nt, Human
cauucaaauguauuacagugg

SEQ ID NO: 438307 - RNA, 22 nt, Human
augguuguauuauuuuuuaaaa

SEQ ID NO: 438308 - RNA, 23 nt, Human
ucuagcaugucgucaaagcugaa

SEQ ID NO: 438309 - RNA, 20 nt, Human
uguaauaggcguaacuaauu

SEQ ID NO: 438310 - RNA, 23 nt, Human
uagacacacaugaaguccaagca

SEQ ID NO: 438311 - RNA, 17 nt, Human
uaauuugguuuucacau

SEQ ID NO: 438312 - RNA, 13 nt, Human
acacacaugaagu

SEQ ID NO: 438313 - RNA, 18 nt, Human
gaaaauaacaauaaaaga

SEQ ID NO: 438314 - RNA, 19 nt, Human
aaacaauaacgauaaaaga

SEQ ID NO: 438315 - RNA, 12 nt, Human
ucuuaagaagac

SEQ ID NO: 438316 - RNA, 14 nt, Human
caguucugaagaag

SEQ ID NO: 438317 - RNA, 22 nt, Human
ggacaguaaaauccacagacca

SEQ ID NO: 438318 - RNA, 17 nt, Human
cugguccuaagucccug

SEQ ID NO: 438319 - RNA, 20 nt, Human
ccaucugguccuaagucccu

SEQ ID NO: 438320 - RNA, 14 nt, Human
cucaacaaacauaa

SEQ ID NO: 438321 - RNA, 16 nt, Human
uauaugucacuuugcu

SEQ ID NO: 438322 - RNA, 20 nt, Human
acuuuauuuucuauaauuua

SEQ ID NO: 438323 - RNA, 14 nt, Human
aauauuauguuaaa

SEQ ID NO: 438324 - RNA, 16 nt, Human
ucuuauaauuuaaaau

SEQ ID NO: 438325 - RNA, 14 nt, Human
ugguauguuuucag

SEQ ID NO: 438326 - RNA, 22 nt, Human
cuaagucccugcugcccuuccc

SEQ ID NO: 438327 - RNA, 18 nt, Human
gcuccauuuuuagugaaa

SEQ ID NO: 438328 - RNA, 12 nt, Human
gaauuggagcuc

SEQ ID NO: 438329 - RNA, 14 nt, Human
auugucuagugaaa

SEQ ID NO: 438330 - RNA, 19 nt, Human
agucaaauugugugaaagg

SEQ ID NO: 438331 - RNA, 14 nt, Human
ucuaggaaauauuu

SEQ ID NO: 438332 - RNA, 17 nt, Human
ugaacuugguuuuaauu

SEQ ID NO: 438333 - RNA, 22 nt, Human
ccauucuuccucccauucagga

SEQ ID NO: 438334 - RNA, 18 nt, Human
caaaaagcuacuuauugu

SEQ ID NO: 438335 - RNA, 16 nt, Human
aagacugcacaucaaa

SEQ ID NO: 438336 - RNA, 13 nt, Human
cugccuucucaac

SEQ ID NO: 438337 - RNA, 13 nt, Human
ucacauuccugaa

SEQ ID NO: 438338 - RNA, 15 nt, Human
guaaggggaauugag

SEQ ID NO: 438339 - RNA, 19 nt, Human
caauucuugccaaauauaa

SEQ ID NO: 438340 - RNA, 16 nt, Human
aucuauauuuuacaua

SEQ ID NO: 438341 - RNA, 18 nt, Human
uauaacaaugcuguauuu

SEQ ID NO: 438342 - RNA, 21 nt, Human
ccuuuuuuugaaaaaaagcuu

SEQ ID NO: 438343 - RNA, 17 nt, Human
uuccaagugauugaaac

SEQ ID NO: 438344 - RNA, 14 nt, Human
uugugauugauuau

SEQ ID NO: 438345 - RNA, 20 nt, Human
aggauauucucacagcucca

SEQ ID NO: 438346 - RNA, 16 nt, Human
uuauaauuuaaaauau

SEQ ID NO: 438347 - RNA, 18 nt, Human
uauuuuguuucagugcac

SEQ ID NO: 438348 - RNA, 15 nt, Human
acucaacaaacauaa

SEQ ID NO: 438349 - RNA, 16 nt, Human
aaauaacaaugaaagu

SEQ ID NO: 438350 - RNA, 18 nt, Human
auauuuuuuucugaaauu

SEQ ID NO: 438351 - RNA, 15 nt, Human
acaaggaaaaaauaa

SEQ ID NO: 438352 - RNA, 19 nt, Human
agaguuuagcuggaaaagu

SEQ ID NO: 438353 - RNA, 16 nt, Human
uucaugcuguucauga

SEQ ID NO: 438354 - RNA, 15 nt, Human
auuguagcauccugg

SEQ ID NO: 438355 - RNA, 16 nt, Human
ccuccuuuuaaaguaa

SEQ ID NO: 438356 - RNA, 18 nt, Human
uaagcuucacuguaaaau

SEQ ID NO: 438357 - RNA, 21 nt, Human
aaagaaaauaacgauaaaaga

SEQ ID NO: 438358 - RNA, 19 nt, Human
uacucuuauaucuauauuu

SEQ ID NO: 438359 - RNA, 21 nt, Human
uagggugauauuaaccagggg

SEQ ID NO: 438360 - RNA, 17 nt, Human
cggcuggagcugccucu

SEQ ID NO: 438361 - RNA, 17 nt, Human
gcugcccuuccccuucc

SEQ ID NO: 438362 - RNA, 12 nt, Human
aauaauuuuuaa

SEQ ID NO: 438363 - RNA, 13 nt, Human
gaaccuaggguga

SEQ ID NO: 438364 - RNA, 15 nt, Human
uucacauuuaaauaa

SEQ ID NO: 438365 - RNA, 15 nt, Human
uuaauucugaaagca

SEQ ID NO: 438366 - RNA, 16 nt, Human
ucuugagguaaaagca

SEQ ID NO: 438367 - RNA, 13 nt, Human
uuuucuuuucauu

SEQ ID NO: 438368 - RNA, 16 nt, Human
cagggcucacagaauu

SEQ ID NO: 438369 - RNA, 21 nt, Human
uagaagucacauuccugaaca

SEQ ID NO: 438370 - RNA, 19 nt, Human
uguugaagagguuuuaaag

SEQ ID NO: 438371 - RNA, 15 nt, Human
gccguccccagagcu

SEQ ID NO: 438372 - RNA, 16 nt, Human
aaaguugaauuuuaca

SEQ ID NO: 438373 - RNA, 18 nt, Human
uucaaugccccugaauuu

SEQ ID NO: 438374 - RNA, 17 nt, Human
uuuccugggagcuuuug

SEQ ID NO: 438375 - RNA, 13 nt, Human
ccuccuuuuaaag

SEQ ID NO: 438376 - RNA, 16 nt, Human
cuucccacacugucca

SEQ ID NO: 438377 - RNA, 18 nt, Human
uuuuagugaaauauuauu

SEQ ID NO: 438378 - RNA, 22 nt, Human
accaaucaugaauuaguuuuau

SEQ ID NO: 438379 - RNA, 16 nt, Human
augcuguauuuuaaaa

SEQ ID NO: 438380 - RNA, 16 nt, Human
uaaacgucuuaaauau

SEQ ID NO: 438381 - RNA, 14 nt, Human
uggcuugaguuuaa

SEQ ID NO: 438382 - RNA, 15 nt, Human
uauuuucaugcuguu

SEQ ID NO: 438383 - RNA, 13 nt, Human
cacacugaagaag

SEQ ID NO: 438384 - RNA, 12 nt, Human
cuccauuuuuag

SEQ ID NO: 438385 - RNA, 17 nt, Human
uaauuuuuauauuugaa

SEQ ID NO: 438386 - RNA, 14 nt, Human
auuauauauauuuu

SEQ ID NO: 438387 - RNA, 13 nt, Human
uuaaaaaagaaac

SEQ ID NO: 438388 - RNA, 17 nt, Human
acaaaugcauuucuaaa

SEQ ID NO: 438389 - RNA, 16 nt, Human
auuuuaauaauguuuc

SEQ ID NO: 438390 - RNA, 17 nt, Human
ugguucccuugaugaag

SEQ ID NO: 438391 - RNA, 22 nt, Human
uggacgagaaaacaauaacgau

SEQ ID NO: 438392 - RNA, 20 nt, Human
aauuuugugaagcaaaauuu

SEQ ID NO: 438393 - RNA, 20 nt, Human
uuuaaauagcuuuuuucucu

SEQ ID NO: 438394 - RNA, 20 nt, Human
uauaugcuaagucuuauaua

SEQ ID NO: 438395 - RNA, 19 nt, Human
acucuuauaucuauauuuu

SEQ ID NO: 438396 - RNA, 19 nt, Human
uauauuuuugugauuuugu

SEQ ID NO: 438397 - RNA, 23 nt, Human
gcccacggcuggagcugccucuc

SEQ ID NO: 438398 - RNA, 13 nt, Human
ucuuauaauuuaa

SEQ ID NO: 438399 - RNA, 21 nt, Human
uuacauuuguauaaaauaauu

SEQ ID NO: 438400 - RNA, 21 nt, Human
ucauucacucaacaaacauaa

SEQ ID NO: 438401 - RNA, 16 nt, Human
cugugccguccccaga

SEQ ID NO: 438402 - RNA, 21 nt, Human
auuuuuucucuaggaaauauu

SEQ ID NO: 438403 - RNA, 16 nt, Human
aguugaauuuuacaug

SEQ ID NO: 438404 - RNA, 11 nt, Human
uucacagggga

SEQ ID NO: 438405 - RNA, 16 nt, Human
aaaguguuugaaagcu

SEQ ID NO: 438406 - RNA, 16 nt, Human
ugaaguccaagcauuu

SEQ ID NO: 438407 - RNA, 20 nt, Human
aagcuucacuguaaaauaau

SEQ ID NO: 438408 - RNA, 23 nt, Human
uccaacuaucucauuuccaagca

SEQ ID NO: 438409 - RNA, 17 nt, Human
caaauauaaauaaaaau

SEQ ID NO: 438410 - RNA, 21 nt, Human
auuuuccugaaaacccuugcc

SEQ ID NO: 438411 - RNA, 21 nt, Human
gccaaauauaaauaaaaauaa

SEQ ID NO: 438412 - RNA, 22 nt, Human
cugugccguccccagagcuaca

SEQ ID NO: 438413 - RNA, 23 nt, Human
cuuaagaagacugcauuauauuu

SEQ ID NO: 438414 - RNA, 16 nt, Human
aaauauuauguuaaaa

SEQ ID NO: 438415 - RNA, 13 nt, Human
ucacuguaaaaua

SEQ ID NO: 438416 - RNA, 20 nt, Human
uuuaaauaaaguguuugaaa

SEQ ID NO: 438417 - RNA, 16 nt, Human
uucccaacuccagaaa

SEQ ID NO: 438418 - RNA, 18 nt, Human
acaugaacuuguaaagga

SEQ ID NO: 438419 - RNA, 12 nt, Human
gcugaugcaguu

SEQ ID NO: 438420 - RNA, 20 nt, Human
ugauuucugagcauuuaaua

SEQ ID NO: 438421 - RNA, 17 nt, Human
aaccuagggugauauua

SEQ ID NO: 438422 - RNA, 17 nt, Human
caaauccaaugaaauga

SEQ ID NO: 438423 - RNA, 17 nt, Human
ucucucacuuguuuuau

SEQ ID NO: 438424 - RNA, 13 nt, Human
ucuauaauuuaaa

SEQ ID NO: 438425 - RNA, 19 nt, Human
cacggcuggagcugccucu

SEQ ID NO: 438426 - RNA, 18 nt, Human
gccuuggggcugaugcag

SEQ ID NO: 438427 - RNA, 15 nt, Human
uauaaauaaaaauaa

SEQ ID NO: 438428 - RNA, 15 nt, Human
aauauaaauaaaaau

SEQ ID NO: 438429 - RNA, 22 nt, Human
uuuuauagcuacuaauuuuaaa

SEQ ID NO: 438430 - RNA, 20 nt, Human
uagaugcaguucugaagaag

SEQ ID NO: 438431 - RNA, 15 nt, Human
aaaaguugaauuuua

SEQ ID NO: 438432 - RNA, 15 nt, Human
uccuaagucccugcu

SEQ ID NO: 438433 - RNA, 16 nt, Human
aauuacauuuguauaa

SEQ ID NO: 438434 - RNA, 16 nt, Human
aagaaaauaacaauaa

SEQ ID NO: 438435 - RNA, 20 nt, Human
aguuguuucuacuacaugga

SEQ ID NO: 438436 - RNA, 15 nt, Human
cagugaaagaaaaua

SEQ ID NO: 438437 - RNA, 19 nt, Human
guccaggucuaccaaaaau

SEQ ID NO: 438438 - RNA, 22 nt, Human
uuugaugcuacaggauuugaaa

SEQ ID NO: 438439 - RNA, 16 nt, Human
uaaugaauacuuuaua

SEQ ID NO: 438440 - RNA, 18 nt, Human
acacuguccauucuuccu

SEQ ID NO: 438441 - RNA, 16 nt, Human
gaaaaaauaacaauga

SEQ ID NO: 438442 - RNA, 19 nt, Human
aauuuuuauauuugaaaua

SEQ ID NO: 438443 - RNA, 17 nt, Human
gacgagaaaacaauaac

SEQ ID NO: 438444 - RNA, 17 nt, Human
acuguccauucuuccuc

SEQ ID NO: 438445 - RNA, 12 nt, Human
uaagaagacugc

SEQ ID NO: 438446 - RNA, 17 nt, Human
uaaaagacaaggaaaaa

SEQ ID NO: 438447 - RNA, 18 nt, Human
uguacuuuauuuucuaua

SEQ ID NO: 438448 - RNA, 18 nt, Human
agagaaugagagacacac

SEQ ID NO: 438449 - RNA, 13 nt, Human
uauuucuaugaaa

SEQ ID NO: 438450 - RNA, 18 nt, Human
cugagggcauagaaguaa

SEQ ID NO: 438451 - RNA, 11 nt, Human
ccuucccacac

SEQ ID NO: 438452 - RNA, 14 nt, Human
uuaugauuaaguaa

SEQ ID NO: 438453 - RNA, 15 nt, Human
aaauauaaauaaaaa

SEQ ID NO: 438454 - RNA, 18 nt, Human
uuuauguuuaauucugaa

SEQ ID NO: 438455 - RNA, 16 nt, Human
aaaauccauacauuug

SEQ ID NO: 438456 - RNA, 21 nt, Human
aaagcugaaauggacuuuugu

SEQ ID NO: 438457 - RNA, 13 nt, Human
ugcauuucuaaag

SEQ ID NO: 438458 - RNA, 16 nt, Human
gacauuugcucaugga

SEQ ID NO: 438459 - RNA, 15 nt, Human
auuuuacauggcugg

SEQ ID NO: 438460 - RNA, 12 nt, Human
auauaaauaaaa

SEQ ID NO: 438461 - RNA, 19 nt, Human
aacaguuguguuugaagca

SEQ ID NO: 438462 - RNA, 19 nt, Human
cacaggaaccacaagacug

SEQ ID NO: 438463 - RNA, 15 nt, Human
uguauuuuaaaagaa

SEQ ID NO: 438464 - RNA, 18 nt, Human
uaaguuuuuuuuuaaaaa

SEQ ID NO: 438465 - RNA, 16 nt, Human
aaagacaaggaaaaaa

SEQ ID NO: 438466 - RNA, 15 nt, Human
aaauauuuauuuuaa

SEQ ID NO: 438467 - RNA, 23 nt, Human
auauaacaaugcuguauuuuaaa

SEQ ID NO: 438468 - RNA, 22 nt, Human
agugagcagucaggaaagagaa

SEQ ID NO: 438469 - RNA, 13 nt, Human
ugaaaaucuuaua

SEQ ID NO: 438470 - RNA, 18 nt, Human
gaaacaaaaggauaauga

SEQ ID NO: 438471 - RNA, 22 nt, Human
agaagcaccaaucaugaauuag

SEQ ID NO: 438472 - RNA, 16 nt, Human
uuaaauuguaauaggc

SEQ ID NO: 438473 - RNA, 21 nt, Human
aauuuuuauauuugaaauauu

SEQ ID NO: 438474 - RNA, 17 nt, Human
auuauuuuuuaaaaaaa

SEQ ID NO: 438475 - RNA, 13 nt, Human
cagaaaaguugaa

SEQ ID NO: 438476 - RNA, 12 nt, Human
uuuuuucugaaa

SEQ ID NO: 438477 - RNA, 14 nt, Human
acuaauuuuaaaau

SEQ ID NO: 438478 - RNA, 14 nt, Human
agaauuugauaugu

SEQ ID NO: 438479 - RNA, 18 nt, Human
uguaaaggaauuuaaaaa

SEQ ID NO: 438480 - RNA, 20 nt, Human
aacaaugcuguauuuuaaaa

SEQ ID NO: 438481 - RNA, 15 nt, Human
aagccuccuuuuaaa

SEQ ID NO: 438482 - RNA, 17 nt, Human
gccuccuuuuaaaguaa

SEQ ID NO: 438483 - RNA, 23 nt, Human
gauagauaggucagugcaaauac

SEQ ID NO: 438484 - RNA, 17 nt, Human
uauuuuuuucugaaauu

SEQ ID NO: 438485 - RNA, 23 nt, Human
aaagauucaaugccccugaauuu

SEQ ID NO: 438486 - RNA, 13 nt, Human
uuccuucugcucc

SEQ ID NO: 438487 - RNA, 18 nt, Human
gaauaauccuaaacauau

SEQ ID NO: 438488 - RNA, 16 nt, Human
agaguuccuucugcuc

SEQ ID NO: 438489 - RNA, 16 nt, Human
ugaauuuaaauagcuu

SEQ ID NO: 438490 - RNA, 21 nt, Human
cuuuuguagaagucacauucc

SEQ ID NO: 438491 - RNA, 17 nt, Human
ugcccacggcuggagcu

SEQ ID NO: 438492 - RNA, 14 nt, Human
cuucccacacuguc

SEQ ID NO: 438493 - RNA, 22 nt, Human
uggaaaguuuaugguuguauua

SEQ ID NO: 438494 - RNA, 18 nt, Human
uaaaagacaaggaaaaaa

SEQ ID NO: 438495 - RNA, 15 nt, Human
aaacauaugaauuau

SEQ ID NO: 438496 - RNA, 18 nt, Human
aaauaacgauaaaagaca

SEQ ID NO: 438497 - RNA, 17 nt, Human
acuuccagauccuggaa

SEQ ID NO: 438498 - RNA, 19 nt, Human
uccagaaagugacaagcuc

SEQ ID NO: 438499 - RNA, 20 nt, Human
uuccacagaagcuccaggua

SEQ ID NO: 438500 - RNA, 16 nt, Human
aaagcuacuuauugua

SEQ ID NO: 438501 - RNA, 20 nt, Human
gaaacauuugguaaggggaa

SEQ ID NO: 438502 - RNA, 22 nt, Human
auuuucuucucacauuuauauu

SEQ ID NO: 438503 - RNA, 15 nt, Human
cucauccacuuucca

SEQ ID NO: 438504 - RNA, 23 nt, Human
acuuauuguagcauccuggaaua

SEQ ID NO: 438505 - RNA, 19 nt, Human
aaagacagugaaagaaaau

SEQ ID NO: 438506 - RNA, 22 nt, Human
uuguaacaagccuccuuuuaaa

SEQ ID NO: 438507 - RNA, 15 nt, Human
uaacgauaaaagaca

SEQ ID NO: 438508 - RNA, 23 nt, Human
ucuuagaugcaguucugaagaag

SEQ ID NO: 438509 - RNA, 13 nt, Human
uacuuuauuuucu

SEQ ID NO: 438510 - RNA, 19 nt, Human
cuuccagauccuggaaauc

SEQ ID NO: 438511 - RNA, 23 nt, Human
ugaauuacauuuguauaaaauaa

SEQ ID NO: 438512 - RNA, 21 nt, Human
acagcccuucuuuccacagaa

SEQ ID NO: 438513 - RNA, 22 nt, Human
ugguccuaagucccugcugccc

SEQ ID NO: 438514 - RNA, 14 nt, Human
ggcauucaaaugua

SEQ ID NO: 438515 - RNA, 14 nt, Human
acauauauaacaau

SEQ ID NO: 438516 - RNA, 15 nt, Human
auaucuauauuuuac

SEQ ID NO: 438517 - RNA, 13 nt, Human
cacuguaaaauaa

SEQ ID NO: 438518 - RNA, 22 nt, Human
uuaccucugccucagaaaacaa

SEQ ID NO: 438519 - RNA, 20 nt, Human
acuagaguuuagcuggaaaa

SEQ ID NO: 438520 - RNA, 15 nt, Human
gcuguauuuuaaaag

SEQ ID NO: 438521 - RNA, 19 nt, Human
guccauucuuccucccauu

SEQ ID NO: 438522 - RNA, 14 nt, Human
uugccaugugcuag

SEQ ID NO: 438523 - RNA, 13 nt, Human
gaagaacugaaau

SEQ ID NO: 438524 - RNA, 22 nt, Human
aaagacagugaaagaaaauaac

SEQ ID NO: 438525 - RNA, 21 nt, Human
aacuuguaaaggaauuuaaaa

SEQ ID NO: 438526 - RNA, 14 nt, Human
uuauuauauuuaca

SEQ ID NO: 438527 - RNA, 14 nt, Human
agaauucauucacu

SEQ ID NO: 438528 - RNA, 15 nt, Human
auuuuaaaagaauga

SEQ ID NO: 438529 - RNA, 23 nt, Human
aaaauaucacuugucaauaaaau

SEQ ID NO: 438530 - RNA, 17 nt, Human
uccauucuuccucccau

SEQ ID NO: 438531 - RNA, 21 nt, Human
ugaugcuacaggauuugaaau

SEQ ID NO: 438532 - RNA, 20 nt, Human
uguaagaaaauaucacuugu

SEQ ID NO: 438533 - RNA, 21 nt, Human
gaaaaguauguuagugcaaau

SEQ ID NO: 438534 - RNA, 18 nt, Human
aaaguaacccuacaaaac

SEQ ID NO: 438535 - RNA, 13 nt, Human
aacacaacuauau

SEQ ID NO: 438536 - RNA, 13 nt, Human
augcuguucauga

SEQ ID NO: 438537 - RNA, 21 nt, Human
ugguccuaagucccugcugcc

SEQ ID NO: 438538 - RNA, 16 nt, Human
aacuugguuuuaauua

SEQ ID NO: 438539 - RNA, 16 nt, Human
uucugaaauuuccugg

SEQ ID NO: 438540 - RNA, 20 nt, Human
agaagaacugaaaucauacu

SEQ ID NO: 438541 - RNA, 21 nt, Human
uugaagcacagugaucaaguu

SEQ ID NO: 438542 - RNA, 20 nt, Human
uucuaggacugaauuaugaa

SEQ ID NO: 438543 - RNA, 13 nt, Human
aagacagugaaag

SEQ ID NO: 438544 - RNA, 23 nt, Human
gggaaacaaaaggauaaugaaua

SEQ ID NO: 438545 - RNA, 20 nt, Human
gaaacgaggauugggaaaaa

SEQ ID NO: 438546 - RNA, 12 nt, Human
gguuuauauaag

SEQ ID NO: 438547 - RNA, 21 nt, Human
auaugcucuaaacauguuuau

SEQ ID NO: 438548 - RNA, 17 nt, Human
gaagcaccaaucaugaa

SEQ ID NO: 438549 - RNA, 22 nt, Human
cugggacaggggagaaccuagg

SEQ ID NO: 438550 - RNA, 17 nt, Human
uugccaaauauaaauaa

SEQ ID NO: 438551 - RNA, 11 nt, Human
auaauuuaaau

SEQ ID NO: 438552 - RNA, 12 nt, Human
acacugaagaag

SEQ ID NO: 438553 - RNA, 20 nt, Human
cacuguggguagacacacau

SEQ ID NO: 438554 - RNA, 16 nt, Human
aagcuucacuguaaaa

SEQ ID NO: 438555 - RNA, 11 nt, Human
cauaugaaaag

SEQ ID NO: 438556 - RNA, 13 nt, Human
uuggacgagaaaa

SEQ ID NO: 438557 - RNA, 22 nt, Human
uucauucacucaacaaacauaa

SEQ ID NO: 438558 - RNA, 19 nt, Human
auagcuacuaauuuuaaaa

SEQ ID NO: 438559 - RNA, 20 nt, Human
auucccagccagcacagccu

SEQ ID NO: 438560 - RNA, 17 nt, Human
gcugccucucucaucca

SEQ ID NO: 438561 - RNA, 15 nt, Human
ucuaggacugaauua

SEQ ID NO: 438562 - RNA, 22 nt, Human
uuuauagcuacuaauuuuaaaa

SEQ ID NO: 438563 - RNA, 13 nt, Human
aggauuugaaauu

SEQ ID NO: 438564 - RNA, 21 nt, Human
aagcuccauuuuuagugaaau

SEQ ID NO: 438565 - RNA, 13 nt, Human
uuuuaauuugguu

SEQ ID NO: 438566 - RNA, 21 nt, Human
gcaaaauuuuuucucuaggaa

SEQ ID NO: 438567 - RNA, 11 nt, Human
uuauauuuauu

SEQ ID NO: 438568 - RNA, 11 nt, Human
aauuuaaauau

SEQ ID NO: 438569 - RNA, 21 nt, Human
cuaccaaaaaucucaauauuu

SEQ ID NO: 438570 - RNA, 17 nt, Human
auaauuuaaauauaugc

SEQ ID NO: 438571 - RNA, 22 nt, Human
guacacugccuucucaacucca

SEQ ID NO: 438572 - RNA, 18 nt, Human
gaagcaccaaucaugaau

SEQ ID NO: 438573 - RNA, 22 nt, Human
uguugcccacagcuguaugauu

SEQ ID NO: 438574 - RNA, 23 nt, Human
agaaugauuaugaauuacauuug

SEQ ID NO: 438575 - RNA, 15 nt, Human
cuguaaaauaauaac

SEQ ID NO: 438576 - RNA, 15 nt, Human
ucuauauuuuacaua

SEQ ID NO: 438577 - RNA, 22 nt, Human
acuuauuguagcauccuggaau

SEQ ID NO: 438578 - RNA, 18 nt, Human
agcaaaauuuuuucucua

SEQ ID NO: 438579 - RNA, 18 nt, Human
guuaguauuguccagguc

SEQ ID NO: 438580 - RNA, 13 nt, Human
aggaaaaaauaac

SEQ ID NO: 438581 - RNA, 21 nt, Human
cugaaauaaacgucuuaaaua

SEQ ID NO: 438582 - RNA, 15 nt, Human
uauuuauuuuaauaa

SEQ ID NO: 438583 - RNA, 21 nt, Human
uuauauauauuuuuuucugaa

SEQ ID NO: 438584 - RNA, 19 nt, Human
gaauacucuuauaucuaua

SEQ ID NO: 438585 - RNA, 21 nt, Human
uuauguuuaauucugaaagca

SEQ ID NO: 438586 - RNA, 18 nt, Human
aaaagacaaggaaaaaau

SEQ ID NO: 438587 - RNA, 16 nt, Human
agugaaggauuuaugu

SEQ ID NO: 438588 - RNA, 18 nt, Human
acaaaaggauaaugaaua

SEQ ID NO: 438589 - RNA, 21 nt, Human
aaaauaugccccauucaacau

SEQ ID NO: 438590 - RNA, 14 nt, Human
guaacugauuugua

SEQ ID NO: 438591 - RNA, 14 nt, Human
ugcuucuguuuuau

SEQ ID NO: 438592 - RNA, 14 nt, Human
uccagauccuggaa

SEQ ID NO: 438593 - RNA, 13 nt, Human
uaacaauaaaaga

SEQ ID NO: 438594 - RNA, 22 nt, Human
aaccuacacgagauacagaauu

SEQ ID NO: 438595 - RNA, 21 nt, Human
caucuagcaugucgucaaagc

SEQ ID NO: 438596 - RNA, 18 nt, Human
auaaaguguuugaaagcu

SEQ ID NO: 438597 - RNA, 14 nt, Human
ggcaauagucaaau

SEQ ID NO: 438598 - RNA, 15 nt, Human
uauaauuuaaauaua

SEQ ID NO: 438599 - RNA, 16 nt, Human
cacacuguccauucuu

SEQ ID NO: 438600 - RNA, 22 nt, Human
cuuguaaaggaauuuaaaaauc

SEQ ID NO: 438601 - RNA, 12 nt, Human
aguguuugaaag

SEQ ID NO: 438602 - RNA, 22 nt, Human
aaacaaggaugaauuaaguuuu

SEQ ID NO: 438603 - RNA, 17 nt, Human
uacaaaugcauuucuaa

SEQ ID NO: 438604 - RNA, 16 nt, Human
ccuucccacacugucc

SEQ ID NO: 438605 - RNA, 15 nt, Human
cuacuaauuuuaaaa

SEQ ID NO: 438606 - RNA, 12 nt, Human
agaaaacaauaa

SEQ ID NO: 438607 - RNA, 19 nt, Human
agaaaauaacaauaaaaga

SEQ ID NO: 438608 - RNA, 13 nt, Human
aaaauaacgauaa

SEQ ID NO: 438609 - RNA, 19 nt, Human
uauuuaaccucuaaauucu

SEQ ID NO: 438610 - RNA, 18 nt, Human
cuaauguguaagacaaaa

SEQ ID NO: 438611 - RNA, 22 nt, Human
aguauguuagugcaaauuguca

SEQ ID NO: 438612 - RNA, 21 nt, Human
gacagucaccucauggaauug

SEQ ID NO: 438613 - RNA, 14 nt, Human
cagauccuggaaau

SEQ ID NO: 438614 - RNA, 20 nt, Human
gaugcccacggcuggagcug

SEQ ID NO: 438615 - RNA, 20 nt, Human
acuucuuaggguuaugauua

SEQ ID NO: 438616 - RNA, 20 nt, Human
auaauccuaaacauaugaau

SEQ ID NO: 438617 - RNA, 18 nt, Human
uuacuguaagaaaauauc

SEQ ID NO: 438618 - RNA, 19 nt, Human
aaaauaacgauaaaagaca

SEQ ID NO: 438619 - RNA, 23 nt, Human
cuagaauuugauaugugaacagu

SEQ ID NO: 438620 - RNA, 22 nt, Human
gcccacggcuggagcugccucu

SEQ ID NO: 438621 - RNA, 13 nt, Human
cuugcugcaccug

SEQ ID NO: 438622 - RNA, 14 nt, Human
uaaauaaaaauaau

SEQ ID NO: 438623 - RNA, 23 nt, Human
caugcugucuacacuaagagaga

SEQ ID NO: 438624 - RNA, 22 nt, Human
ucaacuccaaacugacucuuaa

SEQ ID NO: 438625 - RNA, 19 nt, Human
gucaaucagccuaguugau

SEQ ID NO: 438626 - RNA, 21 nt, Human
uaauaggcguaacuaauuuua

SEQ ID NO: 438627 - RNA, 16 nt, Human
ugaaauuguauuacaa

SEQ ID NO: 438628 - RNA, 16 nt, Human
ugacaagcucacagac

SEQ ID NO: 438629 - RNA, 16 nt, Human
auuuuuagugaaauau

SEQ ID NO: 438630 - RNA, 21 nt, Human
uguauaaaauaauuuuuauau

SEQ ID NO: 438631 - RNA, 16 nt, Human
aggguguguaaguaga

SEQ ID NO: 438632 - RNA, 14 nt, Human
ugugaaaagcucca

SEQ ID NO: 438633 - RNA, 23 nt, Human
auuccugaacaggauauucucac

SEQ ID NO: 438634 - RNA, 21 nt, Human
caaggaaaaaauaacaaugaa

SEQ ID NO: 438635 - RNA, 17 nt, Human
guuuaauucugaaagca

SEQ ID NO: 438636 - RNA, 14 nt, Human
uauaucuauauuuu

SEQ ID NO: 438637 - RNA, 15 nt, Human
agucccugcugcccu

SEQ ID NO: 438638 - RNA, 22 nt, Human
aaauaacaaugaaaguugauaa

SEQ ID NO: 438639 - RNA, 15 nt, Human
augauaacuggaaac

SEQ ID NO: 438640 - RNA, 19 nt, Human
uuugccaaguucuccacua

SEQ ID NO: 438641 - RNA, 16 nt, Human
aauuuuuaauuauaug

SEQ ID NO: 438642 - RNA, 16 nt, Human
cuguccauucuuccuc

SEQ ID NO: 438643 - RNA, 15 nt, Human
aaaaaagaaacauuu

SEQ ID NO: 438644 - RNA, 22 nt, Human
accauuucuugagguaaaagca

SEQ ID NO: 438645 - RNA, 19 nt, Human
ugaaauuguauuacaaauc

SEQ ID NO: 438646 - RNA, 17 nt, Human
ggagcucguggaacagu

SEQ ID NO: 438647 - RNA, 18 nt, Human
aaaucuuauaauuuaaaa

SEQ ID NO: 438648 - RNA, 20 nt, Human
augcaguuguugcccacagc

SEQ ID NO: 438649 - RNA, 23 nt, Human
caaaauggaauacucuuauaucu

SEQ ID NO: 438650 - RNA, 19 nt, Human
guaguccuguaauggaagc

SEQ ID NO: 438651 - RNA, 18 nt, Human
cugcugcccuuccccuuc

SEQ ID NO: 438652 - RNA, 14 nt, Human
uaaaggaauuuaaa

SEQ ID NO: 438653 - RNA, 18 nt, Human
cugcccuuccccuuccca

SEQ ID NO: 438654 - RNA, 21 nt, Human
gcuacaggccccaucuggucc

SEQ ID NO: 438655 - RNA, 17 nt, Human
aaagcuccauuuuuagu

SEQ ID NO: 438656 - RNA, 23 nt, Human
uagauguauagguugaugguggu

SEQ ID NO: 438657 - RNA, 21 nt, Human
cuuuccaauaaagaguuccuu

SEQ ID NO: 438658 - RNA, 22 nt, Human
uauuccuuuuucucuccucucc

SEQ ID NO: 438659 - RNA, 13 nt, Human
acagcccuucuuu

SEQ ID NO: 438660 - RNA, 23 nt, Human
agucccugcugcccuuccccuuc

SEQ ID NO: 438661 - RNA, 20 nt, Human
aaagacaaggaaaaaauaac

SEQ ID NO: 438662 - RNA, 23 nt, Human
ucuaccaaaaaucucaauauuuc

SEQ ID NO: 438663 - RNA, 21 nt, Human
gccuuuucccaacuccagaaa

SEQ ID NO: 438664 - RNA, 19 nt, Human
gcugcccuuccccuuccca

SEQ ID NO: 438665 - RNA, 22 nt, Human
acauggcuggagcuagaauuug

SEQ ID NO: 438666 - RNA, 15 nt, Human
cuuaagaagacugca

SEQ ID NO: 438667 - RNA, 16 nt, Human
ucaguuuuugugaaaa

SEQ ID NO: 438668 - RNA, 18 nt, Human
acugacucuuaagaagac

SEQ ID NO: 438669 - RNA, 17 nt, Human
ccugcugcccuuccccu

SEQ ID NO: 438670 - RNA, 23 nt, Human
cuuauaucuauauuuuacauaaa

SEQ ID NO: 438671 - RNA, 19 nt, Human
caccugugccguccccaga

SEQ ID NO: 438672 - RNA, 14 nt, Human
ccaaugaaaugagu

SEQ ID NO: 438673 - RNA, 15 nt, Human
gaaagaaaauaacga

SEQ ID NO: 438674 - RNA, 22 nt, Human
uuuccaagcaaguauuagaaua

SEQ ID NO: 438675 - RNA, 14 nt, Human
gcugcccuuccccu

SEQ ID NO: 438676 - RNA, 21 nt, Human
auaguuacccaaauuaagaga

SEQ ID NO: 438677 - RNA, 22 nt, Human
auaacaaugcuguauuuuaaaa

SEQ ID NO: 438678 - RNA, 17 nt, Human
aagcuuccauuguuguc

SEQ ID NO: 438679 - RNA, 22 nt, Human
cuaagcuucacuguaaaauaau

SEQ ID NO: 438680 - RNA, 14 nt, Human
caugaacuuguaaa

SEQ ID NO: 438681 - RNA, 23 nt, Human
aagagccuuuuuuugaaaaaaag

SEQ ID NO: 438682 - RNA, 15 nt, Human
aaauaauuuuuauau

SEQ ID NO: 438683 - RNA, 17 nt, Human
ccccugaauuuaaauag

SEQ ID NO: 438684 - RNA, 19 nt, Human
uuaauuugguuuucacauu

SEQ ID NO: 438685 - RNA, 21 nt, Human
uuauuuucuauaauuuaaaua

SEQ ID NO: 438686 - RNA, 17 nt, Human
cuucacuguaaaauaau

SEQ ID NO: 438687 - RNA, 14 nt, Human
cccacacuguccau

SEQ ID NO: 438688 - RNA, 17 nt, Human
ccugugccguccccaga

SEQ ID NO: 438689 - RNA, 15 nt, Human
aagccagauuuuccu

SEQ ID NO: 438690 - RNA, 21 nt, Human
uauacugugugcuaaaacaag

SEQ ID NO: 438691 - RNA, 17 nt, Human
cuaagcuucacuguaaa

SEQ ID NO: 438692 - RNA, 14 nt, Human
aagcuacuuauugu

SEQ ID NO: 438693 - RNA, 19 nt, Human
ccccuucccacacugucca

SEQ ID NO: 438694 - RNA, 19 nt, Human
auagugaggagcuuugaaa

SEQ ID NO: 438695 - RNA, 21 nt, Human
guauacugugugcuaaaacaa

SEQ ID NO: 438696 - RNA, 23 nt, Human
caaagcugaaauggacuuuugua

SEQ ID NO: 438697 - RNA, 14 nt, Human
auuuucuauaauuu

SEQ ID NO: 438698 - RNA, 21 nt, Human
uuuauauaagcuuguauuccu

SEQ ID NO: 438699 - RNA, 16 nt, Human
acuuguuuuauuuaac

SEQ ID NO: 438700 - RNA, 17 nt, Human
uuuuuaauuauauggcu

SEQ ID NO: 438701 - RNA, 19 nt, Human
acauuuguauaaaauaauu

SEQ ID NO: 438702 - RNA, 22 nt, Human
ugggcacuguggguagacacac

SEQ ID NO: 438703 - RNA, 16 nt, Human
ugcacaucaaaauaug

SEQ ID NO: 438704 - RNA, 24 nt, Human
aucugguccuaagucccugcugcc

SEQ ID NO: 438705 - RNA, 13 nt, Human
guaacuaauuuua

SEQ ID NO: 438706 - RNA, 15 nt, Human
agugacaagcucaca

SEQ ID NO: 438707 - RNA, 16 nt, Human
caaaaggauaaugaau

SEQ ID NO: 438708 - RNA, 23 nt, Human
cacacuguccauucuuccuccca

SEQ ID NO: 438709 - RNA, 19 nt, Human
auugaggacacugauaugg

SEQ ID NO: 438710 - RNA, 16 nt, Human
auugucuagugaaacu

SEQ ID NO: 438711 - RNA, 19 nt, Human
aaccgaacugauguaagua

SEQ ID NO: 438712 - RNA, 13 nt, Human
uuuugaaucauca

SEQ ID NO: 438713 - RNA, 18 nt, Human
aaaaucuuauaauuuaaa

SEQ ID NO: 438714 - RNA, 16 nt, Human
auaauccuaaacauau

SEQ ID NO: 438715 - RNA, 22 nt, Human
aagagccuuuuuuugaaaaaaa

SEQ ID NO: 438716 - RNA, 19 nt, Human
uguaguguuggagaagaac

SEQ ID NO: 438717 - RNA, 21 nt, Human
uaaaagacagugaaagaaaau

SEQ ID NO: 438718 - RNA, 22 nt, Human
cccugaauuuaaauagcuuuuu

SEQ ID NO: 438719 - RNA, 23 nt, Human
auuuuauagcuacuaauuuuaaa

SEQ ID NO: 438720 - RNA, 16 nt, Human
agugaaagaaaauaac

SEQ ID NO: 438721 - RNA, 19 nt, Human
aaaauaacaauaaaagaca

SEQ ID NO: 438722 - RNA, 15 nt, Human
uuaauuuguaguguu

SEQ ID NO: 438723 - RNA, 11 nt, Human
gagguaaaagc

SEQ ID NO: 438724 - RNA, 20 nt, Human
caagagccuuuuuuugaaaa

SEQ ID NO: 438725 - RNA, 15 nt, Human
guugaagagguuuua

SEQ ID NO: 438726 - RNA, 13 nt, Human
ccucauggaauug

SEQ ID NO: 438727 - RNA, 21 nt, Human
ucacaugaacuuguaaaggaa

SEQ ID NO: 438728 - RNA, 23 nt, Human
uuagaugcaguucugaagaagau

SEQ ID NO: 438729 - RNA, 17 nt, Human
aaagacaaggaaaaaau

SEQ ID NO: 438730 - RNA, 22 nt, Human
acauuggaaacaagucagucau

SEQ ID NO: 438731 - RNA, 18 nt, Human
uuauuacuguaagaaaau

SEQ ID NO: 438732 - RNA, 15 nt, Human
uacuaauuuuaaaau

SEQ ID NO: 438733 - RNA, 17 nt, Human
augcuguucaugaaaga

SEQ ID NO: 438734 - RNA, 23 nt, Human
agaguuuagcuggaaaaguaugu

SEQ ID NO: 438735 - RNA, 15 nt, Human
ugcuguauuuuaaaa

SEQ ID NO: 438736 - RNA, 16 nt, Human
ugauaugugaacaguu

SEQ ID NO: 438737 - RNA, 18 nt, Human
cuuuccacagaagcucca

SEQ ID NO: 438738 - RNA, 17 nt, Human
cuggagggaagccuugg

SEQ ID NO: 438739 - RNA, 19 nt, Human
uggugaacuugguuuuaau

SEQ ID NO: 438740 - RNA, 17 nt, Human
cucguggaacaguuacc

SEQ ID NO: 438741 - RNA, 22 nt, Human
agaauuuuaugcggcauuuucu

SEQ ID NO: 438742 - RNA, 17 nt, Human
auauuuuacauaaauuu

SEQ ID NO: 438743 - RNA, 18 nt, Human
ucaaggguacacugccuu

SEQ ID NO: 438744 - RNA, 17 nt, Human
gauaaaagacagugaaa

SEQ ID NO: 438745 - RNA, 15 nt, Human
cacaggacagcccuu

SEQ ID NO: 438746 - RNA, 15 nt, Human
cugacucuuaagaag

SEQ ID NO: 438747 - RNA, 17 nt, Human
gaagaccucauuuugaa

SEQ ID NO: 438748 - RNA, 22 nt, Human
uuucuaggacugaauuaugaaa

SEQ ID NO: 438749 - RNA, 18 nt, Human
aaauauuuauuuuaauaa

SEQ ID NO: 438750 - RNA, 17 nt, Human
cagugaaagaaaauaac

SEQ ID NO: 438751 - RNA, 16 nt, Human
cuuauaauuuaaaaua

SEQ ID NO: 438752 - RNA, 19 nt, Human
aagucuuucacauuuaaau

SEQ ID NO: 438753 - RNA, 21 nt, Human
ccaaauauaaauaaaaauaau

SEQ ID NO: 438754 - RNA, 12 nt, Human
gaaaauaacaau

SEQ ID NO: 438755 - RNA, 12 nt, Human
guagacacacau

SEQ ID NO: 438756 - RNA, 17 nt, Human
aaucuuucacaggggac

SEQ ID NO: 438757 - RNA, 19 nt, Human
augaguaacugauuuguaa

SEQ ID NO: 438758 - RNA, 14 nt, Human
guaacuaauuuuaa

SEQ ID NO: 438759 - RNA, 22 nt, Human
gcacagccucuuagaugcaguu

SEQ ID NO: 438760 - RNA, 16 nt, Human
cucucucauccacuuu

SEQ ID NO: 438761 - RNA, 18 nt, Human
uacuuuauuuucuauaau

SEQ ID NO: 438762 - RNA, 16 nt, Human
cugcucucaguucacu

SEQ ID NO: 438763 - RNA, 15 nt, Human
ucacaggacagcccu

SEQ ID NO: 438764 - RNA, 15 nt, Human
agucaccucauggaa

SEQ ID NO: 438765 - RNA, 17 nt, Human
agcuucacuguaaaaua

SEQ ID NO: 438766 - RNA, 14 nt, Human
uucuggaauaaucc

SEQ ID NO: 438767 - RNA, 15 nt, Human
uggagcuagaauuug

SEQ ID NO: 438768 - RNA, 21 nt, Human
uuuuauggcacuaguauuucu

SEQ ID NO: 438769 - RNA, 23 nt, Human
ucaaugccccugaauuuaaauag

SEQ ID NO: 438770 - RNA, 16 nt, Human
aaaagcuccauuuuua

SEQ ID NO: 438771 - RNA, 19 nt, Human
uguauacugugugcuaaaa

SEQ ID NO: 438772 - RNA, 22 nt, Human
ggacagcccuucuuuccacaga

SEQ ID NO: 438773 - RNA, 19 nt, Human
ugggacaggggagaaccua

SEQ ID NO: 438774 - RNA, 16 nt, Human
cuaagucccugcugcc

SEQ ID NO: 438775 - RNA, 20 nt, Human
uuaaguuuuuuuuuaaaaaa

SEQ ID NO: 438776 - RNA, 16 nt, Human
ugcaaauugucacagg

SEQ ID NO: 438777 - RNA, 14 nt, Human
aaauauuauuuuau

SEQ ID NO: 438778 - RNA, 23 nt, Human
acuuuccaauaaagaguuccuuc

SEQ ID NO: 438779 - RNA, 12 nt, Human
uuuuuuuuaaaa

SEQ ID NO: 438780 - RNA, 19 nt, Human
uuuccugaaaacccuugcc

SEQ ID NO: 438781 - RNA, 14 nt, Human
acacugaagaagca

SEQ ID NO: 438782 - RNA, 15 nt, Human
uuuagugaaauauua

SEQ ID NO: 438783 - RNA, 14 nt, Human
guauuuuaaaagaa

SEQ ID NO: 438784 - RNA, 14 nt, Human
auuugaaauuguau

SEQ ID NO: 438785 - RNA, 22 nt, Human
gaauaucuccgucaacucauau

SEQ ID NO: 438786 - RNA, 14 nt, Human
ugcuguauuuuaaa

SEQ ID NO: 438787 - RNA, 20 nt, Human
auuacuguaagaaaauauca

SEQ ID NO: 438788 - RNA, 20 nt, Human
guauuuaauagguuuggaca

SEQ ID NO: 438789 - RNA, 17 nt, Human
cuauauuuuacauaaau

SEQ ID NO: 438790 - RNA, 13 nt, Human
aguuaccucugcc

SEQ ID NO: 438791 - RNA, 22 nt, Human
agaauuugauaugugaacaguu

SEQ ID NO: 438792 - RNA, 15 nt, Human
augaauuaaguuuuu

SEQ ID NO: 438793 - RNA, 17 nt, Human
gcaccugugccgucccc

SEQ ID NO: 438794 - RNA, 15 nt, Human
aacgauaaaagacag

SEQ ID NO: 438795 - RNA, 13 nt, Human
auuggacaguaaa

SEQ ID NO: 438796 - RNA, 17 nt, Human
uauauuguagauaauac

SEQ ID NO: 438797 - RNA, 22 nt, Human
uugaaaaucuuauaauuuaaaa

SEQ ID NO: 438798 - RNA, 19 nt, Human
augaauuacauuuguauaa

SEQ ID NO: 438799 - RNA, 23 nt, Human
caaauacgugggcauucaaaugu

SEQ ID NO: 438800 - RNA, 17 nt, Human
ucuuauaauuuaaaaua

SEQ ID NO: 438801 - RNA, 17 nt, Human
aaagaaacauuugguaa

SEQ ID NO: 438802 - RNA, 16 nt, Human
cuucacuguaaaauaa

SEQ ID NO: 438803 - RNA, 20 nt, Human
agcuuauugucuagugaaac

SEQ ID NO: 438804 - RNA, 20 nt, Human
agccuuggggcugaugcagu

SEQ ID NO: 438805 - RNA, 15 nt, Human
cuuuucccaacucca

SEQ ID NO: 438806 - RNA, 16 nt, Human
caauaacgauaaaaga

SEQ ID NO: 438807 - RNA, 22 nt, Human
gaugcaguuguugcccacagcu

SEQ ID NO: 438808 - RNA, 20 nt, Human
augaagauacugaaauaaac

SEQ ID NO: 438809 - RNA, 15 nt, Human
auaaaguguuugaaa

SEQ ID NO: 438810 - RNA, 23 nt, Human
gaaaaucuuauaauuuaaaauau

SEQ ID NO: 438811 - RNA, 22 nt, Human
uaauaggcguaacuaauuuuaa

SEQ ID NO: 438812 - RNA, 20 nt, Human
uaucuccgucaacucauauu

SEQ ID NO: 438813 - RNA, 16 nt, Human
aauauaaauaaaaaua

SEQ ID NO: 438814 - RNA, 23 nt, Human
uguugcccacagcuguaugauuc

SEQ ID NO: 438815 - RNA, 16 nt, Human
ugcuguauuuuaaaag

SEQ ID NO: 438816 - RNA, 21 nt, Human
auaauuuuuauauuugaaaua

SEQ ID NO: 438817 - RNA, 21 nt, Human
ucuuauaucuauauuuuacau

SEQ ID NO: 438818 - RNA, 17 nt, Human
aauaaaguguuugaaag

SEQ ID NO: 438819 - RNA, 14 nt, Human
gugagcuacaaaug

SEQ ID NO: 438820 - RNA, 15 nt, Human
aaaauaacaaugaaa

SEQ ID NO: 438821 - RNA, 17 nt, Human
gacagucaccucaugga

SEQ ID NO: 438822 - RNA, 13 nt, Human
aaaaauccuacuu

SEQ ID NO: 438823 - RNA, 22 nt, Human
gaugguucccuugaugaagaag

SEQ ID NO: 438824 - RNA, 17 nt, Human
ucuaaauucuuucauuu

SEQ ID NO: 438825 - RNA, 20 nt, Human
cagugaaagaaaauaacgau

SEQ ID NO: 438826 - RNA, 12 nt, Human
auaacuggaaac

SEQ ID NO: 438827 - RNA, 15 nt, Human
aaggaaaaaauaaca

SEQ ID NO: 438828 - RNA, 20 nt, Human
ugauuauaugucacuuugcu

SEQ ID NO: 438829 - RNA, 20 nt, Human
auuuucaguuauuauauuua

SEQ ID NO: 438830 - RNA, 14 nt, Human
gaaaacaauaacga

SEQ ID NO: 438831 - RNA, 19 nt, Human
cuguccauucuuccuccca

SEQ ID NO: 438832 - RNA, 15 nt, Human
ugucaauaaaaucca

SEQ ID NO: 438833 - RNA, 13 nt, Human
aacaauaaaagac

SEQ ID NO: 438834 - RNA, 16 nt, Human
aucaaguuauuuuuaa

SEQ ID NO: 438835 - RNA, 20 nt, Human
gaaaauaacgauaaaagaca

SEQ ID NO: 438836 - RNA, 14 nt, Human
cuuucauaauaagu

SEQ ID NO: 438837 - RNA, 21 nt, Human
gaaaaaaagcuuuuuuugaau

SEQ ID NO: 438838 - RNA, 17 nt, Human
gucaaagcugaaaugga

SEQ ID NO: 438839 - RNA, 17 nt, Human
aacaguuaccucugccu

SEQ ID NO: 438840 - RNA, 18 nt, Human
uuucucugauacagaaaa

SEQ ID NO: 438841 - RNA, 13 nt, Human
uuuuaaaaaagaa

SEQ ID NO: 438842 - RNA, 18 nt, Human
cuggaaacuucagcgguu

SEQ ID NO: 438843 - RNA, 18 nt, Human
auucuugccaaauauaaa

SEQ ID NO: 438844 - RNA, 18 nt, Human
cggcuggagcugccucuc

SEQ ID NO: 438845 - RNA, 20 nt, Human
uguuggugaacuugguuuua

SEQ ID NO: 438846 - RNA, 14 nt, Human
uuuuaaaaaagaaa

SEQ ID NO: 438847 - RNA, 19 nt, Human
uggaacaguuaccucugcc

SEQ ID NO: 438848 - RNA, 18 nt, Human
aaguugauaugccuuuuc

SEQ ID NO: 438849 - RNA, 16 nt, Human
uuuuagugaaauauua

SEQ ID NO: 438850 - RNA, 18 nt, Human
auuaaguuuuuuuuuaaa

SEQ ID NO: 438851 - RNA, 14 nt, Human
aacgauaaaagaca

SEQ ID NO: 438852 - RNA, 14 nt, Human
aaaagacagugaaa

SEQ ID NO: 438853 - RNA, 16 nt, Human
uacauuuguauaaaau

SEQ ID NO: 438854 - RNA, 17 nt, Human
ucuauaauuuaaauaua

SEQ ID NO: 438855 - RNA, 19 nt, Human
gucaaauugugugaaaggu

SEQ ID NO: 438856 - RNA, 11 nt, Human
auuuaaaaauc

SEQ ID NO: 438857 - RNA, 19 nt, Human
aggucuaccaaaaaucuca

SEQ ID NO: 438858 - RNA, 21 nt, Human
auuuguauaaaauaauuuuua

SEQ ID NO: 438859 - RNA, 15 nt, Human
aaggaauuuaaaaau

SEQ ID NO: 438860 - RNA, 16 nt, Human
augaauacuuuauaaa

SEQ ID NO: 438861 - RNA, 19 nt, Human
aagucagucauucagauau

SEQ ID NO: 438862 - RNA, 14 nt, Human
accacaagacugca

SEQ ID NO: 438863 - RNA, 15 nt, Human
aaaagacaaggaaaa

SEQ ID NO: 438864 - RNA, 23 nt, Human
auuauauggcuugaguuuaaauu

SEQ ID NO: 438865 - RNA, 22 nt, Human
auauauaacaaugcuguauuuu

SEQ ID NO: 438866 - RNA, 22 nt, Human
gaaaacaauaacgauaaaagac

SEQ ID NO: 438867 - RNA, 13 nt, Human
ugguccuaagucc

SEQ ID NO: 438868 - RNA, 20 nt, Human
aaucuuucacaggggacagg

SEQ ID NO: 438869 - RNA, 18 nt, Human
cauagguuuaauaauuuu

SEQ ID NO: 438870 - RNA, 22 nt, Human
ccugcugcccuuccccuuccca

SEQ ID NO: 438871 - RNA, 14 nt, Human
auuuauuuuaauaa

SEQ ID NO: 438872 - RNA, 21 nt, Human
gaugcccacggcuggagcugc

SEQ ID NO: 438873 - RNA, 20 nt, Human
uaauaaguugcauagguuua

SEQ ID NO: 438874 - RNA, 22 nt, Human
ccacagcuguaugauucccagc

SEQ ID NO: 438875 - RNA, 20 nt, Human
agaugcaguucugaagaaga

SEQ ID NO: 438876 - RNA, 16 nt, Human
uuaaauagcuuuuuuc

SEQ ID NO: 438877 - RNA, 11 nt, Human
acugggacagg

SEQ ID NO: 438878 - RNA, 13 nt, Human
uggacgagaaaac

SEQ ID NO: 438879 - RNA, 14 nt, Human
agcucguggaacag

SEQ ID NO: 438880 - RNA, 17 nt, Human
agcuacaggccccaucu

SEQ ID NO: 438881 - RNA, 23 nt, Human
uuguaacaagccuccuuuuaaag

SEQ ID NO: 438882 - RNA, 15 nt, Human
uaaauucuuucauuu

SEQ ID NO: 438883 - RNA, 13 nt, Human
aagcauuccaacu

SEQ ID NO: 438884 - RNA, 13 nt, Human
auuauauauauuu

SEQ ID NO: 438885 - RNA, 12 nt, Human
gacagugaaaga

SEQ ID NO: 438886 - RNA, 23 nt, Human
ucuccauguacuggcaagaccug

SEQ ID NO: 438887 - RNA, 21 nt, Human
auguuuaauucugaaagcaac

SEQ ID NO: 438888 - RNA, 18 nt, Human
gaaaauaucacuugucaa

SEQ ID NO: 438889 - RNA, 18 nt, Human
uaauuuuaacucuauaau

SEQ ID NO: 438890 - RNA, 20 nt, Human
aacaagccuccuuuuaaagu

SEQ ID NO: 438891 - RNA, 19 nt, Human
auaauuuuuauauuugaaa

SEQ ID NO: 438892 - RNA, 14 nt, Human
auuuguauaaaaua

SEQ ID NO: 438893 - RNA, 13 nt, Human
uagcuuuuuucuc

SEQ ID NO: 438894 - RNA, 17 nt, Human
cucuuuugggauuuuug

SEQ ID NO: 438895 - RNA, 22 nt, Human
uguauacugugugcuaaaacaa

SEQ ID NO: 438896 - RNA, 21 nt, Human
auuauauggcuugaguuuaaa

SEQ ID NO: 438897 - RNA, 22 nt, Human
aaagagugaaggauuuauguuu

SEQ ID NO: 438898 - RNA, 23 nt, Human
cugaaaucauacuucuuaggguu

SEQ ID NO: 438899 - RNA, 22 nt, Human
cgguccuugcugcaccugugcc

SEQ ID NO: 438900 - RNA, 23 nt, Human
ucugauacagaaaaguugaauuu

SEQ ID NO: 438901 - RNA, 18 nt, Human
caguuguugcccacagcu

SEQ ID NO: 438902 - RNA, 16 nt, Human
uucucuaggaaauauu

SEQ ID NO: 438903 - RNA, 19 nt, Human
gaauaucuccgucaacuca

SEQ ID NO: 438904 - RNA, 18 nt, Human
gaaaauaacgauaaaaga

SEQ ID NO: 438905 - RNA, 18 nt, Human
aaagagugaaggauuuau

SEQ ID NO: 438906 - RNA, 14 nt, Human
cauagaaguaaaaa

SEQ ID NO: 438907 - RNA, 19 nt, Human
uacuucuuaggguuaugau

SEQ ID NO: 438908 - RNA, 21 nt, Human
agccucuuagaugcaguucug

SEQ ID NO: 438909 - RNA, 23 nt, Human
acugucuuguuggacgagaaaac

SEQ ID NO: 438910 - RNA, 23 nt, Human
uagaagucacauuccugaacagg

SEQ ID NO: 438911 - RNA, 19 nt, Human
caauaaagaguuccuucug

SEQ ID NO: 438912 - RNA, 16 nt, Human
acauuugcucauggaa

SEQ ID NO: 438913 - RNA, 19 nt, Human
caugaguaacugauuugua

SEQ ID NO: 438914 - RNA, 17 nt, Human
cuacaggccccaucugg

SEQ ID NO: 438915 - RNA, 13 nt, Human
auugucuagugaa

SEQ ID NO: 438916 - RNA, 19 nt, Human
aagcuuguauuccuuuuuc

SEQ ID NO: 438917 - RNA, 16 nt, Human
uugucaauaaaaucca

SEQ ID NO: 438918 - RNA, 18 nt, Human
auuuuaacucuauaaugu

SEQ ID NO: 438919 - RNA, 15 nt, Human
uaacaauaaaagaca

SEQ ID NO: 438920 - RNA, 13 nt, Human
caacaucuaguga

SEQ ID NO: 438921 - RNA, 17 nt, Human
guauuauuuuuuaaaaa

SEQ ID NO: 438922 - RNA, 19 nt, Human
uucccuugaugaagaaguu

SEQ ID NO: 438923 - RNA, 13 nt, Human
uuuaaaaauccua

SEQ ID NO: 438924 - RNA, 18 nt, Human
acaagccuccuuuuaaag

SEQ ID NO: 438925 - RNA, 13 nt, Human
aaauaaaaauaau

SEQ ID NO: 438926 - RNA, 16 nt, Human
gaguuccuucugcucc

SEQ ID NO: 438927 - RNA, 20 nt, Human
auacugugugcuaaaacaag

SEQ ID NO: 438928 - RNA, 20 nt, Human
gaauucauucacucaacaaa

SEQ ID NO: 438929 - RNA, 16 nt, Human
aaauauaaauaaaaau

SEQ ID NO: 438930 - RNA, 23 nt, Human
uccaaacugacucuuaagaagac

SEQ ID NO: 438931 - RNA, 12 nt, Human
ggcugaugcagu

SEQ ID NO: 438932 - RNA, 23 nt, Human
uguagguagaucuggucuuuaga

SEQ ID NO: 438933 - RNA, 21 nt, Human
caagacugcacaucaaaauau

SEQ ID NO: 438934 - RNA, 19 nt, Human
uagugagcagucaggaaag

SEQ ID NO: 438935 - RNA, 21 nt, Human
ucccugcugcccuuccccuuc

SEQ ID NO: 438936 - RNA, 21 nt, Human
gauuauauauauuuuuuucug

SEQ ID NO: 438937 - RNA, 17 nt, Human
aagacagugaaagaaaa

SEQ ID NO: 438938 - RNA, 22 nt, Human
uguucugauauuggacaguaaa

SEQ ID NO: 438939 - RNA, 20 nt, Human
uaugaaaaggcuaagcuuca

SEQ ID NO: 438940 - RNA, 14 nt, Human
aauuguauuacaaa

SEQ ID NO: 438941 - RNA, 14 nt, Human
auauuugaaauauu

SEQ ID NO: 438942 - RNA, 19 nt, Human
gaaaauaacgauaaaagac

SEQ ID NO: 438943 - RNA, 22 nt, Human
uuuguagaagucacauuccuga

SEQ ID NO: 438944 - RNA, 23 nt, Human
uuauagcuacuaauuuuaaaaug

SEQ ID NO: 438945 - RNA, 22 nt, Human
agaaagugacaagcucacagac

SEQ ID NO: 438946 - RNA, 21 nt, Human
uuuuagggguagcauuugugu

SEQ ID NO: 438947 - RNA, 23 nt, Human
uuuguauaaaauaauuuuuauau

SEQ ID NO: 438948 - RNA, 18 nt, Human
cuuucacauuuaaauaaa

SEQ ID NO: 438949 - RNA, 18 nt, Human
uuacaaaugggaaacaaa

SEQ ID NO: 438950 - RNA, 12 nt, Human
ugagagacacac

SEQ ID NO: 438951 - RNA, 21 nt, Human
acagugaaagaaaauaacaau

SEQ ID NO: 438952 - RNA, 10 nt, Human
auguuuucag

SEQ ID NO: 438953 - RNA, 16 nt, Human
uuucugaaauuuccug

SEQ ID NO: 438954 - RNA, 14 nt, Human
auaaaauaauuuuu

SEQ ID NO: 438955 - RNA, 21 nt, Human
ugaaauggacuuuuguacaua

SEQ ID NO: 438956 - RNA, 14 nt, Human
agaaaauaacaaua

SEQ ID NO: 438957 - RNA, 17 nt, Human
aaauccuacuuucauaa

SEQ ID NO: 438958 - RNA, 17 nt, Human
aucaaggguacacugcc

SEQ ID NO: 438959 - RNA, 17 nt, Human
aggguguguaaguagau

SEQ ID NO: 438960 - RNA, 21 nt, Human
agcccuucuuuccacagaagc

SEQ ID NO: 438961 - RNA, 15 nt, Human
acugaagaagcacca

SEQ ID NO: 438962 - RNA, 23 nt, Human
cuuauuguagcauccuggaauau

SEQ ID NO: 438963 - RNA, 22 nt, Human
gcuaaaacaagcacuaaacaaa

SEQ ID NO: 438964 - RNA, 15 nt, Human
ucaguuuuugugaaa

SEQ ID NO: 438965 - RNA, 21 nt, Human
aauucauucacucaacaaaca

SEQ ID NO: 438966 - RNA, 13 nt, Human
aaaugggaaacaa

SEQ ID NO: 438967 - RNA, 18 nt, Human
ucaacucauauuuucaug

SEQ ID NO: 438968 - RNA, 21 nt, Human
auuauauuuauuacuguaaga

SEQ ID NO: 438969 - RNA, 20 nt, Human
augcuucuguuuuauaauuu

SEQ ID NO: 438970 - RNA, 20 nt, Human
ucaauaaaauccauacauuu

SEQ ID NO: 438971 - RNA, 16 nt, Human
uuguaaaggaauuuaa

SEQ ID NO: 438972 - RNA, 16 nt, Human
ugcauagguuuaauaa

SEQ ID NO: 438973 - RNA, 13 nt, Human
cccuuccccuucc

SEQ ID NO: 438974 - RNA, 21 nt, Human
gacagugaaagaaaauaacaa

SEQ ID NO: 438975 - RNA, 14 nt, Human
auuauuuuuuaaaa

SEQ ID NO: 438976 - RNA, 14 nt, Human
uauaauuuaaaaua

SEQ ID NO: 438977 - RNA, 18 nt, Human
aguucuccacuagcuaug

SEQ ID NO: 438978 - RNA, 22 nt, Human
agucauucagauaugauucaaa

SEQ ID NO: 438979 - RNA, 20 nt, Human
augucgucaaagcugaaaug

SEQ ID NO: 438980 - RNA, 18 nt, Human
uuguaaaggaauuuaaaa

SEQ ID NO: 438981 - RNA, 17 nt, Human
uuucacauuuaaauaaa

SEQ ID NO: 438982 - RNA, 20 nt, Human
gucauucagauaugauucaa

SEQ ID NO: 438983 - RNA, 14 nt, Human
caaaugcauuucua

SEQ ID NO: 438984 - RNA, 21 nt, Human
ugaaauaaacgucuuaaauau

SEQ ID NO: 438985 - RNA, 17 nt, Human
caagccuccuuuuaaag

SEQ ID NO: 438986 - RNA, 18 nt, Human
uaaugaauacuuuauaaa

SEQ ID NO: 438987 - RNA, 18 nt, Human
cagccucuuagaugcagu

SEQ ID NO: 438988 - RNA, 18 nt, Human
ugaacuugguuuuaauua

SEQ ID NO: 438989 - RNA, 21 nt, Human
ugaaacgaggauugggaaaaa

SEQ ID NO: 438990 - RNA, 19 nt, Human
acagucaccucauggaauu

SEQ ID NO: 438991 - RNA, 17 nt, Human
cuaucucauuuccaagc

SEQ ID NO: 438992 - RNA, 23 nt, Human
uaauuuguaguguuggagaagaa

SEQ ID NO: 438993 - RNA, 18 nt, Human
acauuugcucauggaauu

SEQ ID NO: 438994 - RNA, 13 nt, Human
auauauauuuuuu

SEQ ID NO: 438995 - RNA, 18 nt, Human
caugaauuaguuuuauau

SEQ ID NO: 438996 - RNA, 16 nt, Human
ugcuguucaugaaaga

SEQ ID NO: 438997 - RNA, 22 nt, Human
ugaguuuuucuuuucauuuacc

SEQ ID NO: 438998 - RNA, 23 nt, Human
caccucauggaauuggagcucgu

SEQ ID NO: 438999 - RNA, 23 nt, Human
caauaacgauaaaagacagugaa

SEQ ID NO: 439000 - RNA, 23 nt, Human
auaauguguucauucuggaauaa

SEQ ID NO: 439001 - RNA, 22 nt, Human
agcuuguauuccuuuuucucuc

SEQ ID NO: 439002 - RNA, 17 nt, Human
cgucaacucauauuuuc

SEQ ID NO: 439003 - RNA, 21 nt, Human
aggacagcccuucuuuccaca

SEQ ID NO: 439004 - RNA, 19 nt, Human
aaaagacagugaaagaaaa

SEQ ID NO: 439005 - RNA, 18 nt, Human
auagcuacuaauuuuaaa

SEQ ID NO: 439006 - RNA, 14 nt, Human
augggccauaugaa

SEQ ID NO: 439007 - RNA, 18 nt, Human
gacauuugcucauggaau

SEQ ID NO: 439008 - RNA, 17 nt, Human
cccacggcuggagcugc

SEQ ID NO: 439009 - RNA, 16 nt, Human
aaauauuuauuuuaau

SEQ ID NO: 439010 - RNA, 22 nt, Human
auuacuguaagaaaauaucacu

SEQ ID NO: 439011 - RNA, 23 nt, Human
aguuauuuuuaauuugguuuuca

SEQ ID NO: 439012 - RNA, 12 nt, Human
aauuuaaauaua

SEQ ID NO: 439013 - RNA, 15 nt, Human
ucuaugaaauauuau

SEQ ID NO: 439014 - RNA, 18 nt, Human
guauuauuuuuuaaaaaa

SEQ ID NO: 439015 - RNA, 14 nt, Human
uugaaauuguauua

SEQ ID NO: 439016 - RNA, 21 nt, Human
cacaugaacuuguaaaggaau

SEQ ID NO: 439017 - RNA, 13 nt, Human
aaaguguuugaaa

SEQ ID NO: 439018 - RNA, 16 nt, Human
auuuguauaaaauaau

SEQ ID NO: 439019 - RNA, 22 nt, Human
uauuucagauaaucacaauaca

SEQ ID NO: 439020 - RNA, 22 nt, Human
aauaauccuaaacauaugaauu

SEQ ID NO: 439021 - RNA, 17 nt, Human
aagcacagugaucaagu

SEQ ID NO: 439022 - RNA, 18 nt, Human
uuuauggcacuaguauuu

SEQ ID NO: 439023 - RNA, 14 nt, Human
auuucuaugaaaua

SEQ ID NO: 439024 - RNA, 20 nt, Human
cuuccucccauucaggaugc

SEQ ID NO: 439025 - RNA, 22 nt, Human
uuuacauggcuggagcuagaau

SEQ ID NO: 439026 - RNA, 16 nt, Human
acauuuauauuuuugu

SEQ ID NO: 439027 - RNA, 11 nt, Human
cgauaaaagac

SEQ ID NO: 439028 - RNA, 13 nt, Human
auuuuuuaaaaaa

SEQ ID NO: 439029 - RNA, 16 nt, Human
ucucuaggaaauauuu

SEQ ID NO: 439030 - RNA, 15 nt, Human
acgagauacagaauu

SEQ ID NO: 439031 - RNA, 19 nt, Human
augcccacggcuggagcug

SEQ ID NO: 439032 - RNA, 12 nt, Human
aaaauaacaaua

SEQ ID NO: 439033 - RNA, 13 nt, Human
gccguccccagag

SEQ ID NO: 439034 - RNA, 22 nt, Human
cuuuccacagaagcuccaggua

SEQ ID NO: 439035 - RNA, 22 nt, Human
caugaguaacugauuuguaaca

SEQ ID NO: 439036 - RNA, 19 nt, Human
guuauuauauuuacaaaug

SEQ ID NO: 439037 - RNA, 16 nt, Human
gaucaaguuauuuuua

SEQ ID NO: 439038 - RNA, 12 nt, Human
aagaaaauaacg

SEQ ID NO: 439039 - RNA, 16 nt, Human
aaaagcaucacaugaa

SEQ ID NO: 439040 - RNA, 14 nt, Human
augauguuuagaaa

SEQ ID NO: 439041 - RNA, 19 nt, Human
acaauaacgauaaaagaca

SEQ ID NO: 439042 - RNA, 20 nt, Human
agccuaguugaucagcuuau

SEQ ID NO: 439043 - RNA, 21 nt, Human
ucuuaggguuaugauuaagua

SEQ ID NO: 439044 - RNA, 21 nt, Human
aagauacugaaauaaacgucu

SEQ ID NO: 439045 - RNA, 15 nt, Human
ggcaauagucaaauu

SEQ ID NO: 439046 - RNA, 13 nt, Human
acuaauuuuaaaa

SEQ ID NO: 439047 - RNA, 19 nt, Human
auuaaguuuuuuuuuaaaa

SEQ ID NO: 439048 - RNA, 19 nt, Human
acuucagcgguuuauauaa

SEQ ID NO: 439049 - RNA, 18 nt, Human
acauuuauauuuuuguga

SEQ ID NO: 439050 - RNA, 14 nt, Human
uuuguauaaaauaa

SEQ ID NO: 439051 - RNA, 20 nt, Human
accucugccucagaaaacaa

SEQ ID NO: 439052 - RNA, 18 nt, Human
guuucaaacauauauaac

SEQ ID NO: 439053 - RNA, 13 nt, Human
ucugaaauuuccu

SEQ ID NO: 439054 - RNA, 23 nt, Human
uuuuauagcuacuaauuuuaaaa

SEQ ID NO: 439055 - RNA, 23 nt, Human
augucaauucuugccaaauauaa

SEQ ID NO: 439056 - RNA, 20 nt, Human
auuacauuuguauaaaauaa

SEQ ID NO: 439057 - RNA, 18 nt, Human
auuuaguauuuuguuuca

SEQ ID NO: 439058 - RNA, 17 nt, Human
gcaaauugucacaggac

SEQ ID NO: 439059 - RNA, 19 nt, Human
caucaaggguacacugccu

SEQ ID NO: 439060 - RNA, 12 nt, Human
uguuugaaagcu

SEQ ID NO: 439061 - RNA, 15 nt, Human
aaggguacacugccu

SEQ ID NO: 439062 - RNA, 17 nt, Human
ggaaauauuuauuuuaa

SEQ ID NO: 439063 - RNA, 23 nt, Human
cugccucucucauccacuuucca

SEQ ID NO: 439064 - RNA, 19 nt, Human
cauggaauuggagcucgug

SEQ ID NO: 439065 - RNA, 22 nt, Human
agucccugcugcccuuccccuu

SEQ ID NO: 439066 - RNA, 14 nt, Human
cccauucaggaugc

SEQ ID NO: 439067 - RNA, 17 nt, Human
ucuauaauguguucauu

SEQ ID NO: 439068 - RNA, 21 nt, Human
agcuacuuauuguagcauccu

SEQ ID NO: 439069 - RNA, 21 nt, Human
aaguuuaugguuguauuauuu

SEQ ID NO: 439070 - RNA, 21 nt, Human
caccagucugacuguuuccau

SEQ ID NO: 439071 - RNA, 17 nt, Human
augauuaaguaaugaua

SEQ ID NO: 439072 - RNA, 21 nt, Human
aauaauguuucaaacauauau

SEQ ID NO: 439073 - RNA, 20 nt, Human
auacucuuauaucuauauuu

SEQ ID NO: 439074 - RNA, 19 nt, Human
aaaaucuuauaauuuaaaa

SEQ ID NO: 439075 - RNA, 17 nt, Human
aaaaguugaauuuuaca

SEQ ID NO: 439076 - RNA, 15 nt, Human
auauaaauaaaaaua

SEQ ID NO: 439077 - RNA, 17 nt, Human
accugugccguccccag

SEQ ID NO: 439078 - RNA, 23 nt, Human
ggaacaguuaccucugccucaga

SEQ ID NO: 439079 - RNA, 19 nt, Human
acuaucucauuuccaagca

SEQ ID NO: 439080 - RNA, 13 nt, Human
aagaaaauaacga

SEQ ID NO: 439081 - RNA, 16 nt, Human
cauuucuaaagccauu

SEQ ID NO: 439082 - RNA, 21 nt, Human
uuuguauaaaauaauuuuuau

SEQ ID NO: 439083 - RNA, 13 nt, Human
ugaaagaaaauaa

SEQ ID NO: 439084 - RNA, 17 nt, Human
uauauauuuuuuucuga

SEQ ID NO: 439085 - RNA, 19 nt, Human
cuaagcuucacuguaaaau

SEQ ID NO: 439086 - RNA, 14 nt, Human
uaacuaauuuuaac

SEQ ID NO: 439087 - RNA, 18 nt, Human
uuuaauuugguuuucaca

SEQ ID NO: 439088 - RNA, 21 nt, Human
uaguauuucuaugaaauauua

SEQ ID NO: 439089 - RNA, 16 nt, Human
auuugaugcuacagga

SEQ ID NO: 439090 - RNA, 14 nt, Human
aagcaucacaugaa

SEQ ID NO: 439091 - RNA, 14 nt, Human
aagucagucauuca

SEQ ID NO: 439092 - RNA, 20 nt, Human
uaugcuucuguuuuauaauu

SEQ ID NO: 439093 - RNA, 20 nt, Human
uagcauuuguguugaagagg

SEQ ID NO: 439094 - RNA, 15 nt, Human
guuuuucuuuucauu

SEQ ID NO: 439095 - RNA, 19 nt, Human
uuguagaagucacauuccu

SEQ ID NO: 439096 - RNA, 18 nt, Human
uauuuucaguuauuauau

SEQ ID NO: 439097 - RNA, 15 nt, Human
ugauucaaaugucua

SEQ ID NO: 439098 - RNA, 17 nt, Human
auuuuaauaauguuuca

SEQ ID NO: 439099 - RNA, 21 nt, Human
aaacaauaacgauaaaagaca

SEQ ID NO: 439100 - RNA, 17 nt, Human
aagcuuuuuuugaauca

SEQ ID NO: 439101 - RNA, 17 nt, Human
ucauacuucuuaggguu

SEQ ID NO: 439102 - RNA, 22 nt, Human
aaaucaggguuaguauugucca

SEQ ID NO: 439103 - RNA, 15 nt, Human
ccacaggaaccacaa

SEQ ID NO: 439104 - RNA, 15 nt, Human
cucgugggacaguca

SEQ ID NO: 439105 - RNA, 13 nt, Human
uaugaaauauuau

SEQ ID NO: 439106 - RNA, 15 nt, Human
ucuuauaauuuaaaa

SEQ ID NO: 439107 - RNA, 20 nt, Human
uaacgauaaaagacagugaa

SEQ ID NO: 439108 - RNA, 20 nt, Human
cugcugcccuuccccuuccc

SEQ ID NO: 439109 - RNA, 17 nt, Human
aaauaacgauaaaagac

SEQ ID NO: 439110 - RNA, 17 nt, Human
uguaaaggaauuuaaaa

SEQ ID NO: 439111 - RNA, 22 nt, Human
cccaugauguuuagaaacacaa

SEQ ID NO: 439112 - RNA, 17 nt, Human
auauuugaaauauugac

SEQ ID NO: 439113 - RNA, 16 nt, Human
guuuuuuuuuaaaaaa

SEQ ID NO: 439114 - RNA, 22 nt, Human
agcacagccucuuagaugcagu

SEQ ID NO: 439115 - RNA, 15 nt, Human
uaagucccugcugcc

SEQ ID NO: 439116 - RNA, 12 nt, Human
aagaaaauaaca

SEQ ID NO: 439117 - RNA, 19 nt, Human
aaguugcauagguuuaaua

SEQ ID NO: 439118 - RNA, 15 nt, Human
guccuugcugcaccu

SEQ ID NO: 439119 - RNA, 16 nt, Human
auccuugaagauuuac

SEQ ID NO: 439120 - RNA, 22 nt, Human
aagucccugcugcccuuccccu

SEQ ID NO: 439121 - RNA, 18 nt, Human
uagugaaauauuauuuua

SEQ ID NO: 439122 - RNA, 18 nt, Human
ugcaccugugccgucccc

SEQ ID NO: 439123 - RNA, 15 nt, Human
uuauagcuacuaauu

SEQ ID NO: 439124 - RNA, 23 nt, Human
gaaaacaauaacgauaaaagaca

SEQ ID NO: 439125 - RNA, 19 nt, Human
cucauggaauuggagcucg

SEQ ID NO: 439126 - RNA, 18 nt, Human
agugcacuaauguguaag

SEQ ID NO: 439127 - RNA, 15 nt, Human
gccccauucaacauc

SEQ ID NO: 439128 - RNA, 22 nt, Human
ucuagcaugucgucaaagcuga

SEQ ID NO: 439129 - RNA, 15 nt, Human
ugauaugugaacagu

SEQ ID NO: 439130 - RNA, 19 nt, Human
gugaacuugguuuuaauua

SEQ ID NO: 439131 - RNA, 22 nt, Human
caauaaaagacaaggaaaaaau

SEQ ID NO: 439132 - RNA, 16 nt, Human
gcuuccauuguugucu

SEQ ID NO: 439133 - RNA, 20 nt, Human
aaauaauuuuuauauuugaa

SEQ ID NO: 439134 - RNA, 13 nt, Human
acaaggaaaaaau

SEQ ID NO: 439135 - RNA, 18 nt, Human
uaauaauguuucaaacau

SEQ ID NO: 439136 - RNA, 20 nt, Human
aagucuuucacauuuaaaua

SEQ ID NO: 439137 - RNA, 18 nt, Human
cagcuuauugucuaguga

SEQ ID NO: 439138 - RNA, 17 nt, Human
ucccugcugcccuuccc

SEQ ID NO: 439139 - RNA, 17 nt, Human
uuauuacuguaagaaaa

SEQ ID NO: 439140 - RNA, 22 nt, Human
gcugccucucucauccacuuuc

SEQ ID NO: 439141 - RNA, 23 nt, Human
auuucugagcauuuaauauggau

SEQ ID NO: 439142 - RNA, 20 nt, Human
agagacacacugaagaagca

SEQ ID NO: 439143 - RNA, 15 nt, Human
ccagcacagccucuu

SEQ ID NO: 439144 - RNA, 19 nt, Human
auuggagcucgugggacag

SEQ ID NO: 439145 - RNA, 17 nt, Human
auuuucuauaauuuaaa

SEQ ID NO: 439146 - RNA, 12 nt, Human
gauaaaagacag

SEQ ID NO: 439147 - RNA, 13 nt, Human
acaauaaaagaca

SEQ ID NO: 439148 - RNA, 14 nt, Human
aaagagaacuucca

SEQ ID NO: 439149 - RNA, 18 nt, Human
uguccauucuuccuccca

SEQ ID NO: 439150 - RNA, 19 nt, Human
gcucauggaauuggagcuc

SEQ ID NO: 439151 - RNA, 22 nt, Human
gaaaaucuuauaauuuaaaaua

SEQ ID NO: 439152 - RNA, 16 nt, Human
acugauguaaguaaac

SEQ ID NO: 439153 - RNA, 19 nt, Human
cuuuuggaagguauuuaau

SEQ ID NO: 439154 - RNA, 14 nt, Human
acauagugaggagc

SEQ ID NO: 439155 - RNA, 15 nt, Human
uaggaaauauuuauu

SEQ ID NO: 439156 - RNA, 20 nt, Human
aauaauuuuuauauuugaaa

SEQ ID NO: 439157 - RNA, 16 nt, Human
aaaaauuccaagugau

SEQ ID NO: 439158 - RNA, 16 nt, Human
aggacugaauuaugaa

SEQ ID NO: 439159 - RNA, 15 nt, Human
aauaacgauaaaaga

SEQ ID NO: 439160 - RNA, 14 nt, Human
ucaacucauauuuu

SEQ ID NO: 439161 - RNA, 18 nt, Human
acaaauccaaugaaauga

SEQ ID NO: 439162 - RNA, 22 nt, Human
auauaugcuaagucuuauauau

SEQ ID NO: 439163 - RNA, 11 nt, Human
auacucuuaua

SEQ ID NO: 439164 - RNA, 15 nt, Human
cucguggaacaguua

SEQ ID NO: 439165 - RNA, 14 nt, Human
auuguccaggucua

SEQ ID NO: 439166 - RNA, 20 nt, Human
accuacacgagauacagaau

SEQ ID NO: 439167 - RNA, 13 nt, Human
aaauccuugaaga

SEQ ID NO: 439168 - RNA, 19 nt, Human
agacagugaaagaaaauaa

SEQ ID NO: 439169 - RNA, 21 nt, Human
auauaugcuaagucuuauaua

SEQ ID NO: 439170 - RNA, 16 nt, Human
guccauucuuccuccc

SEQ ID NO: 439171 - RNA, 16 nt, Human
uuuauauuugaaauau

SEQ ID NO: 439172 - RNA, 19 nt, Human
uccccagagcuacaggccc

SEQ ID NO: 439173 - RNA, 21 nt, Human
uauuguagcauccuggaauau

SEQ ID NO: 439174 - RNA, 14 nt, Human
gaaaaaauaacaau

SEQ ID NO: 439175 - RNA, 18 nt, Human
aggaaaaaauaacaauga

SEQ ID NO: 439176 - RNA, 14 nt, Human
cacuaaacaaagag

SEQ ID NO: 439177 - RNA, 20 nt, Human
ugguuguauuauuuuuuaaa

SEQ ID NO: 439178 - RNA, 11 nt, Human
auuuuugaagc

SEQ ID NO: 439179 - RNA, 20 nt, Human
ucacaugaacuuguaaagga

SEQ ID NO: 439180 - RNA, 20 nt, Human
aguuuuuuuuuaaaaaagaa

SEQ ID NO: 439181 - RNA, 13 nt, Human
uaacgauaaaaga

SEQ ID NO: 439182 - RNA, 24 nt, Human
auauucucacagcuccaagaauuu

SEQ ID NO: 439183 - RNA, 21 nt, Human
cuucucacauuuauauuuuug

SEQ ID NO: 439184 - RNA, 14 nt, Human
ucccugcugcccuu

SEQ ID NO: 439185 - RNA, 15 nt, Human
uucacuguaaaauaa

SEQ ID NO: 439186 - RNA, 23 nt, Human
acgaggauugggaaaaaguaauu

SEQ ID NO: 439187 - RNA, 14 nt, Human
cagugaaagaaaau

SEQ ID NO: 439188 - RNA, 20 nt, Human
uaacaagccuccuuuuaaag

SEQ ID NO: 439189 - RNA, 17 nt, Human
uaaaagacagugaaaga

SEQ ID NO: 439190 - RNA, 13 nt, Human
cacaacuauauug

SEQ ID NO: 439191 - RNA, 22 nt, Human
caaaugggaaacaaaaggauaa

SEQ ID NO: 439192 - RNA, 17 nt, Human
agcuacuaauuuuaaaa

SEQ ID NO: 439193 - RNA, 21 nt, Human
uauuauuuuauagcuacuaau

SEQ ID NO: 439194 - RNA, 15 nt, Human
gugaacuugguuuua

SEQ ID NO: 439195 - RNA, 18 nt, Human
aacaaugcuguauuuuaa

SEQ ID NO: 439196 - RNA, 20 nt, Human
uaaaacaagcacuaaacaaa

SEQ ID NO: 439197 - RNA, 18 nt, Human
ugcauagguuuaauaauu

SEQ ID NO: 439198 - RNA, 14 nt, Human
caaggaaaaaauaa

SEQ ID NO: 439199 - RNA, 19 nt, Human
gcacuaguauuucuaugaa

SEQ ID NO: 439200 - RNA, 18 nt, Human
uacauuuguauaaaauaa

SEQ ID NO: 439201 - RNA, 19 nt, Human
ucaauucuugccaaauaua

SEQ ID NO: 439202 - RNA, 22 nt, Human
aacugauguaaguaaacggucu

SEQ ID NO: 439203 - RNA, 19 nt, Human
uauuuuaauaauguuucaa

SEQ ID NO: 439204 - RNA, 16 nt, Human
aaaauaacaauaaaag

SEQ ID NO: 439205 - RNA, 16 nt, Human
ccauuuuuagugaaau

SEQ ID NO: 439206 - RNA, 13 nt, Human
acuguaaaauaau

SEQ ID NO: 439207 - RNA, 20 nt, Human
ugaaaaucuuauaauuuaaa

SEQ ID NO: 439208 - RNA, 22 nt, Human
aucaucaagucuuucacauuua

SEQ ID NO: 439209 - RNA, 13 nt, Human
aucucaauauuuc

SEQ ID NO: 439210 - RNA, 15 nt, Human
uuauauauauuuuuu

SEQ ID NO: 439211 - RNA, 16 nt, Human
ugaagauacugaaaua

SEQ ID NO: 439212 - RNA, 18 nt, Human
aguauuuuguuucagugc

SEQ ID NO: 439213 - RNA, 15 nt, Human
uagauaggccauggg

SEQ ID NO: 439214 - RNA, 15 nt, Human
ucauaauaaguugca

SEQ ID NO: 439215 - RNA, 11 nt, Human
aagucccugcu

SEQ ID NO: 439216 - RNA, 17 nt, Human
auucaaugccccugaau

SEQ ID NO: 439217 - RNA, 20 nt, Human
uuacaaauccaaugaaauga

SEQ ID NO: 439218 - RNA, 12 nt, Human
uauaauuuaaaa

SEQ ID NO: 439219 - RNA, 22 nt, Human
auauuuacaaaugggaaacaaa

SEQ ID NO: 439220 - RNA, 13 nt, Human
aauuuuuauauuu

SEQ ID NO: 439221 - RNA, 24 nt, Human
cauucuggaauaauccuaaacaua

SEQ ID NO: 439222 - RNA, 23 nt, Human
uaacgauaaaagacagugaaaga

SEQ ID NO: 439223 - RNA, 14 nt, Human
uaaaagacaaggaa

SEQ ID NO: 439224 - RNA, 16 nt, Human
cuaaauucuuucauuu

SEQ ID NO: 439225 - RNA, 18 nt, Human
cuucucacauuuauauuu

SEQ ID NO: 439226 - RNA, 17 nt, Human
guuuaauaauuuuuaau

SEQ ID NO: 439227 - RNA, 19 nt, Human
auuuucuauaauuuaaaua

SEQ ID NO: 439228 - RNA, 17 nt, Human
aaauaacaauaaaagac

SEQ ID NO: 439229 - RNA, 15 nt, Human
uuucucugauacaga

SEQ ID NO: 439230 - RNA, 16 nt, Human
agcuacaggccccauc

SEQ ID NO: 439231 - RNA, 19 nt, Human
agcuacuaauuuuaaaaug

SEQ ID NO: 439232 - RNA, 17 nt, Human
cugccucucucauccac

SEQ ID NO: 439233 - RNA, 11 nt, Human
aaagauucaau

SEQ ID NO: 439234 - RNA, 22 nt, Human
ugguuguauuauuuuuuaaaaa

SEQ ID NO: 439235 - RNA, 12 nt, Human
cauagaaguaaa

SEQ ID NO: 439236 - RNA, 17 nt, Human
aaauauaaauaaaaaua

SEQ ID NO: 439237 - RNA, 16 nt, Human
gcuccaagaauuucua

SEQ ID NO: 439238 - RNA, 23 nt, Human
agcaugucgucaaagcugaaaug

SEQ ID NO: 439239 - RNA, 11 nt, Human
auacugaaaua

SEQ ID NO: 439240 - RNA, 14 nt, Human
aauauuauuuuaua

SEQ ID NO: 439241 - RNA, 12 nt, Human
uauuauuuuuua

SEQ ID NO: 439242 - RNA, 14 nt, Human
auuuaaauauaugc

SEQ ID NO: 439243 - RNA, 13 nt, Human
auuuucaugcugu

SEQ ID NO: 439244 - RNA, 17 nt, Human
ucaaguuauuuuuaauu

SEQ ID NO: 439245 - RNA, 13 nt, Human
uuuagugaaauau

SEQ ID NO: 439246 - RNA, 17 nt, Human
gacaaggaaaaaauaac

SEQ ID NO: 439247 - RNA, 17 nt, Human
cacuuuccaauaaagag

SEQ ID NO: 439248 - RNA, 18 nt, Human
uuuuaaaaaagaaacauu

SEQ ID NO: 439249 - RNA, 18 nt, Human
cuccgucaacucauauuu

SEQ ID NO: 439250 - RNA, 17 nt, Human
aagacaaggaaaaaaua

SEQ ID NO: 439251 - RNA, 17 nt, Human
aauaacgauaaaagaca

SEQ ID NO: 439252 - RNA, 15 nt, Human
cccugcugcccuucc

SEQ ID NO: 439253 - RNA, 16 nt, Human
uccuguaauggaagca

SEQ ID NO: 439254 - RNA, 18 nt, Human
auuuuuagugaaauauua

SEQ ID NO: 439255 - RNA, 15 nt, Human
caagcucacagaccu

SEQ ID NO: 439256 - RNA, 15 nt, Human
cagccagcacagccu

SEQ ID NO: 439257 - RNA, 13 nt, Human
cauuuguauaaaa

SEQ ID NO: 439258 - RNA, 19 nt, Human
gguuuaauaauuuuuaauu

SEQ ID NO: 439259 - RNA, 23 nt, Human
uuuauaugcuucuguuuuauaau

SEQ ID NO: 439260 - RNA, 18 nt, Human
acaaaugcauuucuaaag

SEQ ID NO: 439261 - RNA, 14 nt, Human
cuaagcauuccaac

SEQ ID NO: 439262 - RNA, 14 nt, Human
uucacauuuaaaua

SEQ ID NO: 439263 - RNA, 21 nt, Human
aggguuaugauuaaguaauga

SEQ ID NO: 439264 - RNA, 19 nt, Human
cucacauuuauauuuuugu

SEQ ID NO: 439265 - RNA, 23 nt, Human
aacuuguaaaggaauuuaaaaau

SEQ ID NO: 439266 - RNA, 20 nt, Human
uuugcaagccagauuuuccu

SEQ ID NO: 439267 - RNA, 23 nt, Human
ggaugguucccuugaugaagaag

SEQ ID NO: 439268 - RNA, 18 nt, Human
acucuuaagaagacugca

SEQ ID NO: 439269 - RNA, 17 nt, Human
aauaugcucuaaacaug

SEQ ID NO: 439270 - RNA, 16 nt, Human
gacaagcucacagacc

SEQ ID NO: 439271 - RNA, 18 nt, Human
uguauuauuuuuuaaaaa

SEQ ID NO: 439272 - RNA, 15 nt, Human
uuuaauaauuuuuaa

SEQ ID NO: 439273 - RNA, 16 nt, Human
auaaugaauacuuuau

SEQ ID NO: 439274 - RNA, 12 nt, Human
agcuuuuuucuc

SEQ ID NO: 439275 - RNA, 16 nt, Human
cacuaguauuucuaug

SEQ ID NO: 439276 - RNA, 14 nt, Human
uacuaauuuuaaaa

SEQ ID NO: 439277 - RNA, 16 nt, Human
uguaguccuguaaugg

SEQ ID NO: 439278 - RNA, 22 nt, Human
ggcuaagcuucacuguaaaaua

SEQ ID NO: 439279 - RNA, 16 nt, Human
ugcuaagucuuauaua

SEQ ID NO: 439280 - RNA, 13 nt, Human
auuuuaaaagaau

SEQ ID NO: 439281 - RNA, 13 nt, Human
aagacaaggaaaa

SEQ ID NO: 439282 - RNA, 17 nt, Human
uucacuguaaaauaaua

SEQ ID NO: 439283 - RNA, 21 nt, Human
ugaauuaugaaacuuuuggaa

SEQ ID NO: 439284 - RNA, 20 nt, Human
cugauauuggacaguaaaau

SEQ ID NO: 439285 - RNA, 20 nt, Human
uauacugugugcuaaaacaa

SEQ ID NO: 439286 - RNA, 11 nt, Human
cuguuuuauaa

SEQ ID NO: 439287 - RNA, 15 nt, Human
uccagauccuggaaa

SEQ ID NO: 439288 - RNA, 19 nt, Human
gacagucaccucauggaau

SEQ ID NO: 439289 - RNA, 15 nt, Human
uaauuugguuuucac

SEQ ID NO: 439290 - RNA, 23 nt, Human
augaaacuuuuggaagguauuua

SEQ ID NO: 439291 - RNA, 12 nt, Human
gaagaccucauu

SEQ ID NO: 439292 - RNA, 17 nt, Human
uagaagucacauuccug

SEQ ID NO: 439293 - RNA, 17 nt, Human
gaaugagagacacacug

SEQ ID NO: 439294 - RNA, 18 nt, Human
uuuucucuccucucccca

SEQ ID NO: 439295 - RNA, 19 nt, Human
ugaaauggacuuuuguaca

SEQ ID NO: 439296 - RNA, 22 nt, Human
acacuguccauucuuccuccca

SEQ ID NO: 439297 - RNA, 18 nt, Human
uuuugugaagcaaaauuu

SEQ ID NO: 439298 - RNA, 24 nt, Human
uaauuuaaaauaugcucuaaacau

SEQ ID NO: 439299 - RNA, 18 nt, Human
gagccgguccuugcugca

SEQ ID NO: 439300 - RNA, 14 nt, Human
uauuugaaauauug

SEQ ID NO: 439301 - RNA, 23 nt, Human
ugaaaaucuuauaauuuaaaaua

SEQ ID NO: 439302 - RNA, 15 nt, Human
aucuuauaauuuaaa

SEQ ID NO: 439303 - RNA, 15 nt, Human
acagugaaagaaaau

SEQ ID NO: 439304 - RNA, 16 nt, Human
acggcuggagcugccu

SEQ ID NO: 439305 - RNA, 20 nt, Human
uauuuauuacuguaagaaaa

SEQ ID NO: 439306 - RNA, 14 nt, Human
uaaaauccauacau

SEQ ID NO: 439307 - RNA, 13 nt, Human
auaaauaaaaaua

SEQ ID NO: 439308 - RNA, 21 nt, Human
cuuguuggacgagaaaacaau

SEQ ID NO: 439309 - RNA, 16 nt, Human
uucaguuauuauauuu

SEQ ID NO: 439310 - RNA, 23 nt, Human
cuaguaauuggaaaggcagcucu

SEQ ID NO: 439311 - RNA, 15 nt, Human
cugcccuuccccuuc

SEQ ID NO: 439312 - RNA, 21 nt, Human
acaguuaccucugccucagaa

SEQ ID NO: 439313 - RNA, 23 nt, Human
auguuaaaacugggacaggggag

SEQ ID NO: 439314 - RNA, 11 nt, Human
caucuagugag

SEQ ID NO: 439315 - RNA, 20 nt, Human
auaaauggcuuccuggcaau

SEQ ID NO: 439316 - RNA, 11 nt, Human
aauuuaaauag

SEQ ID NO: 439317 - RNA, 17 nt, Human
uuugauaugugaacagu

SEQ ID NO: 439318 - RNA, 17 nt, Human
agacacacugaagaagc

SEQ ID NO: 439319 - RNA, 23 nt, Human
aauauuuauuuuaauaauguuuc

SEQ ID NO: 439320 - RNA, 21 nt, Human
ucaagucuuucacauuuaaau

SEQ ID NO: 439321 - RNA, 19 nt, Human
uguuggacgagaaaacaau

SEQ ID NO: 439322 - RNA, 14 nt, Human
ugcuaagucuuaua

SEQ ID NO: 439323 - RNA, 23 nt, Human
uaaguuuuuuuuuaaaaaagaaa

SEQ ID NO: 439324 - RNA, 16 nt, Human
aauaaaguguuugaaa

SEQ ID NO: 439325 - RNA, 18 nt, Human
acaaaugggaaacaaaag

SEQ ID NO: 439326 - RNA, 18 nt, Human
auagucaaauugugugaa

SEQ ID NO: 439327 - RNA, 17 nt, Human
acacuaagagagaauga

SEQ ID NO: 439328 - RNA, 17 nt, Human
ugcacaucaaaauaugc

SEQ ID NO: 439329 - RNA, 14 nt, Human
gagcuuuuguagaa

SEQ ID NO: 439330 - RNA, 18 nt, Human
uuugaagcacagugauca

SEQ ID NO: 439331 - RNA, 13 nt, Human
cuucucaacucca

SEQ ID NO: 439332 - RNA, 16 nt, Human
cauuuguauaaaauaa

SEQ ID NO: 439333 - RNA, 22 nt, Human
uuugaaacgaggauugggaaaa

SEQ ID NO: 439334 - RNA, 22 nt, Human
aaauguugacaugggacauuug

SEQ ID NO: 439335 - RNA, 23 nt, Human
augaauuaaguuuuuuuuuaaaa

SEQ ID NO: 439336 - RNA, 17 nt, Human
aaaaauccuacuuucau

SEQ ID NO: 439337 - RNA, 20 nt, Human
aaauccuugaagauuuacca

SEQ ID NO: 439338 - RNA, 23 nt, Human
ggaugaauuaaguuuuuuuuuaa

SEQ ID NO: 439339 - RNA, 20 nt, Human
uaaaagacagugaaagaaaa

SEQ ID NO: 439340 - RNA, 15 nt, Human
gccucuuagaugcag

SEQ ID NO: 439341 - RNA, 17 nt, Human
gacagugaaagaaaaua

SEQ ID NO: 439342 - RNA, 16 nt, Human
gcuucacuguaaaaua

SEQ ID NO: 439343 - RNA, 14 nt, Human
aaucucaauauuuc

SEQ ID NO: 439344 - RNA, 18 nt, Human
ucucuaggaaauauuuau

SEQ ID NO: 439345 - RNA, 21 nt, Human
gguuuucacauuggaaacaag

SEQ ID NO: 439346 - RNA, 20 nt, Human
gaauacucuuauaucuauau

SEQ ID NO: 439347 - RNA, 15 nt, Human
uuuaugguuguauua

SEQ ID NO: 439348 - RNA, 13 nt, Human
aguguuugaaagc

SEQ ID NO: 439349 - RNA, 14 nt, Human
ucccuugaugaaga

SEQ ID NO: 439350 - RNA, 16 nt, Human
uacaaaugggaaacaa

SEQ ID NO: 439351 - RNA, 21 nt, Human
augcuacaggauuugaaauug

SEQ ID NO: 439352 - RNA, 15 nt, Human
gaaaacaaggaugaa

SEQ ID NO: 439353 - RNA, 15 nt, Human
uacaggauuugaaau

SEQ ID NO: 439354 - RNA, 14 nt, Human
aagucccugcugcc

SEQ ID NO: 439355 - RNA, 16 nt, Human
acaaggaugaauuaag

SEQ ID NO: 439356 - RNA, 23 nt, Human
ugaaaugaguuuuucuuuucauu

SEQ ID NO: 439357 - RNA, 17 nt, Human
agacagugaaagaaaau

SEQ ID NO: 439358 - RNA, 16 nt, Human
acuaaacaaagaguga

SEQ ID NO: 439359 - RNA, 18 nt, Human
uucugauauuggacagua

SEQ ID NO: 439360 - RNA, 14 nt, Human
aguuuuuuuuuaaa

SEQ ID NO: 439361 - RNA, 20 nt, Human
aauucuugccaaauauaaau

SEQ ID NO: 439362 - RNA, 20 nt, Human
aaagacagugaaagaaaaua

SEQ ID NO: 439363 - RNA, 21 nt, Human
auuuacaaaugggaaacaaaa

SEQ ID NO: 439364 - RNA, 12 nt, Human
uuccugaacagg

SEQ ID NO: 439365 - RNA, 17 nt, Human
auaaguacaugauaagc

SEQ ID NO: 439366 - RNA, 21 nt, Human
auuuaauagguuuggacaaaa

SEQ ID NO: 439367 - RNA, 14 nt, Human
acgagaaaacaaua

SEQ ID NO: 439368 - RNA, 20 nt, Human
aaaaucuuauaauuuaaaau

SEQ ID NO: 439369 - RNA, 19 nt, Human
gcugcaccugugccguccc

SEQ ID NO: 439370 - RNA, 16 nt, Human
cauagaaguaaaaaca

SEQ ID NO: 439371 - RNA, 21 nt, Human
aaauaauuuuuauauuugaaa

SEQ ID NO: 439372 - RNA, 15 nt, Human
agacaaggaaaaaau

SEQ ID NO: 439373 - RNA, 18 nt, Human
aagucuuucacauuuaaa

SEQ ID NO: 439374 - RNA, 19 nt, Human
auuguaguccuguaaugga

SEQ ID NO: 439375 - RNA, 13 nt, Human
cuuccucccauuc

SEQ ID NO: 439376 - RNA, 19 nt, Human
ucaguuauuauauuuacaa

SEQ ID NO: 439377 - RNA, 14 nt, Human
cuaggacugaauua

SEQ ID NO: 439378 - RNA, 20 nt, Human
ugagagacacacugaagaag

SEQ ID NO: 439379 - RNA, 16 nt, Human
uuaauaauuuuuaauu

SEQ ID NO: 439380 - RNA, 20 nt, Human
caagccuccuuuuaaaguaa

SEQ ID NO: 439381 - RNA, 18 nt, Human
aucuuauaauuuaaaaua

SEQ ID NO: 439382 - RNA, 21 nt, Human
auuccuuuuucucuccucucc

SEQ ID NO: 439383 - RNA, 19 nt, Human
guuguauuauuuuuuaaaa

SEQ ID NO: 439384 - RNA, 17 nt, Human
uuauaaucuuucacagg

SEQ ID NO: 439385 - RNA, 15 nt, Human
aagaaaauaacaaua

SEQ ID NO: 439386 - RNA, 16 nt, Human
uuucacauuuaaauaa

SEQ ID NO: 439387 - RNA, 14 nt, Human
ucuuccucccauuc

SEQ ID NO: 439388 - RNA, 14 nt, Human
aaugauuaugaauu

SEQ ID NO: 439389 - RNA, 16 nt, Human
cacuuuccaauaaaga

SEQ ID NO: 439390 - RNA, 14 nt, Human
cuugagguaaaagc

SEQ ID NO: 439391 - RNA, 19 nt, Human
aagcauuccaacuaucuca

SEQ ID NO: 439392 - RNA, 14 nt, Human
uuucuaugaaauau

SEQ ID NO: 439393 - RNA, 22 nt, Human
acaccuuguacuuuauuuucua

SEQ ID NO: 439394 - RNA, 18 nt, Human
cagugaaagaaaauaaca

SEQ ID NO: 439395 - RNA, 22 nt, Human
aucuccgucaacucauauuuuc

SEQ ID NO: 439396 - RNA, 18 nt, Human
cuucacuguaaaauaaua

SEQ ID NO: 439397 - RNA, 18 nt, Human
uaaaagacagugaaagaa

SEQ ID NO: 439398 - RNA, 19 nt, Human
agugaggagcuuugaaacg

SEQ ID NO: 439399 - RNA, 17 nt, Human
agguuuuaaagcuucca

SEQ ID NO: 439400 - RNA, 15 nt, Human
auuucuaugaaauau

SEQ ID NO: 439401 - RNA, 14 nt, Human
guugaauuuuacau

SEQ ID NO: 439402 - RNA, 20 nt, Human
gaaaauaacaauaaaagaca

SEQ ID NO: 439403 - RNA, 17 nt, Human
uaacgauaaaagacagu

SEQ ID NO: 439404 - RNA, 20 nt, Human
aagucacauuccugaacagg

SEQ ID NO: 439405 - RNA, 19 nt, Human
gaaagaaaauaacaauaaa

SEQ ID NO: 439406 - RNA, 20 nt, Human
caaauauaaauaaaaauaau

SEQ ID NO: 439407 - RNA, 18 nt, Human
uggagggaagccuugggg

SEQ ID NO: 439408 - RNA, 13 nt, Human
uuaaauuguaaua

SEQ ID NO: 439409 - RNA, 21 nt, Human
gaagucacauuccugaacagg

SEQ ID NO: 439410 - RNA, 15 nt, Human
agggcucacagaauu

SEQ ID NO: 439411 - RNA, 16 nt, Human
agugaaauauuauuuu

SEQ ID NO: 439412 - RNA, 19 nt, Human
aaacaaaaggauaaugaau

SEQ ID NO: 439413 - RNA, 22 nt, Human
acggcuggagcugccucucuca

SEQ ID NO: 439414 - RNA, 14 nt, Human
auauuuauuuuaau

SEQ ID NO: 439415 - RNA, 14 nt, Human
uuucugaaauuucc

SEQ ID NO: 439416 - RNA, 12 nt, Human
cagauuuuccug

SEQ ID NO: 439417 - RNA, 22 nt, Human
gauaaaagacagugaaagaaaa

SEQ ID NO: 439418 - RNA, 22 nt, Human
cauuuaaauaaaguguuugaaa

SEQ ID NO: 439419 - RNA, 18 nt, Human
cuuuucccaacuccagaa

SEQ ID NO: 439420 - RNA, 20 nt, Human
aaagagugaaggauuuaugu

SEQ ID NO: 439421 - RNA, 13 nt, Human
uaauuuuuauauu

SEQ ID NO: 439422 - RNA, 12 nt, Human
cauuauauuuau

SEQ ID NO: 439423 - RNA, 21 nt, Human
uauuacuguaagaaaauauca

SEQ ID NO: 439424 - RNA, 17 nt, Human
uaaccucuaaauucuuu

SEQ ID NO: 439425 - RNA, 20 nt, Human
aaaacaagcacuaaacaaag

SEQ ID NO: 439426 - RNA, 15 nt, Human
uaaaagacaaggaaa

SEQ ID NO: 439427 - RNA, 16 nt, Human
acaaauccaaugaaau

SEQ ID NO: 439428 - RNA, 13 nt, Human
cugaaauuuccug

SEQ ID NO: 439429 - RNA, 17 nt, Human
uugugaagcaaaauuuu

SEQ ID NO: 439430 - RNA, 15 nt, Human
uacaaaugcauuucu

SEQ ID NO: 439431 - RNA, 16 nt, Human
aaaauaauccucaguu

SEQ ID NO: 439432 - RNA, 14 nt, Human
uauaauuuaaauau

SEQ ID NO: 439433 - RNA, 13 nt, Human
auugauuauaugu

SEQ ID NO: 439434 - RNA, 12 nt, Human
uuuuauauuuga

SEQ ID NO: 439435 - RNA, 19 nt, Human
uaucacuugucaauaaaau

SEQ ID NO: 439436 - RNA, 15 nt, Human
ugccucucucaucca

SEQ ID NO: 439437 - RNA, 14 nt, Human
agucugacuguuuc

SEQ ID NO: 439438 - RNA, 13 nt, Human
gacaaggaaaaaa

SEQ ID NO: 439439 - RNA, 20 nt, Human
uacaucccuuaccugggaaa

SEQ ID NO: 439440 - RNA, 14 nt, Human
agcaaguauuagaa

SEQ ID NO: 439441 - RNA, 14 nt, Human
uaaagcuuccauug

SEQ ID NO: 439442 - RNA, 19 nt, Human
auuuucaguuauuauauuu

SEQ ID NO: 439443 - RNA, 15 nt, Human
auaauuuugugaagc

SEQ ID NO: 439444 - RNA, 23 nt, Human
aggaugguucccuugaugaagaa

SEQ ID NO: 439445 - RNA, 17 nt, Human
cgauaaaagacagugaa

SEQ ID NO: 439446 - RNA, 13 nt, Human
aacaagccuccuu

SEQ ID NO: 439447 - RNA, 14 nt, Human
cuaaacauaugaau

SEQ ID NO: 439448 - RNA, 12 nt, Human
guccccagagcu

SEQ ID NO: 439449 - RNA, 13 nt, Human
uaaacauguuuau

SEQ ID NO: 439450 - RNA, 23 nt, Human
uagauaggucagugcaaauacuc

SEQ ID NO: 439451 - RNA, 15 nt, Human
agaaaacaauaacga

SEQ ID NO: 439452 - RNA, 21 nt, Human
gugccguccccagagcuacag

SEQ ID NO: 439453 - RNA, 17 nt, Human
uacagaaaaguugaauu

SEQ ID NO: 439454 - RNA, 21 nt, Human
uuucaugcuguucaugaaaga

SEQ ID NO: 439455 - RNA, 19 nt, Human
aauauuauguuaaaacugg

SEQ ID NO: 439456 - RNA, 16 nt, Human
uuuucucuaggaaaua

SEQ ID NO: 439457 - RNA, 23 nt, Human
uacaaaugggaaacaaaaggaua

SEQ ID NO: 439458 - RNA, 22 nt, Human
uagacacacaugaaguccaagc

SEQ ID NO: 439459 - RNA, 12 nt, Human
uucucuaggaaa

SEQ ID NO: 439460 - RNA, 16 nt, Human
uaacaauaaaagacaa

SEQ ID NO: 439461 - RNA, 17 nt, Human
cagucauucagauauga

SEQ ID NO: 439462 - RNA, 19 nt, Human
uaucucauuuccaagcaag

SEQ ID NO: 439463 - RNA, 18 nt, Human
auggcuugaguuuaaauu

SEQ ID NO: 439464 - RNA, 19 nt, Human
ucugagcauuuaauaugga

SEQ ID NO: 439465 - RNA, 17 nt, Human
ccccaguuguuucuacu

SEQ ID NO: 439466 - RNA, 14 nt, Human
uauauuuuacauaa

SEQ ID NO: 439467 - RNA, 21 nt, Human
gaaaacaauaacgauaaaaga

SEQ ID NO: 439468 - RNA, 23 nt, Human
guaauuccguagguuauuuucag

SEQ ID NO: 439469 - RNA, 12 nt, Human
caggacagcccu

SEQ ID NO: 439470 - RNA, 15 nt, Human
gcacagccucuuaga

SEQ ID NO: 439471 - RNA, 12 nt, Human
uauuuuuuucug

SEQ ID NO: 439472 - RNA, 20 nt, Human
ccuaagucccugcugcccuu

SEQ ID NO: 439473 - RNA, 14 nt, Human
acaaauccaaugaa

SEQ ID NO: 439474 - RNA, 15 nt, Human
uuuaguauuuuguuu

SEQ ID NO: 439475 - RNA, 14 nt, Human
gccccaucuggucc

SEQ ID NO: 439476 - RNA, 22 nt, Human
gaugcaguucugaagaagaugg

SEQ ID NO: 439477 - RNA, 13 nt, Human
ccagcacagccuc

SEQ ID NO: 439478 - RNA, 22 nt, Human
aauuacauuuguauaaaauaau

SEQ ID NO: 439479 - RNA, 21 nt, Human
aauaauccucaguuuuuguga

SEQ ID NO: 439480 - RNA, 13 nt, Human
uuuguuucagugc

SEQ ID NO: 439481 - RNA, 18 nt, Human
caaugccccugaauuuaa

SEQ ID NO: 439482 - RNA, 18 nt, Human
auuauuuuuuaaaaaaau

SEQ ID NO: 439483 - RNA, 21 nt, Human
uuuuaauuugguuuucacauu

SEQ ID NO: 439484 - RNA, 20 nt, Human
cuaauguguaagacaaaaag

SEQ ID NO: 439485 - RNA, 16 nt, Human
acaugaaguccaagca

SEQ ID NO: 439486 - RNA, 19 nt, Human
agaaaauaacgauaaaaga

SEQ ID NO: 439487 - RNA, 18 nt, Human
ucuaugaaauauuauguu

SEQ ID NO: 439488 - RNA, 16 nt, Human
uucaaugccccugaau

SEQ ID NO: 439489 - RNA, 12 nt, Human
gacgagaaaaca

SEQ ID NO: 439490 - RNA, 12 nt, Human
aauuuuaaaaug

SEQ ID NO: 439491 - RNA, 21 nt, Human
uacauaaauuuaguauuuugu

SEQ ID NO: 439492 - RNA, 17 nt, Human
acagaaaaguugaauuu

SEQ ID NO: 439493 - RNA, 15 nt, Human
aauacuuuauaaagg

SEQ ID NO: 439494 - RNA, 17 nt, Human
ccaaaaaucucaauauu

SEQ ID NO: 439495 - RNA, 19 nt, Human
agagccuuuuuuugaaaaa

SEQ ID NO: 439496 - RNA, 18 nt, Human
gaugcaguucugaagaag

SEQ ID NO: 439497 - RNA, 13 nt, Human
cucagaaaacaag

SEQ ID NO: 439498 - RNA, 22 nt, Human
ccauuucuugagguaaaagcau

SEQ ID NO: 439499 - RNA, 15 nt, Human
acuuuauaaaggauu

SEQ ID NO: 439500 - RNA, 19 nt, Human
auuuugugaagcaaaauuu

SEQ ID NO: 439501 - RNA, 20 nt, Human
uagaagucacauuccugaac

SEQ ID NO: 439502 - RNA, 16 nt, Human
uucuauaauuuaaaua

SEQ ID NO: 439503 - RNA, 22 nt, Human
uuuaauaauguuucaaacauau

SEQ ID NO: 439504 - RNA, 18 nt, Human
uauuuuacauaaauuuag

SEQ ID NO: 439505 - RNA, 17 nt, Human
agggcauagaaguaaaa

SEQ ID NO: 439506 - RNA, 14 nt, Human
aaauauaaauaaaa

SEQ ID NO: 439507 - RNA, 14 nt, Human
auaaauaaaaauaa

SEQ ID NO: 439508 - RNA, 19 nt, Human
auucccagccagcacagcc

SEQ ID NO: 439509 - RNA, 13 nt, Human
auaacuggaaacu

SEQ ID NO: 439510 - RNA, 23 nt, Human
aguaauuggaaaggcagcucuaa

SEQ ID NO: 439511 - RNA, 15 nt, Human
caaggaaaaaauaac

SEQ ID NO: 439512 - RNA, 22 nt, Human
auauaaauaaaaauaauccuca

SEQ ID NO: 439513 - RNA, 20 nt, Human
gacauuugcucauggaauug

SEQ ID NO: 439514 - RNA, 21 nt, Human
aaaauuuuuucucuaggaaau

SEQ ID NO: 439515 - RNA, 15 nt, Human
auuauuuuuuaaaaa

SEQ ID NO: 439516 - RNA, 15 nt, Human
aagcacuaaacaaag

SEQ ID NO: 439517 - RNA, 14 nt, Human
acagaauuuuaugc

SEQ ID NO: 439518 - RNA, 23 nt, Human
auuuaaauagcuuuuuucucuga

SEQ ID NO: 439519 - RNA, 13 nt, Human
auaacgauaaaag

SEQ ID NO: 439520 - RNA, 22 nt, Human
aauuuuuucucuaggaaauauu

SEQ ID NO: 439521 - RNA, 16 nt, Human
auaacuggaaacuuca

SEQ ID NO: 439522 - RNA, 14 nt, Human
ugcucauggaauug

SEQ ID NO: 439523 - RNA, 14 nt, Human
gaaugauuaugaau

SEQ ID NO: 439524 - RNA, 18 nt, Human
aaauauaaauaaaaauaa

SEQ ID NO: 439525 - RNA, 22 nt, Human
agaaugagagacacacugaaga

SEQ ID NO: 439526 - RNA, 19 nt, Human
gucuuucacauuuaaauaa

SEQ ID NO: 439527 - RNA, 23 nt, Human
uuuccaucaaggguacacugccu

SEQ ID NO: 439528 - RNA, 13 nt, Human
ccuuccccuuccc

SEQ ID NO: 439529 - RNA, 12 nt, Human
auuuuaaaagaa

SEQ ID NO: 439530 - RNA, 20 nt, Human
uugauaaguacaugauaagc

SEQ ID NO: 439531 - RNA, 17 nt, Human
ugaaggauuuauguuua

SEQ ID NO: 439532 - RNA, 17 nt, Human
cucgugggacagucacc

SEQ ID NO: 439533 - RNA, 23 nt, Human
ugaauuauguuugcauguucacu

SEQ ID NO: 439534 - RNA, 20 nt, Human
uggaauaauccuaaacauau

SEQ ID NO: 439535 - RNA, 14 nt, Human
aacucauauuuuca

SEQ ID NO: 439536 - RNA, 17 nt, Human
auguugacaugggacau

SEQ ID NO: 439537 - RNA, 16 nt, Human
accucugccucagaaa

SEQ ID NO: 439538 - RNA, 14 nt, Human
gauaugugaacagu

SEQ ID NO: 439539 - RNA, 16 nt, Human
uucacauuuaaauaaa

SEQ ID NO: 439540 - RNA, 19 nt, Human
aaaccgaacugauguaagu

SEQ ID NO: 439541 - RNA, 16 nt, Human
ugauacagaaaaguug

SEQ ID NO: 439542 - RNA, 16 nt, Human
ccccuucccacacugu

SEQ ID NO: 439543 - RNA, 13 nt, Human
cugaauuuaaaua

SEQ ID NO: 439544 - RNA, 13 nt, Human
caguuauuauauu

SEQ ID NO: 439545 - RNA, 20 nt, Human
acagcccuucuuuccacaga

SEQ ID NO: 439546 - RNA, 17 nt, Human
aaccucuaaauucuuuc

SEQ ID NO: 439547 - RNA, 15 nt, Human
caaauccaaugaaau

SEQ ID NO: 439548 - RNA, 16 nt, Human
acaugaacuuguaaag

SEQ ID NO: 439549 - RNA, 18 nt, Human
auguuaaaacugggacag

SEQ ID NO: 439550 - RNA, 19 nt, Human
uucacauuggaaacaaguc

SEQ ID NO: 439551 - RNA, 18 nt, Human
uucucuaggaaauauuua

SEQ ID NO: 439552 - RNA, 12 nt, Human
agacagugaaag

SEQ ID NO: 439553 - RNA, 15 nt, Human
agaauaccacaggaa

SEQ ID NO: 439554 - RNA, 17 nt, Human
cugaacaggauauucuc

SEQ ID NO: 439555 - RNA, 13 nt, Human
aacucuauaaugu

SEQ ID NO: 439556 - RNA, 16 nt, Human
uauuuuugugauuuug

SEQ ID NO: 439557 - RNA, 12 nt, Human
cagugaaagaaa

SEQ ID NO: 439558 - RNA, 15 nt, Human
aguucugaagaagau

SEQ ID NO: 439559 - RNA, 15 nt, Human
ccuugccaugugcua

SEQ ID NO: 439560 - RNA, 13 nt, Human
uuauguuuaauuc

SEQ ID NO: 439561 - RNA, 21 nt, Human
cauuucuugagguaaaagcau

SEQ ID NO: 439562 - RNA, 23 nt, Human
ugcauagguuuaauaauuuuuaa

SEQ ID NO: 439563 - RNA, 19 nt, Human
gcuuguauuccuuuuucuc

SEQ ID NO: 439564 - RNA, 20 nt, Brucella suis 1330
uuugccgcgcgaagcgcauc

SEQ ID NO: 439565 - RNA, 22 nt, Brucella suis 1330
uuugguuugaaaauguucuaaa

SEQ ID NO: 439566 - RNA, 19 nt, Brucella suis 1330
uuucgggaugcgcucuaac

SEQ ID NO: 439567 - RNA, 22 nt, Brucella suis 1330
uuucgggcaaggggcggaacag

SEQ ID NO: 439568 - RNA, 20 nt, Brucella suis 1330
uuugcaagccgcggcgcgac

SEQ ID NO: 439569 - RNA, 14 nt, Brucella suis 1330
uuuuaugcaucuga

SEQ ID NO: 439570 - RNA, 22 nt, Brucella suis 1330
uuggugaaggauaucgaaaaau

SEQ ID NO: 439571 - RNA, 20 nt, Brucella suis 1330
uugcuggaaaugcucuagaa

SEQ ID NO: 439572 - RNA, 21 nt, Brucella suis 1330
uugcuugagggguucggcguc

SEQ ID NO: 439573 - RNA, 22 nt, Brucella suis 1330
uugcggguugaauccuuccuga

SEQ ID NO: 439574 - RNA, 17 nt, Brucella suis 1330
uugcgggaaggcgcgac

SEQ ID NO: 439575 - RNA, 16 nt, Brucella suis 1330
uugcgcuugccgccgg

SEQ ID NO: 439576 - RNA, 21 nt, Brucella suis 1330
uugcgcagcgcaggcgcgauc

SEQ ID NO: 439577 - RNA, 14 nt, Brucella suis 1330
uugcgcagcgccgc

SEQ ID NO: 439578 - RNA, 22 nt, Brucella suis 1330
uugcgcaaggcccucgcggauc

SEQ ID NO: 439579 - RNA, 18 nt, Brucella suis 1330
uugcgcaaacaucgacau

SEQ ID NO: 439580 - RNA, 12 nt, Brucella suis 1330
uugcgaauggca

SEQ ID NO: 439581 - RNA, 13 nt, Brucella suis 1330
uugcgaauggcaa

SEQ ID NO: 439582 - RNA, 21 nt, Brucella suis 1330
uugccuucaggcggcgcucga

SEQ ID NO: 439583 - RNA, 16 nt, Brucella suis 1330
uugccuucaucggcaa

SEQ ID NO: 439584 - RNA, 16 nt, Brucella suis 1330
uugccgccuuucaugc

SEQ ID NO: 439585 - RNA, 19 nt, Brucella suis 1330
uugccgcucucgucgagaa

SEQ ID NO: 439586 - RNA, 22 nt, Brucella suis 1330
uugcagggcuugcuugccauuc

SEQ ID NO: 439587 - RNA, 16 nt, Brucella suis 1330
uugcaugggcgugauc

SEQ ID NO: 439588 - RNA, 16 nt, Brucella suis 1330
uugcagccgccagauc

SEQ ID NO: 439589 - RNA, 14 nt, Brucella suis 1330
uugcagagcgcauc

SEQ ID NO: 439590 - RNA, 20 nt, Brucella suis 1330
uugauuucggauugaagccg

SEQ ID NO: 439591 - RNA, 20 nt, Brucella suis 1330
uugcaaagcgcaucccgaaa

SEQ ID NO: 439592 - RNA, 22 nt, Brucella suis 1330
uugcaacgucaagcagcggauc

SEQ ID NO: 439593 - RNA, 22 nt, Brucella suis 1330
uugaucgagccgacaucgcgcu

SEQ ID NO: 439594 - RNA, 14 nt, Brucella suis 1330
uugaucgccgcacg

SEQ ID NO: 439595 - RNA, 11 nt, Brucella suis 1330
uugaucggcau

SEQ ID NO: 439596 - RNA, 21 nt, Brucella suis 1330
uugaugacgaaaaaggcgauc

SEQ ID NO: 439597 - RNA, 19 nt, Brucella suis 1330
uugaggcugucgaaugucu

SEQ ID NO: 439598 - RNA, 17 nt, Brucella suis 1330
uugaggauugccgccgc

SEQ ID NO: 439599 - RNA, 23 nt, Brucella suis 1330
uugagaguagucugcgcaucguc

SEQ ID NO: 439600 - RNA, 14 nt, Brucella suis 1330
uugaccagauagcc

SEQ ID NO: 439601 - RNA, 14 nt, Brucella suis 1330
uuccguaucuccgg

SEQ ID NO: 439602 - RNA, 17 nt, Brucella suis 1330
uuccggcagaccggauc

SEQ ID NO: 439603 - RNA, 17 nt, Brucella suis 1330
uuccgcuacugcggcga

SEQ ID NO: 439604 - RNA, 12 nt, Brucella suis 1330
uuccagccguuc

SEQ ID NO: 439605 - RNA, 22 nt, Brucella suis 1330
uuccacgaugagaaugccguuc

SEQ ID NO: 439606 - RNA, 22 nt, Brucella suis 1330
uucacacuuuucgggaugcgcu

SEQ ID NO: 439607 - RNA, 21 nt, Brucella suis 1330
uuaugcuauagagcgccgauc

SEQ ID NO: 439608 - RNA, 19 nt, Brucella suis 1330
uuagagcauuuccagcaaa

SEQ ID NO: 439609 - RNA, 19 nt, Brucella suis 1330
uguugggguuggccugaac

SEQ ID NO: 439610 - RNA, 13 nt, Brucella suis 1330
uguuuaugaaaac

SEQ ID NO: 439611 - RNA, 23 nt, Brucella suis 1330
uuaacagaaccaucggaaccgcu

SEQ ID NO: 439612 - RNA, 13 nt, Brucella suis 1330
uguucuuccgaga

SEQ ID NO: 439613 - RNA, 14 nt, Brucella suis 1330
uguuaaaaccggaa

SEQ ID NO: 439614 - RNA, 14 nt, Brucella suis 1330
ugugcagacaggcc

SEQ ID NO: 439615 - RNA, 19 nt, Brucella suis 1330
ugugcagacaggccagucg

SEQ ID NO: 439616 - RNA, 12 nt, Brucella suis 1330
ugugaaggcgcu

SEQ ID NO: 439617 - RNA, 22 nt, Brucella suis 1330
ugugaugcgguucagauugcag

SEQ ID NO: 439618 - RNA, 19 nt, Brucella suis 1330
ugugauuccaacauuugcu

SEQ ID NO: 439619 - RNA, 21 nt, Brucella suis 1330
ugucaguucaggugcgacuuc

SEQ ID NO: 439620 - RNA, 22 nt, Brucella suis 1330
uguagaagacaaagcccgucuc

SEQ ID NO: 439621 - RNA, 13 nt, Brucella suis 1330
ugucagcgggcaa

SEQ ID NO: 439622 - RNA, 18 nt, Brucella suis 1330
ugucagcuuuccggcuuc

SEQ ID NO: 439623 - RNA, 15 nt, Brucella suis 1330
ugggcgcaccgcaag

SEQ ID NO: 439624 - RNA, 14 nt, Brucella suis 1330
uggcugcccgccgc

SEQ ID NO: 439625 - RNA, 19 nt, Brucella suis 1330
uggcugagauaaaccggcc

SEQ ID NO: 439626 - RNA, 16 nt, Brucella suis 1330
uggcguugagccgcgc

SEQ ID NO: 439627 - RNA, 18 nt, Brucella suis 1330
uggcguugagccgcgcca

SEQ ID NO: 439628 - RNA, 18 nt, Brucella suis 1330
uggcgucgaauaucuuga

SEQ ID NO: 439629 - RNA, 20 nt, Brucella suis 1330
uggcggccaagcggaucgcg

SEQ ID NO: 439630 - RNA, 14 nt, Brucella suis 1330
uggcgcccgcccgc

SEQ ID NO: 439631 - RNA, 18 nt, Brucella suis 1330
uggcgcccgcccgccgca

SEQ ID NO: 439632 - RNA, 17 nt, Brucella suis 1330
uggccgagcgacacauc

SEQ ID NO: 439633 - RNA, 14 nt, Brucella suis 1330
uggccgaaccgucc

SEQ ID NO: 439634 - RNA, 13 nt, Brucella suis 1330
uggcagccgggau

SEQ ID NO: 439635 - RNA, 15 nt, Brucella suis 1330
uggcacaagaacagc

SEQ ID NO: 439636 - RNA, 12 nt, Brucella suis 1330
uggcaagcccgc

SEQ ID NO: 439637 - RNA, 15 nt, Brucella suis 1330
uggcaagcccgcugc

SEQ ID NO: 439638 - RNA, 15 nt, Brucella suis 1330
uggauuucgagcuga

SEQ ID NO: 439639 - RNA, 17 nt, Brucella suis 1330
uggaugucgauuucacc

SEQ ID NO: 439640 - RNA, 16 nt, Brucella suis 1330
uggagugcacggccau

SEQ ID NO: 439641 - RNA, 18 nt, Brucella suis 1330
uggagcgcauccgccugc

SEQ ID NO: 439642 - RNA, 18 nt, Brucella suis 1330
uggagcauuuccagcaaa

SEQ ID NO: 439643 - RNA, 20 nt, Brucella suis 1330
uggaacucgaagauggaacg

SEQ ID NO: 439644 - RNA, 23 nt, Brucella suis 1330
uggaacguacaccgaggccgcca

SEQ ID NO: 439645 - RNA, 15 nt, Brucella suis 1330
ugcggcggcgcgcaa

SEQ ID NO: 439646 - RNA, 16 nt, Brucella suis 1330
ugcggcaguccggcag

SEQ ID NO: 439647 - RNA, 21 nt, Brucella suis 1330
ugcggauaucgcuggcgucga

SEQ ID NO: 439648 - RNA, 15 nt, Brucella suis 1330
ugcggaucggcuuca

SEQ ID NO: 439649 - RNA, 17 nt, Brucella suis 1330
ugcgcucgguaucggcg

SEQ ID NO: 439650 - RNA, 23 nt, Brucella suis 1330
ugcgcucgauggguaggauaaug

SEQ ID NO: 439651 - RNA, 15 nt, Brucella suis 1330
ugcgcgcgcauggcg

SEQ ID NO: 439652 - RNA, 20 nt, Brucella suis 1330
ugcgccagcgauugcgcauu

SEQ ID NO: 439653 - RNA, 23 nt, Brucella suis 1330
ugcgauuucgccuucgccgagau

SEQ ID NO: 439654 - RNA, 15 nt, Brucella suis 1330
ugccugccgcagcca

SEQ ID NO: 439655 - RNA, 22 nt, Brucella suis 1330
ugccgggcgcaaccuggcugca

SEQ ID NO: 439656 - RNA, 17 nt, Brucella suis 1330
ugccggccugaaacagc

SEQ ID NO: 439657 - RNA, 16 nt, Brucella suis 1330
ugccgauuucggcgug

SEQ ID NO: 439658 - RNA, 23 nt, Brucella suis 1330
ugccgagccgaauuccgccaugc

SEQ ID NO: 439659 - RNA, 22 nt, Brucella suis 1330
ugccgacgcgcucggcaagcuc

SEQ ID NO: 439660 - RNA, 14 nt, Brucella suis 1330
ugccagauggcguu

SEQ ID NO: 439661 - RNA, 23 nt, Brucella suis 1330
ugccaccagcacacagccaagac

SEQ ID NO: 439662 - RNA, 17 nt, Brucella suis 1330
ugcaucccgaaaagugc

SEQ ID NO: 439663 - RNA, 13 nt, Brucella suis 1330
ugcauaaucggca

SEQ ID NO: 439664 - RNA, 12 nt, Brucella suis 1330
ugcaccgccgau

SEQ ID NO: 439665 - RNA, 16 nt, Brucella suis 1330
ugcaauggucgacaau

SEQ ID NO: 439666 - RNA, 17 nt, Brucella suis 1330
ugauuugucggaagccg

SEQ ID NO: 439667 - RNA, 16 nt, Brucella suis 1330
ugaucguauagcccug

SEQ ID NO: 439668 - RNA, 17 nt, Brucella suis 1330
ugauccgucacggucag

SEQ ID NO: 439669 - RNA, 14 nt, Brucella suis 1330
ugagggccgugacc

SEQ ID NO: 439670 - RNA, 20 nt, Brucella suis 1330
ugagcuugcgcagcgccgca

SEQ ID NO: 439671 - RNA, 21 nt, Brucella suis 1330
ugagcuugcgcagcgccgcau

SEQ ID NO: 439672 - RNA, 20 nt, Brucella suis 1330
ugacuugaagucaucccgcc

SEQ ID NO: 439673 - RNA, 20 nt, Brucella suis 1330
ugagcaccggaagcgcaaaa

SEQ ID NO: 439674 - RNA, 23 nt, Brucella suis 1330
ugacggucgaagccacggcgauu

SEQ ID NO: 439675 - RNA, 21 nt, Brucella suis 1330
ugacggcagccucgacacgcc

SEQ ID NO: 439676 - RNA, 21 nt, Brucella suis 1330
ugacggcccggugcagcggca

SEQ ID NO: 439677 - RNA, 20 nt, Brucella suis 1330
ugacggccugcaaauggcgu

SEQ ID NO: 439678 - RNA, 19 nt, Brucella suis 1330
ugacgcccauuucacccgc

SEQ ID NO: 439679 - RNA, 16 nt, Brucella suis 1330
ugacgccauugaccgc

SEQ ID NO: 439680 - RNA, 17 nt, Brucella suis 1330
ugacgaucuggaacagu

SEQ ID NO: 439681 - RNA, 20 nt, Brucella suis 1330
ugacgagcgcacgcaggcau

SEQ ID NO: 439682 - RNA, 21 nt, Brucella suis 1330
ugacgaaaaaggcgaucaggu

SEQ ID NO: 439683 - RNA, 22 nt, Brucella suis 1330
ugacgaaaugaacaucggcgcg

SEQ ID NO: 439684 - RNA, 22 nt, Brucella suis 1330
ugaccgugauucuuucuucgcc

SEQ ID NO: 439685 - RNA, 18 nt, Brucella suis 1330
ugaccgccuggcccggcu

SEQ ID NO: 439686 - RNA, 13 nt, Brucella suis 1330
ugacaauggccgu

SEQ ID NO: 439687 - RNA, 16 nt, Brucella suis 1330
ugacaccuucggccag

SEQ ID NO: 439688 - RNA, 13 nt, Brucella suis 1330
ugaagacaucgag

SEQ ID NO: 439689 - RNA, 14 nt, Brucella suis 1330
ugaaaucgucacug

SEQ ID NO: 439690 - RNA, 14 nt, Brucella suis 1330
ucuuugucggcucc

SEQ ID NO: 439691 - RNA, 19 nt, Brucella suis 1330
ugaaagaccgcauuccggc

SEQ ID NO: 439692 - RNA, 19 nt, Brucella suis 1330
ugaaaggugaaggccugcu

SEQ ID NO: 439693 - RNA, 14 nt, Brucella suis 1330
ucguggcggcaaaa

SEQ ID NO: 439694 - RNA, 14 nt, Brucella suis 1330
ucgucuucaagcac

SEQ ID NO: 439695 - RNA, 20 nt, Brucella suis 1330
ucgguggcauugcccaugga

SEQ ID NO: 439696 - RNA, 22 nt, Brucella suis 1330
ucgguguuggucugcggcuucc

SEQ ID NO: 439697 - RNA, 21 nt, Brucella suis 1330
ucgggcaaggggcggaacagg

SEQ ID NO: 439698 - RNA, 20 nt, Brucella suis 1330
ucggcuuuacguccggcacg

SEQ ID NO: 439699 - RNA, 15 nt, Brucella suis 1330
ucggcgaugaagcgg

SEQ ID NO: 439700 - RNA, 17 nt, Brucella suis 1330
ucggccuugaucggcau

SEQ ID NO: 439701 - RNA, 19 nt, Brucella suis 1330
ucggccgacagaugcgcau

SEQ ID NO: 439702 - RNA, 16 nt, Brucella suis 1330
ucggcccagcaccgcg

SEQ ID NO: 439703 - RNA, 14 nt, Brucella suis 1330
ucggccccggcacg

SEQ ID NO: 439704 - RNA, 17 nt, Brucella suis 1330
ucggccagagcuucgcc

SEQ ID NO: 439705 - RNA, 23 nt, Brucella suis 1330
ucggccagagcuucgccgccaug

SEQ ID NO: 439706 - RNA, 17 nt, Brucella suis 1330
ucggcauggcagccgau

SEQ ID NO: 439707 - RNA, 20 nt, Brucella suis 1330
ucggcauaggcuucggccgc

SEQ ID NO: 439708 - RNA, 13 nt, Brucella suis 1330
ucgcugcggccau

SEQ ID NO: 439709 - RNA, 15 nt, Brucella suis 1330
ucgcugcggccaugc

SEQ ID NO: 439710 - RNA, 15 nt, Brucella suis 1330
ucgcucaggccuguu

SEQ ID NO: 439711 - RNA, 16 nt, Brucella suis 1330
ucgcgcucggcaagcg

SEQ ID NO: 439712 - RNA, 14 nt, Brucella suis 1330
ucgcgcaggccgcg

SEQ ID NO: 439713 - RNA, 18 nt, Brucella suis 1330
ucgcgcaggccgcggcau

SEQ ID NO: 439714 - RNA, 16 nt, Brucella suis 1330
ucgccugcaccaugga

SEQ ID NO: 439715 - RNA, 14 nt, Brucella suis 1330
ucgccgugcgccug

SEQ ID NO: 439716 - RNA, 17 nt, Brucella suis 1330
ucgccaguuucauuucc

SEQ ID NO: 439717 - RNA, 12 nt, Brucella suis 1330
ucgccagcgccg

SEQ ID NO: 439718 - RNA, 23 nt, Brucella suis 1330
ucgccaagaagaacacagccccu

SEQ ID NO: 439719 - RNA, 13 nt, Brucella suis 1330
ucgccaagcuuga

SEQ ID NO: 439720 - RNA, 20 nt, Brucella suis 1330
ucgccaagcuugaucgccgc

SEQ ID NO: 439721 - RNA, 16 nt, Brucella suis 1330
ucgcaucugccaguug

SEQ ID NO: 439722 - RNA, 23 nt, Brucella suis 1330
ucgcauccggcccguugccgauc

SEQ ID NO: 439723 - RNA, 15 nt, Brucella suis 1330
ucgaguucugcgcgg

SEQ ID NO: 439724 - RNA, 20 nt, Brucella suis 1330
ucgagaaaaagaugcgccgg

SEQ ID NO: 439725 - RNA, 23 nt, Brucella suis 1330
ucgacgcuuuccaccggcucauu

SEQ ID NO: 439726 - RNA, 12 nt, Brucella suis 1330
uccggcguuucu

SEQ ID NO: 439727 - RNA, 20 nt, Brucella suis 1330
uccggcaaaacggcaggcau

SEQ ID NO: 439728 - RNA, 23 nt, Brucella suis 1330
uccgcggcgguuuugagcugcug

SEQ ID NO: 439729 - RNA, 17 nt, Brucella suis 1330
uccgccucccugcgcgc

SEQ ID NO: 439730 - RNA, 18 nt, Brucella suis 1330
uccgccggggcaggcucc

SEQ ID NO: 439731 - RNA, 17 nt, Brucella suis 1330
uccgacagggcaagcgc

SEQ ID NO: 439732 - RNA, 18 nt, Brucella suis 1330
ucccaagcggguuucagc

SEQ ID NO: 439733 - RNA, 20 nt, Brucella suis 1330
uccagucaggauauuucggc

SEQ ID NO: 439734 - RNA, 18 nt, Brucella suis 1330
uccagaauaucuucgagc

SEQ ID NO: 439735 - RNA, 20 nt, Brucella suis 1330
uccagaacuucgccaagccc

SEQ ID NO: 439736 - RNA, 19 nt, Brucella suis 1330
ucauuggauagauggaaag

SEQ ID NO: 439737 - RNA, 17 nt, Brucella suis 1330
ucauuuuugacaagccg

SEQ ID NO: 439738 - RNA, 15 nt, Brucella suis 1330
ucauggccgccccgg

SEQ ID NO: 439739 - RNA, 16 nt, Brucella suis 1330
ucaucgcccucgcgcc

SEQ ID NO: 439740 - RNA, 18 nt, Brucella suis 1330
ucaucgcccucgcgccaa

SEQ ID NO: 439741 - RNA, 16 nt, Brucella suis 1330
ucaucgauaugcgcga

SEQ ID NO: 439742 - RNA, 17 nt, Brucella suis 1330
ucauccagucauggcgc

SEQ ID NO: 439743 - RNA, 19 nt, Brucella suis 1330
ucagggccacuccguugcc

SEQ ID NO: 439744 - RNA, 11 nt, Brucella suis 1330
ucagccucgua

SEQ ID NO: 439745 - RNA, 15 nt, Brucella suis 1330
ucagcaggcgccgug

SEQ ID NO: 439746 - RNA, 16 nt, Brucella suis 1330
ucagaucgcgcggcga

SEQ ID NO: 439747 - RNA, 12 nt, Brucella suis 1330
ucagaaccggaa

SEQ ID NO: 439748 - RNA, 20 nt, Brucella suis 1330
ucacccuuggcgacggccag

SEQ ID NO: 439749 - RNA, 19 nt, Brucella suis 1330
ucaccacgauuucgcccac

SEQ ID NO: 439750 - RNA, 19 nt, Brucella suis 1330
ucaccacgccaucuucgac

SEQ ID NO: 439751 - RNA, 16 nt, Brucella suis 1330
ucaaugcuggccugug

SEQ ID NO: 439752 - RNA, 17 nt, Brucella suis 1330
ucaaugcugcaucgcga

SEQ ID NO: 439753 - RNA, 15 nt, Brucella suis 1330
ucaagaaugugccgc

SEQ ID NO: 439754 - RNA, 20 nt, Brucella suis 1330
ucaaaggagccgcugcgcag

SEQ ID NO: 439755 - RNA, 19 nt, Brucella suis 1330
ucaaaaaccggagccgccg

SEQ ID NO: 439756 - RNA, 16 nt, Brucella suis 1330
uaucgcggaucggcag

SEQ ID NO: 439757 - RNA, 20 nt, Brucella suis 1330
uaucgcgaagauaagcggca

SEQ ID NO: 439758 - RNA, 22 nt, Brucella suis 1330
uagcggcgcggcaggaucgcca

SEQ ID NO: 439759 - RNA, 17 nt, Brucella suis 1330
uagcgcauggcagcaaa

SEQ ID NO: 439760 - RNA, 19 nt, Brucella suis 1330
uagcccugaucguaaagca

SEQ ID NO: 439761 - RNA, 17 nt, Brucella suis 1330
uagagcauuuccagcaa

SEQ ID NO: 439762 - RNA, 21 nt, Brucella suis 1330
uagagcauuuccagcaaaagu

SEQ ID NO: 439763 - RNA, 12 nt, Brucella suis 1330
uagaaugcgcuu

SEQ ID NO: 439764 - RNA, 14 nt, Brucella suis 1330
uacgcagcgucgca

SEQ ID NO: 439765 - RNA, 16 nt, Brucella suis 1330
uaccggcaucagccuu

SEQ ID NO: 439766 - RNA, 16 nt, Brucella suis 1330
uaccgccaaggaacgc

SEQ ID NO: 439767 - RNA, 21 nt, Brucella suis 1330
uacaucaaaccaguugaagcu

SEQ ID NO: 439768 - RNA, 19 nt, Brucella suis 1330
uaccaagcgcauccagccg

SEQ ID NO: 439769 - RNA, 16 nt, Brucella suis 1330
uaaugccccgcaccga

SEQ ID NO: 439770 - RNA, 22 nt, Brucella suis 1330
uaaaugcacccggcaccgcaaa

SEQ ID NO: 439771 - RNA, 16 nt, Brucella suis 1330
guugugccugccgcgc

SEQ ID NO: 439772 - RNA, 19 nt, Brucella suis 1330
guugucuucaagcgcaagc

SEQ ID NO: 439773 - RNA, 19 nt, Brucella suis 1330
guugcgcgccagugcgcca

SEQ ID NO: 439774 - RNA, 17 nt, Brucella suis 1330
guugcgccaccacggcg

SEQ ID NO: 439775 - RNA, 19 nt, Brucella suis 1330
guugccgaucagcaucgcc

SEQ ID NO: 439776 - RNA, 16 nt, Brucella suis 1330
guugauggaaggcgcu

SEQ ID NO: 439777 - RNA, 24 nt, Brucella suis 1330
guugccauugacggagccggacgu

SEQ ID NO: 439778 - RNA, 17 nt, Brucella suis 1330
guugaucucauuucggc

SEQ ID NO: 439779 - RNA, 19 nt, Brucella suis 1330
guuccgugccgauuucggc

SEQ ID NO: 439780 - RNA, 20 nt, Brucella suis 1330
guuccgcauccgaaaugcgc

SEQ ID NO: 439781 - RNA, 19 nt, Brucella suis 1330
guuccgcccgaauugcggc

SEQ ID NO: 439782 - RNA, 14 nt, Brucella suis 1330
guuccagucgccuu

SEQ ID NO: 439783 - RNA, 17 nt, Brucella suis 1330
guuccagucgccuuccg

SEQ ID NO: 439784 - RNA, 12 nt, Brucella suis 1330
guucaugccgga

SEQ ID NO: 439785 - RNA, 15 nt, Brucella suis 1330
guucaggugcgacuu

SEQ ID NO: 439786 - RNA, 15 nt, Brucella suis 1330
guucaggccggccuu

SEQ ID NO: 439787 - RNA, 19 nt, Brucella suis 1330
guucagccgcuccggcguc

SEQ ID NO: 439788 - RNA, 17 nt, Brucella suis 1330
guucacgcgccauguug

SEQ ID NO: 439789 - RNA, 23 nt, Brucella suis 1330
guucaauucacccuuggccggaa

SEQ ID NO: 439790 - RNA, 20 nt, Brucella suis 1330
guucaagcaguaugauuugu

SEQ ID NO: 439791 - RNA, 17 nt, Brucella suis 1330
guuaauuccacgcgccg

SEQ ID NO: 439792 - RNA, 19 nt, Brucella suis 1330
gugcgcggacgggcaggca

SEQ ID NO: 439793 - RNA, 16 nt, Brucella suis 1330
gugccagaucggcaag

SEQ ID NO: 439794 - RNA, 15 nt, Brucella suis 1330
gugcaagcgcaaagc

SEQ ID NO: 439795 - RNA, 14 nt, Brucella suis 1330
gugacuuugaucgc

SEQ ID NO: 439796 - RNA, 14 nt, Brucella suis 1330
gugacggaugaggc

SEQ ID NO: 439797 - RNA, 22 nt, Brucella suis 1330
gugaauucgggguucuucaacu

SEQ ID NO: 439798 - RNA, 13 nt, Brucella suis 1330
gucugcuugccgc

SEQ ID NO: 439799 - RNA, 14 nt, Brucella suis 1330
gucugcuugccgcc

SEQ ID NO: 439800 - RNA, 19 nt, Brucella suis 1330
gucucgccguucgccacgu

SEQ ID NO: 439801 - RNA, 15 nt, Brucella suis 1330
gucgucuagcgccau

SEQ ID NO: 439802 - RNA, 17 nt, Brucella suis 1330
gucgccgaaaagcgccu

SEQ ID NO: 439803 - RNA, 14 nt, Brucella suis 1330
gucgccagcgccgg

SEQ ID NO: 439804 - RNA, 16 nt, Brucella suis 1330
gucgagcaaugcgccg

SEQ ID NO: 439805 - RNA, 13 nt, Brucella suis 1330
gucgagaauggca

SEQ ID NO: 439806 - RNA, 23 nt, Brucella suis 1330
gucgaauaucuugaagccuuccg

SEQ ID NO: 439807 - RNA, 20 nt, Brucella suis 1330
gucgaaaagcuugcccguca

SEQ ID NO: 439808 - RNA, 14 nt, Brucella suis 1330
guccucgcgccaga

SEQ ID NO: 439809 - RNA, 23 nt, Brucella suis 1330
guccgguuuucugguuuccgcca

SEQ ID NO: 439810 - RNA, 17 nt, Brucella suis 1330
guccgguccccgccgcc

SEQ ID NO: 439811 - RNA, 14 nt, Brucella suis 1330
guccggccugcgcc

SEQ ID NO: 439812 - RNA, 15 nt, Brucella suis 1330
guccggccugcgcca

SEQ ID NO: 439813 - RNA, 15 nt, Brucella suis 1330
guccagucaaugccg

SEQ ID NO: 439814 - RNA, 18 nt, Brucella suis 1330
gucacgcagcguguagcc

SEQ ID NO: 439815 - RNA, 23 nt, Brucella suis 1330
gucacccgcgucgucugcauccu

SEQ ID NO: 439816 - RNA, 15 nt, Brucella suis 1330
guauccccggcaaag

SEQ ID NO: 439817 - RNA, 23 nt, Brucella suis 1330
guacauacaugaugaucgccagc

SEQ ID NO: 439818 - RNA, 21 nt, Brucella suis 1330
gguuuugcguuggaaaaugcg

SEQ ID NO: 439819 - RNA, 15 nt, Brucella suis 1330
guaaagcgcgccauc

SEQ ID NO: 439820 - RNA, 18 nt, Brucella suis 1330
gguuccaguccagcgcgc

SEQ ID NO: 439821 - RNA, 18 nt, Brucella suis 1330
gguuacuugcgcuuugca

SEQ ID NO: 439822 - RNA, 15 nt, Brucella suis 1330
ggugaugcgcccguu

SEQ ID NO: 439823 - RNA, 22 nt, Brucella suis 1330
ggugacggucguuucgccgccc

SEQ ID NO: 439824 - RNA, 14 nt, Brucella suis 1330
ggugaacuggcaag

SEQ ID NO: 439825 - RNA, 14 nt, Brucella suis 1330
ggucuucauggcuu

SEQ ID NO: 439826 - RNA, 15 nt, Brucella suis 1330
ggucuucgcccggca

SEQ ID NO: 439827 - RNA, 17 nt, Brucella suis 1330
ggucagccacgauaccg

SEQ ID NO: 439828 - RNA, 23 nt, Brucella suis 1330
gggcaggaggccaaaaagcguau

SEQ ID NO: 439829 - RNA, 18 nt, Brucella suis 1330
gggcacgcucgauccgcu

SEQ ID NO: 439830 - RNA, 11 nt, Brucella suis 1330
gggaucgagcc

SEQ ID NO: 439831 - RNA, 13 nt, Brucella suis 1330
gggaaacggccag

SEQ ID NO: 439832 - RNA, 16 nt, Brucella suis 1330
ggcuucguaaagcgcg

SEQ ID NO: 439833 - RNA, 15 nt, Brucella suis 1330
ggcugagggaaacac

SEQ ID NO: 439834 - RNA, 18 nt, Brucella suis 1330
ggcugaggcggcagacgu

SEQ ID NO: 439835 - RNA, 18 nt, Brucella suis 1330
ggcucuccggcaaaacgg

SEQ ID NO: 439836 - RNA, 16 nt, Brucella suis 1330
ggcgucggauaacgcg

SEQ ID NO: 439837 - RNA, 20 nt, Brucella suis 1330
ggcggucugaaaucagaucg

SEQ ID NO: 439838 - RNA, 15 nt, Brucella suis 1330
ggcggguagccgcca

SEQ ID NO: 439839 - RNA, 16 nt, Brucella suis 1330
ggcggccugaccggcc

SEQ ID NO: 439840 - RNA, 18 nt, Brucella suis 1330
ggcggaugcgcggcgcca

SEQ ID NO: 439841 - RNA, 14 nt, Brucella suis 1330
ggcggaucggcagg

SEQ ID NO: 439842 - RNA, 18 nt, Brucella suis 1330
ggcggauauucgccgccu

SEQ ID NO: 439843 - RNA, 18 nt, Brucella suis 1330
ggcggagccucaucggcg

SEQ ID NO: 439844 - RNA, 12 nt, Brucella suis 1330
ggcgcuccaugc

SEQ ID NO: 439845 - RNA, 19 nt, Brucella suis 1330
ggcgcgagcacgccgcuca

SEQ ID NO: 439846 - RNA, 14 nt, Brucella suis 1330
ggcgcgaaaccgga

SEQ ID NO: 439847 - RNA, 13 nt, Brucella suis 1330
ggcgccgucggga

SEQ ID NO: 439848 - RNA, 23 nt, Brucella suis 1330
ggcgcccaccauauuugccgcca

SEQ ID NO: 439849 - RNA, 18 nt, Brucella suis 1330
ggcgcaaggucucgacag

SEQ ID NO: 439850 - RNA, 19 nt, Brucella suis 1330
ggcgcaaggucucgacagu

SEQ ID NO: 439851 - RNA, 23 nt, Brucella suis 1330
ggccuuguuuucugccggugccg

SEQ ID NO: 439852 - RNA, 16 nt, Brucella suis 1330
ggccgcucgcugcggc

SEQ ID NO: 439853 - RNA, 12 nt, Brucella suis 1330
ggccgaucgcca

SEQ ID NO: 439854 - RNA, 12 nt, Brucella suis 1330
ggccgauuuccg

SEQ ID NO: 439855 - RNA, 13 nt, Brucella suis 1330
ggccgaaucgcga

SEQ ID NO: 439856 - RNA, 16 nt, Brucella suis 1330
ggcccuggaaagaagc

SEQ ID NO: 439857 - RNA, 20 nt, Brucella suis 1330
ggccagccagcgcauaaagg

SEQ ID NO: 439858 - RNA, 15 nt, Brucella suis 1330
ggcaucgcggaucgu

SEQ ID NO: 439859 - RNA, 14 nt, Brucella suis 1330
ggcaggccgccugg

SEQ ID NO: 439860 - RNA, 15 nt, Brucella suis 1330
ggcagcggcgcgcca

SEQ ID NO: 439861 - RNA, 15 nt, Brucella suis 1330
ggcagcgcgguuuuu

SEQ ID NO: 439862 - RNA, 15 nt, Brucella suis 1330
ggcaccgaccgggcu

SEQ ID NO: 439863 - RNA, 20 nt, Brucella suis 1330
ggcaccaugcggcuccaguu

SEQ ID NO: 439864 - RNA, 21 nt, Brucella suis 1330
ggcacaagcuugauaaggccg

SEQ ID NO: 439865 - RNA, 16 nt, Brucella suis 1330
ggcaaugucgcaaagc

SEQ ID NO: 439866 - RNA, 14 nt, Brucella suis 1330
ggcaauggccgcau

SEQ ID NO: 439867 - RNA, 15 nt, Brucella suis 1330
ggcaauggccgcaug

SEQ ID NO: 439868 - RNA, 20 nt, Brucella suis 1330
ggcaaucuugaccuggccag

SEQ ID NO: 439869 - RNA, 13 nt, Brucella suis 1330
ggcaauaugcgcc

SEQ ID NO: 439870 - RNA, 15 nt, Brucella suis 1330
ggcaagcuuuucacg

SEQ ID NO: 439871 - RNA, 13 nt, Brucella suis 1330
ggcaagcgccugc

SEQ ID NO: 439872 - RNA, 15 nt, Brucella suis 1330
ggcaagcgccugcug

SEQ ID NO: 439873 - RNA, 18 nt, Brucella suis 1330
ggcaagccccagcacgaa

SEQ ID NO: 439874 - RNA, 15 nt, Brucella suis 1330
ggcaaacggauugcc

SEQ ID NO: 439875 - RNA, 13 nt, Brucella suis 1330
ggcaacacggcgc

SEQ ID NO: 439876 - RNA, 16 nt, Brucella suis 1330
ggagacuguuccgccc

SEQ ID NO: 439877 - RNA, 15 nt, Brucella suis 1330
ggacugauuuccgcu

SEQ ID NO: 439878 - RNA, 16 nt, Brucella suis 1330
ggacuauuuccaucgc

SEQ ID NO: 439879 - RNA, 20 nt, Brucella suis 1330
ggacgcgcagauauggcgcc

SEQ ID NO: 439880 - RNA, 18 nt, Brucella suis 1330
ggacauaaaccgaugacg

SEQ ID NO: 439881 - RNA, 18 nt, Brucella suis 1330
ggaaugcggggcuuuuca

SEQ ID NO: 439882 - RNA, 21 nt, Brucella suis 1330
ggaagauccccagccagaacc

SEQ ID NO: 439883 - RNA, 20 nt, Brucella suis 1330
ggaaauuauagccgccaagc

SEQ ID NO: 439884 - RNA, 16 nt, Brucella suis 1330
ggaaauuuaucgucac

SEQ ID NO: 439885 - RNA, 20 nt, Brucella suis 1330
ggaaaggucuuccgggacaa

SEQ ID NO: 439886 - RNA, 15 nt, Brucella suis 1330
gcuuugaccgccgcg

SEQ ID NO: 439887 - RNA, 14 nt, Brucella suis 1330
gcuuugcccuugcg

SEQ ID NO: 439888 - RNA, 20 nt, Brucella suis 1330
gcuuugcccuugcgaauggc

SEQ ID NO: 439889 - RNA, 13 nt, Brucella suis 1330
gcuuucgccgccc

SEQ ID NO: 439890 - RNA, 17 nt, Brucella suis 1330
gcuugaagcugccgcgg

SEQ ID NO: 439891 - RNA, 21 nt, Brucella suis 1330
gcuucugcucaccaaaaggcg

SEQ ID NO: 439892 - RNA, 20 nt, Brucella suis 1330
gcuucgcgcaggccgcggca

SEQ ID NO: 439893 - RNA, 23 nt, Brucella suis 1330
gcuucgaucguuucgccaugcuc

SEQ ID NO: 439894 - RNA, 17 nt, Brucella suis 1330
gcuucgcaccuuccaca

SEQ ID NO: 439895 - RNA, 14 nt, Brucella suis 1330
gcuucgagcgccuu

SEQ ID NO: 439896 - RNA, 14 nt, Brucella suis 1330
gcuuccuuuucggc

SEQ ID NO: 439897 - RNA, 20 nt, Brucella suis 1330
gcuuccacgcggauaucggc

SEQ ID NO: 439898 - RNA, 21 nt, Brucella suis 1330
gcuucaugauagagggccgaa

SEQ ID NO: 439899 - RNA, 18 nt, Brucella suis 1330
gcuucaggucggcauuga

SEQ ID NO: 439900 - RNA, 19 nt, Brucella suis 1330
gcuucagucuggauuccuu

SEQ ID NO: 439901 - RNA, 20 nt, Brucella suis 1330
gcuucacgcggcugcucgac

SEQ ID NO: 439902 - RNA, 16 nt, Brucella suis 1330
gcuucaaaggccugau

SEQ ID NO: 439903 - RNA, 23 nt, Brucella suis 1330
gcuucaaaggccugauauucggc

SEQ ID NO: 439904 - RNA, 13 nt, Brucella suis 1330
gcuguccgagagc

SEQ ID NO: 439905 - RNA, 16 nt, Brucella suis 1330
gcuguaaccgccaccu

SEQ ID NO: 439906 - RNA, 18 nt, Brucella suis 1330
gcugcugcacuugcgcca

SEQ ID NO: 439907 - RNA, 19 nt, Brucella suis 1330
gcugcgacgagaugcgcuu

SEQ ID NO: 439908 - RNA, 20 nt, Brucella suis 1330
gcugaucuggaaggaaagcc

SEQ ID NO: 439909 - RNA, 16 nt, Brucella suis 1330
gcucuaguugcgcuga

SEQ ID NO: 439910 - RNA, 13 nt, Brucella suis 1330
gcucggcgaugaa

SEQ ID NO: 439911 - RNA, 14 nt, Brucella suis 1330
gcucgcucucgcau

SEQ ID NO: 439912 - RNA, 14 nt, Brucella suis 1330
gcucgcauagccga

SEQ ID NO: 439913 - RNA, 21 nt, Brucella suis 1330
gcucgacgcuuuccaccggcu

SEQ ID NO: 439914 - RNA, 22 nt, Brucella suis 1330
gcuacacccagcauauggauga

SEQ ID NO: 439915 - RNA, 18 nt, Brucella suis 1330
gcguucugaaaccgcagg

SEQ ID NO: 439916 - RNA, 18 nt, Brucella suis 1330
gcguucaacuccgucaga

SEQ ID NO: 439917 - RNA, 19 nt, Brucella suis 1330
gcguuauaagccgccucaa

SEQ ID NO: 439918 - RNA, 15 nt, Brucella suis 1330
gcguggauauuggca

SEQ ID NO: 439919 - RNA, 15 nt, Brucella suis 1330
gcgugcggucgccgc

SEQ ID NO: 439920 - RNA, 17 nt, Brucella suis 1330
gcgugaugagccgcuuc

SEQ ID NO: 439921 - RNA, 20 nt, Brucella suis 1330
gcgugaugcgcaggcgcucg

SEQ ID NO: 439922 - RNA, 13 nt, Brucella suis 1330
gcgugaucggccg

SEQ ID NO: 439923 - RNA, 22 nt, Brucella suis 1330
gcgugauaggcgacacggccga

SEQ ID NO: 439924 - RNA, 23 nt, Brucella suis 1330
gcgugauaggcgacacggccgau

SEQ ID NO: 439925 - RNA, 13 nt, Brucella suis 1330
gcgugagccggcg

SEQ ID NO: 439926 - RNA, 12 nt, Brucella suis 1330
gcgugaccagcc

SEQ ID NO: 439927 - RNA, 19 nt, Brucella suis 1330
gcgucugccggagcgacca

SEQ ID NO: 439928 - RNA, 13 nt, Brucella suis 1330
gcgucaggcccag

SEQ ID NO: 439929 - RNA, 13 nt, Brucella suis 1330
gcgucauaggcag

SEQ ID NO: 439930 - RNA, 12 nt, Brucella suis 1330
gcgucacggcga

SEQ ID NO: 439931 - RNA, 19 nt, Brucella suis 1330
gcguauuuucgagccaaaa

SEQ ID NO: 439932 - RNA, 17 nt, Brucella suis 1330
gcguaccggagcuaaag

SEQ ID NO: 439933 - RNA, 20 nt, Brucella suis 1330
gcguaaucacuugcaagcgc

SEQ ID NO: 439934 - RNA, 20 nt, Brucella suis 1330
gcguacaacaucgccugagg

SEQ ID NO: 439935 - RNA, 20 nt, Brucella suis 1330
gcggucgagcuuuccaucgu

SEQ ID NO: 439936 - RNA, 21 nt, Brucella suis 1330
gcggucgaaaccuuguugaca

SEQ ID NO: 439937 - RNA, 16 nt, Brucella suis 1330
gcgggcuuuccagccc

SEQ ID NO: 439938 - RNA, 19 nt, Brucella suis 1330
gcgggcuuuccagcccccu

SEQ ID NO: 439939 - RNA, 13 nt, Brucella suis 1330
gcggcuugaaauc

SEQ ID NO: 439940 - RNA, 13 nt, Brucella suis 1330
gcggcgcgccaaa

SEQ ID NO: 439941 - RNA, 15 nt, Brucella suis 1330
gcggccugaccggcc

SEQ ID NO: 439942 - RNA, 23 nt, Brucella suis 1330
gcggcccuuuucuauugaacacc

SEQ ID NO: 439943 - RNA, 18 nt, Brucella suis 1330
gcggcccgauuccuccgg

SEQ ID NO: 439944 - RNA, 15 nt, Brucella suis 1330
gcggccagaauaucc

SEQ ID NO: 439945 - RNA, 14 nt, Brucella suis 1330
gcggccaagcgcau

SEQ ID NO: 439946 - RNA, 22 nt, Brucella suis 1330
gcggcauuggugaaggauaucg

SEQ ID NO: 439947 - RNA, 22 nt, Brucella suis 1330
gcggaaacgauuguuuucggca

SEQ ID NO: 439948 - RNA, 19 nt, Brucella suis 1330
gcggaaaccaguggccuuc

SEQ ID NO: 439949 - RNA, 13 nt, Brucella suis 1330
gcgcuuuccccgg

SEQ ID NO: 439950 - RNA, 20 nt, Brucella suis 1330
gcgcuuggcaaaaggcgcaa

SEQ ID NO: 439951 - RNA, 21 nt, Brucella suis 1330
gcgcugaugugucgaaaacuc

SEQ ID NO: 439952 - RNA, 20 nt, Brucella suis 1330
gcgcugauucuggauuucau

SEQ ID NO: 439953 - RNA, 22 nt, Brucella suis 1330
gcgcucgucgccucauggcggc

SEQ ID NO: 439954 - RNA, 18 nt, Brucella suis 1330
gcgcguaucgacaccgcc

SEQ ID NO: 439955 - RNA, 22 nt, Brucella suis 1330
gcgcguaucgacaccgccaagu

SEQ ID NO: 439956 - RNA, 16 nt, Brucella suis 1330
gcgcggcuuccagcgc

SEQ ID NO: 439957 - RNA, 19 nt, Brucella suis 1330
gcgcggaucguacggcccu

SEQ ID NO: 439958 - RNA, 16 nt, Brucella suis 1330
gcgcgcuaugcguggu

SEQ ID NO: 439959 - RNA, 17 nt, Brucella suis 1330
gcgcgcgguugauaucg

SEQ ID NO: 439960 - RNA, 21 nt, Brucella suis 1330
gcgcgcgguugauaucgcgga

SEQ ID NO: 439961 - RNA, 14 nt, Brucella suis 1330
gcgcgcgccgccau

SEQ ID NO: 439962 - RNA, 15 nt, Brucella suis 1330
gcgcgccgaaaaucg

SEQ ID NO: 439963 - RNA, 23 nt, Brucella suis 1330
gcgcgcccucgcgcucggcaagc

SEQ ID NO: 439964 - RNA, 14 nt, Brucella suis 1330
gcgcgcaagggccg

SEQ ID NO: 439965 - RNA, 15 nt, Brucella suis 1330
gcgcgagcacgccgc

SEQ ID NO: 439966 - RNA, 15 nt, Brucella suis 1330
gcgccuguccgccug

SEQ ID NO: 439967 - RNA, 12 nt, Brucella suis 1330
gcgccagcgcgg

SEQ ID NO: 439968 - RNA, 21 nt, Brucella suis 1330
gcgcaucuguucugccaucgc

SEQ ID NO: 439969 - RNA, 14 nt, Brucella suis 1330
gcgcaucuuuuccg

SEQ ID NO: 439970 - RNA, 19 nt, Brucella suis 1330
gcgcaucgucaaucacgcc

SEQ ID NO: 439971 - RNA, 17 nt, Brucella suis 1330
gcgcaucggccagcuga

SEQ ID NO: 439972 - RNA, 14 nt, Brucella suis 1330
gcgcaucgccaccg

SEQ ID NO: 439973 - RNA, 17 nt, Brucella suis 1330
gcgcauccagccggcgc

SEQ ID NO: 439974 - RNA, 18 nt, Brucella suis 1330
gcgcaucccgaaaagugc

SEQ ID NO: 439975 - RNA, 15 nt, Brucella suis 1330
gcgcauaucgcgcga

SEQ ID NO: 439976 - RNA, 22 nt, Brucella suis 1330
gcgcaucauccugagcuugucg

SEQ ID NO: 439977 - RNA, 15 nt, Brucella suis 1330
gcgcaguuucgcagc

SEQ ID NO: 439978 - RNA, 22 nt, Brucella suis 1330
gcgcagggucugcgccagauca

SEQ ID NO: 439979 - RNA, 17 nt, Brucella suis 1330
gcgcaggccgcggcauc

SEQ ID NO: 439980 - RNA, 21 nt, Brucella suis 1330
gcgcaggacuucacccgccag

SEQ ID NO: 439981 - RNA, 15 nt, Brucella suis 1330
gcgcagcgccgcaua

SEQ ID NO: 439982 - RNA, 12 nt, Brucella suis 1330
gcgcagcgccgc

SEQ ID NO: 439983 - RNA, 20 nt, Brucella suis 1330
gcgcagcaucugcgcgagga

SEQ ID NO: 439984 - RNA, 14 nt, Brucella suis 1330
gcgcagcagcgcaa

SEQ ID NO: 439985 - RNA, 19 nt, Brucella suis 1330
gcgcagcagcaucgccgcc

SEQ ID NO: 439986 - RNA, 13 nt, Brucella suis 1330
gcgcacgcgcacc

SEQ ID NO: 439987 - RNA, 15 nt, Brucella suis 1330
gcgcaccugacggcg

SEQ ID NO: 439988 - RNA, 16 nt, Brucella suis 1330
gcgcaccgguauugcc

SEQ ID NO: 439989 - RNA, 16 nt, Brucella suis 1330
gcgcaccgcacgcaag

SEQ ID NO: 439990 - RNA, 19 nt, Brucella suis 1330
gcgauauccggcacggcca

SEQ ID NO: 439991 - RNA, 18 nt, Brucella suis 1330
gcgauaguguccacgcgc

SEQ ID NO: 439992 - RNA, 14 nt, Brucella suis 1330
gcgauagcuuucua

SEQ ID NO: 439993 - RNA, 19 nt, Brucella suis 1330
gcgaguuuucaaaccaaaa

SEQ ID NO: 439994 - RNA, 15 nt, Brucella suis 1330
gcgagcgcgccacgg

SEQ ID NO: 439995 - RNA, 20 nt, Brucella suis 1330
gcgaccaccauggaggcgcu

SEQ ID NO: 439996 - RNA, 14 nt, Brucella suis 1330
gcgaagcgguuuug

SEQ ID NO: 439997 - RNA, 21 nt, Brucella suis 1330
gcgaagaccuucuggaagcgc

SEQ ID NO: 439998 - RNA, 16 nt, Brucella suis 1330
gcgaaccguccacgau

SEQ ID NO: 439999 - RNA, 20 nt, Brucella suis 1330
gcgaaccguccacgauggcc

SEQ ID NO: 440000 - RNA, 23 nt, Brucella suis 1330
gcgaaauaaucguaucgccaaag

SEQ ID NO: 440001 - RNA, 15 nt, Brucella suis 1330
gcgaaaccggaacgc

SEQ ID NO: 440002 - RNA, 14 nt, Brucella suis 1330
gccuuugcgcgccu

SEQ ID NO: 440003 - RNA, 20 nt, Brucella suis 1330
gcgaaaaccggcuggcuuuc

SEQ ID NO: 440004 - RNA, 21 nt, Brucella suis 1330
gcgaaaaccggcuggcuuucg

SEQ ID NO: 440005 - RNA, 13 nt, Brucella suis 1330
gcgaaaagccgcc

SEQ ID NO: 440006 - RNA, 13 nt, Brucella suis 1330
gccuuugccgcgc

SEQ ID NO: 440007 - RNA, 13 nt, Brucella suis 1330
gccuugaugccgc

SEQ ID NO: 440008 - RNA, 20 nt, Brucella suis 1330
gccuugauguccggcgcgcu

SEQ ID NO: 440009 - RNA, 20 nt, Brucella suis 1330
gccuucuucccguaauuccc

SEQ ID NO: 440010 - RNA, 22 nt, Brucella suis 1330
gccuucuucccguaauucccgc

SEQ ID NO: 440011 - RNA, 17 nt, Brucella suis 1330
gccuucauucuuucaga

SEQ ID NO: 440012 - RNA, 18 nt, Brucella suis 1330
gccugugccaaugacaug

SEQ ID NO: 440013 - RNA, 13 nt, Brucella suis 1330
gccugugcgacga

SEQ ID NO: 440014 - RNA, 21 nt, Brucella suis 1330
gccugguuucacaggccgguu

SEQ ID NO: 440015 - RNA, 18 nt, Brucella suis 1330
gccuggcgaaaacggcca

SEQ ID NO: 440016 - RNA, 17 nt, Brucella suis 1330
gccugcugcauccugcu

SEQ ID NO: 440017 - RNA, 21 nt, Brucella suis 1330
gccugcgccaguuuucgcggc

SEQ ID NO: 440018 - RNA, 20 nt, Brucella suis 1330
gccugcgccagcgauugcgc

SEQ ID NO: 440019 - RNA, 22 nt, Brucella suis 1330
gccugcgccagcgauugcgcau

SEQ ID NO: 440020 - RNA, 14 nt, Brucella suis 1330
gccucgcgcccggu

SEQ ID NO: 440021 - RNA, 18 nt, Brucella suis 1330
gccuccugugcauugcca

SEQ ID NO: 440022 - RNA, 13 nt, Brucella suis 1330
gccguuggaaacg

SEQ ID NO: 440023 - RNA, 18 nt, Brucella suis 1330
gccgugaaacagugccgc

SEQ ID NO: 440024 - RNA, 19 nt, Brucella suis 1330
gccgugaaaggugaaggcc

SEQ ID NO: 440025 - RNA, 16 nt, Brucella suis 1330
gccgucgaagcgcugc

SEQ ID NO: 440026 - RNA, 13 nt, Brucella suis 1330
gccggugccggca

SEQ ID NO: 440027 - RNA, 19 nt, Brucella suis 1330
gccgguccagaucgauggc

SEQ ID NO: 440028 - RNA, 18 nt, Brucella suis 1330
gccgguaucaagcuucau

SEQ ID NO: 440029 - RNA, 16 nt, Brucella suis 1330
gccggucaaaacgccc

SEQ ID NO: 440030 - RNA, 23 nt, Brucella suis 1330
gccgggucuucauagaccccgcc

SEQ ID NO: 440031 - RNA, 13 nt, Brucella suis 1330
gccggggccggau

SEQ ID NO: 440032 - RNA, 15 nt, Brucella suis 1330
gccgggcggcuugcc

SEQ ID NO: 440033 - RNA, 16 nt, Brucella suis 1330
gccgggccaacgccgg

SEQ ID NO: 440034 - RNA, 15 nt, Brucella suis 1330
gccgggauuuucggc

SEQ ID NO: 440035 - RNA, 16 nt, Brucella suis 1330
gccgcuugcgccgaac

SEQ ID NO: 440036 - RNA, 16 nt, Brucella suis 1330
gccgcucggcgaugaa

SEQ ID NO: 440037 - RNA, 18 nt, Brucella suis 1330
gccgcgcaaguuccgcau

SEQ ID NO: 440038 - RNA, 13 nt, Brucella suis 1330
gccgcagccgcca

SEQ ID NO: 440039 - RNA, 21 nt, Brucella suis 1330
gccgcaauccuggugcgcagc

SEQ ID NO: 440040 - RNA, 22 nt, Brucella suis 1330
gccgaugggccggucuucccgc

SEQ ID NO: 440041 - RNA, 16 nt, Brucella suis 1330
gccgaugauauugccc

SEQ ID NO: 440042 - RNA, 14 nt, Brucella suis 1330
gccgagaugggcaa

SEQ ID NO: 440043 - RNA, 22 nt, Brucella suis 1330
gccgaagcugcgcgaaccagau

SEQ ID NO: 440044 - RNA, 22 nt, Brucella suis 1330
gccgaagccagguggcugcccg

SEQ ID NO: 440045 - RNA, 15 nt, Brucella suis 1330
gccgaaauuggccgc

SEQ ID NO: 440046 - RNA, 16 nt, Brucella suis 1330
gcccuuuaucagcgau

SEQ ID NO: 440047 - RNA, 17 nt, Brucella suis 1330
gcccuggggcaugacau

SEQ ID NO: 440048 - RNA, 13 nt, Brucella suis 1330
gcccucgccgccg

SEQ ID NO: 440049 - RNA, 16 nt, Brucella suis 1330
gcccucgccgccggug

SEQ ID NO: 440050 - RNA, 13 nt, Brucella suis 1330
gcccguugccgau

SEQ ID NO: 440051 - RNA, 14 nt, Brucella suis 1330
gcccgguuccggcg

SEQ ID NO: 440052 - RNA, 15 nt, Brucella suis 1330
gcccgccgcgacgau

SEQ ID NO: 440053 - RNA, 23 nt, Brucella suis 1330
gcccgccgcaagcucugucggcu

SEQ ID NO: 440054 - RNA, 17 nt, Brucella suis 1330
gcccgacugcacgucuu

SEQ ID NO: 440055 - RNA, 21 nt, Brucella suis 1330
gcccgagaagcucaacgccgu

SEQ ID NO: 440056 - RNA, 15 nt, Brucella suis 1330
gccccacggaucgac

SEQ ID NO: 440057 - RNA, 23 nt, Brucella suis 1330
gcccauaaggcggaugcgcggcg

SEQ ID NO: 440058 - RNA, 23 nt, Brucella suis 1330
gcccaggccucugccuccauggc

SEQ ID NO: 440059 - RNA, 18 nt, Brucella suis 1330
gcccagaaccgaggcaau

SEQ ID NO: 440060 - RNA, 20 nt, Brucella suis 1330
gcccacggucgagugcggcc

SEQ ID NO: 440061 - RNA, 23 nt, Brucella suis 1330
gcccacauagggccuuuccggcg

SEQ ID NO: 440062 - RNA, 12 nt, Brucella suis 1330
gccauggccgaa

SEQ ID NO: 440063 - RNA, 14 nt, Brucella suis 1330
gccaugcgcaugaa

SEQ ID NO: 440064 - RNA, 14 nt, Brucella suis 1330
gccaugccuucccg

SEQ ID NO: 440065 - RNA, 15 nt, Brucella suis 1330
gccaugccgccaagg

SEQ ID NO: 440066 - RNA, 15 nt, Brucella suis 1330
gccagugcgccaccg

SEQ ID NO: 440067 - RNA, 18 nt, Brucella suis 1330
gccagugcgccaccgcga

SEQ ID NO: 440068 - RNA, 20 nt, Brucella suis 1330
gccagugcauuggaaacgcc

SEQ ID NO: 440069 - RNA, 18 nt, Brucella suis 1330
gccagcgcauaaaggccg

SEQ ID NO: 440070 - RNA, 14 nt, Brucella suis 1330
gccagcgauugcgc

SEQ ID NO: 440071 - RNA, 19 nt, Brucella suis 1330
gccagccgaaaugagauca

SEQ ID NO: 440072 - RNA, 21 nt, Brucella suis 1330
gccagccgcaaucagccagaa

SEQ ID NO: 440073 - RNA, 12 nt, Brucella suis 1330
gccagcccgcuu

SEQ ID NO: 440074 - RNA, 15 nt, Brucella suis 1330
gccagcaggccggcg

SEQ ID NO: 440075 - RNA, 14 nt, Brucella suis 1330
gccagauaaccugc

SEQ ID NO: 440076 - RNA, 18 nt, Brucella suis 1330
gccagauaaccugcgcga

SEQ ID NO: 440077 - RNA, 19 nt, Brucella suis 1330
gccagauaagacauggcuu

SEQ ID NO: 440078 - RNA, 19 nt, Brucella suis 1330
gccagagcauuuucgccgc

SEQ ID NO: 440079 - RNA, 22 nt, Brucella suis 1330
gccagagcauuuucgccgcagc

SEQ ID NO: 440080 - RNA, 22 nt, Brucella suis 1330
gccagagcggcauauugcggcg

SEQ ID NO: 440081 - RNA, 23 nt, Brucella suis 1330
gccagagcggcauauugcggcgg

SEQ ID NO: 440082 - RNA, 19 nt, Brucella suis 1330
gccaccgcgaucaguucgc

SEQ ID NO: 440083 - RNA, 18 nt, Brucella suis 1330
gccaccauggccgccccg

SEQ ID NO: 440084 - RNA, 13 nt, Brucella suis 1330
gccaccacggcgc

SEQ ID NO: 440085 - RNA, 13 nt, Brucella suis 1330
gccaaucgccgcg

SEQ ID NO: 440086 - RNA, 21 nt, Brucella suis 1330
gccaauccccucaccuugccg

SEQ ID NO: 440087 - RNA, 22 nt, Brucella suis 1330
gccaagugcggucugcuugccg

SEQ ID NO: 440088 - RNA, 12 nt, Brucella suis 1330
gccaauaccgug

SEQ ID NO: 440089 - RNA, 15 nt, Brucella suis 1330
gccaaggcugcgcgc

SEQ ID NO: 440090 - RNA, 14 nt, Brucella suis 1330
gccaagcgccacgc

SEQ ID NO: 440091 - RNA, 15 nt, Brucella suis 1330
gcauccuugucggca

SEQ ID NO: 440092 - RNA, 16 nt, Brucella suis 1330
gcaucaugucauggcc

SEQ ID NO: 440093 - RNA, 17 nt, Brucella suis 1330
gcaucagccucccuuca

SEQ ID NO: 440094 - RNA, 17 nt, Brucella suis 1330
gcaucagccuucgucaa

SEQ ID NO: 440095 - RNA, 21 nt, Brucella suis 1330
gcaucaaccuuuucggcaagg

SEQ ID NO: 440096 - RNA, 23 nt, Brucella suis 1330
gcauauagguguuggucaugcgc

SEQ ID NO: 440097 - RNA, 14 nt, Brucella suis 1330
gcagugaaagccgc

SEQ ID NO: 440098 - RNA, 15 nt, Brucella suis 1330
gcaguccggcagccg

SEQ ID NO: 440099 - RNA, 15 nt, Brucella suis 1330
gcagucagcaccgua

SEQ ID NO: 440100 - RNA, 21 nt, Brucella suis 1330
gcaguagggcaguagggcagu

SEQ ID NO: 440101 - RNA, 21 nt, Brucella suis 1330
gcagggcauggguggccgcca

SEQ ID NO: 440102 - RNA, 14 nt, Brucella suis 1330
gcaggacaagccgc

SEQ ID NO: 440103 - RNA, 21 nt, Brucella suis 1330
gcagcucggcuucaaaggccu

SEQ ID NO: 440104 - RNA, 22 nt, Brucella suis 1330
gcagcgucacaaaacagacgcc

SEQ ID NO: 440105 - RNA, 21 nt, Brucella suis 1330
gcagcggucacagaagcaagc

SEQ ID NO: 440106 - RNA, 13 nt, Brucella suis 1330
gcagcgccgcgcc

SEQ ID NO: 440107 - RNA, 16 nt, Brucella suis 1330
gcagcgauauccggca

SEQ ID NO: 440108 - RNA, 13 nt, Brucella suis 1330
gcagccacggcag

SEQ ID NO: 440109 - RNA, 16 nt, Brucella suis 1330
gcagcaugaucgccac

SEQ ID NO: 440110 - RNA, 15 nt, Brucella suis 1330
gcagcaucgccgcca

SEQ ID NO: 440111 - RNA, 16 nt, Brucella suis 1330
gcagaugagcggcagc

SEQ ID NO: 440112 - RNA, 19 nt, Brucella suis 1330
gcagaugcccgcuuucccg

SEQ ID NO: 440113 - RNA, 17 nt, Brucella suis 1330
gcagauaaagcgcaagc

SEQ ID NO: 440114 - RNA, 13 nt, Brucella suis 1330
gcagagcgcaucc

SEQ ID NO: 440115 - RNA, 15 nt, Brucella suis 1330
gcacgucggacuucu

SEQ ID NO: 440116 - RNA, 17 nt, Brucella suis 1330
gcacgucaucaucgucu

SEQ ID NO: 440117 - RNA, 17 nt, Brucella suis 1330
gcacggcaaucagaucg

SEQ ID NO: 440118 - RNA, 17 nt, Brucella suis 1330
gcaccuucgcuaucacc

SEQ ID NO: 440119 - RNA, 17 nt, Brucella suis 1330
gcaccugggccacggcg

SEQ ID NO: 440120 - RNA, 21 nt, Brucella suis 1330
gcaccgaaaauuguggccgau

SEQ ID NO: 440121 - RNA, 17 nt, Brucella suis 1330
gcaccagcgcgccgauc

SEQ ID NO: 440122 - RNA, 15 nt, Brucella suis 1330
gcaccagcgcgccga

SEQ ID NO: 440123 - RNA, 13 nt, Brucella suis 1330
gcaccagcgcgcc

SEQ ID NO: 440124 - RNA, 19 nt, Brucella suis 1330
gcaccagcggcacgccgcc

SEQ ID NO: 440125 - RNA, 16 nt, Brucella suis 1330
gcaccaagaccgccgc

SEQ ID NO: 440126 - RNA, 14 nt, Brucella suis 1330
gcacauggcggccu

SEQ ID NO: 440127 - RNA, 14 nt, Brucella suis 1330
gcacauaaaacgcg

SEQ ID NO: 440128 - RNA, 17 nt, Brucella suis 1330
gcacauaaaacgcgccg

SEQ ID NO: 440129 - RNA, 14 nt, Brucella suis 1330
gcacagccagaaag

SEQ ID NO: 440130 - RNA, 14 nt, Brucella suis 1330
gcacacggucaugc

SEQ ID NO: 440131 - RNA, 23 nt, Brucella suis 1330
gcaaucagaucgguaugggcaau

SEQ ID NO: 440132 - RNA, 12 nt, Brucella suis 1330
gcaauaucgcga

SEQ ID NO: 440133 - RNA, 18 nt, Brucella suis 1330
gcaauaugcgccuugcgc

SEQ ID NO: 440134 - RNA, 23 nt, Brucella suis 1330
gcaauaugcgccuugcgccgcag

SEQ ID NO: 440135 - RNA, 14 nt, Brucella suis 1330
gcaauaccaagcgc

SEQ ID NO: 440136 - RNA, 20 nt, Brucella suis 1330
gauuggauuugacguuugaa

SEQ ID NO: 440137 - RNA, 16 nt, Brucella suis 1330
gauugccgcgcgcggc

SEQ ID NO: 440138 - RNA, 18 nt, Brucella suis 1330
gauugcgcaagugcugca

SEQ ID NO: 440139 - RNA, 15 nt, Brucella suis 1330
gauugcccauugccc

SEQ ID NO: 440140 - RNA, 19 nt, Brucella suis 1330
gauugaauccgaucggcgc

SEQ ID NO: 440141 - RNA, 15 nt, Brucella suis 1330
gauuccaacauuugc

SEQ ID NO: 440142 - RNA, 20 nt, Brucella suis 1330
gauuccaacauuugcucaac

SEQ ID NO: 440143 - RNA, 18 nt, Brucella suis 1330
gaugucgauuucaccggg

SEQ ID NO: 440144 - RNA, 20 nt, Brucella suis 1330
gauggcguucgucaaugcgc

SEQ ID NO: 440145 - RNA, 17 nt, Brucella suis 1330
gauggaagacauugcca

SEQ ID NO: 440146 - RNA, 22 nt, Brucella suis 1330
gauggaacggaaaaugcccggc

SEQ ID NO: 440147 - RNA, 23 nt, Brucella suis 1330
gaugcuugccucguccgguuuuc

SEQ ID NO: 440148 - RNA, 19 nt, Brucella suis 1330
gaugcggaacacgccgcca

SEQ ID NO: 440149 - RNA, 17 nt, Brucella suis 1330
gaugcggaugacuucgg

SEQ ID NO: 440150 - RNA, 11 nt, Brucella suis 1330
gaugcgccagu

SEQ ID NO: 440151 - RNA, 17 nt, Brucella suis 1330
gaugcgccagcgaugau

SEQ ID NO: 440152 - RNA, 16 nt, Brucella suis 1330
gaugcgcagccgcguc

SEQ ID NO: 440153 - RNA, 17 nt, Brucella suis 1330
gaugccgggcacgaaaa

SEQ ID NO: 440154 - RNA, 23 nt, Brucella suis 1330
gaugaugcuugccucguccgguu

SEQ ID NO: 440155 - RNA, 17 nt, Brucella suis 1330
gaugauagcgcccgccu

SEQ ID NO: 440156 - RNA, 22 nt, Brucella suis 1330
gaugauaucgccuucgcgcacc

SEQ ID NO: 440157 - RNA, 17 nt, Brucella suis 1330
gaugagcaggcgaucca

SEQ ID NO: 440158 - RNA, 14 nt, Brucella suis 1330
gaugacggcgcggc

SEQ ID NO: 440159 - RNA, 22 nt, Brucella suis 1330
gaugacgaaaugaacaucggcg

SEQ ID NO: 440160 - RNA, 18 nt, Brucella suis 1330
gaucuugcguugcgauau

SEQ ID NO: 440161 - RNA, 17 nt, Brucella suis 1330
gaucuggggcacgagaa

SEQ ID NO: 440162 - RNA, 23 nt, Brucella suis 1330
gaucuucggcaucagaaauuugc

SEQ ID NO: 440163 - RNA, 13 nt, Brucella suis 1330
gaucuggaacagu

SEQ ID NO: 440164 - RNA, 17 nt, Brucella suis 1330
gaucgugccgccuucgg

SEQ ID NO: 440165 - RNA, 17 nt, Brucella suis 1330
gaucgugccggaauggc

SEQ ID NO: 440166 - RNA, 13 nt, Brucella suis 1330
gaucggcgagcgc

SEQ ID NO: 440167 - RNA, 15 nt, Brucella suis 1330
gaucggccauuucgg

SEQ ID NO: 440168 - RNA, 17 nt, Brucella suis 1330
gaucaccgcagucaugc

SEQ ID NO: 440169 - RNA, 15 nt, Brucella suis 1330
gaucacagccgcgcc

SEQ ID NO: 440170 - RNA, 16 nt, Brucella suis 1330
gaucacagccgcgcca

SEQ ID NO: 440171 - RNA, 22 nt, Brucella suis 1330
gauaucuuccugaauggucugc

SEQ ID NO: 440172 - RNA, 22 nt, Brucella suis 1330
gauaucggacuggauuucgagc

SEQ ID NO: 440173 - RNA, 15 nt, Brucella suis 1330
gauaucgccuucgcg

SEQ ID NO: 440174 - RNA, 20 nt, Brucella suis 1330
gauauccggcacggccacgc

SEQ ID NO: 440175 - RNA, 16 nt, Brucella suis 1330
gauaucgagaccggcu

SEQ ID NO: 440176 - RNA, 16 nt, Brucella suis 1330
gauaucgagcgccaga

SEQ ID NO: 440177 - RNA, 22 nt, Brucella suis 1330
gauaucgagcgccagaucgaug

SEQ ID NO: 440178 - RNA, 17 nt, Brucella suis 1330
gauaucaugcucgucgg

SEQ ID NO: 440179 - RNA, 13 nt, Brucella suis 1330
gauaggcgcgccc

SEQ ID NO: 440180 - RNA, 15 nt, Brucella suis 1330
gauaggugagcggca

SEQ ID NO: 440181 - RNA, 15 nt, Brucella suis 1330
gaggcguuccgccuc

SEQ ID NO: 440182 - RNA, 15 nt, Brucella suis 1330
gaggaaauugacgcc

SEQ ID NO: 440183 - RNA, 15 nt, Brucella suis 1330
gagcugcaucgcagg

SEQ ID NO: 440184 - RNA, 18 nt, Brucella suis 1330
gagcguccgagcggcagc

SEQ ID NO: 440185 - RNA, 21 nt, Brucella suis 1330
gagcggucgacagugaaaucg

SEQ ID NO: 440186 - RNA, 15 nt, Brucella suis 1330
gagcggcagcagcca

SEQ ID NO: 440187 - RNA, 14 nt, Brucella suis 1330
gagcgcauccagcg

SEQ ID NO: 440188 - RNA, 13 nt, Brucella suis 1330
gagcgcaucccga

SEQ ID NO: 440189 - RNA, 17 nt, Brucella suis 1330
gagcgcaauaucggcga

SEQ ID NO: 440190 - RNA, 15 nt, Brucella suis 1330
gagcgauuucuggag

SEQ ID NO: 440191 - RNA, 21 nt, Brucella suis 1330
gagccuucauugcggccaagc

SEQ ID NO: 440192 - RNA, 18 nt, Brucella suis 1330
gagccggccacgaaaugg

SEQ ID NO: 440193 - RNA, 20 nt, Brucella suis 1330
gagccggaaaauaucaaagc

SEQ ID NO: 440194 - RNA, 15 nt, Brucella suis 1330
gagccgaauuccgcc

SEQ ID NO: 440195 - RNA, 13 nt, Brucella suis 1330
gagcccgccgaaa

SEQ ID NO: 440196 - RNA, 20 nt, Brucella suis 1330
gagcauucccuucgcgccgc

SEQ ID NO: 440197 - RNA, 16 nt, Brucella suis 1330
gagcauuuuucgggcg

SEQ ID NO: 440198 - RNA, 17 nt, Brucella suis 1330
gagccaaaaaugugaaa

SEQ ID NO: 440199 - RNA, 14 nt, Brucella suis 1330
gagcauggaucgcc

SEQ ID NO: 440200 - RNA, 18 nt, Brucella suis 1330
gagcaugaucgcccgccc

SEQ ID NO: 440201 - RNA, 16 nt, Brucella suis 1330
gagcaggcaggccgcc

SEQ ID NO: 440202 - RNA, 18 nt, Brucella suis 1330
gacgggcgagcgccagcg

SEQ ID NO: 440203 - RNA, 19 nt, Brucella suis 1330
gacggcgcagcgacuucca

SEQ ID NO: 440204 - RNA, 17 nt, Brucella suis 1330
gacgauuuucgccaagc

SEQ ID NO: 440205 - RNA, 18 nt, Brucella suis 1330
gacgaucuuuuccauaug

SEQ ID NO: 440206 - RNA, 15 nt, Brucella suis 1330
gacgaucuggaaggc

SEQ ID NO: 440207 - RNA, 23 nt, Brucella suis 1330
gacgaucaggaauacgcccugca

SEQ ID NO: 440208 - RNA, 14 nt, Brucella suis 1330
gacgagaugcgcuu

SEQ ID NO: 440209 - RNA, 18 nt, Brucella suis 1330
gacgagcggcaggccgaa

SEQ ID NO: 440210 - RNA, 20 nt, Brucella suis 1330
gaccucauuugccaccugca

SEQ ID NO: 440211 - RNA, 22 nt, Brucella suis 1330
gaccgccucgacagcacugcca

SEQ ID NO: 440212 - RNA, 21 nt, Brucella suis 1330
gaccaacuucgggggaaugcg

SEQ ID NO: 440213 - RNA, 16 nt, Brucella suis 1330
gacaugccaagagccg

SEQ ID NO: 440214 - RNA, 20 nt, Brucella suis 1330
gacaugaaggagaggccgau

SEQ ID NO: 440215 - RNA, 18 nt, Brucella suis 1330
gacagcaaccgaaagcgc

SEQ ID NO: 440216 - RNA, 15 nt, Brucella suis 1330
gacagauugcuaaau

SEQ ID NO: 440217 - RNA, 18 nt, Brucella suis 1330
gacaccugcggcgccaga

SEQ ID NO: 440218 - RNA, 21 nt, Brucella suis 1330
gacaaccacgcuugcgcccgc

SEQ ID NO: 440219 - RNA, 15 nt, Brucella suis 1330
gaauagcgagaucga

SEQ ID NO: 440220 - RNA, 19 nt, Brucella suis 1330
gaauaucgaucaaggccgu

SEQ ID NO: 440221 - RNA, 19 nt, Brucella suis 1330
gaagucacgauggcccagc

SEQ ID NO: 440222 - RNA, 15 nt, Brucella suis 1330
gaaggcgcggcagcu

SEQ ID NO: 440223 - RNA, 17 nt, Brucella suis 1330
gaaggcgggaaggcaau

SEQ ID NO: 440224 - RNA, 22 nt, Brucella suis 1330
gaaggcgcgacguaaagcguga

SEQ ID NO: 440225 - RNA, 16 nt, Brucella suis 1330
gaaggccucaucgauc

SEQ ID NO: 440226 - RNA, 19 nt, Brucella suis 1330
gaaggccucaucgaucacg

SEQ ID NO: 440227 - RNA, 19 nt, Brucella suis 1330
gaaggcaucggugcgcggc

SEQ ID NO: 440228 - RNA, 17 nt, Brucella suis 1330
gaaggaauccgguucgc

SEQ ID NO: 440229 - RNA, 16 nt, Brucella suis 1330
gaaggaaugggcgggg

SEQ ID NO: 440230 - RNA, 19 nt, Brucella suis 1330
gaagcguaaugccccgcac

SEQ ID NO: 440231 - RNA, 22 nt, Brucella suis 1330
gaagcggcgcgaugcgaaacgg

SEQ ID NO: 440232 - RNA, 15 nt, Brucella suis 1330
gaagcgccgauaccg

SEQ ID NO: 440233 - RNA, 18 nt, Brucella suis 1330
gaagagcguugcugccgg

SEQ ID NO: 440234 - RNA, 21 nt, Brucella suis 1330
gaagaaauucgcuguugcgcc

SEQ ID NO: 440235 - RNA, 19 nt, Brucella suis 1330
gaagaacagaagcaccagc

SEQ ID NO: 440236 - RNA, 19 nt, Brucella suis 1330
gaacugggcggccagcucc

SEQ ID NO: 440237 - RNA, 20 nt, Brucella suis 1330
gaacggguggcgcgaaaccg

SEQ ID NO: 440238 - RNA, 15 nt, Brucella suis 1330
gaacgcugaaugcgg

SEQ ID NO: 440239 - RNA, 16 nt, Brucella suis 1330
gaacgccaaugcgguc

SEQ ID NO: 440240 - RNA, 14 nt, Brucella suis 1330
gaaaccccggcagc

SEQ ID NO: 440241 - RNA, 15 nt, Brucella suis 1330
gaaaccaaagcgucc

SEQ ID NO: 440242 - RNA, 14 nt, Brucella suis 1330
gaaaauauagccgc

SEQ ID NO: 440243 - RNA, 21 nt, Brucella suis 1330
gaaaagcucgcgucccgcacg

SEQ ID NO: 440244 - RNA, 19 nt, Brucella suis 1330
gaaaaggcucaaucgccgc

SEQ ID NO: 440245 - RNA, 22 nt, Brucella suis 1330
gaaaaggcuggccaugcgggca

SEQ ID NO: 440246 - RNA, 15 nt, Brucella suis 1330
gaaaaguccuuuccg

SEQ ID NO: 440247 - RNA, 13 nt, Brucella suis 1330
gaaaaaagcccgg

SEQ ID NO: 440248 - RNA, 14 nt, Brucella suis 1330
gaaaaacccggucu

SEQ ID NO: 440249 - RNA, 21 nt, Brucella suis 1330
cuuugcaccgcgccggaaggc

SEQ ID NO: 440250 - RNA, 18 nt, Brucella suis 1330
cuuugccgcauaaagcac

SEQ ID NO: 440251 - RNA, 14 nt, Brucella suis 1330
cuuugccgcgcgaa

SEQ ID NO: 440252 - RNA, 15 nt, Brucella suis 1330
cuuugaccgccgcga

SEQ ID NO: 440253 - RNA, 21 nt, Brucella suis 1330
cuuuccaguacggcgcgcuga

SEQ ID NO: 440254 - RNA, 18 nt, Brucella suis 1330
cuugucgccugauagcau

SEQ ID NO: 440255 - RNA, 22 nt, Brucella suis 1330
cuuguccaccaccugcccgcac

SEQ ID NO: 440256 - RNA, 17 nt, Brucella suis 1330
cuuggcuuccagcguca

SEQ ID NO: 440257 - RNA, 21 nt, Brucella suis 1330
cuuggcaucaaccuuuucggc

SEQ ID NO: 440258 - RNA, 22 nt, Brucella suis 1330
cuuggcaucaaccuuuucggca

SEQ ID NO: 440259 - RNA, 13 nt, Brucella suis 1330
cuugcggcggcgu

SEQ ID NO: 440260 - RNA, 15 nt, Brucella suis 1330
cuugccggccugaaa

SEQ ID NO: 440261 - RNA, 18 nt, Brucella suis 1330
cuugccgccuuucaugcc

SEQ ID NO: 440262 - RNA, 21 nt, Brucella suis 1330
cuugccaccacgauggaagga

SEQ ID NO: 440263 - RNA, 19 nt, Brucella suis 1330
cuugccaaaaugauuucgc

SEQ ID NO: 440264 - RNA, 16 nt, Brucella suis 1330
cuugccaacauggcug

SEQ ID NO: 440265 - RNA, 24 nt, Brucella suis 1330
cuugcaacauugauguguccggcg

SEQ ID NO: 440266 - RNA, 19 nt, Brucella suis 1330
cuugaugccugcaugggca

SEQ ID NO: 440267 - RNA, 16 nt, Brucella suis 1330
cuugaugcggcggcgc

SEQ ID NO: 440268 - RNA, 13 nt, Brucella suis 1330
cuugaagcaaggc

SEQ ID NO: 440269 - RNA, 12 nt, Brucella suis 1330
cuucucccaaag

SEQ ID NO: 440270 - RNA, 18 nt, Brucella suis 1330
cuucgacugaacauggaa

SEQ ID NO: 440271 - RNA, 17 nt, Brucella suis 1330
cuucgacguggagcagg

SEQ ID NO: 440272 - RNA, 21 nt, Brucella suis 1330
cuuccggcagaccggaucgcg

SEQ ID NO: 440273 - RNA, 19 nt, Brucella suis 1330
cuuccgcaagccaguccuu

SEQ ID NO: 440274 - RNA, 20 nt, Brucella suis 1330
cuuccacgcggauaucggcg

SEQ ID NO: 440275 - RNA, 13 nt, Brucella suis 1330
cuucccgcaauuc

SEQ ID NO: 440276 - RNA, 20 nt, Brucella suis 1330
cuucauucaaucugcauaau

SEQ ID NO: 440277 - RNA, 19 nt, Brucella suis 1330
cuguccugccagcggcaga

SEQ ID NO: 440278 - RNA, 20 nt, Brucella suis 1330
cuguccgguccccgccgccg

SEQ ID NO: 440279 - RNA, 21 nt, Brucella suis 1330
cugggucauuuuugacaagcc

SEQ ID NO: 440280 - RNA, 17 nt, Brucella suis 1330
cugggcgaugagcgcca

SEQ ID NO: 440281 - RNA, 21 nt, Brucella suis 1330
cuggcuccagucgaggcagcc

SEQ ID NO: 440282 - RNA, 23 nt, Brucella suis 1330
cuggccaagcgucuugcgcucca

SEQ ID NO: 440283 - RNA, 16 nt, Brucella suis 1330
cuggcaacgacggcug

SEQ ID NO: 440284 - RNA, 18 nt, Brucella suis 1330
cuggacauaaaccgauga

SEQ ID NO: 440285 - RNA, 20 nt, Brucella suis 1330
cuggaaauauucgggcggca

SEQ ID NO: 440286 - RNA, 19 nt, Brucella suis 1330
cugcuucaucgcggcagcc

SEQ ID NO: 440287 - RNA, 14 nt, Brucella suis 1330
cugcugcgcggcau

SEQ ID NO: 440288 - RNA, 14 nt, Brucella suis 1330
cugcugccaugucu

SEQ ID NO: 440289 - RNA, 17 nt, Brucella suis 1330
cugcucggcgcggcguu

SEQ ID NO: 440290 - RNA, 19 nt, Brucella suis 1330
cugcuccaucgcaaaggag

SEQ ID NO: 440291 - RNA, 11 nt, Brucella suis 1330
cugcgcgcgcg

SEQ ID NO: 440292 - RNA, 22 nt, Brucella suis 1330
cugcgcgaaccagauccaccgc

SEQ ID NO: 440293 - RNA, 23 nt, Brucella suis 1330
cugcgcgcaaaccaggaccgcga

SEQ ID NO: 440294 - RNA, 21 nt, Brucella suis 1330
cugcgcgaauagcgagaucga

SEQ ID NO: 440295 - RNA, 20 nt, Brucella suis 1330
cugcgccaguuuucgcggca

SEQ ID NO: 440296 - RNA, 14 nt, Brucella suis 1330
cugcaagauaggcc

SEQ ID NO: 440297 - RNA, 15 nt, Brucella suis 1330
cugauagcaaggcgc

SEQ ID NO: 440298 - RNA, 21 nt, Brucella suis 1330
cugagcaauagagucgccgaa

SEQ ID NO: 440299 - RNA, 13 nt, Brucella suis 1330
cugacgcgcaucu

SEQ ID NO: 440300 - RNA, 19 nt, Brucella suis 1330
cugaaaucugcgccgguuu

SEQ ID NO: 440301 - RNA, 13 nt, Brucella suis 1330
cugaaaagcccgc

SEQ ID NO: 440302 - RNA, 17 nt, Brucella suis 1330
cucgauggccugcacau

SEQ ID NO: 440303 - RNA, 19 nt, Brucella suis 1330
cucgaucggugcaaugcca

SEQ ID NO: 440304 - RNA, 18 nt, Brucella suis 1330
cuccggguucucgucgau

SEQ ID NO: 440305 - RNA, 23 nt, Brucella suis 1330
cuccagauaccgguacuggccaa

SEQ ID NO: 440306 - RNA, 20 nt, Brucella suis 1330
cucaaaaaccggagccgccg

SEQ ID NO: 440307 - RNA, 14 nt, Brucella suis 1330
cuauuauucaccgc

SEQ ID NO: 440308 - RNA, 13 nt, Brucella suis 1330
cuaaaaagcgcgc

SEQ ID NO: 440309 - RNA, 22 nt, Brucella suis 1330
cguuggaaaaugcgacaaaaca

SEQ ID NO: 440310 - RNA, 13 nt, Brucella suis 1330
cguugcuggaaca

SEQ ID NO: 440311 - RNA, 22 nt, Brucella suis 1330
cguugcgaugagccucaauggc

SEQ ID NO: 440312 - RNA, 19 nt, Brucella suis 1330
cguugccgagaaugaccac

SEQ ID NO: 440313 - RNA, 18 nt, Brucella suis 1330
cguugcagauauuccuuc

SEQ ID NO: 440314 - RNA, 14 nt, Brucella suis 1330
cguugcaucggcgg

SEQ ID NO: 440315 - RNA, 13 nt, Brucella suis 1330
cguugaugacgaa

SEQ ID NO: 440316 - RNA, 15 nt, Brucella suis 1330
cguucgucaaugcgc

SEQ ID NO: 440317 - RNA, 19 nt, Brucella suis 1330
cgugccguaauucgacacg

SEQ ID NO: 440318 - RNA, 14 nt, Brucella suis 1330
cgugcagccugaac

SEQ ID NO: 440319 - RNA, 14 nt, Brucella suis 1330
cgugcagaugcgag

SEQ ID NO: 440320 - RNA, 15 nt, Brucella suis 1330
cgucuugauugcgaa

SEQ ID NO: 440321 - RNA, 13 nt, Brucella suis 1330
cgucuucggcgca

SEQ ID NO: 440322 - RNA, 15 nt, Brucella suis 1330
cgucugauccgugag

SEQ ID NO: 440323 - RNA, 19 nt, Brucella suis 1330
cgucguugaacuugcccgc

SEQ ID NO: 440324 - RNA, 18 nt, Brucella suis 1330
cgucggaaauaucgccga

SEQ ID NO: 440325 - RNA, 20 nt, Brucella suis 1330
cgucgcgaaucucgaucuug

SEQ ID NO: 440326 - RNA, 21 nt, Brucella suis 1330
cgucgccagcucgccggcuuc

SEQ ID NO: 440327 - RNA, 22 nt, Brucella suis 1330
cgucgagaagcaucagcuugcc

SEQ ID NO: 440328 - RNA, 20 nt, Brucella suis 1330
cguccuucaggcccuugccg

SEQ ID NO: 440329 - RNA, 15 nt, Brucella suis 1330
cguccucaucgccgg

SEQ ID NO: 440330 - RNA, 19 nt, Brucella suis 1330
cguccggcuucgugcaaac

SEQ ID NO: 440331 - RNA, 20 nt, Brucella suis 1330
cgucccggaagccgccuucc

SEQ ID NO: 440332 - RNA, 23 nt, Brucella suis 1330
cgucauaggcaauaccaagcgca

SEQ ID NO: 440333 - RNA, 16 nt, Brucella suis 1330
cgucaguggcagcagg

SEQ ID NO: 440334 - RNA, 14 nt, Brucella suis 1330
cgucaccgugcgca

SEQ ID NO: 440335 - RNA, 23 nt, Brucella suis 1330
cgucaaugccauccguaucggcg

SEQ ID NO: 440336 - RNA, 17 nt, Brucella suis 1330
cgucaaugcgcgcccgu

SEQ ID NO: 440337 - RNA, 21 nt, Brucella suis 1330
cgucacaaaacagacgcccuc

SEQ ID NO: 440338 - RNA, 23 nt, Brucella suis 1330
cguaucgccaaugcccugcugca

SEQ ID NO: 440339 - RNA, 19 nt, Brucella suis 1330
cguaucggcggcaagcgcg

SEQ ID NO: 440340 - RNA, 16 nt, Brucella suis 1330
cguaucgacaccgcca

SEQ ID NO: 440341 - RNA, 16 nt, Brucella suis 1330
cguacaacaucgccug

SEQ ID NO: 440342 - RNA, 18 nt, Brucella suis 1330
cguaaucacuugcaagcg

SEQ ID NO: 440343 - RNA, 20 nt, Brucella suis 1330
cguaaucacuugcaagcgcg

SEQ ID NO: 440344 - RNA, 23 nt, Brucella suis 1330
cgguuuucaucgcgucagggcga

SEQ ID NO: 440345 - RNA, 15 nt, Brucella suis 1330
cgguuuucgccgcaa

SEQ ID NO: 440346 - RNA, 23 nt, Brucella suis 1330
cgguucgggcauuguggugcgca

SEQ ID NO: 440347 - RNA, 17 nt, Brucella suis 1330
cgguguuucgguccaca

SEQ ID NO: 440348 - RNA, 21 nt, Brucella suis 1330
cgguuaugggcgguauugcug

SEQ ID NO: 440349 - RNA, 14 nt, Brucella suis 1330
cgguggcauugccc

SEQ ID NO: 440350 - RNA, 22 nt, Brucella suis 1330
cggugcgcggaaaauguuccgc

SEQ ID NO: 440351 - RNA, 13 nt, Brucella suis 1330
cggugccggcagg

SEQ ID NO: 440352 - RNA, 19 nt, Brucella suis 1330
cggugaucggcgugccauu

SEQ ID NO: 440353 - RNA, 15 nt, Brucella suis 1330
cggucacccgcacgc

SEQ ID NO: 440354 - RNA, 17 nt, Brucella suis 1330
cggucaaaacgccccgg

SEQ ID NO: 440355 - RNA, 14 nt, Brucella suis 1330
cggguugcgcccgg

SEQ ID NO: 440356 - RNA, 18 nt, Brucella suis 1330
cgggucguucaccgcaac

SEQ ID NO: 440357 - RNA, 14 nt, Brucella suis 1330
cgggcgagcgccag

SEQ ID NO: 440358 - RNA, 20 nt, Brucella suis 1330
cgggccaacgccggcaccgc

SEQ ID NO: 440359 - RNA, 20 nt, Brucella suis 1330
cgggcauuguggugcgcauc

SEQ ID NO: 440360 - RNA, 21 nt, Brucella suis 1330
cgggcauuguggugcgcaucu

SEQ ID NO: 440361 - RNA, 14 nt, Brucella suis 1330
cgggcauggaagcc

SEQ ID NO: 440362 - RNA, 16 nt, Brucella suis 1330
cgggaauagccgagcu

SEQ ID NO: 440363 - RNA, 12 nt, Brucella suis 1330
cgggaaggcgcg

SEQ ID NO: 440364 - RNA, 17 nt, Brucella suis 1330
cgggaacaauaggcgcg

SEQ ID NO: 440365 - RNA, 18 nt, Brucella suis 1330
cggcuuccagauugucuu

SEQ ID NO: 440366 - RNA, 16 nt, Brucella suis 1330
cggcuguuuucgaggc

SEQ ID NO: 440367 - RNA, 18 nt, Brucella suis 1330
cggcuucagaucgcgcgg

SEQ ID NO: 440368 - RNA, 20 nt, Brucella suis 1330
cggcuggauauagaugccgu

SEQ ID NO: 440369 - RNA, 13 nt, Brucella suis 1330
cggcugcggcaau

SEQ ID NO: 440370 - RNA, 21 nt, Brucella suis 1330
cggcugccuuggcgaucagcg

SEQ ID NO: 440371 - RNA, 15 nt, Brucella suis 1330
cggcguggugcccgc

SEQ ID NO: 440372 - RNA, 15 nt, Brucella suis 1330
cggcgucagggcauu

SEQ ID NO: 440373 - RNA, 20 nt, Brucella suis 1330
cggcgucaguggcagcaggc

SEQ ID NO: 440374 - RNA, 16 nt, Brucella suis 1330
cggcggcuccagccgg

SEQ ID NO: 440375 - RNA, 15 nt, Brucella suis 1330
cggcggcaacgggcg

SEQ ID NO: 440376 - RNA, 23 nt, Brucella suis 1330
cggcgcuugaugacgccaucuuc

SEQ ID NO: 440377 - RNA, 22 nt, Brucella suis 1330
cggcggaaacgauuguuuucgg

SEQ ID NO: 440378 - RNA, 16 nt, Brucella suis 1330
cggcgcugcucgcgca

SEQ ID NO: 440379 - RNA, 19 nt, Brucella suis 1330
cggcgcauucaggcggccu

SEQ ID NO: 440380 - RNA, 14 nt, Brucella suis 1330
cggcgaaacgccug

SEQ ID NO: 440381 - RNA, 13 nt, Brucella suis 1330
cggccuuugcgcc

SEQ ID NO: 440382 - RNA, 15 nt, Brucella suis 1330
cggccuuugcgccgg

SEQ ID NO: 440383 - RNA, 16 nt, Brucella suis 1330
cggccgcccuugcgca

SEQ ID NO: 440384 - RNA, 19 nt, Brucella suis 1330
cggcccgguccgcgcucgu

SEQ ID NO: 440385 - RNA, 15 nt, Brucella suis 1330
cggcccgcgcacgcg

SEQ ID NO: 440386 - RNA, 14 nt, Brucella suis 1330
cggccaugcgcaug

SEQ ID NO: 440387 - RNA, 15 nt, Brucella suis 1330
cggccauuucagguu

SEQ ID NO: 440388 - RNA, 20 nt, Brucella suis 1330
cggccauuucggcuuccagc

SEQ ID NO: 440389 - RNA, 20 nt, Brucella suis 1330
cggcccaaaggccgcgccga

SEQ ID NO: 440390 - RNA, 15 nt, Brucella suis 1330
cggccaagcggaucg

SEQ ID NO: 440391 - RNA, 20 nt, Brucella suis 1330
cggcauuuugcgaaaugcgc

SEQ ID NO: 440392 - RNA, 14 nt, Brucella suis 1330
cggcauauugcggc

SEQ ID NO: 440393 - RNA, 22 nt, Brucella suis 1330
cggcaucaaacuggauccggcg

SEQ ID NO: 440394 - RNA, 12 nt, Brucella suis 1330
cggcaucacugg

SEQ ID NO: 440395 - RNA, 18 nt, Brucella suis 1330
cggcaucagaaauuugcg

SEQ ID NO: 440396 - RNA, 21 nt, Brucella suis 1330
cggcaguuucaccauggccgc

SEQ ID NO: 440397 - RNA, 13 nt, Brucella suis 1330
cggcauaaauguc

SEQ ID NO: 440398 - RNA, 21 nt, Brucella suis 1330
cggcaggugccaucaagcguc

SEQ ID NO: 440399 - RNA, 20 nt, Brucella suis 1330
cggcagcggcgugccgggcg

SEQ ID NO: 440400 - RNA, 17 nt, Brucella suis 1330
cggcagcgaaccgucca

SEQ ID NO: 440401 - RNA, 23 nt, Brucella suis 1330
cggcagccgccgccgcaaaggca

SEQ ID NO: 440402 - RNA, 13 nt, Brucella suis 1330
cggcacucgaaaa

SEQ ID NO: 440403 - RNA, 13 nt, Brucella suis 1330
cggcacgaucagg

SEQ ID NO: 440404 - RNA, 20 nt, Brucella suis 1330
cggcacgaacagaucgccaa

SEQ ID NO: 440405 - RNA, 21 nt, Brucella suis 1330
cggcacgaacagaucgccaag

SEQ ID NO: 440406 - RNA, 22 nt, Brucella suis 1330
cggcaaucgcuucacgcggcug

SEQ ID NO: 440407 - RNA, 18 nt, Brucella suis 1330
cggcaaugaucuggcgcg

SEQ ID NO: 440408 - RNA, 15 nt, Brucella suis 1330
cggcaaucgagacgg

SEQ ID NO: 440409 - RNA, 20 nt, Brucella suis 1330
cggcaaucgagacggaacgc

SEQ ID NO: 440410 - RNA, 21 nt, Brucella suis 1330
cggcaaguguggcgucgucaa

SEQ ID NO: 440411 - RNA, 23 nt, Brucella suis 1330
cggcaagcgcggucagcucgucc

SEQ ID NO: 440412 - RNA, 17 nt, Brucella suis 1330
cggcaagauagccccag

SEQ ID NO: 440413 - RNA, 19 nt, Brucella suis 1330
cggcaagaacaagaacggc

SEQ ID NO: 440414 - RNA, 19 nt, Brucella suis 1330
cggaugcgguugcgacauu

SEQ ID NO: 440415 - RNA, 21 nt, Brucella suis 1330
cggaucuugcgcacauaugcg

SEQ ID NO: 440416 - RNA, 18 nt, Brucella suis 1330
cggaucgugacccgcccu

SEQ ID NO: 440417 - RNA, 15 nt, Brucella suis 1330
cggaucgaggccgaa

SEQ ID NO: 440418 - RNA, 22 nt, Brucella suis 1330
cggaucaaaccggccaugccca

SEQ ID NO: 440419 - RNA, 19 nt, Brucella suis 1330
cggauaauagaugagcugg

SEQ ID NO: 440420 - RNA, 19 nt, Brucella suis 1330
cggagccggccuuugcgcg

SEQ ID NO: 440421 - RNA, 17 nt, Brucella suis 1330
cggacggaugcggaaac

SEQ ID NO: 440422 - RNA, 18 nt, Brucella suis 1330
cggacgagauugccgcca

SEQ ID NO: 440423 - RNA, 18 nt, Brucella suis 1330
cgcugcgacgagaugcgc

SEQ ID NO: 440424 - RNA, 13 nt, Brucella suis 1330
cgcugaucggcgc

SEQ ID NO: 440425 - RNA, 18 nt, Brucella suis 1330
cgcucuggacgaaaggcg

SEQ ID NO: 440426 - RNA, 20 nt, Brucella suis 1330
cgcuccaugcggucggccgc

SEQ ID NO: 440427 - RNA, 20 nt, Brucella suis 1330
cgcuccacacgaacagcagc

SEQ ID NO: 440428 - RNA, 23 nt, Brucella suis 1330
cgcuccacacgaacagcagcagg

SEQ ID NO: 440429 - RNA, 19 nt, Brucella suis 1330
cgcucaucgcaguugcacc

SEQ ID NO: 440430 - RNA, 14 nt, Brucella suis 1330
cgcguugcggccgg

SEQ ID NO: 440431 - RNA, 14 nt, Brucella suis 1330
cgcgucaucgccac

SEQ ID NO: 440432 - RNA, 13 nt, Brucella suis 1330
cgcgucagccggu

SEQ ID NO: 440433 - RNA, 17 nt, Brucella suis 1330
cgcggccacaagcgccg

SEQ ID NO: 440434 - RNA, 21 nt, Brucella suis 1330
cgcggcaucccugucgccgaa

SEQ ID NO: 440435 - RNA, 16 nt, Brucella suis 1330
cgcggcagcuaugcgc

SEQ ID NO: 440436 - RNA, 20 nt, Brucella suis 1330
cgcggcagauaaagcgcaag

SEQ ID NO: 440437 - RNA, 16 nt, Brucella suis 1330
cgcggcaagauagccc

SEQ ID NO: 440438 - RNA, 13 nt, Brucella suis 1330
cgcggcaaugcgc

SEQ ID NO: 440439 - RNA, 14 nt, Brucella suis 1330
cgcggcaaugcgcu

SEQ ID NO: 440440 - RNA, 16 nt, Brucella suis 1330
cgcgcuuggcgaagcc

SEQ ID NO: 440441 - RNA, 21 nt, Brucella suis 1330
cgcgcugcaauggucgacaau

SEQ ID NO: 440442 - RNA, 12 nt, Brucella suis 1330
cgcgcucgccgc

SEQ ID NO: 440443 - RNA, 19 nt, Brucella suis 1330
cgcgcggccccgauuuugg

SEQ ID NO: 440444 - RNA, 16 nt, Brucella suis 1330
cgcgcggcgaaacgcc

SEQ ID NO: 440445 - RNA, 12 nt, Brucella suis 1330
cgcgcgcggcuu

SEQ ID NO: 440446 - RNA, 14 nt, Brucella suis 1330
cgcgcgcgcgcagg

SEQ ID NO: 440447 - RNA, 20 nt, Brucella suis 1330
cgcgccgaugaggccgguaa

SEQ ID NO: 440448 - RNA, 12 nt, Brucella suis 1330
cgcgcccggcgg

SEQ ID NO: 440449 - RNA, 13 nt, Brucella suis 1330
cgcgccaugccau

SEQ ID NO: 440450 - RNA, 18 nt, Brucella suis 1330
cgcgccaugccauccucg

SEQ ID NO: 440451 - RNA, 18 nt, Brucella suis 1330
cgcgccauaaccucgacg

SEQ ID NO: 440452 - RNA, 13 nt, Brucella suis 1330
cgcgccaggcuuc

SEQ ID NO: 440453 - RNA, 15 nt, Brucella suis 1330
cgcgcaucgggcgca

SEQ ID NO: 440454 - RNA, 19 nt, Brucella suis 1330
cgcgcaucuuuuccgaaaa

SEQ ID NO: 440455 - RNA, 21 nt, Brucella suis 1330
cgcgcaucgcgguucgggcau

SEQ ID NO: 440456 - RNA, 15 nt, Brucella suis 1330
cgcgcaggccgcggc

SEQ ID NO: 440457 - RNA, 19 nt, Brucella suis 1330
cgcgcagacgcagcgcauu

SEQ ID NO: 440458 - RNA, 15 nt, Brucella suis 1330
cgcgcagauauggcg

SEQ ID NO: 440459 - RNA, 16 nt, Brucella suis 1330
cgcgcaccugacggcg

SEQ ID NO: 440460 - RNA, 13 nt, Brucella suis 1330
cgcgacaagcgca

SEQ ID NO: 440461 - RNA, 22 nt, Brucella suis 1330
cgccuucgagaaccagcggcca

SEQ ID NO: 440462 - RNA, 16 nt, Brucella suis 1330
cgccugaucgucaggc

SEQ ID NO: 440463 - RNA, 21 nt, Brucella suis 1330
cgccugaucgucaggcgcauu

SEQ ID NO: 440464 - RNA, 14 nt, Brucella suis 1330
cgccggcgccgcca

SEQ ID NO: 440465 - RNA, 12 nt, Brucella suis 1330
cgccggaaacgg

SEQ ID NO: 440466 - RNA, 23 nt, Brucella suis 1330
cgccgccaggcaaaugcuccuuc

SEQ ID NO: 440467 - RNA, 12 nt, Brucella suis 1330
cgcccggcaucc

SEQ ID NO: 440468 - RNA, 14 nt, Brucella suis 1330
cgcccagcucgaaa

SEQ ID NO: 440469 - RNA, 17 nt, Brucella suis 1330
cgcccagcucgaaacau

SEQ ID NO: 440470 - RNA, 13 nt, Brucella suis 1330
cgccauugaccgc

SEQ ID NO: 440471 - RNA, 17 nt, Brucella suis 1330
cgccagcuuccgucagg

SEQ ID NO: 440472 - RNA, 21 nt, Brucella suis 1330
cgccacgaucgagcgaacggc

SEQ ID NO: 440473 - RNA, 15 nt, Brucella suis 1330
cgccaccggcggcgc

SEQ ID NO: 440474 - RNA, 14 nt, Brucella suis 1330
cgccaccgcgccgg

SEQ ID NO: 440475 - RNA, 21 nt, Brucella suis 1330
cgccaagcuugaucgccgcac

SEQ ID NO: 440476 - RNA, 18 nt, Brucella suis 1330
cgccaagccggcgcagcg

SEQ ID NO: 440477 - RNA, 19 nt, Brucella suis 1330
cgcauuuucgagcaucgau

SEQ ID NO: 440478 - RNA, 17 nt, Brucella suis 1330
cgcauugccgaugacug

SEQ ID NO: 440479 - RNA, 12 nt, Brucella suis 1330
cgcauugcccac

SEQ ID NO: 440480 - RNA, 13 nt, Brucella suis 1330
cgcagcgccgcau

SEQ ID NO: 440481 - RNA, 21 nt, Brucella suis 1330
cgcagccagggauugcgcaag

SEQ ID NO: 440482 - RNA, 20 nt, Brucella suis 1330
cgcagcagcgcaaacucguc

SEQ ID NO: 440483 - RNA, 20 nt, Brucella suis 1330
cgcagcagcggaucgaccga

SEQ ID NO: 440484 - RNA, 18 nt, Brucella suis 1330
cgcacuuuugcuggaaau

SEQ ID NO: 440485 - RNA, 12 nt, Brucella suis 1330
cgcacguccggc

SEQ ID NO: 440486 - RNA, 14 nt, Brucella suis 1330
cgcacggucuugcc

SEQ ID NO: 440487 - RNA, 14 nt, Brucella suis 1330
cgcacgcaggacaa

SEQ ID NO: 440488 - RNA, 20 nt, Brucella suis 1330
cgcacgauuauccuuugacg

SEQ ID NO: 440489 - RNA, 15 nt, Brucella suis 1330
cgcaagcuggaacca

SEQ ID NO: 440490 - RNA, 21 nt, Brucella suis 1330
cgcaagccaguccuugcccuc

SEQ ID NO: 440491 - RNA, 21 nt, Brucella suis 1330
cgcaacaagacggaucagcga

SEQ ID NO: 440492 - RNA, 12 nt, Brucella suis 1330
cgcaaagcgcgc

SEQ ID NO: 440493 - RNA, 19 nt, Brucella suis 1330
cgauggaaggaaagcccag

SEQ ID NO: 440494 - RNA, 16 nt, Brucella suis 1330
cgaugccugccaugcc

SEQ ID NO: 440495 - RNA, 13 nt, Brucella suis 1330
cgaugcgaaacgg

SEQ ID NO: 440496 - RNA, 14 nt, Brucella suis 1330
cgaucuggccgaua

SEQ ID NO: 440497 - RNA, 20 nt, Brucella suis 1330
cgauccgcuugcuucgggca

SEQ ID NO: 440498 - RNA, 21 nt, Brucella suis 1330
cgaucaccgcagucaugccca

SEQ ID NO: 440499 - RNA, 19 nt, Brucella suis 1330
cgaguugccacgcgccgcc

SEQ ID NO: 440500 - RNA, 17 nt, Brucella suis 1330
cgaguaucuggcgauaa

SEQ ID NO: 440501 - RNA, 23 nt, Brucella suis 1330
cgagcggcauggcguagaaauag

SEQ ID NO: 440502 - RNA, 13 nt, Brucella suis 1330
cgagcgcgccacg

SEQ ID NO: 440503 - RNA, 15 nt, Brucella suis 1330
cgagaccugccauca

SEQ ID NO: 440504 - RNA, 18 nt, Brucella suis 1330
cgagaauggcaacacggc

SEQ ID NO: 440505 - RNA, 22 nt, Brucella suis 1330
cgagaagcgguguggcccgguc

SEQ ID NO: 440506 - RNA, 22 nt, Brucella suis 1330
cgagaagcaucagcuugcccau

SEQ ID NO: 440507 - RNA, 15 nt, Brucella suis 1330
cgagaacggcggcgg

SEQ ID NO: 440508 - RNA, 20 nt, Brucella suis 1330
cgacuugaagagccgcaggc

SEQ ID NO: 440509 - RNA, 13 nt, Brucella suis 1330
cgagaaaagcgca

SEQ ID NO: 440510 - RNA, 14 nt, Brucella suis 1330
cgacuggcggaauu

SEQ ID NO: 440511 - RNA, 17 nt, Brucella suis 1330
cgaccggucgaagcggc

SEQ ID NO: 440512 - RNA, 20 nt, Brucella suis 1330
cgaccgaaugaaccggcucu

SEQ ID NO: 440513 - RNA, 20 nt, Brucella suis 1330
cgacagggugacgacugaaa

SEQ ID NO: 440514 - RNA, 20 nt, Brucella suis 1330
cgacauauuugucgccgacu

SEQ ID NO: 440515 - RNA, 20 nt, Brucella suis 1330
cgacauccuugaaaagcugg

SEQ ID NO: 440516 - RNA, 17 nt, Brucella suis 1330
cgacacguccgggaagc

SEQ ID NO: 440517 - RNA, 22 nt, Brucella suis 1330
cgacacauccguuacacgcccc

SEQ ID NO: 440518 - RNA, 23 nt, Brucella suis 1330
cgaauuucaucgcccucgcgcca

SEQ ID NO: 440519 - RNA, 15 nt, Brucella suis 1330
cgacaaaacaaauag

SEQ ID NO: 440520 - RNA, 20 nt, Brucella suis 1330
cgaauuccucuccgcccaua

SEQ ID NO: 440521 - RNA, 24 nt, Brucella suis 1330
cgaauucagagcgauuucuggagc

SEQ ID NO: 440522 - RNA, 19 nt, Brucella suis 1330
cgaauacagugacgcgcgc

SEQ ID NO: 440523 - RNA, 19 nt, Brucella suis 1330
cgaaggcaagcaggcgcaa

SEQ ID NO: 440524 - RNA, 15 nt, Brucella suis 1330
cgaagcgguuuucgg

SEQ ID NO: 440525 - RNA, 14 nt, Brucella suis 1330
cgaacucgaugccu

SEQ ID NO: 440526 - RNA, 17 nt, Brucella suis 1330
cgaacgcuccugcaugu

SEQ ID NO: 440527 - RNA, 15 nt, Brucella suis 1330
cgaaccguccgguug

SEQ ID NO: 440528 - RNA, 17 nt, Brucella suis 1330
cgaaccugauccagaag

SEQ ID NO: 440529 - RNA, 13 nt, Brucella suis 1330
cgaaauuggccgc

SEQ ID NO: 440530 - RNA, 15 nt, Brucella suis 1330
cgaaaugagaucaac

SEQ ID NO: 440531 - RNA, 22 nt, Brucella suis 1330
cgaaaugccgauaucggcaugu

SEQ ID NO: 440532 - RNA, 21 nt, Brucella suis 1330
cgaaauaggucagcaggcgcc

SEQ ID NO: 440533 - RNA, 18 nt, Brucella suis 1330
cgaaaagugcgaagcgcc

SEQ ID NO: 440534 - RNA, 18 nt, Brucella suis 1330
cgaaaaaugucgcgcgau

SEQ ID NO: 440535 - RNA, 16 nt, Brucella suis 1330
ccuuggcacguugcgc

SEQ ID NO: 440536 - RNA, 19 nt, Brucella suis 1330
ccuuguuuucugccggugc

SEQ ID NO: 440537 - RNA, 21 nt, Brucella suis 1330
ccuugccccggcaccgcgcaa

SEQ ID NO: 440538 - RNA, 12 nt, Brucella suis 1330
ccuugaccgcua

SEQ ID NO: 440539 - RNA, 19 nt, Brucella suis 1330
ccuucgcgccaggcuucgg

SEQ ID NO: 440540 - RNA, 13 nt, Brucella suis 1330
ccugucccuucuu

SEQ ID NO: 440541 - RNA, 22 nt, Brucella suis 1330
ccuguagacgaacucgaugccu

SEQ ID NO: 440542 - RNA, 22 nt, Brucella suis 1330
ccuggcgaaaacggccaugcgc

SEQ ID NO: 440543 - RNA, 15 nt, Brucella suis 1330
ccugaucgucggcuu

SEQ ID NO: 440544 - RNA, 21 nt, Brucella suis 1330
ccucuucguccucgcgccaga

SEQ ID NO: 440545 - RNA, 19 nt, Brucella suis 1330
ccucgcggaucagcuugcc

SEQ ID NO: 440546 - RNA, 19 nt, Brucella suis 1330
ccucgcgcucggcaagcgc

SEQ ID NO: 440547 - RNA, 20 nt, Brucella suis 1330
ccucgcgccagacaaggcgc

SEQ ID NO: 440548 - RNA, 15 nt, Brucella suis 1330
ccucgcccugcuuca

SEQ ID NO: 440549 - RNA, 17 nt, Brucella suis 1330
ccguuauuucgcgcgca

SEQ ID NO: 440550 - RNA, 13 nt, Brucella suis 1330
ccgugacaauggc

SEQ ID NO: 440551 - RNA, 19 nt, Brucella suis 1330
ccgugaaacagugccgcca

SEQ ID NO: 440552 - RNA, 13 nt, Brucella suis 1330
ccgucggccauca

SEQ ID NO: 440553 - RNA, 14 nt, Brucella suis 1330
ccgucagcgcgccg

SEQ ID NO: 440554 - RNA, 16 nt, Brucella suis 1330
ccgucaaaacgccaua

SEQ ID NO: 440555 - RNA, 12 nt, Brucella suis 1330
ccguaucuccgg

SEQ ID NO: 440556 - RNA, 18 nt, Brucella suis 1330
ccgguugccuugcccaug

SEQ ID NO: 440557 - RNA, 12 nt, Brucella suis 1330
ccgguugcgcca

SEQ ID NO: 440558 - RNA, 19 nt, Brucella suis 1330
ccggggggaauggcgcgcg

SEQ ID NO: 440559 - RNA, 21 nt, Brucella suis 1330
ccggcugccaugugcagccgg

SEQ ID NO: 440560 - RNA, 21 nt, Brucella suis 1330
ccggcggugaagaagcgccag

SEQ ID NO: 440561 - RNA, 17 nt, Brucella suis 1330
ccggcgcaaaggccggg

SEQ ID NO: 440562 - RNA, 12 nt, Brucella suis 1330
ccggccugcgcc

SEQ ID NO: 440563 - RNA, 22 nt, Brucella suis 1330
ccggcccguugccgaucagcau

SEQ ID NO: 440564 - RNA, 17 nt, Brucella suis 1330
ccggccaguggccgaag

SEQ ID NO: 440565 - RNA, 20 nt, Brucella suis 1330
ccggcaguuucugccgcgca

SEQ ID NO: 440566 - RNA, 13 nt, Brucella suis 1330
ccggaagcgcaaa

SEQ ID NO: 440567 - RNA, 13 nt, Brucella suis 1330
ccggaagcgcaag

SEQ ID NO: 440568 - RNA, 18 nt, Brucella suis 1330
ccggaagcgcaaggcggc

SEQ ID NO: 440569 - RNA, 18 nt, Brucella suis 1330
ccggaagaacagcgcgaa

SEQ ID NO: 440570 - RNA, 21 nt, Brucella suis 1330
ccgcucuagguucgcguaucg

SEQ ID NO: 440571 - RNA, 18 nt, Brucella suis 1330
ccgcgugaagaauggcaa

SEQ ID NO: 440572 - RNA, 12 nt, Brucella suis 1330
ccgcgcggcuua

SEQ ID NO: 440573 - RNA, 17 nt, Brucella suis 1330
ccgcgcgaagcgcaucg

SEQ ID NO: 440574 - RNA, 18 nt, Brucella suis 1330
ccgcgccggaaggcgggg

SEQ ID NO: 440575 - RNA, 21 nt, Brucella suis 1330
ccgcgaucacagccgcgccaa

SEQ ID NO: 440576 - RNA, 19 nt, Brucella suis 1330
ccgcgacaucaucaaggaa

SEQ ID NO: 440577 - RNA, 14 nt, Brucella suis 1330
ccgcgacacgucaa

SEQ ID NO: 440578 - RNA, 13 nt, Brucella suis 1330
ccgccugcgcaug

SEQ ID NO: 440579 - RNA, 16 nt, Brucella suis 1330
ccgccugccaugccgc

SEQ ID NO: 440580 - RNA, 24 nt, Brucella suis 1330
ccgccugaucgucaggcgcauucg

SEQ ID NO: 440581 - RNA, 18 nt, Brucella suis 1330
ccgccagauccgcugacu

SEQ ID NO: 440582 - RNA, 18 nt, Brucella suis 1330
ccgcauuuucgagcaucg

SEQ ID NO: 440583 - RNA, 13 nt, Brucella suis 1330
ccgcaucgaucac

SEQ ID NO: 440584 - RNA, 17 nt, Brucella suis 1330
ccgcauaggggcgcaag

SEQ ID NO: 440585 - RNA, 16 nt, Brucella suis 1330
ccgcacgcaaggcggc

SEQ ID NO: 440586 - RNA, 18 nt, Brucella suis 1330
ccgauucauuauucguca

SEQ ID NO: 440587 - RNA, 21 nt, Brucella suis 1330
ccgaucaucgccugaaugaaa

SEQ ID NO: 440588 - RNA, 15 nt, Brucella suis 1330
ccgaucacgccguca

SEQ ID NO: 440589 - RNA, 21 nt, Brucella suis 1330
ccgaggggaacgacgcgcuaa

SEQ ID NO: 440590 - RNA, 18 nt, Brucella suis 1330
ccgagcuugcggcggauu

SEQ ID NO: 440591 - RNA, 18 nt, Brucella suis 1330
ccgaggaauuucagcgaa

SEQ ID NO: 440592 - RNA, 13 nt, Brucella suis 1330
ccgagcugcaagg

SEQ ID NO: 440593 - RNA, 21 nt, Brucella suis 1330
ccgagcauggccugcgcaccg

SEQ ID NO: 440594 - RNA, 19 nt, Brucella suis 1330
ccgagauagacaugcggca

SEQ ID NO: 440595 - RNA, 17 nt, Brucella suis 1330
ccgacaaaaaacaccgc

SEQ ID NO: 440596 - RNA, 17 nt, Brucella suis 1330
ccgaaucggaaaggaug

SEQ ID NO: 440597 - RNA, 18 nt, Brucella suis 1330
ccgaaagauuucuucgca

SEQ ID NO: 440598 - RNA, 16 nt, Brucella suis 1330
ccgaaaagccgcgcgg

SEQ ID NO: 440599 - RNA, 19 nt, Brucella suis 1330
cccucuucguccucgcgcc

SEQ ID NO: 440600 - RNA, 22 nt, Brucella suis 1330
cccugaaaaggcucaaucgccg

SEQ ID NO: 440601 - RNA, 12 nt, Brucella suis 1330
cccgucucgcag

SEQ ID NO: 440602 - RNA, 22 nt, Brucella suis 1330
cccgguuuuguuuaucgggccu

SEQ ID NO: 440603 - RNA, 23 nt, Brucella suis 1330
cccggagccuucgcaucgggauc

SEQ ID NO: 440604 - RNA, 12 nt, Brucella suis 1330
cccgcccgcggc

SEQ ID NO: 440605 - RNA, 17 nt, Brucella suis 1330
cccgcauggucgaugcc

SEQ ID NO: 440606 - RNA, 18 nt, Brucella suis 1330
cccgaugcggcugccgcg

SEQ ID NO: 440607 - RNA, 14 nt, Brucella suis 1330
cccgauaaacccgc

SEQ ID NO: 440608 - RNA, 23 nt, Brucella suis 1330
cccgaaaccauccaugcgcggcg

SEQ ID NO: 440609 - RNA, 17 nt, Brucella suis 1330
ccccuugccccggcacc

SEQ ID NO: 440610 - RNA, 16 nt, Brucella suis 1330
ccccgggcagcggcgc

SEQ ID NO: 440611 - RNA, 15 nt, Brucella suis 1330
cccauggcauaccga

SEQ ID NO: 440612 - RNA, 12 nt, Brucella suis 1330
cccaggaacggc

SEQ ID NO: 440613 - RNA, 15 nt, Brucella suis 1330
cccagccaagcgcca

SEQ ID NO: 440614 - RNA, 14 nt, Brucella suis 1330
cccagcauauggau

SEQ ID NO: 440615 - RNA, 20 nt, Brucella suis 1330
cccagaccgucaaaacgcca

SEQ ID NO: 440616 - RNA, 23 nt, Brucella suis 1330
cccaaggucggcucaucgcgcug

SEQ ID NO: 440617 - RNA, 23 nt, Brucella suis 1330
ccauguugggguuggccugaacc

SEQ ID NO: 440618 - RNA, 20 nt, Brucella suis 1330
ccauguccgccugaucguca

SEQ ID NO: 440619 - RNA, 17 nt, Brucella suis 1330
ccaucguuggauugcca

SEQ ID NO: 440620 - RNA, 18 nt, Brucella suis 1330
ccauaucuucgcccugaa

SEQ ID NO: 440621 - RNA, 18 nt, Brucella suis 1330
ccaguuuauucauuggcg

SEQ ID NO: 440622 - RNA, 21 nt, Brucella suis 1330
ccagugcauuggaaacgccgu

SEQ ID NO: 440623 - RNA, 21 nt, Brucella suis 1330
ccaggaugugucggccagagc

SEQ ID NO: 440624 - RNA, 19 nt, Brucella suis 1330
ccagcgugcagccugaaca

SEQ ID NO: 440625 - RNA, 15 nt, Brucella suis 1330
ccagcguaaaugggc

SEQ ID NO: 440626 - RNA, 18 nt, Brucella suis 1330
ccagcgccgaggcgcagg

SEQ ID NO: 440627 - RNA, 13 nt, Brucella suis 1330
ccagccgcgauca

SEQ ID NO: 440628 - RNA, 15 nt, Brucella suis 1330
ccagcaggccggcga

SEQ ID NO: 440629 - RNA, 12 nt, Brucella suis 1330
ccacgcgccgac

SEQ ID NO: 440630 - RNA, 12 nt, Brucella suis 1330
ccacgauuuccg

SEQ ID NO: 440631 - RNA, 16 nt, Brucella suis 1330
ccacgauuuccgcgac

SEQ ID NO: 440632 - RNA, 22 nt, Brucella suis 1330
ccacgagaucaauacgcucgca

SEQ ID NO: 440633 - RNA, 22 nt, Brucella suis 1330
ccacgacaaaaccgugccagau

SEQ ID NO: 440634 - RNA, 14 nt, Brucella suis 1330
ccacgaaacgccug

SEQ ID NO: 440635 - RNA, 14 nt, Brucella suis 1330
ccaccagugcggca

SEQ ID NO: 440636 - RNA, 14 nt, Brucella suis 1330
ccacauccgccacc

SEQ ID NO: 440637 - RNA, 16 nt, Brucella suis 1330
ccacauaaucgcccuc

SEQ ID NO: 440638 - RNA, 18 nt, Brucella suis 1330
ccaagcaggccgcgauca

SEQ ID NO: 440639 - RNA, 17 nt, Brucella suis 1330
ccaagagccgcugaacc

SEQ ID NO: 440640 - RNA, 13 nt, Brucella suis 1330
ccaaccggauuuc

SEQ ID NO: 440641 - RNA, 16 nt, Brucella suis 1330
cauuggcggaugaucg

SEQ ID NO: 440642 - RNA, 16 nt, Brucella suis 1330
cauuggcguugagccg

SEQ ID NO: 440643 - RNA, 18 nt, Brucella suis 1330
cauugcggccaagcgcau

SEQ ID NO: 440644 - RNA, 19 nt, Brucella suis 1330
cauugccgcgacugucacc

SEQ ID NO: 440645 - RNA, 16 nt, Brucella suis 1330
cauugccccaaggcgc

SEQ ID NO: 440646 - RNA, 13 nt, Brucella suis 1330
cauugaaaggcag

SEQ ID NO: 440647 - RNA, 16 nt, Brucella suis 1330
cauucauuucaaacaa

SEQ ID NO: 440648 - RNA, 11 nt, Brucella suis 1330
cauuccagaag

SEQ ID NO: 440649 - RNA, 17 nt, Brucella suis 1330
cauucccuucgcgccgc

SEQ ID NO: 440650 - RNA, 23 nt, Brucella suis 1330
cauucccuugaaaucauugcgca

SEQ ID NO: 440651 - RNA, 18 nt, Brucella suis 1330
cauucaucguauucggau

SEQ ID NO: 440652 - RNA, 24 nt, Brucella suis 1330
caugucauuugcgaccauggcgca

SEQ ID NO: 440653 - RNA, 15 nt, Brucella suis 1330
cauggucgaugccgc

SEQ ID NO: 440654 - RNA, 18 nt, Brucella suis 1330
cauggucgaugccgccga

SEQ ID NO: 440655 - RNA, 18 nt, Brucella suis 1330
cauggcggaacccacgca

SEQ ID NO: 440656 - RNA, 17 nt, Brucella suis 1330
cauggccgaaaauauca

SEQ ID NO: 440657 - RNA, 17 nt, Brucella suis 1330
cauggaagggcggguuc

SEQ ID NO: 440658 - RNA, 20 nt, Brucella suis 1330
cauggaagugaauuucggcg

SEQ ID NO: 440659 - RNA, 16 nt, Brucella suis 1330
cauggaaaugcaggug

SEQ ID NO: 440660 - RNA, 19 nt, Brucella suis 1330
caugcgauagcggcgcggc

SEQ ID NO: 440661 - RNA, 21 nt, Brucella suis 1330
caugcccugacucugaccuuc

SEQ ID NO: 440662 - RNA, 15 nt, Brucella suis 1330
caugaucgccaccgg

SEQ ID NO: 440663 - RNA, 19 nt, Brucella suis 1330
caugagcaccggaagcgca

SEQ ID NO: 440664 - RNA, 20 nt, Brucella suis 1330
caugaagcgcggcggccacu

SEQ ID NO: 440665 - RNA, 16 nt, Brucella suis 1330
caucuggccgcuaugc

SEQ ID NO: 440666 - RNA, 13 nt, Brucella suis 1330
caucguggcggca

SEQ ID NO: 440667 - RNA, 22 nt, Brucella suis 1330
caucgggucgaccuucgaguuc

SEQ ID NO: 440668 - RNA, 14 nt, Brucella suis 1330
cauccgcacccggc

SEQ ID NO: 440669 - RNA, 18 nt, Brucella suis 1330
caucauuggcguugagcc

SEQ ID NO: 440670 - RNA, 17 nt, Brucella suis 1330
caucaggucgagcgccu

SEQ ID NO: 440671 - RNA, 18 nt, Brucella suis 1330
caucagaaauuugcgggc

SEQ ID NO: 440672 - RNA, 18 nt, Brucella suis 1330
caucacagucacgccauc

SEQ ID NO: 440673 - RNA, 18 nt, Brucella suis 1330
cauauggaugccgccgca

SEQ ID NO: 440674 - RNA, 13 nt, Brucella suis 1330
cauaugaugaacg

SEQ ID NO: 440675 - RNA, 17 nt, Brucella suis 1330
cauauuccacauugccu

SEQ ID NO: 440676 - RNA, 15 nt, Brucella suis 1330
caucaaaaaaccggg

SEQ ID NO: 440677 - RNA, 17 nt, Brucella suis 1330
cauaucguugccgauca

SEQ ID NO: 440678 - RNA, 23 nt, Brucella suis 1330
cauauagguguuggucaugcgcg

SEQ ID NO: 440679 - RNA, 12 nt, Brucella suis 1330
cauaggcgcgcg

SEQ ID NO: 440680 - RNA, 20 nt, Brucella suis 1330
cauaggcuucggccgcuugc

SEQ ID NO: 440681 - RNA, 15 nt, Brucella suis 1330
cauaccgaucugauu

SEQ ID NO: 440682 - RNA, 16 nt, Brucella suis 1330
caguuucugccgcgca

SEQ ID NO: 440683 - RNA, 20 nt, Brucella suis 1330
cagugcgagcgugaagggca

SEQ ID NO: 440684 - RNA, 21 nt, Brucella suis 1330
cagucgcgguuugcaagccgc

SEQ ID NO: 440685 - RNA, 18 nt, Brucella suis 1330
caguccgauaucgagauu

SEQ ID NO: 440686 - RNA, 22 nt, Brucella suis 1330
caguccagcuuuccgcaucgca

SEQ ID NO: 440687 - RNA, 18 nt, Brucella suis 1330
cagguuuccggacgcgca

SEQ ID NO: 440688 - RNA, 21 nt, Brucella suis 1330
cagguggcggauugcagcggu

SEQ ID NO: 440689 - RNA, 15 nt, Brucella suis 1330
cagguggaucggcgu

SEQ ID NO: 440690 - RNA, 18 nt, Brucella suis 1330
caggucagcggcggauaa

SEQ ID NO: 440691 - RNA, 19 nt, Brucella suis 1330
cagggcuugcuugccauuc

SEQ ID NO: 440692 - RNA, 15 nt, Brucella suis 1330
caggccgcggcaucc

SEQ ID NO: 440693 - RNA, 23 nt, Brucella suis 1330
caggccgcggcaucccugucgcc

SEQ ID NO: 440694 - RNA, 20 nt, Brucella suis 1330
caggcccaccgugccgagaa

SEQ ID NO: 440695 - RNA, 19 nt, Brucella suis 1330
caggaucgguuaugggcgg

SEQ ID NO: 440696 - RNA, 13 nt, Brucella suis 1330
caggaucgacagc

SEQ ID NO: 440697 - RNA, 20 nt, Brucella suis 1330
cagcuugucgucgugcagcg

SEQ ID NO: 440698 - RNA, 20 nt, Brucella suis 1330
cagcguucaacuccgucaga

SEQ ID NO: 440699 - RNA, 12 nt, Brucella suis 1330
cagcggcgcgcc

SEQ ID NO: 440700 - RNA, 20 nt, Brucella suis 1330
cagccgucgagggcaccggc

SEQ ID NO: 440701 - RNA, 15 nt, Brucella suis 1330
cagccgcgucagccg

SEQ ID NO: 440702 - RNA, 15 nt, Brucella suis 1330
cagccgccgccgcaa

SEQ ID NO: 440703 - RNA, 18 nt, Brucella suis 1330
cagccauuucggaucggc

SEQ ID NO: 440704 - RNA, 13 nt, Brucella suis 1330
cagccagccgaaa

SEQ ID NO: 440705 - RNA, 20 nt, Brucella suis 1330
cagccagaaucugcgcgucg

SEQ ID NO: 440706 - RNA, 17 nt, Brucella suis 1330
cagcagaaggaugaucg

SEQ ID NO: 440707 - RNA, 22 nt, Brucella suis 1330
cagaugugccaccagcacacag

SEQ ID NO: 440708 - RNA, 15 nt, Brucella suis 1330
cagaugcggcgcgca

SEQ ID NO: 440709 - RNA, 13 nt, Brucella suis 1330
cagaucaagcgcu

SEQ ID NO: 440710 - RNA, 19 nt, Brucella suis 1330
cagauaggcguugaugacg

SEQ ID NO: 440711 - RNA, 20 nt, Brucella suis 1330
cagaaugcauuuuucgccgc

SEQ ID NO: 440712 - RNA, 12 nt, Brucella suis 1330
cacuuccagaua

SEQ ID NO: 440713 - RNA, 20 nt, Brucella suis 1330
cacuggcauuauuccgccug

SEQ ID NO: 440714 - RNA, 22 nt, Brucella suis 1330
cacguccuuggcacguugcgcc

SEQ ID NO: 440715 - RNA, 19 nt, Brucella suis 1330
cacgggcuuugccgcauaa

SEQ ID NO: 440716 - RNA, 18 nt, Brucella suis 1330
cacggcuucauccagauc

SEQ ID NO: 440717 - RNA, 15 nt, Brucella suis 1330
cacggcaaucagauc

SEQ ID NO: 440718 - RNA, 23 nt, Brucella suis 1330
cacggauuuccaccacgcgcgcu

SEQ ID NO: 440719 - RNA, 18 nt, Brucella suis 1330
cacgauuuccgcgacauc

SEQ ID NO: 440720 - RNA, 18 nt, Brucella suis 1330
cacgauuucgcccacgcc

SEQ ID NO: 440721 - RNA, 13 nt, Brucella suis 1330
cacgagaacggua

SEQ ID NO: 440722 - RNA, 14 nt, Brucella suis 1330
cacgaaacgccugc

SEQ ID NO: 440723 - RNA, 16 nt, Brucella suis 1330
caccuucggccagcgc

SEQ ID NO: 440724 - RNA, 21 nt, Brucella suis 1330
caccuucggguuuuuuaccgc

SEQ ID NO: 440725 - RNA, 15 nt, Brucella suis 1330
caccugggccacggc

SEQ ID NO: 440726 - RNA, 23 nt, Brucella suis 1330
caccgccccgcgugaugagccgc

SEQ ID NO: 440727 - RNA, 20 nt, Brucella suis 1330
caccgcaaagagaaccaccu

SEQ ID NO: 440728 - RNA, 16 nt, Brucella suis 1330
cacccgcacgccgugc

SEQ ID NO: 440729 - RNA, 17 nt, Brucella suis 1330
caccauauucguccacg

SEQ ID NO: 440730 - RNA, 19 nt, Brucella suis 1330
caccaagaccgccgcgaug

SEQ ID NO: 440731 - RNA, 22 nt, Brucella suis 1330
caccaauauugcaggcgacauc

SEQ ID NO: 440732 - RNA, 16 nt, Brucella suis 1330
cacaucaccauugccc

SEQ ID NO: 440733 - RNA, 23 nt, Brucella suis 1330
cacaggcucgggcagcuugucga

SEQ ID NO: 440734 - RNA, 19 nt, Brucella suis 1330
cacacuuuucgggaugcgg

SEQ ID NO: 440735 - RNA, 18 nt, Brucella suis 1330
cacaaagcggcccguauc

SEQ ID NO: 440736 - RNA, 14 nt, Brucella suis 1330
caauuccggcaucg

SEQ ID NO: 440737 - RNA, 17 nt, Brucella suis 1330
caauggcccgauaucgg

SEQ ID NO: 440738 - RNA, 16 nt, Brucella suis 1330
caaugcugcaucgcga

SEQ ID NO: 440739 - RNA, 18 nt, Brucella suis 1330
caaugcaaucauaaaggc

SEQ ID NO: 440740 - RNA, 17 nt, Brucella suis 1330
caaugaucuggcgcgcg

SEQ ID NO: 440741 - RNA, 14 nt, Brucella suis 1330
caaugacaagcgga

SEQ ID NO: 440742 - RNA, 19 nt, Brucella suis 1330
caaggccgauggcgaucac

SEQ ID NO: 440743 - RNA, 17 nt, Brucella suis 1330
caaggcccucgcggauc

SEQ ID NO: 440744 - RNA, 21 nt, Brucella suis 1330
caagcggcuucagaucgcgcg

SEQ ID NO: 440745 - RNA, 18 nt, Brucella suis 1330
caagccgcuccgcaccga

SEQ ID NO: 440746 - RNA, 14 nt, Brucella suis 1330
caagcgcggucagc

SEQ ID NO: 440747 - RNA, 17 nt, Brucella suis 1330
caagaucgacaaagccu

SEQ ID NO: 440748 - RNA, 20 nt, Brucella suis 1330
caagaauaggagccggccac

SEQ ID NO: 440749 - RNA, 13 nt, Brucella suis 1330
caacgccgucagc

SEQ ID NO: 440750 - RNA, 21 nt, Brucella suis 1330
caacgcccuucaaaccauccu

SEQ ID NO: 440751 - RNA, 21 nt, Brucella suis 1330
caacgaauacagugacgcgcg

SEQ ID NO: 440752 - RNA, 22 nt, Brucella suis 1330
caacagccguaccggcaucagc

SEQ ID NO: 440753 - RNA, 18 nt, Brucella suis 1330
caaagaucgcguaagucc

SEQ ID NO: 440754 - RNA, 16 nt, Brucella suis 1330
caaaagauuagagcgc

SEQ ID NO: 440755 - RNA, 17 nt, Brucella suis 1330
caaaagugcgaagcgcc

SEQ ID NO: 440756 - RNA, 18 nt, Brucella suis 1330
caaaaguuuucagcggcg

SEQ ID NO: 440757 - RNA, 20 nt, Brucella suis 1330
caaaaucgagugcggccugc

SEQ ID NO: 440758 - RNA, 19 nt, Brucella suis 1330
auuuuucgccgcgcacugg

SEQ ID NO: 440759 - RNA, 22 nt, Brucella suis 1330
auuuucauggguaccuuccagc

SEQ ID NO: 440760 - RNA, 17 nt, Brucella suis 1330
auuugacguccggcuuc

SEQ ID NO: 440761 - RNA, 12 nt, Brucella suis 1330
auuucgcgcgca

SEQ ID NO: 440762 - RNA, 13 nt, Brucella suis 1330
auuucaucucgcg

SEQ ID NO: 440763 - RNA, 18 nt, Brucella suis 1330
auuaagccgggcggcgcg

SEQ ID NO: 440764 - RNA, 19 nt, Brucella suis 1330
auuaagccgggcggcgcgg

SEQ ID NO: 440765 - RNA, 16 nt, Brucella suis 1330
auggugcugccauggc

SEQ ID NO: 440766 - RNA, 19 nt, Brucella suis 1330
auggucugcgccaguuccu

SEQ ID NO: 440767 - RNA, 13 nt, Brucella suis 1330
auggcugcccgcg

SEQ ID NO: 440768 - RNA, 17 nt, Brucella suis 1330
auggcguccccaucgaa

SEQ ID NO: 440769 - RNA, 13 nt, Brucella suis 1330
auggcgugccgaa

SEQ ID NO: 440770 - RNA, 23 nt, Brucella suis 1330
auggcgggccauuuccaaugccu

SEQ ID NO: 440771 - RNA, 16 nt, Brucella suis 1330
auggcggagagcgcga

SEQ ID NO: 440772 - RNA, 16 nt, Brucella suis 1330
auggccgccccgacga

SEQ ID NO: 440773 - RNA, 15 nt, Brucella suis 1330
auggccgccccggcg

SEQ ID NO: 440774 - RNA, 20 nt, Brucella suis 1330
augcucuaggaaaacuugcu

SEQ ID NO: 440775 - RNA, 22 nt, Brucella suis 1330
augcguucucaagagcccgccg

SEQ ID NO: 440776 - RNA, 23 nt, Brucella suis 1330
augcguucucaagagcccgccga

SEQ ID NO: 440777 - RNA, 19 nt, Brucella suis 1330
augcguuuucgagccaaaa

SEQ ID NO: 440778 - RNA, 18 nt, Brucella suis 1330
augcggaacacgccgcca

SEQ ID NO: 440779 - RNA, 17 nt, Brucella suis 1330
augcgcucccggucuuc

SEQ ID NO: 440780 - RNA, 19 nt, Brucella suis 1330
augcgcgcccgucaccggc

SEQ ID NO: 440781 - RNA, 17 nt, Brucella suis 1330
augcgccuugcgccgca

SEQ ID NO: 440782 - RNA, 14 nt, Brucella suis 1330
augcgaugagccuu

SEQ ID NO: 440783 - RNA, 14 nt, Brucella suis 1330
augcgacaaaacaa

SEQ ID NO: 440784 - RNA, 22 nt, Brucella suis 1330
augccuugauccagucggcaag

SEQ ID NO: 440785 - RNA, 16 nt, Brucella suis 1330
augccugccgcagcca

SEQ ID NO: 440786 - RNA, 13 nt, Brucella suis 1330
augccggaugcgg

SEQ ID NO: 440787 - RNA, 16 nt, Brucella suis 1330
augccgauaucggcau

SEQ ID NO: 440788 - RNA, 15 nt, Brucella suis 1330
augcccagcucgccg

SEQ ID NO: 440789 - RNA, 13 nt, Brucella suis 1330
augcaccuucgcu

SEQ ID NO: 440790 - RNA, 20 nt, Brucella suis 1330
augccaccgcgaucaguucg

SEQ ID NO: 440791 - RNA, 22 nt, Brucella suis 1330
augcaaaaccgguucccgcuuc

SEQ ID NO: 440792 - RNA, 15 nt, Brucella suis 1330
augaucuggcgcgcg

SEQ ID NO: 440793 - RNA, 19 nt, Brucella suis 1330
augagcuugcgcccgccga

SEQ ID NO: 440794 - RNA, 12 nt, Brucella suis 1330
augagccgcuuc

SEQ ID NO: 440795 - RNA, 14 nt, Brucella suis 1330
augacggcgcggcg

SEQ ID NO: 440796 - RNA, 17 nt, Brucella suis 1330
aucugcaacaccaucga

SEQ ID NO: 440797 - RNA, 23 nt, Brucella suis 1330
aucucguucacaaucuugccaac

SEQ ID NO: 440798 - RNA, 23 nt, Brucella suis 1330
aucgguggccuugccauggccga

SEQ ID NO: 440799 - RNA, 15 nt, Brucella suis 1330
aucgguggugccgaa

SEQ ID NO: 440800 - RNA, 22 nt, Brucella suis 1330
aucggcagcuuuggcgccgucg

SEQ ID NO: 440801 - RNA, 20 nt, Brucella suis 1330
aucggcaucggaaaggucuu

SEQ ID NO: 440802 - RNA, 19 nt, Brucella suis 1330
aucggaagggcaaggcgcg

SEQ ID NO: 440803 - RNA, 22 nt, Brucella suis 1330
aucgcgagcagcgcgaugagcc

SEQ ID NO: 440804 - RNA, 18 nt, Brucella suis 1330
aucgccaguuucauuucc

SEQ ID NO: 440805 - RNA, 17 nt, Brucella suis 1330
aucgccaccauggccgc

SEQ ID NO: 440806 - RNA, 19 nt, Brucella suis 1330
aucgccaccauggccgccc

SEQ ID NO: 440807 - RNA, 15 nt, Brucella suis 1330
aucgcauccaguccg

SEQ ID NO: 440808 - RNA, 23 nt, Brucella suis 1330
aucgcaucggucagcacgcccgu

SEQ ID NO: 440809 - RNA, 19 nt, Brucella suis 1330
aucgcacgauagccgcgga

SEQ ID NO: 440810 - RNA, 15 nt, Brucella suis 1330
aucgaugagaucguu

SEQ ID NO: 440811 - RNA, 18 nt, Brucella suis 1330
aucgaugauaucgccuuc

SEQ ID NO: 440812 - RNA, 18 nt, Brucella suis 1330
aucgauaucugcaacacc

SEQ ID NO: 440813 - RNA, 19 nt, Brucella suis 1330
auccggccccuuucgcauc

SEQ ID NO: 440814 - RNA, 22 nt, Brucella suis 1330
auccggcagcuuucgcaccgcg

SEQ ID NO: 440815 - RNA, 16 nt, Brucella suis 1330
aucccgguugagccgu

SEQ ID NO: 440816 - RNA, 17 nt, Brucella suis 1330
aucccgcuucgaugcgu

SEQ ID NO: 440817 - RNA, 22 nt, Brucella suis 1330
aucccgaaaagugcgaagcgcc

SEQ ID NO: 440818 - RNA, 17 nt, Brucella suis 1330
auccaucugcuccugcg

SEQ ID NO: 440819 - RNA, 19 nt, Brucella suis 1330
auccauaugcagcggcacu

SEQ ID NO: 440820 - RNA, 20 nt, Brucella suis 1330
auccaccgcgcugaagcggc

SEQ ID NO: 440821 - RNA, 19 nt, Brucella suis 1330
aucauugccccaaggcgca

SEQ ID NO: 440822 - RNA, 14 nt, Brucella suis 1330
aucauccggcucau

SEQ ID NO: 440823 - RNA, 22 nt, Brucella suis 1330
aucagucgcgguuugcaagccg

SEQ ID NO: 440824 - RNA, 15 nt, Brucella suis 1330
aucagcuugccgcca

SEQ ID NO: 440825 - RNA, 16 nt, Brucella suis 1330
auaucgccuucgcgca

SEQ ID NO: 440826 - RNA, 22 nt, Brucella suis 1330
auaucggauucuuaugccagau

SEQ ID NO: 440827 - RNA, 15 nt, Brucella suis 1330
auauucgucggucag

SEQ ID NO: 440828 - RNA, 16 nt, Brucella suis 1330
auaguucaaggcugcu

SEQ ID NO: 440829 - RNA, 13 nt, Brucella suis 1330
auagucaguuccu

SEQ ID NO: 440830 - RNA, 14 nt, Brucella suis 1330
auagucgaaaaaag

SEQ ID NO: 440831 - RNA, 17 nt, Brucella suis 1330
auagggccuuuccggcg

SEQ ID NO: 440832 - RNA, 16 nt, Brucella suis 1330
auaggcgcgcgccucg

SEQ ID NO: 440833 - RNA, 23 nt, Brucella suis 1330
auaggcacccuugguugcgcgcc

SEQ ID NO: 440834 - RNA, 19 nt, Brucella suis 1330
auagcucgacgcuuuccac

SEQ ID NO: 440835 - RNA, 19 nt, Brucella suis 1330
auagaccaugccgccagcc

SEQ ID NO: 440836 - RNA, 22 nt, Brucella suis 1330
auacgguccugcaaaccggcug

SEQ ID NO: 440837 - RNA, 15 nt, Brucella suis 1330
auaccgugaucaggg

SEQ ID NO: 440838 - RNA, 16 nt, Brucella suis 1330
auacaccaaugcaggc

SEQ ID NO: 440839 - RNA, 23 nt, Brucella suis 1330
aguuuggcuaaagauaccagauc

SEQ ID NO: 440840 - RNA, 18 nt, Brucella suis 1330
aguggaucgacauauuug

SEQ ID NO: 440841 - RNA, 19 nt, Brucella suis 1330
aguggauuggauuugacgu

SEQ ID NO: 440842 - RNA, 22 nt, Brucella suis 1330
agugcgcacgccugccgcgcgg

SEQ ID NO: 440843 - RNA, 21 nt, Brucella suis 1330
agugcauaugaugaacgucaa

SEQ ID NO: 440844 - RNA, 14 nt, Brucella suis 1330
agucggcaaggcgg

SEQ ID NO: 440845 - RNA, 15 nt, Brucella suis 1330
aguaggccccgucau

SEQ ID NO: 440846 - RNA, 11 nt, Brucella suis 1330
aggucggcauu

SEQ ID NO: 440847 - RNA, 19 nt, Brucella suis 1330
aggggaugggggccgggcg

SEQ ID NO: 440848 - RNA, 17 nt, Brucella suis 1330
aggggaacgacgcgcua

SEQ ID NO: 440849 - RNA, 22 nt, Brucella suis 1330
agggcugccgcacagcaucaug

SEQ ID NO: 440850 - RNA, 16 nt, Brucella suis 1330
agggcguaaucagcgu

SEQ ID NO: 440851 - RNA, 20 nt, Brucella suis 1330
agggcgcugcgaaggcccuu

SEQ ID NO: 440852 - RNA, 11 nt, Brucella suis 1330
agggccgccga

SEQ ID NO: 440853 - RNA, 19 nt, Brucella suis 1330
aggcggcgcauucggccgc

SEQ ID NO: 440854 - RNA, 16 nt, Brucella suis 1330
aggcggauauucgccg

SEQ ID NO: 440855 - RNA, 19 nt, Brucella suis 1330
aggcgcgaggcggcugcgg

SEQ ID NO: 440856 - RNA, 20 nt, Brucella suis 1330
aggcgaaauauuggcuaaaa

SEQ ID NO: 440857 - RNA, 19 nt, Brucella suis 1330
aggccucugccuccauggc

SEQ ID NO: 440858 - RNA, 17 nt, Brucella suis 1330
aggccgagcgccgccgc

SEQ ID NO: 440859 - RNA, 20 nt, Brucella suis 1330
aggccacgcacggucuugcc

SEQ ID NO: 440860 - RNA, 22 nt, Brucella suis 1330
aggcagggaggagccgauaugc

SEQ ID NO: 440861 - RNA, 20 nt, Brucella suis 1330
aggagcgugucuugcccaga

SEQ ID NO: 440862 - RNA, 17 nt, Brucella suis 1330
aggaagccugcaccggc

SEQ ID NO: 440863 - RNA, 13 nt, Brucella suis 1330
agcuuuucacgcg

SEQ ID NO: 440864 - RNA, 20 nt, Brucella suis 1330
agcuuuccaucgucauugcg

SEQ ID NO: 440865 - RNA, 19 nt, Brucella suis 1330
agcuugcgcacacggcgca

SEQ ID NO: 440866 - RNA, 23 nt, Brucella suis 1330
agcuucggaagaaagauggucaa

SEQ ID NO: 440867 - RNA, 16 nt, Brucella suis 1330
agcguccauccggcgg

SEQ ID NO: 440868 - RNA, 23 nt, Brucella suis 1330
agcguauuuucgagccaaaagug

SEQ ID NO: 440869 - RNA, 18 nt, Brucella suis 1330
agcggcggguagccgcca

SEQ ID NO: 440870 - RNA, 22 nt, Brucella suis 1330
agcggccaucuuccaguuccga

SEQ ID NO: 440871 - RNA, 20 nt, Brucella suis 1330
agcggcaucaucgucggcca

SEQ ID NO: 440872 - RNA, 20 nt, Brucella suis 1330
agcggcaggagccggaaaau

SEQ ID NO: 440873 - RNA, 22 nt, Brucella suis 1330
agcggcagcggcgugccgggcg

SEQ ID NO: 440874 - RNA, 15 nt, Brucella suis 1330
agcggcacgccgccc

SEQ ID NO: 440875 - RNA, 16 nt, Brucella suis 1330
agcggcacgccgccca

SEQ ID NO: 440876 - RNA, 17 nt, Brucella suis 1330
agcggauauucggcguu

SEQ ID NO: 440877 - RNA, 17 nt, Brucella suis 1330
agcgcggcaaugcgcuu

SEQ ID NO: 440878 - RNA, 22 nt, Brucella suis 1330
agcgcggagcaacaccccgcgc

SEQ ID NO: 440879 - RNA, 23 nt, Brucella suis 1330
agcgcgcccaaucucgauaucgg

SEQ ID NO: 440880 - RNA, 14 nt, Brucella suis 1330
agcgcgccaucggc

SEQ ID NO: 440881 - RNA, 23 nt, Brucella suis 1330
agcgcgaagaccuucuggaagcg

SEQ ID NO: 440882 - RNA, 20 nt, Brucella suis 1330
agcgcgaacaugccugccgc

SEQ ID NO: 440883 - RNA, 17 nt, Brucella suis 1330
agcgccuuugccgcgcg

SEQ ID NO: 440884 - RNA, 14 nt, Brucella suis 1330
agcgccuucagcgu

SEQ ID NO: 440885 - RNA, 18 nt, Brucella suis 1330
agcgccgcauaauccuca

SEQ ID NO: 440886 - RNA, 17 nt, Brucella suis 1330
agcgcaaagcgcgcgcc

SEQ ID NO: 440887 - RNA, 21 nt, Brucella suis 1330
agcgauuggcuucaaucagga

SEQ ID NO: 440888 - RNA, 22 nt, Brucella suis 1330
agcgacucuacgcugaucgcaa

SEQ ID NO: 440889 - RNA, 14 nt, Brucella suis 1330
agcgaagcgaugac

SEQ ID NO: 440890 - RNA, 18 nt, Brucella suis 1330
agccuggaugacaucggc

SEQ ID NO: 440891 - RNA, 14 nt, Brucella suis 1330
agccucaucggcgg

SEQ ID NO: 440892 - RNA, 20 nt, Brucella suis 1330
agccucgauaaucuggcugg

SEQ ID NO: 440893 - RNA, 13 nt, Brucella suis 1330
agccuauaucgcg

SEQ ID NO: 440894 - RNA, 14 nt, Brucella suis 1330
agccgcuccggcgu

SEQ ID NO: 440895 - RNA, 14 nt, Brucella suis 1330
agccgcagccgcca

SEQ ID NO: 440896 - RNA, 22 nt, Brucella suis 1330
agccgaagggaaugggaucgac

SEQ ID NO: 440897 - RNA, 19 nt, Brucella suis 1330
agcauuuccagcaaaagug

SEQ ID NO: 440898 - RNA, 20 nt, Brucella suis 1330
agcauggugcgcacuuccgc

SEQ ID NO: 440899 - RNA, 13 nt, Brucella suis 1330
agcaucgcccccu

SEQ ID NO: 440900 - RNA, 19 nt, Brucella suis 1330
agcagcgcgaugagccgac

SEQ ID NO: 440901 - RNA, 20 nt, Brucella suis 1330
agcacauccugcaccggcuu

SEQ ID NO: 440902 - RNA, 22 nt, Brucella suis 1330
agcaaaggucgggugccagauc

SEQ ID NO: 440903 - RNA, 22 nt, Brucella suis 1330
agauuguaauccauggccacga

SEQ ID NO: 440904 - RNA, 11 nt, Brucella suis 1330
agaucaucgcc

SEQ ID NO: 440905 - RNA, 13 nt, Brucella suis 1330
agauagcccggca

SEQ ID NO: 440906 - RNA, 22 nt, Brucella suis 1330
agauaaucagcagaaggaugau

SEQ ID NO: 440907 - RNA, 13 nt, Brucella suis 1330
agagcgccgaucu

SEQ ID NO: 440908 - RNA, 23 nt, Brucella suis 1330
agacggacuucuucaccagccuu

SEQ ID NO: 440909 - RNA, 21 nt, Brucella suis 1330
agaccagcaggaagaaggcga

SEQ ID NO: 440910 - RNA, 20 nt, Brucella suis 1330
agaauuuggaaguuuuccug

SEQ ID NO: 440911 - RNA, 22 nt, Brucella suis 1330
agaagcuucuauagauggccgc

SEQ ID NO: 440912 - RNA, 22 nt, Brucella suis 1330
agaagcucgacaucaagcgggc

SEQ ID NO: 440913 - RNA, 22 nt, Brucella suis 1330
agaaggcgacgagaccugccau

SEQ ID NO: 440914 - RNA, 22 nt, Brucella suis 1330
agaagacggcggguggcagcga

SEQ ID NO: 440915 - RNA, 23 nt, Brucella suis 1330
acggucacgauugucgagccgca

SEQ ID NO: 440916 - RNA, 17 nt, Brucella suis 1330
acgggcgagcgccagcg

SEQ ID NO: 440917 - RNA, 22 nt, Brucella suis 1330
acgggaauauagccgaugcaga

SEQ ID NO: 440918 - RNA, 19 nt, Brucella suis 1330
acggcgagacagacuggaa

SEQ ID NO: 440919 - RNA, 16 nt, Brucella suis 1330
acggcgaaagcugccg

SEQ ID NO: 440920 - RNA, 17 nt, Brucella suis 1330
acggccaugcgcaugaa

SEQ ID NO: 440921 - RNA, 16 nt, Brucella suis 1330
acggcagguaagagca

SEQ ID NO: 440922 - RNA, 23 nt, Brucella suis 1330
acggcacguucggcaaucguguc

SEQ ID NO: 440923 - RNA, 15 nt, Brucella suis 1330
acggaucaggcgcca

SEQ ID NO: 440924 - RNA, 21 nt, Brucella suis 1330
acgcuugcgcccgcgguuucu

SEQ ID NO: 440925 - RNA, 20 nt, Brucella suis 1330
acgcuuggccucuuccagga

SEQ ID NO: 440926 - RNA, 23 nt, Brucella suis 1330
acgcugcgugggaaaccgcgcgg

SEQ ID NO: 440927 - RNA, 20 nt, Brucella suis 1330
acgcgcguugcggccgggcc

SEQ ID NO: 440928 - RNA, 19 nt, Brucella suis 1330
acgcgcuaaaaagcgcgcg

SEQ ID NO: 440929 - RNA, 13 nt, Brucella suis 1330
acgcgccgauacc

SEQ ID NO: 440930 - RNA, 18 nt, Brucella suis 1330
acgcgcauuuuccgguug

SEQ ID NO: 440931 - RNA, 19 nt, Brucella suis 1330
acgcgcaucuuuuccgaaa

SEQ ID NO: 440932 - RNA, 18 nt, Brucella suis 1330
acgcgcagacgcagcgca

SEQ ID NO: 440933 - RNA, 22 nt, Brucella suis 1330
acgcgcagauauggcgccugcg

SEQ ID NO: 440934 - RNA, 22 nt, Brucella suis 1330
acgcgcagcagcaucgccgcca

SEQ ID NO: 440935 - RNA, 23 nt, Brucella suis 1330
acgccgcaugacgugacggucga

SEQ ID NO: 440936 - RNA, 14 nt, Brucella suis 1330
acgccauugaccgc

SEQ ID NO: 440937 - RNA, 20 nt, Brucella suis 1330
acgcaaucuuugauagacag

SEQ ID NO: 440938 - RNA, 22 nt, Brucella suis 1330
acgauucgcccuuuaucagcga

SEQ ID NO: 440939 - RNA, 20 nt, Brucella suis 1330
accugcggcgccagaugcgc

SEQ ID NO: 440940 - RNA, 21 nt, Brucella suis 1330
accugcggcgccagaugcgca

SEQ ID NO: 440941 - RNA, 14 nt, Brucella suis 1330
accugccaucacca

SEQ ID NO: 440942 - RNA, 24 nt, Brucella suis 1330
accugauccagaagccgcuugcau

SEQ ID NO: 440943 - RNA, 16 nt, Brucella suis 1330
accuccgacaccagcc

SEQ ID NO: 440944 - RNA, 17 nt, Brucella suis 1330
accggauuugccaagcg

SEQ ID NO: 440945 - RNA, 23 nt, Brucella suis 1330
accgcgcaauugcgcaaggcccu

SEQ ID NO: 440946 - RNA, 14 nt, Brucella suis 1330
accgccugcgcgca

SEQ ID NO: 440947 - RNA, 15 nt, Brucella suis 1330
accgccugcgcgcau

SEQ ID NO: 440948 - RNA, 18 nt, Brucella suis 1330
accgccugcgcgcauuuc

SEQ ID NO: 440949 - RNA, 16 nt, Brucella suis 1330
acccggcaccgcaaag

SEQ ID NO: 440950 - RNA, 14 nt, Brucella suis 1330
acccaugcgaugag

SEQ ID NO: 440951 - RNA, 18 nt, Brucella suis 1330
acccagccaagcgccacg

SEQ ID NO: 440952 - RNA, 13 nt, Brucella suis 1330
accaaucggccuu

SEQ ID NO: 440953 - RNA, 16 nt, Brucella suis 1330
accacauugccccacg

SEQ ID NO: 440954 - RNA, 18 nt, Brucella suis 1330
accaaaacauacuccccu

SEQ ID NO: 440955 - RNA, 20 nt, Brucella suis 1330
acauacugccuuacugcccu

SEQ ID NO: 440956 - RNA, 18 nt, Brucella suis 1330
acagucacgccaucagca

SEQ ID NO: 440957 - RNA, 21 nt, Brucella suis 1330
acagcggcgcgccugggcuuu

SEQ ID NO: 440958 - RNA, 22 nt, Brucella suis 1330
acagccaagacuaugcgccacg

SEQ ID NO: 440959 - RNA, 16 nt, Brucella suis 1330
acacggccgaucgcca

SEQ ID NO: 440960 - RNA, 19 nt, Brucella suis 1330
acaccgaccggcacccacu

SEQ ID NO: 440961 - RNA, 11 nt, Brucella suis 1330
acaauggccgu

SEQ ID NO: 440962 - RNA, 16 nt, Brucella suis 1330
acaaucuccggcgcgg

SEQ ID NO: 440963 - RNA, 20 nt, Brucella suis 1330
acaagagggcgcagcagcgc

SEQ ID NO: 440964 - RNA, 22 nt, Brucella suis 1330
acaacgcugcgugggaaaccgc

SEQ ID NO: 440965 - RNA, 20 nt, Brucella suis 1330
acaaagaguuguagcgguuc

SEQ ID NO: 440966 - RNA, 23 nt, Brucella suis 1330
acaaagccgggauuuuagagcgc

SEQ ID NO: 440967 - RNA, 16 nt, Brucella suis 1330
acaaaggauuagagcg

SEQ ID NO: 440968 - RNA, 20 nt, Brucella suis 1330
acaaauaguuagagcggcuc

SEQ ID NO: 440969 - RNA, 15 nt, Brucella suis 1330
aauguuccgcaccgc

SEQ ID NO: 440970 - RNA, 14 nt, Brucella suis 1330
aaugugaaggcgcu

SEQ ID NO: 440971 - RNA, 18 nt, Brucella suis 1330
aaugcggggcuuuucauu

SEQ ID NO: 440972 - RNA, 12 nt, Brucella suis 1330
aaugcgccgcca

SEQ ID NO: 440973 - RNA, 22 nt, Brucella suis 1330
aaugccuugagaugagcgacgu

SEQ ID NO: 440974 - RNA, 14 nt, Brucella suis 1330
aaugaucuggcgcg

SEQ ID NO: 440975 - RNA, 21 nt, Brucella suis 1330
aaucgcgagcagcgcgaugag

SEQ ID NO: 440976 - RNA, 19 nt, Brucella suis 1330
uuuuagagcgcaucccgaa

SEQ ID NO: 440977 - RNA, 13 nt, Brucella suis 1330
aaucguaucgcca

SEQ ID NO: 440978 - RNA, 18 nt, Brucella suis 1330
uuugcggcggaugaaccc

SEQ ID NO: 440979 - RNA, 18 nt, Brucella suis 1330
uuugccgcauuuucgagc

SEQ ID NO: 440980 - RNA, 11 nt, Brucella suis 1330
uuugcgcccag

SEQ ID NO: 440981 - RNA, 19 nt, Brucella suis 1330
uuucgggaugcgcucuaau

SEQ ID NO: 440982 - RNA, 19 nt, Brucella suis 1330
uuucgggaugcgcuuuaaa

SEQ ID NO: 440983 - RNA, 15 nt, Brucella suis 1330
uuucgguuuggcgag

SEQ ID NO: 440984 - RNA, 18 nt, Brucella suis 1330
uuucugguuuccgccauc

SEQ ID NO: 440985 - RNA, 15 nt, Brucella suis 1330
aaucgagaucgcgcg

SEQ ID NO: 440986 - RNA, 18 nt, Brucella suis 1330
aaucgaugucgccgcuca

SEQ ID NO: 440987 - RNA, 15 nt, Brucella suis 1330
aaucgauuucgucca

SEQ ID NO: 440988 - RNA, 18 nt, Brucella suis 1330
uuggcaugugauagucga

SEQ ID NO: 440989 - RNA, 17 nt, Brucella suis 1330
aauccacuacaaccggc

SEQ ID NO: 440990 - RNA, 17 nt, Brucella suis 1330
uugcgccaaucgccgcg

SEQ ID NO: 440991 - RNA, 17 nt, Brucella suis 1330
uugccgggcgggcagca

SEQ ID NO: 440992 - RNA, 19 nt, Brucella suis 1330
uugccgcgcgaagcgcauc

SEQ ID NO: 440993 - RNA, 17 nt, Brucella suis 1330
uugccgccgcgcguauc

SEQ ID NO: 440994 - RNA, 14 nt, Brucella suis 1330
uugccgcauuaucc

SEQ ID NO: 440995 - RNA, 15 nt, Brucella suis 1330
uugccccaaggcgca

SEQ ID NO: 440996 - RNA, 20 nt, Brucella suis 1330
uugccaugaaacccgcgauc

SEQ ID NO: 440997 - RNA, 23 nt, Brucella suis 1330
uugcaucgccaagcuugaucgcc

SEQ ID NO: 440998 - RNA, 12 nt, Brucella suis 1330
uugcaucggcag

SEQ ID NO: 440999 - RNA, 14 nt, Brucella suis 1330
uugcaagcgcgaug

SEQ ID NO: 441000 - RNA, 14 nt, Brucella suis 1330
uugaugcgccaguc

SEQ ID NO: 441001 - RNA, 23 nt, Brucella suis 1330
uugaugcggcggcgcgcaaguuc

SEQ ID NO: 441002 - RNA, 19 nt, Brucella suis 1330
uucuggagccgcucuaggu

SEQ ID NO: 441003 - RNA, 14 nt, Brucella suis 1330
uucugcugcggauc

SEQ ID NO: 441004 - RNA, 20 nt, Brucella suis 1330
uucugcuuaucaaggccggg

SEQ ID NO: 441005 - RNA, 14 nt, Brucella suis 1330
uucugccgcgcauc

SEQ ID NO: 441006 - RNA, 19 nt, Brucella suis 1330
aaucacgccacugcccugg

SEQ ID NO: 441007 - RNA, 15 nt, Brucella suis 1330
aaucagaucggcgcu

SEQ ID NO: 441008 - RNA, 16 nt, Brucella suis 1330
uucgcccgugccgcgu

SEQ ID NO: 441009 - RNA, 19 nt, Brucella suis 1330
uuccgcgcaaaaucugcuc

SEQ ID NO: 441010 - RNA, 20 nt, Brucella suis 1330
uucccacuuaugggagacau

SEQ ID NO: 441011 - RNA, 18 nt, Brucella suis 1330
uuccaugcccggcgcgac

SEQ ID NO: 441012 - RNA, 18 nt, Brucella suis 1330
uuccaguuccauugcaac

SEQ ID NO: 441013 - RNA, 17 nt, Brucella suis 1330
uucauggcuugaagcgu

SEQ ID NO: 441014 - RNA, 17 nt, Brucella suis 1330
uucauauucgaugagcu

SEQ ID NO: 441015 - RNA, 15 nt, Brucella suis 1330
uuauccgaaaaccgu

SEQ ID NO: 441016 - RNA, 21 nt, Brucella suis 1330
uuagcugcuguagcagcaaca

SEQ ID NO: 441017 - RNA, 21 nt, Brucella suis 1330
uguugcagaagguacuggcaa

SEQ ID NO: 441018 - RNA, 18 nt, Brucella suis 1330
uguugaaacaggccuuca

SEQ ID NO: 441019 - RNA, 16 nt, Brucella suis 1330
uguucacauuucauga

SEQ ID NO: 441020 - RNA, 19 nt, Brucella suis 1330
ugucugcgugauauugcag

SEQ ID NO: 441021 - RNA, 21 nt, Brucella suis 1330
ugucugggaggacauucauga

SEQ ID NO: 441022 - RNA, 14 nt, Brucella suis 1330
ugucacgccggcau

SEQ ID NO: 441023 - RNA, 20 nt, Brucella suis 1330
ugggcgagaaugcaccgccg

SEQ ID NO: 441024 - RNA, 21 nt, Brucella suis 1330
ugggcgagaaugcaccgccga

SEQ ID NO: 441025 - RNA, 22 nt, Brucella suis 1330
ugggcccuuaugaucgccgccc

SEQ ID NO: 441026 - RNA, 17 nt, Brucella suis 1330
aauaucugaaucuccgg

SEQ ID NO: 441027 - RNA, 23 nt, Brucella suis 1330
uggcguccccaucgaaaccggca

SEQ ID NO: 441028 - RNA, 22 nt, Brucella suis 1330
uggcgucaccugcaacgcgcca

SEQ ID NO: 441029 - RNA, 13 nt, Brucella suis 1330
uggcgcacgucga

SEQ ID NO: 441030 - RNA, 22 nt, Brucella suis 1330
uggcgauaauaauuggcaagcg

SEQ ID NO: 441031 - RNA, 17 nt, Brucella suis 1330
uggccgaagccgcuugc

SEQ ID NO: 441032 - RNA, 22 nt, Brucella suis 1330
uggccagccgcaaugagcccgc

SEQ ID NO: 441033 - RNA, 22 nt, Brucella suis 1330
uggacaugaacacggcgcgguc

SEQ ID NO: 441034 - RNA, 20 nt, Brucella suis 1330
uggaaauuauagccgccaag

SEQ ID NO: 441035 - RNA, 13 nt, Brucella suis 1330
uggaacaagaagc

SEQ ID NO: 441036 - RNA, 20 nt, Brucella suis 1330
uggaaaaaauccgcaauggc

SEQ ID NO: 441037 - RNA, 15 nt, Brucella suis 1330
uggaaaacgccgccu

SEQ ID NO: 441038 - RNA, 15 nt, Brucella suis 1330
ugcuugccgccgauc

SEQ ID NO: 441039 - RNA, 18 nt, Brucella suis 1330
ugcuugagggguucggcg

SEQ ID NO: 441040 - RNA, 20 nt, Brucella suis 1330
ugcgggccaugguuucggcg

SEQ ID NO: 441041 - RNA, 12 nt, Brucella suis 1330
ugcgggcaagca

SEQ ID NO: 441042 - RNA, 17 nt, Brucella suis 1330
ugcggcggcgucagcuu

SEQ ID NO: 441043 - RNA, 17 nt, Brucella suis 1330
ugcgcuugccgccggau

SEQ ID NO: 441044 - RNA, 14 nt, Brucella suis 1330
ugcgcuucgcgcag

SEQ ID NO: 441045 - RNA, 15 nt, Brucella suis 1330
ugcgcccgcgccgcu

SEQ ID NO: 441046 - RNA, 18 nt, Brucella suis 1330
ugcgcccuccaccgcuca

SEQ ID NO: 441047 - RNA, 13 nt, Brucella suis 1330
ugcgcacgaccag

SEQ ID NO: 441048 - RNA, 14 nt, Brucella suis 1330
ugcgaugauauucg

SEQ ID NO: 441049 - RNA, 15 nt, Brucella suis 1330
ugcgaaaugcgcgcg

SEQ ID NO: 441050 - RNA, 20 nt, Brucella suis 1330
ugcgaaagcaccgaucacgc

SEQ ID NO: 441051 - RNA, 18 nt, Brucella suis 1330
ugcgaagcgguguucggg

SEQ ID NO: 441052 - RNA, 20 nt, Brucella suis 1330
ugccuuccccauacguccag

SEQ ID NO: 441053 - RNA, 17 nt, Brucella suis 1330
aauagcuuaugcgcgcc

SEQ ID NO: 441054 - RNA, 19 nt, Brucella suis 1330
aauagccggucgagccgac

SEQ ID NO: 441055 - RNA, 15 nt, Brucella suis 1330
ugccggugccggcag

SEQ ID NO: 441056 - RNA, 17 nt, Brucella suis 1330
ugccggucgcaggcgcu

SEQ ID NO: 441057 - RNA, 19 nt, Brucella suis 1330
ugccggaugcgguugcgac

SEQ ID NO: 441058 - RNA, 15 nt, Brucella suis 1330
ugccgcuuccagcau

SEQ ID NO: 441059 - RNA, 21 nt, Brucella suis 1330
ugccgcguucagccaccgacu

SEQ ID NO: 441060 - RNA, 19 nt, Brucella suis 1330
ugcccuggaugcggaacac

SEQ ID NO: 441061 - RNA, 21 nt, Brucella suis 1330
ugcccggaucaauuccugugc

SEQ ID NO: 441062 - RNA, 15 nt, Brucella suis 1330
ugccacgcgccgcca

SEQ ID NO: 441063 - RNA, 13 nt, Brucella suis 1330
ugcagccugaaca

SEQ ID NO: 441064 - RNA, 19 nt, Brucella suis 1330
ugcagcccaaccgagcaga

SEQ ID NO: 441065 - RNA, 22 nt, Brucella suis 1330
ugcacgucaccauauucgucca

SEQ ID NO: 441066 - RNA, 23 nt, Brucella suis 1330
ugcacgucaccauauucguccac

SEQ ID NO: 441067 - RNA, 19 nt, Brucella suis 1330
ugcacgcacaucggaaagc

SEQ ID NO: 441068 - RNA, 15 nt, Brucella suis 1330
ugauggcggagcgga

SEQ ID NO: 441069 - RNA, 13 nt, Brucella suis 1330
ugaucuggaagga

SEQ ID NO: 441070 - RNA, 16 nt, Brucella suis 1330
ugaucucggagcggcc

SEQ ID NO: 441071 - RNA, 19 nt, Brucella suis 1330
ugaucgugccggaauggcc

SEQ ID NO: 441072 - RNA, 17 nt, Brucella suis 1330
ugaucgauucggcuuca

SEQ ID NO: 441073 - RNA, 23 nt, Brucella suis 1330
ugauauugcccauaccgaucuga

SEQ ID NO: 441074 - RNA, 20 nt, Brucella suis 1330
ugacucugaccuuccugacc

SEQ ID NO: 441075 - RNA, 20 nt, Brucella suis 1330
ugacggucguuucgccgccc

SEQ ID NO: 441076 - RNA, 12 nt, Brucella suis 1330
ugacgagcgcac

SEQ ID NO: 441077 - RNA, 20 nt, Brucella suis 1330
ugaccuuccugacccauggc

SEQ ID NO: 441078 - RNA, 17 nt, Brucella suis 1330
ugaaaucagaucggcga

SEQ ID NO: 441079 - RNA, 19 nt, Brucella suis 1330
ugaaaucgcugaucggcgc

SEQ ID NO: 441080 - RNA, 18 nt, Brucella suis 1330
ugaaagcguagagugcuu

SEQ ID NO: 441081 - RNA, 16 nt, Brucella suis 1330
ucuugggauucucgaa

SEQ ID NO: 441082 - RNA, 14 nt, Brucella suis 1330
ucuugccgccgcuu

SEQ ID NO: 441083 - RNA, 15 nt, Brucella suis 1330
ucuuccagaaugcgc

SEQ ID NO: 441084 - RNA, 16 nt, Brucella suis 1330
ucugcuggagcuucgg

SEQ ID NO: 441085 - RNA, 22 nt, Brucella suis 1330
ucugcacgucaucaucgucuuc

SEQ ID NO: 441086 - RNA, 14 nt, Brucella suis 1330
ucugcaucccgaaa

SEQ ID NO: 441087 - RNA, 13 nt, Brucella suis 1330
ucugauucaauca

SEQ ID NO: 441088 - RNA, 13 nt, Brucella suis 1330
ucucuugccgccg

SEQ ID NO: 441089 - RNA, 15 nt, Brucella suis 1330
ucucuauccgcugau

SEQ ID NO: 441090 - RNA, 16 nt, Brucella suis 1330
ucuccggcaaaacggc

SEQ ID NO: 441091 - RNA, 15 nt, Brucella suis 1330
ucguguccggcguca

SEQ ID NO: 441092 - RNA, 16 nt, Brucella suis 1330
ucgugaagccgcuuca

SEQ ID NO: 441093 - RNA, 12 nt, Brucella suis 1330
ucgucggcuucg

SEQ ID NO: 441094 - RNA, 22 nt, Brucella suis 1330
ucguccagcccugccggcucau

SEQ ID NO: 441095 - RNA, 21 nt, Brucella suis 1330
ucgggucgaucaucagcggcg

SEQ ID NO: 441096 - RNA, 19 nt, Brucella suis 1330
ucgggcuugauagcgccgg

SEQ ID NO: 441097 - RNA, 14 nt, Brucella suis 1330
ucgggcagcuuguc

SEQ ID NO: 441098 - RNA, 22 nt, Brucella suis 1330
ucggcuuuacguccggcacgau

SEQ ID NO: 441099 - RNA, 17 nt, Brucella suis 1330
ucggccuggucuagccg

SEQ ID NO: 441100 - RNA, 23 nt, Brucella suis 1330
ucggccugugcgacgaggccuga

SEQ ID NO: 441101 - RNA, 11 nt, Brucella suis 1330
ucggccaguuu

SEQ ID NO: 441102 - RNA, 21 nt, Brucella suis 1330
ucggccagagcuucgccgcca

SEQ ID NO: 441103 - RNA, 13 nt, Brucella suis 1330
ucggcaacgccga

SEQ ID NO: 441104 - RNA, 16 nt, Brucella suis 1330
ucggcaagggcaagca

SEQ ID NO: 441105 - RNA, 16 nt, Brucella suis 1330
ucggcaaggccgcgcu

SEQ ID NO: 441106 - RNA, 22 nt, Brucella suis 1330
ucgcguauccaggugcagucuu

SEQ ID NO: 441107 - RNA, 20 nt, Brucella suis 1330
ucgcgcggcuuaucgcucuu

SEQ ID NO: 441108 - RNA, 22 nt, Brucella suis 1330
ucgcgauccugcugcgcggcau

SEQ ID NO: 441109 - RNA, 18 nt, Brucella suis 1330
ucgcgaccgggcuucuug

SEQ ID NO: 441110 - RNA, 18 nt, Brucella suis 1330
ucgccggaaccgcucuaa

SEQ ID NO: 441111 - RNA, 16 nt, Brucella suis 1330
ucgccgcccgguuccg

SEQ ID NO: 441112 - RNA, 15 nt, Brucella suis 1330
ucgccagcaccucga

SEQ ID NO: 441113 - RNA, 16 nt, Brucella suis 1330
ucgccaagccggcgca

SEQ ID NO: 441114 - RNA, 18 nt, Brucella suis 1330
ucgcaguugcaccgcccg

SEQ ID NO: 441115 - RNA, 16 nt, Brucella suis 1330
ucgcagguuccgccgc

SEQ ID NO: 441116 - RNA, 17 nt, Brucella suis 1330
ucgaugaccaccgcgaa

SEQ ID NO: 441117 - RNA, 22 nt, Brucella suis 1330
ucgaugaacaggagcggaagca

SEQ ID NO: 441118 - RNA, 22 nt, Brucella suis 1330
ucgaucccuucgacguggagca

SEQ ID NO: 441119 - RNA, 16 nt, Brucella suis 1330
ucgagccgacaucgcg

SEQ ID NO: 441120 - RNA, 19 nt, Brucella suis 1330
ucgagccgacaucgcgcuu

SEQ ID NO: 441121 - RNA, 19 nt, Brucella suis 1330
ucgagcauuucaugcacgg

SEQ ID NO: 441122 - RNA, 14 nt, Brucella suis 1330
ucgagaucgaccgc

SEQ ID NO: 441123 - RNA, 17 nt, Brucella suis 1330
ucgagcaaugcgccgug

SEQ ID NO: 441124 - RNA, 18 nt, Brucella suis 1330
ucgagaauggcaacacgg

SEQ ID NO: 441125 - RNA, 20 nt, Brucella suis 1330
ucgacguccucguucuugcc

SEQ ID NO: 441126 - RNA, 21 nt, Brucella suis 1330
ucgacgcuuuccaccggcuca

SEQ ID NO: 441127 - RNA, 23 nt, Brucella suis 1330
ucgaaggacaagacuuccucgcc

SEQ ID NO: 441128 - RNA, 23 nt, Brucella suis 1330
uccuggugcgcagcucggcuuca

SEQ ID NO: 441129 - RNA, 15 nt, Brucella suis 1330
uccuuuccaguucca

SEQ ID NO: 441130 - RNA, 19 nt, Brucella suis 1330
uccugcuucaucgcggcag

SEQ ID NO: 441131 - RNA, 15 nt, Brucella suis 1330
uccugcugcgcggca

SEQ ID NO: 441132 - RNA, 13 nt, Brucella suis 1330
uccugcggcuucu

SEQ ID NO: 441133 - RNA, 14 nt, Brucella suis 1330
uccugccagcggca

SEQ ID NO: 441134 - RNA, 16 nt, Brucella suis 1330
uccugcaccggcuucc

SEQ ID NO: 441135 - RNA, 21 nt, Brucella suis 1330
uccgggucuucgcccggcaug

SEQ ID NO: 441136 - RNA, 21 nt, Brucella suis 1330
uccggguucaauacccaugcc

SEQ ID NO: 441137 - RNA, 17 nt, Brucella suis 1330
uccggcguggccaagau

SEQ ID NO: 441138 - RNA, 23 nt, Brucella suis 1330
uccggccccuuucgcaucagacg

SEQ ID NO: 441139 - RNA, 22 nt, Brucella suis 1330
uccgcggcgguuuugagcugcu

SEQ ID NO: 441140 - RNA, 17 nt, Brucella suis 1330
uccgccgaucugcacgg

SEQ ID NO: 441141 - RNA, 20 nt, Brucella suis 1330
uccagguauagauaucgagc

SEQ ID NO: 441142 - RNA, 15 nt, Brucella suis 1330
uccagcuucggaaga

SEQ ID NO: 441143 - RNA, 17 nt, Brucella suis 1330
uccagcuugcagugcag

SEQ ID NO: 441144 - RNA, 20 nt, Brucella suis 1330
ucauccgccuuggaugccgc

SEQ ID NO: 441145 - RNA, 17 nt, Brucella suis 1330
ucauaucguugccgauc

SEQ ID NO: 441146 - RNA, 22 nt, Brucella suis 1330
ucagguuucgacaagcuucagg

SEQ ID NO: 441147 - RNA, 16 nt, Brucella suis 1330
ucagguuacauggacg

SEQ ID NO: 441148 - RNA, 16 nt, Brucella suis 1330
ucagguggaucggcgu

SEQ ID NO: 441149 - RNA, 12 nt, Brucella suis 1330
ucaggucgcuuu

SEQ ID NO: 441150 - RNA, 16 nt, Brucella suis 1330
ucaggucgcuuucgau

SEQ ID NO: 441151 - RNA, 21 nt, Brucella suis 1330
ucagggcaaucugcgcugccc

SEQ ID NO: 441152 - RNA, 17 nt, Brucella suis 1330
ucaggcgaucaacgcuu

SEQ ID NO: 441153 - RNA, 18 nt, Brucella suis 1330
ucaggcccuugucgcgca

SEQ ID NO: 441154 - RNA, 22 nt, Brucella suis 1330
ucagcggcggguagccgccauu

SEQ ID NO: 441155 - RNA, 16 nt, Brucella suis 1330
ucagcgcaaagccugc

SEQ ID NO: 441156 - RNA, 15 nt, Brucella suis 1330
ucagcaggcguugca

SEQ ID NO: 441157 - RNA, 22 nt, Brucella suis 1330
ucagcaaguuuaucggccugau

SEQ ID NO: 441158 - RNA, 22 nt, Brucella suis 1330
ucacgcgcagcagcaucgccgc

SEQ ID NO: 441159 - RNA, 18 nt, Brucella suis 1330
uauuuccaucgcuugaac

SEQ ID NO: 441160 - RNA, 22 nt, Brucella suis 1330
ucaaaacuuucccggcgcacgg

SEQ ID NO: 441161 - RNA, 15 nt, Brucella suis 1330
uauucggccuugacg

SEQ ID NO: 441162 - RNA, 18 nt, Brucella suis 1330
uauuccacauugccuucg

SEQ ID NO: 441163 - RNA, 22 nt, Brucella suis 1330
uauggcacaagaacagccgccc

SEQ ID NO: 441164 - RNA, 15 nt, Brucella suis 1330
uauggaugccgccgc

SEQ ID NO: 441165 - RNA, 15 nt, Brucella suis 1330
uaucgcggaucggca

SEQ ID NO: 441166 - RNA, 15 nt, Brucella suis 1330
uaucgauaucugcaa

SEQ ID NO: 441167 - RNA, 17 nt, Brucella suis 1330
uaucaagccgguuugcu

SEQ ID NO: 441168 - RNA, 21 nt, Brucella suis 1330
uaguucaggccggccuugauc

SEQ ID NO: 441169 - RNA, 20 nt, Brucella suis 1330
uaggaaagaguucgcccguc

SEQ ID NO: 441170 - RNA, 18 nt, Brucella suis 1330
uagagcauuuccagcaaa

SEQ ID NO: 441171 - RNA, 14 nt, Brucella suis 1330
uagagcgcguuucg

SEQ ID NO: 441172 - RNA, 22 nt, Brucella suis 1330
uagagcgcguuucgaucugauu

SEQ ID NO: 441173 - RNA, 13 nt, Brucella suis 1330
uagagaccuugau

SEQ ID NO: 441174 - RNA, 13 nt, Brucella suis 1330
uacuggccaagcg

SEQ ID NO: 441175 - RNA, 21 nt, Brucella suis 1330
uaccgacggucggaauaucga

SEQ ID NO: 441176 - RNA, 22 nt, Brucella suis 1330
uaaucgccgggccuugccaaaa

SEQ ID NO: 441177 - RNA, 17 nt, Brucella suis 1330
uaauccucacggccaua

SEQ ID NO: 441178 - RNA, 13 nt, Brucella suis 1330
uaacgacgaacga

SEQ ID NO: 441179 - RNA, 20 nt, Brucella suis 1330
guuuccagccugcugcaucc

SEQ ID NO: 441180 - RNA, 20 nt, Brucella suis 1330
guuucauuuccucaaaacuu

SEQ ID NO: 441181 - RNA, 13 nt, Brucella suis 1330
uaaagaccacgaa

SEQ ID NO: 441182 - RNA, 21 nt, Brucella suis 1330
uaaaugcacccggcaccgcaa

SEQ ID NO: 441183 - RNA, 16 nt, Brucella suis 1330
guugagaucgcgcgca

SEQ ID NO: 441184 - RNA, 18 nt, Brucella suis 1330
guucucgacaaugccgag

SEQ ID NO: 441185 - RNA, 17 nt, Brucella suis 1330
guucguggcggggcagg

SEQ ID NO: 441186 - RNA, 17 nt, Brucella suis 1330
guucggcgagcgucuug

SEQ ID NO: 441187 - RNA, 22 nt, Brucella suis 1330
guucgcucguaacgggagcagc

SEQ ID NO: 441188 - RNA, 15 nt, Brucella suis 1330
guucgcaauuccggc

SEQ ID NO: 441189 - RNA, 16 nt, Brucella suis 1330
aagugugcgcgcgcca

SEQ ID NO: 441190 - RNA, 13 nt, Brucella suis 1330
gugcgccaccgcg

SEQ ID NO: 441191 - RNA, 17 nt, Brucella suis 1330
aaguggcgcgugccguu

SEQ ID NO: 441192 - RNA, 19 nt, Brucella suis 1330
aagugggaaccgguuuucg

SEQ ID NO: 441193 - RNA, 19 nt, Brucella suis 1330
aagugcgcagcaucugcgc

SEQ ID NO: 441194 - RNA, 23 nt, Brucella suis 1330
gugccggacgggaauauagccga

SEQ ID NO: 441195 - RNA, 14 nt, Brucella suis 1330
gugccagauggcgu

SEQ ID NO: 441196 - RNA, 18 nt, Brucella suis 1330
gugcauaggauucgcggc

SEQ ID NO: 441197 - RNA, 18 nt, Brucella suis 1330
gugauuugauccaugcgc

SEQ ID NO: 441198 - RNA, 18 nt, Brucella suis 1330
gugcaaagcggcuuucca

SEQ ID NO: 441199 - RNA, 13 nt, Brucella suis 1330
gucggcgcugcuc

SEQ ID NO: 441200 - RNA, 21 nt, Brucella suis 1330
gucggccagagcuucgccgcc

SEQ ID NO: 441201 - RNA, 16 nt, Brucella suis 1330
gucggagguucgaauc

SEQ ID NO: 441202 - RNA, 16 nt, Brucella suis 1330
gucgcguauccaggug

SEQ ID NO: 441203 - RNA, 15 nt, Brucella suis 1330
gucgcuaccaugcgg

SEQ ID NO: 441204 - RNA, 19 nt, Brucella suis 1330
gucgcgaccuucuugccau

SEQ ID NO: 441205 - RNA, 13 nt, Brucella suis 1330
gucgccagcgccg

SEQ ID NO: 441206 - RNA, 20 nt, Brucella suis 1330
gucgcaggcggaugaagcgc

SEQ ID NO: 441207 - RNA, 14 nt, Brucella suis 1330
gucgaucaugcgga

SEQ ID NO: 441208 - RNA, 20 nt, Brucella suis 1330
gucgaggaaaaagcccgcca

SEQ ID NO: 441209 - RNA, 14 nt, Brucella suis 1330
gucgaaggaucgaa

SEQ ID NO: 441210 - RNA, 20 nt, Brucella suis 1330
gucgaaggaucgaagggcug

SEQ ID NO: 441211 - RNA, 19 nt, Brucella suis 1330
guccgguccccgccgccga

SEQ ID NO: 441212 - RNA, 20 nt, Brucella suis 1330
gucaucgccaccauggccgc

SEQ ID NO: 441213 - RNA, 17 nt, Brucella suis 1330
gucagcgcaaagccugc

SEQ ID NO: 441214 - RNA, 21 nt, Brucella suis 1330
gucagcgaaaccaucgcacca

SEQ ID NO: 441215 - RNA, 24 nt, Brucella suis 1330
gucagcaggcgccgugcccgacug

SEQ ID NO: 441216 - RNA, 16 nt, Brucella suis 1330
gucagcagguugacga

SEQ ID NO: 441217 - RNA, 14 nt, Brucella suis 1330
gucacugagaacuu

SEQ ID NO: 441218 - RNA, 22 nt, Brucella suis 1330
gucagaaagucugcuuccgcau

SEQ ID NO: 441219 - RNA, 17 nt, Brucella suis 1330
gucacgguugccuugcu

SEQ ID NO: 441220 - RNA, 20 nt, Brucella suis 1330
gucacgccaucagcauugaa

SEQ ID NO: 441221 - RNA, 18 nt, Brucella suis 1330
gucaccugcaacgcgcca

SEQ ID NO: 441222 - RNA, 15 nt, Brucella suis 1330
gucaaugccaccgcg

SEQ ID NO: 441223 - RNA, 14 nt, Brucella suis 1330
gucaaugccauccg

SEQ ID NO: 441224 - RNA, 21 nt, Brucella suis 1330
guauucuuccagaaugcgccg

SEQ ID NO: 441225 - RNA, 20 nt, Brucella suis 1330
guauuagacgaauaaaacgc

SEQ ID NO: 441226 - RNA, 19 nt, Brucella suis 1330
guauuuguuuugccgcauu

SEQ ID NO: 441227 - RNA, 19 nt, Brucella suis 1330
guaucggcgauauggcgca

SEQ ID NO: 441228 - RNA, 18 nt, Brucella suis 1330
guaucggcaguuucaucu

SEQ ID NO: 441229 - RNA, 19 nt, Brucella suis 1330
guauauucggcgaccgccu

SEQ ID NO: 441230 - RNA, 15 nt, Brucella suis 1330
guagcgcauggcagc

SEQ ID NO: 441231 - RNA, 22 nt, Brucella suis 1330
guacugcaauccggcgugaucg

SEQ ID NO: 441232 - RNA, 13 nt, Brucella suis 1330
guaaucgccggug

SEQ ID NO: 441233 - RNA, 21 nt, Brucella suis 1330
guaauaacgacgcccgccccc

SEQ ID NO: 441234 - RNA, 21 nt, Brucella suis 1330
guaaauccuccagauugaucc

SEQ ID NO: 441235 - RNA, 15 nt, Brucella suis 1330
gguuuuucgguuuuc

SEQ ID NO: 441236 - RNA, 15 nt, Brucella suis 1330
ggugcgagcaggcuu

SEQ ID NO: 441237 - RNA, 22 nt, Brucella suis 1330
ggugcgagcaggcuuucggccu

SEQ ID NO: 441238 - RNA, 18 nt, Brucella suis 1330
ggugauguuugcgaaccg

SEQ ID NO: 441239 - RNA, 18 nt, Brucella suis 1330
ggugaaggauaucgaaaa

SEQ ID NO: 441240 - RNA, 16 nt, Brucella suis 1330
ggucggcuugccgacc

SEQ ID NO: 441241 - RNA, 20 nt, Brucella suis 1330
ggucgagcgccuguccgccu

SEQ ID NO: 441242 - RNA, 20 nt, Brucella suis 1330
gguccaccacaugcuccagg

SEQ ID NO: 441243 - RNA, 21 nt, Brucella suis 1330
ggucagaucaucugccaacca

SEQ ID NO: 441244 - RNA, 12 nt, Brucella suis 1330
gguauccagcag

SEQ ID NO: 441245 - RNA, 23 nt, Brucella suis 1330
gguaagcccugucagcgccgccc

SEQ ID NO: 441246 - RNA, 24 nt, Brucella suis 1330
gguaacgaugauauaggcgcaauc

SEQ ID NO: 441247 - RNA, 22 nt, Brucella suis 1330
gguaagcgaccaccaccgggca

SEQ ID NO: 441248 - RNA, 13 nt, Brucella suis 1330
ggggacgcagccu

SEQ ID NO: 441249 - RNA, 18 nt, Brucella suis 1330
gggcuucugcgcccgcgc

SEQ ID NO: 441250 - RNA, 19 nt, Brucella suis 1330
gggcgucgcgcaucauugg

SEQ ID NO: 441251 - RNA, 15 nt, Brucella suis 1330
gggcggcgcggcggc

SEQ ID NO: 441252 - RNA, 13 nt, Brucella suis 1330
gggcggccacggc

SEQ ID NO: 441253 - RNA, 19 nt, Brucella suis 1330
gggccuuguuuucugccgg

SEQ ID NO: 441254 - RNA, 21 nt, Brucella suis 1330
gggcauguugcccaucgcgcu

SEQ ID NO: 441255 - RNA, 22 nt, Brucella suis 1330
gggcaugacauccaugaaagcc

SEQ ID NO: 441256 - RNA, 14 nt, Brucella suis 1330
gggcagugaaagcc

SEQ ID NO: 441257 - RNA, 12 nt, Brucella suis 1330
gggcaagggccu

SEQ ID NO: 441258 - RNA, 20 nt, Brucella suis 1330
gggaggcaaauguuggaauc

SEQ ID NO: 441259 - RNA, 22 nt, Brucella suis 1330
ggcgucacauaaagcguggcga

SEQ ID NO: 441260 - RNA, 19 nt, Brucella suis 1330
ggcgguuugcgaccaugag

SEQ ID NO: 441261 - RNA, 21 nt, Brucella suis 1330
ggcggugguuucccuugaaga

SEQ ID NO: 441262 - RNA, 18 nt, Brucella suis 1330
ggcggucacgcuccgcca

SEQ ID NO: 441263 - RNA, 20 nt, Brucella suis 1330
ggcgguaaugcuggccacca

SEQ ID NO: 441264 - RNA, 13 nt, Brucella suis 1330
ggcggggagcagg

SEQ ID NO: 441265 - RNA, 18 nt, Brucella suis 1330
ggcgggcggggaauaucg

SEQ ID NO: 441266 - RNA, 22 nt, Brucella suis 1330
ggcgggagcggcacaugaaaua

SEQ ID NO: 441267 - RNA, 14 nt, Brucella suis 1330
ggcggcgcucgacc

SEQ ID NO: 441268 - RNA, 17 nt, Brucella suis 1330
ggcggauaaugcucgcc

SEQ ID NO: 441269 - RNA, 22 nt, Brucella suis 1330
ggcggaagcgggaauagccgag

SEQ ID NO: 441270 - RNA, 17 nt, Brucella suis 1330
ggcgcgugccguuucca

SEQ ID NO: 441271 - RNA, 23 nt, Brucella suis 1330
ggcgcggcaggaucgccagaagc

SEQ ID NO: 441272 - RNA, 19 nt, Brucella suis 1330
ggcgccaccgucaccggcu

SEQ ID NO: 441273 - RNA, 13 nt, Brucella suis 1330
ggcgagcgccagc

SEQ ID NO: 441274 - RNA, 16 nt, Brucella suis 1330
ggcgaggaaaaucgac

SEQ ID NO: 441275 - RNA, 21 nt, Brucella suis 1330
ggcgagaauugcaucgcgguu

SEQ ID NO: 441276 - RNA, 14 nt, Brucella suis 1330
ggcgaccgccuuuu

SEQ ID NO: 441277 - RNA, 20 nt, Brucella suis 1330
ggcgacacggccgaucgcca

SEQ ID NO: 441278 - RNA, 16 nt, Brucella suis 1330
ggcgaaaagccgccuc

SEQ ID NO: 441279 - RNA, 22 nt, Brucella suis 1330
ggccuuugucauaucagacggu

SEQ ID NO: 441280 - RNA, 17 nt, Brucella suis 1330
ggccuugcggcggcguu

SEQ ID NO: 441281 - RNA, 15 nt, Brucella suis 1330
aaggcgacgagaccu

SEQ ID NO: 441282 - RNA, 12 nt, Brucella suis 1330
aaggcgaucagg

SEQ ID NO: 441283 - RNA, 23 nt, Brucella suis 1330
ggccgguaaaauuggcagcgccg

SEQ ID NO: 441284 - RNA, 17 nt, Brucella suis 1330
ggccauuucggcuucca

SEQ ID NO: 441285 - RNA, 21 nt, Brucella suis 1330
ggccauuucggcuuccagcag

SEQ ID NO: 441286 - RNA, 17 nt, Brucella suis 1330
ggccaguggccgaagcc

SEQ ID NO: 441287 - RNA, 13 nt, Brucella suis 1330
ggccaggaaaacg

SEQ ID NO: 441288 - RNA, 16 nt, Brucella suis 1330
ggccacuccguugccg

SEQ ID NO: 441289 - RNA, 14 nt, Brucella suis 1330
ggcauggauuucca

SEQ ID NO: 441290 - RNA, 12 nt, Brucella suis 1330
ggcauggaagcc

SEQ ID NO: 441291 - RNA, 20 nt, Brucella suis 1330
ggcaucgcucaccuuuucca

SEQ ID NO: 441292 - RNA, 13 nt, Brucella suis 1330
ggcauccuugccg

SEQ ID NO: 441293 - RNA, 16 nt, Brucella suis 1330
ggcauccuugccgguu

SEQ ID NO: 441294 - RNA, 18 nt, Brucella suis 1330
ggcauccuugucggcauc

SEQ ID NO: 441295 - RNA, 14 nt, Brucella suis 1330
ggcagugcgagcgu

SEQ ID NO: 441296 - RNA, 15 nt, Brucella suis 1330
ggcagcggcgugccg

SEQ ID NO: 441297 - RNA, 16 nt, Brucella suis 1330
ggcaccggccuugaug

SEQ ID NO: 441298 - RNA, 14 nt, Brucella suis 1330
ggcaauccuuucca

SEQ ID NO: 441299 - RNA, 16 nt, Brucella suis 1330
ggcaauccccggacca

SEQ ID NO: 441300 - RNA, 16 nt, Brucella suis 1330
ggcaaucagcacggca

SEQ ID NO: 441301 - RNA, 16 nt, Brucella suis 1330
ggcaaggccacgcacg

SEQ ID NO: 441302 - RNA, 15 nt, Brucella suis 1330
ggcaagggcaagcag

SEQ ID NO: 441303 - RNA, 19 nt, Brucella suis 1330
ggcaaggccgcgcuccaga

SEQ ID NO: 441304 - RNA, 18 nt, Brucella suis 1330
ggcaaggagcgagcuugc

SEQ ID NO: 441305 - RNA, 14 nt, Brucella suis 1330
ggcaagcuggaagg

SEQ ID NO: 441306 - RNA, 15 nt, Brucella suis 1330
ggaucgaccgaacgg

SEQ ID NO: 441307 - RNA, 15 nt, Brucella suis 1330
ggaucagucgacaau

SEQ ID NO: 441308 - RNA, 17 nt, Brucella suis 1330
ggauagcguaaaacgca

SEQ ID NO: 441309 - RNA, 19 nt, Brucella suis 1330
ggauagcguaaaacgcacc

SEQ ID NO: 441310 - RNA, 17 nt, Brucella suis 1330
ggauacgucacccgccu

SEQ ID NO: 441311 - RNA, 15 nt, Brucella suis 1330
ggauaaugcgacaaa

SEQ ID NO: 441312 - RNA, 19 nt, Brucella suis 1330
ggaggcauccuugucggca

SEQ ID NO: 441313 - RNA, 20 nt, Brucella suis 1330
aaggcccccagaaggcgcgg

SEQ ID NO: 441314 - RNA, 19 nt, Brucella suis 1330
ggagcgcacaccgaacugg

SEQ ID NO: 441315 - RNA, 13 nt, Brucella suis 1330
ggagccggaaaau

SEQ ID NO: 441316 - RNA, 15 nt, Brucella suis 1330
ggagauacgcuucau

SEQ ID NO: 441317 - RNA, 18 nt, Brucella suis 1330
ggagaaaagaugggcgca

SEQ ID NO: 441318 - RNA, 16 nt, Brucella suis 1330
ggacauaaaccgauga

SEQ ID NO: 441319 - RNA, 19 nt, Brucella suis 1330
ggaaugcgcuugcccgcau

SEQ ID NO: 441320 - RNA, 19 nt, Brucella suis 1330
ggaacauauaaagcaaagg

SEQ ID NO: 441321 - RNA, 13 nt, Brucella suis 1330
gcuggcgccgccg

SEQ ID NO: 441322 - RNA, 19 nt, Brucella suis 1330
gcuggccaugaugccgguc

SEQ ID NO: 441323 - RNA, 23 nt, Brucella suis 1330
gcuggcaucgccaauuccgccgg

SEQ ID NO: 441324 - RNA, 17 nt, Brucella suis 1330
gcuggauuaugcucuua

SEQ ID NO: 441325 - RNA, 15 nt, Brucella suis 1330
gcuggaaaugcucua

SEQ ID NO: 441326 - RNA, 13 nt, Brucella suis 1330
gcugcuuuaccac

SEQ ID NO: 441327 - RNA, 20 nt, Brucella suis 1330
gcugcuguagcagcaacagg

SEQ ID NO: 441328 - RNA, 14 nt, Brucella suis 1330
gcugcuggccgucg

SEQ ID NO: 441329 - RNA, 21 nt, Brucella suis 1330
gcugcugauagcagccgcuuc

SEQ ID NO: 441330 - RNA, 17 nt, Brucella suis 1330
gcugcggaucuucgauc

SEQ ID NO: 441331 - RNA, 20 nt, Brucella suis 1330
gcugauucuggauuucaucc

SEQ ID NO: 441332 - RNA, 23 nt, Brucella suis 1330
gcugcaaagggugcaagcgcaaa

SEQ ID NO: 441333 - RNA, 18 nt, Brucella suis 1330
gcugcaacaaaaugccca

SEQ ID NO: 441334 - RNA, 21 nt, Brucella suis 1330
gcucuuccggccguuauuccc

SEQ ID NO: 441335 - RNA, 17 nt, Brucella suis 1330
gcucuuaaaaugccgcc

SEQ ID NO: 441336 - RNA, 17 nt, Brucella suis 1330
gcucguccggccagccg

SEQ ID NO: 441337 - RNA, 16 nt, Brucella suis 1330
gcucggugccgcgcgg

SEQ ID NO: 441338 - RNA, 15 nt, Brucella suis 1330
gcuccugcaugugcg

SEQ ID NO: 441339 - RNA, 17 nt, Brucella suis 1330
gcuccuauuucugauga

SEQ ID NO: 441340 - RNA, 16 nt, Brucella suis 1330
gcuccgcccuggcggc

SEQ ID NO: 441341 - RNA, 23 nt, Brucella suis 1330
gcuccgaugcguuggaaaaugcg

SEQ ID NO: 441342 - RNA, 21 nt, Brucella suis 1330
gcucaccuuuuccaccggccc

SEQ ID NO: 441343 - RNA, 18 nt, Brucella suis 1330
gcucaccaccuucgccgu

SEQ ID NO: 441344 - RNA, 13 nt, Brucella suis 1330
gcucaaucgccgc

SEQ ID NO: 441345 - RNA, 15 nt, Brucella suis 1330
gcucaaugccgcauu

SEQ ID NO: 441346 - RNA, 19 nt, Brucella suis 1330
gcuaugcgcaauugcgcgc

SEQ ID NO: 441347 - RNA, 18 nt, Brucella suis 1330
gcuaugcgguuucagcgc

SEQ ID NO: 441348 - RNA, 19 nt, Brucella suis 1330
gcuaugcgguuucagcgcc

SEQ ID NO: 441349 - RNA, 18 nt, Brucella suis 1330
gcuaucacccgauaaacc

SEQ ID NO: 441350 - RNA, 19 nt, Brucella suis 1330
gcuauagccugcgccaguu

SEQ ID NO: 441351 - RNA, 15 nt, Brucella suis 1330
gcuauaagcggcucu

SEQ ID NO: 441352 - RNA, 13 nt, Brucella suis 1330
gcguugcuggaac

SEQ ID NO: 441353 - RNA, 17 nt, Brucella suis 1330
gcuaaaaagcgcgcgca

SEQ ID NO: 441354 - RNA, 22 nt, Brucella suis 1330
gcguucucaagagcccgccgaa

SEQ ID NO: 441355 - RNA, 22 nt, Brucella suis 1330
gcguucgauucgcuaucgaaac

SEQ ID NO: 441356 - RNA, 22 nt, Brucella suis 1330
gcguguagccgcgaaccgucgc

SEQ ID NO: 441357 - RNA, 22 nt, Brucella suis 1330
gcgugguccagccagccgaaau

SEQ ID NO: 441358 - RNA, 16 nt, Brucella suis 1330
gcgugcaggcugccca

SEQ ID NO: 441359 - RNA, 21 nt, Brucella suis 1330
aaggaaagccguuucgaucac

SEQ ID NO: 441360 - RNA, 17 nt, Brucella suis 1330
aagcuucacauccuuca

SEQ ID NO: 441361 - RNA, 17 nt, Brucella suis 1330
aagcuugaacccgccga

SEQ ID NO: 441362 - RNA, 18 nt, Brucella suis 1330
gcguccuucaggccgucg

SEQ ID NO: 441363 - RNA, 15 nt, Brucella suis 1330
gcgucacggucggau

SEQ ID NO: 441364 - RNA, 19 nt, Brucella suis 1330
gcguaucguuaucgcgcag

SEQ ID NO: 441365 - RNA, 15 nt, Brucella suis 1330
gcggguagccgccau

SEQ ID NO: 441366 - RNA, 20 nt, Brucella suis 1330
gcgggguucguccucaauca

SEQ ID NO: 441367 - RNA, 19 nt, Brucella suis 1330
gcgggcuguuggccggcag

SEQ ID NO: 441368 - RNA, 21 nt, Brucella suis 1330
gcgggcuucugcgcccgcgcc

SEQ ID NO: 441369 - RNA, 21 nt, Brucella suis 1330
gcgggcuucuuccaguuccuu

SEQ ID NO: 441370 - RNA, 21 nt, Brucella suis 1330
gcgggcgcagcgacagcggcg

SEQ ID NO: 441371 - RNA, 23 nt, Brucella suis 1330
gcgggcgaucaucaucaccggca

SEQ ID NO: 441372 - RNA, 17 nt, Brucella suis 1330
gcggcuugcgcgacgau

SEQ ID NO: 441373 - RNA, 14 nt, Brucella suis 1330
gcggcuugccacca

SEQ ID NO: 441374 - RNA, 15 nt, Brucella suis 1330
aagcuggaaggccag

SEQ ID NO: 441375 - RNA, 21 nt, Brucella suis 1330
aagcugccgcgaaaaagccga

SEQ ID NO: 441376 - RNA, 23 nt, Brucella suis 1330
aagcucgacccagcuaaggccgg

SEQ ID NO: 441377 - RNA, 19 nt, Brucella suis 1330
aagcucgcgucccgcacgc

SEQ ID NO: 441378 - RNA, 19 nt, Brucella suis 1330
gcggcgcauucggccgccu

SEQ ID NO: 441379 - RNA, 20 nt, Brucella suis 1330
gcggcgaguugccacgcgcc

SEQ ID NO: 441380 - RNA, 16 nt, Brucella suis 1330
gcggcgaacgagcggc

SEQ ID NO: 441381 - RNA, 15 nt, Brucella suis 1330
gcggccggagcgcag

SEQ ID NO: 441382 - RNA, 17 nt, Brucella suis 1330
gcggcaugggccgcacg

SEQ ID NO: 441383 - RNA, 15 nt, Brucella suis 1330
gcggcacgccgccca

SEQ ID NO: 441384 - RNA, 14 nt, Brucella suis 1330
gcggcacccgcaac

SEQ ID NO: 441385 - RNA, 19 nt, Brucella suis 1330
gcggcaaugcgcuucgcgc

SEQ ID NO: 441386 - RNA, 23 nt, Brucella suis 1330
aagccggcgcagcgcgaccucau

SEQ ID NO: 441387 - RNA, 14 nt, Brucella suis 1330
gcggcaaaggccgc

SEQ ID NO: 441388 - RNA, 19 nt, Brucella suis 1330
gcggauggggugagggcca

SEQ ID NO: 441389 - RNA, 21 nt, Brucella suis 1330
gcggaugcgcggcgccagcgc

SEQ ID NO: 441390 - RNA, 16 nt, Brucella suis 1330
gcggaugauguugcga

SEQ ID NO: 441391 - RNA, 16 nt, Brucella suis 1330
gcggauacccaugcga

SEQ ID NO: 441392 - RNA, 23 nt, Brucella suis 1330
gcggagccucaucggcgggccag

SEQ ID NO: 441393 - RNA, 15 nt, Brucella suis 1330
gcggagcguccggcg

SEQ ID NO: 441394 - RNA, 15 nt, Brucella suis 1330
gcggagaugauggcg

SEQ ID NO: 441395 - RNA, 19 nt, Brucella suis 1330
gcggagcaacaccccgcgc

SEQ ID NO: 441396 - RNA, 19 nt, Brucella suis 1330
gcggacgggguuucgccgg

SEQ ID NO: 441397 - RNA, 18 nt, Brucella suis 1330
gcggaagcgacgauaucg

SEQ ID NO: 441398 - RNA, 16 nt, Brucella suis 1330
gcggaacacgccgcca

SEQ ID NO: 441399 - RNA, 17 nt, Brucella suis 1330
gcggaacacgccgccau

SEQ ID NO: 441400 - RNA, 19 nt, Brucella suis 1330
gcggaaaauguuccgcacc

SEQ ID NO: 441401 - RNA, 14 nt, Brucella suis 1330
gcggaaacccgacc

SEQ ID NO: 441402 - RNA, 12 nt, Brucella suis 1330
gcgcuugcgacc

SEQ ID NO: 441403 - RNA, 17 nt, Brucella suis 1330
gcgcuucgaggaaccag

SEQ ID NO: 441404 - RNA, 17 nt, Brucella suis 1330
gcgcugcgaaggcccuu

SEQ ID NO: 441405 - RNA, 20 nt, Brucella suis 1330
gcgcugcaauggucgacaau

SEQ ID NO: 441406 - RNA, 19 nt, Brucella suis 1330
gcgcgauggcguugcggcg

SEQ ID NO: 441407 - RNA, 22 nt, Brucella suis 1330
gcgcgaacaugccugccgcagc

SEQ ID NO: 441408 - RNA, 22 nt, Brucella suis 1330
gcgcgaaccagauccaccgcgc

SEQ ID NO: 441409 - RNA, 21 nt, Brucella suis 1330
gcgccuuggacaccucgccga

SEQ ID NO: 441410 - RNA, 15 nt, Brucella suis 1330
gcgccugggcuuuca

SEQ ID NO: 441411 - RNA, 23 nt, Brucella suis 1330
gcgccugaggccggacgcuucaa

SEQ ID NO: 441412 - RNA, 21 nt, Brucella suis 1330
gcgccuacgcggggaaaucag

SEQ ID NO: 441413 - RNA, 15 nt, Brucella suis 1330
gcgccaugccauccu

SEQ ID NO: 441414 - RNA, 23 nt, Brucella suis 1330
gcgccaugccauccucgccaagc

SEQ ID NO: 441415 - RNA, 16 nt, Brucella suis 1330
gcgccaaacugcaccg

SEQ ID NO: 441416 - RNA, 13 nt, Brucella suis 1330
gcgcauggcaugg

SEQ ID NO: 441417 - RNA, 12 nt, Brucella suis 1330
gcgcaucgaaag

SEQ ID NO: 441418 - RNA, 20 nt, Brucella suis 1330
gcgcauccagccggcgcauc

SEQ ID NO: 441419 - RNA, 15 nt, Brucella suis 1330
gcgcauccgccugcg

SEQ ID NO: 441420 - RNA, 14 nt, Brucella suis 1330
gcgcauaucgagcc

SEQ ID NO: 441421 - RNA, 22 nt, Brucella suis 1330
gcgcacgaccagaagcccgcgc

SEQ ID NO: 441422 - RNA, 20 nt, Brucella suis 1330
gcgcaauaaugcagcgccgc

SEQ ID NO: 441423 - RNA, 19 nt, Brucella suis 1330
gcgcaacacgcgcuccagc

SEQ ID NO: 441424 - RNA, 14 nt, Brucella suis 1330
gcgcaaacucgucg

SEQ ID NO: 441425 - RNA, 18 nt, Brucella suis 1330
gcgcaaagcccgccgaag

SEQ ID NO: 441426 - RNA, 23 nt, Brucella suis 1330
gcgcaaaacgcuugacgaaacgc

SEQ ID NO: 441427 - RNA, 14 nt, Brucella suis 1330
gcgaugcccaucgc

SEQ ID NO: 441428 - RNA, 19 nt, Brucella suis 1330
gcgaucuuacgaccaagcc

SEQ ID NO: 441429 - RNA, 20 nt, Brucella suis 1330
gcgauccaccaucacgucga

SEQ ID NO: 441430 - RNA, 12 nt, Brucella suis 1330
gcgauccagcgc

SEQ ID NO: 441431 - RNA, 12 nt, Brucella suis 1330
gcgaucaucgca

SEQ ID NO: 441432 - RNA, 14 nt, Brucella suis 1330
gcgaucagcgcaag

SEQ ID NO: 441433 - RNA, 13 nt, Brucella suis 1330
gcgaucaccagcc

SEQ ID NO: 441434 - RNA, 21 nt, Brucella suis 1330
gcgaucaacgcuuugaccgcc

SEQ ID NO: 441435 - RNA, 20 nt, Brucella suis 1330
gcgauaccagacgcgcacgu

SEQ ID NO: 441436 - RNA, 14 nt, Brucella suis 1330
gcgaggaagccugc

SEQ ID NO: 441437 - RNA, 15 nt, Brucella suis 1330
gcgacauagccgauc

SEQ ID NO: 441438 - RNA, 17 nt, Brucella suis 1330
gcgacagcggcgcgccu

SEQ ID NO: 441439 - RNA, 14 nt, Brucella suis 1330
gccuucgcgccagg

SEQ ID NO: 441440 - RNA, 17 nt, Brucella suis 1330
gccuucgcgccaggcuu

SEQ ID NO: 441441 - RNA, 18 nt, Brucella suis 1330
gccuucgacaaccgcgcc

SEQ ID NO: 441442 - RNA, 20 nt, Brucella suis 1330
gccuucgacaaccgcgccgc

SEQ ID NO: 441443 - RNA, 19 nt, Brucella suis 1330
gccuuagagaccuugauga

SEQ ID NO: 441444 - RNA, 18 nt, Brucella suis 1330
gccuguugcgaggaaaag

SEQ ID NO: 441445 - RNA, 22 nt, Brucella suis 1330
gccugucacgaucuugccgagg

SEQ ID NO: 441446 - RNA, 17 nt, Brucella suis 1330
gccuggccgauuuccgc

SEQ ID NO: 441447 - RNA, 18 nt, Brucella suis 1330
gccuggccgauuuccgcu

SEQ ID NO: 441448 - RNA, 13 nt, Brucella suis 1330
gccuggaugacau

SEQ ID NO: 441449 - RNA, 14 nt, Brucella suis 1330
gccuggaugacauc

SEQ ID NO: 441450 - RNA, 19 nt, Brucella suis 1330
gccugcuuccuuuucggcu

SEQ ID NO: 441451 - RNA, 18 nt, Brucella suis 1330
gccugcugcauccugcuc

SEQ ID NO: 441452 - RNA, 22 nt, Brucella suis 1330
gccugcugcauccugcucggcg

SEQ ID NO: 441453 - RNA, 21 nt, Brucella suis 1330
gccugcgcaccgguauugccc

SEQ ID NO: 441454 - RNA, 17 nt, Brucella suis 1330
gccugccauccgccccg

SEQ ID NO: 441455 - RNA, 14 nt, Brucella suis 1330
gccugaaugaaaac

SEQ ID NO: 441456 - RNA, 21 nt, Brucella suis 1330
gccucggagccuucauugcgg

SEQ ID NO: 441457 - RNA, 23 nt, Brucella suis 1330
aagccacgcuccacacgaacagc

SEQ ID NO: 441458 - RNA, 19 nt, Brucella suis 1330
gccguucuuggccaugaug

SEQ ID NO: 441459 - RNA, 16 nt, Brucella suis 1330
gccgugaccagcgcaa

SEQ ID NO: 441460 - RNA, 19 nt, Brucella suis 1330
gccgucccggaagccgccu

SEQ ID NO: 441461 - RNA, 17 nt, Brucella suis 1330
gccgguggaauagccgg

SEQ ID NO: 441462 - RNA, 18 nt, Brucella suis 1330
gccggugcccggaagcga

SEQ ID NO: 441463 - RNA, 21 nt, Brucella suis 1330
gccggucuucccgcaauucga

SEQ ID NO: 441464 - RNA, 23 nt, Brucella suis 1330
gccgguaagcccugucagcgccg

SEQ ID NO: 441465 - RNA, 16 nt, Brucella suis 1330
gccgggauuuucggcc

SEQ ID NO: 441466 - RNA, 14 nt, Brucella suis 1330
aagccaaagcccgu

SEQ ID NO: 441467 - RNA, 22 nt, Brucella suis 1330
gccggauagggcguaaucagcg

SEQ ID NO: 441468 - RNA, 21 nt, Brucella suis 1330
gccggaaauugggaucgaaag

SEQ ID NO: 441469 - RNA, 15 nt, Brucella suis 1330
gccgcccuugcgcac

SEQ ID NO: 441470 - RNA, 13 nt, Brucella suis 1330
gccgcccugcgcc

SEQ ID NO: 441471 - RNA, 15 nt, Brucella suis 1330
gccgccaggcaaaug

SEQ ID NO: 441472 - RNA, 15 nt, Brucella suis 1330
gccgccagcaggccg

SEQ ID NO: 441473 - RNA, 20 nt, Brucella suis 1330
gccgccaagggccgccgaag

SEQ ID NO: 441474 - RNA, 16 nt, Brucella suis 1330
gccgcauugucgaagg

SEQ ID NO: 441475 - RNA, 20 nt, Brucella suis 1330
gccgcauaaagcacagccag

SEQ ID NO: 441476 - RNA, 14 nt, Brucella suis 1330
gccgcagccgccau

SEQ ID NO: 441477 - RNA, 23 nt, Brucella suis 1330
gccgcagcccggacaggcggcga

SEQ ID NO: 441478 - RNA, 14 nt, Brucella suis 1330
gccgcaauugccgc

SEQ ID NO: 441479 - RNA, 16 nt, Brucella suis 1330
gccgcaaagcgaacgc

SEQ ID NO: 441480 - RNA, 17 nt, Brucella suis 1330
gccgcaaaggcaggcac

SEQ ID NO: 441481 - RNA, 17 nt, Brucella suis 1330
gccgaucaucgccugaa

SEQ ID NO: 441482 - RNA, 21 nt, Brucella suis 1330
gccgauauucgaugaucugcg

SEQ ID NO: 441483 - RNA, 15 nt, Brucella suis 1330
gccgauaugccgacg

SEQ ID NO: 441484 - RNA, 14 nt, Brucella suis 1330
gccgauauccucga

SEQ ID NO: 441485 - RNA, 19 nt, Brucella suis 1330
gccgauaagugccgcgccg

SEQ ID NO: 441486 - RNA, 21 nt, Brucella suis 1330
gccgauaagugccgcgccgau

SEQ ID NO: 441487 - RNA, 20 nt, Brucella suis 1330
gccgagcauggccugcgcac

SEQ ID NO: 441488 - RNA, 15 nt, Brucella suis 1330
gccgaccagaacgau

SEQ ID NO: 441489 - RNA, 20 nt, Brucella suis 1330
gccgacaaaaaacaccgcgc

SEQ ID NO: 441490 - RNA, 17 nt, Brucella suis 1330
gccgaauuccgccaugc

SEQ ID NO: 441491 - RNA, 16 nt, Brucella suis 1330
gccgaagccgaugcgc

SEQ ID NO: 441492 - RNA, 13 nt, Brucella suis 1330
gccgaaccguccg

SEQ ID NO: 441493 - RNA, 17 nt, Brucella suis 1330
gccgaaccgggccgcau

SEQ ID NO: 441494 - RNA, 20 nt, Brucella suis 1330
gccgaaccggggcagggcag

SEQ ID NO: 441495 - RNA, 23 nt, Brucella suis 1330
gccgaaaugagaucaaccccgca

SEQ ID NO: 441496 - RNA, 12 nt, Brucella suis 1330
gccgaaacgccc

SEQ ID NO: 441497 - RNA, 17 nt, Brucella suis 1330
gcccgucuuccuccgca

SEQ ID NO: 441498 - RNA, 19 nt, Brucella suis 1330
gcccgucgaccagcgcaug

SEQ ID NO: 441499 - RNA, 23 nt, Brucella suis 1330
gcccgucacuucaaguuucggau

SEQ ID NO: 441500 - RNA, 21 nt, Brucella suis 1330
gcccgguugcgccaaaacgca

SEQ ID NO: 441501 - RNA, 12 nt, Brucella suis 1330
gcccggugcagc

SEQ ID NO: 441502 - RNA, 13 nt, Brucella suis 1330
gcccggcuggaau

SEQ ID NO: 441503 - RNA, 23 nt, Brucella suis 1330
gcccggcggugaagaagcgccag

SEQ ID NO: 441504 - RNA, 16 nt, Brucella suis 1330
gcccggccuuuucggc

SEQ ID NO: 441505 - RNA, 17 nt, Brucella suis 1330
gcccgcuuuuacgcgcc

SEQ ID NO: 441506 - RNA, 21 nt, Brucella suis 1330
gcccgccucgaccgcaacagg

SEQ ID NO: 441507 - RNA, 14 nt, Brucella suis 1330
gcccgcccggcauc

SEQ ID NO: 441508 - RNA, 20 nt, Brucella suis 1330
gcccgacaaagaucaucgcc

SEQ ID NO: 441509 - RNA, 22 nt, Brucella suis 1330
gcccgacaaagaucaucgccgu

SEQ ID NO: 441510 - RNA, 14 nt, Brucella suis 1330
gccccuugccgucg

SEQ ID NO: 441511 - RNA, 14 nt, Brucella suis 1330
gccccgccagaaaa

SEQ ID NO: 441512 - RNA, 15 nt, Brucella suis 1330
gccccgaucgggcca

SEQ ID NO: 441513 - RNA, 21 nt, Brucella suis 1330
gcccauggacuuuucagccuc

SEQ ID NO: 441514 - RNA, 14 nt, Brucella suis 1330
gccaugacggcccg

SEQ ID NO: 441515 - RNA, 19 nt, Brucella suis 1330
gccaugaagaucaauuccc

SEQ ID NO: 441516 - RNA, 13 nt, Brucella suis 1330
gccaucuuccagu

SEQ ID NO: 441517 - RNA, 20 nt, Brucella suis 1330
gccaucuuccucacccuuca

SEQ ID NO: 441518 - RNA, 17 nt, Brucella suis 1330
gccaucggcaaaggcuc

SEQ ID NO: 441519 - RNA, 16 nt, Brucella suis 1330
gccaucggcacggcgu

SEQ ID NO: 441520 - RNA, 23 nt, Brucella suis 1330
gccauccucgccaagcuuuugca

SEQ ID NO: 441521 - RNA, 13 nt, Brucella suis 1330
gccauccgccccg

SEQ ID NO: 441522 - RNA, 17 nt, Brucella suis 1330
gccaucaagcgucaugc

SEQ ID NO: 441523 - RNA, 15 nt, Brucella suis 1330
gccauagacgcgcag

SEQ ID NO: 441524 - RNA, 23 nt, Brucella suis 1330
gccauagcgcagaaugagcuugc

SEQ ID NO: 441525 - RNA, 18 nt, Brucella suis 1330
gccaguggccgaagccgc

SEQ ID NO: 441526 - RNA, 14 nt, Brucella suis 1330
gccagccagcgcau

SEQ ID NO: 441527 - RNA, 15 nt, Brucella suis 1330
gccagaugugccacc

SEQ ID NO: 441528 - RNA, 21 nt, Brucella suis 1330
gccagaugugccaccagcaca

SEQ ID NO: 441529 - RNA, 19 nt, Brucella suis 1330
gccagauaagguucgaugg

SEQ ID NO: 441530 - RNA, 15 nt, Brucella suis 1330
gccagagacaucaga

SEQ ID NO: 441531 - RNA, 21 nt, Brucella suis 1330
gccacugaccuuuugacggcc

SEQ ID NO: 441532 - RNA, 16 nt, Brucella suis 1330
gccacggcgaaagcug

SEQ ID NO: 441533 - RNA, 17 nt, Brucella suis 1330
gccacggcgaaagcugc

SEQ ID NO: 441534 - RNA, 22 nt, Brucella suis 1330
gccacgcacggucuugccggcc

SEQ ID NO: 441535 - RNA, 19 nt, Brucella suis 1330
gccacgaugccugccggug

SEQ ID NO: 441536 - RNA, 15 nt, Brucella suis 1330
gccaaugacauggca

SEQ ID NO: 441537 - RNA, 15 nt, Brucella suis 1330
gccaauccccucacc

SEQ ID NO: 441538 - RNA, 18 nt, Brucella suis 1330
gccaagcuugaucgccgc

SEQ ID NO: 441539 - RNA, 12 nt, Brucella suis 1330
gccaagcgccag

SEQ ID NO: 441540 - RNA, 17 nt, Brucella suis 1330
gccaagcggaucgcguc

SEQ ID NO: 441541 - RNA, 21 nt, Brucella suis 1330
gccaacgccggcaccgccccg

SEQ ID NO: 441542 - RNA, 14 nt, Brucella suis 1330
gccaaaaggccuuc

SEQ ID NO: 441543 - RNA, 20 nt, Brucella suis 1330
gccaaaaugauuucgcaaug

SEQ ID NO: 441544 - RNA, 20 nt, Brucella suis 1330
gcauugccgagcuugcggcg

SEQ ID NO: 441545 - RNA, 16 nt, Brucella suis 1330
gcauuccccgcccgcg

SEQ ID NO: 441546 - RNA, 20 nt, Brucella suis 1330
gcauucccuucgcgccgccu

SEQ ID NO: 441547 - RNA, 12 nt, Brucella suis 1330
gcauuauuccgc

SEQ ID NO: 441548 - RNA, 16 nt, Brucella suis 1330
gcauuauuccgccugc

SEQ ID NO: 441549 - RNA, 15 nt, Brucella suis 1330
gcauucaggcggccu

SEQ ID NO: 441550 - RNA, 16 nt, Brucella suis 1330
gcaugucauccgaaac

SEQ ID NO: 441551 - RNA, 18 nt, Brucella suis 1330
gcaugucauccgaaacca

SEQ ID NO: 441552 - RNA, 19 nt, Brucella suis 1330
gcauggccucaagugccgc

SEQ ID NO: 441553 - RNA, 15 nt, Brucella suis 1330
gcauggccccggagc

SEQ ID NO: 441554 - RNA, 23 nt, Brucella suis 1330
gcaugaucgugagcgagcgcaca

SEQ ID NO: 441555 - RNA, 17 nt, Brucella suis 1330
gcaugauccgcuccaga

SEQ ID NO: 441556 - RNA, 18 nt, Brucella suis 1330
gcaugacaccuucggcca

SEQ ID NO: 441557 - RNA, 20 nt, Brucella suis 1330
gcaugacaccuucggccagc

SEQ ID NO: 441558 - RNA, 15 nt, Brucella suis 1330
gcaucgugucaucga

SEQ ID NO: 441559 - RNA, 12 nt, Brucella suis 1330
gcaucgagcugg

SEQ ID NO: 441560 - RNA, 21 nt, Brucella suis 1330
gcaucgagcggcacgaugcgc

SEQ ID NO: 441561 - RNA, 14 nt, Brucella suis 1330
gcaucgaaugccgc

SEQ ID NO: 441562 - RNA, 17 nt, Brucella suis 1330
gcaucgaaugccgcaug

SEQ ID NO: 441563 - RNA, 23 nt, Brucella suis 1330
gcaucgaacccuucccgaacuga

SEQ ID NO: 441564 - RNA, 19 nt, Brucella suis 1330
gcaucaugcggucguccuc

SEQ ID NO: 441565 - RNA, 21 nt, Brucella suis 1330
gcauccacucggcggcaucgc

SEQ ID NO: 441566 - RNA, 13 nt, Brucella suis 1330
gcaucagucgaau

SEQ ID NO: 441567 - RNA, 19 nt, Brucella suis 1330
gcaucagucgaauuucagc

SEQ ID NO: 441568 - RNA, 17 nt, Brucella suis 1330
gcaucagaaauuugcgg

SEQ ID NO: 441569 - RNA, 18 nt, Brucella suis 1330
gcaucacuggcaacgacg

SEQ ID NO: 441570 - RNA, 21 nt, Brucella suis 1330
gcaucaaacuggauccggcga

SEQ ID NO: 441571 - RNA, 18 nt, Brucella suis 1330
gcauauugccgagcaugg

SEQ ID NO: 441572 - RNA, 15 nt, Brucella suis 1330
gcauauugcuugucg

SEQ ID NO: 441573 - RNA, 20 nt, Brucella suis 1330
gcaucaauccuucaugccgc

SEQ ID NO: 441574 - RNA, 22 nt, Brucella suis 1330
gcaucaauccuucaugccgccg

SEQ ID NO: 441575 - RNA, 16 nt, Brucella suis 1330
gcaucacagucacgcc

SEQ ID NO: 441576 - RNA, 22 nt, Brucella suis 1330
gcauauccggaccgaaggccag

SEQ ID NO: 441577 - RNA, 21 nt, Brucella suis 1330
gcauauagguguuggucaugc

SEQ ID NO: 441578 - RNA, 13 nt, Brucella suis 1330
gcaguuccugcgc

SEQ ID NO: 441579 - RNA, 15 nt, Brucella suis 1330
gcaguuucaccaugg

SEQ ID NO: 441580 - RNA, 16 nt, Brucella suis 1330
gcaguuucaccauggc

SEQ ID NO: 441581 - RNA, 19 nt, Brucella suis 1330
gcauaauauucagcgaacc

SEQ ID NO: 441582 - RNA, 15 nt, Brucella suis 1330
gcagccgcgaacgau

SEQ ID NO: 441583 - RNA, 16 nt, Brucella suis 1330
gcagcagcaucgccgc

SEQ ID NO: 441584 - RNA, 17 nt, Brucella suis 1330
gcagcaccggcggaagg

SEQ ID NO: 441585 - RNA, 20 nt, Brucella suis 1330
gcagcaccggcggaaggcug

SEQ ID NO: 441586 - RNA, 22 nt, Brucella suis 1330
gcagaucgcauccaguccgcaa

SEQ ID NO: 441587 - RNA, 13 nt, Brucella suis 1330
gcagaaugagcuu

SEQ ID NO: 441588 - RNA, 21 nt, Brucella suis 1330
gcacgccgcccaggaccgcgc

SEQ ID NO: 441589 - RNA, 16 nt, Brucella suis 1330
gcacgcaggacaagcc

SEQ ID NO: 441590 - RNA, 16 nt, Brucella suis 1330
gcacgaugcgcagccg

SEQ ID NO: 441591 - RNA, 22 nt, Brucella suis 1330
gcacgaacagaucgccaagcgc

SEQ ID NO: 441592 - RNA, 16 nt, Brucella suis 1330
gcacgaccagaagccc

SEQ ID NO: 441593 - RNA, 13 nt, Brucella suis 1330
gcaccucaggaug

SEQ ID NO: 441594 - RNA, 17 nt, Brucella suis 1330
gcacaagaacagccgcc

SEQ ID NO: 441595 - RNA, 19 nt, Brucella suis 1330
gcacaagaacagccgcccc

SEQ ID NO: 441596 - RNA, 20 nt, Brucella suis 1330
gcacaagaacagccgccccg

SEQ ID NO: 441597 - RNA, 13 nt, Brucella suis 1330
gcacaagcugcgu

SEQ ID NO: 441598 - RNA, 22 nt, Brucella suis 1330
gcacaagcuugauaaggccguu

SEQ ID NO: 441599 - RNA, 23 nt, Brucella suis 1330
gcaaugugcuggcggccaagcgc

SEQ ID NO: 441600 - RNA, 15 nt, Brucella suis 1330
gcaauggccuugccg

SEQ ID NO: 441601 - RNA, 18 nt, Brucella suis 1330
gcaauggccuugccgauc

SEQ ID NO: 441602 - RNA, 20 nt, Brucella suis 1330
gcaaugcccucuucguccuc

SEQ ID NO: 441603 - RNA, 14 nt, Brucella suis 1330
gcaaucugcgcugc

SEQ ID NO: 441604 - RNA, 17 nt, Brucella suis 1330
gcaaugcaccgauggcc

SEQ ID NO: 441605 - RNA, 17 nt, Brucella suis 1330
gcaaucgccaccggcgg

SEQ ID NO: 441606 - RNA, 18 nt, Brucella suis 1330
gcaauccuggugcgcagc

SEQ ID NO: 441607 - RNA, 23 nt, Brucella suis 1330
gcaaguuccgcauugaugaagcc

SEQ ID NO: 441608 - RNA, 22 nt, Brucella suis 1330
gcaagguggaucuugcgguucg

SEQ ID NO: 441609 - RNA, 19 nt, Brucella suis 1330
gcaaguuuaucggccugau

SEQ ID NO: 441610 - RNA, 22 nt, Brucella suis 1330
gcaauaauuaugcaggaaagcc

SEQ ID NO: 441611 - RNA, 15 nt, Brucella suis 1330
gcaaggagcgagcuu

SEQ ID NO: 441612 - RNA, 13 nt, Brucella suis 1330
gcaagccaaagcc

SEQ ID NO: 441613 - RNA, 19 nt, Brucella suis 1330
gcaagcauuccgggccgca

SEQ ID NO: 441614 - RNA, 16 nt, Brucella suis 1330
gcaagauuuuggcgaa

SEQ ID NO: 441615 - RNA, 23 nt, Brucella suis 1330
gcaagacccaauccgccaacgau

SEQ ID NO: 441616 - RNA, 15 nt, Brucella suis 1330
gcaacgggcgagggc

SEQ ID NO: 441617 - RNA, 23 nt, Brucella suis 1330
gcaacgauaaucgaugagaucgu

SEQ ID NO: 441618 - RNA, 18 nt, Brucella suis 1330
gcaaagcguuccgcgcaa

SEQ ID NO: 441619 - RNA, 12 nt, Brucella suis 1330
gcaaaaagcggc

SEQ ID NO: 441620 - RNA, 17 nt, Brucella suis 1330
gauuucugauccugcuu

SEQ ID NO: 441621 - RNA, 15 nt, Brucella suis 1330
gauuugauccaugcg

SEQ ID NO: 441622 - RNA, 23 nt, Brucella suis 1330
gauuucgccaaguucuuccgcca

SEQ ID NO: 441623 - RNA, 14 nt, Brucella suis 1330
gauugggcggcggc

SEQ ID NO: 441624 - RNA, 19 nt, Brucella suis 1330
gauugcggcugauaugcgc

SEQ ID NO: 441625 - RNA, 16 nt, Brucella suis 1330
gauugcgggcaagcau

SEQ ID NO: 441626 - RNA, 17 nt, Brucella suis 1330
gauugcuauugaaugcc

SEQ ID NO: 441627 - RNA, 21 nt, Brucella suis 1330
gauugaauuagaucggcgcuc

SEQ ID NO: 441628 - RNA, 14 nt, Brucella suis 1330
gauugacgccccca

SEQ ID NO: 441629 - RNA, 22 nt, Brucella suis 1330
gauucgaccuugaaaucgcgcu

SEQ ID NO: 441630 - RNA, 21 nt, Brucella suis 1330
gauuccagaugcggcgcgcau

SEQ ID NO: 441631 - RNA, 15 nt, Brucella suis 1330
gauuagagcgccgau

SEQ ID NO: 441632 - RNA, 15 nt, Brucella suis 1330
gauggguaucgguca

SEQ ID NO: 441633 - RNA, 21 nt, Brucella suis 1330
gauggcgguuuccaucgaauc

SEQ ID NO: 441634 - RNA, 14 nt, Brucella suis 1330
gauggccgaaccgu

SEQ ID NO: 441635 - RNA, 21 nt, Brucella suis 1330
gaugcuuuauucaaccguuuc

SEQ ID NO: 441636 - RNA, 15 nt, Brucella suis 1330
gaucuggcggaugau

SEQ ID NO: 441637 - RNA, 23 nt, Brucella suis 1330
gaucgucugaacggaucuugcgc

SEQ ID NO: 441638 - RNA, 15 nt, Brucella suis 1330
gaucgugaucuucgg

SEQ ID NO: 441639 - RNA, 20 nt, Brucella suis 1330
gaucguaaagcagauggcga

SEQ ID NO: 441640 - RNA, 18 nt, Brucella suis 1330
gaucguagaucgcccggu

SEQ ID NO: 441641 - RNA, 16 nt, Brucella suis 1330
gaucgguacggaaagg

SEQ ID NO: 441642 - RNA, 20 nt, Brucella suis 1330
gaucgguucgccgcuugcgc

SEQ ID NO: 441643 - RNA, 22 nt, Brucella suis 1330
gaucggcgucaggccgagcgca

SEQ ID NO: 441644 - RNA, 17 nt, Brucella suis 1330
gaucggccauuucggcu

SEQ ID NO: 441645 - RNA, 16 nt, Brucella suis 1330
gaucgcgucccuugcc

SEQ ID NO: 441646 - RNA, 21 nt, Brucella suis 1330
gaucgccuuuauauggcgguc

SEQ ID NO: 441647 - RNA, 22 nt, Brucella suis 1330
gaucgaugcgcuccugaaccgg

SEQ ID NO: 441648 - RNA, 19 nt, Brucella suis 1330
gauccgcuccagauugcgg

SEQ ID NO: 441649 - RNA, 20 nt, Brucella suis 1330
gaucccgcuucgaugcgcug

SEQ ID NO: 441650 - RNA, 23 nt, Brucella suis 1330
gaucagcaccaucgaggaauagg

SEQ ID NO: 441651 - RNA, 14 nt, Brucella suis 1330
gaucagaagugcug

SEQ ID NO: 441652 - RNA, 21 nt, Brucella suis 1330
gaucaacgcuuugaccgccgc

SEQ ID NO: 441653 - RNA, 22 nt, Brucella suis 1330
gaucaacgcuuugaccgccgcg

SEQ ID NO: 441654 - RNA, 21 nt, Brucella suis 1330
gauaucugcaacaccaucgag

SEQ ID NO: 441655 - RNA, 18 nt, Brucella suis 1330
gauaucgccuucgcgcac

SEQ ID NO: 441656 - RNA, 21 nt, Brucella suis 1330
gauaggcguugaugacgaaaa

SEQ ID NO: 441657 - RNA, 21 nt, Brucella suis 1330
gauagggcaauuggcccccaa

SEQ ID NO: 441658 - RNA, 18 nt, Brucella suis 1330
gauagccccagcccgccc

SEQ ID NO: 441659 - RNA, 15 nt, Brucella suis 1330
gauaaacccgccccc

SEQ ID NO: 441660 - RNA, 18 nt, Brucella suis 1330
gagugugcauuccccgcc

SEQ ID NO: 441661 - RNA, 20 nt, Brucella suis 1330
gaguggacgguugcugaggg

SEQ ID NO: 441662 - RNA, 20 nt, Brucella suis 1330
gaggcggcauaaggccccca

SEQ ID NO: 441663 - RNA, 18 nt, Brucella suis 1330
gaggcgaauggauugcgg

SEQ ID NO: 441664 - RNA, 23 nt, Brucella suis 1330
gaggcgaauggauugcgggcaug

SEQ ID NO: 441665 - RNA, 21 nt, Brucella suis 1330
gaggauuuccacccgguucga

SEQ ID NO: 441666 - RNA, 16 nt, Brucella suis 1330
gaggaaguggaagcac

SEQ ID NO: 441667 - RNA, 15 nt, Brucella suis 1330
gaggaaaaagcccgc

SEQ ID NO: 441668 - RNA, 17 nt, Brucella suis 1330
gaggaaaaagcccgcca

SEQ ID NO: 441669 - RNA, 20 nt, Brucella suis 1330
gagcgccuguccgccugcca

SEQ ID NO: 441670 - RNA, 16 nt, Brucella suis 1330
gagccccaggaacggc

SEQ ID NO: 441671 - RNA, 20 nt, Brucella suis 1330
gagcauuuuucgggcgaaug

SEQ ID NO: 441672 - RNA, 17 nt, Brucella suis 1330
gagcaugaugccgacga

SEQ ID NO: 441673 - RNA, 12 nt, Brucella suis 1330
aacuccgcgcga

SEQ ID NO: 441674 - RNA, 19 nt, Brucella suis 1330
gagcaucgaucugaaugaa

SEQ ID NO: 441675 - RNA, 22 nt, Brucella suis 1330
gagcaccggaagcgcaaaacag

SEQ ID NO: 441676 - RNA, 11 nt, Brucella suis 1330
gagauuucacc

SEQ ID NO: 441677 - RNA, 17 nt, Brucella suis 1330
gagaguagucugcgcau

SEQ ID NO: 441678 - RNA, 19 nt, Brucella suis 1330
gagagauuucaccacgcca

SEQ ID NO: 441679 - RNA, 21 nt, Brucella suis 1330
gagaauggcaacacggcgcuu

SEQ ID NO: 441680 - RNA, 24 nt, Brucella suis 1330
gagaagcgguguggcccggucgac

SEQ ID NO: 441681 - RNA, 22 nt, Brucella suis 1330
gagaaucuugcccucgccgccg

SEQ ID NO: 441682 - RNA, 15 nt, Brucella suis 1330
gacuuccagaagcgc

SEQ ID NO: 441683 - RNA, 16 nt, Brucella suis 1330
aacuauuuguuuuauc

SEQ ID NO: 441684 - RNA, 15 nt, Brucella suis 1330
gacugauuuccccgc

SEQ ID NO: 441685 - RNA, 16 nt, Brucella suis 1330
gacucugaccuuccug

SEQ ID NO: 441686 - RNA, 16 nt, Brucella suis 1330
gacugaacgaaugcgu

SEQ ID NO: 441687 - RNA, 15 nt, Brucella suis 1330
gacuauuuccaucgc

SEQ ID NO: 441688 - RNA, 18 nt, Brucella suis 1330
gacguccaccaccucgcc

SEQ ID NO: 441689 - RNA, 20 nt, Brucella suis 1330
gacguagggcgcgagcacgc

SEQ ID NO: 441690 - RNA, 12 nt, Brucella suis 1330
gacgaccauggc

SEQ ID NO: 441691 - RNA, 16 nt, Brucella suis 1330
aacgggugcgcugcca

SEQ ID NO: 441692 - RNA, 18 nt, Brucella suis 1330
gaccggcgaaaaggcgau

SEQ ID NO: 441693 - RNA, 13 nt, Brucella suis 1330
gaccggaucgcgc

SEQ ID NO: 441694 - RNA, 14 nt, Brucella suis 1330
gaccgccuuuucca

SEQ ID NO: 441695 - RNA, 21 nt, Brucella suis 1330
aacgcgccgauaccaaggccg

SEQ ID NO: 441696 - RNA, 23 nt, Brucella suis 1330
aacgccugauugaucgugccgga

SEQ ID NO: 441697 - RNA, 18 nt, Brucella suis 1330
aacgccggccugguuuca

SEQ ID NO: 441698 - RNA, 13 nt, Brucella suis 1330
aacgccgaagcca

SEQ ID NO: 441699 - RNA, 17 nt, Brucella suis 1330
aacgcauagagccacga

SEQ ID NO: 441700 - RNA, 15 nt, Brucella suis 1330
gaccaagcccguacc

SEQ ID NO: 441701 - RNA, 20 nt, Brucella suis 1330
gaccaaacagccccgcaaua

SEQ ID NO: 441702 - RNA, 17 nt, Brucella suis 1330
gacagggcgcugcgaag

SEQ ID NO: 441703 - RNA, 15 nt, Brucella suis 1330
gaauucauccgccuu

SEQ ID NO: 441704 - RNA, 21 nt, Brucella suis 1330
gaauuccugaaccacuuccga

SEQ ID NO: 441705 - RNA, 17 nt, Brucella suis 1330
gaauggucugcgccagu

SEQ ID NO: 441706 - RNA, 14 nt, Brucella suis 1330
gaauggcgaaaucg

SEQ ID NO: 441707 - RNA, 20 nt, Brucella suis 1330
gaauagaugaugaagaaaag

SEQ ID NO: 441708 - RNA, 17 nt, Brucella suis 1330
gaauagaccaucgaaag

SEQ ID NO: 441709 - RNA, 13 nt, Brucella suis 1330
gaauagaccaugc

SEQ ID NO: 441710 - RNA, 21 nt, Brucella suis 1330
gaaucagcaaguuuaucggcc

SEQ ID NO: 441711 - RNA, 18 nt, Brucella suis 1330
gaaggcguuggccgcggc

SEQ ID NO: 441712 - RNA, 21 nt, Brucella suis 1330
gaaggcugagugagccuuccg

SEQ ID NO: 441713 - RNA, 17 nt, Brucella suis 1330
gaaggcgcugcacaccc

SEQ ID NO: 441714 - RNA, 18 nt, Brucella suis 1330
gaaggccucgaaauagcc

SEQ ID NO: 441715 - RNA, 16 nt, Brucella suis 1330
gaagcggauuugagga

SEQ ID NO: 441716 - RNA, 18 nt, Brucella suis 1330
gaagcgaagaacagaagc

SEQ ID NO: 441717 - RNA, 16 nt, Brucella suis 1330
gaagccgauccgcagu

SEQ ID NO: 441718 - RNA, 22 nt, Brucella suis 1330
gaagccagguggcugcccgccg

SEQ ID NO: 441719 - RNA, 15 nt, Brucella suis 1330
gaagcacauggcggc

SEQ ID NO: 441720 - RNA, 19 nt, Brucella suis 1330
gaagcaccagcgcgccgau

SEQ ID NO: 441721 - RNA, 23 nt, Brucella suis 1330
gaagaucgucggcaagcuggaag

SEQ ID NO: 441722 - RNA, 16 nt, Brucella suis 1330
gaagaugacgcccagc

SEQ ID NO: 441723 - RNA, 18 nt, Brucella suis 1330
gaagaucaaguggcuuuu

SEQ ID NO: 441724 - RNA, 22 nt, Brucella suis 1330
gaagauaaucgaugucgccgcu

SEQ ID NO: 441725 - RNA, 15 nt, Brucella suis 1330
gaagagccuuuucca

SEQ ID NO: 441726 - RNA, 18 nt, Brucella suis 1330
gaacuuugugccgccgcu

SEQ ID NO: 441727 - RNA, 18 nt, Brucella suis 1330
gaacugguucagccgcuc

SEQ ID NO: 441728 - RNA, 19 nt, Brucella suis 1330
gaacggcuauauuuucggu

SEQ ID NO: 441729 - RNA, 13 nt, Brucella suis 1330
gaacaugcgccac

SEQ ID NO: 441730 - RNA, 14 nt, Brucella suis 1330
gaacaugcgccaga

SEQ ID NO: 441731 - RNA, 21 nt, Brucella suis 1330
gaaccgucgccagcucgccgg

SEQ ID NO: 441732 - RNA, 22 nt, Brucella suis 1330
gaaaugaaagccgagcugcaag

SEQ ID NO: 441733 - RNA, 18 nt, Brucella suis 1330
gaaauccacuacaaccgg

SEQ ID NO: 441734 - RNA, 23 nt, Brucella suis 1330
gaaauccacuacaaccggcucgc

SEQ ID NO: 441735 - RNA, 15 nt, Brucella suis 1330
gaaagcgggccugug

SEQ ID NO: 441736 - RNA, 22 nt, Brucella suis 1330
gaaagggccgccuugcuugaag

SEQ ID NO: 441737 - RNA, 18 nt, Brucella suis 1330
gaaacgagacaaggcaau

SEQ ID NO: 441738 - RNA, 19 nt, Brucella suis 1330
gaaaccggcauuauccgca

SEQ ID NO: 441739 - RNA, 21 nt, Brucella suis 1330
cuuggccaugaugccgacaag

SEQ ID NO: 441740 - RNA, 15 nt, Brucella suis 1330
cuugcgcgcuggaug

SEQ ID NO: 441741 - RNA, 17 nt, Brucella suis 1330
cuugcgcccgcgguuuc

SEQ ID NO: 441742 - RNA, 14 nt, Brucella suis 1330
cuugcgccaaucgc

SEQ ID NO: 441743 - RNA, 21 nt, Brucella suis 1330
cuugccgcguuccacgucuuc

SEQ ID NO: 441744 - RNA, 16 nt, Brucella suis 1330
cuugccgaaaagccgc

SEQ ID NO: 441745 - RNA, 18 nt, Brucella suis 1330
cuugcccgcauauugcuu

SEQ ID NO: 441746 - RNA, 16 nt, Brucella suis 1330
cuugcccucgccgccg

SEQ ID NO: 441747 - RNA, 19 nt, Brucella suis 1330
cuugaucugcuccaucgca

SEQ ID NO: 441748 - RNA, 16 nt, Brucella suis 1330
cuugaagagccgcagg

SEQ ID NO: 441749 - RNA, 15 nt, Brucella suis 1330
cuugaagucaucacc

SEQ ID NO: 441750 - RNA, 14 nt, Brucella suis 1330
cuugaagucauccc

SEQ ID NO: 441751 - RNA, 21 nt, Brucella suis 1330
cuucuugguuucuucggccca

SEQ ID NO: 441752 - RNA, 23 nt, Brucella suis 1330
cuucuguuaucccucaaaacgcu

SEQ ID NO: 441753 - RNA, 14 nt, Brucella suis 1330
cuucuggauuugcu

SEQ ID NO: 441754 - RNA, 19 nt, Brucella suis 1330
cuucggccgacagaugcgc

SEQ ID NO: 441755 - RNA, 14 nt, Brucella suis 1330
cuucggccagcgca

SEQ ID NO: 441756 - RNA, 17 nt, Brucella suis 1330
cuucggcauggcagccg

SEQ ID NO: 441757 - RNA, 19 nt, Brucella suis 1330
cuucgcgcaggccgcggca

SEQ ID NO: 441758 - RNA, 17 nt, Brucella suis 1330
cuucgcgaacaugcgcc

SEQ ID NO: 441759 - RNA, 22 nt, Brucella suis 1330
cuucgccgagaugggcaaauuc

SEQ ID NO: 441760 - RNA, 19 nt, Brucella suis 1330
cuuccugcgaugcgccagc

SEQ ID NO: 441761 - RNA, 15 nt, Brucella suis 1330
cuuccugcggcagcg

SEQ ID NO: 441762 - RNA, 19 nt, Brucella suis 1330
cuuccguggcaaugacggc

SEQ ID NO: 441763 - RNA, 20 nt, Brucella suis 1330
cuucacaugcuugccgaccu

SEQ ID NO: 441764 - RNA, 16 nt, Brucella suis 1330
cuucaccagccuugag

SEQ ID NO: 441765 - RNA, 20 nt, Brucella suis 1330
cugugacgacaaccacgcuu

SEQ ID NO: 441766 - RNA, 17 nt, Brucella suis 1330
cuguccugccagcggca

SEQ ID NO: 441767 - RNA, 19 nt, Brucella suis 1330
cugucgaaauaaugccaag

SEQ ID NO: 441768 - RNA, 18 nt, Brucella suis 1330
cuggccgucgcguucagc

SEQ ID NO: 441769 - RNA, 21 nt, Brucella suis 1330
cuggccaugaugccggucgca

SEQ ID NO: 441770 - RNA, 18 nt, Brucella suis 1330
cuggcagcaugaucgcca

SEQ ID NO: 441771 - RNA, 13 nt, Brucella suis 1330
cugcuucaucgcg

SEQ ID NO: 441772 - RNA, 14 nt, Brucella suis 1330
cugcuucgaucaga

SEQ ID NO: 441773 - RNA, 22 nt, Brucella suis 1330
cugcucggcgcggcguucggca

SEQ ID NO: 441774 - RNA, 19 nt, Brucella suis 1330
cugcucauaaacgcugcug

SEQ ID NO: 441775 - RNA, 12 nt, Brucella suis 1330
cugcggcuucug

SEQ ID NO: 441776 - RNA, 20 nt, Brucella suis 1330
cugcgggccaugguuucggc

SEQ ID NO: 441777 - RNA, 12 nt, Brucella suis 1330
cugcggcggcgu

SEQ ID NO: 441778 - RNA, 19 nt, Brucella suis 1330
cugcgcguuugauagccuc

SEQ ID NO: 441779 - RNA, 17 nt, Brucella suis 1330
cugccuuuagccaagcc

SEQ ID NO: 441780 - RNA, 15 nt, Brucella suis 1330
cugccgcaauccugg

SEQ ID NO: 441781 - RNA, 21 nt, Brucella suis 1330
cugaaaccgucacgccacggc

SEQ ID NO: 441782 - RNA, 18 nt, Brucella suis 1330
cucgguucgcuggccaug

SEQ ID NO: 441783 - RNA, 16 nt, Brucella suis 1330
cucgcuggcgcggcgg

SEQ ID NO: 441784 - RNA, 22 nt, Brucella suis 1330
cucggcaucgcucaccuuuucc

SEQ ID NO: 441785 - RNA, 15 nt, Brucella suis 1330
cucgcucaggccugu

SEQ ID NO: 441786 - RNA, 15 nt, Brucella suis 1330
cucgaaauagccgac

SEQ ID NO: 441787 - RNA, 22 nt, Brucella suis 1330
cuccgacugugauuugauccau

SEQ ID NO: 441788 - RNA, 19 nt, Brucella suis 1330
cuccgcaccgaaggcaagc

SEQ ID NO: 441789 - RNA, 14 nt, Brucella suis 1330
cucccgauaaugcg

SEQ ID NO: 441790 - RNA, 13 nt, Brucella suis 1330
cucauggcggcgc

SEQ ID NO: 441791 - RNA, 22 nt, Brucella suis 1330
cucaucaaaagcgucgcaaugc

SEQ ID NO: 441792 - RNA, 18 nt, Brucella suis 1330
cuaagcggaaaacggcug

SEQ ID NO: 441793 - RNA, 16 nt, Brucella suis 1330
cuaauggcgguuucga

SEQ ID NO: 441794 - RNA, 14 nt, Brucella suis 1330
cguuuggagcggcg

SEQ ID NO: 441795 - RNA, 16 nt, Brucella suis 1330
cuaaaccggaacggau

SEQ ID NO: 441796 - RNA, 16 nt, Brucella suis 1330
cguuggccgcggccgg

SEQ ID NO: 441797 - RNA, 14 nt, Brucella suis 1330
cguugcccaugucc

SEQ ID NO: 441798 - RNA, 21 nt, Brucella suis 1330
cguuccgugccgauuucggcg

SEQ ID NO: 441799 - RNA, 13 nt, Brucella suis 1330
cguuccagggcgc

SEQ ID NO: 441800 - RNA, 13 nt, Brucella suis 1330
cguuacuucggcg

SEQ ID NO: 441801 - RNA, 21 nt, Brucella suis 1330
cgugucauuguuaaagcggau

SEQ ID NO: 441802 - RNA, 19 nt, Brucella suis 1330
cguguagccgcgaaccguc

SEQ ID NO: 441803 - RNA, 17 nt, Brucella suis 1330
cguguacuugaucugcu

SEQ ID NO: 441804 - RNA, 21 nt, Brucella suis 1330
cguguagaacauauccgucug

SEQ ID NO: 441805 - RNA, 13 nt, Brucella suis 1330
cguggucaugcgc

SEQ ID NO: 441806 - RNA, 14 nt, Brucella suis 1330
cgugguaugccagc

SEQ ID NO: 441807 - RNA, 19 nt, Brucella suis 1330
cguggcaagcccgcugcgc

SEQ ID NO: 441808 - RNA, 19 nt, Brucella suis 1330
cguggaucgacaggcgccu

SEQ ID NO: 441809 - RNA, 21 nt, Brucella suis 1330
cgucggucaaugccaccgcga

SEQ ID NO: 441810 - RNA, 17 nt, Brucella suis 1330
cgucgggauggagcgca

SEQ ID NO: 441811 - RNA, 17 nt, Brucella suis 1330
cgucgcagacgaugugc

SEQ ID NO: 441812 - RNA, 15 nt, Brucella suis 1330
cgucgauaucgagcg

SEQ ID NO: 441813 - RNA, 19 nt, Brucella suis 1330
cguccuuuuuugaucucgg

SEQ ID NO: 441814 - RNA, 16 nt, Brucella suis 1330
cguccgccaccgccgg

SEQ ID NO: 441815 - RNA, 15 nt, Brucella suis 1330
cgucccgcccgucga

SEQ ID NO: 441816 - RNA, 23 nt, Brucella suis 1330
cgucccgcccgucgaccagcgca

SEQ ID NO: 441817 - RNA, 17 nt, Brucella suis 1330
cguccauccggcggcgc

SEQ ID NO: 441818 - RNA, 21 nt, Brucella suis 1330
cguccagaucggccuugaucg

SEQ ID NO: 441819 - RNA, 13 nt, Brucella suis 1330
cgucaggcgcauu

SEQ ID NO: 441820 - RNA, 18 nt, Brucella suis 1330
cgucacauaaagcguggc

SEQ ID NO: 441821 - RNA, 22 nt, Brucella suis 1330
cgucaaucacgccacugcccug

SEQ ID NO: 441822 - RNA, 14 nt, Brucella suis 1330
cgucaacggcaagg

SEQ ID NO: 441823 - RNA, 21 nt, Brucella suis 1330
aacccgggccaugacggcccg

SEQ ID NO: 441824 - RNA, 14 nt, Brucella suis 1330
cguaaucgccgggc

SEQ ID NO: 441825 - RNA, 21 nt, Brucella suis 1330
cguaaucacuugcaagcgcga

SEQ ID NO: 441826 - RNA, 14 nt, Brucella suis 1330
cguaaaacgcaccg

SEQ ID NO: 441827 - RNA, 16 nt, Brucella suis 1330
cgguucuugcggcguu

SEQ ID NO: 441828 - RNA, 21 nt, Brucella suis 1330
cgguucgugaagccgcuucaa

SEQ ID NO: 441829 - RNA, 14 nt, Brucella suis 1330
cgguggugccgaag

SEQ ID NO: 441830 - RNA, 13 nt, Brucella suis 1330
cgguggccuugcc

SEQ ID NO: 441831 - RNA, 19 nt, Brucella suis 1330
cggucuucauggcuugaag

SEQ ID NO: 441832 - RNA, 15 nt, Brucella suis 1330
cggucucgcgaccgg

SEQ ID NO: 441833 - RNA, 15 nt, Brucella suis 1330
cggucgucauuuccg

SEQ ID NO: 441834 - RNA, 22 nt, Brucella suis 1330
cggucggcauauuugaggcauu

SEQ ID NO: 441835 - RNA, 23 nt, Brucella suis 1330
cgggguugaucucauuucggcug

SEQ ID NO: 441836 - RNA, 16 nt, Brucella suis 1330
cgggcggccaggacaa

SEQ ID NO: 441837 - RNA, 18 nt, Brucella suis 1330
cgggccaugccugcgaag

SEQ ID NO: 441838 - RNA, 15 nt, Brucella suis 1330
cgggcaauggccgca

SEQ ID NO: 441839 - RNA, 15 nt, Brucella suis 1330
cgggauggagcgcac

SEQ ID NO: 441840 - RNA, 22 nt, Brucella suis 1330
cgggaucaaugaucuggcuugc

SEQ ID NO: 441841 - RNA, 23 nt, Brucella suis 1330
cgggaucaaugaucuggcuugca

SEQ ID NO: 441842 - RNA, 15 nt, Brucella suis 1330
cgggaaugcggaagc

SEQ ID NO: 441843 - RNA, 16 nt, Brucella suis 1330
cgggaaauaaaccguc

SEQ ID NO: 441844 - RNA, 15 nt, Brucella suis 1330
cgggaaaaaucgcgc

SEQ ID NO: 441845 - RNA, 20 nt, Brucella suis 1330
cggcuuuuuauccucccaug

SEQ ID NO: 441846 - RNA, 20 nt, Brucella suis 1330
cggcuuuacguccggcacga

SEQ ID NO: 441847 - RNA, 17 nt, Brucella suis 1330
cggcuuucgccgcccuu

SEQ ID NO: 441848 - RNA, 17 nt, Brucella suis 1330
cggcugucccugcgggc

SEQ ID NO: 441849 - RNA, 14 nt, Brucella suis 1330
cggcugcaucggcu

SEQ ID NO: 441850 - RNA, 18 nt, Brucella suis 1330
cggcgguugugcgccccg

SEQ ID NO: 441851 - RNA, 17 nt, Brucella suis 1330
cggcgguucggcugccu

SEQ ID NO: 441852 - RNA, 14 nt, Brucella suis 1330
cggcggugcggauu

SEQ ID NO: 441853 - RNA, 23 nt, Brucella suis 1330
cggcggcuuuccaguacggcgcg

SEQ ID NO: 441854 - RNA, 23 nt, Brucella suis 1330
cggcggcgucagcuugucgagcg

SEQ ID NO: 441855 - RNA, 12 nt, Brucella suis 1330
cggcggcgcggu

SEQ ID NO: 441856 - RNA, 20 nt, Brucella suis 1330
cggcggaaccauggcugcga

SEQ ID NO: 441857 - RNA, 13 nt, Brucella suis 1330
cggcggaagcggc

SEQ ID NO: 441858 - RNA, 14 nt, Brucella suis 1330
cggcggcaagcgcg

SEQ ID NO: 441859 - RNA, 10 nt, Brucella suis 1330
cggcggcacc

SEQ ID NO: 441860 - RNA, 16 nt, Brucella suis 1330
cggcgcagcgcgaccu

SEQ ID NO: 441861 - RNA, 14 nt, Brucella suis 1330
cggccuuugcgccg

SEQ ID NO: 441862 - RNA, 17 nt, Brucella suis 1330
cggccuuugcgccgggu

SEQ ID NO: 441863 - RNA, 15 nt, Brucella suis 1330
cggccugaaacagca

SEQ ID NO: 441864 - RNA, 14 nt, Brucella suis 1330
cggccugaugccuu

SEQ ID NO: 441865 - RNA, 22 nt, Brucella suis 1330
cggccaucuuccaguuccgagc

SEQ ID NO: 441866 - RNA, 14 nt, Brucella suis 1330
cggccacggcaucc

SEQ ID NO: 441867 - RNA, 22 nt, Brucella suis 1330
cggcauuauccgcaucgaucac

SEQ ID NO: 441868 - RNA, 23 nt, Brucella suis 1330
cggcauguaaaacuccgcgcgaa

SEQ ID NO: 441869 - RNA, 14 nt, Brucella suis 1330
cggcaggaucgcca

SEQ ID NO: 441870 - RNA, 16 nt, Brucella suis 1330
cggcacgacaggcuca

SEQ ID NO: 441871 - RNA, 13 nt, Brucella suis 1330
cggcaagggcaag

SEQ ID NO: 441872 - RNA, 14 nt, Brucella suis 1330
cggcaagcuugacg

SEQ ID NO: 441873 - RNA, 21 nt, Brucella suis 1330
cggcaaggccgcgcuccagau

SEQ ID NO: 441874 - RNA, 13 nt, Brucella suis 1330
cggcaagcgcaau

SEQ ID NO: 441875 - RNA, 23 nt, Brucella suis 1330
cggcaagcgcaauggccuugccg

SEQ ID NO: 441876 - RNA, 17 nt, Brucella suis 1330
cggcaagauaagcgccg

SEQ ID NO: 441877 - RNA, 17 nt, Brucella suis 1330
cggcaacuugcaacgau

SEQ ID NO: 441878 - RNA, 21 nt, Brucella suis 1330
cggcaacgccgaagcuugccg

SEQ ID NO: 441879 - RNA, 20 nt, Brucella suis 1330
cggcaaaaagcggcgucagc

SEQ ID NO: 441880 - RNA, 18 nt, Brucella suis 1330
cggauuuccaccacgcgc

SEQ ID NO: 441881 - RNA, 14 nt, Brucella suis 1330
cggauuuugccuuc

SEQ ID NO: 441882 - RNA, 14 nt, Brucella suis 1330
cggaucgcgcggca

SEQ ID NO: 441883 - RNA, 15 nt, Brucella suis 1330
cggaucaaaccggcc

SEQ ID NO: 441884 - RNA, 16 nt, Brucella suis 1330
cggauaucggcgcgga

SEQ ID NO: 441885 - RNA, 16 nt, Brucella suis 1330
cggauaagaugcgcgc

SEQ ID NO: 441886 - RNA, 19 nt, Brucella suis 1330
cggagccucaucggcgggc

SEQ ID NO: 441887 - RNA, 19 nt, Brucella suis 1330
cggagcgaccagcaacgcg

SEQ ID NO: 441888 - RNA, 18 nt, Brucella suis 1330
cggagcguccgagcggca

SEQ ID NO: 441889 - RNA, 19 nt, Brucella suis 1330
cggacugaaacugaugaug

SEQ ID NO: 441890 - RNA, 21 nt, Brucella suis 1330
cggacgagauugccgccacau

SEQ ID NO: 441891 - RNA, 23 nt, Brucella suis 1330
cggaccgugccgcuuccagcauc

SEQ ID NO: 441892 - RNA, 17 nt, Brucella suis 1330
cgcugaaugcggcaauc

SEQ ID NO: 441893 - RNA, 19 nt, Brucella suis 1330
cgcucuucggggcggccuu

SEQ ID NO: 441894 - RNA, 18 nt, Brucella suis 1330
cgcucucgcauugagcgc

SEQ ID NO: 441895 - RNA, 15 nt, Brucella suis 1330
cgcucgcauagccga

SEQ ID NO: 441896 - RNA, 22 nt, Brucella suis 1330
cgcuaucucuccuaaacucauc

SEQ ID NO: 441897 - RNA, 17 nt, Brucella suis 1330
cgcuacguggcuugaag

SEQ ID NO: 441898 - RNA, 20 nt, Brucella suis 1330
cgcguucacguaggcgcggc

SEQ ID NO: 441899 - RNA, 12 nt, Brucella suis 1330
cgcguucagcca

SEQ ID NO: 441900 - RNA, 21 nt, Brucella suis 1330
cgcguaucggcaaaugucacg

SEQ ID NO: 441901 - RNA, 16 nt, Brucella suis 1330
cgcguaagcggcaauc

SEQ ID NO: 441902 - RNA, 15 nt, Brucella suis 1330
cgcgguuugcaagcc

SEQ ID NO: 441903 - RNA, 15 nt, Brucella suis 1330
aacagccuuggcuuc

SEQ ID NO: 441904 - RNA, 17 nt, Brucella suis 1330
cgcgggggcccagaugu

SEQ ID NO: 441905 - RNA, 18 nt, Brucella suis 1330
cgcgggaaaaaucgcgcg

SEQ ID NO: 441906 - RNA, 17 nt, Brucella suis 1330
cgcggcguucggcaagu

SEQ ID NO: 441907 - RNA, 13 nt, Brucella suis 1330
aacagaugcggga

SEQ ID NO: 441908 - RNA, 13 nt, Brucella suis 1330
cgcgcucggcaag

SEQ ID NO: 441909 - RNA, 21 nt, Brucella suis 1330
cgcgcuccacauccacccgcg

SEQ ID NO: 441910 - RNA, 22 nt, Brucella suis 1330
cgcgcggucaguggaucgacau

SEQ ID NO: 441911 - RNA, 18 nt, Brucella suis 1330
cgcgcgccaucggcaagg

SEQ ID NO: 441912 - RNA, 15 nt, Brucella suis 1330
cgcgccucacccucc

SEQ ID NO: 441913 - RNA, 22 nt, Brucella suis 1330
cgcgccgcuugccagcaccagc

SEQ ID NO: 441914 - RNA, 20 nt, Brucella suis 1330
cgcgcccgucaccgcggcuu

SEQ ID NO: 441915 - RNA, 17 nt, Brucella suis 1330
cgcgccauaaaucgacg

SEQ ID NO: 441916 - RNA, 14 nt, Brucella suis 1330
cgcgauaggugacg

SEQ ID NO: 441917 - RNA, 19 nt, Brucella suis 1330
cgcgauaauauugaaacgc

SEQ ID NO: 441918 - RNA, 19 nt, Brucella suis 1330
cgcgacugucaccgccagc

SEQ ID NO: 441919 - RNA, 16 nt, Brucella suis 1330
cgccugcugccauguc

SEQ ID NO: 441920 - RNA, 17 nt, Brucella suis 1330
cgccucugucaccugac

SEQ ID NO: 441921 - RNA, 19 nt, Brucella suis 1330
cgccucuucauccggcagg

SEQ ID NO: 441922 - RNA, 20 nt, Brucella suis 1330
cgccucuucauccggcaggu

SEQ ID NO: 441923 - RNA, 14 nt, Brucella suis 1330
cgccugaaaccguc

SEQ ID NO: 441924 - RNA, 22 nt, Brucella suis 1330
cgccuacgcggggaaaucaguc

SEQ ID NO: 441925 - RNA, 24 nt, Brucella suis 1330
aacacuucgaucgacccgccaugc

SEQ ID NO: 441926 - RNA, 13 nt, Brucella suis 1330
cgccuaaggcgcg

SEQ ID NO: 441927 - RNA, 14 nt, Brucella suis 1330
cgccguugaagcug

SEQ ID NO: 441928 - RNA, 16 nt, Brucella suis 1330
cgccgugcgauagccc

SEQ ID NO: 441929 - RNA, 24 nt, Brucella suis 1330
cgccgugcgccugaggccggacgc

SEQ ID NO: 441930 - RNA, 20 nt, Brucella suis 1330
cgccggugcucugcgcccag

SEQ ID NO: 441931 - RNA, 11 nt, Brucella suis 1330
cgccgggcaau

SEQ ID NO: 441932 - RNA, 23 nt, Brucella suis 1330
cgccgggaaauuucagccaugcc

SEQ ID NO: 441933 - RNA, 16 nt, Brucella suis 1330
cgccgcggcguuucgg

SEQ ID NO: 441934 - RNA, 18 nt, Brucella suis 1330
cgccgcgcggcagcggca

SEQ ID NO: 441935 - RNA, 13 nt, Brucella suis 1330
cgccgcgcacugg

SEQ ID NO: 441936 - RNA, 19 nt, Brucella suis 1330
cgccgcgcacuggcagcau

SEQ ID NO: 441937 - RNA, 13 nt, Brucella suis 1330
cgccgauccggcg

SEQ ID NO: 441938 - RNA, 16 nt, Brucella suis 1330
cgccgaggaauuucag

SEQ ID NO: 441939 - RNA, 14 nt, Brucella suis 1330
cgccgaagccaggc

SEQ ID NO: 441940 - RNA, 15 nt, Brucella suis 1330
cgccgaaaagcgccu

SEQ ID NO: 441941 - RNA, 14 nt, Brucella suis 1330
cgcccugcgccgga

SEQ ID NO: 441942 - RNA, 17 nt, Brucella suis 1330
cgcccugaagaagcuuc

SEQ ID NO: 441943 - RNA, 20 nt, Brucella suis 1330
cgcccucgaucagcaccauc

SEQ ID NO: 441944 - RNA, 13 nt, Brucella suis 1330
cgcccuccaccgc

SEQ ID NO: 441945 - RNA, 17 nt, Brucella suis 1330
cgcccggucggaaagau

SEQ ID NO: 441946 - RNA, 19 nt, Brucella suis 1330
cgcccggcauccgaggcgc

SEQ ID NO: 441947 - RNA, 18 nt, Brucella suis 1330
cgcccgcggccacaagcg

SEQ ID NO: 441948 - RNA, 13 nt, Brucella suis 1330
cgcccgccucgca

SEQ ID NO: 441949 - RNA, 15 nt, Brucella suis 1330
cgcccgcccgccgca

SEQ ID NO: 441950 - RNA, 18 nt, Brucella suis 1330
cgcauuauccgacgcauc

SEQ ID NO: 441951 - RNA, 22 nt, Brucella suis 1330
cgcauggucucgucggcgguau

SEQ ID NO: 441952 - RNA, 20 nt, Brucella suis 1330
cgcaugauccgcuccagauu

SEQ ID NO: 441953 - RNA, 18 nt, Brucella suis 1330
cgcaucgguggcauugcc

SEQ ID NO: 441954 - RNA, 12 nt, Brucella suis 1330
cgcaucggccag

SEQ ID NO: 441955 - RNA, 18 nt, Brucella suis 1330
cgcauccgaaaugcgcgg

SEQ ID NO: 441956 - RNA, 19 nt, Brucella suis 1330
cgcauaauccucacggcca

SEQ ID NO: 441957 - RNA, 16 nt, Brucella suis 1330
cgcaguucgcgcaucg

SEQ ID NO: 441958 - RNA, 17 nt, Brucella suis 1330
cgcaggacuucacccgc

SEQ ID NO: 441959 - RNA, 20 nt, Brucella suis 1330
cgcagcaucacaugggcauu

SEQ ID NO: 441960 - RNA, 21 nt, Brucella suis 1330
cgcagaucggcgagcgccucg

SEQ ID NO: 441961 - RNA, 18 nt, Brucella suis 1330
cgcacgguaacggugcgc

SEQ ID NO: 441962 - RNA, 15 nt, Brucella suis 1330
cgcaccuuccacauu

SEQ ID NO: 441963 - RNA, 18 nt, Brucella suis 1330
cgcaccgugcuccagaua

SEQ ID NO: 441964 - RNA, 17 nt, Brucella suis 1330
cgcacauugucugaaaa

SEQ ID NO: 441965 - RNA, 17 nt, Brucella suis 1330
cgcacauaugcgauuuc

SEQ ID NO: 441966 - RNA, 18 nt, Brucella suis 1330
cgcacauaaaacgcgccg

SEQ ID NO: 441967 - RNA, 19 nt, Brucella suis 1330
cgcacaaauucauugaaau

SEQ ID NO: 441968 - RNA, 23 nt, Brucella suis 1330
cgcaauucaugcccuauaccgcc

SEQ ID NO: 441969 - RNA, 15 nt, Brucella suis 1330
cgcaagggccgcauc

SEQ ID NO: 441970 - RNA, 16 nt, Brucella suis 1330
cgcaagggccgcaucg

SEQ ID NO: 441971 - RNA, 18 nt, Brucella suis 1330
cgcaagcggcucgaccgu

SEQ ID NO: 441972 - RNA, 18 nt, Brucella suis 1330
cgcaagccaguccuugcc

SEQ ID NO: 441973 - RNA, 21 nt, Brucella suis 1330
cgcaagacccaauccgccaac

SEQ ID NO: 441974 - RNA, 19 nt, Brucella suis 1330
cgcaaaucgucggccaguu

SEQ ID NO: 441975 - RNA, 21 nt, Brucella suis 1330
cgauuguuuccagagcgguuc

SEQ ID NO: 441976 - RNA, 18 nt, Brucella suis 1330
cgaugaugaugacggcga

SEQ ID NO: 441977 - RNA, 18 nt, Brucella suis 1330
cgaugacuuccgggaauu

SEQ ID NO: 441978 - RNA, 18 nt, Brucella suis 1330
cgaucgugucgcgauggc

SEQ ID NO: 441979 - RNA, 13 nt, Brucella suis 1330
cgaucgacccgcc

SEQ ID NO: 441980 - RNA, 21 nt, Brucella suis 1330
cgaucauugccccaaggcgca

SEQ ID NO: 441981 - RNA, 22 nt, Brucella suis 1330
cgaucagggaacggucgcuauu

SEQ ID NO: 441982 - RNA, 20 nt, Brucella suis 1330
cgaucacggccauugcccaa

SEQ ID NO: 441983 - RNA, 14 nt, Brucella suis 1330
cgaucaauccggca

SEQ ID NO: 441984 - RNA, 18 nt, Brucella suis 1330
cgauagcggcgcggcagg

SEQ ID NO: 441985 - RNA, 15 nt, Brucella suis 1330
cgauaggugacgcgg

SEQ ID NO: 441986 - RNA, 21 nt, Brucella suis 1330
cgauaauaauuggcaagcgcc

SEQ ID NO: 441987 - RNA, 15 nt, Brucella suis 1330
cgaggaaaaagcccg

SEQ ID NO: 441988 - RNA, 20 nt, Brucella suis 1330
cgagcaaugcgccgugcagg

SEQ ID NO: 441989 - RNA, 23 nt, Brucella suis 1330
cgagaacggcggcggcgaugccu

SEQ ID NO: 441990 - RNA, 17 nt, Brucella suis 1330
cgacucuacgcugaucg

SEQ ID NO: 441991 - RNA, 21 nt, Brucella suis 1330
aacacaaucgccggaaccgcu

SEQ ID NO: 441992 - RNA, 14 nt, Brucella suis 1330
cgacgggcgagcgc

SEQ ID NO: 441993 - RNA, 18 nt, Brucella suis 1330
cgacgcuuuccaccggcu

SEQ ID NO: 441994 - RNA, 21 nt, Brucella suis 1330
cgaccaugagcagacggccac

SEQ ID NO: 441995 - RNA, 18 nt, Brucella suis 1330
cgaccagcaacgcgcccg

SEQ ID NO: 441996 - RNA, 17 nt, Brucella suis 1330
cgacaucgcgcuuggau

SEQ ID NO: 441997 - RNA, 15 nt, Brucella suis 1330
cgacauccaucggcu

SEQ ID NO: 441998 - RNA, 17 nt, Brucella suis 1330
cgacaaaggugcugucg

SEQ ID NO: 441999 - RNA, 13 nt, Brucella suis 1330
cgaaugcccuuga

SEQ ID NO: 442000 - RNA, 17 nt, Brucella suis 1330
cgaaucucgaucuugcu

SEQ ID NO: 442001 - RNA, 13 nt, Brucella suis 1330
cgaagcgaugacg

SEQ ID NO: 442002 - RNA, 18 nt, Brucella suis 1330
cgaagcgaugacggagcg

SEQ ID NO: 442003 - RNA, 13 nt, Brucella suis 1330
cgaacugaugcgg

SEQ ID NO: 442004 - RNA, 22 nt, Brucella suis 1330
cgaacgcgccuuuucuucaucc

SEQ ID NO: 442005 - RNA, 13 nt, Brucella suis 1330
cgaacgagcggcc

SEQ ID NO: 442006 - RNA, 19 nt, Brucella suis 1330
cgaaaugcgcucuagacgg

SEQ ID NO: 442007 - RNA, 15 nt, Brucella suis 1330
cgaaaugccgauauc

SEQ ID NO: 442008 - RNA, 20 nt, Brucella suis 1330
cgaaaucggguugacgauca

SEQ ID NO: 442009 - RNA, 22 nt, Brucella suis 1330
cgaaaucggguugacgaucacc

SEQ ID NO: 442010 - RNA, 18 nt, Brucella suis 1330
cgaaagcagacgggaagc

SEQ ID NO: 442011 - RNA, 21 nt, Brucella suis 1330
cgaaaauggugauguuugcga

SEQ ID NO: 442012 - RNA, 17 nt, Brucella suis 1330
cgaaaagugcgaagcgg

SEQ ID NO: 442013 - RNA, 20 nt, Brucella suis 1330
cgaaaaucaccauuuucgca

SEQ ID NO: 442014 - RNA, 15 nt, Brucella suis 1330
ccuuucaccaauggc

SEQ ID NO: 442015 - RNA, 23 nt, Brucella suis 1330
ccuuucgcaucagacgccgcaug

SEQ ID NO: 442016 - RNA, 13 nt, Brucella suis 1330
ccuugguugcgcg

SEQ ID NO: 442017 - RNA, 19 nt, Brucella suis 1330
ccuugauguccggcgcgcu

SEQ ID NO: 442018 - RNA, 17 nt, Brucella suis 1330
ccuugaaaucauugcgc

SEQ ID NO: 442019 - RNA, 18 nt, Brucella suis 1330
ccuucuggaagcgcgcgc

SEQ ID NO: 442020 - RNA, 13 nt, Brucella suis 1330
ccuucggcauggc

SEQ ID NO: 442021 - RNA, 15 nt, Brucella suis 1330
ccuucaucggcaagc

SEQ ID NO: 442022 - RNA, 20 nt, Brucella suis 1330
ccuucaccacgauuucgccc

SEQ ID NO: 442023 - RNA, 21 nt, Brucella suis 1330
ccuguuccgcauaggggcgca

SEQ ID NO: 442024 - RNA, 14 nt, Brucella suis 1330
ccuguucaucgggg

SEQ ID NO: 442025 - RNA, 19 nt, Brucella suis 1330
ccugucuuuuccgcugcca

SEQ ID NO: 442026 - RNA, 17 nt, Brucella suis 1330
ccucgcccugcuucaca

SEQ ID NO: 442027 - RNA, 17 nt, Brucella suis 1330
ccucgaucacccgauca

SEQ ID NO: 442028 - RNA, 13 nt, Brucella suis 1330
ccucaaucgcgcc

SEQ ID NO: 442029 - RNA, 19 nt, Brucella suis 1330
ccucaauggucacggccac

SEQ ID NO: 442030 - RNA, 13 nt, Brucella suis 1330
ccguuuugcgccc

SEQ ID NO: 442031 - RNA, 16 nt, Brucella suis 1330
ccguuugaucagccgu

SEQ ID NO: 442032 - RNA, 21 nt, Brucella suis 1330
ccguuuuaacggaaucgccgg

SEQ ID NO: 442033 - RNA, 14 nt, Brucella suis 1330
ccguuucgaucaca

SEQ ID NO: 442034 - RNA, 17 nt, Brucella suis 1330
ccguuccagggcgcgcc

SEQ ID NO: 442035 - RNA, 19 nt, Brucella suis 1330
ccguucaacuggcgcagca

SEQ ID NO: 442036 - RNA, 19 nt, Brucella suis 1330
ccgucgggaccaccggccu

SEQ ID NO: 442037 - RNA, 18 nt, Brucella suis 1330
ccgucgagcagcaucuug

SEQ ID NO: 442038 - RNA, 22 nt, Brucella suis 1330
ccguccgguugcaggcgcaggc

SEQ ID NO: 442039 - RNA, 17 nt, Brucella suis 1330
ccguaccggcaucagcc

SEQ ID NO: 442040 - RNA, 20 nt, Brucella suis 1330
ccgguggacugauuuccccg

SEQ ID NO: 442041 - RNA, 22 nt, Brucella suis 1330
ccggucucgcgaccgggcuucu

SEQ ID NO: 442042 - RNA, 17 nt, Brucella suis 1330
ccggguauucuuccaga

SEQ ID NO: 442043 - RNA, 20 nt, Brucella suis 1330
ccggggcagggcaggccggg

SEQ ID NO: 442044 - RNA, 17 nt, Brucella suis 1330
ccggggccaaaggcggc

SEQ ID NO: 442045 - RNA, 16 nt, Brucella suis 1330
ccgggcugcuuccaca

SEQ ID NO: 442046 - RNA, 11 nt, Brucella suis 1330
ccgggcucuuc

SEQ ID NO: 442047 - RNA, 20 nt, Brucella suis 1330
ccgggcucuucgcauugccg

SEQ ID NO: 442048 - RNA, 18 nt, Brucella suis 1330
aaauugacgccauugacc

SEQ ID NO: 442049 - RNA, 15 nt, Brucella suis 1330
aaauugcuccagcca

SEQ ID NO: 442050 - RNA, 17 nt, Brucella suis 1330
ccgggcagcggcgcgcc

SEQ ID NO: 442051 - RNA, 18 nt, Brucella suis 1330
ccgggcagcggcgcgcca

SEQ ID NO: 442052 - RNA, 11 nt, Brucella suis 1330
ccggcucgccg

SEQ ID NO: 442053 - RNA, 12 nt, Brucella suis 1330
ccggcgggcggg

SEQ ID NO: 442054 - RNA, 13 nt, Brucella suis 1330
ccggcggcgccca

SEQ ID NO: 442055 - RNA, 19 nt, Brucella suis 1330
ccggcggccuugaugcggc

SEQ ID NO: 442056 - RNA, 18 nt, Brucella suis 1330
ccggcgcgggcuuuccag

SEQ ID NO: 442057 - RNA, 17 nt, Brucella suis 1330
ccggcgcaguuucgcag

SEQ ID NO: 442058 - RNA, 15 nt, Brucella suis 1330
ccggccuuugcgccg

SEQ ID NO: 442059 - RNA, 18 nt, Brucella suis 1330
ccggcauggccugcgcgc

SEQ ID NO: 442060 - RNA, 21 nt, Brucella suis 1330
ccgcuuuucauguuuucccag

SEQ ID NO: 442061 - RNA, 20 nt, Brucella suis 1330
ccgcugcgccgcacgcgcga

SEQ ID NO: 442062 - RNA, 22 nt, Brucella suis 1330
ccgcggcaucccugucgccgaa

SEQ ID NO: 442063 - RNA, 15 nt, Brucella suis 1330
ccgcgacgaugggcg

SEQ ID NO: 442064 - RNA, 18 nt, Brucella suis 1330
ccgccggaaccauaucga

SEQ ID NO: 442065 - RNA, 16 nt, Brucella suis 1330
ccgcccgaauugcggc

SEQ ID NO: 442066 - RNA, 21 nt, Brucella suis 1330
ccgccauggucgcgcaccagc

SEQ ID NO: 442067 - RNA, 14 nt, Brucella suis 1330
ccgccaugcccguc

SEQ ID NO: 442068 - RNA, 18 nt, Brucella suis 1330
ccgccaagggccgccgaa

SEQ ID NO: 442069 - RNA, 17 nt, Brucella suis 1330
ccgccaaggaacgcggc

SEQ ID NO: 442070 - RNA, 19 nt, Brucella suis 1330
ccgcauugaugaagccaag

SEQ ID NO: 442071 - RNA, 12 nt, Brucella suis 1330
ccgcaccgccga

SEQ ID NO: 442072 - RNA, 19 nt, Brucella suis 1330
ccgcaauggcgacaugcug

SEQ ID NO: 442073 - RNA, 16 nt, Brucella suis 1330
ccgcaacccauuuuca

SEQ ID NO: 442074 - RNA, 13 nt, Brucella suis 1330
ccgauggcgauca

SEQ ID NO: 442075 - RNA, 23 nt, Brucella suis 1330
ccgaugcguuggaaaaugcgaca

SEQ ID NO: 442076 - RNA, 15 nt, Brucella suis 1330
ccgaugacggcgcgg

SEQ ID NO: 442077 - RNA, 22 nt, Brucella suis 1330
ccgauaagugccgcgccgauga

SEQ ID NO: 442078 - RNA, 17 nt, Brucella suis 1330
ccgaggcugaugcagca

SEQ ID NO: 442079 - RNA, 15 nt, Brucella suis 1330
ccgaggucgccaaga

SEQ ID NO: 442080 - RNA, 19 nt, Brucella suis 1330
ccgaaauagcggcccgauu

SEQ ID NO: 442081 - RNA, 24 nt, Brucella suis 1330
ccgaaaccauccaugcgcggcgaa

SEQ ID NO: 442082 - RNA, 12 nt, Brucella suis 1330
ccgaaaagccgc

SEQ ID NO: 442083 - RNA, 15 nt, Brucella suis 1330
ccgaaaagccgcgcg

SEQ ID NO: 442084 - RNA, 14 nt, Brucella suis 1330
cccugucagaaagu

SEQ ID NO: 442085 - RNA, 17 nt, Brucella suis 1330
cccugcaauaacagcgu

SEQ ID NO: 442086 - RNA, 21 nt, Brucella suis 1330
cccucuaaucgcgagcagcgc

SEQ ID NO: 442087 - RNA, 15 nt, Brucella suis 1330
cccucauggcgauaa

SEQ ID NO: 442088 - RNA, 16 nt, Brucella suis 1330
cccuccaccgcucacc

SEQ ID NO: 442089 - RNA, 18 nt, Brucella suis 1330
cccgugacaauggccguc

SEQ ID NO: 442090 - RNA, 14 nt, Brucella suis 1330
cccgggcagcggcg

SEQ ID NO: 442091 - RNA, 13 nt, Brucella suis 1330
cccggcaugaaca

SEQ ID NO: 442092 - RNA, 20 nt, Brucella suis 1330
cccggcagcgaaggcugccg

SEQ ID NO: 442093 - RNA, 21 nt, Brucella suis 1330
cccggcacgaacagaucgcca

SEQ ID NO: 442094 - RNA, 19 nt, Brucella suis 1330
cccgcgucaucgccaccau

SEQ ID NO: 442095 - RNA, 22 nt, Brucella suis 1330
cccgccuugcagaugagcggca

SEQ ID NO: 442096 - RNA, 20 nt, Brucella suis 1330
cccgcauagccaucgccgac

SEQ ID NO: 442097 - RNA, 15 nt, Brucella suis 1330
ccccggcaccgcgca

SEQ ID NO: 442098 - RNA, 19 nt, Brucella suis 1330
cccagcccuuuucagcgga

SEQ ID NO: 442099 - RNA, 20 nt, Brucella suis 1330
cccacgaggaucggcacgau

SEQ ID NO: 442100 - RNA, 17 nt, Brucella suis 1330
ccauguuuaugaaaaca

SEQ ID NO: 442101 - RNA, 16 nt, Brucella suis 1330
ccaugccuuucagguc

SEQ ID NO: 442102 - RNA, 14 nt, Brucella suis 1330
ccaugaugccgaca

SEQ ID NO: 442103 - RNA, 17 nt, Brucella suis 1330
ccaugaugccgacaagc

SEQ ID NO: 442104 - RNA, 13 nt, Brucella suis 1330
ccaucugccguca

SEQ ID NO: 442105 - RNA, 13 nt, Brucella suis 1330
ccaucugcggcgu

SEQ ID NO: 442106 - RNA, 20 nt, Brucella suis 1330
ccaucggcaaaggcuccggc

SEQ ID NO: 442107 - RNA, 18 nt, Brucella suis 1330
ccaucgcaccauugggca

SEQ ID NO: 442108 - RNA, 14 nt, Brucella suis 1330
ccaucgaaaccggc

SEQ ID NO: 442109 - RNA, 18 nt, Brucella suis 1330
ccauaucuuuccauucca

SEQ ID NO: 442110 - RNA, 16 nt, Brucella suis 1330
ccauauucguccacga

SEQ ID NO: 442111 - RNA, 17 nt, Brucella suis 1330
ccauauuggcggcaagc

SEQ ID NO: 442112 - RNA, 14 nt, Brucella suis 1330
ccauagcucgacgc

SEQ ID NO: 442113 - RNA, 13 nt, Brucella suis 1330
ccagucggcaagg

SEQ ID NO: 442114 - RNA, 15 nt, Brucella suis 1330
ccagucaaugccgug

SEQ ID NO: 442115 - RNA, 17 nt, Brucella suis 1330
ccagcgcauggcauggc

SEQ ID NO: 442116 - RNA, 16 nt, Brucella suis 1330
ccagcgaaacggcagc

SEQ ID NO: 442117 - RNA, 14 nt, Brucella suis 1330
ccagcaccgcgcca

SEQ ID NO: 442118 - RNA, 14 nt, Brucella suis 1330
ccagaccggcaauc

SEQ ID NO: 442119 - RNA, 13 nt, Brucella suis 1330
ccagaaugcgccg

SEQ ID NO: 442120 - RNA, 15 nt, Brucella suis 1330
ccagaauggcgauau

SEQ ID NO: 442121 - RNA, 14 nt, Brucella suis 1330
ccacggcuugcgcg

SEQ ID NO: 442122 - RNA, 23 nt, Brucella suis 1330
ccaccaccccuuccuugccggga

SEQ ID NO: 442123 - RNA, 18 nt, Brucella suis 1330
ccacauugccuucgcgcc

SEQ ID NO: 442124 - RNA, 22 nt, Brucella suis 1330
ccacaugaacuggcggaugaag

SEQ ID NO: 442125 - RNA, 20 nt, Brucella suis 1330
ccacauccgccaccgcgccg

SEQ ID NO: 442126 - RNA, 15 nt, Brucella suis 1330
ccacaccaucgcccg

SEQ ID NO: 442127 - RNA, 14 nt, Brucella suis 1330
ccaauaucgcgccg

SEQ ID NO: 442128 - RNA, 22 nt, Brucella suis 1330
ccaagcgucuugcgcuccacca

SEQ ID NO: 442129 - RNA, 18 nt, Brucella suis 1330
ccaagcccuuccacugca

SEQ ID NO: 442130 - RNA, 23 nt, Brucella suis 1330
ccaaaagcgcgccgaaaaucggc

SEQ ID NO: 442131 - RNA, 23 nt, Brucella suis 1330
cauuucccccaauaucgcgccgg

SEQ ID NO: 442132 - RNA, 20 nt, Brucella suis 1330
cauugucgcauccaugagca

SEQ ID NO: 442133 - RNA, 18 nt, Brucella suis 1330
cauuggugaugcgcccgu

SEQ ID NO: 442134 - RNA, 15 nt, Brucella suis 1330
cauugccuucgcgcc

SEQ ID NO: 442135 - RNA, 18 nt, Brucella suis 1330
cauugccgguugcuucca

SEQ ID NO: 442136 - RNA, 24 nt, Brucella suis 1330
cauugcccgcccgucuucggcgca

SEQ ID NO: 442137 - RNA, 19 nt, Brucella suis 1330
cauugaacgccuuuuucac

SEQ ID NO: 442138 - RNA, 14 nt, Brucella suis 1330
cauucuugcgcccu

SEQ ID NO: 442139 - RNA, 15 nt, Brucella suis 1330
cauugacggcagccu

SEQ ID NO: 442140 - RNA, 14 nt, Brucella suis 1330
cauucuguaaggcc

SEQ ID NO: 442141 - RNA, 16 nt, Brucella suis 1330
cauucaaagaucgcgu

SEQ ID NO: 442142 - RNA, 13 nt, Brucella suis 1330
cauucaaugccac

SEQ ID NO: 442143 - RNA, 15 nt, Brucella suis 1330
cauggugccagcguc

SEQ ID NO: 442144 - RNA, 18 nt, Brucella suis 1330
caugguuugcagcaauuc

SEQ ID NO: 442145 - RNA, 20 nt, Brucella suis 1330
cauggucgaugccgccgaaa

SEQ ID NO: 442146 - RNA, 14 nt, Brucella suis 1330
cauggucaggccaa

SEQ ID NO: 442147 - RNA, 21 nt, Brucella suis 1330
cauggguaccuuccagcaugg

SEQ ID NO: 442148 - RNA, 23 nt, Brucella suis 1330
caugggcggccacggcauccgca

SEQ ID NO: 442149 - RNA, 22 nt, Brucella suis 1330
cauggccugcugcauuuucugc

SEQ ID NO: 442150 - RNA, 15 nt, Brucella suis 1330
cauggcagccgauca

SEQ ID NO: 442151 - RNA, 17 nt, Brucella suis 1330
cauggcagccgaucauc

SEQ ID NO: 442152 - RNA, 15 nt, Brucella suis 1330
cauggacuuuucagc

SEQ ID NO: 442153 - RNA, 22 nt, Brucella suis 1330
cauggagauacgcuucaucgca

SEQ ID NO: 442154 - RNA, 21 nt, Brucella suis 1330
cauggaagugaauuucggcga

SEQ ID NO: 442155 - RNA, 20 nt, Brucella suis 1330
caugcugaaaucgcugaucg

SEQ ID NO: 442156 - RNA, 15 nt, Brucella suis 1330
caugcggaugacgaa

SEQ ID NO: 442157 - RNA, 11 nt, Brucella suis 1330
caucgcccgcc

SEQ ID NO: 442158 - RNA, 21 nt, Brucella suis 1330
caucgccaagcuugaucgccg

SEQ ID NO: 442159 - RNA, 22 nt, Brucella suis 1330
caucgccaagcuugaucgccgc

SEQ ID NO: 442160 - RNA, 21 nt, Brucella suis 1330
caucgcaguugcaccgcccgg

SEQ ID NO: 442161 - RNA, 23 nt, Brucella suis 1330
caucgcaguugcaccgcccggau

SEQ ID NO: 442162 - RNA, 24 nt, Brucella suis 1330
caucgcaguugcaccgcccggauc

SEQ ID NO: 442163 - RNA, 21 nt, Brucella suis 1330
caucgaggaauuuccgcuccu

SEQ ID NO: 442164 - RNA, 15 nt, Brucella suis 1330
caucgaaagcccguc

SEQ ID NO: 442165 - RNA, 19 nt, Brucella suis 1330
cauccgccuuggaugccgc

SEQ ID NO: 442166 - RNA, 22 nt, Brucella suis 1330
cauccccauugcaucgccaagc

SEQ ID NO: 442167 - RNA, 18 nt, Brucella suis 1330
cauccagaacuucgccaa

SEQ ID NO: 442168 - RNA, 19 nt, Brucella suis 1330
caucauuggcguugagccg

SEQ ID NO: 442169 - RNA, 17 nt, Brucella suis 1330
cauccacaaugauguuc

SEQ ID NO: 442170 - RNA, 19 nt, Brucella suis 1330
caucaaggaaaaaaccggc

SEQ ID NO: 442171 - RNA, 23 nt, Brucella suis 1330
cauaggccguuccgccgaucugc

SEQ ID NO: 442172 - RNA, 24 nt, Brucella suis 1330
cauaggcgaucaccucgcccugcu

SEQ ID NO: 442173 - RNA, 16 nt, Brucella suis 1330
cauauaaagcuugaac

SEQ ID NO: 442174 - RNA, 23 nt, Brucella suis 1330
cauaaaggccgaaauagcggccc

SEQ ID NO: 442175 - RNA, 13 nt, Brucella suis 1330
cauaagccccggc

SEQ ID NO: 442176 - RNA, 20 nt, Brucella suis 1330
caguuugagcaugaugccga

SEQ ID NO: 442177 - RNA, 22 nt, Brucella suis 1330
caguuuauucauuggcggcaga

SEQ ID NO: 442178 - RNA, 19 nt, Brucella suis 1330
caguucgucggccagauca

SEQ ID NO: 442179 - RNA, 15 nt, Brucella suis 1330
caguucguggcgggg

SEQ ID NO: 442180 - RNA, 15 nt, Brucella suis 1330
caguuccggcccgcg

SEQ ID NO: 442181 - RNA, 15 nt, Brucella suis 1330
caguuccacgaucug

SEQ ID NO: 442182 - RNA, 18 nt, Brucella suis 1330
caguucagcgugcgauaa

SEQ ID NO: 442183 - RNA, 21 nt, Brucella suis 1330
cagugagcagaagaaagggcg

SEQ ID NO: 442184 - RNA, 13 nt, Brucella suis 1330
cagggcauugccg

SEQ ID NO: 442185 - RNA, 20 nt, Brucella suis 1330
caggcgauccaauauugccu

SEQ ID NO: 442186 - RNA, 20 nt, Brucella suis 1330
caggcgagcauggaucgccu

SEQ ID NO: 442187 - RNA, 21 nt, Brucella suis 1330
caggcccuugccggccgagaa

SEQ ID NO: 442188 - RNA, 23 nt, Brucella suis 1330
aaagcccagccguuuugcgccca

SEQ ID NO: 442189 - RNA, 19 nt, Brucella suis 1330
caggaccacgaacgacacc

SEQ ID NO: 442190 - RNA, 21 nt, Brucella suis 1330
caggaccgcgaggaagccugc

SEQ ID NO: 442191 - RNA, 20 nt, Brucella suis 1330
caggaccgcgcagaucaucg

SEQ ID NO: 442192 - RNA, 15 nt, Brucella suis 1330
caggaauucguccug

SEQ ID NO: 442193 - RNA, 11 nt, Brucella suis 1330
cagcuugucga

SEQ ID NO: 442194 - RNA, 13 nt, Brucella suis 1330
cagcucgauaucg

SEQ ID NO: 442195 - RNA, 13 nt, Brucella suis 1330
cagcuccggguuc

SEQ ID NO: 442196 - RNA, 19 nt, Brucella suis 1330
cagcgccggggccaaaggc

SEQ ID NO: 442197 - RNA, 15 nt, Brucella suis 1330
cagcgaugauagcgc

SEQ ID NO: 442198 - RNA, 18 nt, Brucella suis 1330
cagcgauugcaccauggu

SEQ ID NO: 442199 - RNA, 19 nt, Brucella suis 1330
cagcgcauaaaggccgaaa

SEQ ID NO: 442200 - RNA, 16 nt, Brucella suis 1330
cagcgacagcggcgcg

SEQ ID NO: 442201 - RNA, 14 nt, Brucella suis 1330
cagccugcgaggau

SEQ ID NO: 442202 - RNA, 15 nt, Brucella suis 1330
cagccugaacagcgu

SEQ ID NO: 442203 - RNA, 17 nt, Brucella suis 1330
cagccgaucaucagcga

SEQ ID NO: 442204 - RNA, 19 nt, Brucella suis 1330
cagccgcgaucacagccgc

SEQ ID NO: 442205 - RNA, 16 nt, Brucella suis 1330
cagcaucacaugggca

SEQ ID NO: 442206 - RNA, 14 nt, Brucella suis 1330
cagcagcaucgccg

SEQ ID NO: 442207 - RNA, 15 nt, Brucella suis 1330
cagcagcaucgccgc

SEQ ID NO: 442208 - RNA, 17 nt, Brucella suis 1330
cagcagauugcggaucg

SEQ ID NO: 442209 - RNA, 16 nt, Brucella suis 1330
cagcacgugcccguuc

SEQ ID NO: 442210 - RNA, 21 nt, Brucella suis 1330
cagauagccggugcugucgcc

SEQ ID NO: 442211 - RNA, 17 nt, Brucella suis 1330
cagacgguccgccggau

SEQ ID NO: 442212 - RNA, 22 nt, Brucella suis 1330
cagaagcgcguccuucaggccg

SEQ ID NO: 442213 - RNA, 14 nt, Brucella suis 1330
cagaagccgcuugc

SEQ ID NO: 442214 - RNA, 14 nt, Brucella suis 1330
cagaaggaugaucg

SEQ ID NO: 442215 - RNA, 15 nt, Brucella suis 1330
cagaaggcgcugcac

SEQ ID NO: 442216 - RNA, 16 nt, Brucella suis 1330
cagaaggcgggaaggc

SEQ ID NO: 442217 - RNA, 18 nt, Brucella suis 1330
cagaaagaaagcugucgc

SEQ ID NO: 442218 - RNA, 22 nt, Brucella suis 1330
cagaagcaccagcgcgccgauc

SEQ ID NO: 442219 - RNA, 22 nt, Brucella suis 1330
cacuggucgggauugucgauau

SEQ ID NO: 442220 - RNA, 20 nt, Brucella suis 1330
cacguccggcacuucgccca

SEQ ID NO: 442221 - RNA, 13 nt, Brucella suis 1330
cacggccgaucgc

SEQ ID NO: 442222 - RNA, 20 nt, Brucella suis 1330
cacggauuuccaccacgcgc

SEQ ID NO: 442223 - RNA, 17 nt, Brucella suis 1330
cacgcuccacacgaaca

SEQ ID NO: 442224 - RNA, 23 nt, Brucella suis 1330
cacgcgcuuguaggugaucguau

SEQ ID NO: 442225 - RNA, 18 nt, Brucella suis 1330
cacgcgcgaaaccaugga

SEQ ID NO: 442226 - RNA, 13 nt, Brucella suis 1330
cacgcgccgacaa

SEQ ID NO: 442227 - RNA, 14 nt, Brucella suis 1330
cacgcgccgccauc

SEQ ID NO: 442228 - RNA, 16 nt, Brucella suis 1330
caccggaucggugcgc

SEQ ID NO: 442229 - RNA, 14 nt, Brucella suis 1330
caccgccgaucagg

SEQ ID NO: 442230 - RNA, 19 nt, Brucella suis 1330
caccgauggagcgcccgau

SEQ ID NO: 442231 - RNA, 14 nt, Brucella suis 1330
caccgaagccacga

SEQ ID NO: 442232 - RNA, 20 nt, Brucella suis 1330
cacccuugaucguauagccc

SEQ ID NO: 442233 - RNA, 22 nt, Brucella suis 1330
cacccuuggcgacggccagcgc

SEQ ID NO: 442234 - RNA, 18 nt, Brucella suis 1330
cacccuuuucgggaugcg

SEQ ID NO: 442235 - RNA, 14 nt, Brucella suis 1330
cacccgaaacggug

SEQ ID NO: 442236 - RNA, 15 nt, Brucella suis 1330
caccauucuugcgcc

SEQ ID NO: 442237 - RNA, 23 nt, Brucella suis 1330
caccauggugucauagaccauga

SEQ ID NO: 442238 - RNA, 16 nt, Brucella suis 1330
caccauauuugccgcc

SEQ ID NO: 442239 - RNA, 12 nt, Brucella suis 1330
cacauugccuuc

SEQ ID NO: 442240 - RNA, 19 nt, Brucella suis 1330
caccaaaagagcgcucgcg

SEQ ID NO: 442241 - RNA, 22 nt, Brucella suis 1330
cacauaaucgcccucgaucagc

SEQ ID NO: 442242 - RNA, 14 nt, Brucella suis 1330
cacaaagaacaagc

SEQ ID NO: 442243 - RNA, 13 nt, Brucella suis 1330
caauuccugcgcc

SEQ ID NO: 442244 - RNA, 14 nt, Brucella suis 1330
caaugaucuggcuu

SEQ ID NO: 442245 - RNA, 18 nt, Brucella suis 1330
caaugauguucggcaagg

SEQ ID NO: 442246 - RNA, 18 nt, Brucella suis 1330
caauccggcgugaucggg

SEQ ID NO: 442247 - RNA, 19 nt, Brucella suis 1330
caaucagaucgaaacccgc

SEQ ID NO: 442248 - RNA, 21 nt, Brucella suis 1330
caaggcgcagauagccuuuca

SEQ ID NO: 442249 - RNA, 18 nt, Brucella suis 1330
caaggccgcgcuccagau

SEQ ID NO: 442250 - RNA, 20 nt, Brucella suis 1330
caaggcccucgcggaucagc

SEQ ID NO: 442251 - RNA, 17 nt, Brucella suis 1330
caaggccccagaucagc

SEQ ID NO: 442252 - RNA, 20 nt, Brucella suis 1330
caagcuugaucgccgcacgg

SEQ ID NO: 442253 - RNA, 14 nt, Brucella suis 1330
caagcuuuugcagc

SEQ ID NO: 442254 - RNA, 18 nt, Brucella suis 1330
caaggaaaaaaccggcga

SEQ ID NO: 442255 - RNA, 22 nt, Brucella suis 1330
caagcucgacccagcuaaggcc

SEQ ID NO: 442256 - RNA, 15 nt, Brucella suis 1330
caagaucagccacau

SEQ ID NO: 442257 - RNA, 15 nt, Brucella suis 1330
caacgccguggcggc

SEQ ID NO: 442258 - RNA, 16 nt, Brucella suis 1330
caacgcuggcgcgcug

SEQ ID NO: 442259 - RNA, 16 nt, Brucella suis 1330
caaccccaaauaccgc

SEQ ID NO: 442260 - RNA, 16 nt, Brucella suis 1330
caacauuugcucaacg

SEQ ID NO: 442261 - RNA, 19 nt, Brucella suis 1330
caacagggcgaaaagccgc

SEQ ID NO: 442262 - RNA, 21 nt, Brucella suis 1330
caacacgccgccgcgcggcag

SEQ ID NO: 442263 - RNA, 15 nt, Brucella suis 1330
caaagcgcggaauga

SEQ ID NO: 442264 - RNA, 15 nt, Brucella suis 1330
caaagccgaaugcca

SEQ ID NO: 442265 - RNA, 22 nt, Brucella suis 1330
auuguuccggcacucgaaaauc

SEQ ID NO: 442266 - RNA, 21 nt, Brucella suis 1330
auugaucuucuugcauucgcu

SEQ ID NO: 442267 - RNA, 16 nt, Brucella suis 1330
auugcacagcggucga

SEQ ID NO: 442268 - RNA, 22 nt, Brucella suis 1330
auugaacugcggcugcaucggc

SEQ ID NO: 442269 - RNA, 20 nt, Brucella suis 1330
auucuugcgaaccaucacga

SEQ ID NO: 442270 - RNA, 16 nt, Brucella suis 1330
auucgcuguugcgccc

SEQ ID NO: 442271 - RNA, 16 nt, Brucella suis 1330
auucugaaugacgacc

SEQ ID NO: 442272 - RNA, 17 nt, Brucella suis 1330
auuccuucuccaucugc

SEQ ID NO: 442273 - RNA, 13 nt, Brucella suis 1330
auguguccggcgu

SEQ ID NO: 442274 - RNA, 19 nt, Brucella suis 1330
auguuccgcaccgcacugg

SEQ ID NO: 442275 - RNA, 18 nt, Brucella suis 1330
auuauacaugcuuucgac

SEQ ID NO: 442276 - RNA, 23 nt, Brucella suis 1330
auucaaccauauaaagcuugaac

SEQ ID NO: 442277 - RNA, 22 nt, Brucella suis 1330
augguggugguagcgcccggug

SEQ ID NO: 442278 - RNA, 16 nt, Brucella suis 1330
auggugcggaacaaug

SEQ ID NO: 442279 - RNA, 17 nt, Brucella suis 1330
auggucgaugccgccga

SEQ ID NO: 442280 - RNA, 14 nt, Brucella suis 1330
augggccggucuuc

SEQ ID NO: 442281 - RNA, 21 nt, Brucella suis 1330
augggcaccugggccacggcg

SEQ ID NO: 442282 - RNA, 13 nt, Brucella suis 1330
auggcuugaagcg

SEQ ID NO: 442283 - RNA, 14 nt, Brucella suis 1330
auggcggcgcucgg

SEQ ID NO: 442284 - RNA, 14 nt, Brucella suis 1330
auggccugcgcgcg

SEQ ID NO: 442285 - RNA, 16 nt, Brucella suis 1330
auggccugcgcgcgca

SEQ ID NO: 442286 - RNA, 21 nt, Brucella suis 1330
auggccuuugcagaaccaggc

SEQ ID NO: 442287 - RNA, 18 nt, Brucella suis 1330
augcguugcuggaacauc

SEQ ID NO: 442288 - RNA, 16 nt, Brucella suis 1330
augcgucgauggccgg

SEQ ID NO: 442289 - RNA, 23 nt, Brucella suis 1330
augcgcuucgcgcaggccgcggc

SEQ ID NO: 442290 - RNA, 20 nt, Brucella suis 1330
augcgcuucuuccuucggca

SEQ ID NO: 442291 - RNA, 18 nt, Brucella suis 1330
augcgcaauugcgcgccu

SEQ ID NO: 442292 - RNA, 15 nt, Brucella suis 1330
augcgcacauauuug

SEQ ID NO: 442293 - RNA, 17 nt, Brucella suis 1330
augccgggcacgaaaag

SEQ ID NO: 442294 - RNA, 13 nt, Brucella suis 1330
augccggaaccgc

SEQ ID NO: 442295 - RNA, 16 nt, Brucella suis 1330
augccgccaaggccgg

SEQ ID NO: 442296 - RNA, 16 nt, Brucella suis 1330
augccgaucaucgccu

SEQ ID NO: 442297 - RNA, 18 nt, Brucella suis 1330
augaucgcccgcccggca

SEQ ID NO: 442298 - RNA, 15 nt, Brucella suis 1330
augaaugccgaagcc

SEQ ID NO: 442299 - RNA, 22 nt, Brucella suis 1330
aucuucucgaacugguucagcc

SEQ ID NO: 442300 - RNA, 23 nt, Brucella suis 1330
aucuuauaaaaaggccgcucuuc

SEQ ID NO: 442301 - RNA, 21 nt, Brucella suis 1330
aucugcucguccggccagccg

SEQ ID NO: 442302 - RNA, 22 nt, Brucella suis 1330
aucugcgcgucgagcaaugcgc

SEQ ID NO: 442303 - RNA, 11 nt, Brucella suis 1330
aucucgcccag

SEQ ID NO: 442304 - RNA, 11 nt, Brucella suis 1330
aucuccggcgc

SEQ ID NO: 442305 - RNA, 14 nt, Brucella suis 1330
aucucgaaaugcgc

SEQ ID NO: 442306 - RNA, 22 nt, Brucella suis 1330
aucguuuuguugcacuccggcu

SEQ ID NO: 442307 - RNA, 22 nt, Brucella suis 1330
aucggccuugaaaccaaagcgu

SEQ ID NO: 442308 - RNA, 18 nt, Brucella suis 1330
aucggccauuucggcuuc

SEQ ID NO: 442309 - RNA, 17 nt, Brucella suis 1330
aucgcuuucgagcggau

SEQ ID NO: 442310 - RNA, 20 nt, Brucella suis 1330
aucggaaccccaaugcucga

SEQ ID NO: 442311 - RNA, 23 nt, Brucella suis 1330
aucgcuucacgcggcugcucgac

SEQ ID NO: 442312 - RNA, 22 nt, Brucella suis 1330
aucgcucaccuuuuccaccggc

SEQ ID NO: 442313 - RNA, 17 nt, Brucella suis 1330
aucgcggcagccgccgc

SEQ ID NO: 442314 - RNA, 22 nt, Brucella suis 1330
aucgcgcguaucgacaccgcca

SEQ ID NO: 442315 - RNA, 17 nt, Brucella suis 1330
aucgcgccggggccgac

SEQ ID NO: 442316 - RNA, 20 nt, Brucella suis 1330
aucgcgccgucgccgaccgc

SEQ ID NO: 442317 - RNA, 17 nt, Brucella suis 1330
aucgcgauaauauugaa

SEQ ID NO: 442318 - RNA, 13 nt, Brucella suis 1330
aucgccaauuccg

SEQ ID NO: 442319 - RNA, 16 nt, Brucella suis 1330
aucgccaauuccgccg

SEQ ID NO: 442320 - RNA, 21 nt, Brucella suis 1330
aucgcaggcuuuauuccauca

SEQ ID NO: 442321 - RNA, 13 nt, Brucella suis 1330
aucgcacgauagc

SEQ ID NO: 442322 - RNA, 23 nt, Brucella suis 1330
aucgauuucguccagaucggccu

SEQ ID NO: 442323 - RNA, 15 nt, Brucella suis 1330
aucgaucacggcgcc

SEQ ID NO: 442324 - RNA, 21 nt, Brucella suis 1330
aucgacauauuugucgccgac

SEQ ID NO: 442325 - RNA, 19 nt, Brucella suis 1330
aucaggauuugggaucggc

SEQ ID NO: 442326 - RNA, 18 nt, Brucella suis 1330
aucagcgcgccggucuuc

SEQ ID NO: 442327 - RNA, 11 nt, Brucella suis 1330
aucagauagcc

SEQ ID NO: 442328 - RNA, 23 nt, Brucella suis 1330
aucacgucggucaaugccaccgc

SEQ ID NO: 442329 - RNA, 15 nt, Brucella suis 1330
aucaccaauauugca

SEQ ID NO: 442330 - RNA, 21 nt, Brucella suis 1330
auaucgccagaauggcgauau

SEQ ID NO: 442331 - RNA, 22 nt, Brucella suis 1330
auaucgccgacgauuucuucca

SEQ ID NO: 442332 - RNA, 14 nt, Brucella suis 1330
auagcgcaucgcca

SEQ ID NO: 442333 - RNA, 13 nt, Brucella suis 1330
auagcgaauggca

SEQ ID NO: 442334 - RNA, 17 nt, Brucella suis 1330
auaguuagagcggcucc

SEQ ID NO: 442335 - RNA, 19 nt, Brucella suis 1330
auagacaugcggcaguccg

SEQ ID NO: 442336 - RNA, 20 nt, Brucella suis 1330
auacguaaaaaggccgcgcg

SEQ ID NO: 442337 - RNA, 17 nt, Brucella suis 1330
auacaugcagaucgcau

SEQ ID NO: 442338 - RNA, 14 nt, Brucella suis 1330
aguuuguugaaaca

SEQ ID NO: 442339 - RNA, 14 nt, Brucella suis 1330
auaacgacgcccgc

SEQ ID NO: 442340 - RNA, 20 nt, Brucella suis 1330
auaacgcuugcagagcgcau

SEQ ID NO: 442341 - RNA, 19 nt, Brucella suis 1330
aguugacgaguuugccguc

SEQ ID NO: 442342 - RNA, 22 nt, Brucella suis 1330
aguuccugcgcgaacacgauga

SEQ ID NO: 442343 - RNA, 18 nt, Brucella suis 1330
aguggucugggcgaugag

SEQ ID NO: 442344 - RNA, 22 nt, Brucella suis 1330
aguggaucuuugaaaccggcca

SEQ ID NO: 442345 - RNA, 20 nt, Brucella suis 1330
aggucacgcccaugaucgcg

SEQ ID NO: 442346 - RNA, 15 nt, Brucella suis 1330
agggccgaugccgau

SEQ ID NO: 442347 - RNA, 14 nt, Brucella suis 1330
aggcgggaaggcaa

SEQ ID NO: 442348 - RNA, 15 nt, Brucella suis 1330
aggcggaugcgcggc

SEQ ID NO: 442349 - RNA, 17 nt, Brucella suis 1330
aggcgagcauggaucgc

SEQ ID NO: 442350 - RNA, 20 nt, Brucella suis 1330
aggccucgaaauagccgacc

SEQ ID NO: 442351 - RNA, 20 nt, Brucella suis 1330
aggccgguaauaacuuccgg

SEQ ID NO: 442352 - RNA, 19 nt, Brucella suis 1330
aggccgcucuucggggcgg

SEQ ID NO: 442353 - RNA, 18 nt, Brucella suis 1330
aggccgcgaucacggcca

SEQ ID NO: 442354 - RNA, 22 nt, Brucella suis 1330
aggccgaggcaaccgccucggc

SEQ ID NO: 442355 - RNA, 14 nt, Brucella suis 1330
aggccgagcgccgc

SEQ ID NO: 442356 - RNA, 18 nt, Brucella suis 1330
aggcccggugcaaucggc

SEQ ID NO: 442357 - RNA, 13 nt, Brucella suis 1330
aggcccaggccuu

SEQ ID NO: 442358 - RNA, 18 nt, Brucella suis 1330
aggcauaguggcggggug

SEQ ID NO: 442359 - RNA, 19 nt, Brucella suis 1330
aggcauaauaggcaucggc

SEQ ID NO: 442360 - RNA, 18 nt, Brucella suis 1330
aggcagcgcgguuuuugc

SEQ ID NO: 442361 - RNA, 14 nt, Brucella suis 1330
agcugagcuacggg

SEQ ID NO: 442362 - RNA, 20 nt, Brucella suis 1330
agcgugcuuccggguuuugu

SEQ ID NO: 442363 - RNA, 22 nt, Brucella suis 1330
agcggcuucagaucgcgcggcg

SEQ ID NO: 442364 - RNA, 16 nt, Brucella suis 1330
agcggcaggccgaagg

SEQ ID NO: 442365 - RNA, 17 nt, Brucella suis 1330
agcggcaggccgcaaag

SEQ ID NO: 442366 - RNA, 14 nt, Brucella suis 1330
agcggcagcagcca

SEQ ID NO: 442367 - RNA, 15 nt, Brucella suis 1330
agcggcacuucgccg

SEQ ID NO: 442368 - RNA, 21 nt, Brucella suis 1330
agcggcagaccugcgcaauga

SEQ ID NO: 442369 - RNA, 20 nt, Brucella suis 1330
agcggcacguaaucgcguuc

SEQ ID NO: 442370 - RNA, 22 nt, Brucella suis 1330
agcggaucgcgucccuugccgc

SEQ ID NO: 442371 - RNA, 18 nt, Brucella suis 1330
agcgcgcgugagcgcgca

SEQ ID NO: 442372 - RNA, 21 nt, Brucella suis 1330
agcgcggagcaacaccccgcg

SEQ ID NO: 442373 - RNA, 20 nt, Brucella suis 1330
agcgcgaagaccuucuggaa

SEQ ID NO: 442374 - RNA, 18 nt, Brucella suis 1330
agcgccuuugccgcgcga

SEQ ID NO: 442375 - RNA, 11 nt, Brucella suis 1330
agcgccgccgc

SEQ ID NO: 442376 - RNA, 20 nt, Brucella suis 1330
agcgccgaggcgcagguccg

SEQ ID NO: 442377 - RNA, 12 nt, Brucella suis 1330
agcgccgauacc

SEQ ID NO: 442378 - RNA, 16 nt, Brucella suis 1330
agcgcaagaaggcguu

SEQ ID NO: 442379 - RNA, 19 nt, Brucella suis 1330
agcgagcgcacauaaaacg

SEQ ID NO: 442380 - RNA, 16 nt, Brucella suis 1330
agcgacguagggcgcg

SEQ ID NO: 442381 - RNA, 15 nt, Brucella suis 1330
agcgacagcggcgcg

SEQ ID NO: 442382 - RNA, 19 nt, Brucella suis 1330
agcgacaggguaagcgccu

SEQ ID NO: 442383 - RNA, 23 nt, Brucella suis 1330
aaacgcguuccuucggagcgcgu

SEQ ID NO: 442384 - RNA, 16 nt, Brucella suis 1330
aaacgcugccagccgc

SEQ ID NO: 442385 - RNA, 23 nt, Brucella suis 1330
aaacgccgucuauaaacagcguu

SEQ ID NO: 442386 - RNA, 20 nt, Brucella suis 1330
agcgaauagggaaacggcca

SEQ ID NO: 442387 - RNA, 17 nt, Brucella suis 1330
agccgguagccuuuuug

SEQ ID NO: 442388 - RNA, 15 nt, Brucella suis 1330
agccgaauuccgcca

SEQ ID NO: 442389 - RNA, 14 nt, Brucella suis 1330
agcccagcgccuuc

SEQ ID NO: 442390 - RNA, 15 nt, Brucella suis 1330
agcccaaagcgguuu

SEQ ID NO: 442391 - RNA, 17 nt, Brucella suis 1330
agcaucagcuugcccau

SEQ ID NO: 442392 - RNA, 15 nt, Brucella suis 1330
agcaggaucgacagc

SEQ ID NO: 442393 - RNA, 13 nt, Brucella suis 1330
agcaggaucggca

SEQ ID NO: 442394 - RNA, 23 nt, Brucella suis 1330
agcagauccgugaugauggcgag

SEQ ID NO: 442395 - RNA, 14 nt, Brucella suis 1330
agcacugaaacggg

SEQ ID NO: 442396 - RNA, 17 nt, Brucella suis 1330
agcacugaaacgggacc

SEQ ID NO: 442397 - RNA, 15 nt, Brucella suis 1330
acuucuucaccagcc

SEQ ID NO: 442398 - RNA, 20 nt, Brucella suis 1330
acuucagccagaaucugcgc

SEQ ID NO: 442399 - RNA, 18 nt, Brucella suis 1330
acuggaaauauucgggcg

SEQ ID NO: 442400 - RNA, 13 nt, Brucella suis 1330
acugcgaaagcgc

SEQ ID NO: 442401 - RNA, 15 nt, Brucella suis 1330
acucgaacaggccca

SEQ ID NO: 442402 - RNA, 21 nt, Brucella suis 1330
acuauuuccaucgcuugaacc

SEQ ID NO: 442403 - RNA, 14 nt, Brucella suis 1330
acgucuucggcgcc

SEQ ID NO: 442404 - RNA, 13 nt, Brucella suis 1330
acgggcaggcaga

SEQ ID NO: 442405 - RNA, 18 nt, Brucella suis 1330
acgggcuugucgcagccc

SEQ ID NO: 442406 - RNA, 13 nt, Brucella suis 1330
acggcgcggcgca

SEQ ID NO: 442407 - RNA, 20 nt, Brucella suis 1330
acggcgcagcgacuuccagu

SEQ ID NO: 442408 - RNA, 19 nt, Brucella suis 1330
acggcgaaagcugccgcga

SEQ ID NO: 442409 - RNA, 16 nt, Brucella suis 1330
aaaccauggagcgcau

SEQ ID NO: 442410 - RNA, 17 nt, Brucella suis 1330
acgcggauaucggcgcg

SEQ ID NO: 442411 - RNA, 12 nt, Brucella suis 1330
acgcgccgauac

SEQ ID NO: 442412 - RNA, 16 nt, Brucella suis 1330
acgcgagcgcagcggc

SEQ ID NO: 442413 - RNA, 24 nt, Brucella suis 1330
acgccuuauaggcgcgcgccucga

SEQ ID NO: 442414 - RNA, 14 nt, Brucella suis 1330
acgccugccgcgcg

SEQ ID NO: 442415 - RNA, 16 nt, Brucella suis 1330
acgccuaaggcgcgca

SEQ ID NO: 442416 - RNA, 15 nt, Brucella suis 1330
acgccggcaucaaac

SEQ ID NO: 442417 - RNA, 17 nt, Brucella suis 1330
acgccgcuccagccgag

SEQ ID NO: 442418 - RNA, 21 nt, Brucella suis 1330
acgccgaggaauuucagcgaa

SEQ ID NO: 442419 - RNA, 19 nt, Brucella suis 1330
acgcaggcgagaugccgug

SEQ ID NO: 442420 - RNA, 16 nt, Brucella suis 1330
acgaugcgcagccgcg

SEQ ID NO: 442421 - RNA, 21 nt, Brucella suis 1330
accugccaucaccagccccca

SEQ ID NO: 442422 - RNA, 22 nt, Brucella suis 1330
accggcuucggccauuucaggu

SEQ ID NO: 442423 - RNA, 23 nt, Brucella suis 1330
accggcuggucaauaucgcgcag

SEQ ID NO: 442424 - RNA, 15 nt, Brucella suis 1330
accggcucugcggaa

SEQ ID NO: 442425 - RNA, 20 nt, Brucella suis 1330
accggccauaugaacgcuga

SEQ ID NO: 442426 - RNA, 16 nt, Brucella suis 1330
accggcauugagccgc

SEQ ID NO: 442427 - RNA, 17 nt, Brucella suis 1330
accggcauugagccgcg

SEQ ID NO: 442428 - RNA, 19 nt, Brucella suis 1330
accggcauugagccgcgcg

SEQ ID NO: 442429 - RNA, 16 nt, Brucella suis 1330
accggaacggauaacg

SEQ ID NO: 442430 - RNA, 15 nt, Brucella suis 1330
accgcgccggaaggc

SEQ ID NO: 442431 - RNA, 17 nt, Brucella suis 1330
accgcgccggaaggcgg

SEQ ID NO: 442432 - RNA, 15 nt, Brucella suis 1330
accgccuuuuccagu

SEQ ID NO: 442433 - RNA, 18 nt, Brucella suis 1330
accgcgaaagcacccgcu

SEQ ID NO: 442434 - RNA, 19 nt, Brucella suis 1330
acccuuuuucaugcaugau

SEQ ID NO: 442435 - RNA, 17 nt, Brucella suis 1330
acccuucaacagcccga

SEQ ID NO: 442436 - RNA, 14 nt, Brucella suis 1330
acccggucuugagc

SEQ ID NO: 442437 - RNA, 19 nt, Brucella suis 1330
acccgaaacgguggccuuc

SEQ ID NO: 442438 - RNA, 12 nt, Brucella suis 1330
accccaugguuu

SEQ ID NO: 442439 - RNA, 12 nt, Brucella suis 1330
acccaaccacca

SEQ ID NO: 442440 - RNA, 17 nt, Brucella suis 1330
accacgauuucgcccac

SEQ ID NO: 442441 - RNA, 22 nt, Brucella suis 1330
accacaccaucgcccgccgcga

SEQ ID NO: 442442 - RNA, 14 nt, Brucella suis 1330
accacagccgguuc

SEQ ID NO: 442443 - RNA, 15 nt, Brucella suis 1330
accaagcaggccgcg

SEQ ID NO: 442444 - RNA, 20 nt, Brucella suis 1330
acauuggaguuugacaagau

SEQ ID NO: 442445 - RNA, 20 nt, Brucella suis 1330
acauugauauucaugaccuu

SEQ ID NO: 442446 - RNA, 14 nt, Brucella suis 1330
acaugggccgggcg

SEQ ID NO: 442447 - RNA, 16 nt, Brucella suis 1330
acauccaucggcucau

SEQ ID NO: 442448 - RNA, 16 nt, Brucella suis 1330
acaucgcaucggucag

SEQ ID NO: 442449 - RNA, 12 nt, Brucella suis 1330
acauauugcccu

SEQ ID NO: 442450 - RNA, 16 nt, Brucella suis 1330
acagugacgcgcgcau

SEQ ID NO: 442451 - RNA, 20 nt, Brucella suis 1330
acagccccgcaauaacgaau

SEQ ID NO: 442452 - RNA, 22 nt, Brucella suis 1330
aaugucaguugaucgcgauaau

SEQ ID NO: 442453 - RNA, 11 nt, Brucella suis 1330
aaugagcgcgc

SEQ ID NO: 442454 - RNA, 13 nt, Brucella suis 1330
aaucugacccggc

SEQ ID NO: 442455 - RNA, 21 nt, Brucella suis 1330
aaucgugccgguaacgaugau

SEQ ID NO: 442456 - RNA, 17 nt, Brucella suis 1330
aaucgaugacaucuucu

SEQ ID NO: 442457 - RNA, 16 nt, Brucella suis 1330
aauccgcaauggcccg

SEQ ID NO: 442458 - RNA, 14 nt, Brucella suis 1330
aauagcauggcccc

SEQ ID NO: 442459 - RNA, 23 nt, Brucella suis 1330
aaggggcaaauuucagucccgca

SEQ ID NO: 442460 - RNA, 17 nt, Brucella suis 1330
aagggcgcggugccgga

SEQ ID NO: 442461 - RNA, 20 nt, Brucella suis 1330
aagggcggcuuucgccgccc

SEQ ID NO: 442462 - RNA, 17 nt, Brucella suis 1330
aagcuugaucgccgcac

SEQ ID NO: 442463 - RNA, 12 nt, Brucella suis 1330
aagcgcgcgcca

SEQ ID NO: 442464 - RNA, 22 nt, Brucella suis 1330
aagcgcgccaucggcacggcgu

SEQ ID NO: 442465 - RNA, 23 nt, Brucella suis 1330
aagcccggcgauuucgccgggcu

SEQ ID NO: 442466 - RNA, 21 nt, Brucella suis 1330
aagcccaagaaagaucagcca

SEQ ID NO: 442467 - RNA, 13 nt, Brucella suis 1330
aagcaggaucggc

SEQ ID NO: 442468 - RNA, 21 nt, Brucella suis 1330
aagcaccagcgcgccgaucac

SEQ ID NO: 442469 - RNA, 17 nt, Brucella suis 1330
aagcaccaugagcgccg

SEQ ID NO: 442470 - RNA, 13 nt, Brucella suis 1330
aagcaccgaucac

SEQ ID NO: 442471 - RNA, 13 nt, Brucella suis 1330
aacgguucguccu

SEQ ID NO: 442472 - RNA, 20 nt, Brucella suis 1330
aacguacaccgaggccgcca

SEQ ID NO: 442473 - RNA, 15 nt, Brucella suis 1330
aacggaucaggcgcc

SEQ ID NO: 442474 - RNA, 14 nt, Brucella suis 1330
aacggcguccuuca

SEQ ID NO: 442475 - RNA, 21 nt, Brucella suis 1330
aacgcuugcagagcgcaucca

SEQ ID NO: 442476 - RNA, 17 nt, Brucella suis 1330
aaccgaugacgagccuc

SEQ ID NO: 442477 - RNA, 16 nt, Brucella suis 1330
aaccgaagaaugcgca

SEQ ID NO: 442478 - RNA, 21 nt, Brucella suis 1330
aaccgaagaaugcgcagccgu

SEQ ID NO: 442479 - RNA, 23 nt, Brucella suis 1330
aaccccggcagccuucgcugccg

SEQ ID NO: 442480 - RNA, 16 nt, Brucella suis 1330
aaccccaaugcucgau

SEQ ID NO: 442481 - RNA, 16 nt, Brucella suis 1330
aaccaucgagcauuuc

SEQ ID NO: 442482 - RNA, 13 nt, Brucella suis 1330
aaccaaagcgucc

SEQ ID NO: 442483 - RNA, 21 nt, Brucella suis 1330
aacaugcacauccucggcccu

SEQ ID NO: 442484 - RNA, 23 nt, Brucella suis 1330
aacagcccgaacaauuugcgggc

SEQ ID NO: 442485 - RNA, 20 nt, Brucella suis 1330
aacagcguuuccaugcggua

SEQ ID NO: 442486 - RNA, 15 nt, Brucella suis 1330
aacagguugcgccac

SEQ ID NO: 442487 - RNA, 14 nt, Brucella suis 1330
aacaagaagcuucu

SEQ ID NO: 442488 - RNA, 19 nt, Brucella suis 1330
aaaagcgucgcaaugccga

SEQ ID NO: 442489 - RNA, 17 nt, Brucella suis 1330
aaaaggaugaaugccga

SEQ ID NO: 442490 - RNA, 13 nt, Brucella suis 1330
aacaacgggguug

SEQ ID NO: 442491 - RNA, 12 nt, Brucella suis 1330
aaaugcgcgcgg

SEQ ID NO: 442492 - RNA, 23 nt, Brucella suis 1330
aaauggugcugccauggcaguga

SEQ ID NO: 442493 - RNA, 22 nt, Brucella suis 1330
aaaagcacacggucaugcaggc

SEQ ID NO: 442494 - RNA, 15 nt, Brucella suis 1330
aaaggaugacggcuu

SEQ ID NO: 442495 - RNA, 21 nt, Brucella suis 1330
aaagcaccgaucacgccguca

SEQ ID NO: 442496 - RNA, 14 nt, Brucella suis 1330
aaagcagauggcga

SEQ ID NO: 442497 - RNA, 12 nt, Brucella suis 1330
aaacgaggccga

SEQ ID NO: 442498 - RNA, 20 nt, Brucella suis 1330
aaacgauuguuuucggcaug

SEQ ID NO: 442499 - RNA, 15 nt, Brucella suis 1330
aaacgauuuucgcca

SEQ ID NO: 442500 - RNA, 22 nt, Brucella suis 1330
aaacgcaccaagaccgccgcga

SEQ ID NO: 442501 - RNA, 14 nt, Brucella suis 1330
aaagaugcgcgcca

SEQ ID NO: 442502 - RNA, 20 nt, Brucella suis 1330
uuugcuggaaaugcucuaga

SEQ ID NO: 442503 - RNA, 16 nt, Brucella suis 1330
uuucucguuuucaugc

SEQ ID NO: 442504 - RNA, 15 nt, Brucella suis 1330
uuucugccgcgcauc

SEQ ID NO: 442505 - RNA, 20 nt, Brucella suis 1330
uuuugcuggaaaugcucuag

SEQ ID NO: 442506 - RNA, 16 nt, Brucella suis 1330
uuuuggcucgaaaaug

SEQ ID NO: 442507 - RNA, 20 nt, Brucella suis 1330
uuuuggcucgaaaaugcucu

SEQ ID NO: 442508 - RNA, 19 nt, Brucella suis 1330
uuuuggguggcauagccgg

SEQ ID NO: 442509 - RNA, 20 nt, Brucella suis 1330
uuuugguuugaaaauguucu

SEQ ID NO: 442510 - RNA, 15 nt, Brucella suis 1330
uuuugucauggccgg

SEQ ID NO: 442511 - RNA, 11 nt, Brucella suis 1330
uugggcagcag

SEQ ID NO: 442512 - RNA, 17 nt, Brucella suis 1330
uuggcguugagccgcgc

SEQ ID NO: 442513 - RNA, 18 nt, Brucella suis 1330
uugugugccugugccgcu

SEQ ID NO: 442514 - RNA, 16 nt, Brucella suis 1330
uuuagauuugcuuaag

SEQ ID NO: 442515 - RNA, 13 nt, Brucella suis 1330
uuucaauggccgc

SEQ ID NO: 442516 - RNA, 16 nt, Brucella suis 1330
uuucacccuuggcgac

SEQ ID NO: 442517 - RNA, 18 nt, Brucella suis 1330
uuucacugcauuggcgau

SEQ ID NO: 442518 - RNA, 21 nt, Brucella suis 1330
uucuucgcacggcugaucugg

SEQ ID NO: 442519 - RNA, 18 nt, Brucella suis 1330
uucuguaaacugccgcgu

SEQ ID NO: 442520 - RNA, 11 nt, Brucella suis 1330
uucugccgcgc

SEQ ID NO: 442521 - RNA, 17 nt, Brucella suis 1330
uucucgacaaugccgag

SEQ ID NO: 442522 - RNA, 21 nt, Brucella suis 1330
uucgucaaaccgcccuuuucc

SEQ ID NO: 442523 - RNA, 18 nt, Brucella suis 1330
uucggcuuccuugcgcuu

SEQ ID NO: 442524 - RNA, 15 nt, Brucella suis 1330
uucgggcgaauggaa

SEQ ID NO: 442525 - RNA, 17 nt, Brucella suis 1330
uucggauccuccugcgc

SEQ ID NO: 442526 - RNA, 14 nt, Brucella suis 1330
uucgcgcaguuucc

SEQ ID NO: 442527 - RNA, 18 nt, Brucella suis 1330
uucgcgcaucgggcgcac

SEQ ID NO: 442528 - RNA, 22 nt, Brucella suis 1330
uucgacguggagcaggccauuc

SEQ ID NO: 442529 - RNA, 18 nt, Brucella suis 1330
uuccgaagugaucucggc

SEQ ID NO: 442530 - RNA, 15 nt, Brucella suis 1330
uuccgcaagccaguc

SEQ ID NO: 442531 - RNA, 16 nt, Brucella suis 1330
uuccgcaccgccgauc

SEQ ID NO: 442532 - RNA, 19 nt, Brucella suis 1330
uucaggccgucgaucagcu

SEQ ID NO: 442533 - RNA, 19 nt, Brucella suis 1330
uucaucgauaugcgcgaug

SEQ ID NO: 442534 - RNA, 15 nt, Brucella suis 1330
uucaucgcgccgcaa

SEQ ID NO: 442535 - RNA, 20 nt, Brucella suis 1330
uucagcccugcacaccaaaa

SEQ ID NO: 442536 - RNA, 21 nt, Brucella suis 1330
uucagccagaaucugcgcguc

SEQ ID NO: 442537 - RNA, 20 nt, Brucella suis 1330
uuauccuacgcaaaaccgcu

SEQ ID NO: 442538 - RNA, 18 nt, Brucella suis 1330
uuagaucggcgcucuaac

SEQ ID NO: 442539 - RNA, 20 nt, Brucella suis 1330
ugucggcgcugcucgcgcaa

SEQ ID NO: 442540 - RNA, 23 nt, Brucella suis 1330
ugucgcauccaugagcagcggca

SEQ ID NO: 442541 - RNA, 23 nt, Brucella suis 1330
ugucgcaaagcguuccgcgcaaa

SEQ ID NO: 442542 - RNA, 20 nt, Brucella suis 1330
uguaggcuggcaucgccaau

SEQ ID NO: 442543 - RNA, 23 nt, Brucella suis 1330
uggugccgaauguggugacggcg

SEQ ID NO: 442544 - RNA, 17 nt, Brucella suis 1330
uggugccagcgucggcg

SEQ ID NO: 442545 - RNA, 15 nt, Brucella suis 1330
uggugacggcgguga

SEQ ID NO: 442546 - RNA, 12 nt, Brucella suis 1330
uggguaaagcgg

SEQ ID NO: 442547 - RNA, 19 nt, Brucella suis 1330
uggcuugaagcugccgcgg

SEQ ID NO: 442548 - RNA, 13 nt, Brucella suis 1330
uggcggccggcaa

SEQ ID NO: 442549 - RNA, 22 nt, Brucella suis 1330
uggcgaucagcgcaagaaggcg

SEQ ID NO: 442550 - RNA, 23 nt, Brucella suis 1330
uggcgauaauaauuggcaagcgc

SEQ ID NO: 442551 - RNA, 19 nt, Brucella suis 1330
uggcgacgcgcucgucgca

SEQ ID NO: 442552 - RNA, 20 nt, Brucella suis 1330
ugcuugccauucugucggcg

SEQ ID NO: 442553 - RNA, 15 nt, Brucella suis 1330
ugcuugccgauaaua

SEQ ID NO: 442554 - RNA, 19 nt, Brucella suis 1330
ugcuuccucguccuugaac

SEQ ID NO: 442555 - RNA, 17 nt, Brucella suis 1330
ugcuuauacgcuccgcc

SEQ ID NO: 442556 - RNA, 23 nt, Brucella suis 1330
ugcucgucggaaauaucgccgac

SEQ ID NO: 442557 - RNA, 15 nt, Brucella suis 1330
ugcucuauuucggcg

SEQ ID NO: 442558 - RNA, 18 nt, Brucella suis 1330
ugcucgcgcaaggcuuca

SEQ ID NO: 442559 - RNA, 21 nt, Brucella suis 1330
ugcuccagcccuuuccugacc

SEQ ID NO: 442560 - RNA, 17 nt, Brucella suis 1330
ugcgucgcauccagaac

SEQ ID NO: 442561 - RNA, 11 nt, Brucella suis 1330
ugcggcuugcc

SEQ ID NO: 442562 - RNA, 17 nt, Brucella suis 1330
ugcggcgcgcauuucau

SEQ ID NO: 442563 - RNA, 22 nt, Brucella suis 1330
ugcggccgggccaacgccggca

SEQ ID NO: 442564 - RNA, 19 nt, Brucella suis 1330
ugcggccugcacggcuuca

SEQ ID NO: 442565 - RNA, 18 nt, Brucella suis 1330
ugcggaacacgccgccau

SEQ ID NO: 442566 - RNA, 14 nt, Brucella suis 1330
ugcgcgacgaucag

SEQ ID NO: 442567 - RNA, 13 nt, Brucella suis 1330
ugcgccgaacagc

SEQ ID NO: 442568 - RNA, 13 nt, Brucella suis 1330
ugcgcccgccgaa

SEQ ID NO: 442569 - RNA, 18 nt, Brucella suis 1330
ugcgccaccacggcgccu

SEQ ID NO: 442570 - RNA, 15 nt, Brucella suis 1330
ugcgcagcgcaggcg

SEQ ID NO: 442571 - RNA, 14 nt, Brucella suis 1330
ugcgcagcgccgca

SEQ ID NO: 442572 - RNA, 15 nt, Brucella suis 1330
ugcgcagcgccgcau

SEQ ID NO: 442573 - RNA, 20 nt, Brucella suis 1330
ugccgugcacuucgagcagg

SEQ ID NO: 442574 - RNA, 15 nt, Brucella suis 1330
ugccgugucgucguc

SEQ ID NO: 442575 - RNA, 16 nt, Brucella suis 1330
ugccgucaccauucac

SEQ ID NO: 442576 - RNA, 16 nt, Brucella suis 1330
ugccgcguccggcauu

SEQ ID NO: 442577 - RNA, 17 nt, Brucella suis 1330
ugccgcgcaucggccuu

SEQ ID NO: 442578 - RNA, 19 nt, Brucella suis 1330
ugccgcaugauaggcaaca

SEQ ID NO: 442579 - RNA, 23 nt, Brucella suis 1330
ugccgaagcccauggcauaccga

SEQ ID NO: 442580 - RNA, 21 nt, Brucella suis 1330
ugccauucuccgcagccgcca

SEQ ID NO: 442581 - RNA, 22 nt, Brucella suis 1330
ugccaucuucacccacgccaau

SEQ ID NO: 442582 - RNA, 18 nt, Brucella suis 1330
ugccauccguaucggcgg

SEQ ID NO: 442583 - RNA, 18 nt, Brucella suis 1330
ugccaucaccagccccca

SEQ ID NO: 442584 - RNA, 19 nt, Brucella suis 1330
ugccaagugaagcgaagaa

SEQ ID NO: 442585 - RNA, 13 nt, Brucella suis 1330
ugcagggcuugcu

SEQ ID NO: 442586 - RNA, 15 nt, Brucella suis 1330
ugcagccugaacagc

SEQ ID NO: 442587 - RNA, 22 nt, Brucella suis 1330
ugcagaugagcggcagcagcca

SEQ ID NO: 442588 - RNA, 20 nt, Brucella suis 1330
ugcaaauggcaauuuaucug

SEQ ID NO: 442589 - RNA, 13 nt, Brucella suis 1330
ugcaaauggcguu

SEQ ID NO: 442590 - RNA, 19 nt, Brucella suis 1330
ugauguuugcgaaccggag

SEQ ID NO: 442591 - RNA, 17 nt, Brucella suis 1330
ugauggccgggaaugcg

SEQ ID NO: 442592 - RNA, 20 nt, Brucella suis 1330
ugaggccauuuugacccugc

SEQ ID NO: 442593 - RNA, 16 nt, Brucella suis 1330
ugaggccggacgcuuc

SEQ ID NO: 442594 - RNA, 15 nt, Brucella suis 1330
ugagaaggcaagccc

SEQ ID NO: 442595 - RNA, 17 nt, Brucella suis 1330
ugaagcgggccgcuugc

SEQ ID NO: 442596 - RNA, 18 nt, Brucella suis 1330
ugaacggaucuugcgcac

SEQ ID NO: 442597 - RNA, 19 nt, Brucella suis 1330
ugaacagacccuugagcgu

SEQ ID NO: 442598 - RNA, 16 nt, Brucella suis 1330
ucuugucgaagacgcg

SEQ ID NO: 442599 - RNA, 21 nt, Brucella suis 1330
ucuuguucauaggcauuuucc

SEQ ID NO: 442600 - RNA, 15 nt, Brucella suis 1330
ucuugcgcuugcgac

SEQ ID NO: 442601 - RNA, 19 nt, Brucella suis 1330
ucuugaucgauucggcuuc

SEQ ID NO: 442602 - RNA, 16 nt, Brucella suis 1330
ucuucgaucauuuccu

SEQ ID NO: 442603 - RNA, 17 nt, Brucella suis 1330
ucuucaccuguucggcg

SEQ ID NO: 442604 - RNA, 23 nt, Brucella suis 1330
ucuggccgcuaugcgguuucagc

SEQ ID NO: 442605 - RNA, 18 nt, Brucella suis 1330
ucuggaaguccucggcaa

SEQ ID NO: 442606 - RNA, 15 nt, Brucella suis 1330
ucugcuugccgccga

SEQ ID NO: 442607 - RNA, 15 nt, Brucella suis 1330
ucugccgugucgucg

SEQ ID NO: 442608 - RNA, 22 nt, Brucella suis 1330
ucucggccuggucuagccgcgc

SEQ ID NO: 442609 - RNA, 20 nt, Brucella suis 1330
ucucgcccaaggucggcuca

SEQ ID NO: 442610 - RNA, 20 nt, Brucella suis 1330
ucucacuccgaccauuuccc

SEQ ID NO: 442611 - RNA, 14 nt, Brucella suis 1330
ucguucaccgcaac

SEQ ID NO: 442612 - RNA, 19 nt, Brucella suis 1330
ucggucucguucugccagu

SEQ ID NO: 442613 - RNA, 16 nt, Brucella suis 1330
ucggcggcguuucgcc

SEQ ID NO: 442614 - RNA, 14 nt, Brucella suis 1330
ucggcggaaccaug

SEQ ID NO: 442615 - RNA, 18 nt, Brucella suis 1330
ucggccaguucagcggcg

SEQ ID NO: 442616 - RNA, 17 nt, Brucella suis 1330
ucggcagcgaaccgucc

SEQ ID NO: 442617 - RNA, 21 nt, Brucella suis 1330
ucggcaagcuggaaggccagg

SEQ ID NO: 442618 - RNA, 16 nt, Brucella suis 1330
ucggcaagggcggcaa

SEQ ID NO: 442619 - RNA, 15 nt, Brucella suis 1330
ucggcaacgccgaag

SEQ ID NO: 442620 - RNA, 20 nt, Brucella suis 1330
ucggcaaaggcuccggcauu

SEQ ID NO: 442621 - RNA, 22 nt, Brucella suis 1330
ucgcuuucgauuuuugccagau

SEQ ID NO: 442622 - RNA, 20 nt, Brucella suis 1330
ucgcuuucaauggccgcgcg

SEQ ID NO: 442623 - RNA, 20 nt, Brucella suis 1330
ucgcucguaacgggagcagc

SEQ ID NO: 442624 - RNA, 14 nt, Brucella suis 1330
ucgcgucccuugcc

SEQ ID NO: 442625 - RNA, 22 nt, Brucella suis 1330
ucgcggcagccgccgccgcaaa

SEQ ID NO: 442626 - RNA, 23 nt, Brucella suis 1330
ucgcgcguaucgacaccgccaag

SEQ ID NO: 442627 - RNA, 16 nt, Brucella suis 1330
ucgcgccaggcuucgg

SEQ ID NO: 442628 - RNA, 16 nt, Brucella suis 1330
ucgcgccauaaaucga

SEQ ID NO: 442629 - RNA, 17 nt, Brucella suis 1330
ucgcgaucgugucgcga

SEQ ID NO: 442630 - RNA, 22 nt, Brucella suis 1330
ucgcgacaggacaccgucgcca

SEQ ID NO: 442631 - RNA, 12 nt, Brucella suis 1330
ucgccggaaagc

SEQ ID NO: 442632 - RNA, 16 nt, Brucella suis 1330
ucgccgaaaagcgccu

SEQ ID NO: 442633 - RNA, 22 nt, Brucella suis 1330
ucgcccacgcccagcgcggcaa

SEQ ID NO: 442634 - RNA, 16 nt, Brucella suis 1330
ucgacacccggauauu

SEQ ID NO: 442635 - RNA, 17 nt, Brucella suis 1330
ucgacaaccgcgccgcu

SEQ ID NO: 442636 - RNA, 12 nt, Brucella suis 1330
ucgaagcggccu

SEQ ID NO: 442637 - RNA, 21 nt, Brucella suis 1330
ucgaagaguuugacgcccauu

SEQ ID NO: 442638 - RNA, 16 nt, Brucella suis 1330
ucgaagaucaaguggc

SEQ ID NO: 442639 - RNA, 14 nt, Brucella suis 1330
ucgaaaccggcauu

SEQ ID NO: 442640 - RNA, 12 nt, Brucella suis 1330
uccuuuccgggu

SEQ ID NO: 442641 - RNA, 12 nt, Brucella suis 1330
uccuuuuucagc

SEQ ID NO: 442642 - RNA, 18 nt, Brucella suis 1330
uccuugucggcaucgguc

SEQ ID NO: 442643 - RNA, 19 nt, Brucella suis 1330
uccuucuccaucugcggcg

SEQ ID NO: 442644 - RNA, 20 nt, Brucella suis 1330
uccuucuccaucugcggcgu

SEQ ID NO: 442645 - RNA, 17 nt, Brucella suis 1330
uccuguccgacauccau

SEQ ID NO: 442646 - RNA, 15 nt, Brucella suis 1330
uccugccagcggcag

SEQ ID NO: 442647 - RNA, 15 nt, Brucella suis 1330
uccugcgaugcgcca

SEQ ID NO: 442648 - RNA, 17 nt, Brucella suis 1330
uccugaauggucugcgc

SEQ ID NO: 442649 - RNA, 15 nt, Brucella suis 1330
uccucugccugcuga

SEQ ID NO: 442650 - RNA, 23 nt, Brucella suis 1330
uccguguugaaaaggauauccuu

SEQ ID NO: 442651 - RNA, 20 nt, Brucella suis 1330
uccucaagauacaaaaaauc

SEQ ID NO: 442652 - RNA, 19 nt, Brucella suis 1330
uccgucagggccgaugccg

SEQ ID NO: 442653 - RNA, 23 nt, Brucella suis 1330
uccgggcaccgaccgggcuugca

SEQ ID NO: 442654 - RNA, 19 nt, Brucella suis 1330
uccggcccauaccgcgcca

SEQ ID NO: 442655 - RNA, 23 nt, Brucella suis 1330
uccggaauagucaguuccugcuu

SEQ ID NO: 442656 - RNA, 20 nt, Brucella suis 1330
uccgcugccagcuacgccgg

SEQ ID NO: 442657 - RNA, 23 nt, Brucella suis 1330
uccgccugaucgucaggcgcauu

SEQ ID NO: 442658 - RNA, 19 nt, Brucella suis 1330
uccgcgacaucaucaagga

SEQ ID NO: 442659 - RNA, 20 nt, Brucella suis 1330
uccgcauaagccccggcauc

SEQ ID NO: 442660 - RNA, 20 nt, Brucella suis 1330
uccgcaccgaaggcaagcag

SEQ ID NO: 442661 - RNA, 15 nt, Brucella suis 1330
uccgaauacaagccc

SEQ ID NO: 442662 - RNA, 14 nt, Brucella suis 1330
ucccuucgcgccgc

SEQ ID NO: 442663 - RNA, 15 nt, Brucella suis 1330
uccgaaaaccgcuuc

SEQ ID NO: 442664 - RNA, 20 nt, Brucella suis 1330
ucccucuaaucgcgagcagc

SEQ ID NO: 442665 - RNA, 23 nt, Brucella suis 1330
ucccgucagcuuuucaccggcau

SEQ ID NO: 442666 - RNA, 17 nt, Brucella suis 1330
uccaugagcagcggcaa

SEQ ID NO: 442667 - RNA, 19 nt, Brucella suis 1330
uccagcggugacggcggca

SEQ ID NO: 442668 - RNA, 20 nt, Brucella suis 1330
uccagcggugacggcggcag

SEQ ID NO: 442669 - RNA, 14 nt, Brucella suis 1330
uccagaucggccuu

SEQ ID NO: 442670 - RNA, 23 nt, Brucella suis 1330
uccagauugccgcgcgcggcuuc

SEQ ID NO: 442671 - RNA, 20 nt, Brucella suis 1330
uccacggcauugagaccggg

SEQ ID NO: 442672 - RNA, 15 nt, Brucella suis 1330
uccacaccugcacca

SEQ ID NO: 442673 - RNA, 22 nt, Brucella suis 1330
ucauugcggccaagcgcaucgg

SEQ ID NO: 442674 - RNA, 14 nt, Brucella suis 1330
ucaucgucggccag

SEQ ID NO: 442675 - RNA, 13 nt, Brucella suis 1330
ucaugauggaaga

SEQ ID NO: 442676 - RNA, 12 nt, Brucella suis 1330
ucaucgcggcag

SEQ ID NO: 442677 - RNA, 18 nt, Brucella suis 1330
ucaguuuguugaaacagg

SEQ ID NO: 442678 - RNA, 16 nt, Brucella suis 1330
ucagucgaauuucagc

SEQ ID NO: 442679 - RNA, 11 nt, Brucella suis 1330
ucaggaucgcu

SEQ ID NO: 442680 - RNA, 17 nt, Brucella suis 1330
ucaggaaaucgaugaca

SEQ ID NO: 442681 - RNA, 19 nt, Brucella suis 1330
ucagcggauauucggcguu

SEQ ID NO: 442682 - RNA, 18 nt, Brucella suis 1330
ucagaccgaugcucuaac

SEQ ID NO: 442683 - RNA, 13 nt, Brucella suis 1330
ucacgaucuugcc

SEQ ID NO: 442684 - RNA, 15 nt, Brucella suis 1330
uauccgugcccggca

SEQ ID NO: 442685 - RNA, 17 nt, Brucella suis 1330
uaucaccagaccggcaa

SEQ ID NO: 442686 - RNA, 16 nt, Brucella suis 1330
uaggcaacaucgccuu

SEQ ID NO: 442687 - RNA, 20 nt, Brucella suis 1330
uaggcaacaucgccuugcgg

SEQ ID NO: 442688 - RNA, 22 nt, Brucella suis 1330
uaggcagcgauauccggcacgg

SEQ ID NO: 442689 - RNA, 13 nt, Brucella suis 1330
uagcgcgcaccga

SEQ ID NO: 442690 - RNA, 19 nt, Brucella suis 1330
uagccggucgagccgacau

SEQ ID NO: 442691 - RNA, 18 nt, Brucella suis 1330
uagaucggaugcuccacg

SEQ ID NO: 442692 - RNA, 21 nt, Brucella suis 1330
uacguggcuugaagcugccgc

SEQ ID NO: 442693 - RNA, 12 nt, Brucella suis 1330
uacgcugcccuu

SEQ ID NO: 442694 - RNA, 12 nt, Brucella suis 1330
uacacgcggcau

SEQ ID NO: 442695 - RNA, 14 nt, Brucella suis 1330
uaauugucggcguc

SEQ ID NO: 442696 - RNA, 17 nt, Brucella suis 1330
uaagcuuugcaccgcgc

SEQ ID NO: 442697 - RNA, 15 nt, Brucella suis 1330
guuuuuuaccgcccu

SEQ ID NO: 442698 - RNA, 21 nt, Brucella suis 1330
guuuuccgcaaucaagaucga

SEQ ID NO: 442699 - RNA, 15 nt, Brucella suis 1330
guuucggguggccuu

SEQ ID NO: 442700 - RNA, 13 nt, Brucella suis 1330
guuucugccgcgc

SEQ ID NO: 442701 - RNA, 18 nt, Brucella suis 1330
guuucgacaagcuucagg

SEQ ID NO: 442702 - RNA, 19 nt, Brucella suis 1330
guuucgaucacaacgccgu

SEQ ID NO: 442703 - RNA, 18 nt, Brucella suis 1330
guuggcauccacucggcg

SEQ ID NO: 442704 - RNA, 15 nt, Brucella suis 1330
guuggaaacggcgca

SEQ ID NO: 442705 - RNA, 15 nt, Brucella suis 1330
guugccuucaucggc

SEQ ID NO: 442706 - RNA, 15 nt, Brucella suis 1330
guugccacgcgccgc

SEQ ID NO: 442707 - RNA, 19 nt, Brucella suis 1330
guugagccgcgccaugcca

SEQ ID NO: 442708 - RNA, 23 nt, Brucella suis 1330
guggucgccucuucauccggcag

SEQ ID NO: 442709 - RNA, 23 nt, Brucella suis 1330
gugggccucaagcggcuccacca

SEQ ID NO: 442710 - RNA, 16 nt, Brucella suis 1330
guggcuuuuccggcgg

SEQ ID NO: 442711 - RNA, 14 nt, Brucella suis 1330
guggcugcccgccg

SEQ ID NO: 442712 - RNA, 11 nt, Brucella suis 1330
guggccuuccu

SEQ ID NO: 442713 - RNA, 21 nt, Brucella suis 1330
guggccgaugauauugcccau

SEQ ID NO: 442714 - RNA, 19 nt, Brucella suis 1330
guggccgccacccaugucg

SEQ ID NO: 442715 - RNA, 14 nt, Brucella suis 1330
guggagcaccgccc

SEQ ID NO: 442716 - RNA, 23 nt, Brucella suis 1330
gugcgggguugaucucauuucgg

SEQ ID NO: 442717 - RNA, 20 nt, Brucella suis 1330
gugccuggcgaaaacggcca

SEQ ID NO: 442718 - RNA, 12 nt, Brucella suis 1330
gugccgcgccga

SEQ ID NO: 442719 - RNA, 13 nt, Brucella suis 1330
gugcccggcaaca

SEQ ID NO: 442720 - RNA, 13 nt, Brucella suis 1330
gugcauuccccgc

SEQ ID NO: 442721 - RNA, 16 nt, Brucella suis 1330
gugaaacagugccgcc

SEQ ID NO: 442722 - RNA, 16 nt, Brucella suis 1330
gucuuuuccgaugcgg

SEQ ID NO: 442723 - RNA, 22 nt, Brucella suis 1330
gucuucauagaccccgccugag

SEQ ID NO: 442724 - RNA, 18 nt, Brucella suis 1330
gucuucaucgauaugcgc

SEQ ID NO: 442725 - RNA, 15 nt, Brucella suis 1330
gucugugucacgcag

SEQ ID NO: 442726 - RNA, 14 nt, Brucella suis 1330
gucguuucgccgcc

SEQ ID NO: 442727 - RNA, 18 nt, Brucella suis 1330
gucguugccgccgcgcgu

SEQ ID NO: 442728 - RNA, 18 nt, Brucella suis 1330
gucguugacacgcuugaa

SEQ ID NO: 442729 - RNA, 16 nt, Brucella suis 1330
gucggccaguuuggcu

SEQ ID NO: 442730 - RNA, 21 nt, Brucella suis 1330
gucggaaauaucgccgacgau

SEQ ID NO: 442731 - RNA, 19 nt, Brucella suis 1330
gucgcgguuugcaagccgc

SEQ ID NO: 442732 - RNA, 22 nt, Brucella suis 1330
gucgcgguuugcaagccgcggc

SEQ ID NO: 442733 - RNA, 17 nt, Brucella suis 1330
gucgcggccuugauccg

SEQ ID NO: 442734 - RNA, 16 nt, Brucella suis 1330
gucgcgcucgccgccc

SEQ ID NO: 442735 - RNA, 12 nt, Brucella suis 1330
gucgcgcccgca

SEQ ID NO: 442736 - RNA, 23 nt, Brucella suis 1330
gucgcaaccacgguuuucgccgc

SEQ ID NO: 442737 - RNA, 13 nt, Brucella suis 1330
gucgaggcagcca

SEQ ID NO: 442738 - RNA, 16 nt, Brucella suis 1330
guccacgcccuuggcg

SEQ ID NO: 442739 - RNA, 22 nt, Brucella suis 1330
gucauggugugcaaugcagcca

SEQ ID NO: 442740 - RNA, 21 nt, Brucella suis 1330
gucauggccacgccagccgcg

SEQ ID NO: 442741 - RNA, 15 nt, Brucella suis 1330
gucauauucggccuu

SEQ ID NO: 442742 - RNA, 20 nt, Brucella suis 1330
gucauagaccaugacgccgc

SEQ ID NO: 442743 - RNA, 20 nt, Brucella suis 1330
gucauagaucggaugcucca

SEQ ID NO: 442744 - RNA, 16 nt, Brucella suis 1330
gucagggaaaugcgga

SEQ ID NO: 442745 - RNA, 17 nt, Brucella suis 1330
gucagggaaaugcggau

SEQ ID NO: 442746 - RNA, 16 nt, Brucella suis 1330
gucagggcauugccga

SEQ ID NO: 442747 - RNA, 22 nt, Brucella suis 1330
gucagcggcggauaaugcucgc

SEQ ID NO: 442748 - RNA, 14 nt, Brucella suis 1330
gucagcgcaaagcc

SEQ ID NO: 442749 - RNA, 14 nt, Brucella suis 1330
gucaaaacgccccg

SEQ ID NO: 442750 - RNA, 13 nt, Brucella suis 1330
guacggcccucga

SEQ ID NO: 442751 - RNA, 16 nt, Brucella suis 1330
guacggcgcgcugaag

SEQ ID NO: 442752 - RNA, 11 nt, Brucella suis 1330
guaaucgugcc

SEQ ID NO: 442753 - RNA, 15 nt, Brucella suis 1330
guaaucagcgucagc

SEQ ID NO: 442754 - RNA, 22 nt, Brucella suis 1330
guaauaacgacgcccgcccccg

SEQ ID NO: 442755 - RNA, 22 nt, Brucella suis 1330
guaauagcccgguguauccacc

SEQ ID NO: 442756 - RNA, 15 nt, Brucella suis 1330
gguucgggcauugug

SEQ ID NO: 442757 - RNA, 20 nt, Brucella suis 1330
ggugguucaggcuacagguc

SEQ ID NO: 442758 - RNA, 16 nt, Brucella suis 1330
ggugcaaugccaucca

SEQ ID NO: 442759 - RNA, 22 nt, Brucella suis 1330
ggugaaagaccgcauuccggcu

SEQ ID NO: 442760 - RNA, 20 nt, Brucella suis 1330
ggucgacggguugcgaccgg

SEQ ID NO: 442761 - RNA, 16 nt, Brucella suis 1330
ggguacgaaccacggc

SEQ ID NO: 442762 - RNA, 22 nt, Brucella suis 1330
ggguagagcuucuuuucgauga

SEQ ID NO: 442763 - RNA, 13 nt, Brucella suis 1330
ggggcaugacauc

SEQ ID NO: 442764 - RNA, 17 nt, Brucella suis 1330
ggggauugccaugaaac

SEQ ID NO: 442765 - RNA, 16 nt, Brucella suis 1330
gggcuuucucguuuuc

SEQ ID NO: 442766 - RNA, 22 nt, Brucella suis 1330
gggcuuggcuugccgcguucca

SEQ ID NO: 442767 - RNA, 21 nt, Brucella suis 1330
gggcuuccugcaaaagcgcac

SEQ ID NO: 442768 - RNA, 15 nt, Brucella suis 1330
gggccuuuccggcgg

SEQ ID NO: 442769 - RNA, 18 nt, Brucella suis 1330
gggaugggggccgggcgc

SEQ ID NO: 442770 - RNA, 15 nt, Brucella suis 1330
gggagcgcaauaucg

SEQ ID NO: 442771 - RNA, 14 nt, Brucella suis 1330
gggaaccgguuuuc

SEQ ID NO: 442772 - RNA, 21 nt, Brucella suis 1330
gggaacaauaggcgcgggcau

SEQ ID NO: 442773 - RNA, 18 nt, Brucella suis 1330
ggcuugccgcguuccacg

SEQ ID NO: 442774 - RNA, 17 nt, Brucella suis 1330
ggcuugccaccacgaug

SEQ ID NO: 442775 - RNA, 13 nt, Brucella suis 1330
ggcuugccagaug

SEQ ID NO: 442776 - RNA, 18 nt, Brucella suis 1330
ggcuguuucgcauugccc

SEQ ID NO: 442777 - RNA, 17 nt, Brucella suis 1330
ggcugucaaugcagcgu

SEQ ID NO: 442778 - RNA, 21 nt, Brucella suis 1330
ggcucgggcagcuugucgaaa

SEQ ID NO: 442779 - RNA, 13 nt, Brucella suis 1330
ggcucgcucgacu

SEQ ID NO: 442780 - RNA, 23 nt, Brucella suis 1330
ggcucauaguugaaaagggcaag

SEQ ID NO: 442781 - RNA, 18 nt, Brucella suis 1330
ggcgucagggcauugccg

SEQ ID NO: 442782 - RNA, 23 nt, Brucella suis 1330
ggcgucaccugcaacgcgccaaa

SEQ ID NO: 442783 - RNA, 17 nt, Brucella suis 1330
ggcggcuuucgccgccc

SEQ ID NO: 442784 - RNA, 12 nt, Brucella suis 1330
ggcggcuccagc

SEQ ID NO: 442785 - RNA, 16 nt, Brucella suis 1330
ggcggccuuggaggcg

SEQ ID NO: 442786 - RNA, 15 nt, Brucella suis 1330
ggcggcagaauaucu

SEQ ID NO: 442787 - RNA, 15 nt, Brucella suis 1330
ggcggcaagcucgcc

SEQ ID NO: 442788 - RNA, 15 nt, Brucella suis 1330
ggcgcuuuugcgcuc

SEQ ID NO: 442789 - RNA, 17 nt, Brucella suis 1330
ggcgcggcgcauggccu

SEQ ID NO: 442790 - RNA, 14 nt, Brucella suis 1330
ggcgcgcugaagcc

SEQ ID NO: 442791 - RNA, 19 nt, Brucella suis 1330
ggcgcgaugagcgaaaucg

SEQ ID NO: 442792 - RNA, 13 nt, Brucella suis 1330
ggcgcaaaggccg

SEQ ID NO: 442793 - RNA, 14 nt, Brucella suis 1330
ggcgcaaaggccgg

SEQ ID NO: 442794 - RNA, 22 nt, Brucella suis 1330
ggcgaugcccaucgcauugcug

SEQ ID NO: 442795 - RNA, 20 nt, Brucella suis 1330
ggcgaguugccacgcgccgc

SEQ ID NO: 442796 - RNA, 23 nt, Brucella suis 1330
ggcgaguugccacgcgccgccau

SEQ ID NO: 442797 - RNA, 24 nt, Brucella suis 1330
ggcgaguugccacgcgccgccauc

SEQ ID NO: 442798 - RNA, 19 nt, Brucella suis 1330
ggcgagggcgggcggccag

SEQ ID NO: 442799 - RNA, 15 nt, Brucella suis 1330
ggcgagcgcgcuuau

SEQ ID NO: 442800 - RNA, 13 nt, Brucella suis 1330
ggcgagcgcgcca

SEQ ID NO: 442801 - RNA, 23 nt, Brucella suis 1330
ggcgagcgcgccacggauuucca

SEQ ID NO: 442802 - RNA, 14 nt, Brucella suis 1330
ggcgagaucgucug

SEQ ID NO: 442803 - RNA, 20 nt, Brucella suis 1330
ggcgacuggcagggcuucau

SEQ ID NO: 442804 - RNA, 14 nt, Brucella suis 1330
ggccugaccggcca

SEQ ID NO: 442805 - RNA, 21 nt, Brucella suis 1330
ggccuauccucaaaaaccgga

SEQ ID NO: 442806 - RNA, 17 nt, Brucella suis 1330
ggccgucuucgcccgac

SEQ ID NO: 442807 - RNA, 15 nt, Brucella suis 1330
ggccgcuaugcgguu

SEQ ID NO: 442808 - RNA, 13 nt, Brucella suis 1330
ggccgcgccgauc

SEQ ID NO: 442809 - RNA, 14 nt, Brucella suis 1330
ggcccaaaggccgc

SEQ ID NO: 442810 - RNA, 20 nt, Brucella suis 1330
ggcccaaaggccgcgccgau

SEQ ID NO: 442811 - RNA, 15 nt, Brucella suis 1330
ggccauggcuucaag

SEQ ID NO: 442812 - RNA, 15 nt, Brucella suis 1330
ggccaugaugccgac

SEQ ID NO: 442813 - RNA, 15 nt, Brucella suis 1330
ggccaguucagcggc

SEQ ID NO: 442814 - RNA, 16 nt, Brucella suis 1330
ggccacgacagggcgc

SEQ ID NO: 442815 - RNA, 17 nt, Brucella suis 1330
ggccacaagcgccgguu

SEQ ID NO: 442816 - RNA, 23 nt, Brucella suis 1330
ggccaaggccccagaucagcguc

SEQ ID NO: 442817 - RNA, 14 nt, Brucella suis 1330
ggccaacgccacga

SEQ ID NO: 442818 - RNA, 18 nt, Brucella suis 1330
ggcauugcccauggacuu

SEQ ID NO: 442819 - RNA, 18 nt, Brucella suis 1330
ggcauggauggaauaucg

SEQ ID NO: 442820 - RNA, 13 nt, Brucella suis 1330
ggcaucaaacugg

SEQ ID NO: 442821 - RNA, 20 nt, Brucella suis 1330
ggcauaauaggcaucggccu

SEQ ID NO: 442822 - RNA, 19 nt, Brucella suis 1330
ggcaggaucgccagaagcg

SEQ ID NO: 442823 - RNA, 17 nt, Brucella suis 1330
ggcagccgugagcaugg

SEQ ID NO: 442824 - RNA, 16 nt, Brucella suis 1330
ggcagcaugaucgcca

SEQ ID NO: 442825 - RNA, 16 nt, Brucella suis 1330
ggaugucgauuucacc

SEQ ID NO: 442826 - RNA, 17 nt, Brucella suis 1330
ggaucgugagguucuug

SEQ ID NO: 442827 - RNA, 14 nt, Brucella suis 1330
ggaucggaaacgcg

SEQ ID NO: 442828 - RNA, 17 nt, Brucella suis 1330
ggaucggcagcgaaccg

SEQ ID NO: 442829 - RNA, 14 nt, Brucella suis 1330
ggaucgaaaggcuc

SEQ ID NO: 442830 - RNA, 17 nt, Brucella suis 1330
ggaucagcuugccgcca

SEQ ID NO: 442831 - RNA, 15 nt, Brucella suis 1330
ggaucaaaccggcca

SEQ ID NO: 442832 - RNA, 11 nt, Brucella suis 1330
ggagcggcaca

SEQ ID NO: 442833 - RNA, 21 nt, Brucella suis 1330
ggagcgcauccgccugcgcau

SEQ ID NO: 442834 - RNA, 15 nt, Brucella suis 1330
ggacgccugccaucc

SEQ ID NO: 442835 - RNA, 19 nt, Brucella suis 1330
ggaccacgcagggucgcga

SEQ ID NO: 442836 - RNA, 21 nt, Brucella suis 1330
ggaaucuaagcggaaaacggc

SEQ ID NO: 442837 - RNA, 21 nt, Brucella suis 1330
ggaaucugccuugucagaagc

SEQ ID NO: 442838 - RNA, 19 nt, Brucella suis 1330
ggaacugcggaucggcuuc

SEQ ID NO: 442839 - RNA, 18 nt, Brucella suis 1330
gcuuuuuuuaugccgcgu

SEQ ID NO: 442840 - RNA, 21 nt, Brucella suis 1330
ggaaccggcugucccugcggg

SEQ ID NO: 442841 - RNA, 19 nt, Brucella suis 1330
gcuuuucacgcgagcgcag

SEQ ID NO: 442842 - RNA, 20 nt, Brucella suis 1330
gcuuuccagcgggcgcgacu

SEQ ID NO: 442843 - RNA, 17 nt, Brucella suis 1330
gcuuucaauggccgcgc

SEQ ID NO: 442844 - RNA, 15 nt, Brucella suis 1330
gcuugcuuugcccuu

SEQ ID NO: 442845 - RNA, 22 nt, Brucella suis 1330
gcuuggcaccgccugcgcgcau

SEQ ID NO: 442846 - RNA, 19 nt, Brucella suis 1330
gcuugcgaugauauucggc

SEQ ID NO: 442847 - RNA, 17 nt, Brucella suis 1330
gcuugccuuuuggccgc

SEQ ID NO: 442848 - RNA, 19 nt, Brucella suis 1330
gcuugccgaaaagccgcgc

SEQ ID NO: 442849 - RNA, 13 nt, Brucella suis 1330
gcuugaugcgcca

SEQ ID NO: 442850 - RNA, 17 nt, Brucella suis 1330
gcuugccagaugugcca

SEQ ID NO: 442851 - RNA, 19 nt, Brucella suis 1330
gcuugagcguuacuucggc

SEQ ID NO: 442852 - RNA, 21 nt, Brucella suis 1330
gcuugagaaccgaacgcgccu

SEQ ID NO: 442853 - RNA, 20 nt, Brucella suis 1330
gcuugacgaucuuuucggcg

SEQ ID NO: 442854 - RNA, 15 nt, Brucella suis 1330
gcuguugcgcccgcc

SEQ ID NO: 442855 - RNA, 14 nt, Brucella suis 1330
gcuggcgccgccgc

SEQ ID NO: 442856 - RNA, 15 nt, Brucella suis 1330
gcuggcgccgccgcu

SEQ ID NO: 442857 - RNA, 13 nt, Brucella suis 1330
gcuggcaucgcca

SEQ ID NO: 442858 - RNA, 16 nt, Brucella suis 1330
gcuggcacaaagcggc

SEQ ID NO: 442859 - RNA, 19 nt, Brucella suis 1330
gcugccgauggugacgguc

SEQ ID NO: 442860 - RNA, 13 nt, Brucella suis 1330
gcugauuucuucc

SEQ ID NO: 442861 - RNA, 22 nt, Brucella suis 1330
gcugaaaaggcuggccaugcgg

SEQ ID NO: 442862 - RNA, 17 nt, Brucella suis 1330
gcucuucgcauugccga

SEQ ID NO: 442863 - RNA, 19 nt, Brucella suis 1330
gcucuuaaaaugccgccca

SEQ ID NO: 442864 - RNA, 23 nt, Brucella suis 1330
gcucgucggaaauaucgccgacg

SEQ ID NO: 442865 - RNA, 14 nt, Brucella suis 1330
gcucguccaugagc

SEQ ID NO: 442866 - RNA, 19 nt, Brucella suis 1330
gcucguccaugagcgcacc

SEQ ID NO: 442867 - RNA, 21 nt, Brucella suis 1330
gcucggcggcgguaccgaaga

SEQ ID NO: 442868 - RNA, 18 nt, Brucella suis 1330
gcucggaguuuuucggcc

SEQ ID NO: 442869 - RNA, 16 nt, Brucella suis 1330
gcuccagggugccguc

SEQ ID NO: 442870 - RNA, 18 nt, Brucella suis 1330
gcuccagggugccgucgc

SEQ ID NO: 442871 - RNA, 19 nt, Brucella suis 1330
gcuccagccgagcgccaga

SEQ ID NO: 442872 - RNA, 20 nt, Brucella suis 1330
gcuccagccgagcgccagau

SEQ ID NO: 442873 - RNA, 21 nt, Brucella suis 1330
gcuccagaucgugaucuucgg

SEQ ID NO: 442874 - RNA, 21 nt, Brucella suis 1330
gcuccacauccacccgcgaca

SEQ ID NO: 442875 - RNA, 13 nt, Brucella suis 1330
gcucauggucacg

SEQ ID NO: 442876 - RNA, 15 nt, Brucella suis 1330
gcucauggucacgcg

SEQ ID NO: 442877 - RNA, 14 nt, Brucella suis 1330
gcucaaucgccgcg

SEQ ID NO: 442878 - RNA, 17 nt, Brucella suis 1330
gcuaugcgcaauugcgc

SEQ ID NO: 442879 - RNA, 13 nt, Brucella suis 1330
gcuauauugccgc

SEQ ID NO: 442880 - RNA, 20 nt, Brucella suis 1330
gcuaucacguuggggcgccg

SEQ ID NO: 442881 - RNA, 18 nt, Brucella suis 1330
gcguugcaagauccucgc

SEQ ID NO: 442882 - RNA, 20 nt, Brucella suis 1330
gcguguuugcggccuuugcg

SEQ ID NO: 442883 - RNA, 15 nt, Brucella suis 1330
gcgucgauggccggu

SEQ ID NO: 442884 - RNA, 13 nt, Brucella suis 1330
gcgucgcaccgga

SEQ ID NO: 442885 - RNA, 23 nt, Brucella suis 1330
gcgucgcaccggauuugccaagc

SEQ ID NO: 442886 - RNA, 15 nt, Brucella suis 1330
gcggucgcccauaug

SEQ ID NO: 442887 - RNA, 19 nt, Brucella suis 1330
gcgggugaagguccauagc

SEQ ID NO: 442888 - RNA, 14 nt, Brucella suis 1330
gcggggcgacgcug

SEQ ID NO: 442889 - RNA, 19 nt, Brucella suis 1330
gcgggccaugguuucggcg

SEQ ID NO: 442890 - RNA, 18 nt, Brucella suis 1330
gcgggcaauggccgcaug

SEQ ID NO: 442891 - RNA, 20 nt, Brucella suis 1330
gcgggaugacgccgggcaug

SEQ ID NO: 442892 - RNA, 16 nt, Brucella suis 1330
gcggcuuucgccgccc

SEQ ID NO: 442893 - RNA, 15 nt, Brucella suis 1330
gcggcuggaacgagc

SEQ ID NO: 442894 - RNA, 17 nt, Brucella suis 1330
gcggcugauaugcgcau

SEQ ID NO: 442895 - RNA, 17 nt, Brucella suis 1330
gcggcaggccgcaaagc

SEQ ID NO: 442896 - RNA, 14 nt, Brucella suis 1330
gcggcagcggcauc

SEQ ID NO: 442897 - RNA, 19 nt, Brucella suis 1330
gcggcagccgccgccgcaa

SEQ ID NO: 442898 - RNA, 14 nt, Brucella suis 1330
gcggcacgccgccc

SEQ ID NO: 442899 - RNA, 16 nt, Brucella suis 1330
gcggcacccccggcag

SEQ ID NO: 442900 - RNA, 14 nt, Brucella suis 1330
gcggcacaugaaau

SEQ ID NO: 442901 - RNA, 23 nt, Brucella suis 1330
gcggcaaauagcuuaugcgcgcc

SEQ ID NO: 442902 - RNA, 13 nt, Brucella suis 1330
gcggauuucaucg

SEQ ID NO: 442903 - RNA, 15 nt, Brucella suis 1330
gcggauggaccggcu

SEQ ID NO: 442904 - RNA, 14 nt, Brucella suis 1330
gcggaugaacccgc

SEQ ID NO: 442905 - RNA, 20 nt, Brucella suis 1330
gcggaucggcaggauagucu

SEQ ID NO: 442906 - RNA, 23 nt, Brucella suis 1330
gcggaucggcuucaauccgaaau

SEQ ID NO: 442907 - RNA, 20 nt, Brucella suis 1330
gcggaucguaucgccaaugc

SEQ ID NO: 442908 - RNA, 17 nt, Brucella suis 1330
gcggauauucgccgccu

SEQ ID NO: 442909 - RNA, 18 nt, Brucella suis 1330
gcggaucagcgcgccggu

SEQ ID NO: 442910 - RNA, 22 nt, Brucella suis 1330
gcggaucagcgcgccggucuuc

SEQ ID NO: 442911 - RNA, 22 nt, Brucella suis 1330
gcggaucagcuugccgccaauc

SEQ ID NO: 442912 - RNA, 19 nt, Brucella suis 1330
gcggauaguucaaggcugc

SEQ ID NO: 442913 - RNA, 16 nt, Brucella suis 1330
gcggaauucauccgcc

SEQ ID NO: 442914 - RNA, 13 nt, Brucella suis 1330
gcggaaugacaug

SEQ ID NO: 442915 - RNA, 21 nt, Brucella suis 1330
gcggaacugcaugggcucgac

SEQ ID NO: 442916 - RNA, 14 nt, Brucella suis 1330
gcggaagcauaugu

SEQ ID NO: 442917 - RNA, 20 nt, Brucella suis 1330
gcggaagcgagaaugaggcc

SEQ ID NO: 442918 - RNA, 16 nt, Brucella suis 1330
gcggaagcgaggggaa

SEQ ID NO: 442919 - RNA, 19 nt, Brucella suis 1330
gcgcugcucaucaucacau

SEQ ID NO: 442920 - RNA, 18 nt, Brucella suis 1330
gcgcugccauugccgcga

SEQ ID NO: 442921 - RNA, 18 nt, Brucella suis 1330
gcgcucuuuccgcgcauc

SEQ ID NO: 442922 - RNA, 13 nt, Brucella suis 1330
gcgcucgccgccc

SEQ ID NO: 442923 - RNA, 19 nt, Brucella suis 1330
gcgcggcggcaccgcaagu

SEQ ID NO: 442924 - RNA, 13 nt, Brucella suis 1330
gcgcggcggcacc

SEQ ID NO: 442925 - RNA, 14 nt, Brucella suis 1330
gcgcggcgcuucau

SEQ ID NO: 442926 - RNA, 22 nt, Brucella suis 1330
gcgcggcgcuucaucuuccgug

SEQ ID NO: 442927 - RNA, 15 nt, Brucella suis 1330
gcgcggcgaaacgcc

SEQ ID NO: 442928 - RNA, 21 nt, Brucella suis 1330
gcgcgcaaaccaggaccgcga

SEQ ID NO: 442929 - RNA, 21 nt, Brucella suis 1330
gcgcgaucucguccucgauca

SEQ ID NO: 442930 - RNA, 20 nt, Brucella suis 1330
gcgcgaauuuucucagcguu

SEQ ID NO: 442931 - RNA, 14 nt, Brucella suis 1330
gcgcgaagcgcauc

SEQ ID NO: 442932 - RNA, 17 nt, Brucella suis 1330
gcgcgaacaugccugcc

SEQ ID NO: 442933 - RNA, 23 nt, Brucella suis 1330
gcgcgaaccagauccaccgcgcu

SEQ ID NO: 442934 - RNA, 21 nt, Brucella suis 1330
gcgccugaggccggacgcuuc

SEQ ID NO: 442935 - RNA, 16 nt, Brucella suis 1330
gcgccguaauggcgcg

SEQ ID NO: 442936 - RNA, 15 nt, Brucella suis 1330
gcgccgcacgcgcga

SEQ ID NO: 442937 - RNA, 16 nt, Brucella suis 1330
gcgccgaaaaucggca

SEQ ID NO: 442938 - RNA, 22 nt, Brucella suis 1330
gcgcccuugccggauaucgcca

SEQ ID NO: 442939 - RNA, 14 nt, Brucella suis 1330
gcgcccuccaccgc

SEQ ID NO: 442940 - RNA, 12 nt, Brucella suis 1330
gcgccaucggca

SEQ ID NO: 442941 - RNA, 14 nt, Brucella suis 1330
gcgccagccgccag

SEQ ID NO: 442942 - RNA, 14 nt, Brucella suis 1330
gcgccaaucgccgc

SEQ ID NO: 442943 - RNA, 14 nt, Brucella suis 1330
gcgcauggccgcag

SEQ ID NO: 442944 - RNA, 15 nt, Brucella suis 1330
gcgcaauaucggcga

SEQ ID NO: 442945 - RNA, 21 nt, Brucella suis 1330
gcgcaauaaugcagcgccgcg

SEQ ID NO: 442946 - RNA, 12 nt, Brucella suis 1330
gcgcaagugcug

SEQ ID NO: 442947 - RNA, 16 nt, Brucella suis 1330
gcgcaagggccgcauc

SEQ ID NO: 442948 - RNA, 17 nt, Brucella suis 1330
gcgcaacuggucggcga

SEQ ID NO: 442949 - RNA, 22 nt, Brucella suis 1330
gcgcaaaccaggaccgcgagga

SEQ ID NO: 442950 - RNA, 19 nt, Brucella suis 1330
gcgauuucgccuucgccga

SEQ ID NO: 442951 - RNA, 19 nt, Brucella suis 1330
gcgauuguaaaucugcgau

SEQ ID NO: 442952 - RNA, 17 nt, Brucella suis 1330
gcgauugcgcauugaca

SEQ ID NO: 442953 - RNA, 15 nt, Brucella suis 1330
gcgauggcgacgcgc

SEQ ID NO: 442954 - RNA, 15 nt, Brucella suis 1330
gcgauggcgccgcau

SEQ ID NO: 442955 - RNA, 16 nt, Brucella suis 1330
gcgauggcgccgcaug

SEQ ID NO: 442956 - RNA, 17 nt, Brucella suis 1330
gcgaugccugccaugcc

SEQ ID NO: 442957 - RNA, 17 nt, Brucella suis 1330
gcgaugagggccgugac

SEQ ID NO: 442958 - RNA, 14 nt, Brucella suis 1330
gcgaucucguccuc

SEQ ID NO: 442959 - RNA, 11 nt, Brucella suis 1330
gcgaucagcgc

SEQ ID NO: 442960 - RNA, 14 nt, Brucella suis 1330
gcgaucaccucgcc

SEQ ID NO: 442961 - RNA, 19 nt, Brucella suis 1330
gcgaucacggccauugccc

SEQ ID NO: 442962 - RNA, 14 nt, Brucella suis 1330
gcgaauuccacgau

SEQ ID NO: 442963 - RNA, 16 nt, Brucella suis 1330
gcgaauuucaucgccc

SEQ ID NO: 442964 - RNA, 13 nt, Brucella suis 1330
gcgaaggcccuuc

SEQ ID NO: 442965 - RNA, 21 nt, Brucella suis 1330
gccuuggcuuccagcgucagg

SEQ ID NO: 442966 - RNA, 19 nt, Brucella suis 1330
gccuuccgccucuucgaga

SEQ ID NO: 442967 - RNA, 19 nt, Brucella suis 1330
gccuuauaggcgcgcgccu

SEQ ID NO: 442968 - RNA, 13 nt, Brucella suis 1330
gccugccaugccg

SEQ ID NO: 442969 - RNA, 14 nt, Brucella suis 1330
gccugccaugccgc

SEQ ID NO: 442970 - RNA, 16 nt, Brucella suis 1330
gccugccaugccgcca

SEQ ID NO: 442971 - RNA, 18 nt, Brucella suis 1330
gccugcaucauaggccca

SEQ ID NO: 442972 - RNA, 22 nt, Brucella suis 1330
gccugcaccggcccaaaggccg

SEQ ID NO: 442973 - RNA, 21 nt, Brucella suis 1330
gccugcacaucaccauugccc

SEQ ID NO: 442974 - RNA, 18 nt, Brucella suis 1330
gccugcaccugcuggaac

SEQ ID NO: 442975 - RNA, 22 nt, Brucella suis 1330
gccugcaacugcaaggcaucgc

SEQ ID NO: 442976 - RNA, 17 nt, Brucella suis 1330
gccugacggugcagccc

SEQ ID NO: 442977 - RNA, 16 nt, Brucella suis 1330
gccugaaugaaaacga

SEQ ID NO: 442978 - RNA, 23 nt, Brucella suis 1330
gccugaaugaaaacgaggccgac

SEQ ID NO: 442979 - RNA, 17 nt, Brucella suis 1330
gccugaaaccgucacgc

SEQ ID NO: 442980 - RNA, 22 nt, Brucella suis 1330
gccugaaacagcauauugccga

SEQ ID NO: 442981 - RNA, 12 nt, Brucella suis 1330
gccucuuccagg

SEQ ID NO: 442982 - RNA, 13 nt, Brucella suis 1330
gccucggcaucgc

SEQ ID NO: 442983 - RNA, 22 nt, Brucella suis 1330
gccucggagccuucauugcggc

SEQ ID NO: 442984 - RNA, 18 nt, Brucella suis 1330
gccucaucgaucacggcg

SEQ ID NO: 442985 - RNA, 15 nt, Brucella suis 1330
gccguguagggcaag

SEQ ID NO: 442986 - RNA, 19 nt, Brucella suis 1330
gccgucgggaccaccggcc

SEQ ID NO: 442987 - RNA, 20 nt, Brucella suis 1330
gccgucgggaccaccggccu

SEQ ID NO: 442988 - RNA, 18 nt, Brucella suis 1330
gccgguugcuuccaugcc

SEQ ID NO: 442989 - RNA, 13 nt, Brucella suis 1330
gccgguuucgacu

SEQ ID NO: 442990 - RNA, 17 nt, Brucella suis 1330
gccgguuucgacuucgu

SEQ ID NO: 442991 - RNA, 21 nt, Brucella suis 1330
gccggcucauggucacgcgcc

SEQ ID NO: 442992 - RNA, 21 nt, Brucella suis 1330
gccggcgagggcgggcauggg

SEQ ID NO: 442993 - RNA, 23 nt, Brucella suis 1330
gccggagcgaccagcaacgcgcc

SEQ ID NO: 442994 - RNA, 19 nt, Brucella suis 1330
gccgcgcgcggcuuccagc

SEQ ID NO: 442995 - RNA, 13 nt, Brucella suis 1330
gccgcgcgcgcgc

SEQ ID NO: 442996 - RNA, 16 nt, Brucella suis 1330
gccgccagcauggcgu

SEQ ID NO: 442997 - RNA, 11 nt, Brucella suis 1330
gccgcaggcac

SEQ ID NO: 442998 - RNA, 20 nt, Brucella suis 1330
gccgcaggcacuggucggga

SEQ ID NO: 442999 - RNA, 22 nt, Brucella suis 1330
gccgcagcguuuugucauggcc

SEQ ID NO: 443000 - RNA, 23 nt, Brucella suis 1330
gccgcagaccacccggccgcccu

SEQ ID NO: 443001 - RNA, 13 nt, Brucella suis 1330
gccgauugccccg

SEQ ID NO: 443002 - RNA, 13 nt, Brucella suis 1330
gccgauuucggcg

SEQ ID NO: 443003 - RNA, 15 nt, Brucella suis 1330
gccgaucagcaucgc

SEQ ID NO: 443004 - RNA, 20 nt, Brucella suis 1330
gccgaucagcaucgcccccu

SEQ ID NO: 443005 - RNA, 19 nt, Brucella suis 1330
gccgaggaaauugacgcca

SEQ ID NO: 443006 - RNA, 14 nt, Brucella suis 1330
gccgagcggcgcau

SEQ ID NO: 443007 - RNA, 18 nt, Brucella suis 1330
gccgagaaugaccacgcc

SEQ ID NO: 443008 - RNA, 22 nt, Brucella suis 1330
gccgagaaugcgaauaucgucg

SEQ ID NO: 443009 - RNA, 18 nt, Brucella suis 1330
gccgacaaaaaacaccgc

SEQ ID NO: 443010 - RNA, 14 nt, Brucella suis 1330
gccgaauuccgcca

SEQ ID NO: 443011 - RNA, 16 nt, Brucella suis 1330
gcccgucgaccagcgc

SEQ ID NO: 443012 - RNA, 18 nt, Brucella suis 1330
gcccguccucaucgccgg

SEQ ID NO: 443013 - RNA, 17 nt, Brucella suis 1330
gcccggccuuuucggcu

SEQ ID NO: 443014 - RNA, 21 nt, Brucella suis 1330
gcccggaagcgaaaugccgau

SEQ ID NO: 443015 - RNA, 19 nt, Brucella suis 1330
gcccgcccgucuucggcgc

SEQ ID NO: 443016 - RNA, 14 nt, Brucella suis 1330
gcccgcccgccgca

SEQ ID NO: 443017 - RNA, 24 nt, Brucella suis 1330
gcccgaugaucuguucagccgcag

SEQ ID NO: 443018 - RNA, 19 nt, Brucella suis 1330
gcccgacaaagaucaucgc

SEQ ID NO: 443019 - RNA, 14 nt, Brucella suis 1330
gcccgaaagcagac

SEQ ID NO: 443020 - RNA, 17 nt, Brucella suis 1330
gcccgaacaauuugcgg

SEQ ID NO: 443021 - RNA, 21 nt, Brucella suis 1330
gcccgaacaauuugcgggccg

SEQ ID NO: 443022 - RNA, 14 nt, Brucella suis 1330
gccccuaaaggcuc

SEQ ID NO: 443023 - RNA, 23 nt, Brucella suis 1330
gccccuaaaggcucugcgccagc

SEQ ID NO: 443024 - RNA, 22 nt, Brucella suis 1330
gcccauuggaaauuauagccgc

SEQ ID NO: 443025 - RNA, 16 nt, Brucella suis 1330
gcccauguccgccuga

SEQ ID NO: 443026 - RNA, 16 nt, Brucella suis 1330
gcccauggugccagcg

SEQ ID NO: 443027 - RNA, 20 nt, Brucella suis 1330
gcccauucaaccgugcggca

SEQ ID NO: 443028 - RNA, 14 nt, Brucella suis 1330
gcccaaucucgaua

SEQ ID NO: 443029 - RNA, 16 nt, Brucella suis 1330
gcccaaaagcgcgccg

SEQ ID NO: 443030 - RNA, 18 nt, Brucella suis 1330
gcccaaaggccgcgccga

SEQ ID NO: 443031 - RNA, 17 nt, Brucella suis 1330
gccauuauucucccaga

SEQ ID NO: 443032 - RNA, 19 nt, Brucella suis 1330
gccauggcuucaagcggcg

SEQ ID NO: 443033 - RNA, 16 nt, Brucella suis 1330
gccaucuucuuccagu

SEQ ID NO: 443034 - RNA, 21 nt, Brucella suis 1330
gccaucuuucuugaagucauc

SEQ ID NO: 443035 - RNA, 23 nt, Brucella suis 1330
gccaucuuucuugaagucaucac

SEQ ID NO: 443036 - RNA, 14 nt, Brucella suis 1330
gccaucgccgacgc

SEQ ID NO: 443037 - RNA, 14 nt, Brucella suis 1330
gccauaggucacgc

SEQ ID NO: 443038 - RNA, 13 nt, Brucella suis 1330
gccauauccgcca

SEQ ID NO: 443039 - RNA, 16 nt, Brucella suis 1330
gccauauccgccaccg

SEQ ID NO: 443040 - RNA, 18 nt, Brucella suis 1330
gccauauugggagcgcag

SEQ ID NO: 443041 - RNA, 19 nt, Brucella suis 1330
gccauauugggagcgcagu

SEQ ID NO: 443042 - RNA, 17 nt, Brucella suis 1330
gccauagacgcgcagac

SEQ ID NO: 443043 - RNA, 17 nt, Brucella suis 1330
gccaggccgauugccga

SEQ ID NO: 443044 - RNA, 21 nt, Brucella suis 1330
gccagcggcagaccugcgcaa

SEQ ID NO: 443045 - RNA, 21 nt, Brucella suis 1330
gccagccauuucagcggcgau

SEQ ID NO: 443046 - RNA, 14 nt, Brucella suis 1330
gccagaugcgcaaa

SEQ ID NO: 443047 - RNA, 17 nt, Brucella suis 1330
gccagaucgauggugcg

SEQ ID NO: 443048 - RNA, 13 nt, Brucella suis 1330
gccagaucauuga

SEQ ID NO: 443049 - RNA, 21 nt, Brucella suis 1330
gccagauccgcugacugcgcc

SEQ ID NO: 443050 - RNA, 22 nt, Brucella suis 1330
gccagaaagacauuuucgccgg

SEQ ID NO: 443051 - RNA, 15 nt, Brucella suis 1330
gccacggcuuucggu

SEQ ID NO: 443052 - RNA, 21 nt, Brucella suis 1330
gccacggcgaaagcugccgcg

SEQ ID NO: 443053 - RNA, 22 nt, Brucella suis 1330
gccacggcgaaagcugccgcga

SEQ ID NO: 443054 - RNA, 13 nt, Brucella suis 1330
gccacgaggaaga

SEQ ID NO: 443055 - RNA, 20 nt, Brucella suis 1330
gccaaccguaucauccggcg

SEQ ID NO: 443056 - RNA, 15 nt, Brucella suis 1330
gccaaaacgcagccg

SEQ ID NO: 443057 - RNA, 12 nt, Brucella suis 1330
gcauuuccagca

SEQ ID NO: 443058 - RNA, 16 nt, Brucella suis 1330
gcauuguggugcgcau

SEQ ID NO: 443059 - RNA, 14 nt, Brucella suis 1330
gcauuggaaacgcc

SEQ ID NO: 443060 - RNA, 20 nt, Brucella suis 1330
gcauugacaagcgugagcuu

SEQ ID NO: 443061 - RNA, 14 nt, Brucella suis 1330
gcauugaaaggcag

SEQ ID NO: 443062 - RNA, 16 nt, Brucella suis 1330
gcauuccgggccgcac

SEQ ID NO: 443063 - RNA, 16 nt, Brucella suis 1330
gcauguugcccaucgc

SEQ ID NO: 443064 - RNA, 22 nt, Brucella suis 1330
gcaugucauuugcgaccauggc

SEQ ID NO: 443065 - RNA, 21 nt, Brucella suis 1330
gcaugguucuggaaucgagau

SEQ ID NO: 443066 - RNA, 22 nt, Brucella suis 1330
gcaugggccgcacguuccgcau

SEQ ID NO: 443067 - RNA, 14 nt, Brucella suis 1330
gcauggcagccgau

SEQ ID NO: 443068 - RNA, 14 nt, Brucella suis 1330
gcauggaccacgcg

SEQ ID NO: 443069 - RNA, 14 nt, Brucella suis 1330
gcaugaacaugcgc

SEQ ID NO: 443070 - RNA, 15 nt, Brucella suis 1330
gcaugaaaacgccgc

SEQ ID NO: 443071 - RNA, 18 nt, Brucella suis 1330
gcaucugauuugaaaagc

SEQ ID NO: 443072 - RNA, 18 nt, Brucella suis 1330
gcaucgucaaucacgcca

SEQ ID NO: 443073 - RNA, 16 nt, Brucella suis 1330
gcaucguaaucgccgg

SEQ ID NO: 443074 - RNA, 18 nt, Brucella suis 1330
gcaucgguggcauugccc

SEQ ID NO: 443075 - RNA, 20 nt, Brucella suis 1330
gcaucggucagcacgcccgu

SEQ ID NO: 443076 - RNA, 14 nt, Brucella suis 1330
gcaucgcgguucgg

SEQ ID NO: 443077 - RNA, 11 nt, Brucella suis 1330
gcaucgccgcc

SEQ ID NO: 443078 - RNA, 13 nt, Brucella suis 1330
gcaucgcccgaga

SEQ ID NO: 443079 - RNA, 17 nt, Brucella suis 1330
gcaucgaucacaugcgc

SEQ ID NO: 443080 - RNA, 15 nt, Brucella suis 1330
gcaucgaaugccgca

SEQ ID NO: 443081 - RNA, 22 nt, Brucella suis 1330
gcaucgagcggcacgaugcgca

SEQ ID NO: 443082 - RNA, 13 nt, Brucella suis 1330
gcaucgaccagcc

SEQ ID NO: 443083 - RNA, 18 nt, Brucella suis 1330
gcaucaauccuucaugcc

SEQ ID NO: 443084 - RNA, 16 nt, Brucella suis 1330
gcauagccggcaugga

SEQ ID NO: 443085 - RNA, 11 nt, Brucella suis 1330
gcauaaucgcg

SEQ ID NO: 443086 - RNA, 19 nt, Brucella suis 1330
gcauaaucgcgccaugcac

SEQ ID NO: 443087 - RNA, 19 nt, Brucella suis 1330
gcagguuccaguccagcgc

SEQ ID NO: 443088 - RNA, 21 nt, Brucella suis 1330
gcaggcgcucuuuccgcgcau

SEQ ID NO: 443089 - RNA, 19 nt, Brucella suis 1330
gcaggcgcgaucaugccca

SEQ ID NO: 443090 - RNA, 16 nt, Brucella suis 1330
gcaggccgcaaagcga

SEQ ID NO: 443091 - RNA, 20 nt, Brucella suis 1330
gcaggcagaugcgaagcgga

SEQ ID NO: 443092 - RNA, 14 nt, Brucella suis 1330
gcagcggcgcgcca

SEQ ID NO: 443093 - RNA, 13 nt, Brucella suis 1330
gcagcggcgacgg

SEQ ID NO: 443094 - RNA, 15 nt, Brucella suis 1330
gcagcgacccgcgcc

SEQ ID NO: 443095 - RNA, 21 nt, Brucella suis 1330
gcagccuuucaaugucgccgg

SEQ ID NO: 443096 - RNA, 17 nt, Brucella suis 1330
gcagccgcgucagccgg

SEQ ID NO: 443097 - RNA, 16 nt, Brucella suis 1330
gcagcaggcagacgaa

SEQ ID NO: 443098 - RNA, 21 nt, Brucella suis 1330
gcagcagcgcaaacucgucgg

SEQ ID NO: 443099 - RNA, 13 nt, Brucella suis 1330
gcagcagcaucgc

SEQ ID NO: 443100 - RNA, 14 nt, Brucella suis 1330
gcagcagcaucgcc

SEQ ID NO: 443101 - RNA, 15 nt, Brucella suis 1330
gcagcaaagugcaau

SEQ ID NO: 443102 - RNA, 13 nt, Brucella suis 1330
gcagacgggaagc

SEQ ID NO: 443103 - RNA, 16 nt, Brucella suis 1330
gcagaccuuuggcguc

SEQ ID NO: 443104 - RNA, 18 nt, Brucella suis 1330
gcagaaguuucagcgcau

SEQ ID NO: 443105 - RNA, 15 nt, Brucella suis 1330
gcacucaucaaaagc

SEQ ID NO: 443106 - RNA, 22 nt, Brucella suis 1330
gcacggcgaaugacuucaucgc

SEQ ID NO: 443107 - RNA, 14 nt, Brucella suis 1330
gcacgccugccgcg

SEQ ID NO: 443108 - RNA, 20 nt, Brucella suis 1330
gcacgaccagcgcaaugccc

SEQ ID NO: 443109 - RNA, 20 nt, Brucella suis 1330
gcacgaacagaucgccaagc

SEQ ID NO: 443110 - RNA, 13 nt, Brucella suis 1330
gcaccgcacuggg

SEQ ID NO: 443111 - RNA, 12 nt, Brucella suis 1330
gcaccgaucacg

SEQ ID NO: 443112 - RNA, 15 nt, Brucella suis 1330
gcacaauaugguccg

SEQ ID NO: 443113 - RNA, 18 nt, Brucella suis 1330
gcaauugcgcaaggcccu

SEQ ID NO: 443114 - RNA, 21 nt, Brucella suis 1330
gcaauugaccgcuaucgcugc

SEQ ID NO: 443115 - RNA, 14 nt, Brucella suis 1330
gcaaugagcgcgcu

SEQ ID NO: 443116 - RNA, 22 nt, Brucella suis 1330
gcaaugauagcuggaaaaaauc

SEQ ID NO: 443117 - RNA, 18 nt, Brucella suis 1330
gcaaugcaccgauggcca

SEQ ID NO: 443118 - RNA, 20 nt, Brucella suis 1330
gcaaucugguccacgcccuu

SEQ ID NO: 443119 - RNA, 19 nt, Brucella suis 1330
gcaauccccggaccacgca

SEQ ID NO: 443120 - RNA, 18 nt, Brucella suis 1330
gcaagugugcgcgcgcca

SEQ ID NO: 443121 - RNA, 21 nt, Brucella suis 1330
gcaaggcgcgcccgucaccgc

SEQ ID NO: 443122 - RNA, 18 nt, Brucella suis 1330
gcaagcuggaaccagcgu

SEQ ID NO: 443123 - RNA, 18 nt, Brucella suis 1330
gcaagcgggccuuuuuca

SEQ ID NO: 443124 - RNA, 16 nt, Brucella suis 1330
gcaagcccgcugcgcc

SEQ ID NO: 443125 - RNA, 15 nt, Brucella suis 1330
gcaagauaagcgccg

SEQ ID NO: 443126 - RNA, 22 nt, Brucella suis 1330
gcaagaauggcuccguccggcc

SEQ ID NO: 443127 - RNA, 19 nt, Brucella suis 1330
gcaacugaucgagauaagc

SEQ ID NO: 443128 - RNA, 22 nt, Brucella suis 1330
gcaacauugauguguccggcgu

SEQ ID NO: 443129 - RNA, 18 nt, Brucella suis 1330
gcaacagggcgaaaagcc

SEQ ID NO: 443130 - RNA, 20 nt, Brucella suis 1330
gcaacaaaugcaaaugccgc

SEQ ID NO: 443131 - RNA, 20 nt, Brucella suis 1330
gcaaagcuuuggaaccggcu

SEQ ID NO: 443132 - RNA, 13 nt, Brucella suis 1330
gauuucugauccc

SEQ ID NO: 443133 - RNA, 17 nt, Brucella suis 1330
gauuucugaucccgcuu

SEQ ID NO: 443134 - RNA, 22 nt, Brucella suis 1330
gauuucugaucccgcuucgaug

SEQ ID NO: 443135 - RNA, 18 nt, Brucella suis 1330
gauugaagccgauccgca

SEQ ID NO: 443136 - RNA, 14 nt, Brucella suis 1330
gauugggcgaugau

SEQ ID NO: 443137 - RNA, 15 nt, Brucella suis 1330
gauguuccgguucua

SEQ ID NO: 443138 - RNA, 23 nt, Brucella suis 1330
gauuaugcuauagagcgccgauc

SEQ ID NO: 443139 - RNA, 17 nt, Brucella suis 1330
gauuaugcuuuaaaagc

SEQ ID NO: 443140 - RNA, 20 nt, Brucella suis 1330
gauggcugcccgcgccgguc

SEQ ID NO: 443141 - RNA, 15 nt, Brucella suis 1330
gauggcgacgcgcuc

SEQ ID NO: 443142 - RNA, 17 nt, Brucella suis 1330
gauggccgggaaugcgg

SEQ ID NO: 443143 - RNA, 12 nt, Brucella suis 1330
gauggagcggcu

SEQ ID NO: 443144 - RNA, 13 nt, Brucella suis 1330
gaugcguuggaaa

SEQ ID NO: 443145 - RNA, 20 nt, Brucella suis 1330
gaugcgcggauaaacgcuuc

SEQ ID NO: 443146 - RNA, 23 nt, Brucella suis 1330
gaucuguucagccgcagccgcca

SEQ ID NO: 443147 - RNA, 15 nt, Brucella suis 1330
gaucguauccccggc

SEQ ID NO: 443148 - RNA, 23 nt, Brucella suis 1330
gaucgggucgaucaucagcggcg

SEQ ID NO: 443149 - RNA, 23 nt, Brucella suis 1330
gaucgcaccgauauagagcagca

SEQ ID NO: 443150 - RNA, 22 nt, Brucella suis 1330
gaucgaagggcugagggaaaca

SEQ ID NO: 443151 - RNA, 15 nt, Brucella suis 1330
gauccggcgaauggc

SEQ ID NO: 443152 - RNA, 21 nt, Brucella suis 1330
gauccgccaaucagaaugcgu

SEQ ID NO: 443153 - RNA, 18 nt, Brucella suis 1330
gaucauugccccaaggcg

SEQ ID NO: 443154 - RNA, 14 nt, Brucella suis 1330
gaucaggaauacgc

SEQ ID NO: 443155 - RNA, 22 nt, Brucella suis 1330
gaucagcuugucgucgugcagc

SEQ ID NO: 443156 - RNA, 16 nt, Brucella suis 1330
gaucagcgcgccgguc

SEQ ID NO: 443157 - RNA, 17 nt, Brucella suis 1330
gauaugccgacgcgcuc

SEQ ID NO: 443158 - RNA, 20 nt, Brucella suis 1330
gauauagagcagcaccggcg

SEQ ID NO: 443159 - RNA, 13 nt, Brucella suis 1330
gauauucgccgcc

SEQ ID NO: 443160 - RNA, 14 nt, Brucella suis 1330
gauauucgccgccu

SEQ ID NO: 443161 - RNA, 15 nt, Brucella suis 1330
gauagcgcccgccuc

SEQ ID NO: 443162 - RNA, 14 nt, Brucella suis 1330
gauagaaccaccgc

SEQ ID NO: 443163 - RNA, 15 nt, Brucella suis 1330
gauagagggccgaau

SEQ ID NO: 443164 - RNA, 23 nt, Brucella suis 1330
gauacgccccgugaucuugucca

SEQ ID NO: 443165 - RNA, 14 nt, Brucella suis 1330
gaggcggcugcggc

SEQ ID NO: 443166 - RNA, 23 nt, Brucella suis 1330
gaggccgauaagugccgcgccga

SEQ ID NO: 443167 - RNA, 14 nt, Brucella suis 1330
gagcagcaccggcg

SEQ ID NO: 443168 - RNA, 20 nt, Brucella suis 1330
gagcaaucccgucaagacaa

SEQ ID NO: 443169 - RNA, 11 nt, Brucella suis 1330
gagauugccgc

SEQ ID NO: 443170 - RNA, 18 nt, Brucella suis 1330
gagaucguaggcuuuccc

SEQ ID NO: 443171 - RNA, 22 nt, Brucella suis 1330
gagagcaugaucgcccgcccgg

SEQ ID NO: 443172 - RNA, 19 nt, Brucella suis 1330
gagacggguugcaccgcuc

SEQ ID NO: 443173 - RNA, 22 nt, Brucella suis 1330
gagaaccgauuaaaaaaggaug

SEQ ID NO: 443174 - RNA, 18 nt, Brucella suis 1330
gacuuuaauugucggcgu

SEQ ID NO: 443175 - RNA, 15 nt, Brucella suis 1330
gacuggcggccaagc

SEQ ID NO: 443176 - RNA, 20 nt, Brucella suis 1330
gacgugaccgccuggcccgg

SEQ ID NO: 443177 - RNA, 19 nt, Brucella suis 1330
gacggucgaagccacggcg

SEQ ID NO: 443178 - RNA, 23 nt, Brucella suis 1330
gacgggguuucgccggugcccgg

SEQ ID NO: 443179 - RNA, 15 nt, Brucella suis 1330
gacggcgugaugcgc

SEQ ID NO: 443180 - RNA, 21 nt, Brucella suis 1330
gacgcuuggcaccgccugcgc

SEQ ID NO: 443181 - RNA, 23 nt, Brucella suis 1330
gacggauggcauggaccacgcgc

SEQ ID NO: 443182 - RNA, 19 nt, Brucella suis 1330
gacgcugcaacacgccgcc

SEQ ID NO: 443183 - RNA, 22 nt, Brucella suis 1330
gaccuuguuaauucugccgcuc

SEQ ID NO: 443184 - RNA, 20 nt, Brucella suis 1330
gaccuucgaguucgccagca

SEQ ID NO: 443185 - RNA, 13 nt, Brucella suis 1330
gaccgaaggccag

SEQ ID NO: 443186 - RNA, 14 nt, Brucella suis 1330
gaccaugacgccgc

SEQ ID NO: 443187 - RNA, 14 nt, Brucella suis 1330
gaccagcaggaaga

SEQ ID NO: 443188 - RNA, 23 nt, Brucella suis 1330
gaccagcaggaagaaggcgacga

SEQ ID NO: 443189 - RNA, 21 nt, Brucella suis 1330
gaccaccggccugagccauau

SEQ ID NO: 443190 - RNA, 22 nt, Brucella suis 1330
gaccaccggccugagccauauc

SEQ ID NO: 443191 - RNA, 13 nt, Brucella suis 1330
gaccacauugccc

SEQ ID NO: 443192 - RNA, 21 nt, Brucella suis 1330
gaccacauugccccacggauc

SEQ ID NO: 443193 - RNA, 23 nt, Brucella suis 1330
gacauccaucggcucauccucca

SEQ ID NO: 443194 - RNA, 19 nt, Brucella suis 1330
gacagggcaagcgccugcu

SEQ ID NO: 443195 - RNA, 21 nt, Brucella suis 1330
gacaaguccuaaaacaccggc

SEQ ID NO: 443196 - RNA, 15 nt, Brucella suis 1330
gacaaucaggccgau

SEQ ID NO: 443197 - RNA, 17 nt, Brucella suis 1330
gacaacgggugcgcugc

SEQ ID NO: 443198 - RNA, 16 nt, Brucella suis 1330
gaauggcuugcuggag

SEQ ID NO: 443199 - RNA, 17 nt, Brucella suis 1330
gaauggcgaaaucgcca

SEQ ID NO: 443200 - RNA, 16 nt, Brucella suis 1330
gaaugacuucaucgcg

SEQ ID NO: 443201 - RNA, 17 nt, Brucella suis 1330
gacaaaaaacaccgcgc

SEQ ID NO: 443202 - RNA, 13 nt, Brucella suis 1330
gaauccgcgacgc

SEQ ID NO: 443203 - RNA, 22 nt, Brucella suis 1330
gaaucccggugaggggccaaag

SEQ ID NO: 443204 - RNA, 20 nt, Brucella suis 1330
gaaccgcucuaucucuuugu

SEQ ID NO: 443205 - RNA, 19 nt, Brucella suis 1330
gaaccgaggcaaugaaaac

SEQ ID NO: 443206 - RNA, 22 nt, Brucella suis 1330
gaaccgggcccuucucgacagc

SEQ ID NO: 443207 - RNA, 23 nt, Brucella suis 1330
gaaccgggcccuucucgacagcc

SEQ ID NO: 443208 - RNA, 13 nt, Brucella suis 1330
gaaccgggccgca

SEQ ID NO: 443209 - RNA, 18 nt, Brucella suis 1330
gaaccgucgccagcucgc

SEQ ID NO: 443210 - RNA, 14 nt, Brucella suis 1330
gaacccgccgaccg

SEQ ID NO: 443211 - RNA, 19 nt, Brucella suis 1330
gaaccagauccaccgcgcu

SEQ ID NO: 443212 - RNA, 18 nt, Brucella suis 1330
gaacauauguuucggggc

SEQ ID NO: 443213 - RNA, 15 nt, Brucella suis 1330
gaacaggagcggaag

SEQ ID NO: 443214 - RNA, 19 nt, Brucella suis 1330
gaacacgccgacgcggcag

SEQ ID NO: 443215 - RNA, 20 nt, Brucella suis 1330
gaacacagagacaggaaaag

SEQ ID NO: 443216 - RNA, 14 nt, Brucella suis 1330
gaaauuauagccgc

SEQ ID NO: 443217 - RNA, 16 nt, Brucella suis 1330
gaaauucgcuguugcg

SEQ ID NO: 443218 - RNA, 21 nt, Brucella suis 1330
gaaauucgcuguugcgcccgc

SEQ ID NO: 443219 - RNA, 21 nt, Brucella suis 1330
gaaaugcggaucguaucgcca

SEQ ID NO: 443220 - RNA, 12 nt, Brucella suis 1330
gaaaugaaagcc

SEQ ID NO: 443221 - RNA, 17 nt, Brucella suis 1330
gaaaugaacaucggcgc

SEQ ID NO: 443222 - RNA, 22 nt, Brucella suis 1330
gaaauccuggaacaggcccagc

SEQ ID NO: 443223 - RNA, 13 nt, Brucella suis 1330
gaaauaucgccga

SEQ ID NO: 443224 - RNA, 22 nt, Brucella suis 1330
gaaaggccgaggcaaccgccuc

SEQ ID NO: 443225 - RNA, 19 nt, Brucella suis 1330
gaaaggcucuauuuuucca

SEQ ID NO: 443226 - RNA, 14 nt, Brucella suis 1330
gaaagccuuuucga

SEQ ID NO: 443227 - RNA, 20 nt, Brucella suis 1330
gaaagccucgaucacccgau

SEQ ID NO: 443228 - RNA, 14 nt, Brucella suis 1330
gaaagcccggcugg

SEQ ID NO: 443229 - RNA, 22 nt, Brucella suis 1330
gaaagcccaguucguggcgggg

SEQ ID NO: 443230 - RNA, 20 nt, Brucella suis 1330
gaaagacauuuucgccgggg

SEQ ID NO: 443231 - RNA, 15 nt, Brucella suis 1330
gaaaauggcgcuagc

SEQ ID NO: 443232 - RNA, 15 nt, Brucella suis 1330
cuuuucggcggaaag

SEQ ID NO: 443233 - RNA, 18 nt, Brucella suis 1330
cuuuuccaccggcccgcg

SEQ ID NO: 443234 - RNA, 22 nt, Brucella suis 1330
cuuuuccagugcaaagcggcuu

SEQ ID NO: 443235 - RNA, 23 nt, Brucella suis 1330
cuuuaaagcaggaucggcagcag

SEQ ID NO: 443236 - RNA, 14 nt, Brucella suis 1330
cuuguguacccaaa

SEQ ID NO: 443237 - RNA, 20 nt, Brucella suis 1330
cuugcuguaaccgccaccuu

SEQ ID NO: 443238 - RNA, 19 nt, Brucella suis 1330
cuugcuugaagcaaggcgg

SEQ ID NO: 443239 - RNA, 16 nt, Brucella suis 1330
cuugcgcuuugcaagc

SEQ ID NO: 443240 - RNA, 17 nt, Brucella suis 1330
cuugcgccaaucgccgc

SEQ ID NO: 443241 - RNA, 23 nt, Brucella suis 1330
cuugccguuggcauccacucggc

SEQ ID NO: 443242 - RNA, 11 nt, Brucella suis 1330
cuugcccgcau

SEQ ID NO: 443243 - RNA, 17 nt, Brucella suis 1330
cuucggcaagggcaagc

SEQ ID NO: 443244 - RNA, 14 nt, Brucella suis 1330
cuucgaguucgcca

SEQ ID NO: 443245 - RNA, 19 nt, Brucella suis 1330
cuucagaucgcgcggcgaa

SEQ ID NO: 443246 - RNA, 15 nt, Brucella suis 1330
cuuagauaagcgcgu

SEQ ID NO: 443247 - RNA, 22 nt, Brucella suis 1330
cuguaaacugccgcguccggca

SEQ ID NO: 443248 - RNA, 15 nt, Brucella suis 1330
cuggguugaacgguc

SEQ ID NO: 443249 - RNA, 19 nt, Brucella suis 1330
cuggcuucucuugccgccg

SEQ ID NO: 443250 - RNA, 14 nt, Brucella suis 1330
cuggcgcagcagca

SEQ ID NO: 443251 - RNA, 22 nt, Brucella suis 1330
cuggcgaaaacggccaugcgca

SEQ ID NO: 443252 - RNA, 20 nt, Brucella suis 1330
cuggccgacaccgaccggca

SEQ ID NO: 443253 - RNA, 17 nt, Brucella suis 1330
cuggagcucccgaagga

SEQ ID NO: 443254 - RNA, 20 nt, Brucella suis 1330
cugccuccauggcgucccca

SEQ ID NO: 443255 - RNA, 18 nt, Brucella suis 1330
cugccgguauuuugcaac

SEQ ID NO: 443256 - RNA, 24 nt, Brucella suis 1330
cugccggugcauccucgaaaacaa

SEQ ID NO: 443257 - RNA, 15 nt, Brucella suis 1330
cugccauggcaguga

SEQ ID NO: 443258 - RNA, 17 nt, Brucella suis 1330
cugccaaccauugaucu

SEQ ID NO: 443259 - RNA, 20 nt, Brucella suis 1330
cugcaucggcuugggaagau

SEQ ID NO: 443260 - RNA, 22 nt, Brucella suis 1330
cugaugcagcaaagugcaauca

SEQ ID NO: 443261 - RNA, 22 nt, Brucella suis 1330
cugcaacaaaagaagauuucgu

SEQ ID NO: 443262 - RNA, 16 nt, Brucella suis 1330
cugaugagccgcuugu

SEQ ID NO: 443263 - RNA, 16 nt, Brucella suis 1330
cugaucgucaggcgca

SEQ ID NO: 443264 - RNA, 22 nt, Brucella suis 1330
cugauccagaagccgcuugcau

SEQ ID NO: 443265 - RNA, 22 nt, Brucella suis 1330
cugauauugugucagcgggcaa

SEQ ID NO: 443266 - RNA, 16 nt, Brucella suis 1330
cugauaugcgcaugaa

SEQ ID NO: 443267 - RNA, 20 nt, Brucella suis 1330
cugacggauuucggcggcgu

SEQ ID NO: 443268 - RNA, 18 nt, Brucella suis 1330
cugacggcgcagcgacuu

SEQ ID NO: 443269 - RNA, 18 nt, Brucella suis 1330
cugaccagccuugcccug

SEQ ID NO: 443270 - RNA, 17 nt, Brucella suis 1330
cugaauccgcgacgccg

SEQ ID NO: 443271 - RNA, 19 nt, Brucella suis 1330
cugaaguaugggaugaaag

SEQ ID NO: 443272 - RNA, 12 nt, Brucella suis 1330
cugaaccggcga

SEQ ID NO: 443273 - RNA, 14 nt, Brucella suis 1330
cucugcgccagccu

SEQ ID NO: 443274 - RNA, 17 nt, Brucella suis 1330
cucugcgccagccuugc

SEQ ID NO: 443275 - RNA, 19 nt, Brucella suis 1330
cucuauugcccggcgguga

SEQ ID NO: 443276 - RNA, 13 nt, Brucella suis 1330
cucuauuucggcg

SEQ ID NO: 443277 - RNA, 12 nt, Brucella suis 1330
cucguuuucaug

SEQ ID NO: 443278 - RNA, 15 nt, Brucella suis 1330
cucguccggccagcc

SEQ ID NO: 443279 - RNA, 19 nt, Brucella suis 1330
cucggaguuuuucggccag

SEQ ID NO: 443280 - RNA, 13 nt, Brucella suis 1330
cucgcucucgcau

SEQ ID NO: 443281 - RNA, 15 nt, Brucella suis 1330
cucgccugcaccaug

SEQ ID NO: 443282 - RNA, 18 nt, Brucella suis 1330
cucgcgacaggacaccgu

SEQ ID NO: 443283 - RNA, 18 nt, Brucella suis 1330
cucgcauugagcgcccuu

SEQ ID NO: 443284 - RNA, 23 nt, Brucella suis 1330
cucgaaauaggucagcaggcgcc

SEQ ID NO: 443285 - RNA, 15 nt, Brucella suis 1330
cuccgcgcgaaagga

SEQ ID NO: 443286 - RNA, 17 nt, Brucella suis 1330
cuccgcccuggcggcgu

SEQ ID NO: 443287 - RNA, 15 nt, Brucella suis 1330
cuccgcaccgaaggc

SEQ ID NO: 443288 - RNA, 15 nt, Brucella suis 1330
cucccuguccugcca

SEQ ID NO: 443289 - RNA, 18 nt, Brucella suis 1330
cucccggucuuccugcga

SEQ ID NO: 443290 - RNA, 17 nt, Brucella suis 1330
cuccaugcggucggccg

SEQ ID NO: 443291 - RNA, 19 nt, Brucella suis 1330
cucauucggguugccuucg

SEQ ID NO: 443292 - RNA, 13 nt, Brucella suis 1330
cucaagaucugaa

SEQ ID NO: 443293 - RNA, 19 nt, Brucella suis 1330
cuaugcggggaaaucaguc

SEQ ID NO: 443294 - RNA, 19 nt, Brucella suis 1330
cguuaauuccacgcgccga

SEQ ID NO: 443295 - RNA, 19 nt, Brucella suis 1330
cguguugaccacauugccc

SEQ ID NO: 443296 - RNA, 14 nt, Brucella suis 1330
cgugucuugcccag

SEQ ID NO: 443297 - RNA, 14 nt, Brucella suis 1330
cguggucaugcgcg

SEQ ID NO: 443298 - RNA, 17 nt, Brucella suis 1330
cguggcgggggcggcgg

SEQ ID NO: 443299 - RNA, 19 nt, Brucella suis 1330
cguggcggcaaaaagcggc

SEQ ID NO: 443300 - RNA, 22 nt, Brucella suis 1330
cguggcgaagaucgaagcgaaa

SEQ ID NO: 443301 - RNA, 16 nt, Brucella suis 1330
cguggagggauaggug

SEQ ID NO: 443302 - RNA, 14 nt, Brucella suis 1330
cguggacgauucgc

SEQ ID NO: 443303 - RNA, 14 nt, Brucella suis 1330
cgugcaagagcaag

SEQ ID NO: 443304 - RNA, 16 nt, Brucella suis 1330
cgucgugcagcggcga

SEQ ID NO: 443305 - RNA, 21 nt, Brucella suis 1330
cgucgugcggccgcagcccgg

SEQ ID NO: 443306 - RNA, 14 nt, Brucella suis 1330
cgucgagcagcauc

SEQ ID NO: 443307 - RNA, 17 nt, Brucella suis 1330
cgucgagcagcaucuug

SEQ ID NO: 443308 - RNA, 15 nt, Brucella suis 1330
cgucgagcaaugcgc

SEQ ID NO: 443309 - RNA, 17 nt, Brucella suis 1330
cguccgguugcaggcgc

SEQ ID NO: 443310 - RNA, 21 nt, Brucella suis 1330
cguccgacaugggccgggcgc

SEQ ID NO: 443311 - RNA, 16 nt, Brucella suis 1330
cgucauuuccgugacg

SEQ ID NO: 443312 - RNA, 19 nt, Brucella suis 1330
cgucauucaucagcacgaa

SEQ ID NO: 443313 - RNA, 21 nt, Brucella suis 1330
cgucaucgccaccauggccgc

SEQ ID NO: 443314 - RNA, 23 nt, Brucella suis 1330
cgucaucgccaccauggccgccc

SEQ ID NO: 443315 - RNA, 14 nt, Brucella suis 1330
cgucaucaucgucu

SEQ ID NO: 443316 - RNA, 15 nt, Brucella suis 1330
cgucaggccgagcgc

SEQ ID NO: 443317 - RNA, 19 nt, Brucella suis 1330
cgucaggccgagcgcaucg

SEQ ID NO: 443318 - RNA, 13 nt, Brucella suis 1330
cguauuuucgagc

SEQ ID NO: 443319 - RNA, 11 nt, Brucella suis 1330
cguaugcgucc

SEQ ID NO: 443320 - RNA, 16 nt, Brucella suis 1330
cguaagcggcaauccu

SEQ ID NO: 443321 - RNA, 20 nt, Brucella suis 1330
cggugaagaagcgccagcuu

SEQ ID NO: 443322 - RNA, 19 nt, Brucella suis 1330
cggugaagacauggcgggc

SEQ ID NO: 443323 - RNA, 18 nt, Brucella suis 1330
cggucguuucgccgcccg

SEQ ID NO: 443324 - RNA, 14 nt, Brucella suis 1330
cggucggccucgcc

SEQ ID NO: 443325 - RNA, 15 nt, Brucella suis 1330
cggucgcaggcgcuc

SEQ ID NO: 443326 - RNA, 15 nt, Brucella suis 1330
cggucgagccgacau

SEQ ID NO: 443327 - RNA, 22 nt, Brucella suis 1330
cggucgaagcggcgcgaugcga

SEQ ID NO: 443328 - RNA, 17 nt, Brucella suis 1330
cgguccaccacaugcuc

SEQ ID NO: 443329 - RNA, 14 nt, Brucella suis 1330
cgggggaaugcggg

SEQ ID NO: 443330 - RNA, 19 nt, Brucella suis 1330
cgggcuuuuugaaggggcg

SEQ ID NO: 443331 - RNA, 22 nt, Brucella suis 1330
cgggcuguuggccggcagcggu

SEQ ID NO: 443332 - RNA, 15 nt, Brucella suis 1330
cgggcuucuuccagu

SEQ ID NO: 443333 - RNA, 19 nt, Brucella suis 1330
cgggcuucugcgcccgcgc

SEQ ID NO: 443334 - RNA, 12 nt, Brucella suis 1330
cgggcccuucgc

SEQ ID NO: 443335 - RNA, 22 nt, Brucella suis 1330
cgggccagguaucgugcagaag

SEQ ID NO: 443336 - RNA, 17 nt, Brucella suis 1330
cgggcagucagcaccgu

SEQ ID NO: 443337 - RNA, 19 nt, Brucella suis 1330
cgggcaguccggcagccga

SEQ ID NO: 443338 - RNA, 17 nt, Brucella suis 1330
cgggcagugaaagccgc

SEQ ID NO: 443339 - RNA, 18 nt, Brucella suis 1330
cgggcagugaaagccgcg

SEQ ID NO: 443340 - RNA, 14 nt, Brucella suis 1330
cgggcaaucgcccg

SEQ ID NO: 443341 - RNA, 20 nt, Brucella suis 1330
cgggcaaaaucgagugcggc

SEQ ID NO: 443342 - RNA, 23 nt, Brucella suis 1330
cgggaugcgcuuuaaagcaggau

SEQ ID NO: 443343 - RNA, 13 nt, Brucella suis 1330
cgggagcggcaca

SEQ ID NO: 443344 - RNA, 14 nt, Brucella suis 1330
cggcuugccgaccu

SEQ ID NO: 443345 - RNA, 21 nt, Brucella suis 1330
cggcucauucggguugccuuc

SEQ ID NO: 443346 - RNA, 14 nt, Brucella suis 1330
cggcgggagcggca

SEQ ID NO: 443347 - RNA, 14 nt, Brucella suis 1330
cggcggcuucgauc

SEQ ID NO: 443348 - RNA, 17 nt, Brucella suis 1330
cggcggcgucagcuugu

SEQ ID NO: 443349 - RNA, 22 nt, Brucella suis 1330
cggcggcgccaccgucaccggc

SEQ ID NO: 443350 - RNA, 17 nt, Brucella suis 1330
cggcgcgcugcaauggu

SEQ ID NO: 443351 - RNA, 18 nt, Brucella suis 1330
cggcgcgcaaguucgagc

SEQ ID NO: 443352 - RNA, 14 nt, Brucella suis 1330
cggcgcgaaacgcc

SEQ ID NO: 443353 - RNA, 17 nt, Brucella suis 1330
cggcgccuugaugccgc

SEQ ID NO: 443354 - RNA, 20 nt, Brucella suis 1330
cggcgauuuccacgcucgca

SEQ ID NO: 443355 - RNA, 12 nt, Brucella suis 1330
cggcgauuucgc

SEQ ID NO: 443356 - RNA, 24 nt, Brucella suis 1330
cggcgaaagccuugagauccgcau

SEQ ID NO: 443357 - RNA, 21 nt, Brucella suis 1330
cggccggucaagaggaacgac

SEQ ID NO: 443358 - RNA, 18 nt, Brucella suis 1330
cggccagccuauaucgcg

SEQ ID NO: 443359 - RNA, 16 nt, Brucella suis 1330
cggcaugucauuugcg

SEQ ID NO: 443360 - RNA, 22 nt, Brucella suis 1330
cggcauguaaaacuccgcgcga

SEQ ID NO: 443361 - RNA, 22 nt, Brucella suis 1330
cggcaggccgcaaagcgaacgc

SEQ ID NO: 443362 - RNA, 19 nt, Brucella suis 1330
cggcacccccggcaguuuc

SEQ ID NO: 443363 - RNA, 14 nt, Brucella suis 1330
cggcaacggcgcug

SEQ ID NO: 443364 - RNA, 14 nt, Brucella suis 1330
cggcaaccaucuuc

SEQ ID NO: 443365 - RNA, 21 nt, Brucella suis 1330
cggcaaaugucacgcucgucg

SEQ ID NO: 443366 - RNA, 24 nt, Brucella suis 1330
cggcaaauagcuuaugcgcgcccg

SEQ ID NO: 443367 - RNA, 17 nt, Brucella suis 1330
cggaugguucuugaaag

SEQ ID NO: 443368 - RNA, 19 nt, Brucella suis 1330
cggaugguucuugaaagcg

SEQ ID NO: 443369 - RNA, 21 nt, Brucella suis 1330
cggauggguaucggucacagc

SEQ ID NO: 443370 - RNA, 21 nt, Brucella suis 1330
cggaugacuucgguuuccaca

SEQ ID NO: 443371 - RNA, 13 nt, Brucella suis 1330
cggaucggcaagc

SEQ ID NO: 443372 - RNA, 15 nt, Brucella suis 1330
cggaucggaaacgcg

SEQ ID NO: 443373 - RNA, 16 nt, Brucella suis 1330
cggaagguuuuucggu

SEQ ID NO: 443374 - RNA, 18 nt, Brucella suis 1330
cggaagguuuuucgguuu

SEQ ID NO: 443375 - RNA, 19 nt, Brucella suis 1330
cggaagcgcguacggcauu

SEQ ID NO: 443376 - RNA, 17 nt, Brucella suis 1330
cggaagggcaaggcgcg

SEQ ID NO: 443377 - RNA, 20 nt, Brucella suis 1330
cggaacuggaugacaguuuc

SEQ ID NO: 443378 - RNA, 21 nt, Brucella suis 1330
cggaacauauaaagcaaaggc

SEQ ID NO: 443379 - RNA, 20 nt, Brucella suis 1330
cggaaccaucaucuucaccu

SEQ ID NO: 443380 - RNA, 17 nt, Brucella suis 1330
cggaaacgggcuugucg

SEQ ID NO: 443381 - RNA, 19 nt, Brucella suis 1330
cggaaaccaguggccuuca

SEQ ID NO: 443382 - RNA, 19 nt, Brucella suis 1330
cggaaaagcucgcgucccg

SEQ ID NO: 443383 - RNA, 18 nt, Brucella suis 1330
cggaaaaugcccggcgcg

SEQ ID NO: 443384 - RNA, 17 nt, Brucella suis 1330
cgcuuuauuccuuugau

SEQ ID NO: 443385 - RNA, 20 nt, Brucella suis 1330
cgcuugaggcucauaccgau

SEQ ID NO: 443386 - RNA, 18 nt, Brucella suis 1330
cgcuugcauuccagaagg

SEQ ID NO: 443387 - RNA, 20 nt, Brucella suis 1330
cgcuucuuccuucggcaagg

SEQ ID NO: 443388 - RNA, 22 nt, Brucella suis 1330
cgcuucgcugcgguagcgcaug

SEQ ID NO: 443389 - RNA, 16 nt, Brucella suis 1330
cgcuucgaugcguugg

SEQ ID NO: 443390 - RNA, 17 nt, Brucella suis 1330
cgcuucaugggcuugau

SEQ ID NO: 443391 - RNA, 16 nt, Brucella suis 1330
cgcuguaucaagcgau

SEQ ID NO: 443392 - RNA, 17 nt, Brucella suis 1330
cgcugauugggcggcgg

SEQ ID NO: 443393 - RNA, 14 nt, Brucella suis 1330
cgcugacugcgcca

SEQ ID NO: 443394 - RNA, 16 nt, Brucella suis 1330
cgcugaaugcggcaau

SEQ ID NO: 443395 - RNA, 20 nt, Brucella suis 1330
cgcucuaacagucgaagcgg

SEQ ID NO: 443396 - RNA, 23 nt, Brucella suis 1330
cgcucucgucgagaagcaucagc

SEQ ID NO: 443397 - RNA, 18 nt, Brucella suis 1330
cgcuaucagcucuucaca

SEQ ID NO: 443398 - RNA, 16 nt, Brucella suis 1330
cgcgggcgcagcgaca

SEQ ID NO: 443399 - RNA, 14 nt, Brucella suis 1330
cgcgcucggcaagc

SEQ ID NO: 443400 - RNA, 17 nt, Brucella suis 1330
cgcgcgccaucggcaag

SEQ ID NO: 443401 - RNA, 20 nt, Brucella suis 1330
cgcgcaaaaucugcucgucc

SEQ ID NO: 443402 - RNA, 16 nt, Brucella suis 1330
cgcgaugcggcgguga

SEQ ID NO: 443403 - RNA, 19 nt, Brucella suis 1330
cgcgaucuuacgaccaagc

SEQ ID NO: 443404 - RNA, 22 nt, Brucella suis 1330
cgcgaucacagccgcgccaauc

SEQ ID NO: 443405 - RNA, 14 nt, Brucella suis 1330
cgcgauaauauuga

SEQ ID NO: 443406 - RNA, 20 nt, Brucella suis 1330
cgcgagcggacggauggcau

SEQ ID NO: 443407 - RNA, 18 nt, Brucella suis 1330
cgcgacugucaccgccag

SEQ ID NO: 443408 - RNA, 22 nt, Brucella suis 1330
cgcgaaaccauggagcgcaucc

SEQ ID NO: 443409 - RNA, 21 nt, Brucella suis 1330
cgcgaaacgccuuauaggcgc

SEQ ID NO: 443410 - RNA, 15 nt, Brucella suis 1330
cgccugccaugccgc

SEQ ID NO: 443411 - RNA, 16 nt, Brucella suis 1330
cgccugccaugccgcc

SEQ ID NO: 443412 - RNA, 15 nt, Brucella suis 1330
cgccugaggcauuga

SEQ ID NO: 443413 - RNA, 20 nt, Brucella suis 1330
cgccucaauggucacggcca

SEQ ID NO: 443414 - RNA, 13 nt, Brucella suis 1330
cgccgugcugguu

SEQ ID NO: 443415 - RNA, 18 nt, Brucella suis 1330
cgccggggccggaugcgc

SEQ ID NO: 443416 - RNA, 17 nt, Brucella suis 1330
cgccggaagauggagcg

SEQ ID NO: 443417 - RNA, 16 nt, Brucella suis 1330
cgccgcgacgaugggc

SEQ ID NO: 443418 - RNA, 17 nt, Brucella suis 1330
cgccgcgacauagccga

SEQ ID NO: 443419 - RNA, 23 nt, Brucella suis 1330
cgccgccuucaaaacgcagcauc

SEQ ID NO: 443420 - RNA, 23 nt, Brucella suis 1330
cgccgccccgauaaggcggcguu

SEQ ID NO: 443421 - RNA, 20 nt, Brucella suis 1330
cgccgcauggcggcacccgc

SEQ ID NO: 443422 - RNA, 22 nt, Brucella suis 1330
cgcccgucccccaacgugcggu

SEQ ID NO: 443423 - RNA, 15 nt, Brucella suis 1330
cgcccgcaaaucguc

SEQ ID NO: 443424 - RNA, 18 nt, Brucella suis 1330
cgcccccuugauaggcgc

SEQ ID NO: 443425 - RNA, 19 nt, Brucella suis 1330
cgccauauugggagcgcag

SEQ ID NO: 443426 - RNA, 18 nt, Brucella suis 1330
cgccaguuuucgcggcag

SEQ ID NO: 443427 - RNA, 18 nt, Brucella suis 1330
cgccauaaccucgacggc

SEQ ID NO: 443428 - RNA, 14 nt, Brucella suis 1330
cgccagccgcgauc

SEQ ID NO: 443429 - RNA, 15 nt, Brucella suis 1330
cgccagaagcguaau

SEQ ID NO: 443430 - RNA, 20 nt, Brucella suis 1330
cgccagaagcguaaugcccc

SEQ ID NO: 443431 - RNA, 15 nt, Brucella suis 1330
cgccaauccccucac

SEQ ID NO: 443432 - RNA, 18 nt, Brucella suis 1330
cgccaaggcugcgcgcaa

SEQ ID NO: 443433 - RNA, 17 nt, Brucella suis 1330
cgcauuauccgacgcau

SEQ ID NO: 443434 - RNA, 22 nt, Brucella suis 1330
cgcauauugcuugucgaaagcg

SEQ ID NO: 443435 - RNA, 14 nt, Brucella suis 1330
cgcauaaagcacag

SEQ ID NO: 443436 - RNA, 21 nt, Brucella suis 1330
cgcagggucgcgaccuucuug

SEQ ID NO: 443437 - RNA, 21 nt, Brucella suis 1330
cgcaggcgagcauggaucgcc

SEQ ID NO: 443438 - RNA, 12 nt, Brucella suis 1330
cgcagaaggcgc

SEQ ID NO: 443439 - RNA, 14 nt, Brucella suis 1330
cgcaccgcacgcaa

SEQ ID NO: 443440 - RNA, 18 nt, Brucella suis 1330
cgcacaucgggucgaccu

SEQ ID NO: 443441 - RNA, 19 nt, Brucella suis 1330
cgcacauaaaacgcgccga

SEQ ID NO: 443442 - RNA, 13 nt, Brucella suis 1330
cgcacacggcgca

SEQ ID NO: 443443 - RNA, 18 nt, Brucella suis 1330
cgcaauuucaaagcgcgu

SEQ ID NO: 443444 - RNA, 19 nt, Brucella suis 1330
cgcaauggccuugccgauc

SEQ ID NO: 443445 - RNA, 20 nt, Brucella suis 1330
cgcaauuccggcaucgcugg

SEQ ID NO: 443446 - RNA, 18 nt, Brucella suis 1330
cgcaagacccaauccgcc

SEQ ID NO: 443447 - RNA, 18 nt, Brucella suis 1330
cgcaaggcuucgccagug

SEQ ID NO: 443448 - RNA, 13 nt, Brucella suis 1330
cgcaaggcggcgc

SEQ ID NO: 443449 - RNA, 19 nt, Brucella suis 1330
cgcaaccgguucagcccug

SEQ ID NO: 443450 - RNA, 14 nt, Brucella suis 1330
cgcaaccggcgggc

SEQ ID NO: 443451 - RNA, 13 nt, Brucella suis 1330
cgcaaacaucgac

SEQ ID NO: 443452 - RNA, 16 nt, Brucella suis 1330
cgauugucgagccgca

SEQ ID NO: 443453 - RNA, 22 nt, Brucella suis 1330
cgauugccccgccauaaagcac

SEQ ID NO: 443454 - RNA, 19 nt, Brucella suis 1330
cgauucgcuaucgaaacaa

SEQ ID NO: 443455 - RNA, 14 nt, Brucella suis 1330
cgauucgcgauccu

SEQ ID NO: 443456 - RNA, 22 nt, Brucella suis 1330
cgauggcguucgucaaugcgcg

SEQ ID NO: 443457 - RNA, 22 nt, Brucella suis 1330
cgauggccgaaccguccgguug

SEQ ID NO: 443458 - RNA, 12 nt, Brucella suis 1330
cgaugaugaucc

SEQ ID NO: 443459 - RNA, 21 nt, Brucella suis 1330
cgaugaucuguucagccgcag

SEQ ID NO: 443460 - RNA, 15 nt, Brucella suis 1330
cgaugacuuccggga

SEQ ID NO: 443461 - RNA, 16 nt, Brucella suis 1330
cgaugaccaccgcgaa

SEQ ID NO: 443462 - RNA, 19 nt, Brucella suis 1330
cgauccugcugcgcggcau

SEQ ID NO: 443463 - RNA, 20 nt, Brucella suis 1330
cgauccugcugcgcggcauu

SEQ ID NO: 443464 - RNA, 20 nt, Brucella suis 1330
cgauccaguugucgccgggc

SEQ ID NO: 443465 - RNA, 20 nt, Brucella suis 1330
cgauccauaucacgcuugcc

SEQ ID NO: 443466 - RNA, 19 nt, Brucella suis 1330
cgaucaucaucaccggcag

SEQ ID NO: 443467 - RNA, 21 nt, Brucella suis 1330
cgaucacgaccuucuuggagc

SEQ ID NO: 443468 - RNA, 18 nt, Brucella suis 1330
cgaucacggccauugccc

SEQ ID NO: 443469 - RNA, 16 nt, Brucella suis 1330
cgaucaccucgcccug

SEQ ID NO: 443470 - RNA, 20 nt, Brucella suis 1330
cgauaucggacuggauuucg

SEQ ID NO: 443471 - RNA, 19 nt, Brucella suis 1330
cgauauccucgaaagcgca

SEQ ID NO: 443472 - RNA, 16 nt, Brucella suis 1330
cgauauccuggccuuc

SEQ ID NO: 443473 - RNA, 23 nt, Brucella suis 1330
cgauaagcucgauaagauugcgg

SEQ ID NO: 443474 - RNA, 14 nt, Brucella suis 1330
cgauaaggcggcgu

SEQ ID NO: 443475 - RNA, 12 nt, Brucella suis 1330
cgaggaucggca

SEQ ID NO: 443476 - RNA, 18 nt, Brucella suis 1330
cgaggaauuucagcgaag

SEQ ID NO: 443477 - RNA, 22 nt, Brucella suis 1330
cgaggaaaaagcccgccacgag

SEQ ID NO: 443478 - RNA, 14 nt, Brucella suis 1330
cgagcgcagcggca

SEQ ID NO: 443479 - RNA, 21 nt, Brucella suis 1330
cgagaucgugggccucaagcg

SEQ ID NO: 443480 - RNA, 23 nt, Brucella suis 1330
cgacugcgaaugucaguugaucg

SEQ ID NO: 443481 - RNA, 16 nt, Brucella suis 1330
cgacggcgugaugcgc

SEQ ID NO: 443482 - RNA, 15 nt, Brucella suis 1330
cgacggaaacgagcg

SEQ ID NO: 443483 - RNA, 16 nt, Brucella suis 1330
cgacggaaacgagcgc

SEQ ID NO: 443484 - RNA, 14 nt, Brucella suis 1330
cgacgcccgccccc

SEQ ID NO: 443485 - RNA, 17 nt, Brucella suis 1330
cgacgauuucuuccaga

SEQ ID NO: 443486 - RNA, 16 nt, Brucella suis 1330
cgaccugcuucuugcc

SEQ ID NO: 443487 - RNA, 18 nt, Brucella suis 1330
cgaccaguaaggcgggcg

SEQ ID NO: 443488 - RNA, 14 nt, Brucella suis 1330
cgacaugccaagag

SEQ ID NO: 443489 - RNA, 15 nt, Brucella suis 1330
cgacauagccgaucu

SEQ ID NO: 443490 - RNA, 20 nt, Brucella suis 1330
cgacaguccagcuuuccgca

SEQ ID NO: 443491 - RNA, 16 nt, Brucella suis 1330
cgacacggccgaucgc

SEQ ID NO: 443492 - RNA, 19 nt, Brucella suis 1330
cgaagccaggcagacggac

SEQ ID NO: 443493 - RNA, 17 nt, Brucella suis 1330
cgaagccagguggcugc

SEQ ID NO: 443494 - RNA, 19 nt, Brucella suis 1330
cgaagaccuucuggaagcg

SEQ ID NO: 443495 - RNA, 13 nt, Brucella suis 1330
cgaacaugccugc

SEQ ID NO: 443496 - RNA, 17 nt, Brucella suis 1330
cgaaagcacccgcuugg

SEQ ID NO: 443497 - RNA, 13 nt, Brucella suis 1330
ccuuuuucgagaa

SEQ ID NO: 443498 - RNA, 14 nt, Brucella suis 1330
ccuuugccgcgcga

SEQ ID NO: 443499 - RNA, 11 nt, Brucella suis 1330
ccuuugcgggg

SEQ ID NO: 443500 - RNA, 13 nt, Brucella suis 1330
ccuuuuccgcacc

SEQ ID NO: 443501 - RNA, 16 nt, Brucella suis 1330
ccuuuucuucauccag

SEQ ID NO: 443502 - RNA, 15 nt, Brucella suis 1330
ccuuuugacggcccg

SEQ ID NO: 443503 - RNA, 12 nt, Brucella suis 1330
ccuuggcuucca

SEQ ID NO: 443504 - RNA, 18 nt, Brucella suis 1330
ccuugcggauaucgcugg

SEQ ID NO: 443505 - RNA, 15 nt, Brucella suis 1330
ccuugaacuugucgc

SEQ ID NO: 443506 - RNA, 18 nt, Brucella suis 1330
ccuugccgguugccuugc

SEQ ID NO: 443507 - RNA, 15 nt, Brucella suis 1330
ccuucgaguucgcca

SEQ ID NO: 443508 - RNA, 15 nt, Brucella suis 1330
ccuuauaggcgcgcg

SEQ ID NO: 443509 - RNA, 23 nt, Brucella suis 1330
ccuguggcuguuucgcauugccc

SEQ ID NO: 443510 - RNA, 16 nt, Brucella suis 1330
ccugucgccgaaaagc

SEQ ID NO: 443511 - RNA, 14 nt, Brucella suis 1330
ccugugcauugcca

SEQ ID NO: 443512 - RNA, 22 nt, Brucella suis 1330
ccugcuucaucgcggcagccgc

SEQ ID NO: 443513 - RNA, 19 nt, Brucella suis 1330
ccugcgcccauucaaugcc

SEQ ID NO: 443514 - RNA, 13 nt, Brucella suis 1330
ccugcgccaguuu

SEQ ID NO: 443515 - RNA, 22 nt, Brucella suis 1330
ccugagcuugucgaaggaucga

SEQ ID NO: 443516 - RNA, 12 nt, Brucella suis 1330
ccugcaaaccgg

SEQ ID NO: 443517 - RNA, 16 nt, Brucella suis 1330
ccugagaucgaugcgc

SEQ ID NO: 443518 - RNA, 19 nt, Brucella suis 1330
ccucguggaucgacaggcg

SEQ ID NO: 443519 - RNA, 14 nt, Brucella suis 1330
ccucgaccgccacc

SEQ ID NO: 443520 - RNA, 14 nt, Brucella suis 1330
ccucgaagucgcca

SEQ ID NO: 443521 - RNA, 16 nt, Brucella suis 1330
ccucaaucacggcaau

SEQ ID NO: 443522 - RNA, 15 nt, Brucella suis 1330
ccguuuccaucgggg

SEQ ID NO: 443523 - RNA, 13 nt, Brucella suis 1330
ccguugccgauca

SEQ ID NO: 443524 - RNA, 18 nt, Brucella suis 1330
ccguugaagcugucgcca

SEQ ID NO: 443525 - RNA, 22 nt, Brucella suis 1330
ccgugcgauagcccucugaacc

SEQ ID NO: 443526 - RNA, 23 nt, Brucella suis 1330
ccgugacguccaccaccucgcca

SEQ ID NO: 443527 - RNA, 19 nt, Brucella suis 1330
ccgucgcacgcuuggccuc

SEQ ID NO: 443528 - RNA, 17 nt, Brucella suis 1330
ccguaucggcggcaagc

SEQ ID NO: 443529 - RNA, 20 nt, Brucella suis 1330
ccgguuauggcgugccgaaa

SEQ ID NO: 443530 - RNA, 22 nt, Brucella suis 1330
ccgguuaaaauggaaucgcugg

SEQ ID NO: 443531 - RNA, 15 nt, Brucella suis 1330
ccggucggccccggc

SEQ ID NO: 443532 - RNA, 21 nt, Brucella suis 1330
ccggucgagccgacauaggcg

SEQ ID NO: 443533 - RNA, 14 nt, Brucella suis 1330
ccgguauccggcgc

SEQ ID NO: 443534 - RNA, 16 nt, Brucella suis 1330
ccgguauccggcgcga

SEQ ID NO: 443535 - RNA, 16 nt, Brucella suis 1330
ccgggcaucgcucgaa

SEQ ID NO: 443536 - RNA, 22 nt, Brucella suis 1330
ccggcucauggucacgcgccca

SEQ ID NO: 443537 - RNA, 15 nt, Brucella suis 1330
ccggcgucuugucgc

SEQ ID NO: 443538 - RNA, 21 nt, Brucella suis 1330
ccggcgucagggaaaugcgga

SEQ ID NO: 443539 - RNA, 23 nt, Brucella suis 1330
ccggcgggcuugaugcgccaguc

SEQ ID NO: 443540 - RNA, 14 nt, Brucella suis 1330
ccggcggcaggcag

SEQ ID NO: 443541 - RNA, 12 nt, Brucella suis 1330
ccggcauggccu

SEQ ID NO: 443542 - RNA, 21 nt, Brucella suis 1330
ccggcauggccugcgcgcgca

SEQ ID NO: 443543 - RNA, 12 nt, Brucella suis 1330
ccggcagcgaag

SEQ ID NO: 443544 - RNA, 15 nt, Brucella suis 1330
ccggcaccgccccgc

SEQ ID NO: 443545 - RNA, 13 nt, Brucella suis 1330
ccggaucauccau

SEQ ID NO: 443546 - RNA, 13 nt, Brucella suis 1330
ccggaacaaguuc

SEQ ID NO: 443547 - RNA, 15 nt, Brucella suis 1330
ccggaaccauaucga

SEQ ID NO: 443548 - RNA, 16 nt, Brucella suis 1330
ccgcuugcggcgauaa

SEQ ID NO: 443549 - RNA, 12 nt, Brucella suis 1330
ccgcugcgccgc

SEQ ID NO: 443550 - RNA, 21 nt, Brucella suis 1330
ccgcuccagccgagcgccaga

SEQ ID NO: 443551 - RNA, 24 nt, Brucella suis 1330
ccgcuccagccgagcgccagauaa

SEQ ID NO: 443552 - RNA, 22 nt, Brucella suis 1330
ccgcggccggucaagaggaacg

SEQ ID NO: 443553 - RNA, 20 nt, Brucella suis 1330
ccgcgcggucaguggaucga

SEQ ID NO: 443554 - RNA, 15 nt, Brucella suis 1330
ccgcgccaugccauc

SEQ ID NO: 443555 - RNA, 18 nt, Brucella suis 1330
ccgccuucgagaaccagc

SEQ ID NO: 443556 - RNA, 12 nt, Brucella suis 1330
ccgcaucggccu

SEQ ID NO: 443557 - RNA, 18 nt, Brucella suis 1330
ccgcaucuccucaaucgc

SEQ ID NO: 443558 - RNA, 22 nt, Brucella suis 1330
ccgcaucggaagggcaaggcgc

SEQ ID NO: 443559 - RNA, 13 nt, Brucella suis 1330
ccgcaauaacgaa

SEQ ID NO: 443560 - RNA, 20 nt, Brucella suis 1330
ccgcaaggaugugagcgaau

SEQ ID NO: 443561 - RNA, 16 nt, Brucella suis 1330
ccgauugcggcguggg

SEQ ID NO: 443562 - RNA, 15 nt, Brucella suis 1330
ccgauggcgaucacg

SEQ ID NO: 443563 - RNA, 17 nt, Brucella suis 1330
ccgauggcgaucacgaa

SEQ ID NO: 443564 - RNA, 13 nt, Brucella suis 1330
ccgacaugccaag

SEQ ID NO: 443565 - RNA, 14 nt, Brucella suis 1330
ccgacauccaucgg

SEQ ID NO: 443566 - RNA, 20 nt, Brucella suis 1330
ccgacauccuugaaaagcug

SEQ ID NO: 443567 - RNA, 13 nt, Brucella suis 1330
ccgacagggcaag

SEQ ID NO: 443568 - RNA, 17 nt, Brucella suis 1330
ccgaacugggcggccag

SEQ ID NO: 443569 - RNA, 16 nt, Brucella suis 1330
cccuugugaucgccac

SEQ ID NO: 443570 - RNA, 20 nt, Brucella suis 1330
ccgaacagcgcccagaguuc

SEQ ID NO: 443571 - RNA, 20 nt, Brucella suis 1330
cccuugccgucggcgccguc

SEQ ID NO: 443572 - RNA, 14 nt, Brucella suis 1330
cccuugaaaucauu

SEQ ID NO: 443573 - RNA, 16 nt, Brucella suis 1330
cccucgccgacccugu

SEQ ID NO: 443574 - RNA, 19 nt, Brucella suis 1330
cccucaaccgagcagccgc

SEQ ID NO: 443575 - RNA, 20 nt, Brucella suis 1330
cccggcagccuucgcugccg

SEQ ID NO: 443576 - RNA, 14 nt, Brucella suis 1330
cccggcaccgcaaa

SEQ ID NO: 443577 - RNA, 13 nt, Brucella suis 1330
ccccggcgcagcg

SEQ ID NO: 443578 - RNA, 21 nt, Brucella suis 1330
ccccggcaguuucugccgcgc

SEQ ID NO: 443579 - RNA, 22 nt, Brucella suis 1330
ccccggcaguuucugccgcgca

SEQ ID NO: 443580 - RNA, 23 nt, Brucella suis 1330
ccccaucggguguuugcgacggg

SEQ ID NO: 443581 - RNA, 12 nt, Brucella suis 1330
cccacggaucga

SEQ ID NO: 443582 - RNA, 16 nt, Brucella suis 1330
cccaccgucaaucgca

SEQ ID NO: 443583 - RNA, 17 nt, Brucella suis 1330
cccaccgaagccacgaa

SEQ ID NO: 443584 - RNA, 21 nt, Brucella suis 1330
ccaugagaaggcaagccccag

SEQ ID NO: 443585 - RNA, 16 nt, Brucella suis 1330
ccaucuuucuugaagu

SEQ ID NO: 443586 - RNA, 12 nt, Brucella suis 1330
ccaucgaaaccg

SEQ ID NO: 443587 - RNA, 13 nt, Brucella suis 1330
ccauccucgccaa

SEQ ID NO: 443588 - RNA, 12 nt, Brucella suis 1330
ccauccgccccg

SEQ ID NO: 443589 - RNA, 16 nt, Brucella suis 1330
ccagguugcgccgaua

SEQ ID NO: 443590 - RNA, 17 nt, Brucella suis 1330
ccagguugcgccgauau

SEQ ID NO: 443591 - RNA, 14 nt, Brucella suis 1330
ccagcucauggcca

SEQ ID NO: 443592 - RNA, 20 nt, Brucella suis 1330
ccagcgauugcgcauugaca

SEQ ID NO: 443593 - RNA, 13 nt, Brucella suis 1330
ccagccuuuccag

SEQ ID NO: 443594 - RNA, 19 nt, Brucella suis 1330
ccagcgaaacggcagccga

SEQ ID NO: 443595 - RNA, 21 nt, Brucella suis 1330
ccagccggaaugccucccgau

SEQ ID NO: 443596 - RNA, 14 nt, Brucella suis 1330
ccagcaccggcaac

SEQ ID NO: 443597 - RNA, 18 nt, Brucella suis 1330
ccagcaccagcggcacgc

SEQ ID NO: 443598 - RNA, 18 nt, Brucella suis 1330
ccagcaacgcgcccgcca

SEQ ID NO: 443599 - RNA, 13 nt, Brucella suis 1330
ccagauugcgggc

SEQ ID NO: 443600 - RNA, 17 nt, Brucella suis 1330
ccagauugcgggcaagc

SEQ ID NO: 443601 - RNA, 18 nt, Brucella suis 1330
ccagagcauuuucgccgc

SEQ ID NO: 443602 - RNA, 23 nt, Brucella suis 1330
ccagagccucggcgcggacaagc

SEQ ID NO: 443603 - RNA, 17 nt, Brucella suis 1330
ccagagccuguuccaaa

SEQ ID NO: 443604 - RNA, 21 nt, Brucella suis 1330
ccagaagccgcuugcauucca

SEQ ID NO: 443605 - RNA, 17 nt, Brucella suis 1330
ccagaaggcgcggcagc

SEQ ID NO: 443606 - RNA, 14 nt, Brucella suis 1330
ccagacguuccaga

SEQ ID NO: 443607 - RNA, 22 nt, Brucella suis 1330
ccagacguuccagauugccgcg

SEQ ID NO: 443608 - RNA, 16 nt, Brucella suis 1330
ccacggauuuccacca

SEQ ID NO: 443609 - RNA, 21 nt, Brucella suis 1330
ccaccgccugcagccggaaga

SEQ ID NO: 443610 - RNA, 23 nt, Brucella suis 1330
ccaccccuuccuugccgggaaga

SEQ ID NO: 443611 - RNA, 14 nt, Brucella suis 1330
ccacaaaaaccggg

SEQ ID NO: 443612 - RNA, 14 nt, Brucella suis 1330
ccaaugcggucgca

SEQ ID NO: 443613 - RNA, 16 nt, Brucella suis 1330
ccaaugcaggcgcggc

SEQ ID NO: 443614 - RNA, 22 nt, Brucella suis 1330
ccaaggucggcucaucgcgcug

SEQ ID NO: 443615 - RNA, 18 nt, Brucella suis 1330
cauuugacguccggcuuc

SEQ ID NO: 443616 - RNA, 22 nt, Brucella suis 1330
cauuucacccgccagaugauca

SEQ ID NO: 443617 - RNA, 12 nt, Brucella suis 1330
cauuaucggcgg

SEQ ID NO: 443618 - RNA, 19 nt, Brucella suis 1330
caugguugaauuccggcag

SEQ ID NO: 443619 - RNA, 16 nt, Brucella suis 1330
caugcgguaaucagcg

SEQ ID NO: 443620 - RNA, 22 nt, Brucella suis 1330
caugcccggcgcgaccgcguuc

SEQ ID NO: 443621 - RNA, 14 nt, Brucella suis 1330
caugcccaugcagu

SEQ ID NO: 443622 - RNA, 12 nt, Brucella suis 1330
caucgcuugaac

SEQ ID NO: 443623 - RNA, 15 nt, Brucella suis 1330
caucggaauagggaa

SEQ ID NO: 443624 - RNA, 15 nt, Brucella suis 1330
caucgccgacgcgcg

SEQ ID NO: 443625 - RNA, 16 nt, Brucella suis 1330
caucgcaucggucagc

SEQ ID NO: 443626 - RNA, 21 nt, Brucella suis 1330
caucgcaauagaccaccaggc

SEQ ID NO: 443627 - RNA, 17 nt, Brucella suis 1330
caucgaucacaugcgcg

SEQ ID NO: 443628 - RNA, 17 nt, Brucella suis 1330
caucgagcguaacggcg

SEQ ID NO: 443629 - RNA, 15 nt, Brucella suis 1330
caucgaaaccggcau

SEQ ID NO: 443630 - RNA, 14 nt, Brucella suis 1330
cauccuugaugccc

SEQ ID NO: 443631 - RNA, 17 nt, Brucella suis 1330
cauccugcaccggcuuc

SEQ ID NO: 443632 - RNA, 19 nt, Brucella suis 1330
cauccagucauggcgcacg

SEQ ID NO: 443633 - RNA, 14 nt, Brucella suis 1330
cauccagccggcgc

SEQ ID NO: 443634 - RNA, 15 nt, Brucella suis 1330
cauccagccggcgca

SEQ ID NO: 443635 - RNA, 19 nt, Brucella suis 1330
cauccacucggcggcaucg

SEQ ID NO: 443636 - RNA, 22 nt, Brucella suis 1330
caucaggauuugggaucggcgg

SEQ ID NO: 443637 - RNA, 21 nt, Brucella suis 1330
caucagccuucgucaaaccgc

SEQ ID NO: 443638 - RNA, 17 nt, Brucella suis 1330
cauagcguucgaucagu

SEQ ID NO: 443639 - RNA, 15 nt, Brucella suis 1330
cauagccugcaagcg

SEQ ID NO: 443640 - RNA, 22 nt, Brucella suis 1330
cauagcgcgcccaaucucgaua

SEQ ID NO: 443641 - RNA, 14 nt, Brucella suis 1330
cauagagccacgag

SEQ ID NO: 443642 - RNA, 22 nt, Brucella suis 1330
cauagagccacgagaaaauggc

SEQ ID NO: 443643 - RNA, 18 nt, Brucella suis 1330
cagucuucuugugaacau

SEQ ID NO: 443644 - RNA, 14 nt, Brucella suis 1330
cagucacgccauca

SEQ ID NO: 443645 - RNA, 12 nt, Brucella suis 1330
cagguugcgcca

SEQ ID NO: 443646 - RNA, 19 nt, Brucella suis 1330
cagguugcgccaccacggc

SEQ ID NO: 443647 - RNA, 20 nt, Brucella suis 1330
caggcguucccagacaugga

SEQ ID NO: 443648 - RNA, 22 nt, Brucella suis 1330
caggcgcucuuuccgcgcaucg

SEQ ID NO: 443649 - RNA, 14 nt, Brucella suis 1330
caggcacacccggc

SEQ ID NO: 443650 - RNA, 22 nt, Brucella suis 1330
caggauagauauuucuuccaga

SEQ ID NO: 443651 - RNA, 13 nt, Brucella suis 1330
caggagcgcgauc

SEQ ID NO: 443652 - RNA, 19 nt, Brucella suis 1330
caggagcgcgaucaucgca

SEQ ID NO: 443653 - RNA, 13 nt, Brucella suis 1330
caggaccggcgaa

SEQ ID NO: 443654 - RNA, 14 nt, Brucella suis 1330
cagcuucgggaagu

SEQ ID NO: 443655 - RNA, 19 nt, Brucella suis 1330
cagcucguccaugagcgca

SEQ ID NO: 443656 - RNA, 20 nt, Brucella suis 1330
cagcguuuugucauggccgg

SEQ ID NO: 443657 - RNA, 23 nt, Brucella suis 1330
cagcguuuugucauggccggauc

SEQ ID NO: 443658 - RNA, 15 nt, Brucella suis 1330
cagcgguugcggccg

SEQ ID NO: 443659 - RNA, 12 nt, Brucella suis 1330
cagcgcgccgau

SEQ ID NO: 443660 - RNA, 14 nt, Brucella suis 1330
cagcgcgccgauca

SEQ ID NO: 443661 - RNA, 22 nt, Brucella suis 1330
cagcgccuucagcgugaugccc

SEQ ID NO: 443662 - RNA, 16 nt, Brucella suis 1330
cagcgcaggcgcgauc

SEQ ID NO: 443663 - RNA, 20 nt, Brucella suis 1330
cagcgauaguguccacgcgc

SEQ ID NO: 443664 - RNA, 22 nt, Brucella suis 1330
cagcgauaguguccacgcgcuu

SEQ ID NO: 443665 - RNA, 19 nt, Brucella suis 1330
cagcgauggcgacgcgcuc

SEQ ID NO: 443666 - RNA, 22 nt, Brucella suis 1330
cagcgcaaacucgucggaaaau

SEQ ID NO: 443667 - RNA, 20 nt, Brucella suis 1330
cagccaggugcuggugccgc

SEQ ID NO: 443668 - RNA, 15 nt, Brucella suis 1330
cagcacuuccagaua

SEQ ID NO: 443669 - RNA, 16 nt, Brucella suis 1330
cagaucggcaagcgca

SEQ ID NO: 443670 - RNA, 22 nt, Brucella suis 1330
cagaucccguuuugagaugacg

SEQ ID NO: 443671 - RNA, 21 nt, Brucella suis 1330
cagaucaugauuagccguuaa

SEQ ID NO: 443672 - RNA, 13 nt, Brucella suis 1330
cagauaaaaagga

SEQ ID NO: 443673 - RNA, 17 nt, Brucella suis 1330
cagagcgguuccgguua

SEQ ID NO: 443674 - RNA, 16 nt, Brucella suis 1330
cagacuagacaaagcg

SEQ ID NO: 443675 - RNA, 19 nt, Brucella suis 1330
cagacggccaccgggcuuc

SEQ ID NO: 443676 - RNA, 16 nt, Brucella suis 1330
cagacgcuggugacau

SEQ ID NO: 443677 - RNA, 16 nt, Brucella suis 1330
cagacgauuuucgcca

SEQ ID NO: 443678 - RNA, 19 nt, Brucella suis 1330
cagacgaaaauaucggcug

SEQ ID NO: 443679 - RNA, 19 nt, Brucella suis 1330
cagacauggaagaugacgc

SEQ ID NO: 443680 - RNA, 17 nt, Brucella suis 1330
cagacagccuugucgcc

SEQ ID NO: 443681 - RNA, 20 nt, Brucella suis 1330
cagaagaucgucggcaagcu

SEQ ID NO: 443682 - RNA, 23 nt, Brucella suis 1330
cagaagauugaugauaggcugcu

SEQ ID NO: 443683 - RNA, 19 nt, Brucella suis 1330
cacggcgaaagcugccgcg

SEQ ID NO: 443684 - RNA, 22 nt, Brucella suis 1330
cacgcucggcggaagcgacgau

SEQ ID NO: 443685 - RNA, 19 nt, Brucella suis 1330
cacgcucgcauagccgaua

SEQ ID NO: 443686 - RNA, 20 nt, Brucella suis 1330
cacgcgggcgcagcgacagc

SEQ ID NO: 443687 - RNA, 22 nt, Brucella suis 1330
caccguugccucugucagcuuu

SEQ ID NO: 443688 - RNA, 16 nt, Brucella suis 1330
caccggcggaaggcug

SEQ ID NO: 443689 - RNA, 20 nt, Brucella suis 1330
caccggcuggcacaaagcgg

SEQ ID NO: 443690 - RNA, 15 nt, Brucella suis 1330
caccgcgccggaagg

SEQ ID NO: 443691 - RNA, 21 nt, Brucella suis 1330
cacccuuugugccauagacgc

SEQ ID NO: 443692 - RNA, 23 nt, Brucella suis 1330
cacccuugguugcgcgccagugc

SEQ ID NO: 443693 - RNA, 20 nt, Brucella suis 1330
caccagcgcgccgaucacga

SEQ ID NO: 443694 - RNA, 19 nt, Brucella suis 1330
cacaagaacagccgccccg

SEQ ID NO: 443695 - RNA, 14 nt, Brucella suis 1330
caaugugcuggcgg

SEQ ID NO: 443696 - RNA, 14 nt, Brucella suis 1330
caaugugccugaaa

SEQ ID NO: 443697 - RNA, 15 nt, Brucella suis 1330
caauggcgacaugcu

SEQ ID NO: 443698 - RNA, 13 nt, Brucella suis 1330
caauggcggcauc

SEQ ID NO: 443699 - RNA, 19 nt, Brucella suis 1330
caauggcgggccauuucca

SEQ ID NO: 443700 - RNA, 12 nt, Brucella suis 1330
caaucagccaga

SEQ ID NO: 443701 - RNA, 14 nt, Brucella suis 1330
caauaucgcgccgg

SEQ ID NO: 443702 - RNA, 22 nt, Brucella suis 1330
caauaucgcgccggggccgaca

SEQ ID NO: 443703 - RNA, 17 nt, Brucella suis 1330
caauaucggcgaugccc

SEQ ID NO: 443704 - RNA, 19 nt, Brucella suis 1330
caauaugcgccuugcgccg

SEQ ID NO: 443705 - RNA, 13 nt, Brucella suis 1330
caauaaaaggcaa

SEQ ID NO: 443706 - RNA, 18 nt, Brucella suis 1330
caaggcgcgggaugacgc

SEQ ID NO: 443707 - RNA, 17 nt, Brucella suis 1330
caagcuuuugcagccgu

SEQ ID NO: 443708 - RNA, 15 nt, Brucella suis 1330
caagcucguuccaga

SEQ ID NO: 443709 - RNA, 22 nt, Brucella suis 1330
caacgaugacccagccaagcgc

SEQ ID NO: 443710 - RNA, 21 nt, Brucella suis 1330
caacgcugcgugggaaaccgc

SEQ ID NO: 443711 - RNA, 18 nt, Brucella suis 1330
caacgcugucuguuucau

SEQ ID NO: 443712 - RNA, 15 nt, Brucella suis 1330
caacacggcgcuuga

SEQ ID NO: 443713 - RNA, 21 nt, Brucella suis 1330
caaagcgcguuucauugucga

SEQ ID NO: 443714 - RNA, 15 nt, Brucella suis 1330
caaagaaaaaagccc

SEQ ID NO: 443715 - RNA, 14 nt, Brucella suis 1330
auugcggccaagcg

SEQ ID NO: 443716 - RNA, 15 nt, Brucella suis 1330
auugcgggaaggcgc

SEQ ID NO: 443717 - RNA, 22 nt, Brucella suis 1330
auugcuaaaugcaagcgucuuc

SEQ ID NO: 443718 - RNA, 18 nt, Brucella suis 1330
auugccgcgcgcggcuuc

SEQ ID NO: 443719 - RNA, 16 nt, Brucella suis 1330
auugccgcugccggua

SEQ ID NO: 443720 - RNA, 21 nt, Brucella suis 1330
auugcccuaucaagaaugugc

SEQ ID NO: 443721 - RNA, 17 nt, Brucella suis 1330
auugcaucgcgguuuuc

SEQ ID NO: 443722 - RNA, 17 nt, Brucella suis 1330
auugccaaggagcgcga

SEQ ID NO: 443723 - RNA, 16 nt, Brucella suis 1330
auugauguguccggcg

SEQ ID NO: 443724 - RNA, 12 nt, Brucella suis 1330
auugaucaaccc

SEQ ID NO: 443725 - RNA, 18 nt, Brucella suis 1330
auugaaaaaaaugggcgg

SEQ ID NO: 443726 - RNA, 17 nt, Brucella suis 1330
auucugccgcucggcga

SEQ ID NO: 443727 - RNA, 20 nt, Brucella suis 1330
auucugcuuaucaaggccgg

SEQ ID NO: 443728 - RNA, 17 nt, Brucella suis 1330
auucuggacgugcuggu

SEQ ID NO: 443729 - RNA, 20 nt, Brucella suis 1330
auuccugaaccacuuccgaa

SEQ ID NO: 443730 - RNA, 12 nt, Brucella suis 1330
auuccgccaugc

SEQ ID NO: 443731 - RNA, 19 nt, Brucella suis 1330
auucagagcuucauugucc

SEQ ID NO: 443732 - RNA, 20 nt, Brucella suis 1330
augugccguaucacgccgcg

SEQ ID NO: 443733 - RNA, 20 nt, Brucella suis 1330
augucauuugcgaccauggc

SEQ ID NO: 443734 - RNA, 18 nt, Brucella suis 1330
augggcggcggccgggcg

SEQ ID NO: 443735 - RNA, 15 nt, Brucella suis 1330
augggcggccacggc

SEQ ID NO: 443736 - RNA, 17 nt, Brucella suis 1330
augggcggccacggcau

SEQ ID NO: 443737 - RNA, 15 nt, Brucella suis 1330
auggcgaaaucgcca

SEQ ID NO: 443738 - RNA, 21 nt, Brucella suis 1330
auggccugcgcgcgcauggcg

SEQ ID NO: 443739 - RNA, 18 nt, Brucella suis 1330
auggccugcugcauuuuc

SEQ ID NO: 443740 - RNA, 23 nt, Brucella suis 1330
auggccacgacagggcgcugcga

SEQ ID NO: 443741 - RNA, 22 nt, Brucella suis 1330
auggcagugaauacuaaucgca

SEQ ID NO: 443742 - RNA, 22 nt, Brucella suis 1330
auggcaauuuaucugcguuccg

SEQ ID NO: 443743 - RNA, 18 nt, Brucella suis 1330
auggcagaccccaucagc

SEQ ID NO: 443744 - RNA, 16 nt, Brucella suis 1330
auggauugcgggcaug

SEQ ID NO: 443745 - RNA, 17 nt, Brucella suis 1330
auggcaaucuccaucgu

SEQ ID NO: 443746 - RNA, 16 nt, Brucella suis 1330
auggacugaaugcaga

SEQ ID NO: 443747 - RNA, 22 nt, Brucella suis 1330
auggaucaacgcaggcgagaug

SEQ ID NO: 443748 - RNA, 18 nt, Brucella suis 1330
auggaaucgcuggaaccg

SEQ ID NO: 443749 - RNA, 16 nt, Brucella suis 1330
auggaaggaaagccca

SEQ ID NO: 443750 - RNA, 22 nt, Brucella suis 1330
augcuugccucguccgguuuuc

SEQ ID NO: 443751 - RNA, 15 nt, Brucella suis 1330
auggaaaaacccggc

SEQ ID NO: 443752 - RNA, 22 nt, Brucella suis 1330
auggaacggaaaaugcccggcg

SEQ ID NO: 443753 - RNA, 24 nt, Brucella suis 1330
augcgccagagcauuuucgccgca

SEQ ID NO: 443754 - RNA, 18 nt, Brucella suis 1330
augcgcaugaagcgcggc

SEQ ID NO: 443755 - RNA, 20 nt, Brucella suis 1330
augcgccacuucccgcgccu

SEQ ID NO: 443756 - RNA, 19 nt, Brucella suis 1330
augcauuuuucgccgcgca

SEQ ID NO: 443757 - RNA, 14 nt, Brucella suis 1330
augcgauuucgcca

SEQ ID NO: 443758 - RNA, 20 nt, Brucella suis 1330
augcagcgccgcgcccacca

SEQ ID NO: 443759 - RNA, 19 nt, Brucella suis 1330
augcagacaaguccuaaaa

SEQ ID NO: 443760 - RNA, 23 nt, Brucella suis 1330
augauauaggcgcaaucggcacu

SEQ ID NO: 443761 - RNA, 22 nt, Brucella suis 1330
augacgcgggugaggcuuucgc

SEQ ID NO: 443762 - RNA, 22 nt, Brucella suis 1330
augaggucggucagucgcccac

SEQ ID NO: 443763 - RNA, 19 nt, Brucella suis 1330
augaagcgcggcggccacu

SEQ ID NO: 443764 - RNA, 16 nt, Brucella suis 1330
aucuugcugaugagcc

SEQ ID NO: 443765 - RNA, 23 nt, Brucella suis 1330
aucuggcgcgcgaacgggaacaa

SEQ ID NO: 443766 - RNA, 18 nt, Brucella suis 1330
aucuggagugcacggcca

SEQ ID NO: 443767 - RNA, 15 nt, Brucella suis 1330
aucugcgcgcgcgca

SEQ ID NO: 443768 - RNA, 20 nt, Brucella suis 1330
aucggccugaugcaaugcgu

SEQ ID NO: 443769 - RNA, 18 nt, Brucella suis 1330
aucggcaagcgcaauggc

SEQ ID NO: 443770 - RNA, 24 nt, Brucella suis 1330
aucgcucauauggaugccgccgca

SEQ ID NO: 443771 - RNA, 19 nt, Brucella suis 1330
aucgcucgaaggcagccgu

SEQ ID NO: 443772 - RNA, 19 nt, Brucella suis 1330
aucgcuggaaggaaugggc

SEQ ID NO: 443773 - RNA, 13 nt, Brucella suis 1330
aucgcggaacauc

SEQ ID NO: 443774 - RNA, 17 nt, Brucella suis 1330
aucgcgcggcgaaacgc

SEQ ID NO: 443775 - RNA, 23 nt, Brucella suis 1330
aucgcgcaggacuucacccgcca

SEQ ID NO: 443776 - RNA, 13 nt, Brucella suis 1330
aucgccggaaagc

SEQ ID NO: 443777 - RNA, 13 nt, Brucella suis 1330
aucgcccgccgcg

SEQ ID NO: 443778 - RNA, 14 nt, Brucella suis 1330
aucgcccgccgcga

SEQ ID NO: 443779 - RNA, 12 nt, Brucella suis 1330
aucgcccgccgc

SEQ ID NO: 443780 - RNA, 14 nt, Brucella suis 1330
aucgacaggcgccu

SEQ ID NO: 443781 - RNA, 17 nt, Brucella suis 1330
aucgaauagggcaugga

SEQ ID NO: 443782 - RNA, 13 nt, Brucella suis 1330
auccuucggcaug

SEQ ID NO: 443783 - RNA, 16 nt, Brucella suis 1330
auccucgccuuccgac

SEQ ID NO: 443784 - RNA, 17 nt, Brucella suis 1330
auccucgaagucgccag

SEQ ID NO: 443785 - RNA, 19 nt, Brucella suis 1330
auccgcugacugcgccauc

SEQ ID NO: 443786 - RNA, 18 nt, Brucella suis 1330
auccgccgaacccgccga

SEQ ID NO: 443787 - RNA, 18 nt, Brucella suis 1330
auccgccaccgguuuuca

SEQ ID NO: 443788 - RNA, 16 nt, Brucella suis 1330
aucagcauuaugcggc

SEQ ID NO: 443789 - RNA, 18 nt, Brucella suis 1330
aucaaugugcccugcgcg

SEQ ID NO: 443790 - RNA, 14 nt, Brucella suis 1330
aucaaggccgggcc

SEQ ID NO: 443791 - RNA, 15 nt, Brucella suis 1330
aucaacgcuuugacc

SEQ ID NO: 443792 - RNA, 23 nt, Brucella suis 1330
aucaaaagaaaccuugccgcguc

SEQ ID NO: 443793 - RNA, 13 nt, Brucella suis 1330
aucaaccucgcgg

SEQ ID NO: 443794 - RNA, 16 nt, Brucella suis 1330
auauggaugccgccgc

SEQ ID NO: 443795 - RNA, 22 nt, Brucella suis 1330
auauccggcacggccacgcgca

SEQ ID NO: 443796 - RNA, 18 nt, Brucella suis 1330
auaucacgcuugcccgcg

SEQ ID NO: 443797 - RNA, 19 nt, Brucella suis 1330
auagccacccugaugccgg

SEQ ID NO: 443798 - RNA, 15 nt, Brucella suis 1330
auagccugcgccagu

SEQ ID NO: 443799 - RNA, 23 nt, Brucella suis 1330
auagacgcgcagacgcagcgcau

SEQ ID NO: 443800 - RNA, 11 nt, Brucella suis 1330
auacugcgcgc

SEQ ID NO: 443801 - RNA, 17 nt, Brucella suis 1330
auagagcagcaccggcg

SEQ ID NO: 443802 - RNA, 19 nt, Brucella suis 1330
auagagccacgagaaaaug

SEQ ID NO: 443803 - RNA, 18 nt, Brucella suis 1330
auaccgcaccgauccgca

SEQ ID NO: 443804 - RNA, 21 nt, Brucella suis 1330
auaauucagcuuuacugccgg

SEQ ID NO: 443805 - RNA, 17 nt, Brucella suis 1330
aguuggucguccaacuu

SEQ ID NO: 443806 - RNA, 15 nt, Brucella suis 1330
auaaaaaggccgcuc

SEQ ID NO: 443807 - RNA, 19 nt, Brucella suis 1330
auaaagcaggaucgacagc

SEQ ID NO: 443808 - RNA, 18 nt, Brucella suis 1330
auaaagcugguugcgcgg

SEQ ID NO: 443809 - RNA, 21 nt, Brucella suis 1330
aguucuugucugucaccacau

SEQ ID NO: 443810 - RNA, 19 nt, Brucella suis 1330
aguugaaaagggcaagggc

SEQ ID NO: 443811 - RNA, 22 nt, Brucella suis 1330
aguuccguguugaaaaggauau

SEQ ID NO: 443812 - RNA, 13 nt, Brucella suis 1330
aguuccggcccgc

SEQ ID NO: 443813 - RNA, 18 nt, Brucella suis 1330
aguuccugcuucaucgcg

SEQ ID NO: 443814 - RNA, 12 nt, Brucella suis 1330
aguuccauccau

SEQ ID NO: 443815 - RNA, 22 nt, Brucella suis 1330
aguucauccguucgaucggugg

SEQ ID NO: 443816 - RNA, 17 nt, Brucella suis 1330
agguuuuacgggcggca

SEQ ID NO: 443817 - RNA, 21 nt, Brucella suis 1330
agguuugucaguagccugacc

SEQ ID NO: 443818 - RNA, 17 nt, Brucella suis 1330
agguuuuucgguuuuca

SEQ ID NO: 443819 - RNA, 21 nt, Brucella suis 1330
aguaaagucugauagcaaggc

SEQ ID NO: 443820 - RNA, 15 nt, Brucella suis 1330
agguguccuccagcc

SEQ ID NO: 443821 - RNA, 16 nt, Brucella suis 1330
aggugcagucuucggc

SEQ ID NO: 443822 - RNA, 12 nt, Brucella suis 1330
agggcagcuucg

SEQ ID NO: 443823 - RNA, 17 nt, Brucella suis 1330
aggcugccgggguuuuu

SEQ ID NO: 443824 - RNA, 18 nt, Brucella suis 1330
aggcugaguuuuccgcuu

SEQ ID NO: 443825 - RNA, 13 nt, Brucella suis 1330
aggcguuccgccu

SEQ ID NO: 443826 - RNA, 16 nt, Brucella suis 1330
aggccggacgcuucaa

SEQ ID NO: 443827 - RNA, 13 nt, Brucella suis 1330
aggccgcgccgau

SEQ ID NO: 443828 - RNA, 16 nt, Brucella suis 1330
aggcauuuuccuuucu

SEQ ID NO: 443829 - RNA, 21 nt, Brucella suis 1330
agcugccgcggcucucacgcg

SEQ ID NO: 443830 - RNA, 20 nt, Brucella suis 1330
agcugcaagggaaugcgcuu

SEQ ID NO: 443831 - RNA, 17 nt, Brucella suis 1330
agcucgcguuccagccg

SEQ ID NO: 443832 - RNA, 16 nt, Brucella suis 1330
agcguugcaucggcgg

SEQ ID NO: 443833 - RNA, 16 nt, Brucella suis 1330
agcgugucuugcccag

SEQ ID NO: 443834 - RNA, 18 nt, Brucella suis 1330
agcguggcuuuuccggcg

SEQ ID NO: 443835 - RNA, 13 nt, Brucella suis 1330
agcgugcagccug

SEQ ID NO: 443836 - RNA, 16 nt, Brucella suis 1330
agcgugagaccagcgc

SEQ ID NO: 443837 - RNA, 19 nt, Brucella suis 1330
agcgugaccagccccugca

SEQ ID NO: 443838 - RNA, 16 nt, Brucella suis 1330
agcggcuccaacgauu

SEQ ID NO: 443839 - RNA, 20 nt, Brucella suis 1330
agcggcgcgaugcgaaacgg

SEQ ID NO: 443840 - RNA, 14 nt, Brucella suis 1330
agcggcaaaggccg

SEQ ID NO: 443841 - RNA, 23 nt, Brucella suis 1330
agcggaucgugagguucuugagg

SEQ ID NO: 443842 - RNA, 15 nt, Brucella suis 1330
agcggaaaacggcug

SEQ ID NO: 443843 - RNA, 15 nt, Brucella suis 1330
agcgcucgcggcugg

SEQ ID NO: 443844 - RNA, 14 nt, Brucella suis 1330
agcgcauuggcgac

SEQ ID NO: 443845 - RNA, 16 nt, Brucella suis 1330
agcgcauggcagcaaa

SEQ ID NO: 443846 - RNA, 13 nt, Brucella suis 1330
agcgcaucggcca

SEQ ID NO: 443847 - RNA, 15 nt, Brucella suis 1330
agcgcaucccgaaaa

SEQ ID NO: 443848 - RNA, 22 nt, Brucella suis 1330
agcgcaucgacaaucuccccuu

SEQ ID NO: 443849 - RNA, 23 nt, Brucella suis 1330
agcgcaucgacaaucuccccuuc

SEQ ID NO: 443850 - RNA, 14 nt, Brucella suis 1330
agcgcacgcaggca

SEQ ID NO: 443851 - RNA, 22 nt, Brucella suis 1330
agcgauaauccgauuaucgcga

SEQ ID NO: 443852 - RNA, 21 nt, Brucella suis 1330
agcgagcuugcaaugagcgcg

SEQ ID NO: 443853 - RNA, 21 nt, Brucella suis 1330
agcgaauagaccaugccgcca

SEQ ID NO: 443854 - RNA, 15 nt, Brucella suis 1330
agcgaauaugcgggg

SEQ ID NO: 443855 - RNA, 23 nt, Brucella suis 1330
agccuugagauccgcaucggccu

SEQ ID NO: 443856 - RNA, 15 nt, Brucella suis 1330
agccgccucaauggu

SEQ ID NO: 443857 - RNA, 20 nt, Brucella suis 1330
agccgcgaucacagccgcgc

SEQ ID NO: 443858 - RNA, 22 nt, Brucella suis 1330
agccgcgaucacagccgcgcca

SEQ ID NO: 443859 - RNA, 19 nt, Brucella suis 1330
agccccuugccccggcacc

SEQ ID NO: 443860 - RNA, 19 nt, Brucella suis 1330
agcccacggucgagugcgg

SEQ ID NO: 443861 - RNA, 14 nt, Brucella suis 1330
agccaucgccgacg

SEQ ID NO: 443862 - RNA, 20 nt, Brucella suis 1330
agcauuuucgagccaaaaau

SEQ ID NO: 443863 - RNA, 20 nt, Brucella suis 1330
agcauuuucgagccaaaagu

SEQ ID NO: 443864 - RNA, 21 nt, Brucella suis 1330
agcauccgcucgcgcaucgcg

SEQ ID NO: 443865 - RNA, 20 nt, Brucella suis 1330
agcagcaggggcagcgcgcg

SEQ ID NO: 443866 - RNA, 14 nt, Brucella suis 1330
agcacguccuuggc

SEQ ID NO: 443867 - RNA, 13 nt, Brucella suis 1330
agcaccgaucacg

SEQ ID NO: 443868 - RNA, 18 nt, Brucella suis 1330
agaugcugaacaagcaga

SEQ ID NO: 443869 - RNA, 22 nt, Brucella suis 1330
agaugaucauaacagaugcggg

SEQ ID NO: 443870 - RNA, 24 nt, Brucella suis 1330
agagcagcaccggcggaaggcuga

SEQ ID NO: 443871 - RNA, 19 nt, Brucella suis 1330
agagaugcgcgaauuuucu

SEQ ID NO: 443872 - RNA, 16 nt, Brucella suis 1330
agacgugaccgccugg

SEQ ID NO: 443873 - RNA, 16 nt, Brucella suis 1330
agaaaacgccgaagcc

SEQ ID NO: 443874 - RNA, 18 nt, Brucella suis 1330
agaaaagugccagcguuc

SEQ ID NO: 443875 - RNA, 14 nt, Brucella suis 1330
acuucggcggcgcg

SEQ ID NO: 443876 - RNA, 16 nt, Brucella suis 1330
acuuccgccuucgaga

SEQ ID NO: 443877 - RNA, 15 nt, Brucella suis 1330
acuggcggccaagcg

SEQ ID NO: 443878 - RNA, 16 nt, Brucella suis 1330
acuggcgcauggccgc

SEQ ID NO: 443879 - RNA, 20 nt, Brucella suis 1330
acugcggguaugcgcaugau

SEQ ID NO: 443880 - RNA, 13 nt, Brucella suis 1330
acugcacgucuuc

SEQ ID NO: 443881 - RNA, 23 nt, Brucella suis 1330
acucaucaaaagcugccgcaaca

SEQ ID NO: 443882 - RNA, 22 nt, Brucella suis 1330
acucggcauaaaccacgagauc

SEQ ID NO: 443883 - RNA, 18 nt, Brucella suis 1330
acuaugcgccacgagaac

SEQ ID NO: 443884 - RNA, 16 nt, Brucella suis 1330
acggucgagugcggcc

SEQ ID NO: 443885 - RNA, 14 nt, Brucella suis 1330
acgggagcagcucu

SEQ ID NO: 443886 - RNA, 19 nt, Brucella suis 1330
acggauuuccaccacgcgc

SEQ ID NO: 443887 - RNA, 17 nt, Brucella suis 1330
acgcucggcggaagcga

SEQ ID NO: 443888 - RNA, 15 nt, Brucella suis 1330
acgcgggcgcagcga

SEQ ID NO: 443889 - RNA, 21 nt, Brucella suis 1330
acgcggguggauggaauuuca

SEQ ID NO: 443890 - RNA, 18 nt, Brucella suis 1330
acgcccuucaaaccaucc

SEQ ID NO: 443891 - RNA, 18 nt, Brucella suis 1330
acgcccaugaucgcgcca

SEQ ID NO: 443892 - RNA, 18 nt, Brucella suis 1330
acgccauagacgccccau

SEQ ID NO: 443893 - RNA, 20 nt, Brucella suis 1330
acgccaucagcauugaacgc

SEQ ID NO: 443894 - RNA, 20 nt, Brucella suis 1330
acgccauccauguggaaggc

SEQ ID NO: 443895 - RNA, 23 nt, Brucella suis 1330
acgcaggcggauauucgccgccu

SEQ ID NO: 443896 - RNA, 15 nt, Brucella suis 1330
acgcaggacaagccg

SEQ ID NO: 443897 - RNA, 19 nt, Brucella suis 1330
acgcagcguguagccgcga

SEQ ID NO: 443898 - RNA, 16 nt, Brucella suis 1330
acgaucgagcgaacgg

SEQ ID NO: 443899 - RNA, 19 nt, Brucella suis 1330
acgagaucaauacgcucgc

SEQ ID NO: 443900 - RNA, 14 nt, Brucella suis 1330
acgacuuuggccgu

SEQ ID NO: 443901 - RNA, 16 nt, Brucella suis 1330
acgacagggcgcugcg

SEQ ID NO: 443902 - RNA, 18 nt, Brucella suis 1330
acgaaagccuuuucgaua

SEQ ID NO: 443903 - RNA, 13 nt, Brucella suis 1330
accgguuuucauc

SEQ ID NO: 443904 - RNA, 20 nt, Brucella suis 1330
accggcccaaaggccgcgcc

SEQ ID NO: 443905 - RNA, 20 nt, Brucella suis 1330
accggcauugagccgcgcgg

SEQ ID NO: 443906 - RNA, 15 nt, Brucella suis 1330
accgccggcgccgcc

SEQ ID NO: 443907 - RNA, 16 nt, Brucella suis 1330
accgccggcgccgcca

SEQ ID NO: 443908 - RNA, 22 nt, Brucella suis 1330
accgcccggaucaaaccggcca

SEQ ID NO: 443909 - RNA, 22 nt, Brucella suis 1330
accgccaccagaccaucggcaa

SEQ ID NO: 443910 - RNA, 18 nt, Brucella suis 1330
accgaucgugccgccuuc

SEQ ID NO: 443911 - RNA, 22 nt, Brucella suis 1330
accgagcagaaugccacaaggu

SEQ ID NO: 443912 - RNA, 20 nt, Brucella suis 1330
accgaaggcaagcaggcgca

SEQ ID NO: 443913 - RNA, 13 nt, Brucella suis 1330
acccgguaagcga

SEQ ID NO: 443914 - RNA, 17 nt, Brucella suis 1330
accauauuggcggcaag

SEQ ID NO: 443915 - RNA, 19 nt, Brucella suis 1330
accauauaaagcuugaacc

SEQ ID NO: 443916 - RNA, 14 nt, Brucella suis 1330
accaggccgcggga

SEQ ID NO: 443917 - RNA, 16 nt, Brucella suis 1330
accagcaacgcgcccg

SEQ ID NO: 443918 - RNA, 16 nt, Brucella suis 1330
accagauccaccgcgc

SEQ ID NO: 443919 - RNA, 16 nt, Brucella suis 1330
accacgcuugcgcccg

SEQ ID NO: 443920 - RNA, 14 nt, Brucella suis 1330
accaccuucgccgu

SEQ ID NO: 443921 - RNA, 14 nt, Brucella suis 1330
acauguggcgugau

SEQ ID NO: 443922 - RNA, 12 nt, Brucella suis 1330
acaugcuuucga

SEQ ID NO: 443923 - RNA, 20 nt, Brucella suis 1330
acaugcggcaguccggcagc

SEQ ID NO: 443924 - RNA, 20 nt, Brucella suis 1330
acagccgguucggauccucc

SEQ ID NO: 443925 - RNA, 21 nt, Brucella suis 1330
acagacuagacaaagcgguuu

SEQ ID NO: 443926 - RNA, 19 nt, Brucella suis 1330
acagaaccaucggaaccgc

SEQ ID NO: 443927 - RNA, 16 nt, Brucella suis 1330
acaccaaaagagcgcu

SEQ ID NO: 443928 - RNA, 17 nt, Brucella suis 1330
aauugucaggaaaaauc

SEQ ID NO: 443929 - RNA, 17 nt, Brucella suis 1330
aauuccacgcgccgaca

SEQ ID NO: 443930 - RNA, 21 nt, Brucella suis 1330
aaugcaccccaugagaaggca

SEQ ID NO: 443931 - RNA, 18 nt, Brucella suis 1330
uuuugcuggaaaugcucu

SEQ ID NO: 443932 - RNA, 12 nt, Brucella suis 1330
aaucgccgggcc

SEQ ID NO: 443933 - RNA, 14 nt, Brucella suis 1330
aaucuccaucguug

SEQ ID NO: 443934 - RNA, 11 nt, Brucella suis 1330
uuuucauguuu

SEQ ID NO: 443935 - RNA, 20 nt, Brucella suis 1330
uuuucgccaagccggcgcag

SEQ ID NO: 443936 - RNA, 17 nt, Brucella suis 1330
uuuugcgcgggauaaug

SEQ ID NO: 443937 - RNA, 20 nt, Brucella suis 1330
uuucgccaagccggcgcagc

SEQ ID NO: 443938 - RNA, 15 nt, Brucella suis 1330
uuuccaccggcucau

SEQ ID NO: 443939 - RNA, 19 nt, Brucella suis 1330
uuucaggucgucuuucagu

SEQ ID NO: 443940 - RNA, 14 nt, Brucella suis 1330
uuguuaucaagccg

SEQ ID NO: 443941 - RNA, 20 nt, Brucella suis 1330
aauccuggugcgcagcucgg

SEQ ID NO: 443942 - RNA, 19 nt, Brucella suis 1330
aauccucgaucuugucgcc

SEQ ID NO: 443943 - RNA, 22 nt, Brucella suis 1330
uuuacgcauuauccgacgcauc

SEQ ID NO: 443944 - RNA, 17 nt, Brucella suis 1330
uuuagagcauuuccagc

SEQ ID NO: 443945 - RNA, 22 nt, Brucella suis 1330
aauccgguucgcccaugccgca

SEQ ID NO: 443946 - RNA, 19 nt, Brucella suis 1330
uuggcgguuugcgaccaug

SEQ ID NO: 443947 - RNA, 17 nt, Brucella suis 1330
uuggaaucugccuuguc

SEQ ID NO: 443948 - RNA, 19 nt, Brucella suis 1330
uugcuggaaaugcucuagu

SEQ ID NO: 443949 - RNA, 13 nt, Brucella suis 1330
uugcgggcaagca

SEQ ID NO: 443950 - RNA, 17 nt, Brucella suis 1330
uugcggauacccaugcg

SEQ ID NO: 443951 - RNA, 15 nt, Brucella suis 1330
uugcgcugauucugg

SEQ ID NO: 443952 - RNA, 17 nt, Brucella suis 1330
uugcgaccauggcgcau

SEQ ID NO: 443953 - RNA, 15 nt, Brucella suis 1330
uugccuugcccaugg

SEQ ID NO: 443954 - RNA, 21 nt, Brucella suis 1330
uugaucccgaucugagaaagc

SEQ ID NO: 443955 - RNA, 16 nt, Brucella suis 1330
uugaucgagccgacau

SEQ ID NO: 443956 - RNA, 18 nt, Brucella suis 1330
uugagguguuucgcgcaa

SEQ ID NO: 443957 - RNA, 20 nt, Brucella suis 1330
uugaagccuuccgccucuuc

SEQ ID NO: 443958 - RNA, 18 nt, Brucella suis 1330
uugaacgguccaccacau

SEQ ID NO: 443959 - RNA, 15 nt, Brucella suis 1330
uucucuugccgccgc

SEQ ID NO: 443960 - RNA, 12 nt, Brucella suis 1330
uucguagcugcu

SEQ ID NO: 443961 - RNA, 19 nt, Brucella suis 1330
uucggcgaccgccuuuucc

SEQ ID NO: 443962 - RNA, 14 nt, Brucella suis 1330
uucgcaaugccggg

SEQ ID NO: 443963 - RNA, 16 nt, Brucella suis 1330
uuccguggcgcggauc

SEQ ID NO: 443964 - RNA, 16 nt, Brucella suis 1330
uuccggguguccugcc

SEQ ID NO: 443965 - RNA, 17 nt, Brucella suis 1330
uuccggcauaaccgaaa

SEQ ID NO: 443966 - RNA, 21 nt, Brucella suis 1330
uuauccggucggcauauuuga

SEQ ID NO: 443967 - RNA, 21 nt, Brucella suis 1330
uuauccuuugacggacgccug

SEQ ID NO: 443968 - RNA, 17 nt, Brucella suis 1330
uguugggguuggccuga

SEQ ID NO: 443969 - RNA, 16 nt, Brucella suis 1330
uguuggucugcggcuu

SEQ ID NO: 443970 - RNA, 21 nt, Brucella suis 1330
uguucgacuugaagagccgca

SEQ ID NO: 443971 - RNA, 16 nt, Brucella suis 1330
ugucggccagagcuuc

SEQ ID NO: 443972 - RNA, 23 nt, Brucella suis 1330
ugucggccagagcuucgccgcca

SEQ ID NO: 443973 - RNA, 13 nt, Brucella suis 1330
uuaaaauggaauc

SEQ ID NO: 443974 - RNA, 20 nt, Brucella suis 1330
uguccgacagaucggcaaga

SEQ ID NO: 443975 - RNA, 18 nt, Brucella suis 1330
uguccgacauccaucggc

SEQ ID NO: 443976 - RNA, 17 nt, Brucella suis 1330
uguccgguccccgccgc

SEQ ID NO: 443977 - RNA, 19 nt, Brucella suis 1330
uguccacauggucgucgag

SEQ ID NO: 443978 - RNA, 13 nt, Brucella suis 1330
ugucauagccgau

SEQ ID NO: 443979 - RNA, 12 nt, Brucella suis 1330
uguaucccgaaa

SEQ ID NO: 443980 - RNA, 19 nt, Brucella suis 1330
ugguucagccgcuccggcg

SEQ ID NO: 443981 - RNA, 13 nt, Brucella suis 1330
uggucacggccac

SEQ ID NO: 443982 - RNA, 13 nt, Brucella suis 1330
ugggaaaccgcgc

SEQ ID NO: 443983 - RNA, 15 nt, Brucella suis 1330
uggcugcccgccgca

SEQ ID NO: 443984 - RNA, 16 nt, Brucella suis 1330
uggcuaugcgcuucau

SEQ ID NO: 443985 - RNA, 19 nt, Brucella suis 1330
aauaugcgccuugcgccgc

SEQ ID NO: 443986 - RNA, 10 nt, Brucella suis 1330
uggcggcacu

SEQ ID NO: 443987 - RNA, 20 nt, Brucella suis 1330
uggcgacggccagcgcgaug

SEQ ID NO: 443988 - RNA, 14 nt, Brucella suis 1330
uggcgaaaacggcc

SEQ ID NO: 443989 - RNA, 22 nt, Brucella suis 1330
uggccuuugcccuggggcauga

SEQ ID NO: 443990 - RNA, 14 nt, Brucella suis 1330
uggccuuccuugac

SEQ ID NO: 443991 - RNA, 15 nt, Brucella suis 1330
uggccuucagcacau

SEQ ID NO: 443992 - RNA, 18 nt, Brucella suis 1330
uggcauuauuccgccugc

SEQ ID NO: 443993 - RNA, 17 nt, Brucella suis 1330
uggcauagccggcaugg

SEQ ID NO: 443994 - RNA, 15 nt, Brucella suis 1330
uggcauccacucggc

SEQ ID NO: 443995 - RNA, 13 nt, Brucella suis 1330
uggcauccagcac

SEQ ID NO: 443996 - RNA, 18 nt, Brucella suis 1330
uggcagcaugaucgccac

SEQ ID NO: 443997 - RNA, 15 nt, Brucella suis 1330
uggcaagcagcaaaa

SEQ ID NO: 443998 - RNA, 22 nt, Brucella suis 1330
uggcaagugugcagacaggcca

SEQ ID NO: 443999 - RNA, 14 nt, Brucella suis 1330
uggaugccgccgca

SEQ ID NO: 444000 - RNA, 17 nt, Brucella suis 1330
uggauuggauuugacgu

SEQ ID NO: 444001 - RNA, 12 nt, Brucella suis 1330
uggaggcaagcu

SEQ ID NO: 444002 - RNA, 17 nt, Brucella suis 1330
uggacuauuuccaucgc

SEQ ID NO: 444003 - RNA, 20 nt, Brucella suis 1330
uggacgaaaggcggcgcauu

SEQ ID NO: 444004 - RNA, 17 nt, Brucella suis 1330
uggaagaugacgcccag

SEQ ID NO: 444005 - RNA, 15 nt, Brucella suis 1330
ugcuggcagcggcag

SEQ ID NO: 444006 - RNA, 18 nt, Brucella suis 1330
ugcucguccggccagccg

SEQ ID NO: 444007 - RNA, 15 nt, Brucella suis 1330
ugcucggcgagcuug

SEQ ID NO: 444008 - RNA, 17 nt, Brucella suis 1330
ugcguugcuggaacauc

SEQ ID NO: 444009 - RNA, 13 nt, Brucella suis 1330
ugcggcgagcgac

SEQ ID NO: 444010 - RNA, 17 nt, Brucella suis 1330
ugcggauacccaugcga

SEQ ID NO: 444011 - RNA, 17 nt, Brucella suis 1330
ugcggaacacgccgcca

SEQ ID NO: 444012 - RNA, 20 nt, Brucella suis 1330
ugcgcuggaugaugcuuuau

SEQ ID NO: 444013 - RNA, 19 nt, Brucella suis 1330
ugcgcugccauugccgcga

SEQ ID NO: 444014 - RNA, 12 nt, Brucella suis 1330
ugcgcucuagac

SEQ ID NO: 444015 - RNA, 16 nt, Brucella suis 1330
ugcgcucuaugcagca

SEQ ID NO: 444016 - RNA, 23 nt, Brucella suis 1330
ugcgcggugcggauggggugagg

SEQ ID NO: 444017 - RNA, 21 nt, Brucella suis 1330
ugcgcggaaaauguuccgcac

SEQ ID NO: 444018 - RNA, 16 nt, Brucella suis 1330
ugcgcgcuggaugucg

SEQ ID NO: 444019 - RNA, 16 nt, Brucella suis 1330
ugcgcgcgccaucggc

SEQ ID NO: 444020 - RNA, 17 nt, Brucella suis 1330
ugcgcgcgccgccaugg

SEQ ID NO: 444021 - RNA, 20 nt, Brucella suis 1330
ugcgcgcccgucaccggcug

SEQ ID NO: 444022 - RNA, 23 nt, Brucella suis 1330
ugcgcgaggggaugggggccggg

SEQ ID NO: 444023 - RNA, 14 nt, Brucella suis 1330
ugcgcgaugcggcg

SEQ ID NO: 444024 - RNA, 15 nt, Brucella suis 1330
ugcgccgccagcaug

SEQ ID NO: 444025 - RNA, 19 nt, Brucella suis 1330
ugcgcagcucggcuucaaa

SEQ ID NO: 444026 - RNA, 16 nt, Brucella suis 1330
ugcgcagggucugcgc

SEQ ID NO: 444027 - RNA, 24 nt, Brucella suis 1330
ugcgauuuccuugccgcucucguc

SEQ ID NO: 444028 - RNA, 13 nt, Brucella suis 1330
ugccugccgcgcc

SEQ ID NO: 444029 - RNA, 20 nt, Brucella suis 1330
ugccuggcgaaaacggccau

SEQ ID NO: 444030 - RNA, 16 nt, Brucella suis 1330
ugccugaaacaaggcc

SEQ ID NO: 444031 - RNA, 20 nt, Brucella suis 1330
ugccgcccaucccggaagga

SEQ ID NO: 444032 - RNA, 23 nt, Brucella suis 1330
ugccgagcgaacgcuccugcaug

SEQ ID NO: 444033 - RNA, 14 nt, Brucella suis 1330
ugcccucgccgccg

SEQ ID NO: 444034 - RNA, 17 nt, Brucella suis 1330
ugcccauguccgccuga

SEQ ID NO: 444035 - RNA, 20 nt, Brucella suis 1330
ugcccauggacuuuucagcc

SEQ ID NO: 444036 - RNA, 21 nt, Brucella suis 1330
ugcauuuuucgccgcgcacug

SEQ ID NO: 444037 - RNA, 18 nt, Brucella suis 1330
ugcaucgaaugccgcaug

SEQ ID NO: 444038 - RNA, 14 nt, Brucella suis 1330
ugcaggcgcggcaa

SEQ ID NO: 444039 - RNA, 19 nt, Brucella suis 1330
ugcaggcgcaggcccugca

SEQ ID NO: 444040 - RNA, 19 nt, Brucella suis 1330
ugcaccgauggccaggaaa

SEQ ID NO: 444041 - RNA, 16 nt, Brucella suis 1330
ugcacacccuugaucg

SEQ ID NO: 444042 - RNA, 12 nt, Brucella suis 1330
ugcacaguuccg

SEQ ID NO: 444043 - RNA, 22 nt, Brucella suis 1330
ugcaaugcgucgauggccgguu

SEQ ID NO: 444044 - RNA, 16 nt, Brucella suis 1330
ugcaauccacaggaga

SEQ ID NO: 444045 - RNA, 16 nt, Brucella suis 1330
ugcaagccgcggcgcg

SEQ ID NO: 444046 - RNA, 19 nt, Brucella suis 1330
ugauuucccgugcggccuu

SEQ ID NO: 444047 - RNA, 21 nt, Brucella suis 1330
ugcaaagcgcaucccgaaaag

SEQ ID NO: 444048 - RNA, 21 nt, Brucella suis 1330
ugauucaaucagaucgaaaug

SEQ ID NO: 444049 - RNA, 18 nt, Brucella suis 1330
ugauugggcggcggcacg

SEQ ID NO: 444050 - RNA, 13 nt, Brucella suis 1330
ugauccaugcgca

SEQ ID NO: 444051 - RNA, 17 nt, Brucella suis 1330
ugagguguuucgcgcaa

SEQ ID NO: 444052 - RNA, 15 nt, Brucella suis 1330
ugagguugagcugcu

SEQ ID NO: 444053 - RNA, 16 nt, Brucella suis 1330
ugagguugagcugcuc

SEQ ID NO: 444054 - RNA, 18 nt, Brucella suis 1330
ugauagcuggaaaaaauc

SEQ ID NO: 444055 - RNA, 18 nt, Brucella suis 1330
ugauaucgcggaucggca

SEQ ID NO: 444056 - RNA, 15 nt, Brucella suis 1330
ugagggccagaagau

SEQ ID NO: 444057 - RNA, 18 nt, Brucella suis 1330
ugacuuuaauugucggcg

SEQ ID NO: 444058 - RNA, 22 nt, Brucella suis 1330
ugagaaagcuugucgcggccuu

SEQ ID NO: 444059 - RNA, 22 nt, Brucella suis 1330
ugaaugccagauaaccugcgcg

SEQ ID NO: 444060 - RNA, 22 nt, Brucella suis 1330
ugaaugcgccgccagcauggcg

SEQ ID NO: 444061 - RNA, 16 nt, Brucella suis 1330
ugaauuagaucggcgc

SEQ ID NO: 444062 - RNA, 13 nt, Brucella suis 1330
ugaauuucggcga

SEQ ID NO: 444063 - RNA, 22 nt, Brucella suis 1330
ugaaacagugccgccaucggca

SEQ ID NO: 444064 - RNA, 20 nt, Brucella suis 1330
ugaagaagcuucacauccuu

SEQ ID NO: 444065 - RNA, 17 nt, Brucella suis 1330
ucuguucgucugcgcgu

SEQ ID NO: 444066 - RNA, 13 nt, Brucella suis 1330
ugaaaaggcuggc

SEQ ID NO: 444067 - RNA, 15 nt, Brucella suis 1330
ucugucaccugacgg

SEQ ID NO: 444068 - RNA, 19 nt, Brucella suis 1330
ucugcgggcggcggcucca

SEQ ID NO: 444069 - RNA, 12 nt, Brucella suis 1330
ucugcggucuuu

SEQ ID NO: 444070 - RNA, 18 nt, Brucella suis 1330
ucuccugccacgaugccu

SEQ ID NO: 444071 - RNA, 20 nt, Brucella suis 1330
ucgugugcuugccgaaaagc

SEQ ID NO: 444072 - RNA, 17 nt, Brucella suis 1330
ucgugccggaauggcca

SEQ ID NO: 444073 - RNA, 17 nt, Brucella suis 1330
ucgucgcgcucgccgcc

SEQ ID NO: 444074 - RNA, 23 nt, Brucella suis 1330
ucgucacacaccaauguccaguu

SEQ ID NO: 444075 - RNA, 22 nt, Brucella suis 1330
ucggcggcaguuucaccauggc

SEQ ID NO: 444076 - RNA, 22 nt, Brucella suis 1330
ucggcggaacugcaugggcucg

SEQ ID NO: 444077 - RNA, 21 nt, Brucella suis 1330
ucggcgaggucucccggcacg

SEQ ID NO: 444078 - RNA, 14 nt, Brucella suis 1330
ucggcccagcaccg

SEQ ID NO: 444079 - RNA, 21 nt, Brucella suis 1330
ucggccagcgcaaagcgcgcg

SEQ ID NO: 444080 - RNA, 19 nt, Brucella suis 1330
ucggauucuuaugccagau

SEQ ID NO: 444081 - RNA, 19 nt, Brucella suis 1330
ucggcaaacauccagccgg

SEQ ID NO: 444082 - RNA, 14 nt, Brucella suis 1330
ucggagccggccuu

SEQ ID NO: 444083 - RNA, 16 nt, Brucella suis 1330
ucggauaacgcgacaa

SEQ ID NO: 444084 - RNA, 22 nt, Brucella suis 1330
ucggauaagaugcgcgcaagga

SEQ ID NO: 444085 - RNA, 15 nt, Brucella suis 1330
ucgcgcucgccgccc

SEQ ID NO: 444086 - RNA, 19 nt, Brucella suis 1330
ucgcgcucgaaugccucga

SEQ ID NO: 444087 - RNA, 11 nt, Brucella suis 1330
ucgcgccgccu

SEQ ID NO: 444088 - RNA, 21 nt, Brucella suis 1330
ucgccgccggugcucugcgcc

SEQ ID NO: 444089 - RNA, 15 nt, Brucella suis 1330
ucgcaaagcguuccg

SEQ ID NO: 444090 - RNA, 20 nt, Brucella suis 1330
ucgcaaagcguuccgcgcaa

SEQ ID NO: 444091 - RNA, 22 nt, Brucella suis 1330
ucgauggcggagcguccggcgc

SEQ ID NO: 444092 - RNA, 18 nt, Brucella suis 1330
ucgaucaaggccguuauu

SEQ ID NO: 444093 - RNA, 14 nt, Brucella suis 1330
ucgaucagcaccau

SEQ ID NO: 444094 - RNA, 17 nt, Brucella suis 1330
ucgauaucgagcacgag

SEQ ID NO: 444095 - RNA, 14 nt, Brucella suis 1330
ucgaggcugcgcga

SEQ ID NO: 444096 - RNA, 15 nt, Brucella suis 1330
ucgagggcaccggcc

SEQ ID NO: 444097 - RNA, 17 nt, Brucella suis 1330
ucgagggcaccggccuu

SEQ ID NO: 444098 - RNA, 20 nt, Brucella suis 1330
ucgagcgccuguccgccugc

SEQ ID NO: 444099 - RNA, 19 nt, Brucella suis 1330
ucgaaagcccgucggccau

SEQ ID NO: 444100 - RNA, 19 nt, Brucella suis 1330
ucgaaauccaguccgauau

SEQ ID NO: 444101 - RNA, 20 nt, Brucella suis 1330
uccuuaacggugaucggcgu

SEQ ID NO: 444102 - RNA, 14 nt, Brucella suis 1330
uccucacggccaua

SEQ ID NO: 444103 - RNA, 20 nt, Brucella suis 1330
uccgugacgagcgcacgcag

SEQ ID NO: 444104 - RNA, 15 nt, Brucella suis 1330
uccgucagacgaucc

SEQ ID NO: 444105 - RNA, 13 nt, Brucella suis 1330
uccgggccgcaca

SEQ ID NO: 444106 - RNA, 21 nt, Brucella suis 1330
uccggcuugauacugcgcgca

SEQ ID NO: 444107 - RNA, 21 nt, Brucella suis 1330
uccgcauaagccccggcauca

SEQ ID NO: 444108 - RNA, 13 nt, Brucella suis 1330
uccgcaucgcaau

SEQ ID NO: 444109 - RNA, 14 nt, Brucella suis 1330
uccgcaccggcaug

SEQ ID NO: 444110 - RNA, 15 nt, Brucella suis 1330
uccgcaccgcacugg

SEQ ID NO: 444111 - RNA, 14 nt, Brucella suis 1330
uccgcaaucgccac

SEQ ID NO: 444112 - RNA, 20 nt, Brucella suis 1330
uccgaggcgcgcagcagcgg

SEQ ID NO: 444113 - RNA, 19 nt, Brucella suis 1330
uccgacauccaucggcuca

SEQ ID NO: 444114 - RNA, 16 nt, Brucella suis 1330
uccaguccgauaucga

SEQ ID NO: 444115 - RNA, 13 nt, Brucella suis 1330
uccagcagauccg

SEQ ID NO: 444116 - RNA, 17 nt, Brucella suis 1330
uccagcagaauuucagc

SEQ ID NO: 444117 - RNA, 17 nt, Brucella suis 1330
uccagaucggccauuuc

SEQ ID NO: 444118 - RNA, 20 nt, Brucella suis 1330
uccagaucggccauuucggc

SEQ ID NO: 444119 - RNA, 18 nt, Brucella suis 1330
uccacaaugauguucggc

SEQ ID NO: 444120 - RNA, 18 nt, Brucella suis 1330
ucauuguuaaagcggauc

SEQ ID NO: 444121 - RNA, 20 nt, Brucella suis 1330
ucauucggguugccuucgac

SEQ ID NO: 444122 - RNA, 16 nt, Brucella suis 1330
ucaugggcuugaucug

SEQ ID NO: 444123 - RNA, 18 nt, Brucella suis 1330
ucauggcuugaagcguga

SEQ ID NO: 444124 - RNA, 16 nt, Brucella suis 1330
ucauccuugaugccca

SEQ ID NO: 444125 - RNA, 18 nt, Brucella suis 1330
ucaggcccagaugcagcg

SEQ ID NO: 444126 - RNA, 18 nt, Brucella suis 1330
ucaggaucgcuuucgagc

SEQ ID NO: 444127 - RNA, 15 nt, Brucella suis 1330
ucagcuuuuccauca

SEQ ID NO: 444128 - RNA, 15 nt, Brucella suis 1330
ucagcucguccauga

SEQ ID NO: 444129 - RNA, 19 nt, Brucella suis 1330
ucagcuauagccugcgcca

SEQ ID NO: 444130 - RNA, 20 nt, Brucella suis 1330
ucagcgcgccguaauggcgc

SEQ ID NO: 444131 - RNA, 14 nt, Brucella suis 1330
ucagccuccugugc

SEQ ID NO: 444132 - RNA, 23 nt, Brucella suis 1330
ucagcccgcuuuuacgcgccgcc

SEQ ID NO: 444133 - RNA, 17 nt, Brucella suis 1330
ucagauggacauagccg

SEQ ID NO: 444134 - RNA, 17 nt, Brucella suis 1330
aauaaugcagcgccgcg

SEQ ID NO: 444135 - RNA, 19 nt, Brucella suis 1330
ucagaggaucaucaacggu

SEQ ID NO: 444136 - RNA, 19 nt, Brucella suis 1330
ucaauacccaugccuuuca

SEQ ID NO: 444137 - RNA, 15 nt, Brucella suis 1330
ucaauggccgcgcgg

SEQ ID NO: 444138 - RNA, 19 nt, Brucella suis 1330
ucaaccauauaaagcuuga

SEQ ID NO: 444139 - RNA, 20 nt, Brucella suis 1330
uauugcccuuccgggccgca

SEQ ID NO: 444140 - RNA, 21 nt, Brucella suis 1330
uauugccgagcauggccugcg

SEQ ID NO: 444141 - RNA, 14 nt, Brucella suis 1330
ucaaaccggccaug

SEQ ID NO: 444142 - RNA, 17 nt, Brucella suis 1330
ucaaaggaaagauccuu

SEQ ID NO: 444143 - RNA, 15 nt, Brucella suis 1330
ucaaagcgcguuuca

SEQ ID NO: 444144 - RNA, 20 nt, Brucella suis 1330
uaugccgacgcgcucggcaa

SEQ ID NO: 444145 - RNA, 21 nt, Brucella suis 1330
uaucggggcguccgccaccgc

SEQ ID NO: 444146 - RNA, 19 nt, Brucella suis 1330
uagccgcgaaccgucgcca

SEQ ID NO: 444147 - RNA, 13 nt, Brucella suis 1330
uagccugacccgg

SEQ ID NO: 444148 - RNA, 17 nt, Brucella suis 1330
uagccugcaagcgcgac

SEQ ID NO: 444149 - RNA, 18 nt, Brucella suis 1330
uacggcccucgaccgcca

SEQ ID NO: 444150 - RNA, 16 nt, Brucella suis 1330
uaccaaggcccgccuc

SEQ ID NO: 444151 - RNA, 18 nt, Brucella suis 1330
uaaggcccccagaaggcg

SEQ ID NO: 444152 - RNA, 13 nt, Brucella suis 1330
uaaggccugcugg

SEQ ID NO: 444153 - RNA, 16 nt, Brucella suis 1330
uaacggugaucggcgu

SEQ ID NO: 444154 - RNA, 17 nt, Brucella suis 1330
uaacggugcgcccgcga

SEQ ID NO: 444155 - RNA, 18 nt, Brucella suis 1330
uaacaggaacgccgccgg

SEQ ID NO: 444156 - RNA, 13 nt, Brucella suis 1330
guuuucgaggcca

SEQ ID NO: 444157 - RNA, 17 nt, Brucella suis 1330
guuuucgggaugcgcuc

SEQ ID NO: 444158 - RNA, 23 nt, Brucella suis 1330
guuuugcguaggauaaugcgaca

SEQ ID NO: 444159 - RNA, 24 nt, Brucella suis 1330
guuuugucauggccggaucggcca

SEQ ID NO: 444160 - RNA, 17 nt, Brucella suis 1330
guuuuaaccggaagcgc

SEQ ID NO: 444161 - RNA, 21 nt, Brucella suis 1330
guuugcgacgggcgagcgcca

SEQ ID NO: 444162 - RNA, 23 nt, Brucella suis 1330
guuuccugaacggcgugcgcugu

SEQ ID NO: 444163 - RNA, 17 nt, Brucella suis 1330
guugccacgcgccgcca

SEQ ID NO: 444164 - RNA, 21 nt, Brucella suis 1330
guugcacgcacaucggaaagc

SEQ ID NO: 444165 - RNA, 21 nt, Brucella suis 1330
guugcagccgccagauccgcu

SEQ ID NO: 444166 - RNA, 17 nt, Brucella suis 1330
guugcaagauccucgcc

SEQ ID NO: 444167 - RNA, 19 nt, Brucella suis 1330
guugcaagauccucgccuu

SEQ ID NO: 444168 - RNA, 19 nt, Brucella suis 1330
guugaacgguccaccacau

SEQ ID NO: 444169 - RNA, 16 nt, Brucella suis 1330
guuccagggcgcgcca

SEQ ID NO: 444170 - RNA, 22 nt, Brucella suis 1330
guuccgugccgauuucggcgug

SEQ ID NO: 444171 - RNA, 18 nt, Brucella suis 1330
guuccugcggaaugcccu

SEQ ID NO: 444172 - RNA, 18 nt, Brucella suis 1330
guguuuauucaucgucuu

SEQ ID NO: 444173 - RNA, 15 nt, Brucella suis 1330
guuacucggccgcgu

SEQ ID NO: 444174 - RNA, 14 nt, Brucella suis 1330
guuagagcggcucc

SEQ ID NO: 444175 - RNA, 23 nt, Brucella suis 1330
guggucuuugugauuccaacauu

SEQ ID NO: 444176 - RNA, 20 nt, Brucella suis 1330
guggguuugagcguggcucg

SEQ ID NO: 444177 - RNA, 17 nt, Brucella suis 1330
gugggaaaccgcgcggc

SEQ ID NO: 444178 - RNA, 16 nt, Brucella suis 1330
guggcugcccgccgca

SEQ ID NO: 444179 - RNA, 20 nt, Brucella suis 1330
guggaucggcgucaggccga

SEQ ID NO: 444180 - RNA, 17 nt, Brucella suis 1330
gugcucuauccagcuga

SEQ ID NO: 444181 - RNA, 22 nt, Brucella suis 1330
gugccuucgaugaccaccgcga

SEQ ID NO: 444182 - RNA, 15 nt, Brucella suis 1330
gugccgagaaugcga

SEQ ID NO: 444183 - RNA, 22 nt, Brucella suis 1330
gugacggucgaagccacggcga

SEQ ID NO: 444184 - RNA, 14 nt, Brucella suis 1330
gugaaacagugccg

SEQ ID NO: 444185 - RNA, 17 nt, Brucella suis 1330
gugaaacagugccgcca

SEQ ID NO: 444186 - RNA, 21 nt, Brucella suis 1330
gucuucugagaaaaaaaugcg

SEQ ID NO: 444187 - RNA, 22 nt, Brucella suis 1330
gucuucugagaaaaaaaugcgc

SEQ ID NO: 444188 - RNA, 19 nt, Brucella suis 1330
gucugggcgaugagcgcca

SEQ ID NO: 444189 - RNA, 20 nt, Brucella suis 1330
gucugggcgaugagcgccau

SEQ ID NO: 444190 - RNA, 15 nt, Brucella suis 1330
gucugcuugccgccg

SEQ ID NO: 444191 - RNA, 12 nt, Brucella suis 1330
gucugcgccaga

SEQ ID NO: 444192 - RNA, 22 nt, Brucella suis 1330
gucugacgggaugauugcgcca

SEQ ID NO: 444193 - RNA, 16 nt, Brucella suis 1330
gucucgcgaccgggcu

SEQ ID NO: 444194 - RNA, 18 nt, Brucella suis 1330
gucuauuuucugcgggcg

SEQ ID NO: 444195 - RNA, 15 nt, Brucella suis 1330
gucguucaccgcaac

SEQ ID NO: 444196 - RNA, 14 nt, Brucella suis 1330
gucgucuagcgcca

SEQ ID NO: 444197 - RNA, 14 nt, Brucella suis 1330
gucgugacggccgg

SEQ ID NO: 444198 - RNA, 16 nt, Brucella suis 1330
gucgugacggccggaa

SEQ ID NO: 444199 - RNA, 18 nt, Brucella suis 1330
gucggguccagcgaugcc

SEQ ID NO: 444200 - RNA, 18 nt, Brucella suis 1330
gucgccgaaaagcgccug

SEQ ID NO: 444201 - RNA, 24 nt, Brucella suis 1330
gucgaggaagcgguccuggcgcac

SEQ ID NO: 444202 - RNA, 14 nt, Brucella suis 1330
gucgaccagcgcau

SEQ ID NO: 444203 - RNA, 21 nt, Brucella suis 1330
gucgaaaaucuugaucgagcc

SEQ ID NO: 444204 - RNA, 19 nt, Brucella suis 1330
guccggccugcgccagcga

SEQ ID NO: 444205 - RNA, 15 nt, Brucella suis 1330
guccgccaccgccgg

SEQ ID NO: 444206 - RNA, 15 nt, Brucella suis 1330
guccagaucggccuu

SEQ ID NO: 444207 - RNA, 19 nt, Brucella suis 1330
gucauggccacgccagccg

SEQ ID NO: 444208 - RNA, 11 nt, Brucella suis 1330
gucauggcgca

SEQ ID NO: 444209 - RNA, 19 nt, Brucella suis 1330
gucaguucgucggccagau

SEQ ID NO: 444210 - RNA, 16 nt, Brucella suis 1330
gucaggauauuucggc

SEQ ID NO: 444211 - RNA, 12 nt, Brucella suis 1330
gucagcuugucg

SEQ ID NO: 444212 - RNA, 15 nt, Brucella suis 1330
guaucgacaccgcca

SEQ ID NO: 444213 - RNA, 21 nt, Brucella suis 1330
guaucgaagcgggaccauaaa

SEQ ID NO: 444214 - RNA, 13 nt, Brucella suis 1330
guagccaugcguu

SEQ ID NO: 444215 - RNA, 15 nt, Brucella suis 1330
guaacgacgaacgau

SEQ ID NO: 444216 - RNA, 17 nt, Brucella suis 1330
gguugcgcggccagcca

SEQ ID NO: 444217 - RNA, 15 nt, Brucella suis 1330
gguugcuggaauuga

SEQ ID NO: 444218 - RNA, 15 nt, Brucella suis 1330
gguucagccgcuccg

SEQ ID NO: 444219 - RNA, 18 nt, Brucella suis 1330
gguuagcgacuucggguc

SEQ ID NO: 444220 - RNA, 16 nt, Brucella suis 1330
gguuauacucggcguu

SEQ ID NO: 444221 - RNA, 17 nt, Brucella suis 1330
ggugugagugcgcacgc

SEQ ID NO: 444222 - RNA, 19 nt, Brucella suis 1330
ggugucauagaccaugacg

SEQ ID NO: 444223 - RNA, 17 nt, Brucella suis 1330
gguggcugcccgccgca

SEQ ID NO: 444224 - RNA, 20 nt, Brucella suis 1330
gguggcgcccgcccgccgca

SEQ ID NO: 444225 - RNA, 18 nt, Brucella suis 1330
ggugcugucgcccagaac

SEQ ID NO: 444226 - RNA, 22 nt, Brucella suis 1330
ggugagcuugcgcagcgccgca

SEQ ID NO: 444227 - RNA, 16 nt, Brucella suis 1330
ggugaaacggccaagc

SEQ ID NO: 444228 - RNA, 17 nt, Brucella suis 1330
ggugaagaagcgccagc

SEQ ID NO: 444229 - RNA, 14 nt, Brucella suis 1330
ggucucgaagauca

SEQ ID NO: 444230 - RNA, 21 nt, Brucella suis 1330
gguccagcgaugccguggcga

SEQ ID NO: 444231 - RNA, 20 nt, Brucella suis 1330
ggguggcgcccgcccgccgc

SEQ ID NO: 444232 - RNA, 20 nt, Brucella suis 1330
gggucuucauagaccccgcc

SEQ ID NO: 444233 - RNA, 23 nt, Brucella suis 1330
ggguaugugucauaaaaaacggu

SEQ ID NO: 444234 - RNA, 19 nt, Brucella suis 1330
ggggcguccgccaccgccg

SEQ ID NO: 444235 - RNA, 13 nt, Brucella suis 1330
gggaccaccggcc

SEQ ID NO: 444236 - RNA, 13 nt, Brucella suis 1330
ggcuugcaugguu

SEQ ID NO: 444237 - RNA, 21 nt, Brucella suis 1330
ggcuugccagaugugccacca

SEQ ID NO: 444238 - RNA, 15 nt, Brucella suis 1330
ggcuugagcgucagg

SEQ ID NO: 444239 - RNA, 14 nt, Brucella suis 1330
ggcugugcgagcuu

SEQ ID NO: 444240 - RNA, 20 nt, Brucella suis 1330
ggcuucagaucgcgcggcga

SEQ ID NO: 444241 - RNA, 19 nt, Brucella suis 1330
ggcugcguuucggcggcuu

SEQ ID NO: 444242 - RNA, 18 nt, Brucella suis 1330
ggcugcccaugcccgcca

SEQ ID NO: 444243 - RNA, 19 nt, Brucella suis 1330
ggcugcccaugcccgccaa

SEQ ID NO: 444244 - RNA, 16 nt, Brucella suis 1330
ggcugcccgcgccggu

SEQ ID NO: 444245 - RNA, 20 nt, Brucella suis 1330
ggcugaaaucugcgccgguu

SEQ ID NO: 444246 - RNA, 12 nt, Brucella suis 1330
ggcucugcgcca

SEQ ID NO: 444247 - RNA, 15 nt, Brucella suis 1330
ggcuaugcgcuucau

SEQ ID NO: 444248 - RNA, 13 nt, Brucella suis 1330
ggcuaccggaugg

SEQ ID NO: 444249 - RNA, 19 nt, Brucella suis 1330
ggcguccccaucgaaaccg

SEQ ID NO: 444250 - RNA, 17 nt, Brucella suis 1330
ggcggcgucagcuuguc

SEQ ID NO: 444251 - RNA, 15 nt, Brucella suis 1330
ggcggcgguaccgaa

SEQ ID NO: 444252 - RNA, 13 nt, Brucella suis 1330
ggcggcgaugccu

SEQ ID NO: 444253 - RNA, 16 nt, Brucella suis 1330
ggcggauuuccugccu

SEQ ID NO: 444254 - RNA, 21 nt, Brucella suis 1330
ggcgcugcucgcgcaaggcuu

SEQ ID NO: 444255 - RNA, 13 nt, Brucella suis 1330
ggcgcgcugcaau

SEQ ID NO: 444256 - RNA, 15 nt, Brucella suis 1330
ggcgcgaaacgccuu

SEQ ID NO: 444257 - RNA, 18 nt, Brucella suis 1330
ggcgcgaaaccggaacgc

SEQ ID NO: 444258 - RNA, 22 nt, Brucella suis 1330
ggcgccaacggcggcaaacgga

SEQ ID NO: 444259 - RNA, 13 nt, Brucella suis 1330
ggcgaugcccauc

SEQ ID NO: 444260 - RNA, 19 nt, Brucella suis 1330
ggcgaucagguugaugccg

SEQ ID NO: 444261 - RNA, 20 nt, Brucella suis 1330
ggcgagggccucgauuucau

SEQ ID NO: 444262 - RNA, 16 nt, Brucella suis 1330
ggcgaggagcguucca

SEQ ID NO: 444263 - RNA, 23 nt, Brucella suis 1330
ggccgcggcaucccugucgccga

SEQ ID NO: 444264 - RNA, 20 nt, Brucella suis 1330
ggccgaugacggcgcggcgc

SEQ ID NO: 444265 - RNA, 12 nt, Brucella suis 1330
ggccgaugccga

SEQ ID NO: 444266 - RNA, 15 nt, Brucella suis 1330
ggccgagcgccgccg

SEQ ID NO: 444267 - RNA, 16 nt, Brucella suis 1330
ggccgaauagcgcauc

SEQ ID NO: 444268 - RNA, 15 nt, Brucella suis 1330
ggcccuucgcuuuca

SEQ ID NO: 444269 - RNA, 18 nt, Brucella suis 1330
ggcccuucagggacgagc

SEQ ID NO: 444270 - RNA, 23 nt, Brucella suis 1330
ggcccggucacccgcacgccgug

SEQ ID NO: 444271 - RNA, 17 nt, Brucella suis 1330
ggccaggccgauugccg

SEQ ID NO: 444272 - RNA, 22 nt, Brucella suis 1330
ggccagccgcaaugagcccgcg

SEQ ID NO: 444273 - RNA, 14 nt, Brucella suis 1330
ggccacaagcgccg

SEQ ID NO: 444274 - RNA, 15 nt, Brucella suis 1330
ggccaacgccggcac

SEQ ID NO: 444275 - RNA, 18 nt, Brucella suis 1330
ggcauuguggugcgcauc

SEQ ID NO: 444276 - RNA, 18 nt, Brucella suis 1330
ggcauugcgaagcgacuc

SEQ ID NO: 444277 - RNA, 22 nt, Brucella suis 1330
ggcaugaacaguuugagcauga

SEQ ID NO: 444278 - RNA, 19 nt, Brucella suis 1330
ggcauagccggcauggauu

SEQ ID NO: 444279 - RNA, 18 nt, Brucella suis 1330
ggcaggcacacccggcgu

SEQ ID NO: 444280 - RNA, 17 nt, Brucella suis 1330
ggcagacgugaccgccu

SEQ ID NO: 444281 - RNA, 17 nt, Brucella suis 1330
ggcagacgaaaauaucg

SEQ ID NO: 444282 - RNA, 20 nt, Brucella suis 1330
ggcacgcucgauccgcuugc

SEQ ID NO: 444283 - RNA, 12 nt, Brucella suis 1330
ggcaaugcgcuu

SEQ ID NO: 444284 - RNA, 16 nt, Brucella suis 1330
ggcaagcaggcgcaac

SEQ ID NO: 444285 - RNA, 17 nt, Brucella suis 1330
ggcaagccccagcacga

SEQ ID NO: 444286 - RNA, 11 nt, Brucella suis 1330
ggcaacgccga

SEQ ID NO: 444287 - RNA, 20 nt, Brucella suis 1330
ggcaaagccgaaugccagug

SEQ ID NO: 444288 - RNA, 17 nt, Brucella suis 1330
ggcaaaggcuccggcau

SEQ ID NO: 444289 - RNA, 16 nt, Brucella suis 1330
ggcaaaaggcgcaaug

SEQ ID NO: 444290 - RNA, 22 nt, Brucella suis 1330
ggcaaaaucgagugcggccugc

SEQ ID NO: 444291 - RNA, 17 nt, Brucella suis 1330
ggauuugcccgguuuuc

SEQ ID NO: 444292 - RNA, 21 nt, Brucella suis 1330
ggauuuuagagcgcaucccga

SEQ ID NO: 444293 - RNA, 20 nt, Brucella suis 1330
ggauuaugcucuuaaaaugc

SEQ ID NO: 444294 - RNA, 13 nt, Brucella suis 1330
ggaugcgcggcgc

SEQ ID NO: 444295 - RNA, 21 nt, Brucella suis 1330
ggaugcccuucguguccggcg

SEQ ID NO: 444296 - RNA, 14 nt, Brucella suis 1330
ggaugacgccgcuu

SEQ ID NO: 444297 - RNA, 21 nt, Brucella suis 1330
ggaucugguacugcguaccgg

SEQ ID NO: 444298 - RNA, 18 nt, Brucella suis 1330
ggaaaggucuuccgggac

SEQ ID NO: 444299 - RNA, 21 nt, Brucella suis 1330
ggaaagaguuggcccgcgugc

SEQ ID NO: 444300 - RNA, 23 nt, Brucella suis 1330
ggaaagaucugcaucccgaaaag

SEQ ID NO: 444301 - RNA, 22 nt, Brucella suis 1330
ggaaagcccaguucguggcggg

SEQ ID NO: 444302 - RNA, 15 nt, Brucella suis 1330
ggaaacgauuuucgc

SEQ ID NO: 444303 - RNA, 23 nt, Brucella suis 1330
ggaaacgauuuucgccagacgcg

SEQ ID NO: 444304 - RNA, 17 nt, Brucella suis 1330
ggaaaaaauccgcaaug

SEQ ID NO: 444305 - RNA, 13 nt, Brucella suis 1330
gcuuuuccaucac

SEQ ID NO: 444306 - RNA, 20 nt, Brucella suis 1330
gcuuuuuauccucccaugca

SEQ ID NO: 444307 - RNA, 18 nt, Brucella suis 1330
gcuuucgcgggcgugccu

SEQ ID NO: 444308 - RNA, 20 nt, Brucella suis 1330
gcuuuaugcgggugguggcg

SEQ ID NO: 444309 - RNA, 23 nt, Brucella suis 1330
gcuugcuugagggguucggcguc

SEQ ID NO: 444310 - RNA, 14 nt, Brucella suis 1330
gcuugcccgcgcca

SEQ ID NO: 444311 - RNA, 20 nt, Brucella suis 1330
gcuugccagaugugccacca

SEQ ID NO: 444312 - RNA, 20 nt, Brucella suis 1330
gcuugagcguuacuucggcg

SEQ ID NO: 444313 - RNA, 22 nt, Brucella suis 1330
gcuugagaaccgaacgcgccuu

SEQ ID NO: 444314 - RNA, 16 nt, Brucella suis 1330
gcuugaaccuccacgc

SEQ ID NO: 444315 - RNA, 12 nt, Brucella suis 1330
gcuucuuccagu

SEQ ID NO: 444316 - RNA, 23 nt, Brucella suis 1330
gcuucgccgccauggucgcgcac

SEQ ID NO: 444317 - RNA, 19 nt, Brucella suis 1330
gcuucgaucguuucgccau

SEQ ID NO: 444318 - RNA, 15 nt, Brucella suis 1330
gcuucgcacuuuugc

SEQ ID NO: 444319 - RNA, 13 nt, Brucella suis 1330
gcuucgagcgccu

SEQ ID NO: 444320 - RNA, 21 nt, Brucella suis 1330
gcuuccacgcggauaucggcg

SEQ ID NO: 444321 - RNA, 21 nt, Brucella suis 1330
gcuucaugggcuugaucuggg

SEQ ID NO: 444322 - RNA, 18 nt, Brucella suis 1330
gcuucaucgcggcagccg

SEQ ID NO: 444323 - RNA, 15 nt, Brucella suis 1330
gcuucaggucggcau

SEQ ID NO: 444324 - RNA, 20 nt, Brucella suis 1330
gcuucagccauucauggcug

SEQ ID NO: 444325 - RNA, 19 nt, Brucella suis 1330
gcuucacaugcuugccgac

SEQ ID NO: 444326 - RNA, 16 nt, Brucella suis 1330
gcugucgcgcccgcaa

SEQ ID NO: 444327 - RNA, 22 nt, Brucella suis 1330
gcugucgcgcccgcaaaucguc

SEQ ID NO: 444328 - RNA, 19 nt, Brucella suis 1330
gcugucgccagcgccgguc

SEQ ID NO: 444329 - RNA, 18 nt, Brucella suis 1330
gcuggucuggcgaggcgc

SEQ ID NO: 444330 - RNA, 21 nt, Brucella suis 1330
gcuggcuucucuugccgccgc

SEQ ID NO: 444331 - RNA, 22 nt, Brucella suis 1330
gcuggcuucucuugccgccgcu

SEQ ID NO: 444332 - RNA, 22 nt, Brucella suis 1330
gcugcucaucaucacauuggug

SEQ ID NO: 444333 - RNA, 14 nt, Brucella suis 1330
gcugcguuucggcg

SEQ ID NO: 444334 - RNA, 16 nt, Brucella suis 1330
gcugcgugggaaaccg

SEQ ID NO: 444335 - RNA, 18 nt, Brucella suis 1330
gcugcgugggaaaccgcg

SEQ ID NO: 444336 - RNA, 17 nt, Brucella suis 1330
gcugcgcggcauuggug

SEQ ID NO: 444337 - RNA, 14 nt, Brucella suis 1330
gcugcgcgaugcgg

SEQ ID NO: 444338 - RNA, 15 nt, Brucella suis 1330
gcugcgcgaaccaga

SEQ ID NO: 444339 - RNA, 13 nt, Brucella suis 1330
gcugccauugccg

SEQ ID NO: 444340 - RNA, 14 nt, Brucella suis 1330
gcugccauugccgc

SEQ ID NO: 444341 - RNA, 16 nt, Brucella suis 1330
gcugccauugccgcga

SEQ ID NO: 444342 - RNA, 15 nt, Brucella suis 1330
gcugcacacccuuga

SEQ ID NO: 444343 - RNA, 16 nt, Brucella suis 1330
gcugagcagauaggcg

SEQ ID NO: 444344 - RNA, 14 nt, Brucella suis 1330
gcucuauuucggcg

SEQ ID NO: 444345 - RNA, 20 nt, Brucella suis 1330
gcucuaauuuuaugcuggca

SEQ ID NO: 444346 - RNA, 19 nt, Brucella suis 1330
gcucgcgucccgcacgcag

SEQ ID NO: 444347 - RNA, 22 nt, Brucella suis 1330
gcucgaaugccucgaucuggcg

SEQ ID NO: 444348 - RNA, 13 nt, Brucella suis 1330
gcucccgccugca

SEQ ID NO: 444349 - RNA, 14 nt, Brucella suis 1330
gcuccagauugcgg

SEQ ID NO: 444350 - RNA, 22 nt, Brucella suis 1330
gcuccaccaccccuuccuugcc

SEQ ID NO: 444351 - RNA, 21 nt, Brucella suis 1330
gcucauucuguaaacugccgc

SEQ ID NO: 444352 - RNA, 23 nt, Brucella suis 1330
gcucauucuguaaacugccgcgu

SEQ ID NO: 444353 - RNA, 18 nt, Brucella suis 1330
gcucauauggaugccgcc

SEQ ID NO: 444354 - RNA, 19 nt, Brucella suis 1330
gcucauauggaugccgccg

SEQ ID NO: 444355 - RNA, 21 nt, Brucella suis 1330
gcucaggcugaguuuuccgcu

SEQ ID NO: 444356 - RNA, 14 nt, Brucella suis 1330
gcgugcggucgccg

SEQ ID NO: 444357 - RNA, 16 nt, Brucella suis 1330
gcgucccgcacgcagg

SEQ ID NO: 444358 - RNA, 15 nt, Brucella suis 1330
gcguccauccggcgg

SEQ ID NO: 444359 - RNA, 20 nt, Brucella suis 1330
gcgucagcuugucgagcggc

SEQ ID NO: 444360 - RNA, 17 nt, Brucella suis 1330
gcgucaggacaacgucg

SEQ ID NO: 444361 - RNA, 21 nt, Brucella suis 1330
gcguaaucagcgucagcgcaa

SEQ ID NO: 444362 - RNA, 14 nt, Brucella suis 1330
gcguaagcggcaau

SEQ ID NO: 444363 - RNA, 13 nt, Brucella suis 1330
gcgguugcggccg

SEQ ID NO: 444364 - RNA, 20 nt, Brucella suis 1330
gcgguuccgguuaaaacgga

SEQ ID NO: 444365 - RNA, 15 nt, Brucella suis 1330
gcggucucgguucgc

SEQ ID NO: 444366 - RNA, 13 nt, Brucella suis 1330
gcggucgccgccc

SEQ ID NO: 444367 - RNA, 23 nt, Brucella suis 1330
gcgggcaauggccgcaugaacau

SEQ ID NO: 444368 - RNA, 19 nt, Brucella suis 1330
gcggcuuccagauugucuu

SEQ ID NO: 444369 - RNA, 20 nt, Brucella suis 1330
gcggcugaaaucugcgccgg

SEQ ID NO: 444370 - RNA, 19 nt, Brucella suis 1330
gcggcucucacgcgcagca

SEQ ID NO: 444371 - RNA, 19 nt, Brucella suis 1330
gcggcgucagggcauugcc

SEQ ID NO: 444372 - RNA, 16 nt, Brucella suis 1330
gcggcgggugccgcgc

SEQ ID NO: 444373 - RNA, 17 nt, Brucella suis 1330
gcggcggguagccgcca

SEQ ID NO: 444374 - RNA, 15 nt, Brucella suis 1330
gcggcggcgcgcaag

SEQ ID NO: 444375 - RNA, 22 nt, Brucella suis 1330
gcggcggcgcgcaaguucgagc

SEQ ID NO: 444376 - RNA, 17 nt, Brucella suis 1330
gcggcggcaaucgagac

SEQ ID NO: 444377 - RNA, 12 nt, Brucella suis 1330
aagcgguuuugc

SEQ ID NO: 444378 - RNA, 22 nt, Brucella suis 1330
gcggcgccaccgucaccggcug

SEQ ID NO: 444379 - RNA, 16 nt, Brucella suis 1330
aagcgggcuguuggcc

SEQ ID NO: 444380 - RNA, 14 nt, Brucella suis 1330
aagcgcucagcuuu

SEQ ID NO: 444381 - RNA, 14 nt, Brucella suis 1330
gcggccaagcggau

SEQ ID NO: 444382 - RNA, 21 nt, Brucella suis 1330
aagcgccgguucggucccguc

SEQ ID NO: 444383 - RNA, 14 nt, Brucella suis 1330
aagcgccagcuucc

SEQ ID NO: 444384 - RNA, 22 nt, Brucella suis 1330
gcggcaucgagaaaagcgcaac

SEQ ID NO: 444385 - RNA, 21 nt, Brucella suis 1330
gcggcaggccgcaaagcgaac

SEQ ID NO: 444386 - RNA, 15 nt, Brucella suis 1330
aagcgaccaccaccg

SEQ ID NO: 444387 - RNA, 13 nt, Brucella suis 1330
gcgcuccaugcgg

SEQ ID NO: 444388 - RNA, 13 nt, Brucella suis 1330
gcgcucaugaaac

SEQ ID NO: 444389 - RNA, 14 nt, Brucella suis 1330
gcgcguaucgacac

SEQ ID NO: 444390 - RNA, 18 nt, Brucella suis 1330
gcgcggcguucggcaagu

SEQ ID NO: 444391 - RNA, 19 nt, Brucella suis 1330
gcgcggccccgauuuuggc

SEQ ID NO: 444392 - RNA, 22 nt, Brucella suis 1330
gcgcggcaggaucgccagaagc

SEQ ID NO: 444393 - RNA, 14 nt, Brucella suis 1330
gcgcggaaugacau

SEQ ID NO: 444394 - RNA, 12 nt, Brucella suis 1330
gcgcgcggcaua

SEQ ID NO: 444395 - RNA, 20 nt, Brucella suis 1330
gcgcgcauuucauggcgguc

SEQ ID NO: 444396 - RNA, 22 nt, Brucella suis 1330
gcgcgcauuucgguuuucgugc

SEQ ID NO: 444397 - RNA, 16 nt, Brucella suis 1330
gcgcgacaagcgcauc

SEQ ID NO: 444398 - RNA, 22 nt, Brucella suis 1330
gcgccggucuucauggcuugaa

SEQ ID NO: 444399 - RNA, 14 nt, Brucella suis 1330
gcgccgccgcgaca

SEQ ID NO: 444400 - RNA, 21 nt, Brucella suis 1330
gcgccgccgcgacauagccga

SEQ ID NO: 444401 - RNA, 16 nt, Brucella suis 1330
gcgccgccauggccga

SEQ ID NO: 444402 - RNA, 18 nt, Brucella suis 1330
gcgccgauauagacgcca

SEQ ID NO: 444403 - RNA, 20 nt, Brucella suis 1330
gcgccgaaccgggccgcaug

SEQ ID NO: 444404 - RNA, 21 nt, Brucella suis 1330
gcgcccuugccggauaucgcc

SEQ ID NO: 444405 - RNA, 22 nt, Brucella suis 1330
gcgcauucgggucacccggcgc

SEQ ID NO: 444406 - RNA, 15 nt, Brucella suis 1330
gcgcaugaagcgcgg

SEQ ID NO: 444407 - RNA, 19 nt, Brucella suis 1330
gcgcaucgggcgcacaagc

SEQ ID NO: 444408 - RNA, 19 nt, Brucella suis 1330
gcgcaguuucgcagccaag

SEQ ID NO: 444409 - RNA, 13 nt, Brucella suis 1330
gcgcagaucggcg

SEQ ID NO: 444410 - RNA, 16 nt, Brucella suis 1330
gcgcagaucaucguca

SEQ ID NO: 444411 - RNA, 14 nt, Brucella suis 1330
gcgcacguccggca

SEQ ID NO: 444412 - RNA, 20 nt, Brucella suis 1330
gcgcacauaaaacgcgccga

SEQ ID NO: 444413 - RNA, 16 nt, Brucella suis 1330
gcgcaauggccuugcc

SEQ ID NO: 444414 - RNA, 14 nt, Brucella suis 1330
gcgcaauucaugcc

SEQ ID NO: 444415 - RNA, 20 nt, Brucella suis 1330
gcgauaucaccaauauugca

SEQ ID NO: 444416 - RNA, 15 nt, Brucella suis 1330
gcgagcacgccgcuc

SEQ ID NO: 444417 - RNA, 23 nt, Brucella suis 1330
gcgacgauaucgccugcuuccuu

SEQ ID NO: 444418 - RNA, 15 nt, Brucella suis 1330
gcgacgaggccugaa

SEQ ID NO: 444419 - RNA, 16 nt, Brucella suis 1330
gcgacgagaugcgcuu

SEQ ID NO: 444420 - RNA, 20 nt, Brucella suis 1330
gcgacgagaugcgcuuuccg

SEQ ID NO: 444421 - RNA, 15 nt, Brucella suis 1330
gcgacacggccgauc

SEQ ID NO: 444422 - RNA, 13 nt, Brucella suis 1330
aagccccgcccau

SEQ ID NO: 444423 - RNA, 12 nt, Brucella suis 1330
aagcccgccgau

SEQ ID NO: 444424 - RNA, 20 nt, Brucella suis 1330
gcgaauggucggcgucaagc

SEQ ID NO: 444425 - RNA, 19 nt, Brucella suis 1330
gcgaaugacuucaucgcgc

SEQ ID NO: 444426 - RNA, 18 nt, Brucella suis 1330
gcgaauagaccaugccgc

SEQ ID NO: 444427 - RNA, 24 nt, Brucella suis 1330
gcgaauagaccaugccgccagccg

SEQ ID NO: 444428 - RNA, 14 nt, Brucella suis 1330
gcgaagcgguuuuc

SEQ ID NO: 444429 - RNA, 17 nt, Brucella suis 1330
gcgaacacgaugauggc

SEQ ID NO: 444430 - RNA, 17 nt, Brucella suis 1330
gcgaaaucgccacgauc

SEQ ID NO: 444431 - RNA, 17 nt, Brucella suis 1330
gcgaaaccauggagcgc

SEQ ID NO: 444432 - RNA, 20 nt, Brucella suis 1330
gccuuugccgcaauugccgc

SEQ ID NO: 444433 - RNA, 13 nt, Brucella suis 1330
gccuuugcgccgg

SEQ ID NO: 444434 - RNA, 21 nt, Brucella suis 1330
gccuugucgaucccuucgacg

SEQ ID NO: 444435 - RNA, 12 nt, Brucella suis 1330
gccuugcgccgc

SEQ ID NO: 444436 - RNA, 23 nt, Brucella suis 1330
gccuugcccauggugccagcguc

SEQ ID NO: 444437 - RNA, 14 nt, Brucella suis 1330
gccuucauugcggc

SEQ ID NO: 444438 - RNA, 16 nt, Brucella suis 1330
gccuucauugcggcca

SEQ ID NO: 444439 - RNA, 14 nt, Brucella suis 1330
gccuucaaaacgca

SEQ ID NO: 444440 - RNA, 13 nt, Brucella suis 1330
gccugugcggcgg

SEQ ID NO: 444441 - RNA, 17 nt, Brucella suis 1330
gccugugccaaugacau

SEQ ID NO: 444442 - RNA, 13 nt, Brucella suis 1330
gccugcaugggca

SEQ ID NO: 444443 - RNA, 13 nt, Brucella suis 1330
gccugcaccggcc

SEQ ID NO: 444444 - RNA, 13 nt, Brucella suis 1330
gccugcaccaugg

SEQ ID NO: 444445 - RNA, 13 nt, Brucella suis 1330
gccugcacauaaa

SEQ ID NO: 444446 - RNA, 14 nt, Brucella suis 1330
gccugaggccggac

SEQ ID NO: 444447 - RNA, 18 nt, Brucella suis 1330
gccugaaagcugcuggcg

SEQ ID NO: 444448 - RNA, 18 nt, Brucella suis 1330
gccugaaacaaggccgag

SEQ ID NO: 444449 - RNA, 15 nt, Brucella suis 1330
gccucaagugccgcc

SEQ ID NO: 444450 - RNA, 20 nt, Brucella suis 1330
gccguuauuucgcgcgcaag

SEQ ID NO: 444451 - RNA, 16 nt, Brucella suis 1330
gccgugcccgacugaa

SEQ ID NO: 444452 - RNA, 14 nt, Brucella suis 1330
gccguaaauuauga

SEQ ID NO: 444453 - RNA, 15 nt, Brucella suis 1330
gccggggccggaugc

SEQ ID NO: 444454 - RNA, 13 nt, Brucella suis 1330
gccgggcuuuccu

SEQ ID NO: 444455 - RNA, 17 nt, Brucella suis 1330
gccgggcaucgcucgaa

SEQ ID NO: 444456 - RNA, 20 nt, Brucella suis 1330
gccgggcacgaaaagcagga

SEQ ID NO: 444457 - RNA, 23 nt, Brucella suis 1330
gccggcuuccacgcgcuugcgau

SEQ ID NO: 444458 - RNA, 20 nt, Brucella suis 1330
gccgcuauuugaguuuuucu

SEQ ID NO: 444459 - RNA, 17 nt, Brucella suis 1330
gccgcguugcccauguc

SEQ ID NO: 444460 - RNA, 22 nt, Brucella suis 1330
gccgcguggcuaugcgcuucau

SEQ ID NO: 444461 - RNA, 15 nt, Brucella suis 1330
gccgcgugaaaagca

SEQ ID NO: 444462 - RNA, 20 nt, Brucella suis 1330
gccgcgugaaaagcacacgg

SEQ ID NO: 444463 - RNA, 18 nt, Brucella suis 1330
gccgcggaugacgccgcu

SEQ ID NO: 444464 - RNA, 13 nt, Brucella suis 1330
gccgcgcacuggc

SEQ ID NO: 444465 - RNA, 18 nt, Brucella suis 1330
gccgccuucaaaacgcag

SEQ ID NO: 444466 - RNA, 19 nt, Brucella suis 1330
gccgccuucaaaacgcagc

SEQ ID NO: 444467 - RNA, 23 nt, Brucella suis 1330
gccgccuucggcugcuuccggcg

SEQ ID NO: 444468 - RNA, 20 nt, Brucella suis 1330
gccgccgcuuccagcgaaac

SEQ ID NO: 444469 - RNA, 12 nt, Brucella suis 1330
gccgccagaaaa

SEQ ID NO: 444470 - RNA, 19 nt, Brucella suis 1330
gccgcaucggaagggcaag

SEQ ID NO: 444471 - RNA, 19 nt, Brucella suis 1330
gccgcaagcuggaaccagc

SEQ ID NO: 444472 - RNA, 18 nt, Brucella suis 1330
gccgcaagcgugagacca

SEQ ID NO: 444473 - RNA, 23 nt, Brucella suis 1330
aagcaagcacuacgucaacagcc

SEQ ID NO: 444474 - RNA, 21 nt, Brucella suis 1330
gccgaugggccggucuucccg

SEQ ID NO: 444475 - RNA, 14 nt, Brucella suis 1330
gccgaugauuucau

SEQ ID NO: 444476 - RNA, 13 nt, Brucella suis 1330
gccgaugacggcg

SEQ ID NO: 444477 - RNA, 13 nt, Brucella suis 1330
gccgauccugcgc

SEQ ID NO: 444478 - RNA, 16 nt, Brucella suis 1330
gccgagcuugcggcgg

SEQ ID NO: 444479 - RNA, 20 nt, Brucella suis 1330
gccgaggaauuucagcgaag

SEQ ID NO: 444480 - RNA, 14 nt, Brucella suis 1330
gccgagcgccgccg

SEQ ID NO: 444481 - RNA, 16 nt, Brucella suis 1330
gccgagcgccgccgcg

SEQ ID NO: 444482 - RNA, 17 nt, Brucella suis 1330
gccgaauagcgcaucgc

SEQ ID NO: 444483 - RNA, 13 nt, Brucella suis 1330
gccgaaaagccgc

SEQ ID NO: 444484 - RNA, 13 nt, Brucella suis 1330
gcccuugcgcacc

SEQ ID NO: 444485 - RNA, 18 nt, Brucella suis 1330
gcccuugagagccagauc

SEQ ID NO: 444486 - RNA, 22 nt, Brucella suis 1330
gcccuucgcuuucaauggccgc

SEQ ID NO: 444487 - RNA, 21 nt, Brucella suis 1330
gcccuggauaucuuccgcaag

SEQ ID NO: 444488 - RNA, 18 nt, Brucella suis 1330
gcccugcuucacaugcuu

SEQ ID NO: 444489 - RNA, 17 nt, Brucella suis 1330
gcccucgcggaaaagcu

SEQ ID NO: 444490 - RNA, 23 nt, Brucella suis 1330
gcccucgcggaucagcuugccgc

SEQ ID NO: 444491 - RNA, 15 nt, Brucella suis 1330
gcccgccuuugccgc

SEQ ID NO: 444492 - RNA, 17 nt, Brucella suis 1330
gcccgcauagccaucgc

SEQ ID NO: 444493 - RNA, 18 nt, Brucella suis 1330
gcccgcauagccaucgcc

SEQ ID NO: 444494 - RNA, 20 nt, Brucella suis 1330
gcccgcauagccaucgccga

SEQ ID NO: 444495 - RNA, 22 nt, Brucella suis 1330
gccccuaaaggcucugcgccag

SEQ ID NO: 444496 - RNA, 22 nt, Brucella suis 1330
gccccaggaacggcagguaaga

SEQ ID NO: 444497 - RNA, 22 nt, Brucella suis 1330
gccccacggaucgacaaaggug

SEQ ID NO: 444498 - RNA, 17 nt, Brucella suis 1330
gcccacccaccgccugc

SEQ ID NO: 444499 - RNA, 18 nt, Brucella suis 1330
gcccacccaccgccugca

SEQ ID NO: 444500 - RNA, 17 nt, Brucella suis 1330
gcccaaaagcgcgccga

SEQ ID NO: 444501 - RNA, 18 nt, Brucella suis 1330
gccauuucggaucggcgc

SEQ ID NO: 444502 - RNA, 14 nt, Brucella suis 1330
gccauugaccgccu

SEQ ID NO: 444503 - RNA, 16 nt, Brucella suis 1330
gccauugaccgccucg

SEQ ID NO: 444504 - RNA, 18 nt, Brucella suis 1330
aagacauuuucgccgggg

SEQ ID NO: 444505 - RNA, 14 nt, Brucella suis 1330
gccagggauugcgc

SEQ ID NO: 444506 - RNA, 16 nt, Brucella suis 1330
gccagcaggccggcga

SEQ ID NO: 444507 - RNA, 23 nt, Brucella suis 1330
gccacuucgcgggcaauggccgc

SEQ ID NO: 444508 - RNA, 14 nt, Brucella suis 1330
gccacgcgccgcca

SEQ ID NO: 444509 - RNA, 19 nt, Brucella suis 1330
gccaccgccggcgccgcca

SEQ ID NO: 444510 - RNA, 23 nt, Brucella suis 1330
gccaccgcgaaagccagaaccac

SEQ ID NO: 444511 - RNA, 22 nt, Brucella suis 1330
gccaccauggccgccccgacga

SEQ ID NO: 444512 - RNA, 23 nt, Brucella suis 1330
gccaagugcggucugcuugccgc

SEQ ID NO: 444513 - RNA, 16 nt, Brucella suis 1330
gccaagugaagcgaag

SEQ ID NO: 444514 - RNA, 18 nt, Brucella suis 1330
gccaagggccgccgaagc

SEQ ID NO: 444515 - RNA, 16 nt, Brucella suis 1330
gccaagacuaugcgcc

SEQ ID NO: 444516 - RNA, 17 nt, Brucella suis 1330
gccaagacuaugcgcca

SEQ ID NO: 444517 - RNA, 18 nt, Brucella suis 1330
gccaagaucgacaaagcc

SEQ ID NO: 444518 - RNA, 21 nt, Brucella suis 1330
gccaagaucgacaaagccuga

SEQ ID NO: 444519 - RNA, 13 nt, Brucella suis 1330
gcaguccggcagc

SEQ ID NO: 444520 - RNA, 21 nt, Brucella suis 1330
gcaguaugauuugucggaagc

SEQ ID NO: 444521 - RNA, 11 nt, Brucella suis 1330
gcaguaccgac

SEQ ID NO: 444522 - RNA, 15 nt, Brucella suis 1330
gcaggcuguccgaga

SEQ ID NO: 444523 - RNA, 16 nt, Brucella suis 1330
gcaggcucccgccugc

SEQ ID NO: 444524 - RNA, 18 nt, Brucella suis 1330
gcaggcgacaucccgcau

SEQ ID NO: 444525 - RNA, 17 nt, Brucella suis 1330
gcaggcccugcauaucg

SEQ ID NO: 444526 - RNA, 15 nt, Brucella suis 1330
gcaggcaggccgccu

SEQ ID NO: 444527 - RNA, 12 nt, Brucella suis 1330
gcaggcacuggu

SEQ ID NO: 444528 - RNA, 18 nt, Brucella suis 1330
gcaggaucagggccacuc

SEQ ID NO: 444529 - RNA, 14 nt, Brucella suis 1330
gcaggagcgcgauc

SEQ ID NO: 444530 - RNA, 11 nt, Brucella suis 1330
gcagcuugucg

SEQ ID NO: 444531 - RNA, 20 nt, Brucella suis 1330
gcagcucuauugcccggcgg

SEQ ID NO: 444532 - RNA, 23 nt, Brucella suis 1330
gcagcguuuugucauggccggau

SEQ ID NO: 444533 - RNA, 17 nt, Brucella suis 1330
gcagcgucaccgugcgc

SEQ ID NO: 444534 - RNA, 21 nt, Brucella suis 1330
gcagcggaucauccuugaugc

SEQ ID NO: 444535 - RNA, 18 nt, Brucella suis 1330
gcagcgauauccggcacg

SEQ ID NO: 444536 - RNA, 13 nt, Brucella suis 1330
gcagcaccggcgg

SEQ ID NO: 444537 - RNA, 17 nt, Brucella suis 1330
gcagcaauuccugcgcc

SEQ ID NO: 444538 - RNA, 18 nt, Brucella suis 1330
gcagcaauuccugcgcca

SEQ ID NO: 444539 - RNA, 18 nt, Brucella suis 1330
gcagauaggcguugauga

SEQ ID NO: 444540 - RNA, 19 nt, Brucella suis 1330
gcagauaaagggugauggc

SEQ ID NO: 444541 - RNA, 20 nt, Brucella suis 1330
gcagacacgcuuuuucgccu

SEQ ID NO: 444542 - RNA, 18 nt, Brucella suis 1330
gcacuuuugacuugaaau

SEQ ID NO: 444543 - RNA, 18 nt, Brucella suis 1330
gcacuuuugcuggaaaug

SEQ ID NO: 444544 - RNA, 14 nt, Brucella suis 1330
gcacugccaccauc

SEQ ID NO: 444545 - RNA, 21 nt, Brucella suis 1330
gcacggucuugccggccugaa

SEQ ID NO: 444546 - RNA, 19 nt, Brucella suis 1330
gcacggucaugaugcgggg

SEQ ID NO: 444547 - RNA, 13 nt, Brucella suis 1330
gcacgccgugcgc

SEQ ID NO: 444548 - RNA, 15 nt, Brucella suis 1330
gcacgccugccgcgc

SEQ ID NO: 444549 - RNA, 22 nt, Brucella suis 1330
gcacgauaugggucugcgacgg

SEQ ID NO: 444550 - RNA, 18 nt, Brucella suis 1330
gcacgaucgguucgccgc

SEQ ID NO: 444551 - RNA, 20 nt, Brucella suis 1330
gcaccgccugccagcccgcu

SEQ ID NO: 444552 - RNA, 17 nt, Brucella suis 1330
gcacccacugcccgccu

SEQ ID NO: 444553 - RNA, 17 nt, Brucella suis 1330
gcaccauugggcaugga

SEQ ID NO: 444554 - RNA, 20 nt, Brucella suis 1330
gcaccagcggcacgccgccc

SEQ ID NO: 444555 - RNA, 19 nt, Brucella suis 1330
gcaccagcgcgccgaucac

SEQ ID NO: 444556 - RNA, 17 nt, Brucella suis 1330
gcacauggcggccuuuu

SEQ ID NO: 444557 - RNA, 19 nt, Brucella suis 1330
gcacauaaaacgcgccgau

SEQ ID NO: 444558 - RNA, 19 nt, Brucella suis 1330
gcacacggucaugcaggcg

SEQ ID NO: 444559 - RNA, 16 nt, Brucella suis 1330
gcaauugccgcugccg

SEQ ID NO: 444560 - RNA, 16 nt, Brucella suis 1330
gcaauuccugcgccac

SEQ ID NO: 444561 - RNA, 18 nt, Brucella suis 1330
gcaauuccugcgccaccu

SEQ ID NO: 444562 - RNA, 17 nt, Brucella suis 1330
gcaaaucaggcaggcga

SEQ ID NO: 444563 - RNA, 16 nt, Brucella suis 1330
gauuuacguuuucguc

SEQ ID NO: 444564 - RNA, 16 nt, Brucella suis 1330
gauuucacccuuggcg

SEQ ID NO: 444565 - RNA, 21 nt, Brucella suis 1330
gauuguccguccugaugccgu

SEQ ID NO: 444566 - RNA, 18 nt, Brucella suis 1330
gauugccugugcggcggc

SEQ ID NO: 444567 - RNA, 21 nt, Brucella suis 1330
gauugccgcgcgcggcuucca

SEQ ID NO: 444568 - RNA, 22 nt, Brucella suis 1330
gauugccauuuucauccuucgg

SEQ ID NO: 444569 - RNA, 23 nt, Brucella suis 1330
gauucgcccggcccauugacgau

SEQ ID NO: 444570 - RNA, 20 nt, Brucella suis 1330
gauguucggcaaggccgcgc

SEQ ID NO: 444571 - RNA, 22 nt, Brucella suis 1330
gauguguaggcuggcaucgcca

SEQ ID NO: 444572 - RNA, 13 nt, Brucella suis 1330
gauguguccggcg

SEQ ID NO: 444573 - RNA, 12 nt, Brucella suis 1330
gaugugucggcc

SEQ ID NO: 444574 - RNA, 16 nt, Brucella suis 1330
gauggcugcccgcgcc

SEQ ID NO: 444575 - RNA, 23 nt, Brucella suis 1330
aacuuccgguauaugcaccagcg

SEQ ID NO: 444576 - RNA, 12 nt, Brucella suis 1330
gaugcggaacac

SEQ ID NO: 444577 - RNA, 22 nt, Brucella suis 1330
gaugccugccaugccgaaggcg

SEQ ID NO: 444578 - RNA, 21 nt, Brucella suis 1330
gaugcgaauuucaucgcccuc

SEQ ID NO: 444579 - RNA, 20 nt, Brucella suis 1330
gaugccguuuucaucaaauu

SEQ ID NO: 444580 - RNA, 19 nt, Brucella suis 1330
gaugccgauacuguagaaa

SEQ ID NO: 444581 - RNA, 18 nt, Brucella suis 1330
aacuggcgcauggccgca

SEQ ID NO: 444582 - RNA, 16 nt, Brucella suis 1330
gaugcaaaaccgguuc

SEQ ID NO: 444583 - RNA, 21 nt, Brucella suis 1330
gaugagcuaucagccgcccgc

SEQ ID NO: 444584 - RNA, 21 nt, Brucella suis 1330
gaugagcugguuuuucaccau

SEQ ID NO: 444585 - RNA, 23 nt, Brucella suis 1330
gaugacggcuucaacgccguggc

SEQ ID NO: 444586 - RNA, 13 nt, Brucella suis 1330
gaugacgccgcuu

SEQ ID NO: 444587 - RNA, 14 nt, Brucella suis 1330
gaugaaugccgaag

SEQ ID NO: 444588 - RNA, 14 nt, Brucella suis 1330
gaugaagcgccgau

SEQ ID NO: 444589 - RNA, 19 nt, Brucella suis 1330
gaugaacccgcucccccca

SEQ ID NO: 444590 - RNA, 14 nt, Brucella suis 1330
gaucugauugccgu

SEQ ID NO: 444591 - RNA, 12 nt, Brucella suis 1330
gaucugcauccc

SEQ ID NO: 444592 - RNA, 14 nt, Brucella suis 1330
gaucgaggcaaaug

SEQ ID NO: 444593 - RNA, 18 nt, Brucella suis 1330
gaucgacagcggaagcgc

SEQ ID NO: 444594 - RNA, 16 nt, Brucella suis 1330
gauccugucuuuuccg

SEQ ID NO: 444595 - RNA, 23 nt, Brucella suis 1330
gauccagguauagauaucgagcg

SEQ ID NO: 444596 - RNA, 14 nt, Brucella suis 1330
gaucaucagcggcg

SEQ ID NO: 444597 - RNA, 13 nt, Brucella suis 1330
gaucagggaacgg

SEQ ID NO: 444598 - RNA, 16 nt, Brucella suis 1330
gaucagggauaaagcc

SEQ ID NO: 444599 - RNA, 21 nt, Brucella suis 1330
gaucaucaacgguucguccuu

SEQ ID NO: 444600 - RNA, 16 nt, Brucella suis 1330
gaucagcguccauccg

SEQ ID NO: 444601 - RNA, 13 nt, Brucella suis 1330
gaucagcgcgccg

SEQ ID NO: 444602 - RNA, 21 nt, Brucella suis 1330
gaucaccuguggcuguuucgc

SEQ ID NO: 444603 - RNA, 16 nt, Brucella suis 1330
gaucacaugcgcgccc

SEQ ID NO: 444604 - RNA, 18 nt, Brucella suis 1330
gauauuucucgcgccaga

SEQ ID NO: 444605 - RNA, 22 nt, Brucella suis 1330
gauauggcccagaaccugcccg

SEQ ID NO: 444606 - RNA, 22 nt, Brucella suis 1330
gauauggucgugauguugcggg

SEQ ID NO: 444607 - RNA, 22 nt, Brucella suis 1330
gauauccaccuggccgccgccg

SEQ ID NO: 444608 - RNA, 16 nt, Brucella suis 1330
gauagcguaaaacgca

SEQ ID NO: 444609 - RNA, 15 nt, Brucella suis 1330
gauaccaaggccgau

SEQ ID NO: 444610 - RNA, 15 nt, Brucella suis 1330
gagguccaccacacc

SEQ ID NO: 444611 - RNA, 19 nt, Brucella suis 1330
gagguucguuuuauggcga

SEQ ID NO: 444612 - RNA, 15 nt, Brucella suis 1330
gaggcauugcgcggc

SEQ ID NO: 444613 - RNA, 19 nt, Brucella suis 1330
gagcugcaagggaaugcgc

SEQ ID NO: 444614 - RNA, 17 nt, Brucella suis 1330
gagcguacaccgaccag

SEQ ID NO: 444615 - RNA, 11 nt, Brucella suis 1330
aacucggcaua

SEQ ID NO: 444616 - RNA, 15 nt, Brucella suis 1330
gagcggcagcggcgu

SEQ ID NO: 444617 - RNA, 20 nt, Brucella suis 1330
gagcggaagaggacaaggcc

SEQ ID NO: 444618 - RNA, 16 nt, Brucella suis 1330
gagcgcagcggcagca

SEQ ID NO: 444619 - RNA, 14 nt, Brucella suis 1330
gagcgcauccgccu

SEQ ID NO: 444620 - RNA, 18 nt, Brucella suis 1330
gagccgccguaauggcuu

SEQ ID NO: 444621 - RNA, 22 nt, Brucella suis 1330
gacgguaucauaaaugccggcg

SEQ ID NO: 444622 - RNA, 18 nt, Brucella suis 1330
gacggucgaagccacggc

SEQ ID NO: 444623 - RNA, 19 nt, Brucella suis 1330
gacgggcaguccggcagcc

SEQ ID NO: 444624 - RNA, 21 nt, Brucella suis 1330
gacggcuguuuucgaggccau

SEQ ID NO: 444625 - RNA, 21 nt, Brucella suis 1330
gacggccacauaaucgcccuc

SEQ ID NO: 444626 - RNA, 17 nt, Brucella suis 1330
gacggaugaggccugau

SEQ ID NO: 444627 - RNA, 15 nt, Brucella suis 1330
gacggacgccugcca

SEQ ID NO: 444628 - RNA, 19 nt, Brucella suis 1330
gacgcgugaaaauagcugg

SEQ ID NO: 444629 - RNA, 14 nt, Brucella suis 1330
gacgauucgcccuu

SEQ ID NO: 444630 - RNA, 22 nt, Brucella suis 1330
gacgauuucuuccagaauaucu

SEQ ID NO: 444631 - RNA, 15 nt, Brucella suis 1330
gacgagauugccgcc

SEQ ID NO: 444632 - RNA, 21 nt, Brucella suis 1330
gaccuuccugacccauggccu

SEQ ID NO: 444633 - RNA, 14 nt, Brucella suis 1330
aacggccaugcgca

SEQ ID NO: 444634 - RNA, 19 nt, Brucella suis 1330
aacgcuuugaccgccgcga

SEQ ID NO: 444635 - RNA, 16 nt, Brucella suis 1330
gaccagcgcauggcau

SEQ ID NO: 444636 - RNA, 17 nt, Brucella suis 1330
aacgauggugcggcgcg

SEQ ID NO: 444637 - RNA, 20 nt, Brucella suis 1330
gacaugcaugacaccuucgg

SEQ ID NO: 444638 - RNA, 12 nt, Brucella suis 1330
gacauagccgau

SEQ ID NO: 444639 - RNA, 23 nt, Brucella suis 1330
gacauagacgcuuggcaccgccu

SEQ ID NO: 444640 - RNA, 20 nt, Brucella suis 1330
gacaauggcaauaugcgccu

SEQ ID NO: 444641 - RNA, 16 nt, Brucella suis 1330
gacaaugguuauacuc

SEQ ID NO: 444642 - RNA, 17 nt, Brucella suis 1330
gacaagccgcuccgcac

SEQ ID NO: 444643 - RNA, 18 nt, Brucella suis 1330
gacaagccgcuccgcacc

SEQ ID NO: 444644 - RNA, 17 nt, Brucella suis 1330
gacaaggcaaugccgga

SEQ ID NO: 444645 - RNA, 13 nt, Brucella suis 1330
gacaacgcgcagc

SEQ ID NO: 444646 - RNA, 14 nt, Brucella suis 1330
gacaaccgcgccgc

SEQ ID NO: 444647 - RNA, 17 nt, Brucella suis 1330
gacaaaggcccgcgcaa

SEQ ID NO: 444648 - RNA, 16 nt, Brucella suis 1330
gacaaaggugcugucg

SEQ ID NO: 444649 - RNA, 18 nt, Brucella suis 1330
gaauggcaagcagcaaaa

SEQ ID NO: 444650 - RNA, 13 nt, Brucella suis 1330
gaaugcgccgcca

SEQ ID NO: 444651 - RNA, 18 nt, Brucella suis 1330
gaauaucuucgagcguga

SEQ ID NO: 444652 - RNA, 14 nt, Brucella suis 1330
gaagugcugcugca

SEQ ID NO: 444653 - RNA, 21 nt, Brucella suis 1330
gaacguacaccgaggccgcca

SEQ ID NO: 444654 - RNA, 14 nt, Brucella suis 1330
gaacgagcuccccg

SEQ ID NO: 444655 - RNA, 23 nt, Brucella suis 1330
gaaccggcgggcuugaugcgcca

SEQ ID NO: 444656 - RNA, 21 nt, Brucella suis 1330
gaaccggcucugcggaaagcc

SEQ ID NO: 444657 - RNA, 15 nt, Brucella suis 1330
gaaccaggccgcggg

SEQ ID NO: 444658 - RNA, 17 nt, Brucella suis 1330
gaaccaccagagcaaaa

SEQ ID NO: 444659 - RNA, 14 nt, Brucella suis 1330
gaacacgccgacgc

SEQ ID NO: 444660 - RNA, 15 nt, Brucella suis 1330
gaaaugcgcucgaug

SEQ ID NO: 444661 - RNA, 22 nt, Brucella suis 1330
gaaauagcacauaucagcccgc

SEQ ID NO: 444662 - RNA, 16 nt, Brucella suis 1330
gaaacgcuggaaguca

SEQ ID NO: 444663 - RNA, 19 nt, Brucella suis 1330
gaaaagcgcaguucgcgca

SEQ ID NO: 444664 - RNA, 16 nt, Brucella suis 1330
gaaaagugcgaagcgc

SEQ ID NO: 444665 - RNA, 19 nt, Brucella suis 1330
aaccguuucacacuuuucg

SEQ ID NO: 444666 - RNA, 16 nt, Brucella suis 1330
gaaacagcauauugcc

SEQ ID NO: 444667 - RNA, 12 nt, Brucella suis 1330
gaaaccaucgag

SEQ ID NO: 444668 - RNA, 18 nt, Brucella suis 1330
gaaaacgccgaagccagg

SEQ ID NO: 444669 - RNA, 15 nt, Brucella suis 1330
gaaaaagcccgccac

SEQ ID NO: 444670 - RNA, 15 nt, Brucella suis 1330
gaaaaagcccggugu

SEQ ID NO: 444671 - RNA, 21 nt, Brucella suis 1330
gaaaaacccggccuuugcgcc

SEQ ID NO: 444672 - RNA, 17 nt, Brucella suis 1330
cuuuucggcggaaagga

SEQ ID NO: 444673 - RNA, 12 nt, Brucella suis 1330
cuuuucggcuga

SEQ ID NO: 444674 - RNA, 13 nt, Brucella suis 1330
cuuuugcgcucgg

SEQ ID NO: 444675 - RNA, 21 nt, Brucella suis 1330
cuuuuccacagcaggcagcag

SEQ ID NO: 444676 - RNA, 19 nt, Brucella suis 1330
cuuuucgcccgugccgcgu

SEQ ID NO: 444677 - RNA, 19 nt, Brucella suis 1330
cuuuguauuucaaugcugc

SEQ ID NO: 444678 - RNA, 20 nt, Brucella suis 1330
cuuugcggaggcggcugccu

SEQ ID NO: 444679 - RNA, 20 nt, Brucella suis 1330
cuuucgcuuuaaagcuuaac

SEQ ID NO: 444680 - RNA, 14 nt, Brucella suis 1330
cuuucuaaaccgga

SEQ ID NO: 444681 - RNA, 12 nt, Brucella suis 1330
cuuuccagaagg

SEQ ID NO: 444682 - RNA, 16 nt, Brucella suis 1330
cuuucaagcggguaga

SEQ ID NO: 444683 - RNA, 23 nt, Brucella suis 1330
cuuuauauggcggucggcggcgu

SEQ ID NO: 444684 - RNA, 13 nt, Brucella suis 1330
cuugggagcggcg

SEQ ID NO: 444685 - RNA, 21 nt, Brucella suis 1330
cuuggauacgucacccgccuu

SEQ ID NO: 444686 - RNA, 17 nt, Brucella suis 1330
cuucguccucgcgccag

SEQ ID NO: 444687 - RNA, 17 nt, Brucella suis 1330
cuucgacaaccgcgccg

SEQ ID NO: 444688 - RNA, 16 nt, Brucella suis 1330
cuuccgggcaauaucg

SEQ ID NO: 444689 - RNA, 23 nt, Brucella suis 1330
cuuccagauagauaaacgcacca

SEQ ID NO: 444690 - RNA, 13 nt, Brucella suis 1330
cuucaggcggcgc

SEQ ID NO: 444691 - RNA, 18 nt, Brucella suis 1330
cuucaauuuucccggcaa

SEQ ID NO: 444692 - RNA, 13 nt, Brucella suis 1330
cuucaagcgcaag

SEQ ID NO: 444693 - RNA, 18 nt, Brucella suis 1330
cuguuucgcauugcccac

SEQ ID NO: 444694 - RNA, 12 nt, Brucella suis 1330
cuguuuucgagg

SEQ ID NO: 444695 - RNA, 17 nt, Brucella suis 1330
aaccggcauuauccgca

SEQ ID NO: 444696 - RNA, 13 nt, Brucella suis 1330
aaccggcgaugag

SEQ ID NO: 444697 - RNA, 16 nt, Brucella suis 1330
cuuaucggggcggcgu

SEQ ID NO: 444698 - RNA, 19 nt, Brucella suis 1330
cugugcggcggcggaagga

SEQ ID NO: 444699 - RNA, 11 nt, Brucella suis 1330
cugucggcgcu

SEQ ID NO: 444700 - RNA, 20 nt, Brucella suis 1330
cugucggcgcugcucgcgca

SEQ ID NO: 444701 - RNA, 19 nt, Brucella suis 1330
cugucaccugacggauuuc

SEQ ID NO: 444702 - RNA, 16 nt, Brucella suis 1330
cugucagcgccgccca

SEQ ID NO: 444703 - RNA, 19 nt, Brucella suis 1330
cuguagaaaauauagccgc

SEQ ID NO: 444704 - RNA, 20 nt, Brucella suis 1330
cuggcggcacuugucgccau

SEQ ID NO: 444705 - RNA, 17 nt, Brucella suis 1330
cuggcaauaaaaggcaa

SEQ ID NO: 444706 - RNA, 15 nt, Brucella suis 1330
cugcaucgagcggca

SEQ ID NO: 444707 - RNA, 17 nt, Brucella suis 1330
cugcaucgagcggcacg

SEQ ID NO: 444708 - RNA, 16 nt, Brucella suis 1330
cugcaucgcgaggcua

SEQ ID NO: 444709 - RNA, 23 nt, Brucella suis 1330
cugcagcaaucucacacugcaaa

SEQ ID NO: 444710 - RNA, 21 nt, Brucella suis 1330
cugcaaucaccagagacagug

SEQ ID NO: 444711 - RNA, 17 nt, Brucella suis 1330
cugcacacccuugaucg

SEQ ID NO: 444712 - RNA, 12 nt, Brucella suis 1330
cugcaagcgcga

SEQ ID NO: 444713 - RNA, 23 nt, Brucella suis 1330
cugcaagcgcgacaagcgcaucu

SEQ ID NO: 444714 - RNA, 18 nt, Brucella suis 1330
cugcaaaaaauaccagug

SEQ ID NO: 444715 - RNA, 19 nt, Brucella suis 1330
cugaugccuugggaggcga

SEQ ID NO: 444716 - RNA, 19 nt, Brucella suis 1330
cugaggcggccggagcgca

SEQ ID NO: 444717 - RNA, 22 nt, Brucella suis 1330
cugaaugcgccgccagcauggc

SEQ ID NO: 444718 - RNA, 16 nt, Brucella suis 1330
cugaauggucugcgcc

SEQ ID NO: 444719 - RNA, 18 nt, Brucella suis 1330
cugaacggaucuugcgca

SEQ ID NO: 444720 - RNA, 18 nt, Brucella suis 1330
cucugcaagagcggcguu

SEQ ID NO: 444721 - RNA, 23 nt, Brucella suis 1330
cucggcccuggaaagaagcgaaa

SEQ ID NO: 444722 - RNA, 16 nt, Brucella suis 1330
cucggagcggccggau

SEQ ID NO: 444723 - RNA, 22 nt, Brucella suis 1330
cucgcgccagagcggcauauug

SEQ ID NO: 444724 - RNA, 16 nt, Brucella suis 1330
cucgaucuggccgaua

SEQ ID NO: 444725 - RNA, 14 nt, Brucella suis 1330
cucgaucuugucgc

SEQ ID NO: 444726 - RNA, 19 nt, Brucella suis 1330
cucgaucuugucgccgaaa

SEQ ID NO: 444727 - RNA, 15 nt, Brucella suis 1330
cucgaagucgccagc

SEQ ID NO: 444728 - RNA, 17 nt, Brucella suis 1330
cuccucaaucgcgccgu

SEQ ID NO: 444729 - RNA, 12 nt, Brucella suis 1330
cuccaucugcgg

SEQ ID NO: 444730 - RNA, 13 nt, Brucella suis 1330
cucaggccuugcg

SEQ ID NO: 444731 - RNA, 16 nt, Brucella suis 1330
cucacgcgcagcagca

SEQ ID NO: 444732 - RNA, 14 nt, Brucella suis 1330
cuaugcgguuucag

SEQ ID NO: 444733 - RNA, 16 nt, Brucella suis 1330
cguugaagcugucgcc

SEQ ID NO: 444734 - RNA, 18 nt, Brucella suis 1330
cguguuuauucaucgucu

SEQ ID NO: 444735 - RNA, 18 nt, Brucella suis 1330
cgugggccaaccggcaga

SEQ ID NO: 444736 - RNA, 18 nt, Brucella suis 1330
cguggcgauggucgcaag

SEQ ID NO: 444737 - RNA, 20 nt, Brucella suis 1330
aaccgccggaaccauaucga

SEQ ID NO: 444738 - RNA, 17 nt, Brucella suis 1330
aaccgcgcguaucggca

SEQ ID NO: 444739 - RNA, 13 nt, Brucella suis 1330
cgugcggccgcag

SEQ ID NO: 444740 - RNA, 13 nt, Brucella suis 1330
cgugccgauuucg

SEQ ID NO: 444741 - RNA, 18 nt, Brucella suis 1330
cgugauuacccaucacgg

SEQ ID NO: 444742 - RNA, 17 nt, Brucella suis 1330
cgugaugcgcaggcgcu

SEQ ID NO: 444743 - RNA, 15 nt, Brucella suis 1330
cgugagaccagcgca

SEQ ID NO: 444744 - RNA, 20 nt, Brucella suis 1330
aaccgagcagccgcgaacga

SEQ ID NO: 444745 - RNA, 16 nt, Brucella suis 1330
cgugaccagccccugc

SEQ ID NO: 444746 - RNA, 15 nt, Brucella suis 1330
cgugaccagcgcaau

SEQ ID NO: 444747 - RNA, 15 nt, Brucella suis 1330
cgucugcaucgagcg

SEQ ID NO: 444748 - RNA, 21 nt, Brucella suis 1330
cgucugaacggaucuugcgca

SEQ ID NO: 444749 - RNA, 14 nt, Brucella suis 1330
cgucggauaacgcg

SEQ ID NO: 444750 - RNA, 12 nt, Brucella suis 1330
cgucgcgcauca

SEQ ID NO: 444751 - RNA, 19 nt, Brucella suis 1330
cgucgaggaaaaagcccgc

SEQ ID NO: 444752 - RNA, 12 nt, Brucella suis 1330
cguccggcuucg

SEQ ID NO: 444753 - RNA, 16 nt, Brucella suis 1330
cguccagcgcguugcc

SEQ ID NO: 444754 - RNA, 15 nt, Brucella suis 1330
cgucacccgccuugc

SEQ ID NO: 444755 - RNA, 19 nt, Brucella suis 1330
cguaucgccaaugcccugc

SEQ ID NO: 444756 - RNA, 15 nt, Brucella suis 1330
aaccccaaugcucga

SEQ ID NO: 444757 - RNA, 18 nt, Brucella suis 1330
cguacaccgaggccgcca

SEQ ID NO: 444758 - RNA, 23 nt, Brucella suis 1330
cgguugcaggcgcaggcccugca

SEQ ID NO: 444759 - RNA, 16 nt, Brucella suis 1330
cgguucguccuugacg

SEQ ID NO: 444760 - RNA, 22 nt, Brucella suis 1330
cgguucgcccaugccgcaggau

SEQ ID NO: 444761 - RNA, 13 nt, Brucella suis 1330
cgguucgccgcuu

SEQ ID NO: 444762 - RNA, 11 nt, Brucella suis 1330
cgguccgccgg

SEQ ID NO: 444763 - RNA, 22 nt, Brucella suis 1330
cgguaucggcgauauggcgcaa

SEQ ID NO: 444764 - RNA, 13 nt, Brucella suis 1330
cgguaucaagcuu

SEQ ID NO: 444765 - RNA, 23 nt, Brucella suis 1330
aaccagcgacaggguaagcgccu

SEQ ID NO: 444766 - RNA, 13 nt, Brucella suis 1330
cgggucgagaaug

SEQ ID NO: 444767 - RNA, 14 nt, Brucella suis 1330
cgggcggcuugcca

SEQ ID NO: 444768 - RNA, 15 nt, Brucella suis 1330
cgggcggcagcggac

SEQ ID NO: 444769 - RNA, 15 nt, Brucella suis 1330
cgggagcggaagugg

SEQ ID NO: 444770 - RNA, 12 nt, Brucella suis 1330
cggcuugccauu

SEQ ID NO: 444771 - RNA, 22 nt, Brucella suis 1330
cggcuggaacaauuccagccgg

SEQ ID NO: 444772 - RNA, 20 nt, Brucella suis 1330
cggcucucacgcgcagcagc

SEQ ID NO: 444773 - RNA, 17 nt, Brucella suis 1330
cggcucuugggagcggc

SEQ ID NO: 444774 - RNA, 14 nt, Brucella suis 1330
cggcuccagccggu

SEQ ID NO: 444775 - RNA, 19 nt, Brucella suis 1330
cggcgucuucuccaaaggg

SEQ ID NO: 444776 - RNA, 15 nt, Brucella suis 1330
cggcggauuucaucg

SEQ ID NO: 444777 - RNA, 13 nt, Brucella suis 1330
cggcgcggcagga

SEQ ID NO: 444778 - RNA, 17 nt, Brucella suis 1330
cggcgcacucaucaaaa

SEQ ID NO: 444779 - RNA, 17 nt, Brucella suis 1330
cggcgauuuccacgcuc

SEQ ID NO: 444780 - RNA, 19 nt, Brucella suis 1330
cggcgcaaaggccggguuu

SEQ ID NO: 444781 - RNA, 20 nt, Brucella suis 1330
cggcgagcuuguugcggcga

SEQ ID NO: 444782 - RNA, 14 nt, Brucella suis 1330
cggccagcuugaaa

SEQ ID NO: 444783 - RNA, 13 nt, Brucella suis 1330
cggccaagcagga

SEQ ID NO: 444784 - RNA, 15 nt, Brucella suis 1330
cggccaagcgcaucg

SEQ ID NO: 444785 - RNA, 23 nt, Brucella suis 1330
cggccaagcgcaucgguggcauu

SEQ ID NO: 444786 - RNA, 19 nt, Brucella suis 1330
cggcaguccggcagcacgu

SEQ ID NO: 444787 - RNA, 16 nt, Brucella suis 1330
cggcagccuucgcugc

SEQ ID NO: 444788 - RNA, 19 nt, Brucella suis 1330
cggcagcgaaccguccacg

SEQ ID NO: 444789 - RNA, 13 nt, Brucella suis 1330
cggcagcccgaca

SEQ ID NO: 444790 - RNA, 12 nt, Brucella suis 1330
aacagugccgcc

SEQ ID NO: 444791 - RNA, 19 nt, Brucella suis 1330
cggcagaccggaucgcgcg

SEQ ID NO: 444792 - RNA, 18 nt, Brucella suis 1330
cggcacggccacgcgcag

SEQ ID NO: 444793 - RNA, 18 nt, Brucella suis 1330
aacaggcagcaugaacca

SEQ ID NO: 444794 - RNA, 16 nt, Brucella suis 1330
cggaauaucgaucaag

SEQ ID NO: 444795 - RNA, 17 nt, Brucella suis 1330
cggaagcgauuggcuuc

SEQ ID NO: 444796 - RNA, 20 nt, Brucella suis 1330
cggaagcgauuggcuucaau

SEQ ID NO: 444797 - RNA, 12 nt, Brucella suis 1330
cggaagcgcaaa

SEQ ID NO: 444798 - RNA, 23 nt, Brucella suis 1330
cggaagcgcaaaacagcgccauu

SEQ ID NO: 444799 - RNA, 16 nt, Brucella suis 1330
cggaacggauaacgcg

SEQ ID NO: 444800 - RNA, 12 nt, Brucella suis 1330
cggaaagcgcgg

SEQ ID NO: 444801 - RNA, 21 nt, Brucella suis 1330
cggaaagggcugcguuucggc

SEQ ID NO: 444802 - RNA, 19 nt, Brucella suis 1330
cggaaaagaugcgcgucaa

SEQ ID NO: 444803 - RNA, 23 nt, Brucella suis 1330
cggaaaagcgcaguucgcgcauc

SEQ ID NO: 444804 - RNA, 15 nt, Brucella suis 1330
cgcuucgaugcgcug

SEQ ID NO: 444805 - RNA, 13 nt, Brucella suis 1330
cgcuucgaugcgu

SEQ ID NO: 444806 - RNA, 12 nt, Brucella suis 1330
cgcuuccggcug

SEQ ID NO: 444807 - RNA, 17 nt, Brucella suis 1330
cgcugcgguagcgcaug

SEQ ID NO: 444808 - RNA, 15 nt, Brucella suis 1330
cgcugcgggcagccu

SEQ ID NO: 444809 - RNA, 19 nt, Brucella suis 1330
cgcugcgacgagaugcgcu

SEQ ID NO: 444810 - RNA, 23 nt, Brucella suis 1330
cgcugccgguaucaagcuucaua

SEQ ID NO: 444811 - RNA, 21 nt, Brucella suis 1330
cgcugaucgcaagcaggcauu

SEQ ID NO: 444812 - RNA, 17 nt, Brucella suis 1330
cgcucgaaugccucgau

SEQ ID NO: 444813 - RNA, 17 nt, Brucella suis 1330
cgcucgaaggcagccgu

SEQ ID NO: 444814 - RNA, 20 nt, Brucella suis 1330
cgcgugcggucgccgcccgg

SEQ ID NO: 444815 - RNA, 14 nt, Brucella suis 1330
cgcgucccgcacgc

SEQ ID NO: 444816 - RNA, 15 nt, Brucella suis 1330
cgcggcgcauggccu

SEQ ID NO: 444817 - RNA, 22 nt, Brucella suis 1330
cgcggccuugauccgucacggu

SEQ ID NO: 444818 - RNA, 18 nt, Brucella suis 1330
cgcggccacaagcgccgg

SEQ ID NO: 444819 - RNA, 19 nt, Brucella suis 1330
cgcggcaugaaagcgcaau

SEQ ID NO: 444820 - RNA, 18 nt, Brucella suis 1330
cgcggcagcuaugcgcca

SEQ ID NO: 444821 - RNA, 14 nt, Brucella suis 1330
cgcggcaacugccg

SEQ ID NO: 444822 - RNA, 23 nt, Brucella suis 1330
cgcggcaaugcgcuucgcgcagg

SEQ ID NO: 444823 - RNA, 14 nt, Brucella suis 1330
cgcggaucggcagc

SEQ ID NO: 444824 - RNA, 15 nt, Brucella suis 1330
cgcgccgcaacucuu

SEQ ID NO: 444825 - RNA, 19 nt, Brucella suis 1330
cgcgccgaaaaucggcacu

SEQ ID NO: 444826 - RNA, 13 nt, Brucella suis 1330
cgcgcccucgcgc

SEQ ID NO: 444827 - RNA, 17 nt, Brucella suis 1330
cgcgcccucgcgcucgg

SEQ ID NO: 444828 - RNA, 18 nt, Brucella suis 1330
cgcgccccuggcggcacu

SEQ ID NO: 444829 - RNA, 14 nt, Brucella suis 1330
cgcgccaugccauc

SEQ ID NO: 444830 - RNA, 18 nt, Brucella suis 1330
cgcgccagagcggcauau

SEQ ID NO: 444831 - RNA, 13 nt, Brucella suis 1330
cgcgcaucgcgcg

SEQ ID NO: 444832 - RNA, 18 nt, Brucella suis 1330
cgcgcaggccgcggcauc

SEQ ID NO: 444833 - RNA, 18 nt, Brucella suis 1330
cgcgcagauauggcgccu

SEQ ID NO: 444834 - RNA, 18 nt, Brucella suis 1330
cgcgauugcaucggcagc

SEQ ID NO: 444835 - RNA, 21 nt, Brucella suis 1330
cgcgaggcauaauaggcaucg

SEQ ID NO: 444836 - RNA, 19 nt, Brucella suis 1330
cgcgacacgccaaaaccac

SEQ ID NO: 444837 - RNA, 22 nt, Brucella suis 1330
cgcgaagauaagcggcaaaggc

SEQ ID NO: 444838 - RNA, 23 nt, Brucella suis 1330
cgcgaaccgucgccagcucgccg

SEQ ID NO: 444839 - RNA, 19 nt, Brucella suis 1330
cgcgaaccagauccaccgc

SEQ ID NO: 444840 - RNA, 23 nt, Brucella suis 1330
cgcgaaccagauccaccgcgcug

SEQ ID NO: 444841 - RNA, 13 nt, Brucella suis 1330
cgcgaaacgccuu

SEQ ID NO: 444842 - RNA, 12 nt, Brucella suis 1330
cgccuugcgccg

SEQ ID NO: 444843 - RNA, 23 nt, Brucella suis 1330
cgccuugaugccgcucggcaagg

SEQ ID NO: 444844 - RNA, 15 nt, Brucella suis 1330
cgccuuccuugaacu

SEQ ID NO: 444845 - RNA, 23 nt, Brucella suis 1330
cgccuguucaucggggaaggugg

SEQ ID NO: 444846 - RNA, 22 nt, Brucella suis 1330
cgccugcaacugcaaggcaucg

SEQ ID NO: 444847 - RNA, 16 nt, Brucella suis 1330
cgccugcaauggaaaa

SEQ ID NO: 444848 - RNA, 17 nt, Brucella suis 1330
cgccgguuuuccgucug

SEQ ID NO: 444849 - RNA, 17 nt, Brucella suis 1330
aacacgaugauggccgg

SEQ ID NO: 444850 - RNA, 12 nt, Brucella suis 1330
aacacgccgacg

SEQ ID NO: 444851 - RNA, 15 nt, Brucella suis 1330
cgccggaaugggccu

SEQ ID NO: 444852 - RNA, 15 nt, Brucella suis 1330
cgccgcaaccggcgg

SEQ ID NO: 444853 - RNA, 13 nt, Brucella suis 1330
cgcccacgaggau

SEQ ID NO: 444854 - RNA, 20 nt, Brucella suis 1330
cgcccaaggucggcucaucg

SEQ ID NO: 444855 - RNA, 22 nt, Brucella suis 1330
cgccauguugggguuggccuga

SEQ ID NO: 444856 - RNA, 23 nt, Brucella suis 1330
cgccaugaaagaacggcccgcau

SEQ ID NO: 444857 - RNA, 14 nt, Brucella suis 1330
cgccaucggcaagg

SEQ ID NO: 444858 - RNA, 13 nt, Brucella suis 1330
cgccauauccgcc

SEQ ID NO: 444859 - RNA, 16 nt, Brucella suis 1330
cgccauaaagcaccau

SEQ ID NO: 444860 - RNA, 17 nt, Brucella suis 1330
cgccagccgccagcagg

SEQ ID NO: 444861 - RNA, 18 nt, Brucella suis 1330
cgccagccgccagcaggc

SEQ ID NO: 444862 - RNA, 18 nt, Brucella suis 1330
cgccagacaaggcgcggg

SEQ ID NO: 444863 - RNA, 18 nt, Brucella suis 1330
cgccagagcggcauauug

SEQ ID NO: 444864 - RNA, 14 nt, Brucella suis 1330
cgccagauagagcg

SEQ ID NO: 444865 - RNA, 22 nt, Brucella suis 1330
cgccacggauuuccaccacgcg

SEQ ID NO: 444866 - RNA, 18 nt, Brucella suis 1330
cgccaccugcacuucacg

SEQ ID NO: 444867 - RNA, 19 nt, Brucella suis 1330
cgccaccgucaccggcugg

SEQ ID NO: 444868 - RNA, 16 nt, Brucella suis 1330
cgccaccauggccgcc

SEQ ID NO: 444869 - RNA, 15 nt, Brucella suis 1330
cgccaaucgccgcga

SEQ ID NO: 444870 - RNA, 23 nt, Brucella suis 1330
cgccaaucgccgcgauaucgucg

SEQ ID NO: 444871 - RNA, 23 nt, Brucella suis 1330
cgccaauggcauauuuggcggua

SEQ ID NO: 444872 - RNA, 19 nt, Brucella suis 1330
cgccaaucagaaugcgugg

SEQ ID NO: 444873 - RNA, 13 nt, Brucella suis 1330
cgccaagcgcauc

SEQ ID NO: 444874 - RNA, 17 nt, Brucella suis 1330
cgccaagccggcgcagc

SEQ ID NO: 444875 - RNA, 16 nt, Brucella suis 1330
cgcauucccuugaaau

SEQ ID NO: 444876 - RNA, 16 nt, Brucella suis 1330
cgcagggucgcgaccu

SEQ ID NO: 444877 - RNA, 19 nt, Brucella suis 1330
cgcaggaacgcaucgagcu

SEQ ID NO: 444878 - RNA, 19 nt, Brucella suis 1330
cgcagcguuuugucauggc

SEQ ID NO: 444879 - RNA, 14 nt, Brucella suis 1330
cgcagcgacgacau

SEQ ID NO: 444880 - RNA, 22 nt, Brucella suis 1330
cgcacuggggacauagacgcuu

SEQ ID NO: 444881 - RNA, 21 nt, Brucella suis 1330
cgcaccgaucucaccggaagg

SEQ ID NO: 444882 - RNA, 20 nt, Brucella suis 1330
cgcaaccuggcugcaccaga

SEQ ID NO: 444883 - RNA, 22 nt, Brucella suis 1330
cgauugugaccagagagcggau

SEQ ID NO: 444884 - RNA, 16 nt, Brucella suis 1330
cgauugucccgccaug

SEQ ID NO: 444885 - RNA, 21 nt, Brucella suis 1330
cgauucgcccuuuaucagcga

SEQ ID NO: 444886 - RNA, 12 nt, Brucella suis 1330
cgauuaucgcga

SEQ ID NO: 444887 - RNA, 23 nt, Brucella suis 1330
cgauggugacggucguuucgccg

SEQ ID NO: 444888 - RNA, 14 nt, Brucella suis 1330
cgauggcgacgcgc

SEQ ID NO: 444889 - RNA, 19 nt, Brucella suis 1330
cgaugcgccagcgaugaua

SEQ ID NO: 444890 - RNA, 22 nt, Brucella suis 1330
cgaugccgauacuguagaaaau

SEQ ID NO: 444891 - RNA, 18 nt, Brucella suis 1330
cgaugauauucggccagc

SEQ ID NO: 444892 - RNA, 14 nt, Brucella suis 1330
cgaugagcgccauu

SEQ ID NO: 444893 - RNA, 21 nt, Brucella suis 1330
cgaugacgagccucgcccugc

SEQ ID NO: 444894 - RNA, 15 nt, Brucella suis 1330
cgaugaacaggagcg

SEQ ID NO: 444895 - RNA, 21 nt, Brucella suis 1330
cgauauggcgcaaugccugca

SEQ ID NO: 444896 - RNA, 16 nt, Brucella suis 1330
cgauaucggcauguuu

SEQ ID NO: 444897 - RNA, 18 nt, Brucella suis 1330
cgauaucggcauguuucg

SEQ ID NO: 444898 - RNA, 18 nt, Brucella suis 1330
cgauaucaccaauauugc

SEQ ID NO: 444899 - RNA, 16 nt, Brucella suis 1330
cgauaccgacggucgg

SEQ ID NO: 444900 - RNA, 14 nt, Brucella suis 1330
cgaguucugcgcgg

SEQ ID NO: 444901 - RNA, 22 nt, Brucella suis 1330
cgaguggucugggcgaugagcg

SEQ ID NO: 444902 - RNA, 18 nt, Brucella suis 1330
cgaggucucccggcacga

SEQ ID NO: 444903 - RNA, 15 nt, Brucella suis 1330
cgaggcagccacggc

SEQ ID NO: 444904 - RNA, 22 nt, Brucella suis 1330
cgaggaauuucagcgaagcgau

SEQ ID NO: 444905 - RNA, 12 nt, Brucella suis 1330
cgagcggccauu

SEQ ID NO: 444906 - RNA, 15 nt, Brucella suis 1330
cgagcggagccgaag

SEQ ID NO: 444907 - RNA, 20 nt, Brucella suis 1330
cgagcgccuguccgccugcc

SEQ ID NO: 444908 - RNA, 22 nt, Brucella suis 1330
cgagccaaaaaugugaaacgcc

SEQ ID NO: 444909 - RNA, 14 nt, Brucella suis 1330
cgagcauggccugc

SEQ ID NO: 444910 - RNA, 21 nt, Brucella suis 1330
cgagcagcaucuugccaagcu

SEQ ID NO: 444911 - RNA, 17 nt, Brucella suis 1330
cgagauugccgccacau

SEQ ID NO: 444912 - RNA, 20 nt, Brucella suis 1330
cgagauugccgccacaugug

SEQ ID NO: 444913 - RNA, 12 nt, Brucella suis 1330
cgagaucgucug

SEQ ID NO: 444914 - RNA, 18 nt, Brucella suis 1330
cgacuugaagagccgcag

SEQ ID NO: 444915 - RNA, 14 nt, Brucella suis 1330
cgacuccuuguaau

SEQ ID NO: 444916 - RNA, 15 nt, Brucella suis 1330
cgacgcgaucuuacg

SEQ ID NO: 444917 - RNA, 18 nt, Brucella suis 1330
cgacgaggccugaaagcu

SEQ ID NO: 444918 - RNA, 12 nt, Brucella suis 1330
cgaccggucgaa

SEQ ID NO: 444919 - RNA, 22 nt, Brucella suis 1330
cgacagccggucaaaacgcccc

SEQ ID NO: 444920 - RNA, 15 nt, Brucella suis 1330
cgacacggccgaucg

SEQ ID NO: 444921 - RNA, 16 nt, Brucella suis 1330
cgacagaucggcaaga

SEQ ID NO: 444922 - RNA, 20 nt, Brucella suis 1330
cgacacccggauauuucucg

SEQ ID NO: 444923 - RNA, 21 nt, Brucella suis 1330
cgacaaucggaacaaacuggc

SEQ ID NO: 444924 - RNA, 22 nt, Brucella suis 1330
cgaagggaaugggaucgaccga

SEQ ID NO: 444925 - RNA, 13 nt, Brucella suis 1330
cgaaggcccuuca

SEQ ID NO: 444926 - RNA, 12 nt, Brucella suis 1330
ccuggccggcgc

SEQ ID NO: 444927 - RNA, 24 nt, Brucella suis 1330
ccugcgcgcgccgccauggccgaa

SEQ ID NO: 444928 - RNA, 14 nt, Brucella suis 1330
ccugcgaugcgcca

SEQ ID NO: 444929 - RNA, 14 nt, Brucella suis 1330
ccugcacggcuuca

SEQ ID NO: 444930 - RNA, 13 nt, Brucella suis 1330
ccugcacaucacc

SEQ ID NO: 444931 - RNA, 15 nt, Brucella suis 1330
ccugaugcaaugcgu

SEQ ID NO: 444932 - RNA, 18 nt, Brucella suis 1330
ccugaugccggaugcgca

SEQ ID NO: 444933 - RNA, 22 nt, Brucella suis 1330
ccucucacuccgaccauuuccc

SEQ ID NO: 444934 - RNA, 13 nt, Brucella suis 1330
ccucguggaucga

SEQ ID NO: 444935 - RNA, 14 nt, Brucella suis 1330
ccucgcgauugcgc

SEQ ID NO: 444936 - RNA, 16 nt, Brucella suis 1330
ccuccugugcauugcc

SEQ ID NO: 444937 - RNA, 16 nt, Brucella suis 1330
ccucaccuugccgggc

SEQ ID NO: 444938 - RNA, 18 nt, Brucella suis 1330
ccucacccuucaacagcc

SEQ ID NO: 444939 - RNA, 15 nt, Brucella suis 1330
ccgucauucaucagc

SEQ ID NO: 444940 - RNA, 14 nt, Brucella suis 1330
ccgucaaugccauc

SEQ ID NO: 444941 - RNA, 19 nt, Brucella suis 1330
ccgguccccgccgccgaua

SEQ ID NO: 444942 - RNA, 16 nt, Brucella suis 1330
ccggggugaaugcgga

SEQ ID NO: 444943 - RNA, 18 nt, Brucella suis 1330
ccgggcggcgcggcggca

SEQ ID NO: 444944 - RNA, 22 nt, Brucella suis 1330
ccgggaaaucugcgcgcgcgca

SEQ ID NO: 444945 - RNA, 17 nt, Brucella suis 1330
ccggcugccuuggcauc

SEQ ID NO: 444946 - RNA, 22 nt, Brucella suis 1330
ccggcaucacgaagagugcggc

SEQ ID NO: 444947 - RNA, 19 nt, Brucella suis 1330
ccggcauccgaggcgcgca

SEQ ID NO: 444948 - RNA, 23 nt, Brucella suis 1330
ccggcaguuucugccgcgcaucg

SEQ ID NO: 444949 - RNA, 14 nt, Brucella suis 1330
ccggcacuucgccc

SEQ ID NO: 444950 - RNA, 22 nt, Brucella suis 1330
ccggcacgaccagcgcaaugcc

SEQ ID NO: 444951 - RNA, 20 nt, Brucella suis 1330
ccggcacgaacagaucgcca

SEQ ID NO: 444952 - RNA, 13 nt, Brucella suis 1330
ccggcaccgcgca

SEQ ID NO: 444953 - RNA, 14 nt, Brucella suis 1330
ccggcaccgcgcaa

SEQ ID NO: 444954 - RNA, 13 nt, Brucella suis 1330
ccggcaccgcaaa

SEQ ID NO: 444955 - RNA, 15 nt, Brucella suis 1330
ccggaugcgcggaua

SEQ ID NO: 444956 - RNA, 21 nt, Brucella suis 1330
ccggauacaugcagaucgcau

SEQ ID NO: 444957 - RNA, 17 nt, Brucella suis 1330
ccggagccuucgcaucg

SEQ ID NO: 444958 - RNA, 22 nt, Brucella suis 1330
ccggaccacgcagggucgcgac

SEQ ID NO: 444959 - RNA, 18 nt, Brucella suis 1330
ccggaauaucauccaguc

SEQ ID NO: 444960 - RNA, 15 nt, Brucella suis 1330
ccgcucgcgcaucgc

SEQ ID NO: 444961 - RNA, 17 nt, Brucella suis 1330
ccgcgcugaagcggccu

SEQ ID NO: 444962 - RNA, 12 nt, Brucella suis 1330
ccgcgccgauca

SEQ ID NO: 444963 - RNA, 14 nt, Brucella suis 1330
ccgcgccgaucauc

SEQ ID NO: 444964 - RNA, 22 nt, Brucella suis 1330
ccgcgccaugccauccucgcca

SEQ ID NO: 444965 - RNA, 23 nt, Brucella suis 1330
ccgcgauaucgucgcgcucgccg

SEQ ID NO: 444966 - RNA, 19 nt, Brucella suis 1330
ccgcgaggaagccugcacc

SEQ ID NO: 444967 - RNA, 14 nt, Brucella suis 1330
ccgccuuggcgaag

SEQ ID NO: 444968 - RNA, 11 nt, Brucella suis 1330
ccgcgaaaaag

SEQ ID NO: 444969 - RNA, 19 nt, Brucella suis 1330
aaaugcccuuccuuaucga

SEQ ID NO: 444970 - RNA, 20 nt, Brucella suis 1330
aaaugcgaauucagagcgau

SEQ ID NO: 444971 - RNA, 16 nt, Brucella suis 1330
ccgcccuugcgcaccg

SEQ ID NO: 444972 - RNA, 15 nt, Brucella suis 1330
ccgccauaccgucga

SEQ ID NO: 444973 - RNA, 14 nt, Brucella suis 1330
ccgccagcaccggc

SEQ ID NO: 444974 - RNA, 13 nt, Brucella suis 1330
ccgccaccgcgcc

SEQ ID NO: 444975 - RNA, 18 nt, Brucella suis 1330
ccgcaucggaagggcaag

SEQ ID NO: 444976 - RNA, 21 nt, Brucella suis 1330
ccgcaucggccugacggugca

SEQ ID NO: 444977 - RNA, 19 nt, Brucella suis 1330
ccgcaucgaucacaugcgc

SEQ ID NO: 444978 - RNA, 17 nt, Brucella suis 1330
ccgcauccgaaaugcgc

SEQ ID NO: 444979 - RNA, 12 nt, Brucella suis 1330
ccgcagccgcca

SEQ ID NO: 444980 - RNA, 19 nt, Brucella suis 1330
ccgacugaacgaaugcgua

SEQ ID NO: 444981 - RNA, 17 nt, Brucella suis 1330
ccgacgaaagccacgcu

SEQ ID NO: 444982 - RNA, 13 nt, Brucella suis 1330
ccgaaugccagug

SEQ ID NO: 444983 - RNA, 18 nt, Brucella suis 1330
ccgaaugccagugccaua

SEQ ID NO: 444984 - RNA, 15 nt, Brucella suis 1330
ccgaauuccgccaug

SEQ ID NO: 444985 - RNA, 21 nt, Brucella suis 1330
ccgacaaagaucaucgccgug

SEQ ID NO: 444986 - RNA, 18 nt, Brucella suis 1330
ccgaauagcgcaucgcca

SEQ ID NO: 444987 - RNA, 15 nt, Brucella suis 1330
ccgaauaggcgcgca

SEQ ID NO: 444988 - RNA, 16 nt, Brucella suis 1330
ccgaaguuggucgucc

SEQ ID NO: 444989 - RNA, 18 nt, Brucella suis 1330
ccgaagcccgugccaucg

SEQ ID NO: 444990 - RNA, 13 nt, Brucella suis 1330
ccgaagaaugcgc

SEQ ID NO: 444991 - RNA, 19 nt, Brucella suis 1330
ccgaagaaugcgcagccgu

SEQ ID NO: 444992 - RNA, 13 nt, Brucella suis 1330
cccuuguggccac

SEQ ID NO: 444993 - RNA, 13 nt, Brucella suis 1330
cccgucaaugcca

SEQ ID NO: 444994 - RNA, 15 nt, Brucella suis 1330
cccggcuggaauugu

SEQ ID NO: 444995 - RNA, 21 nt, Brucella suis 1330
cccggcggccuugaugcggcg

SEQ ID NO: 444996 - RNA, 12 nt, Brucella suis 1330
cccgcaccgaca

SEQ ID NO: 444997 - RNA, 20 nt, Brucella suis 1330
cccgagaagcucaacgccgu

SEQ ID NO: 444998 - RNA, 20 nt, Brucella suis 1330
cccauucaugcaccuucgcu

SEQ ID NO: 444999 - RNA, 16 nt, Brucella suis 1330
cccaugaccggaugca

SEQ ID NO: 445000 - RNA, 14 nt, Brucella suis 1330
cccauaccgcgcca

SEQ ID NO: 445001 - RNA, 14 nt, Brucella suis 1330
cccagggcagauau

SEQ ID NO: 445002 - RNA, 16 nt, Brucella suis 1330
cccagggaaucgcgca

SEQ ID NO: 445003 - RNA, 15 nt, Brucella suis 1330
cccagaaggcgcggc

SEQ ID NO: 445004 - RNA, 16 nt, Brucella suis 1330
cccacaucgccuugca

SEQ ID NO: 445005 - RNA, 18 nt, Brucella suis 1330
ccauuucauuaucggcgg

SEQ ID NO: 445006 - RNA, 20 nt, Brucella suis 1330
ccauuggaaauuauagccgc

SEQ ID NO: 445007 - RNA, 17 nt, Brucella suis 1330
ccaugcggcuccaguuc

SEQ ID NO: 445008 - RNA, 16 nt, Brucella suis 1330
ccaggcaucauuggcg

SEQ ID NO: 445009 - RNA, 18 nt, Brucella suis 1330
ccaggaccgcgcagauca

SEQ ID NO: 445010 - RNA, 14 nt, Brucella suis 1330
ccagcgugcagccu

SEQ ID NO: 445011 - RNA, 14 nt, Brucella suis 1330
aaauccgacgggcg

SEQ ID NO: 445012 - RNA, 15 nt, Brucella suis 1330
ccagcguauccacga

SEQ ID NO: 445013 - RNA, 16 nt, Brucella suis 1330
ccagcggugacgaucu

SEQ ID NO: 445014 - RNA, 15 nt, Brucella suis 1330
ccagcgcgccgauca

SEQ ID NO: 445015 - RNA, 21 nt, Brucella suis 1330
ccagcgcaaagcgcgcgccaa

SEQ ID NO: 445016 - RNA, 18 nt, Brucella suis 1330
ccagcauccgcucgcgca

SEQ ID NO: 445017 - RNA, 13 nt, Brucella suis 1330
ccagcaaagcgau

SEQ ID NO: 445018 - RNA, 12 nt, Brucella suis 1330
ccagaucggccu

SEQ ID NO: 445019 - RNA, 19 nt, Brucella suis 1330
ccagaucgacagcggaagc

SEQ ID NO: 445020 - RNA, 12 nt, Brucella suis 1330
ccagaaggcgcg

SEQ ID NO: 445021 - RNA, 14 nt, Brucella suis 1330
ccacgcuugcgccc

SEQ ID NO: 445022 - RNA, 16 nt, Brucella suis 1330
ccacgccagccgcgau

SEQ ID NO: 445023 - RNA, 14 nt, Brucella suis 1330
ccacgagaaccgcg

SEQ ID NO: 445024 - RNA, 15 nt, Brucella suis 1330
aaaggcuccggcauu

SEQ ID NO: 445025 - RNA, 17 nt, Brucella suis 1330
ccaccggcccgcgcacg

SEQ ID NO: 445026 - RNA, 15 nt, Brucella suis 1330
ccaccgcgaucaguu

SEQ ID NO: 445027 - RNA, 18 nt, Brucella suis 1330
aaagcucgcgucccgcac

SEQ ID NO: 445028 - RNA, 21 nt, Brucella suis 1330
ccaccacgcgcgcugcgacga

SEQ ID NO: 445029 - RNA, 18 nt, Brucella suis 1330
ccaaugccucauugucgc

SEQ ID NO: 445030 - RNA, 11 nt, Brucella suis 1330
aaagcgaacgc

SEQ ID NO: 445031 - RNA, 14 nt, Brucella suis 1330
aaagcgcaguucgc

SEQ ID NO: 445032 - RNA, 19 nt, Brucella suis 1330
aaagcgcaucccgaaaagu

SEQ ID NO: 445033 - RNA, 15 nt, Brucella suis 1330
ccaaggcccgccucg

SEQ ID NO: 445034 - RNA, 16 nt, Brucella suis 1330
ccaagcccaaagcggu

SEQ ID NO: 445035 - RNA, 22 nt, Brucella suis 1330
ccaagaucagccacauucccga

SEQ ID NO: 445036 - RNA, 22 nt, Brucella suis 1330
ccaaagauacgguucacgccau

SEQ ID NO: 445037 - RNA, 14 nt, Brucella suis 1330
caugccgccaaggc

SEQ ID NO: 445038 - RNA, 18 nt, Brucella suis 1330
caugccauccucgccaag

SEQ ID NO: 445039 - RNA, 16 nt, Brucella suis 1330
caugcaggcggaaggg

SEQ ID NO: 445040 - RNA, 13 nt, Brucella suis 1330
caugaccggaugc

SEQ ID NO: 445041 - RNA, 20 nt, Brucella suis 1330
caugaaggagaggccgauaa

SEQ ID NO: 445042 - RNA, 13 nt, Brucella suis 1330
caucuuuuccgaa

SEQ ID NO: 445043 - RNA, 14 nt, Brucella suis 1330
caugaacaugcgcc

SEQ ID NO: 445044 - RNA, 22 nt, Brucella suis 1330
caucucuuccuaauggaugacg

SEQ ID NO: 445045 - RNA, 21 nt, Brucella suis 1330
caucgucaaucacgccacugc

SEQ ID NO: 445046 - RNA, 22 nt, Brucella suis 1330
caucggguguuugcgacgggcg

SEQ ID NO: 445047 - RNA, 15 nt, Brucella suis 1330
caucggggcgagcgc

SEQ ID NO: 445048 - RNA, 21 nt, Brucella suis 1330
caucggcuugggaagaucaua

SEQ ID NO: 445049 - RNA, 12 nt, Brucella suis 1330
caucggcgcgcu

SEQ ID NO: 445050 - RNA, 12 nt, Brucella suis 1330
caucggcaaauc

SEQ ID NO: 445051 - RNA, 22 nt, Brucella suis 1330
caucggaagggcaaggcgcgcc

SEQ ID NO: 445052 - RNA, 21 nt, Brucella suis 1330
caucgcgucagggcgaggaaa

SEQ ID NO: 445053 - RNA, 13 nt, Brucella suis 1330
caucgcgccgcaa

SEQ ID NO: 445054 - RNA, 17 nt, Brucella suis 1330
caucgccuugcagauaa

SEQ ID NO: 445055 - RNA, 12 nt, Brucella suis 1330
caucgccuugcg

SEQ ID NO: 445056 - RNA, 13 nt, Brucella suis 1330
caucccucccgaa

SEQ ID NO: 445057 - RNA, 16 nt, Brucella suis 1330
cauccagucgaucagu

SEQ ID NO: 445058 - RNA, 21 nt, Brucella suis 1330
caucacuggcaacgacggcug

SEQ ID NO: 445059 - RNA, 14 nt, Brucella suis 1330
cagugcgccaccgc

SEQ ID NO: 445060 - RNA, 22 nt, Brucella suis 1330
cagucgagaaaaagaugcgccg

SEQ ID NO: 445061 - RNA, 16 nt, Brucella suis 1330
cagucauggcgcacgg

SEQ ID NO: 445062 - RNA, 17 nt, Brucella suis 1330
cagucacgguugccuug

SEQ ID NO: 445063 - RNA, 19 nt, Brucella suis 1330
cagucaggauauuucggca

SEQ ID NO: 445064 - RNA, 17 nt, Brucella suis 1330
caguagccugacccggc

SEQ ID NO: 445065 - RNA, 16 nt, Brucella suis 1330
cagguugcgccgauau

SEQ ID NO: 445066 - RNA, 21 nt, Brucella suis 1330
cagggcguagauagcgucagc

SEQ ID NO: 445067 - RNA, 21 nt, Brucella suis 1330
cagggcggaucgugacccgcc

SEQ ID NO: 445068 - RNA, 14 nt, Brucella suis 1330
caggcggccugacc

SEQ ID NO: 445069 - RNA, 22 nt, Brucella suis 1330
caggcggaugaagcgccgauac

SEQ ID NO: 445070 - RNA, 15 nt, Brucella suis 1330
caggccgcgaucacg

SEQ ID NO: 445071 - RNA, 22 nt, Brucella suis 1330
caggccauucccgccucagccg

SEQ ID NO: 445072 - RNA, 15 nt, Brucella suis 1330
caggcccaccgugcc

SEQ ID NO: 445073 - RNA, 20 nt, Brucella suis 1330
caggcagaugcgaagcggau

SEQ ID NO: 445074 - RNA, 21 nt, Brucella suis 1330
caggauuucaacgcugucguc

SEQ ID NO: 445075 - RNA, 23 nt, Brucella suis 1330
cagcguuaccuugccgucaccau

SEQ ID NO: 445076 - RNA, 12 nt, Brucella suis 1330
cagcgguuuucc

SEQ ID NO: 445077 - RNA, 15 nt, Brucella suis 1330
cagcgcguccagcgc

SEQ ID NO: 445078 - RNA, 17 nt, Brucella suis 1330
cagcgcgccgaucacga

SEQ ID NO: 445079 - RNA, 14 nt, Brucella suis 1330
cagcgaaggcugcc

SEQ ID NO: 445080 - RNA, 16 nt, Brucella suis 1330
cagcgaauagaccaug

SEQ ID NO: 445081 - RNA, 22 nt, Brucella suis 1330
cagccggaaugccucccgauaa

SEQ ID NO: 445082 - RNA, 16 nt, Brucella suis 1330
cagccgaaaugagauc

SEQ ID NO: 445083 - RNA, 22 nt, Brucella suis 1330
cagccacgauaccgagaacggc

SEQ ID NO: 445084 - RNA, 14 nt, Brucella suis 1330
cagcauugaacgcc

SEQ ID NO: 445085 - RNA, 16 nt, Brucella suis 1330
cagcaccggcaacggc

SEQ ID NO: 445086 - RNA, 20 nt, Brucella suis 1330
cagcaauuccugcgccaccu

SEQ ID NO: 445087 - RNA, 23 nt, Brucella suis 1330
cagcaaucucacacugcaaaacu

SEQ ID NO: 445088 - RNA, 18 nt, Brucella suis 1330
cagcaaagcgauuucaca

SEQ ID NO: 445089 - RNA, 21 nt, Brucella suis 1330
cagauugaucgcaagccaaag

SEQ ID NO: 445090 - RNA, 17 nt, Brucella suis 1330
cagauggacauagccgg

SEQ ID NO: 445091 - RNA, 20 nt, Brucella suis 1330
cagaugcgcaaaacgcuuga

SEQ ID NO: 445092 - RNA, 11 nt, Brucella suis 1330
cagaucggccu

SEQ ID NO: 445093 - RNA, 20 nt, Brucella suis 1330
cagaucggccuugaucggca

SEQ ID NO: 445094 - RNA, 15 nt, Brucella suis 1330
cagaucgugaucuuc

SEQ ID NO: 445095 - RNA, 19 nt, Brucella suis 1330
cagaucgugaucuucggca

SEQ ID NO: 445096 - RNA, 16 nt, Brucella suis 1330
cagaucgccaagcgca

SEQ ID NO: 445097 - RNA, 12 nt, Brucella suis 1330
cagaucaucgca

SEQ ID NO: 445098 - RNA, 16 nt, Brucella suis 1330
cagagcgguuccgguu

SEQ ID NO: 445099 - RNA, 22 nt, Brucella suis 1330
aaagaucugcaucccgaaaagu

SEQ ID NO: 445100 - RNA, 22 nt, Brucella suis 1330
cagacuagacaaagcgguuugc

SEQ ID NO: 445101 - RNA, 20 nt, Brucella suis 1330
cagacguuccagauugccgc

SEQ ID NO: 445102 - RNA, 13 nt, Brucella suis 1330
cagacgcagcgca

SEQ ID NO: 445103 - RNA, 16 nt, Brucella suis 1330
cagaacuucgccaagc

SEQ ID NO: 445104 - RNA, 19 nt, Brucella suis 1330
cagaagauagacaacgcgc

SEQ ID NO: 445105 - RNA, 20 nt, Brucella suis 1330
cagaagauagacaacgcgca

SEQ ID NO: 445106 - RNA, 12 nt, Brucella suis 1330
cagaaaucaguc

SEQ ID NO: 445107 - RNA, 14 nt, Brucella suis 1330
cacuggcagcauga

SEQ ID NO: 445108 - RNA, 14 nt, Brucella suis 1330
cacgcgccauguug

SEQ ID NO: 445109 - RNA, 12 nt, Brucella suis 1330
cacgccgccaua

SEQ ID NO: 445110 - RNA, 17 nt, Brucella suis 1330
cacgcaggacaagccgc

SEQ ID NO: 445111 - RNA, 21 nt, Brucella suis 1330
cacgagaucaauacgcucgca

SEQ ID NO: 445112 - RNA, 15 nt, Brucella suis 1330
cacgagaaccgcgcc

SEQ ID NO: 445113 - RNA, 17 nt, Brucella suis 1330
cacgagaaccgcgccgg

SEQ ID NO: 445114 - RNA, 22 nt, Brucella suis 1330
cacgaacagaucgccaagcgca

SEQ ID NO: 445115 - RNA, 18 nt, Brucella suis 1330
caccuugccgggcgggca

SEQ ID NO: 445116 - RNA, 16 nt, Brucella suis 1330
caccgugcuccagaua

SEQ ID NO: 445117 - RNA, 17 nt, Brucella suis 1330
caccggcgggagcggca

SEQ ID NO: 445118 - RNA, 23 nt, Brucella suis 1330
caccgcacguugggggacgggcg

SEQ ID NO: 445119 - RNA, 19 nt, Brucella suis 1330
cacccagcauauggaugag

SEQ ID NO: 445120 - RNA, 14 nt, Brucella suis 1330
caccagcgcgccga

SEQ ID NO: 445121 - RNA, 15 nt, Brucella suis 1330
caccagaaauggccc

SEQ ID NO: 445122 - RNA, 18 nt, Brucella suis 1330
cacaucggcggaaaagcg

SEQ ID NO: 445123 - RNA, 20 nt, Brucella suis 1330
cacaggcucgggcagcuugu

SEQ ID NO: 445124 - RNA, 14 nt, Brucella suis 1330
cacacuuuucggga

SEQ ID NO: 445125 - RNA, 17 nt, Brucella suis 1330
cacacgaaccgaaaccg

SEQ ID NO: 445126 - RNA, 14 nt, Brucella suis 1330
cacaagaagcaagu

SEQ ID NO: 445127 - RNA, 18 nt, Brucella suis 1330
cacaaucgccggaaccgc

SEQ ID NO: 445128 - RNA, 20 nt, Brucella suis 1330
caaugugccugaaacaaggc

SEQ ID NO: 445129 - RNA, 13 nt, Brucella suis 1330
caaugaaagcaac

SEQ ID NO: 445130 - RNA, 18 nt, Brucella suis 1330
caaucagggaaaagccgc

SEQ ID NO: 445131 - RNA, 18 nt, Brucella suis 1330
caagcggcgucaggccaa

SEQ ID NO: 445132 - RNA, 18 nt, Brucella suis 1330
caagcgcauccagccggc

SEQ ID NO: 445133 - RNA, 13 nt, Brucella suis 1330
caagccaaagccc

SEQ ID NO: 445134 - RNA, 14 nt, Brucella suis 1330
caagccaaagcccg

SEQ ID NO: 445135 - RNA, 21 nt, Brucella suis 1330
caaauucauugaaauauuccg

SEQ ID NO: 445136 - RNA, 19 nt, Brucella suis 1330
caaagaucaaagguaaggc

SEQ ID NO: 445137 - RNA, 12 nt, Brucella suis 1330
caaaggagccgc

SEQ ID NO: 445138 - RNA, 16 nt, Brucella suis 1330
caaaccaggaccgcga

SEQ ID NO: 445139 - RNA, 21 nt, Brucella suis 1330
caaaagcccgcucuccggcgg

SEQ ID NO: 445140 - RNA, 21 nt, Brucella suis 1330
caaaaacgcguuccuucggag

SEQ ID NO: 445141 - RNA, 22 nt, Brucella suis 1330
caaaaacgcguuccuucggagc

SEQ ID NO: 445142 - RNA, 23 nt, Brucella suis 1330
caaaaagcgguucgugaagccgc

SEQ ID NO: 445143 - RNA, 15 nt, Brucella suis 1330
auuugcccgguuuuc

SEQ ID NO: 445144 - RNA, 14 nt, Brucella suis 1330
auuucugaucccgc

SEQ ID NO: 445145 - RNA, 21 nt, Brucella suis 1330
auuuucauugaacccgccacc

SEQ ID NO: 445146 - RNA, 17 nt, Brucella suis 1330
auuuucauugccgggcg

SEQ ID NO: 445147 - RNA, 17 nt, Brucella suis 1330
auuuucgagcaucgauc

SEQ ID NO: 445148 - RNA, 23 nt, Brucella suis 1330
auuucagguggcggauugcagcg

SEQ ID NO: 445149 - RNA, 12 nt, Brucella suis 1330
auuucauggaaa

SEQ ID NO: 445150 - RNA, 14 nt, Brucella suis 1330
auuucaugaaaaug

SEQ ID NO: 445151 - RNA, 15 nt, Brucella suis 1330
auugucccgccaugu

SEQ ID NO: 445152 - RNA, 22 nt, Brucella suis 1330
auuggcgaccgaaugaaccggc

SEQ ID NO: 445153 - RNA, 14 nt, Brucella suis 1330
auugcgcauugaca

SEQ ID NO: 445154 - RNA, 11 nt, Brucella suis 1330
auuccgccaug

SEQ ID NO: 445155 - RNA, 17 nt, Brucella suis 1330
aaacugaauccgcgacg

SEQ ID NO: 445156 - RNA, 17 nt, Brucella suis 1330
auuccaucagccgggca

SEQ ID NO: 445157 - RNA, 13 nt, Brucella suis 1330
auuaugcggcacu

SEQ ID NO: 445158 - RNA, 21 nt, Brucella suis 1330
auggguggcgcccgcccgccg

SEQ ID NO: 445159 - RNA, 20 nt, Brucella suis 1330
augggcgcagucaggccgac

SEQ ID NO: 445160 - RNA, 21 nt, Brucella suis 1330
auggcgggccaugccugcgaa

SEQ ID NO: 445161 - RNA, 12 nt, Brucella suis 1330
auggcgcgcgcg

SEQ ID NO: 445162 - RNA, 12 nt, Brucella suis 1330
auggcgccgcau

SEQ ID NO: 445163 - RNA, 17 nt, Brucella suis 1330
auggcgagcuggaaacg

SEQ ID NO: 445164 - RNA, 23 nt, Brucella suis 1330
auggcgauaauaauuggcaagcg

SEQ ID NO: 445165 - RNA, 15 nt, Brucella suis 1330
auggcauggaccacg

SEQ ID NO: 445166 - RNA, 16 nt, Brucella suis 1330
auggcauggcuugagc

SEQ ID NO: 445167 - RNA, 14 nt, Brucella suis 1330
auggagauacgcuu

SEQ ID NO: 445168 - RNA, 17 nt, Brucella suis 1330
auggagauacgcuucau

SEQ ID NO: 445169 - RNA, 13 nt, Brucella suis 1330
auggagcauuucc

SEQ ID NO: 445170 - RNA, 16 nt, Brucella suis 1330
augcuccagggugccg

SEQ ID NO: 445171 - RNA, 16 nt, Brucella suis 1330
augcgcggcgccagcg

SEQ ID NO: 445172 - RNA, 17 nt, Brucella suis 1330
augcgcgccagccgcca

SEQ ID NO: 445173 - RNA, 13 nt, Brucella suis 1330
augcgcgcccggc

SEQ ID NO: 445174 - RNA, 19 nt, Brucella suis 1330
augcgccgugcagggugcg

SEQ ID NO: 445175 - RNA, 19 nt, Brucella suis 1330
augcgcaugaagcgcggcg

SEQ ID NO: 445176 - RNA, 18 nt, Brucella suis 1330
augcaugacaccuucggc

SEQ ID NO: 445177 - RNA, 15 nt, Brucella suis 1330
augcauggaggcaag

SEQ ID NO: 445178 - RNA, 20 nt, Brucella suis 1330
augcagaucaguccuugacc

SEQ ID NO: 445179 - RNA, 13 nt, Brucella suis 1330
augcagcgccgcg

SEQ ID NO: 445180 - RNA, 15 nt, Brucella suis 1330
augcaguuccaucca

SEQ ID NO: 445181 - RNA, 18 nt, Brucella suis 1330
augcaucgaaugccgcau

SEQ ID NO: 445182 - RNA, 21 nt, Brucella suis 1330
augcaccgccugccagcccgc

SEQ ID NO: 445183 - RNA, 12 nt, Brucella suis 1330
augcaaggccgg

SEQ ID NO: 445184 - RNA, 18 nt, Brucella suis 1330
augagcuugcgcccgccg

SEQ ID NO: 445185 - RNA, 12 nt, Brucella suis 1330
augauugcgcca

SEQ ID NO: 445186 - RNA, 23 nt, Brucella suis 1330
augcaaaaagggaggcaucagcc

SEQ ID NO: 445187 - RNA, 12 nt, Brucella suis 1330
augagccgcuug

SEQ ID NO: 445188 - RNA, 22 nt, Brucella suis 1330
augacgccugcuaucaacgcug

SEQ ID NO: 445189 - RNA, 16 nt, Brucella suis 1330
augaagaccuggaacg

SEQ ID NO: 445190 - RNA, 18 nt, Brucella suis 1330
augaaagcaacgcccuuc

SEQ ID NO: 445191 - RNA, 20 nt, Brucella suis 1330
aucuucuuccaguuucugaa

SEQ ID NO: 445192 - RNA, 23 nt, Brucella suis 1330
aucuugaucgagccgacaucgcg

SEQ ID NO: 445193 - RNA, 16 nt, Brucella suis 1330
aucuggaacaguucca

SEQ ID NO: 445194 - RNA, 16 nt, Brucella suis 1330
aucucaugauggcccu

SEQ ID NO: 445195 - RNA, 20 nt, Brucella suis 1330
aucgugccgguaacgaugau

SEQ ID NO: 445196 - RNA, 20 nt, Brucella suis 1330
aucgugccgccgugaaaaua

SEQ ID NO: 445197 - RNA, 18 nt, Brucella suis 1330
aucgugccggaauggcca

SEQ ID NO: 445198 - RNA, 17 nt, Brucella suis 1330
aucgucggccaguucag

SEQ ID NO: 445199 - RNA, 16 nt, Brucella suis 1330
aucggugcgcggcgcu

SEQ ID NO: 445200 - RNA, 17 nt, Brucella suis 1330
auccuugucggcaucgg

SEQ ID NO: 445201 - RNA, 22 nt, Brucella suis 1330
auccuugucggcaucggucuug

SEQ ID NO: 445202 - RNA, 22 nt, Brucella suis 1330
auccuguagacgaacucgaugc

SEQ ID NO: 445203 - RNA, 16 nt, Brucella suis 1330
auccuucaugccgccg

SEQ ID NO: 445204 - RNA, 16 nt, Brucella suis 1330
auccugcaccggcuuc

SEQ ID NO: 445205 - RNA, 18 nt, Brucella suis 1330
auccugcucggcgcggcg

SEQ ID NO: 445206 - RNA, 16 nt, Brucella suis 1330
auccugcuucgaucag

SEQ ID NO: 445207 - RNA, 12 nt, Brucella suis 1330
auccucccaugc

SEQ ID NO: 445208 - RNA, 15 nt, Brucella suis 1330
auccgguaagcgucg

SEQ ID NO: 445209 - RNA, 20 nt, Brucella suis 1330
auccggcgggcuuuucauuc

SEQ ID NO: 445210 - RNA, 12 nt, Brucella suis 1330
auccggcagcuu

SEQ ID NO: 445211 - RNA, 19 nt, Brucella suis 1330
auccgccuuggaugccgca

SEQ ID NO: 445212 - RNA, 17 nt, Brucella suis 1330
auccgccaccgcgccgg

SEQ ID NO: 445213 - RNA, 17 nt, Brucella suis 1330
auccgccaccgguuuuc

SEQ ID NO: 445214 - RNA, 20 nt, Brucella suis 1330
auccgccaccgguuuucauc

SEQ ID NO: 445215 - RNA, 20 nt, Brucella suis 1330
auccgcaacucauggaagug

SEQ ID NO: 445216 - RNA, 13 nt, Brucella suis 1330
auccgcaguuccc

SEQ ID NO: 445217 - RNA, 14 nt, Brucella suis 1330
auccgaggcgcgca

SEQ ID NO: 445218 - RNA, 17 nt, Brucella suis 1330
auccauguggaaggcga

SEQ ID NO: 445219 - RNA, 19 nt, Brucella suis 1330
auccaguugucgccgggcu

SEQ ID NO: 445220 - RNA, 14 nt, Brucella suis 1330
auccagcagauccg

SEQ ID NO: 445221 - RNA, 19 nt, Brucella suis 1330
aucaucaaugugcccugcg

SEQ ID NO: 445222 - RNA, 19 nt, Brucella suis 1330
aucagguugaugccgggca

SEQ ID NO: 445223 - RNA, 20 nt, Brucella suis 1330
aucauaacagaugcgggacu

SEQ ID NO: 445224 - RNA, 21 nt, Brucella suis 1330
aucagcgaauagggaaacggc

SEQ ID NO: 445225 - RNA, 18 nt, Brucella suis 1330
aucacggccauugcccaa

SEQ ID NO: 445226 - RNA, 11 nt, Brucella suis 1330
aucaaggccgg

SEQ ID NO: 445227 - RNA, 17 nt, Brucella suis 1330
aucaccggcagggccag

SEQ ID NO: 445228 - RNA, 21 nt, Brucella suis 1330
aucaacccgucuucauugacc

SEQ ID NO: 445229 - RNA, 21 nt, Brucella suis 1330
aucaacgcuuugaccgccgcg

SEQ ID NO: 445230 - RNA, 11 nt, Brucella suis 1330
aucaaaccggc

SEQ ID NO: 445231 - RNA, 19 nt, Brucella suis 1330
auaucacgcuugcccgcgc

SEQ ID NO: 445232 - RNA, 19 nt, Brucella suis 1330
auagcgguugcagccgcca

SEQ ID NO: 445233 - RNA, 13 nt, Brucella suis 1330
auagcucauguuc

SEQ ID NO: 445234 - RNA, 23 nt, Brucella suis 1330
auagcucgacgcuuuccaccggc

SEQ ID NO: 445235 - RNA, 18 nt, Brucella suis 1330
auagcuuaugcgcgcccg

SEQ ID NO: 445236 - RNA, 17 nt, Brucella suis 1330
auaaggcggaugcgcgg

SEQ ID NO: 445237 - RNA, 15 nt, Brucella suis 1330
auaaucguaucgcca

SEQ ID NO: 445238 - RNA, 21 nt, Brucella suis 1330
auaaacugaauccgcgacgcc

SEQ ID NO: 445239 - RNA, 19 nt, Brucella suis 1330
auaaauauucccgauagcc

SEQ ID NO: 445240 - RNA, 13 nt, Brucella suis 1330
agugccgcgccga

SEQ ID NO: 445241 - RNA, 19 nt, Brucella suis 1330
agucgccgaaauuggccgc

SEQ ID NO: 445242 - RNA, 13 nt, Brucella suis 1330
agucaucaccgcg

SEQ ID NO: 445243 - RNA, 20 nt, Brucella suis 1330
aguagggcagugaagaauau

SEQ ID NO: 445244 - RNA, 18 nt, Brucella suis 1330
agguggcugcccgccgca

SEQ ID NO: 445245 - RNA, 17 nt, Brucella suis 1330
aggucuuccgggacaau

SEQ ID NO: 445246 - RNA, 18 nt, Brucella suis 1330
agggccagaucgcgcgcg

SEQ ID NO: 445247 - RNA, 14 nt, Brucella suis 1330
agggcauugccgag

SEQ ID NO: 445248 - RNA, 17 nt, Brucella suis 1330
agggcaguagggcagua

SEQ ID NO: 445249 - RNA, 23 nt, Brucella suis 1330
agggcagaucuguaucccgaaaa

SEQ ID NO: 445250 - RNA, 14 nt, Brucella suis 1330
aggcuggcgccgcc

SEQ ID NO: 445251 - RNA, 20 nt, Brucella suis 1330
aggccgaugaugaucgucag

SEQ ID NO: 445252 - RNA, 18 nt, Brucella suis 1330
aggccgauggcgaucacg

SEQ ID NO: 445253 - RNA, 16 nt, Brucella suis 1330
aggcaacaucgccuug

SEQ ID NO: 445254 - RNA, 19 nt, Brucella suis 1330
aggauuugcccgguuuucg

SEQ ID NO: 445255 - RNA, 14 nt, Brucella suis 1330
aggaugaucggcga

SEQ ID NO: 445256 - RNA, 16 nt, Brucella suis 1330
aggaucagggccacuc

SEQ ID NO: 445257 - RNA, 20 nt, Brucella suis 1330
aaacgggucguucaccgcaa

SEQ ID NO: 445258 - RNA, 16 nt, Brucella suis 1330
aggagcggaagcauau

SEQ ID NO: 445259 - RNA, 17 nt, Brucella suis 1330
aggaccggcgaaaaggc

SEQ ID NO: 445260 - RNA, 16 nt, Brucella suis 1330
aggacaacgggugcgc

SEQ ID NO: 445261 - RNA, 16 nt, Brucella suis 1330
aggaagguuuccggua

SEQ ID NO: 445262 - RNA, 19 nt, Brucella suis 1330
agcuuuuuucgauugaaaa

SEQ ID NO: 445263 - RNA, 14 nt, Brucella suis 1330
agcuuuugcagccg

SEQ ID NO: 445264 - RNA, 16 nt, Brucella suis 1330
agcuugcccaucucga

SEQ ID NO: 445265 - RNA, 16 nt, Brucella suis 1330
agcuugagaaccgaac

SEQ ID NO: 445266 - RNA, 20 nt, Brucella suis 1330
agcuucauaucguugccgau

SEQ ID NO: 445267 - RNA, 19 nt, Brucella suis 1330
agcguuuugucauggccgg

SEQ ID NO: 445268 - RNA, 19 nt, Brucella suis 1330
agcguacaccgaccagcgc

SEQ ID NO: 445269 - RNA, 15 nt, Brucella suis 1330
agcgggaauagccga

SEQ ID NO: 445270 - RNA, 16 nt, Brucella suis 1330
agcggcgggugccgcg

SEQ ID NO: 445271 - RNA, 22 nt, Brucella suis 1330
agcgccggaaugggccugauga

SEQ ID NO: 445272 - RNA, 20 nt, Brucella suis 1330
agcgcaucgguggcauugcc

SEQ ID NO: 445273 - RNA, 14 nt, Brucella suis 1330
agcgcaucgucuuc

SEQ ID NO: 445274 - RNA, 13 nt, Brucella suis 1330
agcgcauccgccu

SEQ ID NO: 445275 - RNA, 15 nt, Brucella suis 1330
agcgcaguucgcgca

SEQ ID NO: 445276 - RNA, 15 nt, Brucella suis 1330
agcgcauaaaggccg

SEQ ID NO: 445277 - RNA, 16 nt, Brucella suis 1330
agcgcauaaaggccga

SEQ ID NO: 445278 - RNA, 17 nt, Brucella suis 1330
agcgaugauagcgcccg

SEQ ID NO: 445279 - RNA, 22 nt, Brucella suis 1330
agccuucauugcggccaagcgc

SEQ ID NO: 445280 - RNA, 17 nt, Brucella suis 1330
agccuuuucgauaacga

SEQ ID NO: 445281 - RNA, 20 nt, Brucella suis 1330
agccgggauucaaucagauc

SEQ ID NO: 445282 - RNA, 16 nt, Brucella suis 1330
agccgcccgccuugga

SEQ ID NO: 445283 - RNA, 19 nt, Brucella suis 1330
agccgauaugccgacgcgc

SEQ ID NO: 445284 - RNA, 16 nt, Brucella suis 1330
agcccgugccaucggu

SEQ ID NO: 445285 - RNA, 13 nt, Brucella suis 1330
agcaugaucgcca

SEQ ID NO: 445286 - RNA, 14 nt, Brucella suis 1330
agcaugaucgcccg

SEQ ID NO: 445287 - RNA, 14 nt, Brucella suis 1330
agcaugaugccgac

SEQ ID NO: 445288 - RNA, 15 nt, Brucella suis 1330
agcaggcgcgcagca

SEQ ID NO: 445289 - RNA, 14 nt, Brucella suis 1330
agauugggcgcgcu

SEQ ID NO: 445290 - RNA, 17 nt, Brucella suis 1330
agaugugccaccagcac

SEQ ID NO: 445291 - RNA, 15 nt, Brucella suis 1330
agaugcccgcuuucc

SEQ ID NO: 445292 - RNA, 16 nt, Brucella suis 1330
agaugaaucaccagcg

SEQ ID NO: 445293 - RNA, 20 nt, Brucella suis 1330
agaucggccauuucggcuuc

SEQ ID NO: 445294 - RNA, 20 nt, Brucella suis 1330
agaucgugaucuucggcauc

SEQ ID NO: 445295 - RNA, 23 nt, Brucella suis 1330
agaucgauaucgagaccggcugc

SEQ ID NO: 445296 - RNA, 21 nt, Brucella suis 1330
agaucaaccccgcacggucau

SEQ ID NO: 445297 - RNA, 14 nt, Brucella suis 1330
agauaggcguugau

SEQ ID NO: 445298 - RNA, 23 nt, Brucella suis 1330
agauaggcguugaugacgaaaaa

SEQ ID NO: 445299 - RNA, 14 nt, Brucella suis 1330
agagcgauccgcca

SEQ ID NO: 445300 - RNA, 17 nt, Brucella suis 1330
agagccccaggaacggc

SEQ ID NO: 445301 - RNA, 20 nt, Brucella suis 1330
agagacaggaaaagccccau

SEQ ID NO: 445302 - RNA, 17 nt, Brucella suis 1330
agacucuuuucgcccgu

SEQ ID NO: 445303 - RNA, 14 nt, Brucella suis 1330
agaccuggaacggg

SEQ ID NO: 445304 - RNA, 19 nt, Brucella suis 1330
agaccgaucgugccgccuu

SEQ ID NO: 445305 - RNA, 13 nt, Brucella suis 1330
agaccccgccuga

SEQ ID NO: 445306 - RNA, 22 nt, Brucella suis 1330
agaaucugcgcgucgagcaaug

SEQ ID NO: 445307 - RNA, 13 nt, Brucella suis 1330
agaaugaccacgc

SEQ ID NO: 445308 - RNA, 20 nt, Brucella suis 1330
agaagacggcggguggcagc

SEQ ID NO: 445309 - RNA, 13 nt, Brucella suis 1330
agaacuucggcac

SEQ ID NO: 445310 - RNA, 11 nt, Brucella suis 1330
agaaagcguca

SEQ ID NO: 445311 - RNA, 15 nt, Brucella suis 1330
agaaaccccggcagc

SEQ ID NO: 445312 - RNA, 23 nt, Brucella suis 1330
acuucccgcccguccucaucgcc

SEQ ID NO: 445313 - RNA, 16 nt, Brucella suis 1330
acugcaaggcaucgcg

SEQ ID NO: 445314 - RNA, 23 nt, Brucella suis 1330
acugauagaaaaacccggucuug

SEQ ID NO: 445315 - RNA, 20 nt, Brucella suis 1330
acgguuuugcguuggaaaau

SEQ ID NO: 445316 - RNA, 18 nt, Brucella suis 1330
acggucgaagccacggcg

SEQ ID NO: 445317 - RNA, 13 nt, Brucella suis 1330
acggguggcgcga

SEQ ID NO: 445318 - RNA, 20 nt, Brucella suis 1330
acgggucguucaccgcaacg

SEQ ID NO: 445319 - RNA, 13 nt, Brucella suis 1330
acgggaagcgugc

SEQ ID NO: 445320 - RNA, 20 nt, Brucella suis 1330
acggcaugacgggcaguccg

SEQ ID NO: 445321 - RNA, 20 nt, Brucella suis 1330
acggcacguucggcaaucgu

SEQ ID NO: 445322 - RNA, 22 nt, Brucella suis 1330
acggauuuccaccacgcgcgcu

SEQ ID NO: 445323 - RNA, 13 nt, Brucella suis 1330
acgcuuugaccgc

SEQ ID NO: 445324 - RNA, 19 nt, Brucella suis 1330
acgcgggcuucugcgcccg

SEQ ID NO: 445325 - RNA, 19 nt, Brucella suis 1330
acgcgcaucuuauccgaaa

SEQ ID NO: 445326 - RNA, 24 nt, Brucella suis 1330
acgcgcagcagcaucgccgccagc

SEQ ID NO: 445327 - RNA, 16 nt, Brucella suis 1330
acgcgacacgccaaaa

SEQ ID NO: 445328 - RNA, 12 nt, Brucella suis 1330
acgcaaucucaa

SEQ ID NO: 445329 - RNA, 19 nt, Brucella suis 1330
acgauucgcccuuuaucag

SEQ ID NO: 445330 - RNA, 20 nt, Brucella suis 1330
acgauagacgcggcggcaau

SEQ ID NO: 445331 - RNA, 19 nt, Brucella suis 1330
acgaggauagcguaaaacg

SEQ ID NO: 445332 - RNA, 13 nt, Brucella suis 1330
acgacgcccgccc

SEQ ID NO: 445333 - RNA, 17 nt, Brucella suis 1330
acgaccagaagcccgcg

SEQ ID NO: 445334 - RNA, 17 nt, Brucella suis 1330
acgaauucaggaucgcu

SEQ ID NO: 445335 - RNA, 14 nt, Brucella suis 1330
acgacaauaaucuc

SEQ ID NO: 445336 - RNA, 20 nt, Brucella suis 1330
acgaauaguuagagcgguuc

SEQ ID NO: 445337 - RNA, 13 nt, Brucella suis 1330
acgaacagcagca

SEQ ID NO: 445338 - RNA, 15 nt, Brucella suis 1330
acgaaccccgcauca

SEQ ID NO: 445339 - RNA, 17 nt, Brucella suis 1330
acgaaccccgcaucaug

SEQ ID NO: 445340 - RNA, 19 nt, Brucella suis 1330
accugacggauuucggcgg

SEQ ID NO: 445341 - RNA, 18 nt, Brucella suis 1330
accgucaaucgcaucugc

SEQ ID NO: 445342 - RNA, 19 nt, Brucella suis 1330
accgguuuucaucgcguca

SEQ ID NO: 445343 - RNA, 17 nt, Brucella suis 1330
accgggccucgcgcccg

SEQ ID NO: 445344 - RNA, 15 nt, Brucella suis 1330
accgggccgcaugau

SEQ ID NO: 445345 - RNA, 15 nt, Brucella suis 1330
accggauuugccaag

SEQ ID NO: 445346 - RNA, 18 nt, Brucella suis 1330
accgcgccauaaccucga

SEQ ID NO: 445347 - RNA, 21 nt, Brucella suis 1330
accgcgccaaggcugcgcgca

SEQ ID NO: 445348 - RNA, 21 nt, Brucella suis 1330
accgccgcgauugcaucggca

SEQ ID NO: 445349 - RNA, 14 nt, Brucella suis 1330
accgauuccagcgu

SEQ ID NO: 445350 - RNA, 16 nt, Brucella suis 1330
accgauggagcgcccg

SEQ ID NO: 445351 - RNA, 14 nt, Brucella suis 1330
accgaugacgagcc

SEQ ID NO: 445352 - RNA, 16 nt, Brucella suis 1330
accgauaccggaucgc

SEQ ID NO: 445353 - RNA, 21 nt, Brucella suis 1330
accgaagccacgaagcgguug

SEQ ID NO: 445354 - RNA, 15 nt, Brucella suis 1330
accccaaugcucgau

SEQ ID NO: 445355 - RNA, 22 nt, Brucella suis 1330
accauuuguuuugucgcauuau

SEQ ID NO: 445356 - RNA, 17 nt, Brucella suis 1330
accauggcgcauucaga

SEQ ID NO: 445357 - RNA, 18 nt, Brucella suis 1330
accauauuugccgccaga

SEQ ID NO: 445358 - RNA, 16 nt, Brucella suis 1330
aaaaugcagcggguuc

SEQ ID NO: 445359 - RNA, 15 nt, Brucella suis 1330
acaggaacgccgccg

SEQ ID NO: 445360 - RNA, 16 nt, Brucella suis 1330
acagcaguaccgacau

SEQ ID NO: 445361 - RNA, 20 nt, Brucella suis 1330
acagagcgggcaaaggcgau

SEQ ID NO: 445362 - RNA, 13 nt, Brucella suis 1330
acacuucgaucga

SEQ ID NO: 445363 - RNA, 16 nt, Brucella suis 1330
acagaagguuacuugc

SEQ ID NO: 445364 - RNA, 18 nt, Brucella suis 1330
acacgguuccaccggcug

SEQ ID NO: 445365 - RNA, 17 nt, Brucella suis 1330
acacgcuuuuucgccuu

SEQ ID NO: 445366 - RNA, 21 nt, Brucella suis 1330
acaccucgccgauauccucga

SEQ ID NO: 445367 - RNA, 22 nt, Brucella suis 1330
acaaugugccguaucacgccgc

SEQ ID NO: 445368 - RNA, 17 nt, Brucella suis 1330
acaagacggaucagcga

SEQ ID NO: 445369 - RNA, 14 nt, Brucella suis 1330
acaaccgcgccgcu

SEQ ID NO: 445370 - RNA, 13 nt, Brucella suis 1330
acaaaaccgccgg

SEQ ID NO: 445371 - RNA, 20 nt, Brucella suis 1330
acaaauaguuagagcgguuc

SEQ ID NO: 445372 - RNA, 20 nt, Brucella suis 1330
acaaauaguuggagcgguuc

SEQ ID NO: 445373 - RNA, 14 nt, Brucella suis 1330
aauugcugggcuuc

SEQ ID NO: 445374 - RNA, 14 nt, Brucella suis 1330
aauggucacggcca

SEQ ID NO: 445375 - RNA, 18 nt, Brucella suis 1330
aauggcgcuagcgaugau

SEQ ID NO: 445376 - RNA, 19 nt, Brucella suis 1330
aaucuugcccucgccgccg

SEQ ID NO: 445377 - RNA, 19 nt, Brucella suis 1330
aagugugaaacgguuuugc

SEQ ID NO: 445378 - RNA, 23 nt, Brucella suis 1330
aagugccgcgccgaugaggccgg

SEQ ID NO: 445379 - RNA, 16 nt, Brucella suis 1330
aaguucauccguucga

SEQ ID NO: 445380 - RNA, 13 nt, Brucella suis 1330
aaggucgaacaug

SEQ ID NO: 445381 - RNA, 18 nt, Brucella suis 1330
aaggccgcgccgaucauc

SEQ ID NO: 445382 - RNA, 14 nt, Brucella suis 1330
aaggcguuggccgc

SEQ ID NO: 445383 - RNA, 19 nt, Brucella suis 1330
aagcggcuuuccagcgggc

SEQ ID NO: 445384 - RNA, 15 nt, Brucella suis 1330
aagcggccuuugauc

SEQ ID NO: 445385 - RNA, 14 nt, Brucella suis 1330
aagcgccagaaaga

SEQ ID NO: 445386 - RNA, 21 nt, Brucella suis 1330
aagcgcauccagccggcgcau

SEQ ID NO: 445387 - RNA, 22 nt, Brucella suis 1330
aagccagguggcugcccgccgc

SEQ ID NO: 445388 - RNA, 12 nt, Brucella suis 1330
aagccacggcga

SEQ ID NO: 445389 - RNA, 19 nt, Brucella suis 1330
aacuuccuugccggucgac

SEQ ID NO: 445390 - RNA, 16 nt, Brucella suis 1330
aacggcggaagcggca

SEQ ID NO: 445391 - RNA, 14 nt, Brucella suis 1330
aacgcccgaucaga

SEQ ID NO: 445392 - RNA, 15 nt, Brucella suis 1330
aacgccacgaaccgu

SEQ ID NO: 445393 - RNA, 23 nt, Brucella suis 1330
aaccgggcccuucucgacagcca

SEQ ID NO: 445394 - RNA, 22 nt, Brucella suis 1330
aaccggcgggcuugaugcgcca

SEQ ID NO: 445395 - RNA, 14 nt, Brucella suis 1330
aaccggccauauga

SEQ ID NO: 445396 - RNA, 22 nt, Brucella suis 1330
aaccggcccacccaccgccugc

SEQ ID NO: 445397 - RNA, 11 nt, Brucella suis 1330
aaccgcuucag

SEQ ID NO: 445398 - RNA, 22 nt, Brucella suis 1330
aaccgcuucagccauucauggc

SEQ ID NO: 445399 - RNA, 20 nt, Brucella suis 1330
aaccggaacgccuaaggcgc

SEQ ID NO: 445400 - RNA, 13 nt, Brucella suis 1330
aacacgagagcgu

SEQ ID NO: 445401 - RNA, 15 nt, Brucella suis 1330
aacacggcgcuugau

SEQ ID NO: 445402 - RNA, 18 nt, Brucella suis 1330
aaaacuuccgacaagcgu

SEQ ID NO: 445403 - RNA, 22 nt, Brucella suis 1330
aaaugcaagugugcgcgcgcca

SEQ ID NO: 445404 - RNA, 18 nt, Brucella suis 1330
aaaucgagugcggccugc

SEQ ID NO: 445405 - RNA, 17 nt, Brucella suis 1330
aaaucggcacuucgcca

SEQ ID NO: 445406 - RNA, 19 nt, Brucella suis 1330
aaagccgauugccccgcca

SEQ ID NO: 445407 - RNA, 19 nt, Brucella suis 1330
aaagcgcaguucgcgcauc

SEQ ID NO: 445408 - RNA, 18 nt, Brucella suis 1330
aaagcgcgccaucggcac

SEQ ID NO: 445409 - RNA, 22 nt, Brucella suis 1330
aaacgcugcugauagcagccgc

SEQ ID NO: 445410 - RNA, 18 nt, Brucella suis 1330
aaacgcggguggauggaa

SEQ ID NO: 445411 - RNA, 20 nt, Brucella suis 1330
aaaccggcauuauccgcauc

SEQ ID NO: 445412 - RNA, 15 nt, Brucella suis 1330
aaaccgcuucagcca

SEQ ID NO: 445413 - RNA, 22 nt, Brucella suis 1330
aaacccggccuuugcgccgggu

SEQ ID NO: 445414 - RNA, 22 nt, Brucella suis 1330
aaacccgaccaguaaggcgggc

SEQ ID NO: 445415 - RNA, 23 nt, Brucella suis 1330
aaaacgacgcgcauuuuccgguu

SEQ ID NO: 445416 - RNA, 14 nt, Brucella suis 1330
aaaacgccgcggcg

SEQ ID NO: 445417 - RNA, 20 nt, Brucella suis 1330
aaaagacgugucaaagccuc

SEQ ID NO: 445418 - RNA, 14 nt, Brucella suis 1330
aaaagugcgaagcg

SEQ ID NO: 445419 - RNA, 17 nt, Brucella suis 1330
aaaagugcgaagcgccu

SEQ ID NO: 445420 - RNA, 22 nt, Brucella suis 1330
aaaaugaaaagccggagcauuc

SEQ ID NO: 445421 - RNA, 17 nt, Brucella suis 1330
uuuugcgcgggauaaug

SEQ ID NO: 445422 - RNA, 15 nt, Brucella suis 1330
uuuugccgcauuuuc

SEQ ID NO: 445423 - RNA, 16 nt, Brucella suis 1330
uuuuggcucgaaaaug

SEQ ID NO: 445424 - RNA, 16 nt, Brucella suis 1330
uuuugguuugaaaaug

SEQ ID NO: 445425 - RNA, 13 nt, Brucella suis 1330
uuuucauucugaa

SEQ ID NO: 445426 - RNA, 19 nt, Brucella suis 1330
uuuucaguugcgcaaacau

SEQ ID NO: 445427 - RNA, 20 nt, Brucella suis 1330
uuuucaccggcauugagccg

SEQ ID NO: 445428 - RNA, 15 nt, Brucella suis 1330
uuuucggaaaagaug

SEQ ID NO: 445429 - RNA, 17 nt, Brucella suis 1330
uuuucggaaaagaugcg

SEQ ID NO: 445430 - RNA, 15 nt, Brucella suis 1330
uuuucggauaagaug

SEQ ID NO: 445431 - RNA, 11 nt, Brucella suis 1330
uuuugagcugc

SEQ ID NO: 445432 - RNA, 18 nt, Brucella suis 1330
uuuugagcugcuggguga

SEQ ID NO: 445433 - RNA, 18 nt, Brucella suis 1330
uuguaguucaggccggcc

SEQ ID NO: 445434 - RNA, 17 nt, Brucella suis 1330
uugucugucaccacauc

SEQ ID NO: 445435 - RNA, 17 nt, Brucella suis 1330
uuggccgcugccugcac

SEQ ID NO: 445436 - RNA, 12 nt, Brucella suis 1330
uugcuugaagca

SEQ ID NO: 445437 - RNA, 19 nt, Brucella suis 1330
uuggauugccauuuucauc

SEQ ID NO: 445438 - RNA, 15 nt, Brucella suis 1330
uuggcaacaaggcga

SEQ ID NO: 445439 - RNA, 14 nt, Brucella suis 1330
uugcuaaaugcaag

SEQ ID NO: 445440 - RNA, 22 nt, Brucella suis 1330
uugcuauaagcaacagggcgaa

SEQ ID NO: 445441 - RNA, 17 nt, Brucella suis 1330
uugcggcggaugaaccc

SEQ ID NO: 445442 - RNA, 14 nt, Brucella suis 1330
uugcgggaaggcgc

SEQ ID NO: 445443 - RNA, 16 nt, Brucella suis 1330
uugcgccaccacggcg

SEQ ID NO: 445444 - RNA, 14 nt, Brucella suis 1330
uugcgauuuccuug

SEQ ID NO: 445445 - RNA, 13 nt, Brucella suis 1330
uugcgcagcgcag

SEQ ID NO: 445446 - RNA, 19 nt, Brucella suis 1330
uugcccauggacuuuucag

SEQ ID NO: 445447 - RNA, 18 nt, Brucella suis 1330
uugccauuuuccguggcg

SEQ ID NO: 445448 - RNA, 14 nt, Brucella suis 1330
uugccgucaccauu

SEQ ID NO: 445449 - RNA, 22 nt, Brucella suis 1330
uugaugauagaauaaagccaua

SEQ ID NO: 445450 - RNA, 21 nt, Brucella suis 1330
uugagccgcgccaugccaucc

SEQ ID NO: 445451 - RNA, 22 nt, Brucella suis 1330
uugaucgcaagccaaagcccgu

SEQ ID NO: 445452 - RNA, 17 nt, Brucella suis 1330
uugaccuggccagccau

SEQ ID NO: 445453 - RNA, 21 nt, Brucella suis 1330
uugacaagaucgucacugcaa

SEQ ID NO: 445454 - RNA, 17 nt, Brucella suis 1330
uugaacgccuuuuucac

SEQ ID NO: 445455 - RNA, 14 nt, Brucella suis 1330
uucuuccgagaacc

SEQ ID NO: 445456 - RNA, 18 nt, Brucella suis 1330
uucuugagguugagcugc

SEQ ID NO: 445457 - RNA, 23 nt, Brucella suis 1330
uucuugagguugagcugcucggc

SEQ ID NO: 445458 - RNA, 14 nt, Brucella suis 1330
uucuggauuucauc

SEQ ID NO: 445459 - RNA, 22 nt, Brucella suis 1330
uucuggacgugcuggugaaaga

SEQ ID NO: 445460 - RNA, 15 nt, Brucella suis 1330
uucucgcaaaacacc

SEQ ID NO: 445461 - RNA, 18 nt, Brucella suis 1330
uucugaaagaacggcagg

SEQ ID NO: 445462 - RNA, 17 nt, Brucella suis 1330
uucggccagcgcaaagc

SEQ ID NO: 445463 - RNA, 16 nt, Brucella suis 1330
uucggccauuucaggu

SEQ ID NO: 445464 - RNA, 15 nt, Brucella suis 1330
uucggcauggcagcc

SEQ ID NO: 445465 - RNA, 13 nt, Brucella suis 1330
uucggauuuuucu

SEQ ID NO: 445466 - RNA, 19 nt, Brucella suis 1330
uucggcaaggaugcugcca

SEQ ID NO: 445467 - RNA, 14 nt, Brucella suis 1330
uucggcaccacaag

SEQ ID NO: 445468 - RNA, 21 nt, Brucella suis 1330
uucucagcguuuucugaaaga

SEQ ID NO: 445469 - RNA, 15 nt, Brucella suis 1330
uucgcuuuaaagcuu

SEQ ID NO: 445470 - RNA, 20 nt, Brucella suis 1330
uucggaaaagaugcgcguca

SEQ ID NO: 445471 - RNA, 21 nt, Brucella suis 1330
uucgcgcgcaagcggcucgac

SEQ ID NO: 445472 - RNA, 22 nt, Brucella suis 1330
uucgcgcaucgggcgcacaagc

SEQ ID NO: 445473 - RNA, 13 nt, Brucella suis 1330
uucgcccacgccc

SEQ ID NO: 445474 - RNA, 13 nt, Brucella suis 1330
uucgcauugccca

SEQ ID NO: 445475 - RNA, 20 nt, Brucella suis 1330
uucgaucacaacgccgucag

SEQ ID NO: 445476 - RNA, 22 nt, Brucella suis 1330
uucgauauugagagauuucacc

SEQ ID NO: 445477 - RNA, 21 nt, Brucella suis 1330
uucgauucgcuaucgaaacaa

SEQ ID NO: 445478 - RNA, 18 nt, Brucella suis 1330
uucgagcaucgaucugaa

SEQ ID NO: 445479 - RNA, 12 nt, Brucella suis 1330
uuccuuccacug

SEQ ID NO: 445480 - RNA, 23 nt, Brucella suis 1330
uuccuuuuggagcggaaaggcuu

SEQ ID NO: 445481 - RNA, 18 nt, Brucella suis 1330
uuccuguccgacauccau

SEQ ID NO: 445482 - RNA, 20 nt, Brucella suis 1330
uuccugcuucaucgcggcag

SEQ ID NO: 445483 - RNA, 17 nt, Brucella suis 1330
uuccugcggcuucuggg

SEQ ID NO: 445484 - RNA, 17 nt, Brucella suis 1330
uuccugcccggcaucac

SEQ ID NO: 445485 - RNA, 14 nt, Brucella suis 1330
uuccgucagggccg

SEQ ID NO: 445486 - RNA, 22 nt, Brucella suis 1330
uuccggaucgcccacgaggauc

SEQ ID NO: 445487 - RNA, 17 nt, Brucella suis 1330
uuccgggccgcaagcug

SEQ ID NO: 445488 - RNA, 21 nt, Brucella suis 1330
uuccgggcugcuuccacaggc

SEQ ID NO: 445489 - RNA, 17 nt, Brucella suis 1330
uuccgcugcgaucugcu

SEQ ID NO: 445490 - RNA, 17 nt, Brucella suis 1330
uuccgccggggcaggcu

SEQ ID NO: 445491 - RNA, 17 nt, Brucella suis 1330
uuccgaauacaagccca

SEQ ID NO: 445492 - RNA, 16 nt, Brucella suis 1330
uuccgacagggcaagc

SEQ ID NO: 445493 - RNA, 21 nt, Brucella suis 1330
uuccgacccgucaaugccauc

SEQ ID NO: 445494 - RNA, 20 nt, Brucella suis 1330
uuccgaugcgggaaaguuau

SEQ ID NO: 445495 - RNA, 14 nt, Brucella suis 1330
uuccgcaccgcacu

SEQ ID NO: 445496 - RNA, 16 nt, Brucella suis 1330
uuccgcaccgcacugg

SEQ ID NO: 445497 - RNA, 13 nt, Brucella suis 1330
uuccgcaccgccg

SEQ ID NO: 445498 - RNA, 19 nt, Brucella suis 1330
uucccggcuuuuuauccuc

SEQ ID NO: 445499 - RNA, 19 nt, Brucella suis 1330
uucccuguggagagaggaa

SEQ ID NO: 445500 - RNA, 15 nt, Brucella suis 1330
uuccccuauucccuu

SEQ ID NO: 445501 - RNA, 22 nt, Brucella suis 1330
uuccaucggcgaggaagagaau

SEQ ID NO: 445502 - RNA, 16 nt, Brucella suis 1330
uuccagauugucuuga

SEQ ID NO: 445503 - RNA, 20 nt, Brucella suis 1330
uuccagagcggguucccacu

SEQ ID NO: 445504 - RNA, 22 nt, Brucella suis 1330
uuccacauccgccaccgcgccg

SEQ ID NO: 445505 - RNA, 13 nt, Brucella suis 1330
uuccacauugccu

SEQ ID NO: 445506 - RNA, 15 nt, Brucella suis 1330
uucauuaaagccaua

SEQ ID NO: 445507 - RNA, 18 nt, Brucella suis 1330
uucauugcgcuugccgcc

SEQ ID NO: 445508 - RNA, 13 nt, Brucella suis 1330
uucauuuuaucaa

SEQ ID NO: 445509 - RNA, 16 nt, Brucella suis 1330
uucaggcacucuccuc

SEQ ID NO: 445510 - RNA, 21 nt, Brucella suis 1330
uucaggcacucuccucugccu

SEQ ID NO: 445511 - RNA, 22 nt, Brucella suis 1330
uucaggauagauauuucuucca

SEQ ID NO: 445512 - RNA, 17 nt, Brucella suis 1330
uucagccugcgaggauu

SEQ ID NO: 445513 - RNA, 22 nt, Brucella suis 1330
uucagcgaaccugauccagaag

SEQ ID NO: 445514 - RNA, 17 nt, Brucella suis 1330
uucagaaagaaagcugu

SEQ ID NO: 445515 - RNA, 21 nt, Brucella suis 1330
uucagaucgacgcagaaauug

SEQ ID NO: 445516 - RNA, 23 nt, Brucella suis 1330
uucacugcauuggcgauuuucug

SEQ ID NO: 445517 - RNA, 17 nt, Brucella suis 1330
uucacauagccugcaag

SEQ ID NO: 445518 - RNA, 18 nt, Brucella suis 1330
uucacauagccugcaagc

SEQ ID NO: 445519 - RNA, 15 nt, Brucella suis 1330
uucacauccuucacu

SEQ ID NO: 445520 - RNA, 19 nt, Brucella suis 1330
uucaaagcgcggaaugaca

SEQ ID NO: 445521 - RNA, 22 nt, Brucella suis 1330
uucaaaggaaagauccuucaca

SEQ ID NO: 445522 - RNA, 20 nt, Brucella suis 1330
uucaaaagcuggaugaucuu

SEQ ID NO: 445523 - RNA, 15 nt, Brucella suis 1330
uucaaacaacgcugc

SEQ ID NO: 445524 - RNA, 15 nt, Brucella suis 1330
uucaaaccaaaaaac

SEQ ID NO: 445525 - RNA, 14 nt, Brucella suis 1330
uucaagcagggcau

SEQ ID NO: 445526 - RNA, 21 nt, Brucella suis 1330
uuauucgugccuggcgaaaac

SEQ ID NO: 445527 - RNA, 21 nt, Brucella suis 1330
uuauugcccggaucauccauu

SEQ ID NO: 445528 - RNA, 17 nt, Brucella suis 1330
uuauuugaacaaagaug

SEQ ID NO: 445529 - RNA, 13 nt, Brucella suis 1330
uuagagcaauccc

SEQ ID NO: 445530 - RNA, 19 nt, Brucella suis 1330
uuagagcauuuccagcaaa

SEQ ID NO: 445531 - RNA, 21 nt, Brucella suis 1330
uuagagcgccgaucugauuca

SEQ ID NO: 445532 - RNA, 20 nt, Brucella suis 1330
uuaugcaggaaagcccggcu

SEQ ID NO: 445533 - RNA, 11 nt, Brucella suis 1330
uuaugcaucug

SEQ ID NO: 445534 - RNA, 22 nt, Brucella suis 1330
uguugcgaggaaaagacguguc

SEQ ID NO: 445535 - RNA, 16 nt, Brucella suis 1330
uguugcgauccucuug

SEQ ID NO: 445536 - RNA, 14 nt, Brucella suis 1330
uuacuccauuaauc

SEQ ID NO: 445537 - RNA, 19 nt, Brucella suis 1330
uuacugcccuauugccuua

SEQ ID NO: 445538 - RNA, 16 nt, Brucella suis 1330
uguucauguuuugaau

SEQ ID NO: 445539 - RNA, 17 nt, Brucella suis 1330
uguucaauaagcuuuuc

SEQ ID NO: 445540 - RNA, 20 nt, Brucella suis 1330
ugugccgcugcaccgggccg

SEQ ID NO: 445541 - RNA, 22 nt, Brucella suis 1330
ugugcugguaaaaugcaccgcc

SEQ ID NO: 445542 - RNA, 14 nt, Brucella suis 1330
ugugccaccagcac

SEQ ID NO: 445543 - RNA, 15 nt, Brucella suis 1330
ugugaaagcacaaag

SEQ ID NO: 445544 - RNA, 18 nt, Brucella suis 1330
ugucgugcuauggcacaa

SEQ ID NO: 445545 - RNA, 13 nt, Brucella suis 1330
ugucguugccgcc

SEQ ID NO: 445546 - RNA, 16 nt, Brucella suis 1330
ugucuagagcauuuuu

SEQ ID NO: 445547 - RNA, 13 nt, Brucella suis 1330
ugucgccgcucau

SEQ ID NO: 445548 - RNA, 19 nt, Brucella suis 1330
ugucgaccggcggcaggca

SEQ ID NO: 445549 - RNA, 18 nt, Brucella suis 1330
ugucgagccgcaacugca

SEQ ID NO: 445550 - RNA, 14 nt, Brucella suis 1330
uguccugccagcgg

SEQ ID NO: 445551 - RNA, 23 nt, Brucella suis 1330
uguccgccugaucgucaggcgca

SEQ ID NO: 445552 - RNA, 17 nt, Brucella suis 1330
uguccgaauaggcgcgc

SEQ ID NO: 445553 - RNA, 20 nt, Brucella suis 1330
ugucauggccgccccggcgc

SEQ ID NO: 445554 - RNA, 22 nt, Brucella suis 1330
ugucagggaaacucucacagcc

SEQ ID NO: 445555 - RNA, 19 nt, Brucella suis 1330
ugucauaaaaaacgguugg

SEQ ID NO: 445556 - RNA, 14 nt, Brucella suis 1330
ugucauacauggcg

SEQ ID NO: 445557 - RNA, 23 nt, Brucella suis 1330
uguacacgccaaccaaagaaaaa

SEQ ID NO: 445558 - RNA, 20 nt, Brucella suis 1330
ugguugcgcggccagccagc

SEQ ID NO: 445559 - RNA, 17 nt, Brucella suis 1330
ugguuucggcgucugcc

SEQ ID NO: 445560 - RNA, 15 nt, Brucella suis 1330
ugguuugaaaauguu

SEQ ID NO: 445561 - RNA, 15 nt, Brucella suis 1330
uggugcugccauggc

SEQ ID NO: 445562 - RNA, 22 nt, Brucella suis 1330
uggugcggcugcacacaaagau

SEQ ID NO: 445563 - RNA, 12 nt, Brucella suis 1330
uggugccagcgu

SEQ ID NO: 445564 - RNA, 19 nt, Brucella suis 1330
uggucugcggcuuccagau

SEQ ID NO: 445565 - RNA, 16 nt, Brucella suis 1330
uggucgcgcaccagcu

SEQ ID NO: 445566 - RNA, 16 nt, Brucella suis 1330
ugguccagucuucauc

SEQ ID NO: 445567 - RNA, 18 nt, Brucella suis 1330
ugggggccacgggccaga

SEQ ID NO: 445568 - RNA, 21 nt, Brucella suis 1330
ugggguaugacgcccuuugcc

SEQ ID NO: 445569 - RNA, 12 nt, Brucella suis 1330
ugggcggccagc

SEQ ID NO: 445570 - RNA, 11 nt, Brucella suis 1330
ugggacuggac

SEQ ID NO: 445571 - RNA, 15 nt, Brucella suis 1330
uggcuucaagcggcg

SEQ ID NO: 445572 - RNA, 21 nt, Brucella suis 1330
uggcugugcugguaaaaugca

SEQ ID NO: 445573 - RNA, 22 nt, Brucella suis 1330
uggcuguuucgcauugcccacg

SEQ ID NO: 445574 - RNA, 12 nt, Brucella suis 1330
uggcugggcccc

SEQ ID NO: 445575 - RNA, 16 nt, Brucella suis 1330
uggcugauuucuuccc

SEQ ID NO: 445576 - RNA, 19 nt, Brucella suis 1330
uggcugcaaucaccagaga

SEQ ID NO: 445577 - RNA, 15 nt, Brucella suis 1330
uggcugcccgccgca

SEQ ID NO: 445578 - RNA, 19 nt, Brucella suis 1330
uggcuaucacguuggggcg

SEQ ID NO: 445579 - RNA, 16 nt, Brucella suis 1330
uggcgggccauuucca

SEQ ID NO: 445580 - RNA, 17 nt, Brucella suis 1330
uggcgggccauuuccaa

SEQ ID NO: 445581 - RNA, 19 nt, Brucella suis 1330
uggcgcgcgaacgggaaca

SEQ ID NO: 445582 - RNA, 21 nt, Brucella suis 1330
uggaaaaacccggccuuugcg

SEQ ID NO: 445583 - RNA, 19 nt, Brucella suis 1330
ugcuugagggguucggcgu

SEQ ID NO: 445584 - RNA, 19 nt, Brucella suis 1330
ugcuucaggcacucuccuc

SEQ ID NO: 445585 - RNA, 14 nt, Brucella suis 1330
ugcuucacaugcuu

SEQ ID NO: 445586 - RNA, 22 nt, Brucella suis 1330
ugcuucacaugcuugccgaccu

SEQ ID NO: 445587 - RNA, 18 nt, Brucella suis 1330
ugcuguagcagcaacagg

SEQ ID NO: 445588 - RNA, 13 nt, Brucella suis 1330
ugcugggcuuccu

SEQ ID NO: 445589 - RNA, 21 nt, Brucella suis 1330
ugcugguuuaagccuuggucc

SEQ ID NO: 445590 - RNA, 20 nt, Brucella suis 1330
ugcuggcggccaagcgccag

SEQ ID NO: 445591 - RNA, 17 nt, Brucella suis 1330
ugcuggaauugacgaca

SEQ ID NO: 445592 - RNA, 13 nt, Brucella suis 1330
ugcuggaaaugcu

SEQ ID NO: 445593 - RNA, 20 nt, Brucella suis 1330
ugcugcuucgcaaaauaguc

SEQ ID NO: 445594 - RNA, 18 nt, Brucella suis 1330
ugcugcauuuucugcauc

SEQ ID NO: 445595 - RNA, 13 nt, Brucella suis 1330
ugcugccaugucu

SEQ ID NO: 445596 - RNA, 19 nt, Brucella suis 1330
ugcugccaugucucgccgu

SEQ ID NO: 445597 - RNA, 14 nt, Brucella suis 1330
ugcugcauccugcu

SEQ ID NO: 445598 - RNA, 20 nt, Brucella suis 1330
ugcugcaauccacaggagau

SEQ ID NO: 445599 - RNA, 21 nt, Brucella suis 1330
ugcugaaaaggcuggccaugc

SEQ ID NO: 445600 - RNA, 22 nt, Brucella suis 1330
ugcugaaacgagacaaggcaau

SEQ ID NO: 445601 - RNA, 21 nt, Brucella suis 1330
ugcucgcccagaaacaaugug

SEQ ID NO: 445602 - RNA, 13 nt, Brucella suis 1330
ugcuccuggcaca

SEQ ID NO: 445603 - RNA, 22 nt, Brucella suis 1330
ugcguuguuuucgcgcagaagg

SEQ ID NO: 445604 - RNA, 13 nt, Brucella suis 1330
ugcggugcuccca

SEQ ID NO: 445605 - RNA, 17 nt, Brucella suis 1330
ugcgggcuucuuccagu

SEQ ID NO: 445606 - RNA, 13 nt, Brucella suis 1330
ugcggggaaauca

SEQ ID NO: 445607 - RNA, 22 nt, Brucella suis 1330
ugcggcggauaucuuccugaau

SEQ ID NO: 445608 - RNA, 16 nt, Brucella suis 1330
ugcggccaagcgcauc

SEQ ID NO: 445609 - RNA, 18 nt, Brucella suis 1330
ugcggaacacgccgccau

SEQ ID NO: 445610 - RNA, 19 nt, Brucella suis 1330
ugcgcgucaaaacaaaaga

SEQ ID NO: 445611 - RNA, 20 nt, Brucella suis 1330
ugcgcguagggcagaucugu

SEQ ID NO: 445612 - RNA, 13 nt, Brucella suis 1330
ugcgcggcgcuuc

SEQ ID NO: 445613 - RNA, 20 nt, Brucella suis 1330
ugcgcggccagccagcgcau

SEQ ID NO: 445614 - RNA, 18 nt, Brucella suis 1330
ugcgcggcaagauagccc

SEQ ID NO: 445615 - RNA, 14 nt, Brucella suis 1330
ugcgcgcccggcgg

SEQ ID NO: 445616 - RNA, 20 nt, Brucella suis 1330
ugcgcgcccgucaccggcug

SEQ ID NO: 445617 - RNA, 21 nt, Brucella suis 1330
ugcgcgcaaggaaagaucugc

SEQ ID NO: 445618 - RNA, 20 nt, Brucella suis 1330
ugcgccaguuuucgcggcag

SEQ ID NO: 445619 - RNA, 23 nt, Brucella suis 1330
ugcgccacgagaaccgcgccggg

SEQ ID NO: 445620 - RNA, 20 nt, Brucella suis 1330
ugccuucuugcacaguuccg

SEQ ID NO: 445621 - RNA, 12 nt, Brucella suis 1330
ugccuucuucau

SEQ ID NO: 445622 - RNA, 20 nt, Brucella suis 1330
ugccuucgacaaccgcgccg

SEQ ID NO: 445623 - RNA, 19 nt, Brucella suis 1330
ugccuucgcgccaggcuuc

SEQ ID NO: 445624 - RNA, 19 nt, Brucella suis 1330
ugccucccgauaaugcgaa

SEQ ID NO: 445625 - RNA, 22 nt, Brucella suis 1330
ugccgguugccuugcccauggu

SEQ ID NO: 445626 - RNA, 15 nt, Brucella suis 1330
ugccggucgcaggcg

SEQ ID NO: 445627 - RNA, 18 nt, Brucella suis 1330
ugccgguauuuugcaacu

SEQ ID NO: 445628 - RNA, 19 nt, Brucella suis 1330
ugccgggcacgaaaagcag

SEQ ID NO: 445629 - RNA, 15 nt, Brucella suis 1330
ugccgcuuccagcau

SEQ ID NO: 445630 - RNA, 15 nt, Brucella suis 1330
ugccgcgaaaaagcc

SEQ ID NO: 445631 - RNA, 23 nt, Brucella suis 1330
ugccgccgcagaccacccggccg

SEQ ID NO: 445632 - RNA, 17 nt, Brucella suis 1330
ugccgcauaaagcacag

SEQ ID NO: 445633 - RNA, 19 nt, Brucella suis 1330
ugccgcauaaagcacagcc

SEQ ID NO: 445634 - RNA, 18 nt, Brucella suis 1330
ugccgagcauggccugcg

SEQ ID NO: 445635 - RNA, 20 nt, Brucella suis 1330
ugcccuggcucuuccggccg

SEQ ID NO: 445636 - RNA, 20 nt, Brucella suis 1330
ugcccuauaccgccaaggaa

SEQ ID NO: 445637 - RNA, 22 nt, Brucella suis 1330
ugcccgucgcaggcggaugaag

SEQ ID NO: 445638 - RNA, 16 nt, Brucella suis 1330
ugcccggaucauccau

SEQ ID NO: 445639 - RNA, 17 nt, Brucella suis 1330
ugcccgccuuugccgca

SEQ ID NO: 445640 - RNA, 19 nt, Brucella suis 1330
ugcccgacugaacgaaugc

SEQ ID NO: 445641 - RNA, 18 nt, Brucella suis 1330
ugccaugccgccaaggcc

SEQ ID NO: 445642 - RNA, 15 nt, Brucella suis 1330
ugccacgcgccgcca

SEQ ID NO: 445643 - RNA, 19 nt, Brucella suis 1330
ugccacgcgccgccaucug

SEQ ID NO: 445644 - RNA, 13 nt, Brucella suis 1330
ugcauuccagaag

SEQ ID NO: 445645 - RNA, 15 nt, Brucella suis 1330
ugcauuccagaaggu

SEQ ID NO: 445646 - RNA, 17 nt, Brucella suis 1330
ugcauccucgaaaacaa

SEQ ID NO: 445647 - RNA, 20 nt, Brucella suis 1330
ugcaucgaaugccgcaugau

SEQ ID NO: 445648 - RNA, 20 nt, Brucella suis 1330
ugcaucgacugcgaauguca

SEQ ID NO: 445649 - RNA, 15 nt, Brucella suis 1330
ugcaguuccauccau

SEQ ID NO: 445650 - RNA, 19 nt, Brucella suis 1330
ugcacgcgggccaacucuu

SEQ ID NO: 445651 - RNA, 16 nt, Brucella suis 1330
ugcaccgcccggauca

SEQ ID NO: 445652 - RNA, 16 nt, Brucella suis 1330
ugcaccgccugccagc

SEQ ID NO: 445653 - RNA, 17 nt, Brucella suis 1330
ugcaccgcgccggaagg

SEQ ID NO: 445654 - RNA, 18 nt, Brucella suis 1330
ugcaccggcccaaaggcc

SEQ ID NO: 445655 - RNA, 14 nt, Brucella suis 1330
ugcaccggcuuccc

SEQ ID NO: 445656 - RNA, 12 nt, Brucella suis 1330
ugcaccagagca

SEQ ID NO: 445657 - RNA, 24 nt, Brucella suis 1330
ugcaaucaccagagacaguggcuc

SEQ ID NO: 445658 - RNA, 15 nt, Brucella suis 1330
ugcaacaccaauagc

SEQ ID NO: 445659 - RNA, 22 nt, Brucella suis 1330
ugcaacaccaucgaguuccggg

SEQ ID NO: 445660 - RNA, 14 nt, Brucella suis 1330
ugcaacaaaagaag

SEQ ID NO: 445661 - RNA, 18 nt, Brucella suis 1330
ugcaacaaaugcaaaugc

SEQ ID NO: 445662 - RNA, 18 nt, Brucella suis 1330
ugauucuggauuucaucc

SEQ ID NO: 445663 - RNA, 22 nt, Brucella suis 1330
ugaugccggucgcaggcgcucu

SEQ ID NO: 445664 - RNA, 22 nt, Brucella suis 1330
ugauugcaggucuuucugcuuc

SEQ ID NO: 445665 - RNA, 17 nt, Brucella suis 1330
ugaucuuguucggcuuu

SEQ ID NO: 445666 - RNA, 14 nt, Brucella suis 1330
ugaugaaaaacccc

SEQ ID NO: 445667 - RNA, 17 nt, Brucella suis 1330
ugaucagggcaaucugc

SEQ ID NO: 445668 - RNA, 17 nt, Brucella suis 1330
ugaucaacccgucuuca

SEQ ID NO: 445669 - RNA, 17 nt, Brucella suis 1330
ugauagcggaaaccagu

SEQ ID NO: 445670 - RNA, 22 nt, Brucella suis 1330
ugauacugcgcgcaaaccagga

SEQ ID NO: 445671 - RNA, 19 nt, Brucella suis 1330
ugauagaccgucuggccug

SEQ ID NO: 445672 - RNA, 17 nt, Brucella suis 1330
ugauagcgcccgccucg

SEQ ID NO: 445673 - RNA, 17 nt, Brucella suis 1330
ugauagcugcauccagc

SEQ ID NO: 445674 - RNA, 12 nt, Brucella suis 1330
ugauaggcugcu

SEQ ID NO: 445675 - RNA, 21 nt, Brucella suis 1330
ugauagggcaauuggccccca

SEQ ID NO: 445676 - RNA, 20 nt, Brucella suis 1330
ugagcaguaucgucguccag

SEQ ID NO: 445677 - RNA, 12 nt, Brucella suis 1330
ugagcaugaugc

SEQ ID NO: 445678 - RNA, 21 nt, Brucella suis 1330
ugagcaauagagucgccgaaa

SEQ ID NO: 445679 - RNA, 19 nt, Brucella suis 1330
ugacgcgggugaggcuuuc

SEQ ID NO: 445680 - RNA, 14 nt, Brucella suis 1330
ugacgcgcaucuuu

SEQ ID NO: 445681 - RNA, 17 nt, Brucella suis 1330
ugacgacggcuaaagca

SEQ ID NO: 445682 - RNA, 21 nt, Brucella suis 1330
ugacgccauugaccgccucga

SEQ ID NO: 445683 - RNA, 20 nt, Brucella suis 1330
ugaccgccucgacagcacug

SEQ ID NO: 445684 - RNA, 13 nt, Brucella suis 1330
ugaccgccgcgau

SEQ ID NO: 445685 - RNA, 14 nt, Brucella suis 1330
ugacgaaaaaggcg

SEQ ID NO: 445686 - RNA, 21 nt, Brucella suis 1330
ugacgaaaaaggcgaucaggu

SEQ ID NO: 445687 - RNA, 16 nt, Brucella suis 1330
ugacgaaacgcggcgu

SEQ ID NO: 445688 - RNA, 16 nt, Brucella suis 1330
ugacccggccuuugcg

SEQ ID NO: 445689 - RNA, 18 nt, Brucella suis 1330
ugacccggcgcaaaggcc

SEQ ID NO: 445690 - RNA, 14 nt, Brucella suis 1330
ugacaucuucuucg

SEQ ID NO: 445691 - RNA, 20 nt, Brucella suis 1330
ugacauggaaaugcagguga

SEQ ID NO: 445692 - RNA, 16 nt, Brucella suis 1330
ugacauccaugaaagc

SEQ ID NO: 445693 - RNA, 15 nt, Brucella suis 1330
ugaaugcgccgccag

SEQ ID NO: 445694 - RNA, 16 nt, Brucella suis 1330
ugaauggucugcgcca

SEQ ID NO: 445695 - RNA, 16 nt, Brucella suis 1330
ugaaugugccugugau

SEQ ID NO: 445696 - RNA, 14 nt, Brucella suis 1330
ugaaggggcgguca

SEQ ID NO: 445697 - RNA, 22 nt, Brucella suis 1330
ugaagguaagcuuugcaccgcg

SEQ ID NO: 445698 - RNA, 19 nt, Brucella suis 1330
ugaaggcucggcaaaggga

SEQ ID NO: 445699 - RNA, 13 nt, Brucella suis 1330
ugaagcugccgcg

SEQ ID NO: 445700 - RNA, 18 nt, Brucella suis 1330
ugaagcaaggcggcccuu

SEQ ID NO: 445701 - RNA, 16 nt, Brucella suis 1330
ugaagccaucuuucuu

SEQ ID NO: 445702 - RNA, 14 nt, Brucella suis 1330
ugaacgccuuuuuc

SEQ ID NO: 445703 - RNA, 12 nt, Brucella suis 1330
ugaagaaaacaa

SEQ ID NO: 445704 - RNA, 20 nt, Brucella suis 1330
ugaagaagauaaucagcaga

SEQ ID NO: 445705 - RNA, 21 nt, Brucella suis 1330
ugaagacaucgguggugccga

SEQ ID NO: 445706 - RNA, 18 nt, Brucella suis 1330
ugaacccgccaccagacc

SEQ ID NO: 445707 - RNA, 19 nt, Brucella suis 1330
ugaacccgccaccagaccg

SEQ ID NO: 445708 - RNA, 21 nt, Brucella suis 1330
ugaacaugcgccacuucccgc

SEQ ID NO: 445709 - RNA, 22 nt, Brucella suis 1330
ugaacgcauagagccacgagaa

SEQ ID NO: 445710 - RNA, 17 nt, Brucella suis 1330
ugaacaucggcgcgcuu

SEQ ID NO: 445711 - RNA, 13 nt, Brucella suis 1330
ugaacaaagauga

SEQ ID NO: 445712 - RNA, 17 nt, Brucella suis 1330
ugaaaucgucacugaga

SEQ ID NO: 445713 - RNA, 20 nt, Brucella suis 1330
ugaaauaauagucgaaaaaa

SEQ ID NO: 445714 - RNA, 21 nt, Brucella suis 1330
ugaaauaauugucaggaaaaa

SEQ ID NO: 445715 - RNA, 11 nt, Brucella suis 1330
ugaaauucuuu

SEQ ID NO: 445716 - RNA, 14 nt, Brucella suis 1330
ugaaagaacggccc

SEQ ID NO: 445717 - RNA, 19 nt, Brucella suis 1330
ugaaacgagacaaggcaau

SEQ ID NO: 445718 - RNA, 14 nt, Brucella suis 1330
ugaaagcacaaaga

SEQ ID NO: 445719 - RNA, 19 nt, Brucella suis 1330
ugaaagcacaaagaacaag

SEQ ID NO: 445720 - RNA, 14 nt, Brucella suis 1330
ugaaaggcagcacu

SEQ ID NO: 445721 - RNA, 16 nt, Brucella suis 1330
ugaaaggugaaggccu

SEQ ID NO: 445722 - RNA, 15 nt, Brucella suis 1330
ugaaaauaucugccg

SEQ ID NO: 445723 - RNA, 16 nt, Brucella suis 1330
ugaaaaggauauccuu

SEQ ID NO: 445724 - RNA, 17 nt, Brucella suis 1330
ucuuuuccgaaaaccgu

SEQ ID NO: 445725 - RNA, 11 nt, Brucella suis 1330
ucuuuuuucaa

SEQ ID NO: 445726 - RNA, 22 nt, Brucella suis 1330
ucuuucuugaagucaucaccgc

SEQ ID NO: 445727 - RNA, 21 nt, Brucella suis 1330
ucuugggauucucgaacaggu

SEQ ID NO: 445728 - RNA, 22 nt, Brucella suis 1330
ucuuccaggagagccuuugcuu

SEQ ID NO: 445729 - RNA, 17 nt, Brucella suis 1330
ucuuccaguuucugaau

SEQ ID NO: 445730 - RNA, 22 nt, Brucella suis 1330
ucuuuacaccgucuauuuucug

SEQ ID NO: 445731 - RNA, 14 nt, Brucella suis 1330
ucuuuccaaguuca

SEQ ID NO: 445732 - RNA, 22 nt, Brucella suis 1330
ucuuuccaaguucaugccuguc

SEQ ID NO: 445733 - RNA, 20 nt, Brucella suis 1330
ucuuuccccaugaccggaug

SEQ ID NO: 445734 - RNA, 19 nt, Brucella suis 1330
ucuucacagcggacuuggc

SEQ ID NO: 445735 - RNA, 21 nt, Brucella suis 1330
ucuucacagcggacuuggccu

SEQ ID NO: 445736 - RNA, 23 nt, Brucella suis 1330
ucuguccggccagcuugaaaagc

SEQ ID NO: 445737 - RNA, 22 nt, Brucella suis 1330
ucuggcugagauaaaccggccc

SEQ ID NO: 445738 - RNA, 20 nt, Brucella suis 1330
ucugcucggcgagcuuguug

SEQ ID NO: 445739 - RNA, 20 nt, Brucella suis 1330
ucugcguuccggugcuugug

SEQ ID NO: 445740 - RNA, 14 nt, Brucella suis 1330
ucugcagcaaucuc

SEQ ID NO: 445741 - RNA, 20 nt, Brucella suis 1330
ucugcggaaagcccggccuu

SEQ ID NO: 445742 - RNA, 16 nt, Brucella suis 1330
ucugcggcuuccagau

SEQ ID NO: 445743 - RNA, 20 nt, Brucella suis 1330
ucugcacggcacguucggca

SEQ ID NO: 445744 - RNA, 17 nt, Brucella suis 1330
ucugcacgucaucaucg

SEQ ID NO: 445745 - RNA, 18 nt, Brucella suis 1330
ucugcacgucaucaucgu

SEQ ID NO: 445746 - RNA, 17 nt, Brucella suis 1330
ucucgucgagaagcauc

SEQ ID NO: 445747 - RNA, 22 nt, Brucella suis 1330
ucucgucgagaagcaucagcuu

SEQ ID NO: 445748 - RNA, 12 nt, Brucella suis 1330
ucucguuuucau

SEQ ID NO: 445749 - RNA, 21 nt, Brucella suis 1330
ucuccggcaaaacggcaggca

SEQ ID NO: 445750 - RNA, 13 nt, Brucella suis 1330
ucuccucugccug

SEQ ID NO: 445751 - RNA, 16 nt, Brucella suis 1330
ucuccucugccugcug

SEQ ID NO: 445752 - RNA, 17 nt, Brucella suis 1330
ucucugcucgccugcac

SEQ ID NO: 445753 - RNA, 17 nt, Brucella suis 1330
ucugaucuaguggagca

SEQ ID NO: 445754 - RNA, 16 nt, Brucella suis 1330
ucgugagcgagcgcac

SEQ ID NO: 445755 - RNA, 20 nt, Brucella suis 1330
ucuaagcggaaaacggcugc

SEQ ID NO: 445756 - RNA, 16 nt, Brucella suis 1330
ucgucggucagggcaa

SEQ ID NO: 445757 - RNA, 18 nt, Brucella suis 1330
ucgucgcgcucgccgccc

SEQ ID NO: 445758 - RNA, 21 nt, Brucella suis 1330
ucguaucgccaaagaccagca

SEQ ID NO: 445759 - RNA, 23 nt, Brucella suis 1330
ucguaaucgccgggccuugccaa

SEQ ID NO: 445760 - RNA, 21 nt, Brucella suis 1330
ucgggucgaucaucagcggcg

SEQ ID NO: 445761 - RNA, 15 nt, Brucella suis 1330
ucggguaaggcuuca

SEQ ID NO: 445762 - RNA, 13 nt, Brucella suis 1330
ucggggcggccuu

SEQ ID NO: 445763 - RNA, 17 nt, Brucella suis 1330
ucggggaagguggggag

SEQ ID NO: 445764 - RNA, 14 nt, Brucella suis 1330
ucgggcagggucaa

SEQ ID NO: 445765 - RNA, 15 nt, Brucella suis 1330
ucgggcagugaaagc

SEQ ID NO: 445766 - RNA, 15 nt, Brucella suis 1330
ucggcuugccgaccu

SEQ ID NO: 445767 - RNA, 16 nt, Brucella suis 1330
ucggcggcaguuucac

SEQ ID NO: 445768 - RNA, 20 nt, Brucella suis 1330
ucggcgcucuaauccuuugu

SEQ ID NO: 445769 - RNA, 19 nt, Brucella suis 1330
ucggcgaccgccuuuucca

SEQ ID NO: 445770 - RNA, 22 nt, Brucella suis 1330
ucggccuuguaggaaagcacac

SEQ ID NO: 445771 - RNA, 13 nt, Brucella suis 1330
ucggccuggucua

SEQ ID NO: 445772 - RNA, 13 nt, Brucella suis 1330
ucggccucgccug

SEQ ID NO: 445773 - RNA, 21 nt, Brucella suis 1330
ucggccgggcaucgcucgaag

SEQ ID NO: 445774 - RNA, 14 nt, Brucella suis 1330
ucggccgcguugcc

SEQ ID NO: 445775 - RNA, 21 nt, Brucella suis 1330
ucggccgcguugcccaugucc

SEQ ID NO: 445776 - RNA, 11 nt, Brucella suis 1330
ucggcccagca

SEQ ID NO: 445777 - RNA, 16 nt, Brucella suis 1330
ucggcccagcaccgcg

SEQ ID NO: 445778 - RNA, 14 nt, Brucella suis 1330
ucggccagagcuuc

SEQ ID NO: 445779 - RNA, 13 nt, Brucella suis 1330
ucggcaacaagag

SEQ ID NO: 445780 - RNA, 15 nt, Brucella suis 1330
ucggcaacaagaggg

SEQ ID NO: 445781 - RNA, 22 nt, Brucella suis 1330
ucggcaacaagagggcgcagca

SEQ ID NO: 445782 - RNA, 22 nt, Brucella suis 1330
ucggagccggccuuugcgcgcc

SEQ ID NO: 445783 - RNA, 18 nt, Brucella suis 1330
ucgcuuucaauggccgcg

SEQ ID NO: 445784 - RNA, 23 nt, Brucella suis 1330
ucgcuguccgacgccaaaaggcc

SEQ ID NO: 445785 - RNA, 15 nt, Brucella suis 1330
ucgcgcaggccgcgg

SEQ ID NO: 445786 - RNA, 14 nt, Brucella suis 1330
ucgccuucgccgag

SEQ ID NO: 445787 - RNA, 18 nt, Brucella suis 1330
ucgccgcuugcgccgaac

SEQ ID NO: 445788 - RNA, 13 nt, Brucella suis 1330
ucgccgcacggcg

SEQ ID NO: 445789 - RNA, 19 nt, Brucella suis 1330
ucgccgaaauuggccgcug

SEQ ID NO: 445790 - RNA, 23 nt, Brucella suis 1330
ucgcccugcuucacaugcuugcc

SEQ ID NO: 445791 - RNA, 14 nt, Brucella suis 1330
ucgcccgcccggca

SEQ ID NO: 445792 - RNA, 16 nt, Brucella suis 1330
ucgcccauuuucucca

SEQ ID NO: 445793 - RNA, 23 nt, Brucella suis 1330
ucgccaauuccgccggggcaggc

SEQ ID NO: 445794 - RNA, 19 nt, Brucella suis 1330
ucgccaagcuuuugcagcc

SEQ ID NO: 445795 - RNA, 22 nt, Brucella suis 1330
ucgcaccggauuugccaagcgu

SEQ ID NO: 445796 - RNA, 22 nt, Brucella suis 1330
ucgcacgcuuggccucuuccag

SEQ ID NO: 445797 - RNA, 20 nt, Brucella suis 1330
ucgcaccgauauagagcagc

SEQ ID NO: 445798 - RNA, 21 nt, Brucella suis 1330
ucgcaccgauauagagcagca

SEQ ID NO: 445799 - RNA, 18 nt, Brucella suis 1330
ucgauuugcgcaccagau

SEQ ID NO: 445800 - RNA, 13 nt, Brucella suis 1330
ucgcaagcaggca

SEQ ID NO: 445801 - RNA, 16 nt, Brucella suis 1330
ucgcaagcaggcauug

SEQ ID NO: 445802 - RNA, 16 nt, Brucella suis 1330
ucgaucuggcggauga

SEQ ID NO: 445803 - RNA, 15 nt, Brucella suis 1330
ucgaucggugcaaug

SEQ ID NO: 445804 - RNA, 19 nt, Brucella suis 1330
ucgauauggucgaggauca

SEQ ID NO: 445805 - RNA, 21 nt, Brucella suis 1330
ucgauauccuggccuuccuug

SEQ ID NO: 445806 - RNA, 18 nt, Brucella suis 1330
ucgaguucugcgcggaaa

SEQ ID NO: 445807 - RNA, 17 nt, Brucella suis 1330
ucgagugcggccugcac

SEQ ID NO: 445808 - RNA, 19 nt, Brucella suis 1330
ucgaggccgaacgaggcga

SEQ ID NO: 445809 - RNA, 22 nt, Brucella suis 1330
ucgaggcagccacggcagagug

SEQ ID NO: 445810 - RNA, 14 nt, Brucella suis 1330
ucgagcuuuccauc

SEQ ID NO: 445811 - RNA, 20 nt, Brucella suis 1330
ucgaggaauaggcgccagca

SEQ ID NO: 445812 - RNA, 23 nt, Brucella suis 1330
ucgaggaauaggcgccagcacuu

SEQ ID NO: 445813 - RNA, 19 nt, Brucella suis 1330
ucgacagcacugccaccau

SEQ ID NO: 445814 - RNA, 18 nt, Brucella suis 1330
ucgacacgccggaacacc

SEQ ID NO: 445815 - RNA, 12 nt, Brucella suis 1330
ucgacaccgcca

SEQ ID NO: 445816 - RNA, 16 nt, Brucella suis 1330
ucgacaaucuccccuu

SEQ ID NO: 445817 - RNA, 23 nt, Brucella suis 1330
ucgacaaugucaucggaggcuuc

SEQ ID NO: 445818 - RNA, 17 nt, Brucella suis 1330
ucgaauaucuugaagcc

SEQ ID NO: 445819 - RNA, 19 nt, Brucella suis 1330
ucgaacugguucagccgcu

SEQ ID NO: 445820 - RNA, 21 nt, Brucella suis 1330
ucgaaauccuucagaagcacc

SEQ ID NO: 445821 - RNA, 13 nt, Brucella suis 1330
ucgaaccucugac

SEQ ID NO: 445822 - RNA, 16 nt, Brucella suis 1330
uccuuuuucagcaccg

SEQ ID NO: 445823 - RNA, 14 nt, Brucella suis 1330
ucgaaaacaucgga

SEQ ID NO: 445824 - RNA, 22 nt, Brucella suis 1330
ucgaaaccggcauuauccgcau

SEQ ID NO: 445825 - RNA, 17 nt, Brucella suis 1330
uccuuguuccagucgcc

SEQ ID NO: 445826 - RNA, 15 nt, Brucella suis 1330
uccuuuguuuugacg

SEQ ID NO: 445827 - RNA, 14 nt, Brucella suis 1330
uccuugcccucgau

SEQ ID NO: 445828 - RNA, 22 nt, Brucella suis 1330
uccuugacgcugaagaaaacaa

SEQ ID NO: 445829 - RNA, 16 nt, Brucella suis 1330
uccuucaccacgauuu

SEQ ID NO: 445830 - RNA, 16 nt, Brucella suis 1330
uccuucagaagcacca

SEQ ID NO: 445831 - RNA, 22 nt, Brucella suis 1330
uccugcuucgaucagauaagau

SEQ ID NO: 445832 - RNA, 14 nt, Brucella suis 1330
uccugcaccggcuu

SEQ ID NO: 445833 - RNA, 14 nt, Brucella suis 1330
ucagcgauggcgac

SEQ ID NO: 445834 - RNA, 23 nt, Brucella suis 1330
uccugccaaacuaaaugaagaag

SEQ ID NO: 445835 - RNA, 18 nt, Brucella suis 1330
ucagccgggcagugccgg

SEQ ID NO: 445836 - RNA, 23 nt, Brucella suis 1330
ucagccucggaaaaguccuuucc

SEQ ID NO: 445837 - RNA, 23 nt, Brucella suis 1330
ucagcauugaacgccuuuuucac

SEQ ID NO: 445838 - RNA, 20 nt, Brucella suis 1330
ucagcacaagccauccccau

SEQ ID NO: 445839 - RNA, 22 nt, Brucella suis 1330
ucagauagccggugcugucgcc

SEQ ID NO: 445840 - RNA, 20 nt, Brucella suis 1330
ucagagcuucauugucccaa

SEQ ID NO: 445841 - RNA, 18 nt, Brucella suis 1330
ucagauugaugaaaaacc

SEQ ID NO: 445842 - RNA, 21 nt, Brucella suis 1330
ucagaaccggaauaucuacag

SEQ ID NO: 445843 - RNA, 16 nt, Brucella suis 1330
ucagaaagucugcuuc

SEQ ID NO: 445844 - RNA, 11 nt, Brucella suis 1330
ucagaaaucag

SEQ ID NO: 445845 - RNA, 22 nt, Brucella suis 1330
ucagaaauuugcgggcgaacca

SEQ ID NO: 445846 - RNA, 19 nt, Brucella suis 1330
ucacguaggggucuucucu

SEQ ID NO: 445847 - RNA, 18 nt, Brucella suis 1330
ucacguuugacagccugg

SEQ ID NO: 445848 - RNA, 18 nt, Brucella suis 1330
ucacuccgaccauuuccc

SEQ ID NO: 445849 - RNA, 18 nt, Brucella suis 1330
ucacugcaaaaaauacca

SEQ ID NO: 445850 - RNA, 19 nt, Brucella suis 1330
ucacuggcaacgacggcug

SEQ ID NO: 445851 - RNA, 18 nt, Brucella suis 1330
ucacugucggguuccuua

SEQ ID NO: 445852 - RNA, 21 nt, Brucella suis 1330
ucacuucgucgcugacuucaa

SEQ ID NO: 445853 - RNA, 17 nt, Brucella suis 1330
ucacggaacgucacaga

SEQ ID NO: 445854 - RNA, 15 nt, Brucella suis 1330
ucacgcgcagcagca

SEQ ID NO: 445855 - RNA, 16 nt, Brucella suis 1330
ucacgcgcagcagcau

SEQ ID NO: 445856 - RNA, 12 nt, Brucella suis 1330
ucacgcggcgca

SEQ ID NO: 445857 - RNA, 18 nt, Brucella suis 1330
ucacgccggcaucaaacu

SEQ ID NO: 445858 - RNA, 18 nt, Brucella suis 1330
ucacgccgucaaaggaaa

SEQ ID NO: 445859 - RNA, 14 nt, Brucella suis 1330
ucacgccacugccc

SEQ ID NO: 445860 - RNA, 12 nt, Brucella suis 1330
ucacgcagcgug

SEQ ID NO: 445861 - RNA, 19 nt, Brucella suis 1330
ucaccugacggauuucggc

SEQ ID NO: 445862 - RNA, 23 nt, Brucella suis 1330
ucaccggcuggcacaaagcggcc

SEQ ID NO: 445863 - RNA, 22 nt, Brucella suis 1330
ucaccggcugggccuuguuuuc

SEQ ID NO: 445864 - RNA, 21 nt, Brucella suis 1330
ucaccgcgacgcuucuugcug

SEQ ID NO: 445865 - RNA, 17 nt, Brucella suis 1330
ucaccgagggcagcuuc

SEQ ID NO: 445866 - RNA, 16 nt, Brucella suis 1330
ucacccgccuugcaga

SEQ ID NO: 445867 - RNA, 12 nt, Brucella suis 1330
ucacccuccacc

SEQ ID NO: 445868 - RNA, 19 nt, Brucella suis 1330
ucaccagcccccagaugaa

SEQ ID NO: 445869 - RNA, 20 nt, Brucella suis 1330
ucaccagccccgccagaaaa

SEQ ID NO: 445870 - RNA, 22 nt, Brucella suis 1330
ucaccagccccgccagaaaaac

SEQ ID NO: 445871 - RNA, 17 nt, Brucella suis 1330
ucaccagcgucgcaccg

SEQ ID NO: 445872 - RNA, 20 nt, Brucella suis 1330
ucaccacgauuucgcccacg

SEQ ID NO: 445873 - RNA, 17 nt, Brucella suis 1330
ucacauuucaugaaaau

SEQ ID NO: 445874 - RNA, 21 nt, Brucella suis 1330
ucaccacaucggcggaaaagc

SEQ ID NO: 445875 - RNA, 19 nt, Brucella suis 1330
ucacaacgccgucagcccc

SEQ ID NO: 445876 - RNA, 19 nt, Brucella suis 1330
ucacaaugugaaugaaaaa

SEQ ID NO: 445877 - RNA, 19 nt, Brucella suis 1330
ucacacugcaaaacugaag

SEQ ID NO: 445878 - RNA, 22 nt, Brucella suis 1330
ucacacuuuuggcucgaaaaug

SEQ ID NO: 445879 - RNA, 15 nt, Brucella suis 1330
ucacagauucaaaac

SEQ ID NO: 445880 - RNA, 15 nt, Brucella suis 1330
ucaaugaucuggcuu

SEQ ID NO: 445881 - RNA, 12 nt, Brucella suis 1330
ucaaugccaucc

SEQ ID NO: 445882 - RNA, 19 nt, Brucella suis 1330
ucaaucgcgccgucgccga

SEQ ID NO: 445883 - RNA, 13 nt, Brucella suis 1330
ucaauucacccuu

SEQ ID NO: 445884 - RNA, 15 nt, Brucella suis 1330
ucacaaaacagacgc

SEQ ID NO: 445885 - RNA, 16 nt, Brucella suis 1330
ucaauaagcuuuucau

SEQ ID NO: 445886 - RNA, 16 nt, Brucella suis 1330
ucaaggccuguuccac

SEQ ID NO: 445887 - RNA, 17 nt, Brucella suis 1330
ucaaggccuguuccaca

SEQ ID NO: 445888 - RNA, 23 nt, Brucella suis 1330
ucaagcggcgucaggccaaagcc

SEQ ID NO: 445889 - RNA, 19 nt, Brucella suis 1330
ucaagcggcuccaccaccu

SEQ ID NO: 445890 - RNA, 14 nt, Brucella suis 1330
ucaagugccgccuu

SEQ ID NO: 445891 - RNA, 15 nt, Brucella suis 1330
ucaacuggcgcagca

SEQ ID NO: 445892 - RNA, 15 nt, Brucella suis 1330
ucaaccgugcauucu

SEQ ID NO: 445893 - RNA, 22 nt, Brucella suis 1330
ucaacgccguggcggcuggcuu

SEQ ID NO: 445894 - RNA, 21 nt, Brucella suis 1330
ucaacuguguugccagcagcg

SEQ ID NO: 445895 - RNA, 18 nt, Brucella suis 1330
ucaagaugcuugaggauc

SEQ ID NO: 445896 - RNA, 16 nt, Brucella suis 1330
ucaaacggcaucauug

SEQ ID NO: 445897 - RNA, 13 nt, Brucella suis 1330
ucaaaggaaagau

SEQ ID NO: 445898 - RNA, 23 nt, Brucella suis 1330
ucaaaggaaagauccuucacaua

SEQ ID NO: 445899 - RNA, 18 nt, Brucella suis 1330
uauuuuuacaaaaaaauc

SEQ ID NO: 445900 - RNA, 22 nt, Brucella suis 1330
uauuuucgagccaaaagugcgc

SEQ ID NO: 445901 - RNA, 21 nt, Brucella suis 1330
ucaaaaacgagggguuuugau

SEQ ID NO: 445902 - RNA, 12 nt, Brucella suis 1330
ucaaaacaaagg

SEQ ID NO: 445903 - RNA, 13 nt, Brucella suis 1330
ucaaaacgcagca

SEQ ID NO: 445904 - RNA, 22 nt, Brucella suis 1330
ucaaaacgccauagaacagcaa

SEQ ID NO: 445905 - RNA, 17 nt, Brucella suis 1330
ucaaaacgcugccagcc

SEQ ID NO: 445906 - RNA, 15 nt, Brucella suis 1330
ucaaaagaaaccuug

SEQ ID NO: 445907 - RNA, 22 nt, Brucella suis 1330
uauuucugaugaacggcuauau

SEQ ID NO: 445908 - RNA, 16 nt, Brucella suis 1330
uauuucuuccagacag

SEQ ID NO: 445909 - RNA, 14 nt, Brucella suis 1330
uauuugaacaaaga

SEQ ID NO: 445910 - RNA, 15 nt, Brucella suis 1330
uauuugaacaaagau

SEQ ID NO: 445911 - RNA, 13 nt, Brucella suis 1330
uauuucgcgcgca

SEQ ID NO: 445912 - RNA, 23 nt, Brucella suis 1330
uauuucggcggaaccauggcugc

SEQ ID NO: 445913 - RNA, 17 nt, Brucella suis 1330
uauugcccggaucaucc

SEQ ID NO: 445914 - RNA, 17 nt, Brucella suis 1330
uauugccuuaaucccuu

SEQ ID NO: 445915 - RNA, 21 nt, Brucella suis 1330
uauucggcgaccgccuuuucc

SEQ ID NO: 445916 - RNA, 22 nt, Brucella suis 1330
uauuccaucagccgggcagugc

SEQ ID NO: 445917 - RNA, 10 nt, Brucella suis 1330
uauuccccua

SEQ ID NO: 445918 - RNA, 16 nt, Brucella suis 1330
uauuccccuauucccc

SEQ ID NO: 445919 - RNA, 14 nt, Brucella suis 1330
uauuccgccugcaa

SEQ ID NO: 445920 - RNA, 19 nt, Brucella suis 1330
uauggcgcaaugccugcac

SEQ ID NO: 445921 - RNA, 18 nt, Brucella suis 1330
uaugcggggcgacgcugc

SEQ ID NO: 445922 - RNA, 18 nt, Brucella suis 1330
uaugggcgguauugcugc

SEQ ID NO: 445923 - RNA, 16 nt, Brucella suis 1330
uaugugucauaaaaaa

SEQ ID NO: 445924 - RNA, 19 nt, Brucella suis 1330
uaugcagcguguuggccca

SEQ ID NO: 445925 - RNA, 20 nt, Brucella suis 1330
uaucgcgaagauaagcggca

SEQ ID NO: 445926 - RNA, 14 nt, Brucella suis 1330
uaucggucacagcg

SEQ ID NO: 445927 - RNA, 11 nt, Brucella suis 1330
uauccacgccc

SEQ ID NO: 445928 - RNA, 18 nt, Brucella suis 1330
uauccacgauauguuccg

SEQ ID NO: 445929 - RNA, 19 nt, Brucella suis 1330
uaucagacgguccgccgga

SEQ ID NO: 445930 - RNA, 13 nt, Brucella suis 1330
uauaugcaccagc

SEQ ID NO: 445931 - RNA, 16 nt, Brucella suis 1330
uaucaacgcugcaaca

SEQ ID NO: 445932 - RNA, 17 nt, Brucella suis 1330
uauaagcggcucucaaa

SEQ ID NO: 445933 - RNA, 18 nt, Brucella suis 1330
uaggcuucggccgcuugc

SEQ ID NO: 445934 - RNA, 15 nt, Brucella suis 1330
uaggcccaggccucu

SEQ ID NO: 445935 - RNA, 14 nt, Brucella suis 1330
uaggcauaaucuuu

SEQ ID NO: 445936 - RNA, 17 nt, Brucella suis 1330
uaggcauuuuccuuucu

SEQ ID NO: 445937 - RNA, 15 nt, Brucella suis 1330
uaggauucuccuauu

SEQ ID NO: 445938 - RNA, 23 nt, Brucella suis 1330
uaggcacccuugguugcgcgcca

SEQ ID NO: 445939 - RNA, 20 nt, Brucella suis 1330
uagcggugcuggccguggca

SEQ ID NO: 445940 - RNA, 15 nt, Brucella suis 1330
uagcaacuuccuugc

SEQ ID NO: 445941 - RNA, 15 nt, Brucella suis 1330
uagcagcaacaggca

SEQ ID NO: 445942 - RNA, 20 nt, Brucella suis 1330
uagaugagcugguuuuucac

SEQ ID NO: 445943 - RNA, 22 nt, Brucella suis 1330
uacugcccuauugccuuaaucc

SEQ ID NO: 445944 - RNA, 21 nt, Brucella suis 1330
uacuccccuacucccuuauuc

SEQ ID NO: 445945 - RNA, 21 nt, Brucella suis 1330
uacgcagccgaugccuugauc

SEQ ID NO: 445946 - RNA, 17 nt, Brucella suis 1330
uacgcagcgucgcagac

SEQ ID NO: 445947 - RNA, 21 nt, Brucella suis 1330
uaccgccggggcugccgaugg

SEQ ID NO: 445948 - RNA, 18 nt, Brucella suis 1330
uaaugcgaacaguuucaa

SEQ ID NO: 445949 - RNA, 16 nt, Brucella suis 1330
uaauagucgaaaaaag

SEQ ID NO: 445950 - RNA, 18 nt, Brucella suis 1330
uaauagucgaaaaaagaa

SEQ ID NO: 445951 - RNA, 21 nt, Brucella suis 1330
uaaagccgcuccauucccauu

SEQ ID NO: 445952 - RNA, 17 nt, Brucella suis 1330
uaaaccuuugaaauaau

SEQ ID NO: 445953 - RNA, 19 nt, Brucella suis 1330
uaaaccuuugaaauaauug

SEQ ID NO: 445954 - RNA, 17 nt, Brucella suis 1330
uaaaguacacuccgcuc

SEQ ID NO: 445955 - RNA, 17 nt, Brucella suis 1330
uaaccgucuugaacaga

SEQ ID NO: 445956 - RNA, 19 nt, Brucella suis 1330
guuuuucacauagccugca

SEQ ID NO: 445957 - RNA, 16 nt, Brucella suis 1330
guuuugcguuggaaaa

SEQ ID NO: 445958 - RNA, 14 nt, Brucella suis 1330
guuuugagcugcug

SEQ ID NO: 445959 - RNA, 21 nt, Brucella suis 1330
guuuuccgucugcaucgagcg

SEQ ID NO: 445960 - RNA, 13 nt, Brucella suis 1330
guuuucaaacuuc

SEQ ID NO: 445961 - RNA, 11 nt, Brucella suis 1330
guuuucaccag

SEQ ID NO: 445962 - RNA, 16 nt, Brucella suis 1330
guuuuaucgcauuauc

SEQ ID NO: 445963 - RNA, 16 nt, Brucella suis 1330
guuugcauagggcagu

SEQ ID NO: 445964 - RNA, 15 nt, Brucella suis 1330
guuuguugaaacagg

SEQ ID NO: 445965 - RNA, 18 nt, Brucella suis 1330
guuucagccuccugugca

SEQ ID NO: 445966 - RNA, 14 nt, Brucella suis 1330
guuucagcgccacg

SEQ ID NO: 445967 - RNA, 23 nt, Brucella suis 1330
guuucaguuuguugaaacaggcc

SEQ ID NO: 445968 - RNA, 18 nt, Brucella suis 1330
guuuacuuuucauuaaag

SEQ ID NO: 445969 - RNA, 19 nt, Brucella suis 1330
guuuauucauuggcggcag

SEQ ID NO: 445970 - RNA, 16 nt, Brucella suis 1330
guuucaagcucccaag

SEQ ID NO: 445971 - RNA, 16 nt, Brucella suis 1330
guucucgcaaaacacc

SEQ ID NO: 445972 - RNA, 17 nt, Brucella suis 1330
guucugcgcggaaacca

SEQ ID NO: 445973 - RNA, 12 nt, Brucella suis 1330
guucuaguggau

SEQ ID NO: 445974 - RNA, 18 nt, Brucella suis 1330
guuccgaauacaagccca

SEQ ID NO: 445975 - RNA, 19 nt, Brucella suis 1330
guuccgaccgcaggaccac

SEQ ID NO: 445976 - RNA, 21 nt, Brucella suis 1330
guuccgcaccgcacuggggac

SEQ ID NO: 445977 - RNA, 19 nt, Brucella suis 1330
guuccagacuuccagaagc

SEQ ID NO: 445978 - RNA, 22 nt, Brucella suis 1330
guuccagccguuccucuuccuc

SEQ ID NO: 445979 - RNA, 14 nt, Brucella suis 1330
guuccagggcgcgc

SEQ ID NO: 445980 - RNA, 13 nt, Brucella suis 1330
guucaccgcaacg

SEQ ID NO: 445981 - RNA, 19 nt, Brucella suis 1330
guucacauugacguugaug

SEQ ID NO: 445982 - RNA, 22 nt, Brucella suis 1330
guucacauuucaugaaaaugcc

SEQ ID NO: 445983 - RNA, 16 nt, Brucella suis 1330
guuagcgacuucgggu

SEQ ID NO: 445984 - RNA, 20 nt, Brucella suis 1330
guuaucaagccgguuugcug

SEQ ID NO: 445985 - RNA, 16 nt, Brucella suis 1330
guuaaugccuuugcug

SEQ ID NO: 445986 - RNA, 20 nt, Brucella suis 1330
gugugcuugccgaaaagccg

SEQ ID NO: 445987 - RNA, 19 nt, Brucella suis 1330
gugucgauugccugugcgg

SEQ ID NO: 445988 - RNA, 23 nt, Brucella suis 1330
gugucgauugccugugcggcggc

SEQ ID NO: 445989 - RNA, 15 nt, Brucella suis 1330
guguaggugccgaga

SEQ ID NO: 445990 - RNA, 16 nt, Brucella suis 1330
guguaucaccagaccg

SEQ ID NO: 445991 - RNA, 21 nt, Brucella suis 1330
gugucauagccgaugguccac

SEQ ID NO: 445992 - RNA, 14 nt, Brucella suis 1330
guggucauggccac

SEQ ID NO: 445993 - RNA, 19 nt, Brucella suis 1330
guggucccaaagcgggcug

SEQ ID NO: 445994 - RNA, 18 nt, Brucella suis 1330
guggcgggguguacaaca

SEQ ID NO: 445995 - RNA, 23 nt, Brucella suis 1330
guggagcguacaccgaccagcgc

SEQ ID NO: 445996 - RNA, 20 nt, Brucella suis 1330
guggaacuuugugccgccgc

SEQ ID NO: 445997 - RNA, 17 nt, Brucella suis 1330
guggaaggcgagcaggc

SEQ ID NO: 445998 - RNA, 21 nt, Brucella suis 1330
gugccugacuggcggccaagc

SEQ ID NO: 445999 - RNA, 12 nt, Brucella suis 1330
gugccucaggau

SEQ ID NO: 446000 - RNA, 22 nt, Brucella suis 1330
gugccguaucacgccgcgacuc

SEQ ID NO: 446001 - RNA, 13 nt, Brucella suis 1330
gugccggcaggcu

SEQ ID NO: 446002 - RNA, 15 nt, Brucella suis 1330
gugccggcaggcugu

SEQ ID NO: 446003 - RNA, 15 nt, Brucella suis 1330
gugccauagacgcgc

SEQ ID NO: 446004 - RNA, 15 nt, Brucella suis 1330
gugcagcgugccgug

SEQ ID NO: 446005 - RNA, 15 nt, Brucella suis 1330
gugcacuucgagcag

SEQ ID NO: 446006 - RNA, 22 nt, Brucella suis 1330
gugcacggccaugaagaucaau

SEQ ID NO: 446007 - RNA, 16 nt, Brucella suis 1330
gugcacgaauugcacg

SEQ ID NO: 446008 - RNA, 22 nt, Brucella suis 1330
gugcaaaccuccgacaccagcc

SEQ ID NO: 446009 - RNA, 23 nt, Brucella suis 1330
gugaucagggcaaucugcgcugc

SEQ ID NO: 446010 - RNA, 14 nt, Brucella suis 1330
gugauauugcagac

SEQ ID NO: 446011 - RNA, 17 nt, Brucella suis 1330
gugagcggcaggccgca

SEQ ID NO: 446012 - RNA, 16 nt, Brucella suis 1330
gugagcauggucacgu

SEQ ID NO: 446013 - RNA, 22 nt, Brucella suis 1330
gugacgaucuggaacaguucca

SEQ ID NO: 446014 - RNA, 16 nt, Brucella suis 1330
gugaccagccccugca

SEQ ID NO: 446015 - RNA, 14 nt, Brucella suis 1330
gugacaucaagccc

SEQ ID NO: 446016 - RNA, 15 nt, Brucella suis 1330
gugaagcggauuuua

SEQ ID NO: 446017 - RNA, 18 nt, Brucella suis 1330
gugaagcgcuugccguga

SEQ ID NO: 446018 - RNA, 16 nt, Brucella suis 1330
gugaagugaaaccagc

SEQ ID NO: 446019 - RNA, 20 nt, Brucella suis 1330
gugaauuucggcgacuggca

SEQ ID NO: 446020 - RNA, 19 nt, Brucella suis 1330
gugaaaccagcguggcuuu

SEQ ID NO: 446021 - RNA, 20 nt, Brucella suis 1330
gugaaagacucgaacaggcc

SEQ ID NO: 446022 - RNA, 19 nt, Brucella suis 1330
gucuucuugugaacaugga

SEQ ID NO: 446023 - RNA, 12 nt, Brucella suis 1330
gucuugcucaug

SEQ ID NO: 446024 - RNA, 14 nt, Brucella suis 1330
gucuucgcccggca

SEQ ID NO: 446025 - RNA, 21 nt, Brucella suis 1330
gucuucugagaaaaaaaugcg

SEQ ID NO: 446026 - RNA, 20 nt, Brucella suis 1330
gucuucauagaccccgccug

SEQ ID NO: 446027 - RNA, 16 nt, Brucella suis 1330
gucuuauaguuuucug

SEQ ID NO: 446028 - RNA, 21 nt, Brucella suis 1330
gucuggccugaagccgguucg

SEQ ID NO: 446029 - RNA, 16 nt, Brucella suis 1330
gucuggcgaggcgcug

SEQ ID NO: 446030 - RNA, 16 nt, Brucella suis 1330
gucuagcgccaugagu

SEQ ID NO: 446031 - RNA, 15 nt, Brucella suis 1330
gucgucuagcgccau

SEQ ID NO: 446032 - RNA, 19 nt, Brucella suis 1330
gucgucuuucaguuuuugc

SEQ ID NO: 446033 - RNA, 19 nt, Brucella suis 1330
gucguccagcccugccggc

SEQ ID NO: 446034 - RNA, 19 nt, Brucella suis 1330
gucguccugugcggcugca

SEQ ID NO: 446035 - RNA, 19 nt, Brucella suis 1330
gucgggugaacuggcaagu

SEQ ID NO: 446036 - RNA, 23 nt, Brucella suis 1330
gucgggugccagaucggcaagcg

SEQ ID NO: 446037 - RNA, 19 nt, Brucella suis 1330
gucggcucaucgcgcugcu

SEQ ID NO: 446038 - RNA, 18 nt, Brucella suis 1330
gucggcggcgugggcugc

SEQ ID NO: 446039 - RNA, 13 nt, Brucella suis 1330
gucggcgccgucg

SEQ ID NO: 446040 - RNA, 11 nt, Brucella suis 1330
gucggcauauu

SEQ ID NO: 446041 - RNA, 16 nt, Brucella suis 1330
gucggcaaggcggcuc

SEQ ID NO: 446042 - RNA, 21 nt, Brucella suis 1330
gucgcuacguggcuugaagcu

SEQ ID NO: 446043 - RNA, 15 nt, Brucella suis 1330
gucgcuauuuuucuc

SEQ ID NO: 446044 - RNA, 19 nt, Brucella suis 1330
gucgagcaaugcgccgugc

SEQ ID NO: 446045 - RNA, 16 nt, Brucella suis 1330
guccucgaucaaaccc

SEQ ID NO: 446046 - RNA, 17 nt, Brucella suis 1330
guccguaauaaccgagg

SEQ ID NO: 446047 - RNA, 20 nt, Brucella suis 1330
guccgacauccaucggcuca

SEQ ID NO: 446048 - RNA, 21 nt, Brucella suis 1330
gucccucggggcggucugaaa

SEQ ID NO: 446049 - RNA, 16 nt, Brucella suis 1330
guccagucuucaucga

SEQ ID NO: 446050 - RNA, 18 nt, Brucella suis 1330
guccagcgcguugccuug

SEQ ID NO: 446051 - RNA, 17 nt, Brucella suis 1330
guccagcccugccggcu

SEQ ID NO: 446052 - RNA, 16 nt, Brucella suis 1330
guccagccaggugcug

SEQ ID NO: 446053 - RNA, 17 nt, Brucella suis 1330
guccagaaagagcaucc

SEQ ID NO: 446054 - RNA, 16 nt, Brucella suis 1330
gucauggccacgccag

SEQ ID NO: 446055 - RNA, 21 nt, Brucella suis 1330
gucaugcgcgcccugcagggc

SEQ ID NO: 446056 - RNA, 15 nt, Brucella suis 1330
gucaugcgcggcaug

SEQ ID NO: 446057 - RNA, 17 nt, Brucella suis 1330
gucauauucggccuuga

SEQ ID NO: 446058 - RNA, 18 nt, Brucella suis 1330
gucacaaugugaaugaaa

SEQ ID NO: 446059 - RNA, 21 nt, Brucella suis 1330
gucaaaauggccucagauuca

SEQ ID NO: 446060 - RNA, 18 nt, Brucella suis 1330
gucaccauucacaucgag

SEQ ID NO: 446061 - RNA, 18 nt, Brucella suis 1330
guauuucaaugcugcauc

SEQ ID NO: 446062 - RNA, 12 nt, Brucella suis 1330
guauggcaaaag

SEQ ID NO: 446063 - RNA, 9 nt, Brucella suis 1330
guaucggcg

SEQ ID NO: 446064 - RNA, 19 nt, Brucella suis 1330
guaucgccaaugcccugcu

SEQ ID NO: 446065 - RNA, 22 nt, Brucella suis 1330
guaucgccaaugcccugcugca

SEQ ID NO: 446066 - RNA, 13 nt, Brucella suis 1330
guauccaccagac

SEQ ID NO: 446067 - RNA, 13 nt, Brucella suis 1330
guagcuucugggu

SEQ ID NO: 446068 - RNA, 15 nt, Brucella suis 1330
guagcuucuggguga

SEQ ID NO: 446069 - RNA, 19 nt, Brucella suis 1330
guauagacauucugcacgu

SEQ ID NO: 446070 - RNA, 18 nt, Brucella suis 1330
guagccaugcguuuuugg

SEQ ID NO: 446071 - RNA, 14 nt, Brucella suis 1330
guagcagcaacagg

SEQ ID NO: 446072 - RNA, 23 nt, Brucella suis 1330
guagaaagcgucauaggcagcga

SEQ ID NO: 446073 - RNA, 16 nt, Brucella suis 1330
guacgccauagacgcc

SEQ ID NO: 446074 - RNA, 16 nt, Brucella suis 1330
guacaccgaggccgcc

SEQ ID NO: 446075 - RNA, 17 nt, Brucella suis 1330
guaauucccgcagcaug

SEQ ID NO: 446076 - RNA, 22 nt, Brucella suis 1330
gguuuucggaaaagaugcgcgu

SEQ ID NO: 446077 - RNA, 13 nt, Brucella suis 1330
gguuuugagcugc

SEQ ID NO: 446078 - RNA, 11 nt, Brucella suis 1330
gguuuuucggu

SEQ ID NO: 446079 - RNA, 13 nt, Brucella suis 1330
gguuuuuccaaaa

SEQ ID NO: 446080 - RNA, 22 nt, Brucella suis 1330
gguuggauaauugaucggcugg

SEQ ID NO: 446081 - RNA, 21 nt, Brucella suis 1330
gguugcgccgguguagagcug

SEQ ID NO: 446082 - RNA, 21 nt, Brucella suis 1330
gguucguugaacugcaucaca

SEQ ID NO: 446083 - RNA, 21 nt, Brucella suis 1330
gguucgcucguaacgggagca

SEQ ID NO: 446084 - RNA, 16 nt, Brucella suis 1330
gguucagcccugcaca

SEQ ID NO: 446085 - RNA, 14 nt, Brucella suis 1330
gguucaauacccau

SEQ ID NO: 446086 - RNA, 16 nt, Brucella suis 1330
gguucaauacccaugc

SEQ ID NO: 446087 - RNA, 15 nt, Brucella suis 1330
gguggcauugcccau

SEQ ID NO: 446088 - RNA, 20 nt, Brucella suis 1330
ggugcugcauccuucaagca

SEQ ID NO: 446089 - RNA, 22 nt, Brucella suis 1330
ggugccaucaagcgucaugcca

SEQ ID NO: 446090 - RNA, 22 nt, Brucella suis 1330
ggugccaagaagaagagccugc

SEQ ID NO: 446091 - RNA, 19 nt, Brucella suis 1330
ggugcauuuuuccagaccu

SEQ ID NO: 446092 - RNA, 19 nt, Brucella suis 1330
ggugaggcuggcgccgccg

SEQ ID NO: 446093 - RNA, 15 nt, Brucella suis 1330
gguccccgccgccga

SEQ ID NO: 446094 - RNA, 14 nt, Brucella suis 1330
ggucagcaggcgcc

SEQ ID NO: 446095 - RNA, 20 nt, Brucella suis 1330
ggucaguggcaugggagcac

SEQ ID NO: 446096 - RNA, 17 nt, Brucella suis 1330
ggucagaucaucugcca

SEQ ID NO: 446097 - RNA, 19 nt, Brucella suis 1330
ggucaaaauggccucagau

SEQ ID NO: 446098 - RNA, 23 nt, Brucella suis 1330
gggugcaagcgcaaagcuuucca

SEQ ID NO: 446099 - RNA, 15 nt, Brucella suis 1330
ggggcgacgcugcaa

SEQ ID NO: 446100 - RNA, 16 nt, Brucella suis 1330
ggggccugaaugcaau

SEQ ID NO: 446101 - RNA, 20 nt, Brucella suis 1330
ggggccaaaggucggcggcg

SEQ ID NO: 446102 - RNA, 14 nt, Brucella suis 1330
ggggccgacagggc

SEQ ID NO: 446103 - RNA, 18 nt, Brucella suis 1330
ggggcaaauuucaguccc

SEQ ID NO: 446104 - RNA, 18 nt, Brucella suis 1330
gggcuucugcgcccgcgc

SEQ ID NO: 446105 - RNA, 19 nt, Brucella suis 1330
gggcuguuggccggcagcg

SEQ ID NO: 446106 - RNA, 23 nt, Brucella suis 1330
gggcugucggcaaacauccagcc

SEQ ID NO: 446107 - RNA, 12 nt, Brucella suis 1330
gggcgggcggcc

SEQ ID NO: 446108 - RNA, 12 nt, Brucella suis 1330
gggcggcggccg

SEQ ID NO: 446109 - RNA, 15 nt, Brucella suis 1330
gggcggcggccgggc

SEQ ID NO: 446110 - RNA, 12 nt, Brucella suis 1330
gggcggccagga

SEQ ID NO: 446111 - RNA, 20 nt, Brucella suis 1330
gggcgcuuuauuccuuugau

SEQ ID NO: 446112 - RNA, 18 nt, Brucella suis 1330
gggccucgauuucaucuc

SEQ ID NO: 446113 - RNA, 14 nt, Brucella suis 1330
gggccgcacguucc

SEQ ID NO: 446114 - RNA, 21 nt, Brucella suis 1330
gggcccuuaugaucgccgccc

SEQ ID NO: 446115 - RNA, 15 nt, Brucella suis 1330
gggccaugccugcga

SEQ ID NO: 446116 - RNA, 19 nt, Brucella suis 1330
gggccagguaucgugcaga

SEQ ID NO: 446117 - RNA, 14 nt, Brucella suis 1330
gggcaauagaagga

SEQ ID NO: 446118 - RNA, 22 nt, Brucella suis 1330
gggcaagcauuccgggccgcac

SEQ ID NO: 446119 - RNA, 21 nt, Brucella suis 1330
gggcaaaaucgagugcggccu

SEQ ID NO: 446120 - RNA, 16 nt, Brucella suis 1330
gggauuuucggccagc

SEQ ID NO: 446121 - RNA, 21 nt, Brucella suis 1330
gggauugcgcaagugcugcaa

SEQ ID NO: 446122 - RNA, 15 nt, Brucella suis 1330
gggagagaacacaga

SEQ ID NO: 446123 - RNA, 13 nt, Brucella suis 1330
gggagcagcucua

SEQ ID NO: 446124 - RNA, 18 nt, Brucella suis 1330
gggagaaaagaugggcgc

SEQ ID NO: 446125 - RNA, 15 nt, Brucella suis 1330
gggacgcgugaaaau

SEQ ID NO: 446126 - RNA, 18 nt, Brucella suis 1330
ggcuuuuccggcggcggc

SEQ ID NO: 446127 - RNA, 17 nt, Brucella suis 1330
ggcuuucucguuuucau

SEQ ID NO: 446128 - RNA, 11 nt, Brucella suis 1330
ggcuucuucca

SEQ ID NO: 446129 - RNA, 13 nt, Brucella suis 1330
ggcuugauagcgc

SEQ ID NO: 446130 - RNA, 16 nt, Brucella suis 1330
ggcuucagaucgcgcg

SEQ ID NO: 446131 - RNA, 21 nt, Brucella suis 1330
ggcuuccagcaggcgcgcagc

SEQ ID NO: 446132 - RNA, 16 nt, Brucella suis 1330
ggcuguccgagagcga

SEQ ID NO: 446133 - RNA, 18 nt, Brucella suis 1330
ggccgaugacggcgcggc

SEQ ID NO: 446134 - RNA, 16 nt, Brucella suis 1330
ggccgacagaugcgca

SEQ ID NO: 446135 - RNA, 15 nt, Brucella suis 1330
ggccgaagccgaugc

SEQ ID NO: 446136 - RNA, 20 nt, Brucella suis 1330
ggccgaagccgaugcgcuga

SEQ ID NO: 446137 - RNA, 14 nt, Brucella suis 1330
ggccgaagccgcuu

SEQ ID NO: 446138 - RNA, 20 nt, Brucella suis 1330
ggccgaaggaugcaagccgg

SEQ ID NO: 446139 - RNA, 14 nt, Brucella suis 1330
ggcccgcgugcacg

SEQ ID NO: 446140 - RNA, 22 nt, Brucella suis 1330
ggcccccagaaggcgcggcagc

SEQ ID NO: 446141 - RNA, 11 nt, Brucella suis 1330
ggcccaggccu

SEQ ID NO: 446142 - RNA, 14 nt, Brucella suis 1330
ggcccagauguucc

SEQ ID NO: 446143 - RNA, 17 nt, Brucella suis 1330
ggccauggcuucaagcg

SEQ ID NO: 446144 - RNA, 12 nt, Brucella suis 1330
ggccauagcccc

SEQ ID NO: 446145 - RNA, 18 nt, Brucella suis 1330
ggccaguuuggcugugcu

SEQ ID NO: 446146 - RNA, 15 nt, Brucella suis 1330
ggccagccagcgcau

SEQ ID NO: 446147 - RNA, 18 nt, Brucella suis 1330
ggccagaucgcgcgcggc

SEQ ID NO: 446148 - RNA, 13 nt, Brucella suis 1330
ggccacggcaucc

SEQ ID NO: 446149 - RNA, 15 nt, Brucella suis 1330
ggccacgccagccgc

SEQ ID NO: 446150 - RNA, 20 nt, Brucella suis 1330
ggccacccagcccgaagacc

SEQ ID NO: 446151 - RNA, 21 nt, Brucella suis 1330
ggcaugggcaacccggcggcc

SEQ ID NO: 446152 - RNA, 23 nt, Brucella suis 1330
ggcaugggcaacccggcggccuu

SEQ ID NO: 446153 - RNA, 19 nt, Brucella suis 1330
ggcauggaucaacgcaggc

SEQ ID NO: 446154 - RNA, 11 nt, Brucella suis 1330
ggcaucaaacu

SEQ ID NO: 446155 - RNA, 14 nt, Brucella suis 1330
ggcaguccggcagc

SEQ ID NO: 446156 - RNA, 16 nt, Brucella suis 1330
ggcaguccggcagcac

SEQ ID NO: 446157 - RNA, 14 nt, Brucella suis 1330
ggcauaaaugcccu

SEQ ID NO: 446158 - RNA, 14 nt, Brucella suis 1330
ggcaguagggcagu

SEQ ID NO: 446159 - RNA, 18 nt, Brucella suis 1330
ggcaggccgccugggaga

SEQ ID NO: 446160 - RNA, 14 nt, Brucella suis 1330
ggcaggagccggaa

SEQ ID NO: 446161 - RNA, 12 nt, Brucella suis 1330
ggcagcggcagg

SEQ ID NO: 446162 - RNA, 17 nt, Brucella suis 1330
ggcagcgacccgcgccc

SEQ ID NO: 446163 - RNA, 17 nt, Brucella suis 1330
ggcagccuucgcugccg

SEQ ID NO: 446164 - RNA, 19 nt, Brucella suis 1330
ggcagccucgacacgccgg

SEQ ID NO: 446165 - RNA, 14 nt, Brucella suis 1330
ggcagccgccgccg

SEQ ID NO: 446166 - RNA, 16 nt, Brucella suis 1330
ggcagaccccaucagc

SEQ ID NO: 446167 - RNA, 20 nt, Brucella suis 1330
ggcacgauaugggucugcga

SEQ ID NO: 446168 - RNA, 19 nt, Brucella suis 1330
ggauugccgccaugcccgu

SEQ ID NO: 446169 - RNA, 15 nt, Brucella suis 1330
ggauucuuaugccag

SEQ ID NO: 446170 - RNA, 18 nt, Brucella suis 1330
ggauucgaaccucugacc

SEQ ID NO: 446171 - RNA, 18 nt, Brucella suis 1330
ggauucuccuauugccag

SEQ ID NO: 446172 - RNA, 19 nt, Brucella suis 1330
ggaugcgcggcgccagcgc

SEQ ID NO: 446173 - RNA, 22 nt, Brucella suis 1330
ggaugacuucgguuuccacauc

SEQ ID NO: 446174 - RNA, 15 nt, Brucella suis 1330
ggaucauccauuccu

SEQ ID NO: 446175 - RNA, 21 nt, Brucella suis 1330
ggaucauccuugaugcccagc

SEQ ID NO: 446176 - RNA, 15 nt, Brucella suis 1330
ggaucagaagugcug

SEQ ID NO: 446177 - RNA, 13 nt, Brucella suis 1330
ggauaucgccaga

SEQ ID NO: 446178 - RNA, 14 nt, Brucella suis 1330
ggaggcggcugccu

SEQ ID NO: 446179 - RNA, 20 nt, Brucella suis 1330
ggauaacgcgacaaaacaaa

SEQ ID NO: 446180 - RNA, 22 nt, Brucella suis 1330
ggagcguccgagcggcagcggc

SEQ ID NO: 446181 - RNA, 21 nt, Brucella suis 1330
ggagccuucauugcggccaag

SEQ ID NO: 446182 - RNA, 16 nt, Brucella suis 1330
ggagccgccguaaugg

SEQ ID NO: 446183 - RNA, 12 nt, Brucella suis 1330
ggagcaggccau

SEQ ID NO: 446184 - RNA, 15 nt, Brucella suis 1330
ggagagaggaagcaa

SEQ ID NO: 446185 - RNA, 17 nt, Brucella suis 1330
ggagagaggaagcaaga

SEQ ID NO: 446186 - RNA, 23 nt, Brucella suis 1330
ggacggccgauuuucugcugcgg

SEQ ID NO: 446187 - RNA, 23 nt, Brucella suis 1330
ggaauuccugaaccacuuccgaa

SEQ ID NO: 446188 - RNA, 14 nt, Brucella suis 1330
ggaaucagaccacu

SEQ ID NO: 446189 - RNA, 15 nt, Brucella suis 1330
ggaaggcgagcaggc

SEQ ID NO: 446190 - RNA, 17 nt, Brucella suis 1330
ggaaggcgagcaggccg

SEQ ID NO: 446191 - RNA, 14 nt, Brucella suis 1330
ggaagggaaagcgg

SEQ ID NO: 446192 - RNA, 18 nt, Brucella suis 1330
ggaagcgcaaaacagcgc

SEQ ID NO: 446193 - RNA, 17 nt, Brucella suis 1330
ggaagagaaucuugccc

SEQ ID NO: 446194 - RNA, 16 nt, Brucella suis 1330
ggaacgcaucgagcug

SEQ ID NO: 446195 - RNA, 22 nt, Brucella suis 1330
ggaacgcggccuugucgauccc

SEQ ID NO: 446196 - RNA, 14 nt, Brucella suis 1330
ggaacgagcucccc

SEQ ID NO: 446197 - RNA, 23 nt, Brucella suis 1330
ggaaccagcgugcagccugaaca

SEQ ID NO: 446198 - RNA, 20 nt, Brucella suis 1330
ggaacaggcagcaugaacca

SEQ ID NO: 446199 - RNA, 23 nt, Brucella suis 1330
ggaacauauaaagcaaaggcccc

SEQ ID NO: 446200 - RNA, 17 nt, Brucella suis 1330
ggaaauaucgccgacga

SEQ ID NO: 446201 - RNA, 16 nt, Brucella suis 1330
ggaaaucaguccacug

SEQ ID NO: 446202 - RNA, 18 nt, Brucella suis 1330
ggaaaucaguccacugga

SEQ ID NO: 446203 - RNA, 20 nt, Brucella suis 1330
ggaaauucccgcccgugagg

SEQ ID NO: 446204 - RNA, 17 nt, Brucella suis 1330
ggaaagguguccuccag

SEQ ID NO: 446205 - RNA, 14 nt, Brucella suis 1330
ggaaaaacccggcc

SEQ ID NO: 446206 - RNA, 20 nt, Brucella suis 1330
ggaaaagcuggcauccagca

SEQ ID NO: 446207 - RNA, 22 nt, Brucella suis 1330
gcuuuugcagccgugaaacagu

SEQ ID NO: 446208 - RNA, 21 nt, Brucella suis 1330
gcuuuuguuucaagcucccaa

SEQ ID NO: 446209 - RNA, 14 nt, Brucella suis 1330
gcuuuguauuucaa

SEQ ID NO: 446210 - RNA, 17 nt, Brucella suis 1330
gcuuuguauuucaaugc

SEQ ID NO: 446211 - RNA, 18 nt, Brucella suis 1330
gcuuugcggaggcggcug

SEQ ID NO: 446212 - RNA, 21 nt, Brucella suis 1330
gcuuuucauuuuccucauaaa

SEQ ID NO: 446213 - RNA, 13 nt, Brucella suis 1330
gcuuucgccgccc

SEQ ID NO: 446214 - RNA, 18 nt, Brucella suis 1330
gcuuucaucgccuguucc

SEQ ID NO: 446215 - RNA, 19 nt, Brucella suis 1330
gcuuuccgacagggcaagc

SEQ ID NO: 446216 - RNA, 23 nt, Brucella suis 1330
gcuuuccgcaucgcaauagacca

SEQ ID NO: 446217 - RNA, 15 nt, Brucella suis 1330
gcuuucaauggccgc

SEQ ID NO: 446218 - RNA, 23 nt, Brucella suis 1330
gcuuuauccgcaauacgccuggc

SEQ ID NO: 446219 - RNA, 15 nt, Brucella suis 1330
gcuugucgcggccuu

SEQ ID NO: 446220 - RNA, 20 nt, Brucella suis 1330
gcuuuaaaagcauauugaag

SEQ ID NO: 446221 - RNA, 23 nt, Brucella suis 1330
gcuuggauacgucacccgccuug

SEQ ID NO: 446222 - RNA, 12 nt, Brucella suis 1330
gcuugcuugcca

SEQ ID NO: 446223 - RNA, 19 nt, Brucella suis 1330
gcuugccguuggcauccac

SEQ ID NO: 446224 - RNA, 23 nt, Brucella suis 1330
gcuugccggaaagguguccucca

SEQ ID NO: 446225 - RNA, 13 nt, Brucella suis 1330
gcuugcaaugagc

SEQ ID NO: 446226 - RNA, 18 nt, Brucella suis 1330
gcuugaucgccgcacggc

SEQ ID NO: 446227 - RNA, 15 nt, Brucella suis 1330
gcuugaacccgccga

SEQ ID NO: 446228 - RNA, 20 nt, Brucella suis 1330
gcuugaaauaaucgagaucg

SEQ ID NO: 446229 - RNA, 12 nt, Brucella suis 1330
gcuucuuccagu

SEQ ID NO: 446230 - RNA, 20 nt, Brucella suis 1330
gcuucuuccaguuccuucuu

SEQ ID NO: 446231 - RNA, 13 nt, Brucella suis 1330
gcuucucccaaag

SEQ ID NO: 446232 - RNA, 15 nt, Brucella suis 1330
gcuucucccaaagcg

SEQ ID NO: 446233 - RNA, 19 nt, Brucella suis 1330
gcuucucccaaagcgggcg

SEQ ID NO: 446234 - RNA, 18 nt, Brucella suis 1330
gcuucgcuccgcaccuca

SEQ ID NO: 446235 - RNA, 19 nt, Brucella suis 1330
gcuucgcuccgcaccucag

SEQ ID NO: 446236 - RNA, 15 nt, Brucella suis 1330
gcuucgcuucgcucc

SEQ ID NO: 446237 - RNA, 20 nt, Brucella suis 1330
gcuucgcgcaggccgcggca

SEQ ID NO: 446238 - RNA, 23 nt, Brucella suis 1330
gcuucgaggaaccagagugccuu

SEQ ID NO: 446239 - RNA, 16 nt, Brucella suis 1330
gcuucgcacuuuugcu

SEQ ID NO: 446240 - RNA, 14 nt, Brucella suis 1330
gcuuccuuuucggc

SEQ ID NO: 446241 - RNA, 18 nt, Brucella suis 1330
gcuuccggcguggugagc

SEQ ID NO: 446242 - RNA, 12 nt, Brucella suis 1330
gcuuccggcugc

SEQ ID NO: 446243 - RNA, 18 nt, Brucella suis 1330
gcuuccguaucuccgggc

SEQ ID NO: 446244 - RNA, 17 nt, Brucella suis 1330
gcuuccgucagggccga

SEQ ID NO: 446245 - RNA, 13 nt, Brucella suis 1330
gcuuccaugccca

SEQ ID NO: 446246 - RNA, 11 nt, Brucella suis 1330
gcuuccagcau

SEQ ID NO: 446247 - RNA, 12 nt, Brucella suis 1330
gcuuccagcauc

SEQ ID NO: 446248 - RNA, 17 nt, Brucella suis 1330
gcuuccagcgccucaua

SEQ ID NO: 446249 - RNA, 13 nt, Brucella suis 1330
gcuucaucgcggc

SEQ ID NO: 446250 - RNA, 16 nt, Brucella suis 1330
gcuucaucuucuuggu

SEQ ID NO: 446251 - RNA, 21 nt, Brucella suis 1330
gcuucaggcacucuccucugc

SEQ ID NO: 446252 - RNA, 13 nt, Brucella suis 1330
gcuucaacaugca

SEQ ID NO: 446253 - RNA, 17 nt, Brucella suis 1330
gcuucaacgccguggcg

SEQ ID NO: 446254 - RNA, 14 nt, Brucella suis 1330
gcuucaaucaggau

SEQ ID NO: 446255 - RNA, 17 nt, Brucella suis 1330
gcuucacauccuucacu

SEQ ID NO: 446256 - RNA, 16 nt, Brucella suis 1330
gcuuaguuguuuucuu

SEQ ID NO: 446257 - RNA, 17 nt, Brucella suis 1330
gcuuaucaaggccgggc

SEQ ID NO: 446258 - RNA, 16 nt, Brucella suis 1330
gcuuaugugaagauuu

SEQ ID NO: 446259 - RNA, 16 nt, Brucella suis 1330
gcuuaacccaaccacc

SEQ ID NO: 446260 - RNA, 15 nt, Brucella suis 1330
gcuguugcgcccgcc

SEQ ID NO: 446261 - RNA, 16 nt, Brucella suis 1330
gcugucguuccaauuc

SEQ ID NO: 446262 - RNA, 14 nt, Brucella suis 1330
gcugucgccagcgc

SEQ ID NO: 446263 - RNA, 15 nt, Brucella suis 1330
gcugucgccagcgcc

SEQ ID NO: 446264 - RNA, 14 nt, Brucella suis 1330
gcugucgaaugucu

SEQ ID NO: 446265 - RNA, 13 nt, Brucella suis 1330
gcugguuuuucac

SEQ ID NO: 446266 - RNA, 14 nt, Brucella suis 1330
gcugguuggccaga

SEQ ID NO: 446267 - RNA, 23 nt, Brucella suis 1330
gcuggucuggcgaggcgcugaug

SEQ ID NO: 446268 - RNA, 14 nt, Brucella suis 1330
gcugguccauacgg

SEQ ID NO: 446269 - RNA, 23 nt, Brucella suis 1330
gcuggcuccagucgaggcagcca

SEQ ID NO: 446270 - RNA, 15 nt, Brucella suis 1330
gcuggcggccaagcg

SEQ ID NO: 446271 - RNA, 12 nt, Brucella suis 1330
gcuggcgcgcug

SEQ ID NO: 446272 - RNA, 13 nt, Brucella suis 1330
gcuggcauccagc

SEQ ID NO: 446273 - RNA, 23 nt, Brucella suis 1330
gcuggcauccagcacuuccagau

SEQ ID NO: 446274 - RNA, 16 nt, Brucella suis 1330
gcuggcagcggcagga

SEQ ID NO: 446275 - RNA, 14 nt, Brucella suis 1330
gcuggcacaaagcg

SEQ ID NO: 446276 - RNA, 14 nt, Brucella suis 1330
gcuggaugaucuuu

SEQ ID NO: 446277 - RNA, 22 nt, Brucella suis 1330
gcuggaugaucuuugucggguc

SEQ ID NO: 446278 - RNA, 19 nt, Brucella suis 1330
gcuggaacuggcgcauggc

SEQ ID NO: 446279 - RNA, 21 nt, Brucella suis 1330
gcuggaacaauuccagccggg

SEQ ID NO: 446280 - RNA, 22 nt, Brucella suis 1330
gcugcuuccacaggcgccagcc

SEQ ID NO: 446281 - RNA, 14 nt, Brucella suis 1330
gcugcucgcgcaag

SEQ ID NO: 446282 - RNA, 13 nt, Brucella suis 1330
gcugcgugcugcu

SEQ ID NO: 446283 - RNA, 15 nt, Brucella suis 1330
gcugcggccaugcgc

SEQ ID NO: 446284 - RNA, 16 nt, Brucella suis 1330
gcugcggccaugcgca

SEQ ID NO: 446285 - RNA, 23 nt, Brucella suis 1330
gcugcggaucuucgaucauuucc

SEQ ID NO: 446286 - RNA, 14 nt, Brucella suis 1330
gcugccugcggugc

SEQ ID NO: 446287 - RNA, 16 nt, Brucella suis 1330
gcugccugcggugcug

SEQ ID NO: 446288 - RNA, 19 nt, Brucella suis 1330
gcugccgcacagcaucaug

SEQ ID NO: 446289 - RNA, 18 nt, Brucella suis 1330
gcugccccauaugacgcg

SEQ ID NO: 446290 - RNA, 15 nt, Brucella suis 1330
gcugauucuggauuu

SEQ ID NO: 446291 - RNA, 21 nt, Brucella suis 1330
gcugauucuggauuucaucca

SEQ ID NO: 446292 - RNA, 19 nt, Brucella suis 1330
gcugcaaagggugcaagcg

SEQ ID NO: 446293 - RNA, 12 nt, Brucella suis 1330
gcugcaacaaaa

SEQ ID NO: 446294 - RNA, 16 nt, Brucella suis 1330
gcugcaacaaaaugcc

SEQ ID NO: 446295 - RNA, 14 nt, Brucella suis 1330
gcugaugcggauga

SEQ ID NO: 446296 - RNA, 18 nt, Brucella suis 1330
gcugaucggcgcaggggc

SEQ ID NO: 446297 - RNA, 20 nt, Brucella suis 1330
gcugaucggcgcaggggccg

SEQ ID NO: 446298 - RNA, 13 nt, Brucella suis 1330
gcugaugagccgc

SEQ ID NO: 446299 - RNA, 21 nt, Brucella suis 1330
gcugauauugugucagcgggc

SEQ ID NO: 446300 - RNA, 21 nt, Brucella suis 1330
gcugaguuuuccgcuuucuuc

SEQ ID NO: 446301 - RNA, 20 nt, Brucella suis 1330
gcugaggcggccggagcgca

SEQ ID NO: 446302 - RNA, 22 nt, Brucella suis 1330
gcugagggaaacacucugccug

SEQ ID NO: 446303 - RNA, 13 nt, Brucella suis 1330
gcugaacauggcu

SEQ ID NO: 446304 - RNA, 16 nt, Brucella suis 1330
gcucuucgcauugccg

SEQ ID NO: 446305 - RNA, 14 nt, Brucella suis 1330
gcucuauuuuucca

SEQ ID NO: 446306 - RNA, 14 nt, Brucella suis 1330
gcucucaaaaaggu

SEQ ID NO: 446307 - RNA, 19 nt, Brucella suis 1330
gcucucacgcgcagcagca

SEQ ID NO: 446308 - RNA, 19 nt, Brucella suis 1330
gcucguccggccagccgac

SEQ ID NO: 446309 - RNA, 18 nt, Brucella suis 1330
gcuccugcgucgcaucca

SEQ ID NO: 446310 - RNA, 19 nt, Brucella suis 1330
gcuccugcgucgcauccag

SEQ ID NO: 446311 - RNA, 18 nt, Brucella suis 1330
gcuccuuaaccuuuuucc

SEQ ID NO: 446312 - RNA, 12 nt, Brucella suis 1330
gcuccugcaugu

SEQ ID NO: 446313 - RNA, 16 nt, Brucella suis 1330
gcucccggucuuccug

SEQ ID NO: 446314 - RNA, 17 nt, Brucella suis 1330
gcucccggucuuccugc

SEQ ID NO: 446315 - RNA, 19 nt, Brucella suis 1330
gcucccgaaggauuuucca

SEQ ID NO: 446316 - RNA, 17 nt, Brucella suis 1330
gcuccagucgaggcagc

SEQ ID NO: 446317 - RNA, 21 nt, Brucella suis 1330
gcuccacuagaucagagcggu

SEQ ID NO: 446318 - RNA, 13 nt, Brucella suis 1330
gcucaugcgggug

SEQ ID NO: 446319 - RNA, 18 nt, Brucella suis 1330
gcuccacacgaacagcag

SEQ ID NO: 446320 - RNA, 19 nt, Brucella suis 1330
gcuccacacgaacagcagc

SEQ ID NO: 446321 - RNA, 22 nt, Brucella suis 1330
gcuaugcucuugcggcuugaaa

SEQ ID NO: 446322 - RNA, 22 nt, Brucella suis 1330
gcuaugcgcaauugcgcgccug

SEQ ID NO: 446323 - RNA, 14 nt, Brucella suis 1330
gcuauaagcaacag

SEQ ID NO: 446324 - RNA, 20 nt, Brucella suis 1330
gcuaucacguuggggcgccg

SEQ ID NO: 446325 - RNA, 17 nt, Brucella suis 1330
gcuaucgcugcuuuacc

SEQ ID NO: 446326 - RNA, 22 nt, Brucella suis 1330
gcuaucgcugcuuuaccacgau

SEQ ID NO: 446327 - RNA, 16 nt, Brucella suis 1330
gcguuccagccguucc

SEQ ID NO: 446328 - RNA, 16 nt, Brucella suis 1330
gcguguuugcggccuu

SEQ ID NO: 446329 - RNA, 14 nt, Brucella suis 1330
gcgugaugagccgc

SEQ ID NO: 446330 - RNA, 17 nt, Brucella suis 1330
gcgugaccagccccugc

SEQ ID NO: 446331 - RNA, 19 nt, Brucella suis 1330
gcgugauaggcgacacggc

SEQ ID NO: 446332 - RNA, 22 nt, Brucella suis 1330
gcguccuuuuuugaucucggag

SEQ ID NO: 446333 - RNA, 18 nt, Brucella suis 1330
gcguccgccaccgccggc

SEQ ID NO: 446334 - RNA, 16 nt, Brucella suis 1330
gcguccgagcggcagc

SEQ ID NO: 446335 - RNA, 16 nt, Brucella suis 1330
gcguccauccggcggc

SEQ ID NO: 446336 - RNA, 17 nt, Brucella suis 1330
gcgucagggcauugccg

SEQ ID NO: 446337 - RNA, 17 nt, Brucella suis 1330
gcgucaccgugcgcaau

SEQ ID NO: 446338 - RNA, 19 nt, Brucella suis 1330
gcgucacgucauaggcaau

SEQ ID NO: 446339 - RNA, 13 nt, Brucella suis 1330
gcgucaacaggcu

SEQ ID NO: 446340 - RNA, 14 nt, Brucella suis 1330
gcgucaacaggcug

SEQ ID NO: 446341 - RNA, 16 nt, Brucella suis 1330
gcggucucgaagauca

SEQ ID NO: 446342 - RNA, 19 nt, Brucella suis 1330
gcggucugcuugccgccga

SEQ ID NO: 446343 - RNA, 23 nt, Brucella suis 1330
gcgguaauaacgacgcccgcccc

SEQ ID NO: 446344 - RNA, 13 nt, Brucella suis 1330
gcgggggcggcgg

SEQ ID NO: 446345 - RNA, 13 nt, Brucella suis 1330
gcgggcggcggcu

SEQ ID NO: 446346 - RNA, 22 nt, Brucella suis 1330
gcgggagcggcacaugaaauaa

SEQ ID NO: 446347 - RNA, 20 nt, Brucella suis 1330
gcgggagauguguaggcugg

SEQ ID NO: 446348 - RNA, 23 nt, Brucella suis 1330
gcgggaauagcaacuuccuugcc

SEQ ID NO: 446349 - RNA, 20 nt, Brucella suis 1330
gcgggaaaaaucgcgcggcu

SEQ ID NO: 446350 - RNA, 16 nt, Brucella suis 1330
gcggcuuucgccgccc

SEQ ID NO: 446351 - RNA, 18 nt, Brucella suis 1330
gcggcuuuccagcgggcg

SEQ ID NO: 446352 - RNA, 13 nt, Brucella suis 1330
gcggcuggcuucu

SEQ ID NO: 446353 - RNA, 16 nt, Brucella suis 1330
gcggcguuuuccauga

SEQ ID NO: 446354 - RNA, 15 nt, Brucella suis 1330
gcggcguggaaagcu

SEQ ID NO: 446355 - RNA, 15 nt, Brucella suis 1330
gcggcgugccgggcg

SEQ ID NO: 446356 - RNA, 21 nt, Brucella suis 1330
gcggcgguucggcugccuugg

SEQ ID NO: 446357 - RNA, 19 nt, Brucella suis 1330
gcggcgguuuugagcugcu

SEQ ID NO: 446358 - RNA, 20 nt, Brucella suis 1330
gcggcgguuuugagcugcug

SEQ ID NO: 446359 - RNA, 15 nt, Brucella suis 1330
gcggcggucaguucc

SEQ ID NO: 446360 - RNA, 14 nt, Brucella suis 1330
gcggcggucggccu

SEQ ID NO: 446361 - RNA, 14 nt, Brucella suis 1330
gcggcggauuucau

SEQ ID NO: 446362 - RNA, 20 nt, Brucella suis 1330
gcggcggauaaugcucgccc

SEQ ID NO: 446363 - RNA, 13 nt, Brucella suis 1330
gcggcgccagcgc

SEQ ID NO: 446364 - RNA, 15 nt, Brucella suis 1330
gcggcgcauggccuc

SEQ ID NO: 446365 - RNA, 20 nt, Brucella suis 1330
gcggcgcaaagcccagccgu

SEQ ID NO: 446366 - RNA, 16 nt, Brucella suis 1330
gcggcacccccggcag

SEQ ID NO: 446367 - RNA, 16 nt, Brucella suis 1330
gcggcaagcgcgugga

SEQ ID NO: 446368 - RNA, 21 nt, Brucella suis 1330
gcggauuugaggauugccgcc

SEQ ID NO: 446369 - RNA, 23 nt, Brucella suis 1330
gcggauuugaggauugccgccgc

SEQ ID NO: 446370 - RNA, 19 nt, Brucella suis 1330
gcggauggaccggcugguc

SEQ ID NO: 446371 - RNA, 15 nt, Brucella suis 1330
gcggaugaagcgccg

SEQ ID NO: 446372 - RNA, 14 nt, Brucella suis 1330
gcggaucgggcgca

SEQ ID NO: 446373 - RNA, 16 nt, Brucella suis 1330
gcggaucgggcgcagc

SEQ ID NO: 446374 - RNA, 18 nt, Brucella suis 1330
gcggaucagcuugccgcc

SEQ ID NO: 446375 - RNA, 20 nt, Brucella suis 1330
gcggauaguucaaggcugcu

SEQ ID NO: 446376 - RNA, 21 nt, Brucella suis 1330
gcggauaguucaaggcugcug

SEQ ID NO: 446377 - RNA, 19 nt, Brucella suis 1330
gcggaauucauccgccuug

SEQ ID NO: 446378 - RNA, 16 nt, Brucella suis 1330
gcggaacaggcagcau

SEQ ID NO: 446379 - RNA, 18 nt, Brucella suis 1330
gcggaacccacgcacggu

SEQ ID NO: 446380 - RNA, 17 nt, Brucella suis 1330
gcgcuuugcaagcggca

SEQ ID NO: 446381 - RNA, 16 nt, Brucella suis 1330
gcgcuuuaaagcagga

SEQ ID NO: 446382 - RNA, 16 nt, Brucella suis 1330
gcgcuucgcgcaggcc

SEQ ID NO: 446383 - RNA, 18 nt, Brucella suis 1330
gcgcugaagccguuccau

SEQ ID NO: 446384 - RNA, 20 nt, Brucella suis 1330
gcgcugaagccguuccauga

SEQ ID NO: 446385 - RNA, 15 nt, Brucella suis 1330
gcgcugaagcggccu

SEQ ID NO: 446386 - RNA, 16 nt, Brucella suis 1330
gcgcugaagcggccua

SEQ ID NO: 446387 - RNA, 17 nt, Brucella suis 1330
gcgcgcgugagcgcgca

SEQ ID NO: 446388 - RNA, 12 nt, Brucella suis 1330
gcgcgcgcggcu

SEQ ID NO: 446389 - RNA, 14 nt, Brucella suis 1330
gcgcgccgaugggc

SEQ ID NO: 446390 - RNA, 19 nt, Brucella suis 1330
gcgcgcccgucaccggcug

SEQ ID NO: 446391 - RNA, 19 nt, Brucella suis 1330
gcgccuuuucuucauccag

SEQ ID NO: 446392 - RNA, 23 nt, Brucella suis 1330
gcgccuuuucuucauccaguucg

SEQ ID NO: 446393 - RNA, 13 nt, Brucella suis 1330
gcgccuggcgcug

SEQ ID NO: 446394 - RNA, 16 nt, Brucella suis 1330
gcgccucacccuccac

SEQ ID NO: 446395 - RNA, 21 nt, Brucella suis 1330
gcgccggggccaaaggcggcu

SEQ ID NO: 446396 - RNA, 22 nt, Brucella suis 1330
gcgccgggaaauuucagccaug

SEQ ID NO: 446397 - RNA, 22 nt, Brucella suis 1330
gcgccgggauuuucggccagcg

SEQ ID NO: 446398 - RNA, 21 nt, Brucella suis 1330
gcgccggaagauggagcggcu

SEQ ID NO: 446399 - RNA, 22 nt, Brucella suis 1330
gcgccggaagauggagcggcug

SEQ ID NO: 446400 - RNA, 19 nt, Brucella suis 1330
gcgccgccuucaaaacgca

SEQ ID NO: 446401 - RNA, 18 nt, Brucella suis 1330
gcgcccacgugagagguc

SEQ ID NO: 446402 - RNA, 15 nt, Brucella suis 1330
gcgccagugcgccac

SEQ ID NO: 446403 - RNA, 19 nt, Brucella suis 1330
gcgccauaaccucgacggc

SEQ ID NO: 446404 - RNA, 13 nt, Brucella suis 1330
gcgccacgcgggc

SEQ ID NO: 446405 - RNA, 21 nt, Brucella suis 1330
gcgccaccgucaccggcuggg

SEQ ID NO: 446406 - RNA, 16 nt, Brucella suis 1330
gcgccaauccagguca

SEQ ID NO: 446407 - RNA, 18 nt, Brucella suis 1330
gcgccaauccaggucagc

SEQ ID NO: 446408 - RNA, 17 nt, Brucella suis 1330
gcgcauucaggcggccu

SEQ ID NO: 446409 - RNA, 17 nt, Brucella suis 1330
gcgcaugaagcgcggcg

SEQ ID NO: 446410 - RNA, 22 nt, Brucella suis 1330
gcgcaucgguggcauugcccau

SEQ ID NO: 446411 - RNA, 20 nt, Brucella suis 1330
gcgcaucgacaaucuccccu

SEQ ID NO: 446412 - RNA, 13 nt, Brucella suis 1330
gcgcaucccgaaa

SEQ ID NO: 446413 - RNA, 19 nt, Brucella suis 1330
gcgcaucccgaaaagugug

SEQ ID NO: 446414 - RNA, 23 nt, Brucella suis 1330
gcgcaguuucgcagccaagaucg

SEQ ID NO: 446415 - RNA, 16 nt, Brucella suis 1330
gcgcaguucgcgcauc

SEQ ID NO: 446416 - RNA, 20 nt, Brucella suis 1330
gcgcagugccuuugccuccg

SEQ ID NO: 446417 - RNA, 11 nt, Brucella suis 1330
gcgcagcgaca

SEQ ID NO: 446418 - RNA, 17 nt, Brucella suis 1330
gcgcagcgacagcggcg

SEQ ID NO: 446419 - RNA, 17 nt, Brucella suis 1330
gcgcagccgcgucagcc

SEQ ID NO: 446420 - RNA, 23 nt, Brucella suis 1330
gcgcagaaugagcuugcgcccgc

SEQ ID NO: 446421 - RNA, 15 nt, Brucella suis 1330
gcgcacuggcagcau

SEQ ID NO: 446422 - RNA, 16 nt, Brucella suis 1330
gcgcacuggcagcaug

SEQ ID NO: 446423 - RNA, 23 nt, Brucella suis 1330
gcgcaccauucuugcgcccucca

SEQ ID NO: 446424 - RNA, 20 nt, Brucella suis 1330
gcgcacauauuugccauagc

SEQ ID NO: 446425 - RNA, 14 nt, Brucella suis 1330
gcgcaaggcggcgc

SEQ ID NO: 446426 - RNA, 17 nt, Brucella suis 1330
gcgcaacuuuguuguug

SEQ ID NO: 446427 - RNA, 23 nt, Brucella suis 1330
gcgcaagaaggcguucgcgggcg

SEQ ID NO: 446428 - RNA, 18 nt, Brucella suis 1330
gcgaugcgccagcgauga

SEQ ID NO: 446429 - RNA, 22 nt, Brucella suis 1330
gcgagcggacggauggcaugga

SEQ ID NO: 446430 - RNA, 20 nt, Brucella suis 1330
gcgagcgucuuggcgucggu

SEQ ID NO: 446431 - RNA, 22 nt, Brucella suis 1330
gcgagcgcgccacggauuucca

SEQ ID NO: 446432 - RNA, 15 nt, Brucella suis 1330
gcgagacagacugga

SEQ ID NO: 446433 - RNA, 16 nt, Brucella suis 1330
gcgagaacuucccgcc

SEQ ID NO: 446434 - RNA, 18 nt, Brucella suis 1330
gcgagaacuucccgcccg

SEQ ID NO: 446435 - RNA, 22 nt, Brucella suis 1330
gcgacguagggcgcgagcacgc

SEQ ID NO: 446436 - RNA, 18 nt, Brucella suis 1330
gcgacgggcgagcgccag

SEQ ID NO: 446437 - RNA, 19 nt, Brucella suis 1330
gcgacggaaacgagcgcgc

SEQ ID NO: 446438 - RNA, 13 nt, Brucella suis 1330
gcgacgcgcucgu

SEQ ID NO: 446439 - RNA, 12 nt, Brucella suis 1330
gcgacgccgccc

SEQ ID NO: 446440 - RNA, 12 nt, Brucella suis 1330
gcgacaucauca

SEQ ID NO: 446441 - RNA, 16 nt, Brucella suis 1330
gcgacauagccgaucu

SEQ ID NO: 446442 - RNA, 16 nt, Brucella suis 1330
gcgacauugaggcugu

SEQ ID NO: 446443 - RNA, 17 nt, Brucella suis 1330
gcgacaggguaagcgcc

SEQ ID NO: 446444 - RNA, 13 nt, Brucella suis 1330
gcgacagcggcgc

SEQ ID NO: 446445 - RNA, 15 nt, Brucella suis 1330
gcgacagcggcgcgc

SEQ ID NO: 446446 - RNA, 15 nt, Brucella suis 1330
gcgaagcgaugacgg

SEQ ID NO: 446447 - RNA, 23 nt, Brucella suis 1330
gcgaagcgaugacggagcguccg

SEQ ID NO: 446448 - RNA, 20 nt, Brucella suis 1330
gcgaagcucaucggguucug

SEQ ID NO: 446449 - RNA, 12 nt, Brucella suis 1330
gcgaagaacaga

SEQ ID NO: 446450 - RNA, 13 nt, Brucella suis 1330
gcgaaagcgauga

SEQ ID NO: 446451 - RNA, 20 nt, Brucella suis 1330
gcgaaacggcagccgaggcg

SEQ ID NO: 446452 - RNA, 18 nt, Brucella suis 1330
gcgaaaaugauagcugca

SEQ ID NO: 446453 - RNA, 22 nt, Brucella suis 1330
gccguuuucaucaaauuugaug

SEQ ID NO: 446454 - RNA, 23 nt, Brucella suis 1330
gcgaaaagccgccucugucaccu

SEQ ID NO: 446455 - RNA, 17 nt, Brucella suis 1330
gccguuccucuuccuca

SEQ ID NO: 446456 - RNA, 18 nt, Brucella suis 1330
gccguuauuucgcgcgca

SEQ ID NO: 446457 - RNA, 22 nt, Brucella suis 1330
gccgugaaacagugccgccauc

SEQ ID NO: 446458 - RNA, 16 nt, Brucella suis 1330
gccgucgagggcaccg

SEQ ID NO: 446459 - RNA, 22 nt, Brucella suis 1330
gccguccccacgggauggcggc

SEQ ID NO: 446460 - RNA, 21 nt, Brucella suis 1330
gccgucccggaagccgccuuc

SEQ ID NO: 446461 - RNA, 17 nt, Brucella suis 1330
gccguaucacgccgcga

SEQ ID NO: 446462 - RNA, 18 nt, Brucella suis 1330
gccgguucggucccgucc

SEQ ID NO: 446463 - RNA, 19 nt, Brucella suis 1330
gccggugcugucgcccaga

SEQ ID NO: 446464 - RNA, 13 nt, Brucella suis 1330
gccggugcccgga

SEQ ID NO: 446465 - RNA, 12 nt, Brucella suis 1330
gccgguccagau

SEQ ID NO: 446466 - RNA, 15 nt, Brucella suis 1330
gccggucaaaacgcc

SEQ ID NO: 446467 - RNA, 18 nt, Brucella suis 1330
gccggucaaaacgccccg

SEQ ID NO: 446468 - RNA, 23 nt, Brucella suis 1330
gccggucaaaacgccccggcaug

SEQ ID NO: 446469 - RNA, 16 nt, Brucella suis 1330
gccgguauccagcaga

SEQ ID NO: 446470 - RNA, 21 nt, Brucella suis 1330
gccgguauccagcagauccgu

SEQ ID NO: 446471 - RNA, 13 nt, Brucella suis 1330
gccgggcgcgcgc

SEQ ID NO: 446472 - RNA, 19 nt, Brucella suis 1330
gccgggcggaucggcagga

SEQ ID NO: 446473 - RNA, 13 nt, Brucella suis 1330
gccgggaaaucug

SEQ ID NO: 446474 - RNA, 20 nt, Brucella suis 1330
gccggacgugacaucaagcc

SEQ ID NO: 446475 - RNA, 17 nt, Brucella suis 1330
gccgcuucugcucacca

SEQ ID NO: 446476 - RNA, 23 nt, Brucella suis 1330
gccgcuucugcucaccaaaaggc

SEQ ID NO: 446477 - RNA, 22 nt, Brucella suis 1330
gccgcugcgcagaagauugaug

SEQ ID NO: 446478 - RNA, 13 nt, Brucella suis 1330
gccgcugccugca

SEQ ID NO: 446479 - RNA, 13 nt, Brucella suis 1330
gccgcuccagccg

SEQ ID NO: 446480 - RNA, 16 nt, Brucella suis 1330
gccgcuccagccgagc

SEQ ID NO: 446481 - RNA, 16 nt, Brucella suis 1330
gccgcgucagccgguu

SEQ ID NO: 446482 - RNA, 12 nt, Brucella suis 1330
gccgcgcgggcu

SEQ ID NO: 446483 - RNA, 20 nt, Brucella suis 1330
gccgcgcgggcaagcgggaa

SEQ ID NO: 446484 - RNA, 22 nt, Brucella suis 1330
gccgcgcgcggcuuccagcgcc

SEQ ID NO: 446485 - RNA, 23 nt, Brucella suis 1330
gccgcgcgcggcuuccagcgccu

SEQ ID NO: 446486 - RNA, 22 nt, Brucella suis 1330
gccgcgauaucgucgcgcucgc

SEQ ID NO: 446487 - RNA, 22 nt, Brucella suis 1330
gccgcgaucacggccauugccc

SEQ ID NO: 446488 - RNA, 17 nt, Brucella suis 1330
gccgccuucggcugcuu

SEQ ID NO: 446489 - RNA, 12 nt, Brucella suis 1330
gccgccggugcu

SEQ ID NO: 446490 - RNA, 15 nt, Brucella suis 1330
gccgccgcgcggcag

SEQ ID NO: 446491 - RNA, 14 nt, Brucella suis 1330
gccgcaauccuggu

SEQ ID NO: 446492 - RNA, 20 nt, Brucella suis 1330
gccgcaauccuggugcgcag

SEQ ID NO: 446493 - RNA, 16 nt, Brucella suis 1330
gccgcaaugagcccgc

SEQ ID NO: 446494 - RNA, 15 nt, Brucella suis 1330
gccgcaaaggcaggc

SEQ ID NO: 446495 - RNA, 17 nt, Brucella suis 1330
gccgauaagugccgcgc

SEQ ID NO: 446496 - RNA, 19 nt, Brucella suis 1330
gccgaggaggggacgcagc

SEQ ID NO: 446497 - RNA, 13 nt, Brucella suis 1330
gccgagcgccgcc

SEQ ID NO: 446498 - RNA, 17 nt, Brucella suis 1330
gccgagcgccgccgcga

SEQ ID NO: 446499 - RNA, 15 nt, Brucella suis 1330
gccgagcauggccug

SEQ ID NO: 446500 - RNA, 22 nt, Brucella suis 1330
gccgagcauggccugcgcaccg

SEQ ID NO: 446501 - RNA, 17 nt, Brucella suis 1330
gccgagauugggcagca

SEQ ID NO: 446502 - RNA, 12 nt, Brucella suis 1330
gccgacgcgcgu

SEQ ID NO: 446503 - RNA, 14 nt, Brucella suis 1330
gccgacgcgcguga

SEQ ID NO: 446504 - RNA, 13 nt, Brucella suis 1330
gccgaccagaacg

SEQ ID NO: 446505 - RNA, 20 nt, Brucella suis 1330
gccgacaaaaaacaccgcgc

SEQ ID NO: 446506 - RNA, 16 nt, Brucella suis 1330
gccgaauuccgccaug

SEQ ID NO: 446507 - RNA, 17 nt, Brucella suis 1330
gccgaaggaugcaagcc

SEQ ID NO: 446508 - RNA, 21 nt, Brucella suis 1330
gccgaaauuggccgcugccug

SEQ ID NO: 446509 - RNA, 16 nt, Brucella suis 1330
gccgaaaauggugaug

SEQ ID NO: 446510 - RNA, 16 nt, Brucella suis 1330
gccgaaaaucggcacu

SEQ ID NO: 446511 - RNA, 16 nt, Brucella suis 1330
gcccuuuuugaagcca

SEQ ID NO: 446512 - RNA, 15 nt, Brucella suis 1330
gccgaaaaccaccuu

SEQ ID NO: 446513 - RNA, 12 nt, Brucella suis 1330
gccgaaaagccg

SEQ ID NO: 446514 - RNA, 17 nt, Brucella suis 1330
gcccuuggcgcucauga

SEQ ID NO: 446515 - RNA, 15 nt, Brucella suis 1330
gcccuugucgcgcaa

SEQ ID NO: 446516 - RNA, 16 nt, Brucella suis 1330
gcccuuccgggccgca

SEQ ID NO: 446517 - RNA, 14 nt, Brucella suis 1330
gcccuucgcagcua

SEQ ID NO: 446518 - RNA, 15 nt, Brucella suis 1330
gcccuucaucaagcu

SEQ ID NO: 446519 - RNA, 15 nt, Brucella suis 1330
gcccugucagaaagu

SEQ ID NO: 446520 - RNA, 19 nt, Brucella suis 1330
gcccuggaaagaagcgaaa

SEQ ID NO: 446521 - RNA, 22 nt, Brucella suis 1330
gcccugacucugaccuuccuga

SEQ ID NO: 446522 - RNA, 15 nt, Brucella suis 1330
gcccucgcgcucggc

SEQ ID NO: 446523 - RNA, 17 nt, Brucella suis 1330
gcccggucucgcgaccg

SEQ ID NO: 446524 - RNA, 18 nt, Brucella suis 1330
gcccggucacccgcacgc

SEQ ID NO: 446525 - RNA, 23 nt, Brucella suis 1330
gcccggucacccgcacgccgugc

SEQ ID NO: 446526 - RNA, 20 nt, Brucella suis 1330
gcccggcgauuucgccgggc

SEQ ID NO: 446527 - RNA, 16 nt, Brucella suis 1330
gcccggcauggccugc

SEQ ID NO: 446528 - RNA, 22 nt, Brucella suis 1330
gcccggcauggccugcgcgcgc

SEQ ID NO: 446529 - RNA, 17 nt, Brucella suis 1330
gcccggauugaccgaau

SEQ ID NO: 446530 - RNA, 15 nt, Brucella suis 1330
gcccgcgcuccucga

SEQ ID NO: 446531 - RNA, 13 nt, Brucella suis 1330
gcccgccggggcc

SEQ ID NO: 446532 - RNA, 18 nt, Brucella suis 1330
gcccgaagcgcaaagccc

SEQ ID NO: 446533 - RNA, 19 nt, Brucella suis 1330
gccccuuugcuucggccga

SEQ ID NO: 446534 - RNA, 14 nt, Brucella suis 1330
gccccuugccccgg

SEQ ID NO: 446535 - RNA, 15 nt, Brucella suis 1330
gccccuugccccggc

SEQ ID NO: 446536 - RNA, 16 nt, Brucella suis 1330
gccccuaaagccgcuc

SEQ ID NO: 446537 - RNA, 13 nt, Brucella suis 1330
gcccagcgcggca

SEQ ID NO: 446538 - RNA, 17 nt, Brucella suis 1330
gcccagauguuccugcg

SEQ ID NO: 446539 - RNA, 14 nt, Brucella suis 1330
gcccagagcgguuu

SEQ ID NO: 446540 - RNA, 17 nt, Brucella suis 1330
gcccagagcgguuucaa

SEQ ID NO: 446541 - RNA, 14 nt, Brucella suis 1330
gcccagaaccugcc

SEQ ID NO: 446542 - RNA, 18 nt, Brucella suis 1330
gcccacgcccgacaaaga

SEQ ID NO: 446543 - RNA, 17 nt, Brucella suis 1330
gcccaccgaagccacga

SEQ ID NO: 446544 - RNA, 21 nt, Brucella suis 1330
gcccacccaccgccugcagcc

SEQ ID NO: 446545 - RNA, 22 nt, Brucella suis 1330
gcccacccaccgccugcagccg

SEQ ID NO: 446546 - RNA, 22 nt, Brucella suis 1330
gcccaagacaagaugagcaggc

SEQ ID NO: 446547 - RNA, 16 nt, Brucella suis 1330
gccauucuccgcagcc

SEQ ID NO: 446548 - RNA, 12 nt, Brucella suis 1330
gccauugaccgc

SEQ ID NO: 446549 - RNA, 20 nt, Brucella suis 1330
gccauguugggguuggccug

SEQ ID NO: 446550 - RNA, 18 nt, Brucella suis 1330
gccauggccgaaaauauc

SEQ ID NO: 446551 - RNA, 23 nt, Brucella suis 1330
gccaugaguugucaauacaccug

SEQ ID NO: 446552 - RNA, 22 nt, Brucella suis 1330
gccaugaaagaacggcccgcau

SEQ ID NO: 446553 - RNA, 21 nt, Brucella suis 1330
gccaucuuccucacccuucaa

SEQ ID NO: 446554 - RNA, 16 nt, Brucella suis 1330
gccauccacaaaaacc

SEQ ID NO: 446555 - RNA, 24 nt, Brucella suis 1330
gccaucaccagcccccagaugaag

SEQ ID NO: 446556 - RNA, 22 nt, Brucella suis 1330
gccagguggcugcccgccgcaa

SEQ ID NO: 446557 - RNA, 21 nt, Brucella suis 1330
gccagcugauauugugucagc

SEQ ID NO: 446558 - RNA, 20 nt, Brucella suis 1330
gccagcggcagaccugcgca

SEQ ID NO: 446559 - RNA, 16 nt, Brucella suis 1330
gccagccgcaaugagc

SEQ ID NO: 446560 - RNA, 22 nt, Brucella suis 1330
gccagagcauuuucgccgcagc

SEQ ID NO: 446561 - RNA, 12 nt, Brucella suis 1330
gccagaaaaugc

SEQ ID NO: 446562 - RNA, 13 nt, Brucella suis 1330
gccagaaaaaccg

SEQ ID NO: 446563 - RNA, 14 nt, Brucella suis 1330
gccagaaaaaccgu

SEQ ID NO: 446564 - RNA, 20 nt, Brucella suis 1330
gccacugcgaaagcgccaga

SEQ ID NO: 446565 - RNA, 14 nt, Brucella suis 1330
gccacccugaugcc

SEQ ID NO: 446566 - RNA, 22 nt, Brucella suis 1330
gccaauuccgccggggcaggcu

SEQ ID NO: 446567 - RNA, 12 nt, Brucella suis 1330
gccaauccccuc

SEQ ID NO: 446568 - RNA, 19 nt, Brucella suis 1330
gccaauccaggucagcggc

SEQ ID NO: 446569 - RNA, 12 nt, Brucella suis 1330
gccaaggcugcg

SEQ ID NO: 446570 - RNA, 20 nt, Brucella suis 1330
gccaagcguugcaagauccu

SEQ ID NO: 446571 - RNA, 20 nt, Brucella suis 1330
gccaagcuugaucgccgcac

SEQ ID NO: 446572 - RNA, 17 nt, Brucella suis 1330
gccaagcuuuugcagcc

SEQ ID NO: 446573 - RNA, 18 nt, Brucella suis 1330
gccaaggaacgcggccuu

SEQ ID NO: 446574 - RNA, 14 nt, Brucella suis 1330
gccaagcgcaucga

SEQ ID NO: 446575 - RNA, 18 nt, Brucella suis 1330
gccaagcccuuccacugc

SEQ ID NO: 446576 - RNA, 19 nt, Brucella suis 1330
gccaagcccuuccacugca

SEQ ID NO: 446577 - RNA, 18 nt, Brucella suis 1330
gccaagaucgacaaagcc

SEQ ID NO: 446578 - RNA, 19 nt, Brucella suis 1330
gccaagaagaacacagccc

SEQ ID NO: 446579 - RNA, 22 nt, Brucella suis 1330
gccaagaagaacacagccccuu

SEQ ID NO: 446580 - RNA, 16 nt, Brucella suis 1330
gccaacucuuuccugu

SEQ ID NO: 446581 - RNA, 23 nt, Brucella suis 1330
gccaaccauauuggcggcaagcu

SEQ ID NO: 446582 - RNA, 20 nt, Brucella suis 1330
gccaaccaaagaaaaaagcc

SEQ ID NO: 446583 - RNA, 19 nt, Brucella suis 1330
gcauuuccagcaaaagugc

SEQ ID NO: 446584 - RNA, 21 nt, Brucella suis 1330
gcauugccugugccaaugaca

SEQ ID NO: 446585 - RNA, 14 nt, Brucella suis 1330
gcauugcccaugga

SEQ ID NO: 446586 - RNA, 13 nt, Brucella suis 1330
gcauucugccggu

SEQ ID NO: 446587 - RNA, 23 nt, Brucella suis 1330
gcauucgggucacccggcgcagu

SEQ ID NO: 446588 - RNA, 15 nt, Brucella suis 1330
gcauucgaugaacag

SEQ ID NO: 446589 - RNA, 21 nt, Brucella suis 1330
gcauucccuucgcgccgccuu

SEQ ID NO: 446590 - RNA, 15 nt, Brucella suis 1330
gcauucaggcggccu

SEQ ID NO: 446591 - RNA, 18 nt, Brucella suis 1330
gcaugggcgugaucggcc

SEQ ID NO: 446592 - RNA, 21 nt, Brucella suis 1330
gcaugggcgcgugugcauagg

SEQ ID NO: 446593 - RNA, 20 nt, Brucella suis 1330
gcaugggcaacccggcggcc

SEQ ID NO: 446594 - RNA, 14 nt, Brucella suis 1330
gcaugggcaagaca

SEQ ID NO: 446595 - RNA, 13 nt, Brucella suis 1330
gcauggcucugaa

SEQ ID NO: 446596 - RNA, 20 nt, Brucella suis 1330
gcauggcaagacggggcaag

SEQ ID NO: 446597 - RNA, 21 nt, Brucella suis 1330
gcauggaucgccuuuauaugg

SEQ ID NO: 446598 - RNA, 20 nt, Brucella suis 1330
gcaugaugccgacgaaagcc

SEQ ID NO: 446599 - RNA, 21 nt, Brucella suis 1330
gcaugaacaugcgccacuucc

SEQ ID NO: 446600 - RNA, 20 nt, Brucella suis 1330
gcaucuuuuccgaaaaccgu

SEQ ID NO: 446601 - RNA, 17 nt, Brucella suis 1330
gcaucuugccaagcuca

SEQ ID NO: 446602 - RNA, 22 nt, Brucella suis 1330
gcaucucuuccuaauggaugac

SEQ ID NO: 446603 - RNA, 19 nt, Brucella suis 1330
gcaucgucaaucacgccac

SEQ ID NO: 446604 - RNA, 20 nt, Brucella suis 1330
gcaucggcuugggaagauca

SEQ ID NO: 446605 - RNA, 23 nt, Brucella suis 1330
gcaucgggaucaaugaucuggcu

SEQ ID NO: 446606 - RNA, 14 nt, Brucella suis 1330
gcaucggcggugca

SEQ ID NO: 446607 - RNA, 16 nt, Brucella suis 1330
gcaucgggcgcugucc

SEQ ID NO: 446608 - RNA, 17 nt, Brucella suis 1330
gcaucggaagggcaagg

SEQ ID NO: 446609 - RNA, 22 nt, Brucella suis 1330
gcaucggaagggcaaggcgcgc

SEQ ID NO: 446610 - RNA, 22 nt, Brucella suis 1330
gcaucgacaaucuccccuuccu

SEQ ID NO: 446611 - RNA, 18 nt, Brucella suis 1330
gcaucgagaaaagcgcaa

SEQ ID NO: 446612 - RNA, 20 nt, Brucella suis 1330
gcauccugcucggcgcggcg

SEQ ID NO: 446613 - RNA, 12 nt, Brucella suis 1330
gcaucccugucg

SEQ ID NO: 446614 - RNA, 19 nt, Brucella suis 1330
gcauccgaaaugcgcggcg

SEQ ID NO: 446615 - RNA, 22 nt, Brucella suis 1330
gcauccgaaaugcgcggcggca

SEQ ID NO: 446616 - RNA, 13 nt, Brucella suis 1330
gcauccagccggc

SEQ ID NO: 446617 - RNA, 16 nt, Brucella suis 1330
gcauccacucggcggc

SEQ ID NO: 446618 - RNA, 22 nt, Brucella suis 1330
gcauccagaacuucgccaagcc

SEQ ID NO: 446619 - RNA, 23 nt, Brucella suis 1330
gcauccagaacuucgccaagccc

SEQ ID NO: 446620 - RNA, 12 nt, Brucella suis 1330
gcauccagcacu

SEQ ID NO: 446621 - RNA, 17 nt, Brucella suis 1330
gcauccagcacuuccag

SEQ ID NO: 446622 - RNA, 20 nt, Brucella suis 1330
gcauccagcacuuccagaua

SEQ ID NO: 446623 - RNA, 12 nt, Brucella suis 1330
gcaucagccuuc

SEQ ID NO: 446624 - RNA, 16 nt, Brucella suis 1330
gcaucagcuugcccau

SEQ ID NO: 446625 - RNA, 20 nt, Brucella suis 1330
gcaucacgaagagugcggcu

SEQ ID NO: 446626 - RNA, 23 nt, Brucella suis 1330
gcaucacgaagagugcggcuguc

SEQ ID NO: 446627 - RNA, 18 nt, Brucella suis 1330
gcaucagaaauuugcggg

SEQ ID NO: 446628 - RNA, 20 nt, Brucella suis 1330
gcaucagaaauuugcgggcg

SEQ ID NO: 446629 - RNA, 13 nt, Brucella suis 1330
gcaucaaccuuuu

SEQ ID NO: 446630 - RNA, 17 nt, Brucella suis 1330
gcaucaaccuuuucggc

SEQ ID NO: 446631 - RNA, 23 nt, Brucella suis 1330
gcauaugaugaacgucaauagca

SEQ ID NO: 446632 - RNA, 17 nt, Brucella suis 1330
gcauauuccacauugcc

SEQ ID NO: 446633 - RNA, 15 nt, Brucella suis 1330
gcauauugccgagca

SEQ ID NO: 446634 - RNA, 14 nt, Brucella suis 1330
gcagugcaggacug

SEQ ID NO: 446635 - RNA, 21 nt, Brucella suis 1330
gcagucaggccgaccgcaaug

SEQ ID NO: 446636 - RNA, 17 nt, Brucella suis 1330
gcagggcaggccgggag

SEQ ID NO: 446637 - RNA, 17 nt, Brucella suis 1330
gcaggccgugaagauug

SEQ ID NO: 446638 - RNA, 15 nt, Brucella suis 1330
gcaggcaggccgccu

SEQ ID NO: 446639 - RNA, 21 nt, Brucella suis 1330
gcagcgucacaaaacagacgc

SEQ ID NO: 446640 - RNA, 16 nt, Brucella suis 1330
gcagcguauucaggga

SEQ ID NO: 446641 - RNA, 16 nt, Brucella suis 1330
gcagcgcgguuuuugc

SEQ ID NO: 446642 - RNA, 12 nt, Brucella suis 1330
gcagcgccgcgc

SEQ ID NO: 446643 - RNA, 14 nt, Brucella suis 1330
gcagcgccgcgccc

SEQ ID NO: 446644 - RNA, 16 nt, Brucella suis 1330
gcagcgcaaacucguc

SEQ ID NO: 446645 - RNA, 21 nt, Brucella suis 1330
gcagcccggacaggcggcgac

SEQ ID NO: 446646 - RNA, 20 nt, Brucella suis 1330
gcagcaugcgguucaggugg

SEQ ID NO: 446647 - RNA, 17 nt, Brucella suis 1330
gcagcaucuugccaagc

SEQ ID NO: 446648 - RNA, 18 nt, Brucella suis 1330
gcagcaucacaugggcau

SEQ ID NO: 446649 - RNA, 16 nt, Brucella suis 1330
gcagcaucgccgccag

SEQ ID NO: 446650 - RNA, 13 nt, Brucella suis 1330
gcagcaaaaccgu

SEQ ID NO: 446651 - RNA, 16 nt, Brucella suis 1330
gcacucuccucugccu

SEQ ID NO: 446652 - RNA, 22 nt, Brucella suis 1330
gcacugaaacgggaccaagccc

SEQ ID NO: 446653 - RNA, 14 nt, Brucella suis 1330
gcacgucaucaucg

SEQ ID NO: 446654 - RNA, 12 nt, Brucella suis 1330
gcacggcggcuu

SEQ ID NO: 446655 - RNA, 20 nt, Brucella suis 1330
gcacgaccagcgcaaugccc

SEQ ID NO: 446656 - RNA, 16 nt, Brucella suis 1330
gcaccgcaaagagaac

SEQ ID NO: 446657 - RNA, 21 nt, Brucella suis 1330
gcaccgauauagagcagcacc

SEQ ID NO: 446658 - RNA, 22 nt, Brucella suis 1330
gcaccgauauagagcagcaccg

SEQ ID NO: 446659 - RNA, 15 nt, Brucella suis 1330
gcaccgauccgcaac

SEQ ID NO: 446660 - RNA, 14 nt, Brucella suis 1330
gcacccuauucccc

SEQ ID NO: 446661 - RNA, 20 nt, Brucella suis 1330
gcaccagcggcacgccgccc

SEQ ID NO: 446662 - RNA, 15 nt, Brucella suis 1330
gcacauaucagcccg

SEQ ID NO: 446663 - RNA, 18 nt, Brucella suis 1330
gcacauagaaaucaaccu

SEQ ID NO: 446664 - RNA, 14 nt, Brucella suis 1330
gcacacggcgcagg

SEQ ID NO: 446665 - RNA, 18 nt, Brucella suis 1330
gcaauugccgcugccggu

SEQ ID NO: 446666 - RNA, 18 nt, Brucella suis 1330
gcaauugcugggcuuccu

SEQ ID NO: 446667 - RNA, 15 nt, Brucella suis 1330
gcaauucgauugucc

SEQ ID NO: 446668 - RNA, 17 nt, Brucella suis 1330
gcaaugugcgggcuucu

SEQ ID NO: 446669 - RNA, 21 nt, Brucella suis 1330
gcaaugugcgggcuucuucca

SEQ ID NO: 446670 - RNA, 19 nt, Brucella suis 1330
gcaaugcgccgugcagggu

SEQ ID NO: 446671 - RNA, 21 nt, Brucella suis 1330
gcaaugcgcuucgcgcaggcc

SEQ ID NO: 446672 - RNA, 15 nt, Brucella suis 1330
gcaauggccgcauga

SEQ ID NO: 446673 - RNA, 19 nt, Brucella suis 1330
gcaauggccgcaugaacau

SEQ ID NO: 446674 - RNA, 14 nt, Brucella suis 1330
gcaauggagcagga

SEQ ID NO: 446675 - RNA, 13 nt, Brucella suis 1330
gcaauggccuugc

SEQ ID NO: 446676 - RNA, 18 nt, Brucella suis 1330
gcaagugugaaagcacaa

SEQ ID NO: 446677 - RNA, 23 nt, Brucella suis 1330
gcaagugugaaagcacaaagaac

SEQ ID NO: 446678 - RNA, 15 nt, Brucella suis 1330
gcaagugugcagaca

SEQ ID NO: 446679 - RNA, 19 nt, Brucella suis 1330
gcaagugugcagacaggcc

SEQ ID NO: 446680 - RNA, 22 nt, Brucella suis 1330
gcaagugugcagacaggccagu

SEQ ID NO: 446681 - RNA, 24 nt, Brucella suis 1330
gcaagugugcgcgcgccaucggca

SEQ ID NO: 446682 - RNA, 21 nt, Brucella suis 1330
gcaauagaccaccaggccgga

SEQ ID NO: 446683 - RNA, 20 nt, Brucella suis 1330
gcaauauauacacgcagacg

SEQ ID NO: 446684 - RNA, 15 nt, Brucella suis 1330
gcaauaucgauccag

SEQ ID NO: 446685 - RNA, 22 nt, Brucella suis 1330
gcaaggucucgacaguccagcu

SEQ ID NO: 446686 - RNA, 18 nt, Brucella suis 1330
gcaaggggcggaacaggc

SEQ ID NO: 446687 - RNA, 22 nt, Brucella suis 1330
gcaagcgcgauggcguugcggc

SEQ ID NO: 446688 - RNA, 17 nt, Brucella suis 1330
gcaacuuccuugccggu

SEQ ID NO: 446689 - RNA, 22 nt, Brucella suis 1330
gcaaaugccgaagcccauggca

SEQ ID NO: 446690 - RNA, 17 nt, Brucella suis 1330
gcaaaggccgccgucgc

SEQ ID NO: 446691 - RNA, 14 nt, Brucella suis 1330
gcaaaggccggguu

SEQ ID NO: 446692 - RNA, 18 nt, Brucella suis 1330
gcaaaggcaggcacaccc

SEQ ID NO: 446693 - RNA, 18 nt, Brucella suis 1330
gcaaagccgaaugccagu

SEQ ID NO: 446694 - RNA, 24 nt, Brucella suis 1330
gcaaaccuccgacaccagccguuc

SEQ ID NO: 446695 - RNA, 12 nt, Brucella suis 1330
gauuuuucuuug

SEQ ID NO: 446696 - RNA, 18 nt, Brucella suis 1330
gauugaggccgaaaacca

SEQ ID NO: 446697 - RNA, 16 nt, Brucella suis 1330
gauugcgcaagugcug

SEQ ID NO: 446698 - RNA, 15 nt, Brucella suis 1330
gauugcuaaaugcaa

SEQ ID NO: 446699 - RNA, 16 nt, Brucella suis 1330
gauugcuaaaugcaag

SEQ ID NO: 446700 - RNA, 14 nt, Brucella suis 1330
gauuggauuugacg

SEQ ID NO: 446701 - RNA, 16 nt, Brucella suis 1330
gauuguggcaaaagcc

SEQ ID NO: 446702 - RNA, 18 nt, Brucella suis 1330
gauguccgaaugcaaggg

SEQ ID NO: 446703 - RNA, 18 nt, Brucella suis 1330
gauuaugcuuuaaaagca

SEQ ID NO: 446704 - RNA, 17 nt, Brucella suis 1330
gauggucgcaagaccca

SEQ ID NO: 446705 - RNA, 18 nt, Brucella suis 1330
gaugggccggucuucccg

SEQ ID NO: 446706 - RNA, 17 nt, Brucella suis 1330
gauggcgaucacgaaaa

SEQ ID NO: 446707 - RNA, 19 nt, Brucella suis 1330
gauggaaggaaagcccagu

SEQ ID NO: 446708 - RNA, 14 nt, Brucella suis 1330
gauggaauuucacc

SEQ ID NO: 446709 - RNA, 23 nt, Brucella suis 1330
gauggaauaucgcucauauggau

SEQ ID NO: 446710 - RNA, 21 nt, Brucella suis 1330
gauggaccauauccaucugcu

SEQ ID NO: 446711 - RNA, 22 nt, Brucella suis 1330
gaugcuugaggaucgucugacg

SEQ ID NO: 446712 - RNA, 13 nt, Brucella suis 1330
gaugcguuggaaa

SEQ ID NO: 446713 - RNA, 19 nt, Brucella suis 1330
gaugcgaaacggagaaaac

SEQ ID NO: 446714 - RNA, 14 nt, Brucella suis 1330
gaugccgacaagca

SEQ ID NO: 446715 - RNA, 13 nt, Brucella suis 1330
gaugaugaccuga

SEQ ID NO: 446716 - RNA, 18 nt, Brucella suis 1330
gaugagcuaucagccgcc

SEQ ID NO: 446717 - RNA, 22 nt, Brucella suis 1330
gaugaauggggggcaggcaaau

SEQ ID NO: 446718 - RNA, 18 nt, Brucella suis 1330
gaugacuucgguuuccac

SEQ ID NO: 446719 - RNA, 16 nt, Brucella suis 1330
gaucgucagcaccgcu

SEQ ID NO: 446720 - RNA, 14 nt, Brucella suis 1330
gaucgucuugcaug

SEQ ID NO: 446721 - RNA, 19 nt, Brucella suis 1330
gaucgggccaucuuccuca

SEQ ID NO: 446722 - RNA, 16 nt, Brucella suis 1330
gaucgcccgcccggca

SEQ ID NO: 446723 - RNA, 20 nt, Brucella suis 1330
gaucgccuuucaccagagcc

SEQ ID NO: 446724 - RNA, 13 nt, Brucella suis 1330
gaucgccagaagc

SEQ ID NO: 446725 - RNA, 15 nt, Brucella suis 1330
gaucgccagaagcgu

SEQ ID NO: 446726 - RNA, 22 nt, Brucella suis 1330
gaucgagccgacaucgcgcuug

SEQ ID NO: 446727 - RNA, 14 nt, Brucella suis 1330
gaucgacagccggu

SEQ ID NO: 446728 - RNA, 23 nt, Brucella suis 1330
gauccugcgcccugucagaaagu

SEQ ID NO: 446729 - RNA, 13 nt, Brucella suis 1330
gauccagaagccg

SEQ ID NO: 446730 - RNA, 15 nt, Brucella suis 1330
gauccagaucuuccu

SEQ ID NO: 446731 - RNA, 18 nt, Brucella suis 1330
gaucagguugaugccggg

SEQ ID NO: 446732 - RNA, 22 nt, Brucella suis 1330
gaucagguuucgacaagcuuca

SEQ ID NO: 446733 - RNA, 14 nt, Brucella suis 1330
gaucaugggcggcc

SEQ ID NO: 446734 - RNA, 21 nt, Brucella suis 1330
gaucagcguccauccggcggc

SEQ ID NO: 446735 - RNA, 13 nt, Brucella suis 1330
gaucagccacauu

SEQ ID NO: 446736 - RNA, 13 nt, Brucella suis 1330
gaucagcaucgcc

SEQ ID NO: 446737 - RNA, 20 nt, Brucella suis 1330
gauaucgccugcuuccuuuu

SEQ ID NO: 446738 - RNA, 15 nt, Brucella suis 1330
gauacuguagaaaau

SEQ ID NO: 446739 - RNA, 19 nt, Brucella suis 1330
gauagagguaggacugugg

SEQ ID NO: 446740 - RNA, 15 nt, Brucella suis 1330
gauacugcgcggugc

SEQ ID NO: 446741 - RNA, 16 nt, Brucella suis 1330
gauacgcuucaucgca

SEQ ID NO: 446742 - RNA, 13 nt, Brucella suis 1330
gauaccaaggccg

SEQ ID NO: 446743 - RNA, 14 nt, Brucella suis 1330
gauaccaaggccga

SEQ ID NO: 446744 - RNA, 18 nt, Brucella suis 1330
gauaacgcgacaaaacaa

SEQ ID NO: 446745 - RNA, 13 nt, Brucella suis 1330
gauaaucagcaga

SEQ ID NO: 446746 - RNA, 15 nt, Brucella suis 1330
gauaaucuggcuggu

SEQ ID NO: 446747 - RNA, 13 nt, Brucella suis 1330
gauaaugaagaca

SEQ ID NO: 446748 - RNA, 18 nt, Brucella suis 1330
gauaaugcgacaaaacaa

SEQ ID NO: 446749 - RNA, 19 nt, Brucella suis 1330
gauaaugcgauaaaaugaa

SEQ ID NO: 446750 - RNA, 23 nt, Brucella suis 1330
gauaaugcucgcccagaaacaau

SEQ ID NO: 446751 - RNA, 14 nt, Brucella suis 1330
gauaaugggcgcag

SEQ ID NO: 446752 - RNA, 14 nt, Brucella suis 1330
gaguucgccagcac

SEQ ID NO: 446753 - RNA, 12 nt, Brucella suis 1330
gagugcggccug

SEQ ID NO: 446754 - RNA, 19 nt, Brucella suis 1330
gaauuuccgcuccugguuc

SEQ ID NO: 446755 - RNA, 14 nt, Brucella suis 1330
gaauuguuccagcc

SEQ ID NO: 446756 - RNA, 17 nt, Brucella suis 1330
gaauggggggcaggcaa

SEQ ID NO: 446757 - RNA, 19 nt, Brucella suis 1330
gaaugcggcaaucgcuuca

SEQ ID NO: 446758 - RNA, 20 nt, Brucella suis 1330
gaaugcccuugagaagcucg

SEQ ID NO: 446759 - RNA, 17 nt, Brucella suis 1330
gaaugccgaagccaggu

SEQ ID NO: 446760 - RNA, 21 nt, Brucella suis 1330
gaaugccgauuugaccauauu

SEQ ID NO: 446761 - RNA, 21 nt, Brucella suis 1330
gaaugccagauaaccugcgcg

SEQ ID NO: 446762 - RNA, 21 nt, Brucella suis 1330
gaaucugccuugucagaagca

SEQ ID NO: 446763 - RNA, 23 nt, Brucella suis 1330
gaaucuccggcccauaccgcgcc

SEQ ID NO: 446764 - RNA, 21 nt, Brucella suis 1330
gaaucugaggccauuuugacc

SEQ ID NO: 446765 - RNA, 21 nt, Brucella suis 1330
gaaucccggcuguuacauaug

SEQ ID NO: 446766 - RNA, 17 nt, Brucella suis 1330
gaaucagaccgaugcuc

SEQ ID NO: 446767 - RNA, 24 nt, Brucella suis 1330
gaaucagaucggcgcucuaauccu

SEQ ID NO: 446768 - RNA, 16 nt, Brucella suis 1330
gaagugcauaugauga

SEQ ID NO: 446769 - RNA, 19 nt, Brucella suis 1330
gaagugagcgcaaggcuuc

SEQ ID NO: 446770 - RNA, 19 nt, Brucella suis 1330
gaagugaucucggccuggu

SEQ ID NO: 446771 - RNA, 11 nt, Brucella suis 1330
gaagguuuuuc

SEQ ID NO: 446772 - RNA, 15 nt, Brucella suis 1330
gaagggcugagggaa

SEQ ID NO: 446773 - RNA, 11 nt, Brucella suis 1330
gaagggcaagg

SEQ ID NO: 446774 - RNA, 13 nt, Brucella suis 1330
gaagggaaagcgg

SEQ ID NO: 446775 - RNA, 17 nt, Brucella suis 1330
gaaggcgggaaggcaau

SEQ ID NO: 446776 - RNA, 20 nt, Brucella suis 1330
gaauagaugaugaagaaaag

SEQ ID NO: 446777 - RNA, 21 nt, Brucella suis 1330
gaauagggaaacggccagggc

SEQ ID NO: 446778 - RNA, 20 nt, Brucella suis 1330
gaauauagccgaugcagaug

SEQ ID NO: 446779 - RNA, 13 nt, Brucella suis 1330
gaauaucuugaag

SEQ ID NO: 446780 - RNA, 16 nt, Brucella suis 1330
gaauaucuugaagccu

SEQ ID NO: 446781 - RNA, 14 nt, Brucella suis 1330
gaaggcaagcaggc

SEQ ID NO: 446782 - RNA, 15 nt, Brucella suis 1330
gaaggcaagcaggcg

SEQ ID NO: 446783 - RNA, 17 nt, Brucella suis 1330
gaaggcaagccccagca

SEQ ID NO: 446784 - RNA, 20 nt, Brucella suis 1330
gaagcuucacauccuucacu

SEQ ID NO: 446785 - RNA, 12 nt, Brucella suis 1330
gaaggagaggcc

SEQ ID NO: 446786 - RNA, 21 nt, Brucella suis 1330
gaagcucgacaucaagcgggc

SEQ ID NO: 446787 - RNA, 13 nt, Brucella suis 1330
gaagcgguuuugc

SEQ ID NO: 446788 - RNA, 22 nt, Brucella suis 1330
gaagcggcauuggccgaagccg

SEQ ID NO: 446789 - RNA, 14 nt, Brucella suis 1330
gaagcgcggcggcc

SEQ ID NO: 446790 - RNA, 13 nt, Brucella suis 1330
gaagcgccagaga

SEQ ID NO: 446791 - RNA, 17 nt, Brucella suis 1330
gaagcgcaaggcggcgc

SEQ ID NO: 446792 - RNA, 16 nt, Brucella suis 1330
gaagcgaagaacagaa

SEQ ID NO: 446793 - RNA, 17 nt, Brucella suis 1330
gaagcgaagaacagaag

SEQ ID NO: 446794 - RNA, 20 nt, Brucella suis 1330
gaagccgguucguugaacug

SEQ ID NO: 446795 - RNA, 22 nt, Brucella suis 1330
gaagccgguucguugaacugca

SEQ ID NO: 446796 - RNA, 16 nt, Brucella suis 1330
gaagccgaagaacagu

SEQ ID NO: 446797 - RNA, 14 nt, Brucella suis 1330
gaagccgauccgca

SEQ ID NO: 446798 - RNA, 11 nt, Brucella suis 1330
gaagcccagcg

SEQ ID NO: 446799 - RNA, 13 nt, Brucella suis 1330
gaagcccagcgcc

SEQ ID NO: 446800 - RNA, 18 nt, Brucella suis 1330
gaagcauauguuccugcg

SEQ ID NO: 446801 - RNA, 23 nt, Brucella suis 1330
gaagcaagugugaaagcacaaag

SEQ ID NO: 446802 - RNA, 14 nt, Brucella suis 1330
gaagcaccagcgcg

SEQ ID NO: 446803 - RNA, 16 nt, Brucella suis 1330
gaagauuucguacugc

SEQ ID NO: 446804 - RNA, 22 nt, Brucella suis 1330
gaagauuucuugcagaugcccg

SEQ ID NO: 446805 - RNA, 21 nt, Brucella suis 1330
gaagauugaugauaggcugcu

SEQ ID NO: 446806 - RNA, 19 nt, Brucella suis 1330
gaagagacuguucuuugca

SEQ ID NO: 446807 - RNA, 16 nt, Brucella suis 1330
gaagagccgcaggcac

SEQ ID NO: 446808 - RNA, 15 nt, Brucella suis 1330
gaagauaaucagcag

SEQ ID NO: 446809 - RNA, 15 nt, Brucella suis 1330
gaagauaaucgaugu

SEQ ID NO: 446810 - RNA, 20 nt, Brucella suis 1330
gaagaucgucggcaagcugg

SEQ ID NO: 446811 - RNA, 15 nt, Brucella suis 1330
gaagacauugccaag

SEQ ID NO: 446812 - RNA, 16 nt, Brucella suis 1330
gaagaccaaacagccc

SEQ ID NO: 446813 - RNA, 21 nt, Brucella suis 1330
gaagaauauggucgcugcggc

SEQ ID NO: 446814 - RNA, 16 nt, Brucella suis 1330
gaagaagauaaucagc

SEQ ID NO: 446815 - RNA, 22 nt, Brucella suis 1330
gaagaagauaaucagcagaagg

SEQ ID NO: 446816 - RNA, 17 nt, Brucella suis 1330
gaagaagcgccagcuuc

SEQ ID NO: 446817 - RNA, 17 nt, Brucella suis 1330
gaagaagagccugccgu

SEQ ID NO: 446818 - RNA, 18 nt, Brucella suis 1330
gaagaaaaguccgggcac

SEQ ID NO: 446819 - RNA, 16 nt, Brucella suis 1330
gaacuucggcauggca

SEQ ID NO: 446820 - RNA, 14 nt, Brucella suis 1330
gaacuucgccaagc

SEQ ID NO: 446821 - RNA, 22 nt, Brucella suis 1330
gaacggcggugguuucccuuga

SEQ ID NO: 446822 - RNA, 13 nt, Brucella suis 1330
gaacggcggcggc

SEQ ID NO: 446823 - RNA, 16 nt, Brucella suis 1330
gaacgcgccuuuucuu

SEQ ID NO: 446824 - RNA, 19 nt, Brucella suis 1330
gaacgccuuuuucacugca

SEQ ID NO: 446825 - RNA, 15 nt, Brucella suis 1330
gaacgccgccggaaa

SEQ ID NO: 446826 - RNA, 18 nt, Brucella suis 1330
gaacgcacugcaagauag

SEQ ID NO: 446827 - RNA, 16 nt, Brucella suis 1330
gaacgcauagagccac

SEQ ID NO: 446828 - RNA, 18 nt, Brucella suis 1330
gaacgcauagagccacga

SEQ ID NO: 446829 - RNA, 15 nt, Brucella suis 1330
gaaccgguuuucggg

SEQ ID NO: 446830 - RNA, 15 nt, Brucella suis 1330
gaaccggggcagggc

SEQ ID NO: 446831 - RNA, 16 nt, Brucella suis 1330
gaaccgaggcaaugaa

SEQ ID NO: 446832 - RNA, 20 nt, Brucella suis 1330
gaaccgaacgcgccuuuucu

SEQ ID NO: 446833 - RNA, 13 nt, Brucella suis 1330
gaacccgccacca

SEQ ID NO: 446834 - RNA, 20 nt, Brucella suis 1330
gaacccggccucugcaagag

SEQ ID NO: 446835 - RNA, 13 nt, Brucella suis 1330
gaaccauguaauc

SEQ ID NO: 446836 - RNA, 22 nt, Brucella suis 1330
gaaccagcggccaucuuccagu

SEQ ID NO: 446837 - RNA, 12 nt, Brucella suis 1330
gaacauggaaaa

SEQ ID NO: 446838 - RNA, 21 nt, Brucella suis 1330
gaacaucgaggaauuuccgcu

SEQ ID NO: 446839 - RNA, 22 nt, Brucella suis 1330
gaacauauccugaaacuugugc

SEQ ID NO: 446840 - RNA, 12 nt, Brucella suis 1330
gaacaggucuga

SEQ ID NO: 446841 - RNA, 23 nt, Brucella suis 1330
gaacagcgcgaacaugccugccg

SEQ ID NO: 446842 - RNA, 21 nt, Brucella suis 1330
gaacacgaugauggccgggaa

SEQ ID NO: 446843 - RNA, 15 nt, Brucella suis 1330
gaacagaagcaccag

SEQ ID NO: 446844 - RNA, 13 nt, Brucella suis 1330
gaacacagccccu

SEQ ID NO: 446845 - RNA, 15 nt, Brucella suis 1330
gaacaagcagaugca

SEQ ID NO: 446846 - RNA, 20 nt, Brucella suis 1330
gaacaagcagaugcagcgga

SEQ ID NO: 446847 - RNA, 16 nt, Brucella suis 1330
gaacaaacuuauccag

SEQ ID NO: 446848 - RNA, 14 nt, Brucella suis 1330
gaacaaagaugaau

SEQ ID NO: 446849 - RNA, 13 nt, Brucella suis 1330
gaaauuucagcca

SEQ ID NO: 446850 - RNA, 20 nt, Brucella suis 1330
gaaauggccccauaaagcug

SEQ ID NO: 446851 - RNA, 15 nt, Brucella suis 1330
gaaaucugcgccggu

SEQ ID NO: 446852 - RNA, 19 nt, Brucella suis 1330
gaaaucuugagcguuauaa

SEQ ID NO: 446853 - RNA, 18 nt, Brucella suis 1330
gaaauagcgguugcagcc

SEQ ID NO: 446854 - RNA, 16 nt, Brucella suis 1330
gaaauagcucauguuc

SEQ ID NO: 446855 - RNA, 22 nt, Brucella suis 1330
gaaagucuggaacguguugaga

SEQ ID NO: 446856 - RNA, 19 nt, Brucella suis 1330
gaaauaauagucgaaaaaa

SEQ ID NO: 446857 - RNA, 20 nt, Brucella suis 1330
gaaauaauagucgaaaaaag

SEQ ID NO: 446858 - RNA, 21 nt, Brucella suis 1330
gaaauaauagucgaaaaaaga

SEQ ID NO: 446859 - RNA, 22 nt, Brucella suis 1330
gaaagcugccgcgaaaaagccg

SEQ ID NO: 446860 - RNA, 13 nt, Brucella suis 1330
gaaaggagcacga

SEQ ID NO: 446861 - RNA, 20 nt, Brucella suis 1330
gaaagcguaaaccucccugu

SEQ ID NO: 446862 - RNA, 13 nt, Brucella suis 1330
gaaagccacgcuc

SEQ ID NO: 446863 - RNA, 23 nt, Brucella suis 1330
gaaagccagaaccaccagagcaa

SEQ ID NO: 446864 - RNA, 21 nt, Brucella suis 1330
gaaagcccugcgucgggugaa

SEQ ID NO: 446865 - RNA, 19 nt, Brucella suis 1330
gaaagccucgaucacccga

SEQ ID NO: 446866 - RNA, 18 nt, Brucella suis 1330
gaaagaucagccagccga

SEQ ID NO: 446867 - RNA, 17 nt, Brucella suis 1330
gaaagacucgaacaggc

SEQ ID NO: 446868 - RNA, 22 nt, Brucella suis 1330
gaaagaaagcugucgcgcccgc

SEQ ID NO: 446869 - RNA, 20 nt, Brucella suis 1330
gaaacggccagggcuggcuc

SEQ ID NO: 446870 - RNA, 16 nt, Brucella suis 1330
gaaacgggaccaagcc

SEQ ID NO: 446871 - RNA, 13 nt, Brucella suis 1330
gaaacgcgugcca

SEQ ID NO: 446872 - RNA, 18 nt, Brucella suis 1330
gaaacgagacaaggcaau

SEQ ID NO: 446873 - RNA, 14 nt, Brucella suis 1330
gaaaccgucacgcc

SEQ ID NO: 446874 - RNA, 12 nt, Brucella suis 1330
gaaaccgugaca

SEQ ID NO: 446875 - RNA, 20 nt, Brucella suis 1330
gaaacccgcucuacuugguu

SEQ ID NO: 446876 - RNA, 19 nt, Brucella suis 1330
gaaaccauccaugcgcggc

SEQ ID NO: 446877 - RNA, 17 nt, Brucella suis 1330
gaaaaugccauggaaca

SEQ ID NO: 446878 - RNA, 13 nt, Brucella suis 1330
gaaaaugcagcgg

SEQ ID NO: 446879 - RNA, 16 nt, Brucella suis 1330
gaaaauauagccgccu

SEQ ID NO: 446880 - RNA, 14 nt, Brucella suis 1330
gaaaauaucugccg

SEQ ID NO: 446881 - RNA, 16 nt, Brucella suis 1330
gaaaauguucuaaagc

SEQ ID NO: 446882 - RNA, 18 nt, Brucella suis 1330
gaaaauuguggccgauga

SEQ ID NO: 446883 - RNA, 17 nt, Brucella suis 1330
gaaaagccggagcauuc

SEQ ID NO: 446884 - RNA, 17 nt, Brucella suis 1330
gaaaagcaggaucaggg

SEQ ID NO: 446885 - RNA, 15 nt, Brucella suis 1330
gaaaagccccauguu

SEQ ID NO: 446886 - RNA, 22 nt, Brucella suis 1330
gaaaacggccaugcgcaugaac

SEQ ID NO: 446887 - RNA, 17 nt, Brucella suis 1330
gaaaacggcugcaacaa

SEQ ID NO: 446888 - RNA, 20 nt, Brucella suis 1330
gaaaacggcugcaacaaaag

SEQ ID NO: 446889 - RNA, 22 nt, Brucella suis 1330
gaaaacggcugcaacaaaagaa

SEQ ID NO: 446890 - RNA, 21 nt, Brucella suis 1330
gaaaaggccuguuccugcaug

SEQ ID NO: 446891 - RNA, 14 nt, Brucella suis 1330
gaaaagggcaaggg

SEQ ID NO: 446892 - RNA, 20 nt, Brucella suis 1330
gaaaagggcaagggccuggc

SEQ ID NO: 446893 - RNA, 11 nt, Brucella suis 1330
gaaaagugcga

SEQ ID NO: 446894 - RNA, 13 nt, Brucella suis 1330
gaaaagugcgaag

SEQ ID NO: 446895 - RNA, 21 nt, Brucella suis 1330
gaaaaccgguucccacuuucg

SEQ ID NO: 446896 - RNA, 14 nt, Brucella suis 1330
gaaaacgaggccga

SEQ ID NO: 446897 - RNA, 15 nt, Brucella suis 1330
gaaaaccgcuucagc

SEQ ID NO: 446898 - RNA, 14 nt, Brucella suis 1330
gaaaaagcccggug

SEQ ID NO: 446899 - RNA, 12 nt, Brucella suis 1330
gaaaaaaaugcg

SEQ ID NO: 446900 - RNA, 20 nt, Brucella suis 1330
gaaaaaccccggcagccuuc

SEQ ID NO: 446901 - RNA, 16 nt, Brucella suis 1330
cuuuuguuuucaaagc

SEQ ID NO: 446902 - RNA, 21 nt, Brucella suis 1330
cuuuugggcgucgcgcaucau

SEQ ID NO: 446903 - RNA, 19 nt, Brucella suis 1330
cuuuugugcucacacagaa

SEQ ID NO: 446904 - RNA, 14 nt, Brucella suis 1330
cuuuucggcaagga

SEQ ID NO: 446905 - RNA, 21 nt, Brucella suis 1330
cuuuucggcaaggaugcugcc

SEQ ID NO: 446906 - RNA, 15 nt, Brucella suis 1330
cuuuuccaccggccc

SEQ ID NO: 446907 - RNA, 15 nt, Brucella suis 1330
cuuuuccgcaaaaau

SEQ ID NO: 446908 - RNA, 17 nt, Brucella suis 1330
cuuugucacgccggcau

SEQ ID NO: 446909 - RNA, 22 nt, Brucella suis 1330
cuuuguuuugacgcgcaucuuu

SEQ ID NO: 446910 - RNA, 22 nt, Brucella suis 1330
cuuucgccgggguuucuucauu

SEQ ID NO: 446911 - RNA, 13 nt, Brucella suis 1330
cuuucgacaaagg

SEQ ID NO: 446912 - RNA, 14 nt, Brucella suis 1330
cuuuccaguuccau

SEQ ID NO: 446913 - RNA, 21 nt, Brucella suis 1330
cuuuauucaaccguuuccuga

SEQ ID NO: 446914 - RNA, 16 nt, Brucella suis 1330
cuuuauagaggaacuc

SEQ ID NO: 446915 - RNA, 17 nt, Brucella suis 1330
cuuguugaaagaaaaga

SEQ ID NO: 446916 - RNA, 13 nt, Brucella suis 1330
cuuguuccagucg

SEQ ID NO: 446917 - RNA, 19 nt, Brucella suis 1330
cuuuaaaagcauauugaag

SEQ ID NO: 446918 - RNA, 18 nt, Brucella suis 1330
cuuguguuucaccagaug

SEQ ID NO: 446919 - RNA, 20 nt, Brucella suis 1330
cuuguguuucaccagaugcu

SEQ ID NO: 446920 - RNA, 14 nt, Brucella suis 1330
cuuguccaccaccu

SEQ ID NO: 446921 - RNA, 22 nt, Brucella suis 1330
cuugcucauggcuuccugcguc

SEQ ID NO: 446922 - RNA, 23 nt, Brucella suis 1330
cuugcucauggcuuccugcgucu

SEQ ID NO: 446923 - RNA, 15 nt, Brucella suis 1330
cuugcggcacugucg

SEQ ID NO: 446924 - RNA, 18 nt, Brucella suis 1330
cuugcgcugauucuggau

SEQ ID NO: 446925 - RNA, 23 nt, Brucella suis 1330
cuugcgcuccaccagcaugaucg

SEQ ID NO: 446926 - RNA, 17 nt, Brucella suis 1330
cuugcgccgcaggaacg

SEQ ID NO: 446927 - RNA, 16 nt, Brucella suis 1330
cuugccgucggcgccg

SEQ ID NO: 446928 - RNA, 17 nt, Brucella suis 1330
cuugccguuggcaucca

SEQ ID NO: 446929 - RNA, 23 nt, Brucella suis 1330
cuugccguuggcauccacucggc

SEQ ID NO: 446930 - RNA, 15 nt, Brucella suis 1330
cuugccucguccggu

SEQ ID NO: 446931 - RNA, 22 nt, Brucella suis 1330
cuugcagaugagcggcagcagc

SEQ ID NO: 446932 - RNA, 21 nt, Brucella suis 1330
cuugagggcgagggccucgau

SEQ ID NO: 446933 - RNA, 15 nt, Brucella suis 1330
cuugauagcgccgga

SEQ ID NO: 446934 - RNA, 16 nt, Brucella suis 1330
cuugauagggcaauug

SEQ ID NO: 446935 - RNA, 17 nt, Brucella suis 1330
cuugaggccgcgcgcgc

SEQ ID NO: 446936 - RNA, 21 nt, Brucella suis 1330
cuugagcguuccgcgauauuu

SEQ ID NO: 446937 - RNA, 15 nt, Brucella suis 1330
cuucuugccuucauc

SEQ ID NO: 446938 - RNA, 20 nt, Brucella suis 1330
cuucuugccuucaucggcaa

SEQ ID NO: 446939 - RNA, 20 nt, Brucella suis 1330
cuucuuccaguuucugaaug

SEQ ID NO: 446940 - RNA, 12 nt, Brucella suis 1330
cuucuguugcag

SEQ ID NO: 446941 - RNA, 13 nt, Brucella suis 1330
cuucugcuugcag

SEQ ID NO: 446942 - RNA, 15 nt, Brucella suis 1330
cuucucuugccgccg

SEQ ID NO: 446943 - RNA, 20 nt, Brucella suis 1330
cuucucuugccgccgcuucc

SEQ ID NO: 446944 - RNA, 18 nt, Brucella suis 1330
cuucgcgggcaauggccg

SEQ ID NO: 446945 - RNA, 14 nt, Brucella suis 1330
cuucgcgcaggccg

SEQ ID NO: 446946 - RNA, 13 nt, Brucella suis 1330
cuucgccaagccc

SEQ ID NO: 446947 - RNA, 20 nt, Brucella suis 1330
cuucgccaagcccuuccacu

SEQ ID NO: 446948 - RNA, 15 nt, Brucella suis 1330
cuucgccgagauggg

SEQ ID NO: 446949 - RNA, 19 nt, Brucella suis 1330
cuuccucguccuugaacuc

SEQ ID NO: 446950 - RNA, 17 nt, Brucella suis 1330
cuuccggccguuauucc

SEQ ID NO: 446951 - RNA, 15 nt, Brucella suis 1330
cuuccggcugcuuuc

SEQ ID NO: 446952 - RNA, 23 nt, Brucella suis 1330
cuuccgcaucguaaucgccgggc

SEQ ID NO: 446953 - RNA, 16 nt, Brucella suis 1330
cuuccgagaaccgauu

SEQ ID NO: 446954 - RNA, 19 nt, Brucella suis 1330
cuuccgaaaaccgcuucag

SEQ ID NO: 446955 - RNA, 16 nt, Brucella suis 1330
cuuccaguuucugaau

SEQ ID NO: 446956 - RNA, 17 nt, Brucella suis 1330
cuucauucaaucugcau

SEQ ID NO: 446957 - RNA, 19 nt, Brucella suis 1330
cuucaggcgcgaggcggcu

SEQ ID NO: 446958 - RNA, 19 nt, Brucella suis 1330
cuucagggacgagcggcag

SEQ ID NO: 446959 - RNA, 21 nt, Brucella suis 1330
cuucagggacgagcggcaggc

SEQ ID NO: 446960 - RNA, 16 nt, Brucella suis 1330
cuucaggcccuugccg

SEQ ID NO: 446961 - RNA, 20 nt, Brucella suis 1330
cuucaggccgucgaucagcu

SEQ ID NO: 446962 - RNA, 14 nt, Brucella suis 1330
cuucaccagccuug

SEQ ID NO: 446963 - RNA, 14 nt, Brucella suis 1330
cuuaugugaagauu

SEQ ID NO: 446964 - RNA, 15 nt, Brucella suis 1330
cuucacauccuucac

SEQ ID NO: 446965 - RNA, 16 nt, Brucella suis 1330
cuucacauccuucacu

SEQ ID NO: 446966 - RNA, 15 nt, Brucella suis 1330
cuucacaugcuugcc

SEQ ID NO: 446967 - RNA, 20 nt, Brucella suis 1330
cuuacaaguauuucauggaa

SEQ ID NO: 446968 - RNA, 17 nt, Brucella suis 1330
cuuaaucccuuacucca

SEQ ID NO: 446969 - RNA, 17 nt, Brucella suis 1330
cuuaauugcuuuccugc

SEQ ID NO: 446970 - RNA, 20 nt, Brucella suis 1330
cuuaauugcuuuccugcaca

SEQ ID NO: 446971 - RNA, 20 nt, Brucella suis 1330
cuuacugcccuauugccuua

SEQ ID NO: 446972 - RNA, 20 nt, Brucella suis 1330
cuguuucgaggcccaggccc

SEQ ID NO: 446973 - RNA, 18 nt, Brucella suis 1330
cuguuucauaaacgcggg

SEQ ID NO: 446974 - RNA, 13 nt, Brucella suis 1330
cuguuuggucuca

SEQ ID NO: 446975 - RNA, 21 nt, Brucella suis 1330
cuguugaggcgaaugaucuug

SEQ ID NO: 446976 - RNA, 16 nt, Brucella suis 1330
cugucgggcucaggcu

SEQ ID NO: 446977 - RNA, 17 nt, Brucella suis 1330
cugucggcaaacaucca

SEQ ID NO: 446978 - RNA, 17 nt, Brucella suis 1330
cugucgccagcgccggu

SEQ ID NO: 446979 - RNA, 16 nt, Brucella suis 1330
cugucgcccagaaccg

SEQ ID NO: 446980 - RNA, 19 nt, Brucella suis 1330
cugucccuucuugcucuca

SEQ ID NO: 446981 - RNA, 14 nt, Brucella suis 1330
cugucaccgccagc

SEQ ID NO: 446982 - RNA, 16 nt, Brucella suis 1330
cugucacgaucuugcc

SEQ ID NO: 446983 - RNA, 17 nt, Brucella suis 1330
cugucacgaucuugccg

SEQ ID NO: 446984 - RNA, 14 nt, Brucella suis 1330
cugucagcgccgcc

SEQ ID NO: 446985 - RNA, 20 nt, Brucella suis 1330
cugucagcuuuccggcuucc

SEQ ID NO: 446986 - RNA, 17 nt, Brucella suis 1330
cuguacauacaugauga

SEQ ID NO: 446987 - RNA, 21 nt, Brucella suis 1330
cuggucaauaucgcgcaggcg

SEQ ID NO: 446988 - RNA, 21 nt, Brucella suis 1330
cugggugaauucgggguucuu

SEQ ID NO: 446989 - RNA, 20 nt, Brucella suis 1330
cuggggauacgugcaagagc

SEQ ID NO: 446990 - RNA, 13 nt, Brucella suis 1330
cugggccuuguuu

SEQ ID NO: 446991 - RNA, 16 nt, Brucella suis 1330
cuggcguccagaagau

SEQ ID NO: 446992 - RNA, 13 nt, Brucella suis 1330
cuggccaagcguc

SEQ ID NO: 446993 - RNA, 10 nt, Brucella suis 1330
cuggcaucca

SEQ ID NO: 446994 - RNA, 21 nt, Brucella suis 1330
cuggcauccagcacuuccaga

SEQ ID NO: 446995 - RNA, 16 nt, Brucella suis 1330
cuggcacaaagcggcc

SEQ ID NO: 446996 - RNA, 21 nt, Brucella suis 1330
cuggagcuucggauuuuucuc

SEQ ID NO: 446997 - RNA, 21 nt, Brucella suis 1330
cugcuugguuuccgccagcau

SEQ ID NO: 446998 - RNA, 13 nt, Brucella suis 1330
cuggaaagaagcg

SEQ ID NO: 446999 - RNA, 14 nt, Brucella suis 1330
cugcucagaggcuc

SEQ ID NO: 447000 - RNA, 19 nt, Brucella suis 1330
cugcucauaaacgcugcug

SEQ ID NO: 447001 - RNA, 13 nt, Brucella suis 1330
cugcuucuugccu

SEQ ID NO: 447002 - RNA, 13 nt, Brucella suis 1330
cugcgugcugcuu

SEQ ID NO: 447003 - RNA, 15 nt, Brucella suis 1330
cugcgggcggcggcu

SEQ ID NO: 447004 - RNA, 16 nt, Brucella suis 1330
cugcgggcgagaucgu

SEQ ID NO: 447005 - RNA, 22 nt, Brucella suis 1330
cugcgguagcgcauggcagcaa

SEQ ID NO: 447006 - RNA, 16 nt, Brucella suis 1330
cugcgcgcgcauggcg

SEQ ID NO: 447007 - RNA, 22 nt, Brucella suis 1330
cugcgcgcgcguggucauggcc

SEQ ID NO: 447008 - RNA, 15 nt, Brucella suis 1330
cugcgcccgcgccgc

SEQ ID NO: 447009 - RNA, 13 nt, Brucella suis 1330
cugcgcccaggcg

SEQ ID NO: 447010 - RNA, 17 nt, Brucella suis 1330
cugcgcaugggacugga

SEQ ID NO: 447011 - RNA, 13 nt, Brucella suis 1330
cugccuccauggc

SEQ ID NO: 447012 - RNA, 16 nt, Brucella suis 1330
cugccggcucaugguc

SEQ ID NO: 447013 - RNA, 23 nt, Brucella suis 1330
cugccggugccggcaggcugucc

SEQ ID NO: 447014 - RNA, 22 nt, Brucella suis 1330
cugccgguucugcauguaguug

SEQ ID NO: 447015 - RNA, 21 nt, Brucella suis 1330
cugccggauuauaccggcgug

SEQ ID NO: 447016 - RNA, 12 nt, Brucella suis 1330
cugccaggcauu

SEQ ID NO: 447017 - RNA, 14 nt, Brucella suis 1330
cugcaaucaccaga

SEQ ID NO: 447018 - RNA, 17 nt, Brucella suis 1330
cugcaagauaggcccag

SEQ ID NO: 447019 - RNA, 19 nt, Brucella suis 1330
cugcaagauaggcccaggc

SEQ ID NO: 447020 - RNA, 16 nt, Brucella suis 1330
cugauuugaaaagccc

SEQ ID NO: 447021 - RNA, 13 nt, Brucella suis 1330
cugcaaaccggcu

SEQ ID NO: 447022 - RNA, 17 nt, Brucella suis 1330
cugaucuaguggagcac

SEQ ID NO: 447023 - RNA, 14 nt, Brucella suis 1330
cugaucguaaagca

SEQ ID NO: 447024 - RNA, 19 nt, Brucella suis 1330
cugaucguaaagcagaugg

SEQ ID NO: 447025 - RNA, 20 nt, Brucella suis 1330
cugauugcaggucuuucugc

SEQ ID NO: 447026 - RNA, 23 nt, Brucella suis 1330
cugauagaugcgauccuuguucu

SEQ ID NO: 447027 - RNA, 20 nt, Brucella suis 1330
cugagggaaacacucugccu

SEQ ID NO: 447028 - RNA, 21 nt, Brucella suis 1330
cugagcuacgggugcuugccu

SEQ ID NO: 447029 - RNA, 20 nt, Brucella suis 1330
cucguuuuugacugcugcca

SEQ ID NO: 447030 - RNA, 23 nt, Brucella suis 1330
cucgucgaaauccuucagaagca

SEQ ID NO: 447031 - RNA, 11 nt, Brucella suis 1330
cucggcuucaa

SEQ ID NO: 447032 - RNA, 16 nt, Brucella suis 1330
cucgcggaaaagcucg

SEQ ID NO: 447033 - RNA, 17 nt, Brucella suis 1330
cucgcgucccgcacgca

SEQ ID NO: 447034 - RNA, 15 nt, Brucella suis 1330
cucgcccagaaacaa

SEQ ID NO: 447035 - RNA, 13 nt, Brucella suis 1330
cucgcaaaacacc

SEQ ID NO: 447036 - RNA, 14 nt, Brucella suis 1330
cucgcaaaacacca

SEQ ID NO: 447037 - RNA, 18 nt, Brucella suis 1330
cucgaucacgaaagucug

SEQ ID NO: 447038 - RNA, 17 nt, Brucella suis 1330
cucgacgcuuuccaccg

SEQ ID NO: 447039 - RNA, 23 nt, Brucella suis 1330
cuccggcgggcuuuuguuuucaa

SEQ ID NO: 447040 - RNA, 14 nt, Brucella suis 1330
cuccggcgcgggcu

SEQ ID NO: 447041 - RNA, 20 nt, Brucella suis 1330
cuccgcaccgaaggcaagca

SEQ ID NO: 447042 - RNA, 19 nt, Brucella suis 1330
cuccgcaccucaggaugag

SEQ ID NO: 447043 - RNA, 20 nt, Brucella suis 1330
cuccgcccauacgcgcggca

SEQ ID NO: 447044 - RNA, 15 nt, Brucella suis 1330
cucccuguccugcca

SEQ ID NO: 447045 - RNA, 15 nt, Brucella suis 1330
cucccugcgcgcgcc

SEQ ID NO: 447046 - RNA, 20 nt, Brucella suis 1330
cuccauuaaucaaaaacaau

SEQ ID NO: 447047 - RNA, 18 nt, Brucella suis 1330
cuccagucgaggcagcca

SEQ ID NO: 447048 - RNA, 22 nt, Brucella suis 1330
cuccagcccuucaucaagcugu

SEQ ID NO: 447049 - RNA, 16 nt, Brucella suis 1330
cuccagccgagcgcca

SEQ ID NO: 447050 - RNA, 21 nt, Brucella suis 1330
cuccagauugcgggcaagcau

SEQ ID NO: 447051 - RNA, 12 nt, Brucella suis 1330
cucauuucggcu

SEQ ID NO: 447052 - RNA, 17 nt, Brucella suis 1330
cucauuuggacaaaagc

SEQ ID NO: 447053 - RNA, 12 nt, Brucella suis 1330
cucauuuuuaga

SEQ ID NO: 447054 - RNA, 18 nt, Brucella suis 1330
cucauggcuuccugcguc

SEQ ID NO: 447055 - RNA, 17 nt, Brucella suis 1330
cucaucggguucugcua

SEQ ID NO: 447056 - RNA, 12 nt, Brucella suis 1330
cucaucgccgga

SEQ ID NO: 447057 - RNA, 21 nt, Brucella suis 1330
cucaucgcaguugcaccgccc

SEQ ID NO: 447058 - RNA, 14 nt, Brucella suis 1330
cucauccuccacga

SEQ ID NO: 447059 - RNA, 23 nt, Brucella suis 1330
cucaucaaaagcgucgcaaugcc

SEQ ID NO: 447060 - RNA, 15 nt, Brucella suis 1330
cucagcuauagccug

SEQ ID NO: 447061 - RNA, 18 nt, Brucella suis 1330
cucagcuuuuccaucacu

SEQ ID NO: 447062 - RNA, 23 nt, Brucella suis 1330
cucagcuuuuccaucacuucguc

SEQ ID NO: 447063 - RNA, 22 nt, Brucella suis 1330
cucaggagauaggggccaaggc

SEQ ID NO: 447064 - RNA, 12 nt, Brucella suis 1330
cucaccuugccg

SEQ ID NO: 447065 - RNA, 21 nt, Brucella suis 1330
cucaaugccgcauucagcaca

SEQ ID NO: 447066 - RNA, 17 nt, Brucella suis 1330
cuaugcgugguccagcc

SEQ ID NO: 447067 - RNA, 18 nt, Brucella suis 1330
cuaucucuccuaaacuca

SEQ ID NO: 447068 - RNA, 15 nt, Brucella suis 1330
cuauccugaccguga

SEQ ID NO: 447069 - RNA, 15 nt, Brucella suis 1330
cuacgcaaaaccgcu

SEQ ID NO: 447070 - RNA, 18 nt, Brucella suis 1330
cuaccggaggcauccuug

SEQ ID NO: 447071 - RNA, 20 nt, Brucella suis 1330
cuaccggaggcauccuuguc

SEQ ID NO: 447072 - RNA, 17 nt, Brucella suis 1330
cguuucgccccguugca

SEQ ID NO: 447073 - RNA, 17 nt, Brucella suis 1330
cguuucggaauagauga

SEQ ID NO: 447074 - RNA, 20 nt, Brucella suis 1330
cguuucgauauccuggccuu

SEQ ID NO: 447075 - RNA, 14 nt, Brucella suis 1330
cuaaagcauaucuu

SEQ ID NO: 447076 - RNA, 12 nt, Brucella suis 1330
cguucagccugc

SEQ ID NO: 447077 - RNA, 18 nt, Brucella suis 1330
cguucacaaucuugccaa

SEQ ID NO: 447078 - RNA, 16 nt, Brucella suis 1330
cguguugagaucgcgc

SEQ ID NO: 447079 - RNA, 21 nt, Brucella suis 1330
cgugugcuugccgaaaagccg

SEQ ID NO: 447080 - RNA, 15 nt, Brucella suis 1330
cgugucguucucuau

SEQ ID NO: 447081 - RNA, 18 nt, Brucella suis 1330
cguggucauggccacgcc

SEQ ID NO: 447082 - RNA, 21 nt, Brucella suis 1330
cguggucauggccacgccagc

SEQ ID NO: 447083 - RNA, 19 nt, Brucella suis 1330
cguggcuuuuccggcggcg

SEQ ID NO: 447084 - RNA, 22 nt, Brucella suis 1330
cguggcaagcccgcugcgccgc

SEQ ID NO: 447085 - RNA, 22 nt, Brucella suis 1330
cguggagggauaggugagcggc

SEQ ID NO: 447086 - RNA, 12 nt, Brucella suis 1330
cgugcuccagau

SEQ ID NO: 447087 - RNA, 15 nt, Brucella suis 1330
cgugcuccagauacc

SEQ ID NO: 447088 - RNA, 13 nt, Brucella suis 1330
cgugcggaagcga

SEQ ID NO: 447089 - RNA, 17 nt, Brucella suis 1330
cgugcgauugaugucau

SEQ ID NO: 447090 - RNA, 16 nt, Brucella suis 1330
cgugccuugaauagcg

SEQ ID NO: 447091 - RNA, 20 nt, Brucella suis 1330
cgugccgccgugaaaauaag

SEQ ID NO: 447092 - RNA, 16 nt, Brucella suis 1330
cgugccggaauggcca

SEQ ID NO: 447093 - RNA, 16 nt, Brucella suis 1330
cgugcauucugccggu

SEQ ID NO: 447094 - RNA, 13 nt, Brucella suis 1330
cgugcaggcugcc

SEQ ID NO: 447095 - RNA, 22 nt, Brucella suis 1330
cgugagcuucaggucggcauug

SEQ ID NO: 447096 - RNA, 22 nt, Brucella suis 1330
cgugaggccgguaaaauuggca

SEQ ID NO: 447097 - RNA, 11 nt, Brucella suis 1330
cgugacggugc

SEQ ID NO: 447098 - RNA, 19 nt, Brucella suis 1330
cgugaccgccuggcccggc

SEQ ID NO: 447099 - RNA, 18 nt, Brucella suis 1330
cgugacgagcgcacgcag

SEQ ID NO: 447100 - RNA, 17 nt, Brucella suis 1330
cgugaagccgcuucaac

SEQ ID NO: 447101 - RNA, 20 nt, Brucella suis 1330
cgugaagauugcuucaggca

SEQ ID NO: 447102 - RNA, 14 nt, Brucella suis 1330
cgucuucuccaaag

SEQ ID NO: 447103 - RNA, 17 nt, Brucella suis 1330
cgucugcaucgagcggc

SEQ ID NO: 447104 - RNA, 18 nt, Brucella suis 1330
cgucugcaucgagcggca

SEQ ID NO: 447105 - RNA, 15 nt, Brucella suis 1330
cgucgugcggccgca

SEQ ID NO: 447106 - RNA, 20 nt, Brucella suis 1330
cgucggccaguucagcggcg

SEQ ID NO: 447107 - RNA, 22 nt, Brucella suis 1330
cgucggcaaugaucuggcgcgc

SEQ ID NO: 447108 - RNA, 15 nt, Brucella suis 1330
cgucggacuucugcu

SEQ ID NO: 447109 - RNA, 18 nt, Brucella suis 1330
cgucggaaaauuccaugc

SEQ ID NO: 447110 - RNA, 20 nt, Brucella suis 1330
cgucgcuaccaugcggccgu

SEQ ID NO: 447111 - RNA, 14 nt, Brucella suis 1330
cgucgcauccagaa

SEQ ID NO: 447112 - RNA, 20 nt, Brucella suis 1330
cgucgcaccggauuugccaa

SEQ ID NO: 447113 - RNA, 18 nt, Brucella suis 1330
cgucgauaucgagcgcga

SEQ ID NO: 447114 - RNA, 19 nt, Brucella suis 1330
cgucgaggaaaaagcccgc

SEQ ID NO: 447115 - RNA, 15 nt, Brucella suis 1330
cgucgaccagcgcau

SEQ ID NO: 447116 - RNA, 14 nt, Brucella suis 1330
cguccuugacggga

SEQ ID NO: 447117 - RNA, 17 nt, Brucella suis 1330
cguccuucaggcccuug

SEQ ID NO: 447118 - RNA, 13 nt, Brucella suis 1330
cguccuucgaggc

SEQ ID NO: 447119 - RNA, 22 nt, Brucella suis 1330
cguccugaugccguuuucauca

SEQ ID NO: 447120 - RNA, 17 nt, Brucella suis 1330
cguccgucgcgugagga

SEQ ID NO: 447121 - RNA, 19 nt, Brucella suis 1330
cguccucaugguugaauuc

SEQ ID NO: 447122 - RNA, 19 nt, Brucella suis 1330
cguccggcacuucgcccag

SEQ ID NO: 447123 - RNA, 13 nt, Brucella suis 1330
cguccgccaccgc

SEQ ID NO: 447124 - RNA, 19 nt, Brucella suis 1330
cgucccgcacgcaggacaa

SEQ ID NO: 447125 - RNA, 21 nt, Brucella suis 1330
cguccccaucgaaaccggcau

SEQ ID NO: 447126 - RNA, 15 nt, Brucella suis 1330
cguccaugagcgcac

SEQ ID NO: 447127 - RNA, 19 nt, Brucella suis 1330
cguccaugagcgcaccauu

SEQ ID NO: 447128 - RNA, 20 nt, Brucella suis 1330
cguccagaagaucgucggca

SEQ ID NO: 447129 - RNA, 15 nt, Brucella suis 1330
cguaauggcgcggcu

SEQ ID NO: 447130 - RNA, 23 nt, Brucella suis 1330
cguaaauauucaggaucuuucca

SEQ ID NO: 447131 - RNA, 17 nt, Brucella suis 1330
cgguugcagccgccaga

SEQ ID NO: 447132 - RNA, 23 nt, Brucella suis 1330
cgguuccaccggcuguguaaaag

SEQ ID NO: 447133 - RNA, 20 nt, Brucella suis 1330
cgguucagauugcagcaagc

SEQ ID NO: 447134 - RNA, 15 nt, Brucella suis 1330
cggugcuggccgugg

SEQ ID NO: 447135 - RNA, 19 nt, Brucella suis 1330
cggugcucugcgcccaggc

SEQ ID NO: 447136 - RNA, 18 nt, Brucella suis 1330
cggugcggauuacgagac

SEQ ID NO: 447137 - RNA, 21 nt, Brucella suis 1330
cggugaagacauggcgggcca

SEQ ID NO: 447138 - RNA, 15 nt, Brucella suis 1330
cggucuugagccggg

SEQ ID NO: 447139 - RNA, 11 nt, Brucella suis 1330
cggucuugccg

SEQ ID NO: 447140 - RNA, 16 nt, Brucella suis 1330
cggucuugccggccug

SEQ ID NO: 447141 - RNA, 23 nt, Brucella suis 1330
cggucuugcgcuugcgaccacca

SEQ ID NO: 447142 - RNA, 13 nt, Brucella suis 1330
cggucuugggauu

SEQ ID NO: 447143 - RNA, 14 nt, Brucella suis 1330
cggucugaaaucag

SEQ ID NO: 447144 - RNA, 20 nt, Brucella suis 1330
cggucaaaacgccccggcau

SEQ ID NO: 447145 - RNA, 15 nt, Brucella suis 1330
cgguacggaaagggc

SEQ ID NO: 447146 - RNA, 16 nt, Brucella suis 1330
cgguacggaaagggcu

SEQ ID NO: 447147 - RNA, 14 nt, Brucella suis 1330
cgguaccgaagagc

SEQ ID NO: 447148 - RNA, 18 nt, Brucella suis 1330
cggguggcgcgaaaccgg

SEQ ID NO: 447149 - RNA, 21 nt, Brucella suis 1330
cgggugccagaucggcaagcg

SEQ ID NO: 447150 - RNA, 23 nt, Brucella suis 1330
cgggguuuuucuuuguccagaaa

SEQ ID NO: 447151 - RNA, 19 nt, Brucella suis 1330
cgggguucuucaacugugu

SEQ ID NO: 447152 - RNA, 20 nt, Brucella suis 1330
cggggcaagaaaaaaggucg

SEQ ID NO: 447153 - RNA, 22 nt, Brucella suis 1330
cgggccaacgccggcaccgccc

SEQ ID NO: 447154 - RNA, 21 nt, Brucella suis 1330
cgggcaucgcucgaaggcagc

SEQ ID NO: 447155 - RNA, 22 nt, Brucella suis 1330
cgggcaagcauuccgggccgca

SEQ ID NO: 447156 - RNA, 19 nt, Brucella suis 1330
cgggaugcgcuuuaaagca

SEQ ID NO: 447157 - RNA, 19 nt, Brucella suis 1330
cgggaucaaugaucuggcu

SEQ ID NO: 447158 - RNA, 13 nt, Brucella suis 1330
cgggaccaccggc

SEQ ID NO: 447159 - RNA, 17 nt, Brucella suis 1330
cgggaaagggccgccuu

SEQ ID NO: 447160 - RNA, 22 nt, Brucella suis 1330
cggcuggaauuguuccagccgg

SEQ ID NO: 447161 - RNA, 21 nt, Brucella suis 1330
cggcugaaagcgccaguucag

SEQ ID NO: 447162 - RNA, 20 nt, Brucella suis 1330
cggcugaaaucugcgccggu

SEQ ID NO: 447163 - RNA, 15 nt, Brucella suis 1330
cggcguuuuccauga

SEQ ID NO: 447164 - RNA, 14 nt, Brucella suis 1330
cggcuccaccaccu

SEQ ID NO: 447165 - RNA, 21 nt, Brucella suis 1330
cggcgugaucucgcagguucc

SEQ ID NO: 447166 - RNA, 17 nt, Brucella suis 1330
cggcgucaguggcagca

SEQ ID NO: 447167 - RNA, 15 nt, Brucella suis 1330
cggcgucagcuuguc

SEQ ID NO: 447168 - RNA, 21 nt, Brucella suis 1330
cggcggugaagaagcgccagc

SEQ ID NO: 447169 - RNA, 13 nt, Brucella suis 1330
cggcggcaggcag

SEQ ID NO: 447170 - RNA, 13 nt, Brucella suis 1330
cggcgcugcucgc

SEQ ID NO: 447171 - RNA, 15 nt, Brucella suis 1330
cggcgcgaccgcguu

SEQ ID NO: 447172 - RNA, 19 nt, Brucella suis 1330
cggcgccuugaugccgcuc

SEQ ID NO: 447173 - RNA, 23 nt, Brucella suis 1330
cggcgccaccgucaccggcuggg

SEQ ID NO: 447174 - RNA, 20 nt, Brucella suis 1330
cggcgcauggccucaagugc

SEQ ID NO: 447175 - RNA, 23 nt, Brucella suis 1330
cggcgcaguuucgcagccaagau

SEQ ID NO: 447176 - RNA, 12 nt, Brucella suis 1330
cggcgcaggcag

SEQ ID NO: 447177 - RNA, 16 nt, Brucella suis 1330
cggcgcaaaggccggg

SEQ ID NO: 447178 - RNA, 20 nt, Brucella suis 1330
cggcgauaccagacgcgcac

SEQ ID NO: 447179 - RNA, 20 nt, Brucella suis 1330
cggccuuugcgccgggucag

SEQ ID NO: 447180 - RNA, 19 nt, Brucella suis 1330
cggccaugcguugcuggaa

SEQ ID NO: 447181 - RNA, 15 nt, Brucella suis 1330
cggccaugcccaugc

SEQ ID NO: 447182 - RNA, 20 nt, Brucella suis 1330
cggccaguuuggcugugcug

SEQ ID NO: 447183 - RNA, 17 nt, Brucella suis 1330
cggccagcuugaaaagc

SEQ ID NO: 447184 - RNA, 23 nt, Brucella suis 1330
cggccagcaauugcugggcuucc

SEQ ID NO: 447185 - RNA, 19 nt, Brucella suis 1330
cggccagaauauccggcuc

SEQ ID NO: 447186 - RNA, 15 nt, Brucella suis 1330
cggccacccagcccg

SEQ ID NO: 447187 - RNA, 15 nt, Brucella suis 1330
cggccaagcgccaga

SEQ ID NO: 447188 - RNA, 13 nt, Brucella suis 1330
cggcauugccugu

SEQ ID NO: 447189 - RNA, 19 nt, Brucella suis 1330
cggcauggccugcgcgcgc

SEQ ID NO: 447190 - RNA, 15 nt, Brucella suis 1330
cggcagccgaaagca

SEQ ID NO: 447191 - RNA, 15 nt, Brucella suis 1330
cggcagaguggacgg

SEQ ID NO: 447192 - RNA, 13 nt, Brucella suis 1330
cggcaccgcgcaa

SEQ ID NO: 447193 - RNA, 19 nt, Brucella suis 1330
cggcaaugucgcaaagcgu

SEQ ID NO: 447194 - RNA, 14 nt, Brucella suis 1330
cggcaaugaucugg

SEQ ID NO: 447195 - RNA, 23 nt, Brucella suis 1330
cggcaauggcgggccauuuccaa

SEQ ID NO: 447196 - RNA, 12 nt, Brucella suis 1330
cggcaagcggcu

SEQ ID NO: 447197 - RNA, 22 nt, Brucella suis 1330
cggcaagcuggaaggccaggcc

SEQ ID NO: 447198 - RNA, 16 nt, Brucella suis 1330
cggcaacggcgcuggc

SEQ ID NO: 447199 - RNA, 16 nt, Brucella suis 1330
cggauauucgccgccu

SEQ ID NO: 447200 - RNA, 19 nt, Brucella suis 1330
cggauagagaacauauccu

SEQ ID NO: 447201 - RNA, 16 nt, Brucella suis 1330
cggauaaugcucgccc

SEQ ID NO: 447202 - RNA, 20 nt, Brucella suis 1330
cggacggauggcauggacca

SEQ ID NO: 447203 - RNA, 15 nt, Brucella suis 1330
cggagaaaacgccga

SEQ ID NO: 447204 - RNA, 12 nt, Brucella suis 1330
cggacgcgcaga

SEQ ID NO: 447205 - RNA, 14 nt, Brucella suis 1330
cggacagauugcua

SEQ ID NO: 447206 - RNA, 21 nt, Brucella suis 1330
cggacaagcucgcguuccagc

SEQ ID NO: 447207 - RNA, 23 nt, Brucella suis 1330
cggaaugcccuggaugcggaaca

SEQ ID NO: 447208 - RNA, 15 nt, Brucella suis 1330
cggaagcgaaaugcc

SEQ ID NO: 447209 - RNA, 16 nt, Brucella suis 1330
cggaagcgaaaugccg

SEQ ID NO: 447210 - RNA, 16 nt, Brucella suis 1330
cggaagcgcaaaacag

SEQ ID NO: 447211 - RNA, 15 nt, Brucella suis 1330
cggaagcgcaaggcg

SEQ ID NO: 447212 - RNA, 15 nt, Brucella suis 1330
cggaacaaacuggcg

SEQ ID NO: 447213 - RNA, 13 nt, Brucella suis 1330
cgcuuggcaccgc

SEQ ID NO: 447214 - RNA, 15 nt, Brucella suis 1330
cgcuugcguuccucu

SEQ ID NO: 447215 - RNA, 21 nt, Brucella suis 1330
cgcuucuuccuucggcaaggg

SEQ ID NO: 447216 - RNA, 23 nt, Brucella suis 1330
cgcuucuuccuucggcaagggca

SEQ ID NO: 447217 - RNA, 22 nt, Brucella suis 1330
cgcuucuugcuguaaccgccac

SEQ ID NO: 447218 - RNA, 12 nt, Brucella suis 1330
cgcuucuucauu

SEQ ID NO: 447219 - RNA, 22 nt, Brucella suis 1330
cgcuucgcgcaggccgcggcau

SEQ ID NO: 447220 - RNA, 15 nt, Brucella suis 1330
cgcuuccggugcuca

SEQ ID NO: 447221 - RNA, 12 nt, Brucella suis 1330
cgcuuccuccag

SEQ ID NO: 447222 - RNA, 12 nt, Brucella suis 1330
cgcugcaacaaa

SEQ ID NO: 447223 - RNA, 16 nt, Brucella suis 1330
cgcugcaacaaaugca

SEQ ID NO: 447224 - RNA, 23 nt, Brucella suis 1330
cgcucuggaauuucuaaaaugaa

SEQ ID NO: 447225 - RNA, 14 nt, Brucella suis 1330
cgcucgccgcccac

SEQ ID NO: 447226 - RNA, 19 nt, Brucella suis 1330
cgcuccgcccuggcggcgu

SEQ ID NO: 447227 - RNA, 16 nt, Brucella suis 1330
cgcucccggucuuccu

SEQ ID NO: 447228 - RNA, 13 nt, Brucella suis 1330
cgcuccaccagca

SEQ ID NO: 447229 - RNA, 12 nt, Brucella suis 1330
cgcucaucgcag

SEQ ID NO: 447230 - RNA, 16 nt, Brucella suis 1330
cgcguugcccaugucc

SEQ ID NO: 447231 - RNA, 20 nt, Brucella suis 1330
cgcgggcuucugcgcccgcg

SEQ ID NO: 447232 - RNA, 18 nt, Brucella suis 1330
cgcgggaaaaaucgcgcg

SEQ ID NO: 447233 - RNA, 15 nt, Brucella suis 1330
cgcggcguggaaagc

SEQ ID NO: 447234 - RNA, 19 nt, Brucella suis 1330
cgcggcgguuuugagcugc

SEQ ID NO: 447235 - RNA, 19 nt, Brucella suis 1330
cgcggcggcaacgggcgag

SEQ ID NO: 447236 - RNA, 14 nt, Brucella suis 1330
cgcggccagccagc

SEQ ID NO: 447237 - RNA, 23 nt, Brucella suis 1330
cgcggcaagauagccccagcccg

SEQ ID NO: 447238 - RNA, 22 nt, Brucella suis 1330
cgcggcaaugcgcuucgcgcag

SEQ ID NO: 447239 - RNA, 16 nt, Brucella suis 1330
cgcggauaucggcgcg

SEQ ID NO: 447240 - RNA, 22 nt, Brucella suis 1330
cgcggacgggcaggcagaugcg

SEQ ID NO: 447241 - RNA, 16 nt, Brucella suis 1330
cgcggaaaagcucgcg

SEQ ID NO: 447242 - RNA, 23 nt, Brucella suis 1330
cgcgcucggcaagcgcggucagc

SEQ ID NO: 447243 - RNA, 23 nt, Brucella suis 1330
cgcgcguggucauggccacgcca

SEQ ID NO: 447244 - RNA, 21 nt, Brucella suis 1330
cgcgcggcuuccagcgccuca

SEQ ID NO: 447245 - RNA, 14 nt, Brucella suis 1330
cgcgcggcaugaaa

SEQ ID NO: 447246 - RNA, 12 nt, Brucella suis 1330
cgcgcgcggccc

SEQ ID NO: 447247 - RNA, 22 nt, Brucella suis 1330
cgcgcgccucgaauuccaccgc

SEQ ID NO: 447248 - RNA, 20 nt, Brucella suis 1330
cgcgcgaaaccauggagcgc

SEQ ID NO: 447249 - RNA, 16 nt, Brucella suis 1330
cgcgccucacccucca

SEQ ID NO: 447250 - RNA, 19 nt, Brucella suis 1330
cgcgccucacccuccaccg

SEQ ID NO: 447251 - RNA, 20 nt, Brucella suis 1330
cgccagauaagacauggcuu

SEQ ID NO: 447252 - RNA, 22 nt, Brucella suis 1330
cgccagauaagacauggcuucc

SEQ ID NO: 447253 - RNA, 20 nt, Brucella suis 1330
cgccagaucaugggcggcca

SEQ ID NO: 447254 - RNA, 22 nt, Brucella suis 1330
cgccagaagcguaaugccccgc

SEQ ID NO: 447255 - RNA, 22 nt, Brucella suis 1330
cgccagagcauuuucgccgcag

SEQ ID NO: 447256 - RNA, 15 nt, Brucella suis 1330
cgccacuucgcgggc

SEQ ID NO: 447257 - RNA, 18 nt, Brucella suis 1330
cgccacgcgggcuucugc

SEQ ID NO: 447258 - RNA, 15 nt, Brucella suis 1330
cgccaccgcgccggu

SEQ ID NO: 447259 - RNA, 18 nt, Brucella suis 1330
cgccaagacuuuccaucc

SEQ ID NO: 447260 - RNA, 18 nt, Brucella suis 1330
cgccaaggaacgcggccu

SEQ ID NO: 447261 - RNA, 16 nt, Brucella suis 1330
cgccaagggccgccga

SEQ ID NO: 447262 - RNA, 20 nt, Brucella suis 1330
cgccaaguucuuccgccaga

SEQ ID NO: 447263 - RNA, 18 nt, Brucella suis 1330
cgccaaacugcaccgucu

SEQ ID NO: 447264 - RNA, 19 nt, Brucella suis 1330
cgcauucccuugaaaucau

SEQ ID NO: 447265 - RNA, 14 nt, Brucella suis 1330
cgcauucagagcuu

SEQ ID NO: 447266 - RNA, 21 nt, Brucella suis 1330
cgcaucguaaucgccgggccu

SEQ ID NO: 447267 - RNA, 20 nt, Brucella suis 1330
cgcaucgcaauagaccacca

SEQ ID NO: 447268 - RNA, 22 nt, Brucella suis 1330
cgcaucgaucacaugcgcgccc

SEQ ID NO: 447269 - RNA, 13 nt, Brucella suis 1330
cgcaucgaccacu

SEQ ID NO: 447270 - RNA, 17 nt, Brucella suis 1330
cgcauccagaacuucgc

SEQ ID NO: 447271 - RNA, 18 nt, Brucella suis 1330
cgcauccagccggcgcau

SEQ ID NO: 447272 - RNA, 19 nt, Brucella suis 1330
cgcauaucgcgcgaccagg

SEQ ID NO: 447273 - RNA, 14 nt, Brucella suis 1330
cgcaggccgcggca

SEQ ID NO: 447274 - RNA, 16 nt, Brucella suis 1330
cgcagcgucgagcagg

SEQ ID NO: 447275 - RNA, 16 nt, Brucella suis 1330
cgcagcaaccaucauc

SEQ ID NO: 447276 - RNA, 15 nt, Brucella suis 1330
cgcagacgcagcgca

SEQ ID NO: 447277 - RNA, 16 nt, Brucella suis 1330
cgcagaaggcgcugca

SEQ ID NO: 447278 - RNA, 12 nt, Brucella suis 1330
cgcacgaccaga

SEQ ID NO: 447279 - RNA, 18 nt, Brucella suis 1330
cgcaccgugcuccagaua

SEQ ID NO: 447280 - RNA, 14 nt, Brucella suis 1330
cgcaccggcaugga

SEQ ID NO: 447281 - RNA, 16 nt, Brucella suis 1330
cgcaccggcauggauc

SEQ ID NO: 447282 - RNA, 21 nt, Brucella suis 1330
cgcaccgauauagagcagcac

SEQ ID NO: 447283 - RNA, 23 nt, Brucella suis 1330
cgcaccgauccgcaacucaugga

SEQ ID NO: 447284 - RNA, 16 nt, Brucella suis 1330
cgcaccgcacugggga

SEQ ID NO: 447285 - RNA, 22 nt, Brucella suis 1330
cgcacaucaaugugaaggcgcu

SEQ ID NO: 447286 - RNA, 22 nt, Brucella suis 1330
cgcaauucguggucaugcgcgc

SEQ ID NO: 447287 - RNA, 19 nt, Brucella suis 1330
cgcaauugcgcaaggcccu

SEQ ID NO: 447288 - RNA, 15 nt, Brucella suis 1330
cgcaaugagcccgcg

SEQ ID NO: 447289 - RNA, 21 nt, Brucella suis 1330
cgcaauggcugucaaugcagc

SEQ ID NO: 447290 - RNA, 22 nt, Brucella suis 1330
cgcaaugugcgggcuucuucca

SEQ ID NO: 447291 - RNA, 19 nt, Brucella suis 1330
cgcaagccaguccuugccc

SEQ ID NO: 447292 - RNA, 15 nt, Brucella suis 1330
cgcaaccaaaacaua

SEQ ID NO: 447293 - RNA, 22 nt, Brucella suis 1330
cgcaaaagcuccaccaccccuu

SEQ ID NO: 447294 - RNA, 18 nt, Brucella suis 1330
cgauuugcgcaccagauu

SEQ ID NO: 447295 - RNA, 19 nt, Brucella suis 1330
cgauugcaccaugguguca

SEQ ID NO: 447296 - RNA, 16 nt, Brucella suis 1330
cgauugcgcauugaca

SEQ ID NO: 447297 - RNA, 18 nt, Brucella suis 1330
cgauguuuucaccaguca

SEQ ID NO: 447298 - RNA, 14 nt, Brucella suis 1330
cgaugucgccgcuc

SEQ ID NO: 447299 - RNA, 21 nt, Brucella suis 1330
cgauggcguucgucaaugcgc

SEQ ID NO: 447300 - RNA, 21 nt, Brucella suis 1330
cgaugcucuaacuauuuauuc

SEQ ID NO: 447301 - RNA, 19 nt, Brucella suis 1330
cgaugccugccaugccgaa

SEQ ID NO: 447302 - RNA, 12 nt, Brucella suis 1330
cgaucaccagcc

SEQ ID NO: 447303 - RNA, 24 nt, Brucella suis 1330
cgaucaacgcuuugaccgccgcga

SEQ ID NO: 447304 - RNA, 21 nt, Brucella suis 1330
cgaucacaacgccgucagccc

SEQ ID NO: 447305 - RNA, 15 nt, Brucella suis 1330
cgaucaaacccucau

SEQ ID NO: 447306 - RNA, 21 nt, Brucella suis 1330
cgauagcccucugaaccggcg

SEQ ID NO: 447307 - RNA, 13 nt, Brucella suis 1330
cgaguugccacgc

SEQ ID NO: 447308 - RNA, 20 nt, Brucella suis 1330
cgaguugugccugccgcgcc

SEQ ID NO: 447309 - RNA, 13 nt, Brucella suis 1330
cgagugugcauuc

SEQ ID NO: 447310 - RNA, 20 nt, Brucella suis 1330
cgagggugaaaccguggaaa

SEQ ID NO: 447311 - RNA, 12 nt, Brucella suis 1330
cgagggguuuuu

SEQ ID NO: 447312 - RNA, 18 nt, Brucella suis 1330
cgagggcgggcggccagg

SEQ ID NO: 447313 - RNA, 17 nt, Brucella suis 1330
cgaggaaaaagcccgcc

SEQ ID NO: 447314 - RNA, 13 nt, Brucella suis 1330
cgagcgugaucuc

SEQ ID NO: 447315 - RNA, 19 nt, Brucella suis 1330
cgagcgugaucucauccac

SEQ ID NO: 447316 - RNA, 17 nt, Brucella suis 1330
cgagcggaagaggacaa

SEQ ID NO: 447317 - RNA, 22 nt, Brucella suis 1330
cgagcgcgcuuaugaucuggcc

SEQ ID NO: 447318 - RNA, 14 nt, Brucella suis 1330
cgagcgcagcggca

SEQ ID NO: 447319 - RNA, 16 nt, Brucella suis 1330
cgagccgacauaggcg

SEQ ID NO: 447320 - RNA, 18 nt, Brucella suis 1330
cgagccgacaucgcgcuu

SEQ ID NO: 447321 - RNA, 16 nt, Brucella suis 1330
cgagcaggcggucgcu

SEQ ID NO: 447322 - RNA, 19 nt, Brucella suis 1330
cgagcaggcuuucggccug

SEQ ID NO: 447323 - RNA, 14 nt, Brucella suis 1330
cgagcagcaucuug

SEQ ID NO: 447324 - RNA, 16 nt, Brucella suis 1330
cgagauugggcagcag

SEQ ID NO: 447325 - RNA, 16 nt, Brucella suis 1330
cgagauugggcgcgcu

SEQ ID NO: 447326 - RNA, 20 nt, Brucella suis 1330
cgagaugggcaaauucauug

SEQ ID NO: 447327 - RNA, 22 nt, Brucella suis 1330
cgagauagacaugcggcagucc

SEQ ID NO: 447328 - RNA, 14 nt, Brucella suis 1330
cgagaccggcugcu

SEQ ID NO: 447329 - RNA, 19 nt, Brucella suis 1330
cgagaauggcaacacggcg

SEQ ID NO: 447330 - RNA, 14 nt, Brucella suis 1330
cgagaaugaccacg

SEQ ID NO: 447331 - RNA, 14 nt, Brucella suis 1330
cgagaacggcggcg

SEQ ID NO: 447332 - RNA, 20 nt, Brucella suis 1330
cgagaaaaagaugcgccggg

SEQ ID NO: 447333 - RNA, 21 nt, Brucella suis 1330
cgacuuuggccgucucugaag

SEQ ID NO: 447334 - RNA, 18 nt, Brucella suis 1330
cgacuuccaguggaagca

SEQ ID NO: 447335 - RNA, 20 nt, Brucella suis 1330
cgacuuccaguggaagcaca

SEQ ID NO: 447336 - RNA, 14 nt, Brucella suis 1330
cgacucauuuuuag

SEQ ID NO: 447337 - RNA, 22 nt, Brucella suis 1330
cgacguaaagcgugagccggcg

SEQ ID NO: 447338 - RNA, 18 nt, Brucella suis 1330
cgacggcgugaugcgcag

SEQ ID NO: 447339 - RNA, 15 nt, Brucella suis 1330
cgaccuugagccccu

SEQ ID NO: 447340 - RNA, 23 nt, Brucella suis 1330
cgaccugagccucgggcagugaa

SEQ ID NO: 447341 - RNA, 13 nt, Brucella suis 1330
cgaccggucgaag

SEQ ID NO: 447342 - RNA, 19 nt, Brucella suis 1330
cgaccggcacccacugccc

SEQ ID NO: 447343 - RNA, 18 nt, Brucella suis 1330
cgaccauggcgcauucag

SEQ ID NO: 447344 - RNA, 18 nt, Brucella suis 1330
cgaccagaagcccgcgcu

SEQ ID NO: 447345 - RNA, 20 nt, Brucella suis 1330
cgaccagaagcccgcgcucc

SEQ ID NO: 447346 - RNA, 12 nt, Brucella suis 1330
cgaccaacccuu

SEQ ID NO: 447347 - RNA, 17 nt, Brucella suis 1330
cgacauguuuuggaaag

SEQ ID NO: 447348 - RNA, 19 nt, Brucella suis 1330
cgacauuggugaugcgccc

SEQ ID NO: 447349 - RNA, 13 nt, Brucella suis 1330
cgacaugcugaaa

SEQ ID NO: 447350 - RNA, 14 nt, Brucella suis 1330
cgacaugcugaaau

SEQ ID NO: 447351 - RNA, 15 nt, Brucella suis 1330
cgacauauucuuccg

SEQ ID NO: 447352 - RNA, 16 nt, Brucella suis 1330
cgacauccaucggcuc

SEQ ID NO: 447353 - RNA, 14 nt, Brucella suis 1330
cgacagggcaagcg

SEQ ID NO: 447354 - RNA, 14 nt, Brucella suis 1330
cgacagaucggcaa

SEQ ID NO: 447355 - RNA, 16 nt, Brucella suis 1330
cgacaaucggaacaaa

SEQ ID NO: 447356 - RNA, 16 nt, Brucella suis 1330
cgaauuuggugcccuu

SEQ ID NO: 447357 - RNA, 16 nt, Brucella suis 1330
cgacaaagaucaucgc

SEQ ID NO: 447358 - RNA, 17 nt, Brucella suis 1330
cgacaagcuucaggcuc

SEQ ID NO: 447359 - RNA, 16 nt, Brucella suis 1330
cgaaugaucuuguucg

SEQ ID NO: 447360 - RNA, 21 nt, Brucella suis 1330
cgaauggcaauuuccagauau

SEQ ID NO: 447361 - RNA, 16 nt, Brucella suis 1330
cgaauggcuugcugga

SEQ ID NO: 447362 - RNA, 23 nt, Brucella suis 1330
cgaaugaaccggcucugcggaaa

SEQ ID NO: 447363 - RNA, 14 nt, Brucella suis 1330
cgaauuccgccaug

SEQ ID NO: 447364 - RNA, 21 nt, Brucella suis 1330
cgaauuccucuccgcccauac

SEQ ID NO: 447365 - RNA, 17 nt, Brucella suis 1330
cgaauagaccaugccgc

SEQ ID NO: 447366 - RNA, 21 nt, Brucella suis 1330
cgaauagcgcaucgccaccgu

SEQ ID NO: 447367 - RNA, 22 nt, Brucella suis 1330
cgaagcgguuuucggauaagau

SEQ ID NO: 447368 - RNA, 15 nt, Brucella suis 1330
cgaagcggccuuuga

SEQ ID NO: 447369 - RNA, 15 nt, Brucella suis 1330
cgaagauaagcggca

SEQ ID NO: 447370 - RNA, 17 nt, Brucella suis 1330
cgaagacgaucuuuucc

SEQ ID NO: 447371 - RNA, 18 nt, Brucella suis 1330
cgaagagacuguucuuug

SEQ ID NO: 447372 - RNA, 19 nt, Brucella suis 1330
cgaagaagaauacgcagcg

SEQ ID NO: 447373 - RNA, 16 nt, Brucella suis 1330
cgaacgcuccugcaug

SEQ ID NO: 447374 - RNA, 15 nt, Brucella suis 1330
cgaacggaugagguc

SEQ ID NO: 447375 - RNA, 13 nt, Brucella suis 1330
cgaacgcacugca

SEQ ID NO: 447376 - RNA, 20 nt, Brucella suis 1330
cgaaccgucgccagcucgcc

SEQ ID NO: 447377 - RNA, 15 nt, Brucella suis 1330
cgaaccagauccacc

SEQ ID NO: 447378 - RNA, 17 nt, Brucella suis 1330
cgaaccagauccaccgc

SEQ ID NO: 447379 - RNA, 23 nt, Brucella suis 1330
cgaacaugccugccgcagccagg

SEQ ID NO: 447380 - RNA, 23 nt, Brucella suis 1330
cgaacaugcgccagagcauuuuc

SEQ ID NO: 447381 - RNA, 13 nt, Brucella suis 1330
cgaacauucaggc

SEQ ID NO: 447382 - RNA, 18 nt, Brucella suis 1330
cgaacagaucgccaagcg

SEQ ID NO: 447383 - RNA, 20 nt, Brucella suis 1330
cgaacagguugcgccaccac

SEQ ID NO: 447384 - RNA, 21 nt, Brucella suis 1330
cgaaaugaacaucggcgcgcu

SEQ ID NO: 447385 - RNA, 15 nt, Brucella suis 1330
cgaacacgaugaugg

SEQ ID NO: 447386 - RNA, 15 nt, Brucella suis 1330
cgaaaguuggacgac

SEQ ID NO: 447387 - RNA, 13 nt, Brucella suis 1330
cgaaaagcuugcc

SEQ ID NO: 447388 - RNA, 13 nt, Brucella suis 1330
cgaaaaccaccuu

SEQ ID NO: 447389 - RNA, 19 nt, Brucella suis 1330
ccuuuugcggggcuuccac

SEQ ID NO: 447390 - RNA, 18 nt, Brucella suis 1330
ccuuuucggcuuccuugc

SEQ ID NO: 447391 - RNA, 13 nt, Brucella suis 1330
ccuuuucuucauc

SEQ ID NO: 447392 - RNA, 20 nt, Brucella suis 1330
ccuuuccggcggcggcgcca

SEQ ID NO: 447393 - RNA, 14 nt, Brucella suis 1330
ccuuugugccuuuc

SEQ ID NO: 447394 - RNA, 22 nt, Brucella suis 1330
ccuuuguuuucauugggcccuu

SEQ ID NO: 447395 - RNA, 17 nt, Brucella suis 1330
ccuugugaucgccacuc

SEQ ID NO: 447396 - RNA, 23 nt, Brucella suis 1330
ccuugugaucgccacucuugugg

SEQ ID NO: 447397 - RNA, 20 nt, Brucella suis 1330
ccuuguaggaaagcacacug

SEQ ID NO: 447398 - RNA, 14 nt, Brucella suis 1330
ccuugcuugaagca

SEQ ID NO: 447399 - RNA, 13 nt, Brucella suis 1330
ccuugcgccgcag

SEQ ID NO: 447400 - RNA, 23 nt, Brucella suis 1330
ccuugcgaauggcaaucuccauc

SEQ ID NO: 447401 - RNA, 21 nt, Brucella suis 1330
ccuugccgguugccuugccca

SEQ ID NO: 447402 - RNA, 17 nt, Brucella suis 1330
ccuugccgucaccauuc

SEQ ID NO: 447403 - RNA, 22 nt, Brucella suis 1330
ccuugccgucggcgccgucguu

SEQ ID NO: 447404 - RNA, 18 nt, Brucella suis 1330
ccuugccgggaagaugca

SEQ ID NO: 447405 - RNA, 21 nt, Brucella suis 1330
ccuugccgggcgggcagcacu

SEQ ID NO: 447406 - RNA, 18 nt, Brucella suis 1330
ccuugccgccuuucaugc

SEQ ID NO: 447407 - RNA, 14 nt, Brucella suis 1330
ccuugccccggcac

SEQ ID NO: 447408 - RNA, 15 nt, Brucella suis 1330
ccuugccaucuucac

SEQ ID NO: 447409 - RNA, 22 nt, Brucella suis 1330
ccuugccaucuucacccacgcc

SEQ ID NO: 447410 - RNA, 17 nt, Brucella suis 1330
ccuugcagaugagcggc

SEQ ID NO: 447411 - RNA, 23 nt, Brucella suis 1330
ccuugagggcagcggucacagaa

SEQ ID NO: 447412 - RNA, 19 nt, Brucella suis 1330
ccuugaaaccaaagcgucc

SEQ ID NO: 447413 - RNA, 12 nt, Brucella suis 1330
ccuugaaaucau

SEQ ID NO: 447414 - RNA, 22 nt, Brucella suis 1330
ccuucuuggagccgaagcgcau

SEQ ID NO: 447415 - RNA, 14 nt, Brucella suis 1330
ccuucucgacagcc

SEQ ID NO: 447416 - RNA, 15 nt, Brucella suis 1330
ccuucggagcgcguu

SEQ ID NO: 447417 - RNA, 12 nt, Brucella suis 1330
ccuucgcgccag

SEQ ID NO: 447418 - RNA, 20 nt, Brucella suis 1330
ccuucgaguucgccagcacc

SEQ ID NO: 447419 - RNA, 22 nt, Brucella suis 1330
ccuuccugcggcagcgacccgc

SEQ ID NO: 447420 - RNA, 16 nt, Brucella suis 1330
ccuuccugacccaugg

SEQ ID NO: 447421 - RNA, 17 nt, Brucella suis 1330
ccuuccugacccauggc

SEQ ID NO: 447422 - RNA, 19 nt, Brucella suis 1330
ccuuccggguguccugccg

SEQ ID NO: 447423 - RNA, 13 nt, Brucella suis 1330
ccuuccgccucuu

SEQ ID NO: 447424 - RNA, 18 nt, Brucella suis 1330
ccugucagcgccgcccag

SEQ ID NO: 447425 - RNA, 15 nt, Brucella suis 1330
ccugucaaaacugau

SEQ ID NO: 447426 - RNA, 14 nt, Brucella suis 1330
ccuggaugacaucg

SEQ ID NO: 447427 - RNA, 16 nt, Brucella suis 1330
ccugcugcaacaaaau

SEQ ID NO: 447428 - RNA, 17 nt, Brucella suis 1330
ccugcgucgcauccaga

SEQ ID NO: 447429 - RNA, 19 nt, Brucella suis 1330
ccugcgucgcauccagaac

SEQ ID NO: 447430 - RNA, 13 nt, Brucella suis 1330
ccugcgcccauuc

SEQ ID NO: 447431 - RNA, 21 nt, Brucella suis 1330
ccugcgccagcgauugcgcau

SEQ ID NO: 447432 - RNA, 23 nt, Brucella suis 1330
ccugcgccagcgauugcgcauug

SEQ ID NO: 447433 - RNA, 22 nt, Brucella suis 1330
ccugcgcaccgguauugcccuu

SEQ ID NO: 447434 - RNA, 16 nt, Brucella suis 1330
ccugcgaggauuucag

SEQ ID NO: 447435 - RNA, 15 nt, Brucella suis 1330
ccugcgaugcgccag

SEQ ID NO: 447436 - RNA, 18 nt, Brucella suis 1330
ccugcauaauuauugcgc

SEQ ID NO: 447437 - RNA, 17 nt, Brucella suis 1330
ccugcacgucaccauau

SEQ ID NO: 447438 - RNA, 20 nt, Brucella suis 1330
ccugcacuucacgcgugcgg

SEQ ID NO: 447439 - RNA, 19 nt, Brucella suis 1330
ccugcaccggcccaaaggc

SEQ ID NO: 447440 - RNA, 13 nt, Brucella suis 1330
ccugcaccaugga

SEQ ID NO: 447441 - RNA, 20 nt, Brucella suis 1330
ccugaaacagcauauugccg

SEQ ID NO: 447442 - RNA, 12 nt, Brucella suis 1330
ccucgucggcga

SEQ ID NO: 447443 - RNA, 16 nt, Brucella suis 1330
ccucggugccaagaag

SEQ ID NO: 447444 - RNA, 20 nt, Brucella suis 1330
ccucgggcagggucaaaaug

SEQ ID NO: 447445 - RNA, 18 nt, Brucella suis 1330
ccucgggcagugaaagcc

SEQ ID NO: 447446 - RNA, 22 nt, Brucella suis 1330
ccucgacguccucguucuugcc

SEQ ID NO: 447447 - RNA, 15 nt, Brucella suis 1330
ccucgacggcggccu

SEQ ID NO: 447448 - RNA, 13 nt, Brucella suis 1330
ccucgaccgccac

SEQ ID NO: 447449 - RNA, 18 nt, Brucella suis 1330
ccucgaauuccaccgccu

SEQ ID NO: 447450 - RNA, 15 nt, Brucella suis 1330
ccucgaagucgccag

SEQ ID NO: 447451 - RNA, 18 nt, Brucella suis 1330
ccucccuguccugccagc

SEQ ID NO: 447452 - RNA, 20 nt, Brucella suis 1330
ccucccuguccugccagcgg

SEQ ID NO: 447453 - RNA, 21 nt, Brucella suis 1330
ccucccuguccugccagcggc

SEQ ID NO: 447454 - RNA, 16 nt, Brucella suis 1330
ccuccccccgcgucau

SEQ ID NO: 447455 - RNA, 21 nt, Brucella suis 1330
ccuccagcccuucaucaagcu

SEQ ID NO: 447456 - RNA, 21 nt, Brucella suis 1330
ccuccacgacgggagccgcag

SEQ ID NO: 447457 - RNA, 15 nt, Brucella suis 1330
ccuacgcagggaaau

SEQ ID NO: 447458 - RNA, 13 nt, Brucella suis 1330
ccguuggcaucca

SEQ ID NO: 447459 - RNA, 22 nt, Brucella suis 1330
ccguuggaaacggcgcaucauc

SEQ ID NO: 447460 - RNA, 20 nt, Brucella suis 1330
ccguugcaccguuucucugc

SEQ ID NO: 447461 - RNA, 21 nt, Brucella suis 1330
ccguguacgcuaucucuccua

SEQ ID NO: 447462 - RNA, 22 nt, Brucella suis 1330
ccgugcggcaagauaagcgccg

SEQ ID NO: 447463 - RNA, 22 nt, Brucella suis 1330
ccgugccaucggugccugacug

SEQ ID NO: 447464 - RNA, 20 nt, Brucella suis 1330
ccgugaaacagugccgccau

SEQ ID NO: 447465 - RNA, 17 nt, Brucella suis 1330
ccgucgcguucagccug

SEQ ID NO: 447466 - RNA, 18 nt, Brucella suis 1330
ccgucagcuuuucaccgg

SEQ ID NO: 447467 - RNA, 17 nt, Brucella suis 1330
ccggugagcgaagcuca

SEQ ID NO: 447468 - RNA, 12 nt, Brucella suis 1330
ccggucuugagc

SEQ ID NO: 447469 - RNA, 20 nt, Brucella suis 1330
ccggucgagccgacauaggc

SEQ ID NO: 447470 - RNA, 16 nt, Brucella suis 1330
ccggucgaagcggcgc

SEQ ID NO: 447471 - RNA, 17 nt, Brucella suis 1330
ccgguauccggcgcgau

SEQ ID NO: 447472 - RNA, 15 nt, Brucella suis 1330
ccgggcuugcauggu

SEQ ID NO: 447473 - RNA, 22 nt, Brucella suis 1330
ccgggcugcuuccacaggcgcc

SEQ ID NO: 447474 - RNA, 22 nt, Brucella suis 1330
ccgggccaacgccggcaccgcc

SEQ ID NO: 447475 - RNA, 12 nt, Brucella suis 1330
ccggcuguuaca

SEQ ID NO: 447476 - RNA, 19 nt, Brucella suis 1330
ccggcugggccuuguuuuc

SEQ ID NO: 447477 - RNA, 19 nt, Brucella suis 1330
ccggcugcggcgccuugau

SEQ ID NO: 447478 - RNA, 22 nt, Brucella suis 1330
ccggcucaaugccgcauucagc

SEQ ID NO: 447479 - RNA, 16 nt, Brucella suis 1330
ccggcguggccaagau

SEQ ID NO: 447480 - RNA, 13 nt, Brucella suis 1330
ccggcgugaucuc

SEQ ID NO: 447481 - RNA, 16 nt, Brucella suis 1330
ccggcgugaucucgca

SEQ ID NO: 447482 - RNA, 13 nt, Brucella suis 1330
ccggcggcggcgc

SEQ ID NO: 447483 - RNA, 13 nt, Brucella suis 1330
ccggcggcgccca

SEQ ID NO: 447484 - RNA, 14 nt, Brucella suis 1330
ccggcggcgcccac

SEQ ID NO: 447485 - RNA, 14 nt, Brucella suis 1330
ccggcggcaggcag

SEQ ID NO: 447486 - RNA, 12 nt, Brucella suis 1330
ccggccaguggc

SEQ ID NO: 447487 - RNA, 15 nt, Brucella suis 1330
ccggccagcuugaaa

SEQ ID NO: 447488 - RNA, 11 nt, Brucella suis 1330
ccggcagcuuu

SEQ ID NO: 447489 - RNA, 20 nt, Brucella suis 1330
ccggcagcacgugcccguuc

SEQ ID NO: 447490 - RNA, 14 nt, Brucella suis 1330
ccggcagccuucgc

SEQ ID NO: 447491 - RNA, 14 nt, Brucella suis 1330
ccggcacgaucagg

SEQ ID NO: 447492 - RNA, 20 nt, Brucella suis 1330
ccggcacgaucagggaacgg

SEQ ID NO: 447493 - RNA, 18 nt, Brucella suis 1330
ccggcaacuugcaacgau

SEQ ID NO: 447494 - RNA, 16 nt, Brucella suis 1330
ccggaaggcggggcug

SEQ ID NO: 447495 - RNA, 20 nt, Brucella suis 1330
ccggaagaaacaaaucagcu

SEQ ID NO: 447496 - RNA, 20 nt, Brucella suis 1330
ccggaagcgcaaggcggcgc

SEQ ID NO: 447497 - RNA, 13 nt, Brucella suis 1330
ccggaaacaccgc

SEQ ID NO: 447498 - RNA, 21 nt, Brucella suis 1330
ccgcuuccagcauccgcucgc

SEQ ID NO: 447499 - RNA, 21 nt, Brucella suis 1330
ccgcugccauaauucagcuuu

SEQ ID NO: 447500 - RNA, 22 nt, Brucella suis 1330
ccgcucugaucuaguggagcac

SEQ ID NO: 447501 - RNA, 13 nt, Brucella suis 1330
ccgcucaccacau

SEQ ID NO: 447502 - RNA, 17 nt, Brucella suis 1330
ccgcguugcccaugucc

SEQ ID NO: 447503 - RNA, 18 nt, Brucella suis 1330
ccgcggguucccugugga

SEQ ID NO: 447504 - RNA, 20 nt, Brucella suis 1330
ccgcggcucucacgcgcagc

SEQ ID NO: 447505 - RNA, 17 nt, Brucella suis 1330
ccgcggcgguuuugagc

SEQ ID NO: 447506 - RNA, 20 nt, Brucella suis 1330
ccgcggcgguuuugagcugc

SEQ ID NO: 447507 - RNA, 17 nt, Brucella suis 1330
ccgcgccucacccucca

SEQ ID NO: 447508 - RNA, 19 nt, Brucella suis 1330
ccgcgccggucuccucagc

SEQ ID NO: 447509 - RNA, 13 nt, Brucella suis 1330
ccgcgcccuggcu

SEQ ID NO: 447510 - RNA, 18 nt, Brucella suis 1330
ccgcgccccuggcggcac

SEQ ID NO: 447511 - RNA, 12 nt, Brucella suis 1330
ccgcgacgccgc

SEQ ID NO: 447512 - RNA, 17 nt, Brucella suis 1330
ccgccuucggcugcuuc

SEQ ID NO: 447513 - RNA, 18 nt, Brucella suis 1330
ccgccuuaucggggcggc

SEQ ID NO: 447514 - RNA, 16 nt, Brucella suis 1330
ccgccugcagccggaa

SEQ ID NO: 447515 - RNA, 13 nt, Brucella suis 1330
ccgccugccagcc

SEQ ID NO: 447516 - RNA, 16 nt, Brucella suis 1330
ccgccugccagcccgc

SEQ ID NO: 447517 - RNA, 13 nt, Brucella suis 1330
ccgccugcaauga

SEQ ID NO: 447518 - RNA, 12 nt, Brucella suis 1330
ccgccucccugc

SEQ ID NO: 447519 - RNA, 15 nt, Brucella suis 1330
ccgccgcuuccagcg

SEQ ID NO: 447520 - RNA, 18 nt, Brucella suis 1330
ccgcccaucccggaagga

SEQ ID NO: 447521 - RNA, 19 nt, Brucella suis 1330
ccgccaugcccgucagcgc

SEQ ID NO: 447522 - RNA, 17 nt, Brucella suis 1330
ccgcauaaagcacagcc

SEQ ID NO: 447523 - RNA, 19 nt, Brucella suis 1330
ccgcauaaaugcuccuggc

SEQ ID NO: 447524 - RNA, 15 nt, Brucella suis 1330
ccgcagugagcagaa

SEQ ID NO: 447525 - RNA, 17 nt, Brucella suis 1330
ccgcagucaugcccaua

SEQ ID NO: 447526 - RNA, 22 nt, Brucella suis 1330
ccgcaauacgccuggccggcgc

SEQ ID NO: 447527 - RNA, 14 nt, Brucella suis 1330
ccgcaaccagcgac

SEQ ID NO: 447528 - RNA, 17 nt, Brucella suis 1330
ccgcaaccagcgacagg

SEQ ID NO: 447529 - RNA, 11 nt, Brucella suis 1330
ccgcaaaggca

SEQ ID NO: 447530 - RNA, 13 nt, Brucella suis 1330
ccgcaaagagaac

SEQ ID NO: 447531 - RNA, 18 nt, Brucella suis 1330
ccgcaaagagaaccaccu

SEQ ID NO: 447532 - RNA, 19 nt, Brucella suis 1330
ccgcaaagagaaccaccuu

SEQ ID NO: 447533 - RNA, 22 nt, Brucella suis 1330
ccgauugccccgccauaaagca

SEQ ID NO: 447534 - RNA, 23 nt, Brucella suis 1330
ccgauugccccgccauaaagcac

SEQ ID NO: 447535 - RNA, 22 nt, Brucella suis 1330
ccgaugugauauccaccuggcc

SEQ ID NO: 447536 - RNA, 21 nt, Brucella suis 1330
ccgaucaucgccugaaugaaa

SEQ ID NO: 447537 - RNA, 11 nt, Brucella suis 1330
ccgaucuauca

SEQ ID NO: 447538 - RNA, 18 nt, Brucella suis 1330
ccgaucagcaucgccccc

SEQ ID NO: 447539 - RNA, 18 nt, Brucella suis 1330
ccgaggggaacgacgcgc

SEQ ID NO: 447540 - RNA, 16 nt, Brucella suis 1330
ccgaccuugagccccu

SEQ ID NO: 447541 - RNA, 17 nt, Brucella suis 1330
ccgaauacaagcccaag

SEQ ID NO: 447542 - RNA, 15 nt, Brucella suis 1330
ccgaacugggcggcc

SEQ ID NO: 447543 - RNA, 12 nt, Brucella suis 1330
ccgaagaacagu

SEQ ID NO: 447544 - RNA, 17 nt, Brucella suis 1330
ccgaagacgaucuuuuc

SEQ ID NO: 447545 - RNA, 17 nt, Brucella suis 1330
cccuucguguccggcgu

SEQ ID NO: 447546 - RNA, 13 nt, Brucella suis 1330
cccuugaaaucau

SEQ ID NO: 447547 - RNA, 15 nt, Brucella suis 1330
cccuugagagccaga

SEQ ID NO: 447548 - RNA, 12 nt, Brucella suis 1330
ccgaaaaccgcu

SEQ ID NO: 447549 - RNA, 19 nt, Brucella suis 1330
ccgaaaaccguuucacacu

SEQ ID NO: 447550 - RNA, 11 nt, Brucella suis 1330
ccgaaaagccg

SEQ ID NO: 447551 - RNA, 12 nt, Brucella suis 1330
ccgaaaagugcg

SEQ ID NO: 447552 - RNA, 14 nt, Brucella suis 1330
cccuucgcgccgcc

SEQ ID NO: 447553 - RNA, 15 nt, Brucella suis 1330
cccuguuucugcugg

SEQ ID NO: 447554 - RNA, 17 nt, Brucella suis 1330
cccuuaugaucgccgcc

SEQ ID NO: 447555 - RNA, 13 nt, Brucella suis 1330
cccuuauuccccu

SEQ ID NO: 447556 - RNA, 20 nt, Brucella suis 1330
cccuuauuccccuauucccu

SEQ ID NO: 447557 - RNA, 19 nt, Brucella suis 1330
cccuucaaaccauccucga

SEQ ID NO: 447558 - RNA, 17 nt, Brucella suis 1330
cccuguccugccagcgg

SEQ ID NO: 447559 - RNA, 20 nt, Brucella suis 1330
cccugucgccgaaaagcgcc

SEQ ID NO: 447560 - RNA, 16 nt, Brucella suis 1330
cccugucagcgccgcc

SEQ ID NO: 447561 - RNA, 18 nt, Brucella suis 1330
cccugucagcgccgccca

SEQ ID NO: 447562 - RNA, 22 nt, Brucella suis 1330
cccuggcggcgugcaggcugcc

SEQ ID NO: 447563 - RNA, 23 nt, Brucella suis 1330
cccuggcggcgugcaggcugccc

SEQ ID NO: 447564 - RNA, 14 nt, Brucella suis 1330
cccuggcggcacuu

SEQ ID NO: 447565 - RNA, 19 nt, Brucella suis 1330
cccuggauguacacgccaa

SEQ ID NO: 447566 - RNA, 13 nt, Brucella suis 1330
cccuggaaagaag

SEQ ID NO: 447567 - RNA, 14 nt, Brucella suis 1330
cccugcuucacaug

SEQ ID NO: 447568 - RNA, 14 nt, Brucella suis 1330
cccugcgggccaug

SEQ ID NO: 447569 - RNA, 21 nt, Brucella suis 1330
cccugaaaaggcucaaucgcc

SEQ ID NO: 447570 - RNA, 14 nt, Brucella suis 1330
cccugcacaccaaa

SEQ ID NO: 447571 - RNA, 19 nt, Brucella suis 1330
cccucugaaccggcgggcu

SEQ ID NO: 447572 - RNA, 14 nt, Brucella suis 1330
ccccuuccuucugg

SEQ ID NO: 447573 - RNA, 16 nt, Brucella suis 1330
ccccuguuucugcugg

SEQ ID NO: 447574 - RNA, 16 nt, Brucella suis 1330
ccccucaccuugccgg

SEQ ID NO: 447575 - RNA, 17 nt, Brucella suis 1330
ccccucaccuugccggg

SEQ ID NO: 447576 - RNA, 13 nt, Brucella suis 1330
ccccuacucccuu

SEQ ID NO: 447577 - RNA, 14 nt, Brucella suis 1330
ccccuacucccuua

SEQ ID NO: 447578 - RNA, 18 nt, Brucella suis 1330
ccccgugaucuuguccag

SEQ ID NO: 447579 - RNA, 20 nt, Brucella suis 1330
ccccgugaucuuguccagac

SEQ ID NO: 447580 - RNA, 22 nt, Brucella suis 1330
ccccggcgggugcgaaaaugau

SEQ ID NO: 447581 - RNA, 17 nt, Brucella suis 1330
cccccuggauauccaca

SEQ ID NO: 447582 - RNA, 21 nt, Brucella suis 1330
cccccggcaguuucugccgcg

SEQ ID NO: 447583 - RNA, 15 nt, Brucella suis 1330
ccccauugcaucgcc

SEQ ID NO: 447584 - RNA, 14 nt, Brucella suis 1330
cccccaacgugcgg

SEQ ID NO: 447585 - RNA, 22 nt, Brucella suis 1330
cccccaacgugcggugcuccca

SEQ ID NO: 447586 - RNA, 17 nt, Brucella suis 1330
ccccaugguuugcagca

SEQ ID NO: 447587 - RNA, 16 nt, Brucella suis 1330
ccccaugagaaggcaa

SEQ ID NO: 447588 - RNA, 18 nt, Brucella suis 1330
ccccaugagaaggcaagc

SEQ ID NO: 447589 - RNA, 13 nt, Brucella suis 1330
ccccaugaccgga

SEQ ID NO: 447590 - RNA, 18 nt, Brucella suis 1330
ccccaguucguugugcca

SEQ ID NO: 447591 - RNA, 15 nt, Brucella suis 1330
cccaugagcuucaac

SEQ ID NO: 447592 - RNA, 14 nt, Brucella suis 1330
cccaugaccggaug

SEQ ID NO: 447593 - RNA, 15 nt, Brucella suis 1330
cccaugacagcaacc

SEQ ID NO: 447594 - RNA, 13 nt, Brucella suis 1330
cccaucaaugcac

SEQ ID NO: 447595 - RNA, 20 nt, Brucella suis 1330
cccauauguauggcaaaagg

SEQ ID NO: 447596 - RNA, 20 nt, Brucella suis 1330
cccagugugaccacugcauc

SEQ ID NO: 447597 - RNA, 17 nt, Brucella suis 1330
cccagaugcagcggcgc

SEQ ID NO: 447598 - RNA, 23 nt, Brucella suis 1330
cccagaggguuccgaauacaagc

SEQ ID NO: 447599 - RNA, 18 nt, Brucella suis 1330
cccagacauggaagauga

SEQ ID NO: 447600 - RNA, 15 nt, Brucella suis 1330
cccacgcccagcgcg

SEQ ID NO: 447601 - RNA, 20 nt, Brucella suis 1330
cccacgaaacagaaagggcg

SEQ ID NO: 447602 - RNA, 17 nt, Brucella suis 1330
cccacccgaaggacugg

SEQ ID NO: 447603 - RNA, 22 nt, Brucella suis 1330
cccaagaaagaucagccagccg

SEQ ID NO: 447604 - RNA, 18 nt, Brucella suis 1330
ccauucgucacuacagcc

SEQ ID NO: 447605 - RNA, 16 nt, Brucella suis 1330
ccauucacuugcgauu

SEQ ID NO: 447606 - RNA, 16 nt, Brucella suis 1330
ccauuauucucccaga

SEQ ID NO: 447607 - RNA, 15 nt, Brucella suis 1330
ccauucaaccgugcg

SEQ ID NO: 447608 - RNA, 20 nt, Brucella suis 1330
ccauggucaggccaagugcg

SEQ ID NO: 447609 - RNA, 12 nt, Brucella suis 1330
ccauggcuucaa

SEQ ID NO: 447610 - RNA, 23 nt, Brucella suis 1330
ccauggaacagacaggauuugcc

SEQ ID NO: 447611 - RNA, 18 nt, Brucella suis 1330
ccaugcucgauaaagccc

SEQ ID NO: 447612 - RNA, 20 nt, Brucella suis 1330
ccaugcgcaaccaaaacaua

SEQ ID NO: 447613 - RNA, 17 nt, Brucella suis 1330
ccaugccuucccgccag

SEQ ID NO: 447614 - RNA, 12 nt, Brucella suis 1330
ccaugcccggcg

SEQ ID NO: 447615 - RNA, 18 nt, Brucella suis 1330
ccaugcaguuccauccau

SEQ ID NO: 447616 - RNA, 15 nt, Brucella suis 1330
ccaugagcuucaaca

SEQ ID NO: 447617 - RNA, 19 nt, Brucella suis 1330
ccaugaaagaacggcccgc

SEQ ID NO: 447618 - RNA, 15 nt, Brucella suis 1330
ccaugaagaucaauu

SEQ ID NO: 447619 - RNA, 23 nt, Brucella suis 1330
ccaugaagaucaauucccuggcu

SEQ ID NO: 447620 - RNA, 23 nt, Brucella suis 1330
ccaugacagcaaccgaaagcgcc

SEQ ID NO: 447621 - RNA, 19 nt, Brucella suis 1330
ccaucucgcccaggaauuc

SEQ ID NO: 447622 - RNA, 22 nt, Brucella suis 1330
ccaucucgcccaggaauucguc

SEQ ID NO: 447623 - RNA, 13 nt, Brucella suis 1330
ccaucgcuugaac

SEQ ID NO: 447624 - RNA, 12 nt, Brucella suis 1330
ccauccucgguu

SEQ ID NO: 447625 - RNA, 14 nt, Brucella suis 1330
ccauccacaaaaac

SEQ ID NO: 447626 - RNA, 14 nt, Brucella suis 1330
ccaucaaccgugca

SEQ ID NO: 447627 - RNA, 16 nt, Brucella suis 1330
ccaucaccagccccca

SEQ ID NO: 447628 - RNA, 15 nt, Brucella suis 1330
ccauaccgcgccaag

SEQ ID NO: 447629 - RNA, 21 nt, Brucella suis 1330
ccaguuucugaaugcgccgcc

SEQ ID NO: 447630 - RNA, 14 nt, Brucella suis 1330
ccagguggcugccc

SEQ ID NO: 447631 - RNA, 19 nt, Brucella suis 1330
ccagguggcugcccgccgc

SEQ ID NO: 447632 - RNA, 12 nt, Brucella suis 1330
ccagggcuggcu

SEQ ID NO: 447633 - RNA, 22 nt, Brucella suis 1330
ccagcgugcagccugaacagcg

SEQ ID NO: 447634 - RNA, 18 nt, Brucella suis 1330
ccagcguauugccguuga

SEQ ID NO: 447635 - RNA, 20 nt, Brucella suis 1330
ccagcccgaagaccaggccc

SEQ ID NO: 447636 - RNA, 21 nt, Brucella suis 1330
ccagcauggugcgcacuuccg

SEQ ID NO: 447637 - RNA, 13 nt, Brucella suis 1330
ccagcaccagcgg

SEQ ID NO: 447638 - RNA, 14 nt, Brucella suis 1330
ccagcaauugcugg

SEQ ID NO: 447639 - RNA, 18 nt, Brucella suis 1330
ccagcaacgcgcccgcca

SEQ ID NO: 447640 - RNA, 15 nt, Brucella suis 1330
ccagaucggccuuga

SEQ ID NO: 447641 - RNA, 18 nt, Brucella suis 1330
ccagaccuuccgggcaau

SEQ ID NO: 447642 - RNA, 20 nt, Brucella suis 1330
ccagaccaucggcaacaaga

SEQ ID NO: 447643 - RNA, 13 nt, Brucella suis 1330
ccagaaagagcau

SEQ ID NO: 447644 - RNA, 15 nt, Brucella suis 1330
ccagaacuucgccaa

SEQ ID NO: 447645 - RNA, 20 nt, Brucella suis 1330
ccagaacuucgccaagcccu

SEQ ID NO: 447646 - RNA, 22 nt, Brucella suis 1330
ccagaagauugcgcgacggagc

SEQ ID NO: 447647 - RNA, 22 nt, Brucella suis 1330
ccagaauggcgauaucaccaau

SEQ ID NO: 447648 - RNA, 16 nt, Brucella suis 1330
ccagaauguugaggga

SEQ ID NO: 447649 - RNA, 12 nt, Brucella suis 1330
ccagaaaaaccg

SEQ ID NO: 447650 - RNA, 12 nt, Brucella suis 1330
ccacggcauccg

SEQ ID NO: 447651 - RNA, 22 nt, Brucella suis 1330
ccacggaucgacaaaggugcug

SEQ ID NO: 447652 - RNA, 15 nt, Brucella suis 1330
ccacgccagccgcga

SEQ ID NO: 447653 - RNA, 22 nt, Brucella suis 1330
ccacgauggaaggaaagcccag

SEQ ID NO: 447654 - RNA, 23 nt, Brucella suis 1330
ccaccuucgccgucgagcagcau

SEQ ID NO: 447655 - RNA, 15 nt, Brucella suis 1330
ccaccucgccaauga

SEQ ID NO: 447656 - RNA, 22 nt, Brucella suis 1330
ccacgauaccgagaacggcggc

SEQ ID NO: 447657 - RNA, 14 nt, Brucella suis 1330
ccacccagcccgaa

SEQ ID NO: 447658 - RNA, 13 nt, Brucella suis 1330
ccacccaccgccu

SEQ ID NO: 447659 - RNA, 13 nt, Brucella suis 1330
ccaccauggaggc

SEQ ID NO: 447660 - RNA, 17 nt, Brucella suis 1330
ccaccauggccgccccg

SEQ ID NO: 447661 - RNA, 22 nt, Brucella suis 1330
ccaccauauuugccgccagaaa

SEQ ID NO: 447662 - RNA, 22 nt, Brucella suis 1330
ccaccagacgauuuucgccaag

SEQ ID NO: 447663 - RNA, 19 nt, Brucella suis 1330
ccaccagaaauggccccau

SEQ ID NO: 447664 - RNA, 14 nt, Brucella suis 1330
ccaccaccucgcca

SEQ ID NO: 447665 - RNA, 15 nt, Brucella suis 1330
ccaccaccugcccgc

SEQ ID NO: 447666 - RNA, 18 nt, Brucella suis 1330
ccacauucauaaccgaag

SEQ ID NO: 447667 - RNA, 14 nt, Brucella suis 1330
ccacaugaacuggc

SEQ ID NO: 447668 - RNA, 18 nt, Brucella suis 1330
ccacacugauuuucaaaa

SEQ ID NO: 447669 - RNA, 13 nt, Brucella suis 1330
ccacacuuccgcu

SEQ ID NO: 447670 - RNA, 16 nt, Brucella suis 1330
ccacacuuccgcucau

SEQ ID NO: 447671 - RNA, 17 nt, Brucella suis 1330
ccacaccggaggagagc

SEQ ID NO: 447672 - RNA, 22 nt, Brucella suis 1330
ccaauuccgccggggcaggcuc

SEQ ID NO: 447673 - RNA, 19 nt, Brucella suis 1330
ccaaugcucgaugguccag

SEQ ID NO: 447674 - RNA, 16 nt, Brucella suis 1330
ccaaugcccugcugca

SEQ ID NO: 447675 - RNA, 16 nt, Brucella suis 1330
ccaauauugcaggcga

SEQ ID NO: 447676 - RNA, 16 nt, Brucella suis 1330
ccaaggccccagauca

SEQ ID NO: 447677 - RNA, 16 nt, Brucella suis 1330
ccaagcgccagaaaga

SEQ ID NO: 447678 - RNA, 19 nt, Brucella suis 1330
ccaagcgucuugcgcucca

SEQ ID NO: 447679 - RNA, 22 nt, Brucella suis 1330
ccaagcgucuugcgcuccacca

SEQ ID NO: 447680 - RNA, 13 nt, Brucella suis 1330
ccaagcccuucca

SEQ ID NO: 447681 - RNA, 22 nt, Brucella suis 1330
ccaagacuuuccauccagucga

SEQ ID NO: 447682 - RNA, 20 nt, Brucella suis 1330
ccaacuuucgggggcaguuc

SEQ ID NO: 447683 - RNA, 14 nt, Brucella suis 1330
ccaacucuuuccug

SEQ ID NO: 447684 - RNA, 22 nt, Brucella suis 1330
ccaaccauugaucuucuugcau

SEQ ID NO: 447685 - RNA, 19 nt, Brucella suis 1330
ccaaaaggcgugaaccaca

SEQ ID NO: 447686 - RNA, 11 nt, Brucella suis 1330
ccaaaagugcg

SEQ ID NO: 447687 - RNA, 19 nt, Brucella suis 1330
ccaaaagugcgaagcgccu

SEQ ID NO: 447688 - RNA, 16 nt, Brucella suis 1330
ccaaaacauacucccc

SEQ ID NO: 447689 - RNA, 17 nt, Brucella suis 1330
ccaaaacauacuccccu

SEQ ID NO: 447690 - RNA, 21 nt, Brucella suis 1330
ccaaagaccagcaggaagaag

SEQ ID NO: 447691 - RNA, 15 nt, Brucella suis 1330
ccaaagcgggcuguu

SEQ ID NO: 447692 - RNA, 18 nt, Brucella suis 1330
ccaaagggugcgagcagg

SEQ ID NO: 447693 - RNA, 12 nt, Brucella suis 1330
cauuucggcuuc

SEQ ID NO: 447694 - RNA, 15 nt, Brucella suis 1330
cauuuccagcaaaag

SEQ ID NO: 447695 - RNA, 16 nt, Brucella suis 1330
cauuuccagcaaaagu

SEQ ID NO: 447696 - RNA, 14 nt, Brucella suis 1330
cauuucaugcacgg

SEQ ID NO: 447697 - RNA, 20 nt, Brucella suis 1330
cauuucaaacaacgcugcgu

SEQ ID NO: 447698 - RNA, 21 nt, Brucella suis 1330
cauuggcgauuuucugcacag

SEQ ID NO: 447699 - RNA, 21 nt, Brucella suis 1330
cauuggcugcuuccgaauaga

SEQ ID NO: 447700 - RNA, 13 nt, Brucella suis 1330
cauugggcccuua

SEQ ID NO: 447701 - RNA, 17 nt, Brucella suis 1330
cauugcgcuugccgccg

SEQ ID NO: 447702 - RNA, 14 nt, Brucella suis 1330
cauugcccauggac

SEQ ID NO: 447703 - RNA, 13 nt, Brucella suis 1330
cauugccaaggag

SEQ ID NO: 447704 - RNA, 20 nt, Brucella suis 1330
cauucgcugcgcuugagaua

SEQ ID NO: 447705 - RNA, 19 nt, Brucella suis 1330
cauucggguugccuucgac

SEQ ID NO: 447706 - RNA, 14 nt, Brucella suis 1330
cauucuuuccccau

SEQ ID NO: 447707 - RNA, 12 nt, Brucella suis 1330
cauuccccgccc

SEQ ID NO: 447708 - RNA, 16 nt, Brucella suis 1330
cauucccgccucagcc

SEQ ID NO: 447709 - RNA, 12 nt, Brucella suis 1330
cauuccgggccg

SEQ ID NO: 447710 - RNA, 21 nt, Brucella suis 1330
cauuccucaagauacaaaaaa

SEQ ID NO: 447711 - RNA, 13 nt, Brucella suis 1330
cauuauucuccca

SEQ ID NO: 447712 - RNA, 20 nt, Brucella suis 1330
cauucaaaaacgcguuccuu

SEQ ID NO: 447713 - RNA, 18 nt, Brucella suis 1330
caugucgaaagcccugcg

SEQ ID NO: 447714 - RNA, 16 nt, Brucella suis 1330
cauguaccuuaaagua

SEQ ID NO: 447715 - RNA, 16 nt, Brucella suis 1330
cauggcgggccaugcc

SEQ ID NO: 447716 - RNA, 17 nt, Brucella suis 1330
cauggcggaacccacgc

SEQ ID NO: 447717 - RNA, 16 nt, Brucella suis 1330
cauggccucaagugcc

SEQ ID NO: 447718 - RNA, 18 nt, Brucella suis 1330
cauggccacgccagccgc

SEQ ID NO: 447719 - RNA, 21 nt, Brucella suis 1330
caugcugauuggauuaugcua

SEQ ID NO: 447720 - RNA, 15 nt, Brucella suis 1330
caugccgccagccgc

SEQ ID NO: 447721 - RNA, 17 nt, Brucella suis 1330
caugcaguuccauccau

SEQ ID NO: 447722 - RNA, 18 nt, Brucella suis 1330
caugcaguuccauccauu

SEQ ID NO: 447723 - RNA, 17 nt, Brucella suis 1330
caugcaggccgugaaga

SEQ ID NO: 447724 - RNA, 13 nt, Brucella suis 1330
caugauggcccuu

SEQ ID NO: 447725 - RNA, 14 nt, Brucella suis 1330
caugauggcccuug

SEQ ID NO: 447726 - RNA, 17 nt, Brucella suis 1330
caugauggcccuugugg

SEQ ID NO: 447727 - RNA, 13 nt, Brucella suis 1330
caugaugccgaca

SEQ ID NO: 447728 - RNA, 17 nt, Brucella suis 1330
caugauccgcuccagau

SEQ ID NO: 447729 - RNA, 16 nt, Brucella suis 1330
caugagcagacggcca

SEQ ID NO: 447730 - RNA, 20 nt, Brucella suis 1330
caugacgccgcuccagccga

SEQ ID NO: 447731 - RNA, 22 nt, Brucella suis 1330
caugacgcgggugaggcuuucg

SEQ ID NO: 447732 - RNA, 18 nt, Brucella suis 1330
caugaccggaugcaaaac

SEQ ID NO: 447733 - RNA, 14 nt, Brucella suis 1330
caugaccuucucga

SEQ ID NO: 447734 - RNA, 15 nt, Brucella suis 1330
caugaagcgcggcgg

SEQ ID NO: 447735 - RNA, 17 nt, Brucella suis 1330
caugaacaugcgccacu

SEQ ID NO: 447736 - RNA, 13 nt, Brucella suis 1330
caugaacagaucg

SEQ ID NO: 447737 - RNA, 15 nt, Brucella suis 1330
caucucguucacaau

SEQ ID NO: 447738 - RNA, 20 nt, Brucella suis 1330
caucguugcggcuugccacc

SEQ ID NO: 447739 - RNA, 14 nt, Brucella suis 1330
caucgucuuccuua

SEQ ID NO: 447740 - RNA, 21 nt, Brucella suis 1330
caucgcucgaaggcagccgug

SEQ ID NO: 447741 - RNA, 22 nt, Brucella suis 1330
caucggaagggcaaggcgcgcc

SEQ ID NO: 447742 - RNA, 23 nt, Brucella suis 1330
caucggcaacaagagggcgcagc

SEQ ID NO: 447743 - RNA, 19 nt, Brucella suis 1330
caucgcaauagaccaccag

SEQ ID NO: 447744 - RNA, 22 nt, Brucella suis 1330
caucgccaccauggccgccccg

SEQ ID NO: 447745 - RNA, 19 nt, Brucella suis 1330
cauccugcucggcgcggcg

SEQ ID NO: 447746 - RNA, 20 nt, Brucella suis 1330
cauccugcaccggcuucccg

SEQ ID NO: 447747 - RNA, 14 nt, Brucella suis 1330
cauccgaaaccaga

SEQ ID NO: 447748 - RNA, 13 nt, Brucella suis 1330
cauccgaggcgcg

SEQ ID NO: 447749 - RNA, 23 nt, Brucella suis 1330
caucccgccccuaaaggcucugc

SEQ ID NO: 447750 - RNA, 23 nt, Brucella suis 1330
caucccgaaaaccgguucccacu

SEQ ID NO: 447751 - RNA, 13 nt, Brucella suis 1330
cauccauguggaa

SEQ ID NO: 447752 - RNA, 22 nt, Brucella suis 1330
cauccaucggcucauccuccac

SEQ ID NO: 447753 - RNA, 10 nt, Brucella suis 1330
cauccagcgu

SEQ ID NO: 447754 - RNA, 11 nt, Brucella suis 1330
cauccagccgg

SEQ ID NO: 447755 - RNA, 23 nt, Brucella suis 1330
cauccagccggcgcaucuguucu

SEQ ID NO: 447756 - RNA, 13 nt, Brucella suis 1330
caucagcuugccc

SEQ ID NO: 447757 - RNA, 15 nt, Brucella suis 1330
caucagcuugcccau

SEQ ID NO: 447758 - RNA, 13 nt, Brucella suis 1330
caucagcggcggg

SEQ ID NO: 447759 - RNA, 22 nt, Brucella suis 1330
caucagcggcggguagccgcca

SEQ ID NO: 447760 - RNA, 20 nt, Brucella suis 1330
caucagcacgaaaugaaagc

SEQ ID NO: 447761 - RNA, 13 nt, Brucella suis 1330
caucagaaauuug

SEQ ID NO: 447762 - RNA, 11 nt, Brucella suis 1330
caucaccagcc

SEQ ID NO: 447763 - RNA, 13 nt, Brucella suis 1330
caucaccagcccc

SEQ ID NO: 447764 - RNA, 21 nt, Brucella suis 1330
caucacauuggugccgaaugu

SEQ ID NO: 447765 - RNA, 15 nt, Brucella suis 1330
caucacaugggcauu

SEQ ID NO: 447766 - RNA, 14 nt, Brucella suis 1330
caucaaugaaagca

SEQ ID NO: 447767 - RNA, 13 nt, Brucella suis 1330
caucaaugcaccc

SEQ ID NO: 447768 - RNA, 12 nt, Brucella suis 1330
cauaggcgcgcg

SEQ ID NO: 447769 - RNA, 18 nt, Brucella suis 1330
cauauacggcuugccauu

SEQ ID NO: 447770 - RNA, 16 nt, Brucella suis 1330
cauauacuuacuagug

SEQ ID NO: 447771 - RNA, 16 nt, Brucella suis 1330
cauagccugcaagcgc

SEQ ID NO: 447772 - RNA, 21 nt, Brucella suis 1330
cauagagcgugcccugaaaug

SEQ ID NO: 447773 - RNA, 18 nt, Brucella suis 1330
cauagaccaugacgccgc

SEQ ID NO: 447774 - RNA, 21 nt, Brucella suis 1330
cauagacgcgcagacgcagcg

SEQ ID NO: 447775 - RNA, 15 nt, Brucella suis 1330
caguucguggcgggg

SEQ ID NO: 447776 - RNA, 23 nt, Brucella suis 1330
caguuucuuguaucuugcggguu

SEQ ID NO: 447777 - RNA, 15 nt, Brucella suis 1330
caguuuguugaaaca

SEQ ID NO: 447778 - RNA, 17 nt, Brucella suis 1330
caguuuguugaaacagg

SEQ ID NO: 447779 - RNA, 22 nt, Brucella suis 1330
cauaaagcugguugcgcggcca

SEQ ID NO: 447780 - RNA, 20 nt, Brucella suis 1330
cauaagccggcaugaaugug

SEQ ID NO: 447781 - RNA, 22 nt, Brucella suis 1330
cauaaggcggaugcgcggcgcc

SEQ ID NO: 447782 - RNA, 12 nt, Brucella suis 1330
cauaaucagccu

SEQ ID NO: 447783 - RNA, 17 nt, Brucella suis 1330
cauaaugcauggaggca

SEQ ID NO: 447784 - RNA, 18 nt, Brucella suis 1330
caguuccggcggaaagcg

SEQ ID NO: 447785 - RNA, 18 nt, Brucella suis 1330
caguuccugcuucaucgc

SEQ ID NO: 447786 - RNA, 19 nt, Brucella suis 1330
caguucagcgugcgauaaa

SEQ ID NO: 447787 - RNA, 15 nt, Brucella suis 1330
cagugcgccaccgcg

SEQ ID NO: 447788 - RNA, 12 nt, Brucella suis 1330
caguggcucucc

SEQ ID NO: 447789 - RNA, 15 nt, Brucella suis 1330
cagugcaaagcggcu

SEQ ID NO: 447790 - RNA, 15 nt, Brucella suis 1330
caguccagcgcgcgg

SEQ ID NO: 447791 - RNA, 15 nt, Brucella suis 1330
cagucaugcccauaa

SEQ ID NO: 447792 - RNA, 19 nt, Brucella suis 1330
caguagggcaguagggcag

SEQ ID NO: 447793 - RNA, 20 nt, Brucella suis 1330
caguagggcaguagggcagu

SEQ ID NO: 447794 - RNA, 21 nt, Brucella suis 1330
caguagggcaguagggcagua

SEQ ID NO: 447795 - RNA, 21 nt, Brucella suis 1330
caguagcuucugggugagcgu

SEQ ID NO: 447796 - RNA, 18 nt, Brucella suis 1330
caguacgguuauggcuca

SEQ ID NO: 447797 - RNA, 23 nt, Brucella suis 1330
caguacgccgccuucccagccgg

SEQ ID NO: 447798 - RNA, 18 nt, Brucella suis 1330
caguacggcgcgcugaag

SEQ ID NO: 447799 - RNA, 13 nt, Brucella suis 1330
caguaaagucuga

SEQ ID NO: 447800 - RNA, 12 nt, Brucella suis 1330
cagguuccgccg

SEQ ID NO: 447801 - RNA, 15 nt, Brucella suis 1330
caggugccaucaagc

SEQ ID NO: 447802 - RNA, 19 nt, Brucella suis 1330
caggucgagcgccuguccg

SEQ ID NO: 447803 - RNA, 18 nt, Brucella suis 1330
cagggauugcgcaagugc

SEQ ID NO: 447804 - RNA, 20 nt, Brucella suis 1330
cagggaaaagccgcgcucca

SEQ ID NO: 447805 - RNA, 16 nt, Brucella suis 1330
caggcuuucggccugu

SEQ ID NO: 447806 - RNA, 17 nt, Brucella suis 1330
caggcuuuccgacaggg

SEQ ID NO: 447807 - RNA, 20 nt, Brucella suis 1330
caggcuuuccgacagggcaa

SEQ ID NO: 447808 - RNA, 16 nt, Brucella suis 1330
caggcugcccaugccc

SEQ ID NO: 447809 - RNA, 20 nt, Brucella suis 1330
caggcugaguuuuccgcuuu

SEQ ID NO: 447810 - RNA, 14 nt, Brucella suis 1330
caggcucugaaacu

SEQ ID NO: 447811 - RNA, 22 nt, Brucella suis 1330
caggcucugaaacugaaaaagg

SEQ ID NO: 447812 - RNA, 13 nt, Brucella suis 1330
caggcggaagggc

SEQ ID NO: 447813 - RNA, 21 nt, Brucella suis 1330
caggcggauauucgccgccuc

SEQ ID NO: 447814 - RNA, 21 nt, Brucella suis 1330
caggcgcaacuguucgggcgu

SEQ ID NO: 447815 - RNA, 14 nt, Brucella suis 1330
caggcgagcaugga

SEQ ID NO: 447816 - RNA, 19 nt, Brucella suis 1330
caggccccgaugcggcugc

SEQ ID NO: 447817 - RNA, 13 nt, Brucella suis 1330
caggcccagcaug

SEQ ID NO: 447818 - RNA, 20 nt, Brucella suis 1330
caggaugcccuucguguccg

SEQ ID NO: 447819 - RNA, 13 nt, Brucella suis 1330
caggaucuuucca

SEQ ID NO: 447820 - RNA, 18 nt, Brucella suis 1330
caggauaaccuucuggaa

SEQ ID NO: 447821 - RNA, 21 nt, Brucella suis 1330
caggaaagcccggcuggaaca

SEQ ID NO: 447822 - RNA, 22 nt, Brucella suis 1330
caggaaaacgccaccuuuuucg

SEQ ID NO: 447823 - RNA, 17 nt, Brucella suis 1330
caggaaaagccccaugu

SEQ ID NO: 447824 - RNA, 15 nt, Brucella suis 1330
cagcucgaaauccag

SEQ ID NO: 447825 - RNA, 16 nt, Brucella suis 1330
cagcucgaaauccagu

SEQ ID NO: 447826 - RNA, 20 nt, Brucella suis 1330
cagcgugcagccugaacagc

SEQ ID NO: 447827 - RNA, 14 nt, Brucella suis 1330
cagcgugaugcccg

SEQ ID NO: 447828 - RNA, 14 nt, Brucella suis 1330
cagcgucaggacaa

SEQ ID NO: 447829 - RNA, 18 nt, Brucella suis 1330
cagcguaaucacuugcaa

SEQ ID NO: 447830 - RNA, 22 nt, Brucella suis 1330
cagcguaaucacuugcaagcgc

SEQ ID NO: 447831 - RNA, 21 nt, Brucella suis 1330
cacugaccuuuugacggcccg

SEQ ID NO: 447832 - RNA, 13 nt, Brucella suis 1330
cacucugccaggc

SEQ ID NO: 447833 - RNA, 19 nt, Brucella suis 1330
cacucccgcaucuccucaa

SEQ ID NO: 447834 - RNA, 16 nt, Brucella suis 1330
cacuacgucaacagcc

SEQ ID NO: 447835 - RNA, 21 nt, Brucella suis 1330
cacuauucaaacggcaucauu

SEQ ID NO: 447836 - RNA, 16 nt, Brucella suis 1330
cacucauuaucagcau

SEQ ID NO: 447837 - RNA, 14 nt, Brucella suis 1330
cacguuggggcgcc

SEQ ID NO: 447838 - RNA, 16 nt, Brucella suis 1330
cacguuugacagccug

SEQ ID NO: 447839 - RNA, 21 nt, Brucella suis 1330
cacgucggucaaugccaccgc

SEQ ID NO: 447840 - RNA, 16 nt, Brucella suis 1330
cacgucguggccagcc

SEQ ID NO: 447841 - RNA, 22 nt, Brucella suis 1330
cacgucaucaucgucuucaagc

SEQ ID NO: 447842 - RNA, 14 nt, Brucella suis 1330
cacguccuuggcac

SEQ ID NO: 447843 - RNA, 18 nt, Brucella suis 1330
cacgucggacuucugcuu

SEQ ID NO: 447844 - RNA, 23 nt, Brucella suis 1330
cacggugaagacauggcgggcca

SEQ ID NO: 447845 - RNA, 16 nt, Brucella suis 1330
cacggcgcaggcaggg

SEQ ID NO: 447846 - RNA, 22 nt, Brucella suis 1330
cacggcgccugugugaacaggu

SEQ ID NO: 447847 - RNA, 12 nt, Brucella suis 1330
cacggcagagug

SEQ ID NO: 447848 - RNA, 16 nt, Brucella suis 1330
cacggauuuccaccac

SEQ ID NO: 447849 - RNA, 17 nt, Brucella suis 1330
cacgcuuggccucuucc

SEQ ID NO: 447850 - RNA, 13 nt, Brucella suis 1330
cacgcucaacacu

SEQ ID NO: 447851 - RNA, 13 nt, Brucella suis 1330
cacgcuccacacg

SEQ ID NO: 447852 - RNA, 14 nt, Brucella suis 1330
cacgcuccgggcuu

SEQ ID NO: 447853 - RNA, 19 nt, Brucella suis 1330
cacgcgcgaaaccauggag

SEQ ID NO: 447854 - RNA, 15 nt, Brucella suis 1330
cacgcgccgacaaaa

SEQ ID NO: 447855 - RNA, 12 nt, Brucella suis 1330
cacgcgcaugcc

SEQ ID NO: 447856 - RNA, 17 nt, Brucella suis 1330
cacgccgccgcgcggca

SEQ ID NO: 447857 - RNA, 17 nt, Brucella suis 1330
cacgccgcgacuccuug

SEQ ID NO: 447858 - RNA, 15 nt, Brucella suis 1330
cacgccggaacaccu

SEQ ID NO: 447859 - RNA, 21 nt, Brucella suis 1330
cacgccgaggaauuucagcga

SEQ ID NO: 447860 - RNA, 19 nt, Brucella suis 1330
cacgcccaugaucgcgcca

SEQ ID NO: 447861 - RNA, 16 nt, Brucella suis 1330
cacgcccagcgcggca

SEQ ID NO: 447862 - RNA, 13 nt, Brucella suis 1330
cacgccagccgcg

SEQ ID NO: 447863 - RNA, 22 nt, Brucella suis 1330
cacgccagccgcgaucacagcc

SEQ ID NO: 447864 - RNA, 15 nt, Brucella suis 1330
cacgccacugcccug

SEQ ID NO: 447865 - RNA, 17 nt, Brucella suis 1330
cacgcacggucuugccg

SEQ ID NO: 447866 - RNA, 17 nt, Brucella suis 1330
cacgcaggacaagccgc

SEQ ID NO: 447867 - RNA, 13 nt, Brucella suis 1330
cacgcaaggcggc

SEQ ID NO: 447868 - RNA, 22 nt, Brucella suis 1330
cacgaugggacaucuuugcggc

SEQ ID NO: 447869 - RNA, 18 nt, Brucella suis 1330
cacgaccagcgcaaugcc

SEQ ID NO: 447870 - RNA, 17 nt, Brucella suis 1330
cacgacaauggcaauau

SEQ ID NO: 447871 - RNA, 16 nt, Brucella suis 1330
cacgaacagaucgcca

SEQ ID NO: 447872 - RNA, 16 nt, Brucella suis 1330
cacgaacagcagcagg

SEQ ID NO: 447873 - RNA, 20 nt, Brucella suis 1330
cacgaaaagcaggaucaggg

SEQ ID NO: 447874 - RNA, 14 nt, Brucella suis 1330
caccuugccgggcg

SEQ ID NO: 447875 - RNA, 20 nt, Brucella suis 1330
caccuuccugccuuugaaga

SEQ ID NO: 447876 - RNA, 15 nt, Brucella suis 1330
caccuucggccagcg

SEQ ID NO: 447877 - RNA, 13 nt, Brucella suis 1330
caccugcggcgcc

SEQ ID NO: 447878 - RNA, 19 nt, Brucella suis 1330
caccugcggcgccagaugc

SEQ ID NO: 447879 - RNA, 21 nt, Brucella suis 1330
caccguugccucugucagcuu

SEQ ID NO: 447880 - RNA, 19 nt, Brucella suis 1330
caccguuucaaaccccagu

SEQ ID NO: 447881 - RNA, 22 nt, Brucella suis 1330
caccguuucggguggccuuugc

SEQ ID NO: 447882 - RNA, 14 nt, Brucella suis 1330
caccgugcuccaga

SEQ ID NO: 447883 - RNA, 13 nt, Brucella suis 1330
caccgucaccggc

SEQ ID NO: 447884 - RNA, 13 nt, Brucella suis 1330
caccgguuuucau

SEQ ID NO: 447885 - RNA, 22 nt, Brucella suis 1330
caccggcugggccuuguuuucu

SEQ ID NO: 447886 - RNA, 16 nt, Brucella suis 1330
caccggcccaaaggcc

SEQ ID NO: 447887 - RNA, 23 nt, Brucella suis 1330
caccgcgggaaaaaucgcgcggc

SEQ ID NO: 447888 - RNA, 16 nt, Brucella suis 1330
caccgcgccggaaggc

SEQ ID NO: 447889 - RNA, 16 nt, Brucella suis 1330
caccgccugccagccc

SEQ ID NO: 447890 - RNA, 15 nt, Brucella suis 1330
caccgccagcagaac

SEQ ID NO: 447891 - RNA, 20 nt, Brucella suis 1330
caccgccagcagaaccgcuu

SEQ ID NO: 447892 - RNA, 12 nt, Brucella suis 1330
caccgcacuggg

SEQ ID NO: 447893 - RNA, 22 nt, Brucella suis 1330
caccgaucacgccgucaaagga

SEQ ID NO: 447894 - RNA, 14 nt, Brucella suis 1330
caccgaggccgcca

SEQ ID NO: 447895 - RNA, 15 nt, Brucella suis 1330
caccgaggccgccac

SEQ ID NO: 447896 - RNA, 22 nt, Brucella suis 1330
caccgaccggcacccacugccc

SEQ ID NO: 447897 - RNA, 19 nt, Brucella suis 1330
cacccuuggcgacggccag

SEQ ID NO: 447898 - RNA, 16 nt, Brucella suis 1330
cacccucggugccaag

SEQ ID NO: 447899 - RNA, 14 nt, Brucella suis 1330
cacccuauuccccu

SEQ ID NO: 447900 - RNA, 15 nt, Brucella suis 1330
cacccuauuccccua

SEQ ID NO: 447901 - RNA, 21 nt, Brucella suis 1330
cacccggcaccgcaaagagaa

SEQ ID NO: 447902 - RNA, 13 nt, Brucella suis 1330
cacccggccgccc

SEQ ID NO: 447903 - RNA, 19 nt, Brucella suis 1330
cacccgcgucgucugcauc

SEQ ID NO: 447904 - RNA, 20 nt, Brucella suis 1330
cacccgauaaacccgccccc

SEQ ID NO: 447905 - RNA, 23 nt, Brucella suis 1330
cacccagcccgaagaccaggccc

SEQ ID NO: 447906 - RNA, 20 nt, Brucella suis 1330
cacccagaaaacgacgcgca

SEQ ID NO: 447907 - RNA, 15 nt, Brucella suis 1330
caccauuacaaaaau

SEQ ID NO: 447908 - RNA, 19 nt, Brucella suis 1330
caccauggugucauagacc

SEQ ID NO: 447909 - RNA, 21 nt, Brucella suis 1330
caccauggugucauagaccau

SEQ ID NO: 447910 - RNA, 15 nt, Brucella suis 1330
caccauggccgcccc

SEQ ID NO: 447911 - RNA, 16 nt, Brucella suis 1330
caccaucucgcccagg

SEQ ID NO: 447912 - RNA, 16 nt, Brucella suis 1330
caccaucgcccgccgc

SEQ ID NO: 447913 - RNA, 21 nt, Brucella suis 1330
caccagucacgguugccuugc

SEQ ID NO: 447914 - RNA, 15 nt, Brucella suis 1330
caccauauucgucca

SEQ ID NO: 447915 - RNA, 19 nt, Brucella suis 1330
caccauauuugccgccaga

SEQ ID NO: 447916 - RNA, 23 nt, Brucella suis 1330
caccagcggcacgccgcccagga

SEQ ID NO: 447917 - RNA, 14 nt, Brucella suis 1330
caccagcgcgccga

SEQ ID NO: 447918 - RNA, 13 nt, Brucella suis 1330
caccagcgcgccg

SEQ ID NO: 447919 - RNA, 23 nt, Brucella suis 1330
caccagccguuccagggcgcgcc

SEQ ID NO: 447920 - RNA, 20 nt, Brucella suis 1330
caccagcacacagccaagac

SEQ ID NO: 447921 - RNA, 22 nt, Brucella suis 1330
caccagaccaucggcaacaaga

SEQ ID NO: 447922 - RNA, 15 nt, Brucella suis 1330
caccagagacagugg

SEQ ID NO: 447923 - RNA, 11 nt, Brucella suis 1330
caccagaugcu

SEQ ID NO: 447924 - RNA, 22 nt, Brucella suis 1330
caccaccucgccauugcgcauu

SEQ ID NO: 447925 - RNA, 14 nt, Brucella suis 1330
caccaccucgccaa

SEQ ID NO: 447926 - RNA, 18 nt, Brucella suis 1330
caccaccgggcagucagc

SEQ ID NO: 447927 - RNA, 20 nt, Brucella suis 1330
caccacaugcuccagggugc

SEQ ID NO: 447928 - RNA, 13 nt, Brucella suis 1330
caccaaugcaggc

SEQ ID NO: 447929 - RNA, 18 nt, Brucella suis 1330
caccaaugcaggcgcggc

SEQ ID NO: 447930 - RNA, 19 nt, Brucella suis 1330
caccaaugcaggcgcggca

SEQ ID NO: 447931 - RNA, 23 nt, Brucella suis 1330
caccacaccaucgcccgccgcga

SEQ ID NO: 447932 - RNA, 16 nt, Brucella suis 1330
cacauuucaugaaaau

SEQ ID NO: 447933 - RNA, 16 nt, Brucella suis 1330
cacauggcggccuuuu

SEQ ID NO: 447934 - RNA, 18 nt, Brucella suis 1330
cacaucgagacggcgcuc

SEQ ID NO: 447935 - RNA, 21 nt, Brucella suis 1330
cacaucgagacggcgcuccau

SEQ ID NO: 447936 - RNA, 16 nt, Brucella suis 1330
cacauaucagcccgcu

SEQ ID NO: 447937 - RNA, 15 nt, Brucella suis 1330
cacauaaucgcccuc

SEQ ID NO: 447938 - RNA, 21 nt, Brucella suis 1330
cacauaaucgcccucgaucag

SEQ ID NO: 447939 - RNA, 21 nt, Brucella suis 1330
cacagccgguucggauccucc

SEQ ID NO: 447940 - RNA, 10 nt, Brucella suis 1330
cacagccuug

SEQ ID NO: 447941 - RNA, 22 nt, Brucella suis 1330
cacagccuuggaauggcgcaca

SEQ ID NO: 447942 - RNA, 14 nt, Brucella suis 1330
cacagccaucagga

SEQ ID NO: 447943 - RNA, 14 nt, Brucella suis 1330
cacagccccuugcc

SEQ ID NO: 447944 - RNA, 19 nt, Brucella suis 1330
cacagccccuugccccggc

SEQ ID NO: 447945 - RNA, 16 nt, Brucella suis 1330
cacagccagaaagaag

SEQ ID NO: 447946 - RNA, 13 nt, Brucella suis 1330
cacagaucaugag

SEQ ID NO: 447947 - RNA, 19 nt, Brucella suis 1330
cacaccaauguccaguugg

SEQ ID NO: 447948 - RNA, 18 nt, Brucella suis 1330
cacaagaacagccgcccc

SEQ ID NO: 447949 - RNA, 18 nt, Brucella suis 1330
caauucaugcccuauacc

SEQ ID NO: 447950 - RNA, 14 nt, Brucella suis 1330
caauuccagccggg

SEQ ID NO: 447951 - RNA, 16 nt, Brucella suis 1330
caaucagggauagaau

SEQ ID NO: 447952 - RNA, 22 nt, Brucella suis 1330
caaucagcacggcaaucagauc

SEQ ID NO: 447953 - RNA, 16 nt, Brucella suis 1330
caauagcauggccccg

SEQ ID NO: 447954 - RNA, 18 nt, Brucella suis 1330
caauagcauggccccgga

SEQ ID NO: 447955 - RNA, 23 nt, Brucella suis 1330
caauauagcagucuucuugugaa

SEQ ID NO: 447956 - RNA, 15 nt, Brucella suis 1330
caaucaccagagaca

SEQ ID NO: 447957 - RNA, 15 nt, Brucella suis 1330
caauaaugcagcgcc

SEQ ID NO: 447958 - RNA, 19 nt, Brucella suis 1330
caagguuugcauagggcag

SEQ ID NO: 447959 - RNA, 12 nt, Brucella suis 1330
caagggaaugcg

SEQ ID NO: 447960 - RNA, 13 nt, Brucella suis 1330
caagggcaagcag

SEQ ID NO: 447961 - RNA, 15 nt, Brucella suis 1330
caagugugcagacag

SEQ ID NO: 447962 - RNA, 15 nt, Brucella suis 1330
caagcuucaggcucu

SEQ ID NO: 447963 - RNA, 19 nt, Brucella suis 1330
caagcuggaaggccaggcc

SEQ ID NO: 447964 - RNA, 19 nt, Brucella suis 1330
caagcgcauccagccggcg

SEQ ID NO: 447965 - RNA, 19 nt, Brucella suis 1330
caagcgcaucgaaagccgu

SEQ ID NO: 447966 - RNA, 22 nt, Brucella suis 1330
caagcgccagaaagacauuuuc

SEQ ID NO: 447967 - RNA, 17 nt, Brucella suis 1330
caagaugcuugaggauc

SEQ ID NO: 447968 - RNA, 13 nt, Brucella suis 1330
caagauagcccca

SEQ ID NO: 447969 - RNA, 17 nt, Brucella suis 1330
caagaucauccggcuca

SEQ ID NO: 447970 - RNA, 21 nt, Brucella suis 1330
caagaucauccggcucauagu

SEQ ID NO: 447971 - RNA, 23 nt, Brucella suis 1330
caagagcggcguugaugucguca

SEQ ID NO: 447972 - RNA, 15 nt, Brucella suis 1330
caagauacaaaaaau

SEQ ID NO: 447973 - RNA, 17 nt, Brucella suis 1330
caagacuuuccauccag

SEQ ID NO: 447974 - RNA, 18 nt, Brucella suis 1330
caagaaagaucagccagc

SEQ ID NO: 447975 - RNA, 16 nt, Brucella suis 1330
caagaacagccgcccc

SEQ ID NO: 447976 - RNA, 17 nt, Brucella suis 1330
caacgguucguccuuga

SEQ ID NO: 447977 - RNA, 17 nt, Brucella suis 1330
caacgggugcgcugcca

SEQ ID NO: 447978 - RNA, 22 nt, Brucella suis 1330
caacgcgccaaacugcaccguc

SEQ ID NO: 447979 - RNA, 19 nt, Brucella suis 1330
caacgauaaugggcgcagu

SEQ ID NO: 447980 - RNA, 21 nt, Brucella suis 1330
caacgaugacccagccaagcg

SEQ ID NO: 447981 - RNA, 15 nt, Brucella suis 1330
caacgcaauggagca

SEQ ID NO: 447982 - RNA, 17 nt, Brucella suis 1330
caacgcaauggagcagg

SEQ ID NO: 447983 - RNA, 15 nt, Brucella suis 1330
caaccuggcugcacc

SEQ ID NO: 447984 - RNA, 14 nt, Brucella suis 1330
caacagccuuggcu

SEQ ID NO: 447985 - RNA, 18 nt, Brucella suis 1330
caacaaaugcaaaugccg

SEQ ID NO: 447986 - RNA, 17 nt, Brucella suis 1330
caaauguuggaaucaga

SEQ ID NO: 447987 - RNA, 12 nt, Brucella suis 1330
caaauucauugu

SEQ ID NO: 447988 - RNA, 13 nt, Brucella suis 1330
caacaaaaugccc

SEQ ID NO: 447989 - RNA, 17 nt, Brucella suis 1330
caaaggcaggcacaccc

SEQ ID NO: 447990 - RNA, 13 nt, Brucella suis 1330
caaagaccagcag

SEQ ID NO: 447991 - RNA, 17 nt, Brucella suis 1330
caaagaccagcaggaag

SEQ ID NO: 447992 - RNA, 20 nt, Brucella suis 1330
caaagcggaucagcgcgccg

SEQ ID NO: 447993 - RNA, 13 nt, Brucella suis 1330
caaacggauugcc

SEQ ID NO: 447994 - RNA, 18 nt, Brucella suis 1330
caaacggcaucauuggaa

SEQ ID NO: 447995 - RNA, 13 nt, Brucella suis 1330
caaaccaggaccg

SEQ ID NO: 447996 - RNA, 22 nt, Brucella suis 1330
caaacauccagccggugaaaau

SEQ ID NO: 447997 - RNA, 13 nt, Brucella suis 1330
caaaccaaaaaac

SEQ ID NO: 447998 - RNA, 11 nt, Brucella suis 1330
caaacaagcuu

SEQ ID NO: 447999 - RNA, 18 nt, Brucella suis 1330
caaaauggugcugccaug

SEQ ID NO: 448000 - RNA, 17 nt, Brucella suis 1330
caaaaguuuucagcggc

SEQ ID NO: 448001 - RNA, 13 nt, Brucella suis 1330
auuugcaggccgu

SEQ ID NO: 448002 - RNA, 21 nt, Brucella suis 1330
auuugccauagccuuucugcc

SEQ ID NO: 448003 - RNA, 17 nt, Brucella suis 1330
auuugcuuaagugucug

SEQ ID NO: 448004 - RNA, 19 nt, Brucella suis 1330
auuugaggauugccgccgc

SEQ ID NO: 448005 - RNA, 14 nt, Brucella suis 1330
auuuuagcugcugu

SEQ ID NO: 448006 - RNA, 14 nt, Brucella suis 1330
auuucgcccacgcc

SEQ ID NO: 448007 - RNA, 16 nt, Brucella suis 1330
auuuccacgcucgcau

SEQ ID NO: 448008 - RNA, 17 nt, Brucella suis 1330
auuuccagcaaaaguga

SEQ ID NO: 448009 - RNA, 21 nt, Brucella suis 1330
auuuccgaagcccgugccauc

SEQ ID NO: 448010 - RNA, 14 nt, Brucella suis 1330
auuucaccacgcca

SEQ ID NO: 448011 - RNA, 17 nt, Brucella suis 1330
auuucaccgcgcaagau

SEQ ID NO: 448012 - RNA, 21 nt, Brucella suis 1330
auuucaccgcgcaagauuuug

SEQ ID NO: 448013 - RNA, 18 nt, Brucella suis 1330
auuucaggcgcugaugug

SEQ ID NO: 448014 - RNA, 15 nt, Brucella suis 1330
auuggcguucacauu

SEQ ID NO: 448015 - RNA, 15 nt, Brucella suis 1330
auuuacguuuucguc

SEQ ID NO: 448016 - RNA, 14 nt, Brucella suis 1330
auuggccgcugccu

SEQ ID NO: 448017 - RNA, 22 nt, Brucella suis 1330
auugcugcagaacaaagaaguu

SEQ ID NO: 448018 - RNA, 21 nt, Brucella suis 1330
auugcggcugauaugcgcaug

SEQ ID NO: 448019 - RNA, 17 nt, Brucella suis 1330
auugcgggaaggcgcga

SEQ ID NO: 448020 - RNA, 19 nt, Brucella suis 1330
auugcaucgccaagcuuga

SEQ ID NO: 448021 - RNA, 16 nt, Brucella suis 1330
auugaugaaaaacccc

SEQ ID NO: 448022 - RNA, 19 nt, Brucella suis 1330
auucuuccagaaugcgccg

SEQ ID NO: 448023 - RNA, 22 nt, Brucella suis 1330
auucuugcgcccuccaccgcuc

SEQ ID NO: 448024 - RNA, 22 nt, Brucella suis 1330
auucgggcggcacccccggcag

SEQ ID NO: 448025 - RNA, 16 nt, Brucella suis 1330
auuccuucuccaucug

SEQ ID NO: 448026 - RNA, 18 nt, Brucella suis 1330
auuccgccggggcaggcu

SEQ ID NO: 448027 - RNA, 17 nt, Brucella suis 1330
auuccgauggaacugcu

SEQ ID NO: 448028 - RNA, 14 nt, Brucella suis 1330
auuccgggccgcac

SEQ ID NO: 448029 - RNA, 21 nt, Brucella suis 1330
auuccucaagauacaaaaaau

SEQ ID NO: 448030 - RNA, 16 nt, Brucella suis 1330
auuccccuaaaucacu

SEQ ID NO: 448031 - RNA, 14 nt, Brucella suis 1330
auuccccuauuccc

SEQ ID NO: 448032 - RNA, 16 nt, Brucella suis 1330
auuccccuauuccccu

SEQ ID NO: 448033 - RNA, 18 nt, Brucella suis 1330
auuccccuauuccccuau

SEQ ID NO: 448034 - RNA, 18 nt, Brucella suis 1330
auuccccuauucccuuaa

SEQ ID NO: 448035 - RNA, 13 nt, Brucella suis 1330
auucccgccucag

SEQ ID NO: 448036 - RNA, 17 nt, Brucella suis 1330
auucccuuaacauacug

SEQ ID NO: 448037 - RNA, 19 nt, Brucella suis 1330
auucccuuaacauacugcc

SEQ ID NO: 448038 - RNA, 22 nt, Brucella suis 1330
auuccaucagccgggcagugcc

SEQ ID NO: 448039 - RNA, 14 nt, Brucella suis 1330
auuccagccgggcu

SEQ ID NO: 448040 - RNA, 20 nt, Brucella suis 1330
auuccagaugcggcgcgcau

SEQ ID NO: 448041 - RNA, 12 nt, Brucella suis 1330
auuccagaaggu

SEQ ID NO: 448042 - RNA, 19 nt, Brucella suis 1330
auuccaacauuugcucaac

SEQ ID NO: 448043 - RNA, 20 nt, Brucella suis 1330
auuccaacauuugcucaacg

SEQ ID NO: 448044 - RNA, 16 nt, Brucella suis 1330
auguugauggaaggcg

SEQ ID NO: 448045 - RNA, 12 nt, Brucella suis 1330
auguucuucccc

SEQ ID NO: 448046 - RNA, 16 nt, Brucella suis 1330
auguucuuccccguca

SEQ ID NO: 448047 - RNA, 14 nt, Brucella suis 1330
auucaucguauucg

SEQ ID NO: 448048 - RNA, 11 nt, Brucella suis 1330
auucaugcccu

SEQ ID NO: 448049 - RNA, 16 nt, Brucella suis 1330
augugucauaaaaaac

SEQ ID NO: 448050 - RNA, 21 nt, Brucella suis 1330
auguuccgggccgggaaaucu

SEQ ID NO: 448051 - RNA, 17 nt, Brucella suis 1330
auguucggguagagcuu

SEQ ID NO: 448052 - RNA, 20 nt, Brucella suis 1330
auggugccagcgucggcggu

SEQ ID NO: 448053 - RNA, 14 nt, Brucella suis 1330
auggcuugaagcgu

SEQ ID NO: 448054 - RNA, 19 nt, Brucella suis 1330
auggguaccuuccagcaug

SEQ ID NO: 448055 - RNA, 18 nt, Brucella suis 1330
auggcguucugaaaccgc

SEQ ID NO: 448056 - RNA, 16 nt, Brucella suis 1330
auggcugauuucuucc

SEQ ID NO: 448057 - RNA, 17 nt, Brucella suis 1330
auggcugcccgcgccgg

SEQ ID NO: 448058 - RNA, 17 nt, Brucella suis 1330
auggcugcgauggaugu

SEQ ID NO: 448059 - RNA, 22 nt, Brucella suis 1330
auggcuggaaauuuaucgucac

SEQ ID NO: 448060 - RNA, 18 nt, Brucella suis 1330
auggcgccgcauggcggc

SEQ ID NO: 448061 - RNA, 21 nt, Brucella suis 1330
auggcgauuauuuuuacaaaa

SEQ ID NO: 448062 - RNA, 22 nt, Brucella suis 1330
auggccugcugcauuuucugca

SEQ ID NO: 448063 - RNA, 19 nt, Brucella suis 1330
auggccucaagugccgccu

SEQ ID NO: 448064 - RNA, 14 nt, Brucella suis 1330
auggcccugucagc

SEQ ID NO: 448065 - RNA, 14 nt, Brucella suis 1330
auggcaaucuccau

SEQ ID NO: 448066 - RNA, 16 nt, Brucella suis 1330
auggcacaagaacagc

SEQ ID NO: 448067 - RNA, 14 nt, Brucella suis 1330
auggcacgcacaag

SEQ ID NO: 448068 - RNA, 17 nt, Brucella suis 1330
auggauugcgggcauga

SEQ ID NO: 448069 - RNA, 17 nt, Brucella suis 1330
auggcaagcagcaaaac

SEQ ID NO: 448070 - RNA, 13 nt, Brucella suis 1330
auggagcggcuga

SEQ ID NO: 448071 - RNA, 21 nt, Brucella suis 1330
auggaugccgccgcagaccac

SEQ ID NO: 448072 - RNA, 18 nt, Brucella suis 1330
auggacggaaccaagguc

SEQ ID NO: 448073 - RNA, 15 nt, Brucella suis 1330
auggaaauagcacau

SEQ ID NO: 448074 - RNA, 16 nt, Brucella suis 1330
auggaaauagcacaua

SEQ ID NO: 448075 - RNA, 16 nt, Brucella suis 1330
auggaaaaacccggcc

SEQ ID NO: 448076 - RNA, 14 nt, Brucella suis 1330
auggaaaaggccug

SEQ ID NO: 448077 - RNA, 24 nt, Brucella suis 1330
augcuggcacugucgggcucaggc

SEQ ID NO: 448078 - RNA, 15 nt, Brucella suis 1330
augcugaacaagcag

SEQ ID NO: 448079 - RNA, 16 nt, Brucella suis 1330
augcguugaaugcaga

SEQ ID NO: 448080 - RNA, 23 nt, Brucella suis 1330
augcguccgacaugggccgggcg

SEQ ID NO: 448081 - RNA, 17 nt, Brucella suis 1330
augcggggcgacgcugc

SEQ ID NO: 448082 - RNA, 13 nt, Brucella suis 1330
augcggauuugga

SEQ ID NO: 448083 - RNA, 20 nt, Brucella suis 1330
augcgcuucgcgcaggccgc

SEQ ID NO: 448084 - RNA, 17 nt, Brucella suis 1330
augcgcucuaaccauuu

SEQ ID NO: 448085 - RNA, 17 nt, Brucella suis 1330
augcgcucuaugcagca

SEQ ID NO: 448086 - RNA, 20 nt, Brucella suis 1330
augcgcggcggcaacgggcg

SEQ ID NO: 448087 - RNA, 18 nt, Brucella suis 1330
augcgcgauggcccagcc

SEQ ID NO: 448088 - RNA, 15 nt, Brucella suis 1330
augcgcgucaaaaca

SEQ ID NO: 448089 - RNA, 19 nt, Brucella suis 1330
augcgauccuuguucuugg

SEQ ID NO: 448090 - RNA, 17 nt, Brucella suis 1330
augcgagguccggggug

SEQ ID NO: 448091 - RNA, 16 nt, Brucella suis 1330
augcaccgccgaugca

SEQ ID NO: 448092 - RNA, 14 nt, Brucella suis 1330
augcaccaucaucg

SEQ ID NO: 448093 - RNA, 22 nt, Brucella suis 1330
augaugauccagguauagauau

SEQ ID NO: 448094 - RNA, 16 nt, Brucella suis 1330
augaugaucgccagca

SEQ ID NO: 448095 - RNA, 18 nt, Brucella suis 1330
augaugccggucgcaggc

SEQ ID NO: 448096 - RNA, 14 nt, Brucella suis 1330
augagcagcggcaa

SEQ ID NO: 448097 - RNA, 17 nt, Brucella suis 1330
augagcgacaggaacau

SEQ ID NO: 448098 - RNA, 17 nt, Brucella suis 1330
augaacccgcucccccc

SEQ ID NO: 448099 - RNA, 14 nt, Brucella suis 1330
aucuuucuugaagu

SEQ ID NO: 448100 - RNA, 15 nt, Brucella suis 1330
aucuugcugaugagc

SEQ ID NO: 448101 - RNA, 20 nt, Brucella suis 1330
aucuugcgcagcgcaggcgc

SEQ ID NO: 448102 - RNA, 20 nt, Brucella suis 1330
aucuuccagagcggguuccc

SEQ ID NO: 448103 - RNA, 12 nt, Brucella suis 1330
aucuuccaucug

SEQ ID NO: 448104 - RNA, 16 nt, Brucella suis 1330
aucuuccgcaagccag

SEQ ID NO: 448105 - RNA, 16 nt, Brucella suis 1330
aucuucgaucauuucc

SEQ ID NO: 448106 - RNA, 19 nt, Brucella suis 1330
aucuucgcccugaaacacu

SEQ ID NO: 448107 - RNA, 18 nt, Brucella suis 1330
aucuucggcaucagaaau

SEQ ID NO: 448108 - RNA, 21 nt, Brucella suis 1330
aucuucggcaucagaaauuug

SEQ ID NO: 448109 - RNA, 19 nt, Brucella suis 1330
aucuguucacauuucauga

SEQ ID NO: 448110 - RNA, 18 nt, Brucella suis 1330
aucuuacgaccaagccca

SEQ ID NO: 448111 - RNA, 15 nt, Brucella suis 1330
aucuggaaggccagc

SEQ ID NO: 448112 - RNA, 16 nt, Brucella suis 1330
aucgucguccagcccu

SEQ ID NO: 448113 - RNA, 15 nt, Brucella suis 1330
aucguaucgccaaag

SEQ ID NO: 448114 - RNA, 21 nt, Brucella suis 1330
aucguaucgccaaagaccagc

SEQ ID NO: 448115 - RNA, 15 nt, Brucella suis 1330
aucgucagcaccgcu

SEQ ID NO: 448116 - RNA, 20 nt, Brucella suis 1330
aucgguggugccgaaggccu

SEQ ID NO: 448117 - RNA, 15 nt, Brucella suis 1330
aucggcgaugcccau

SEQ ID NO: 448118 - RNA, 22 nt, Brucella suis 1330
aucggcgauauggcgcaaugcc

SEQ ID NO: 448119 - RNA, 17 nt, Brucella suis 1330
aucggcagcuuuggcgc

SEQ ID NO: 448120 - RNA, 14 nt, Brucella suis 1330
aucggacuggauuu

SEQ ID NO: 448121 - RNA, 14 nt, Brucella suis 1330
aucggaacaaacug

SEQ ID NO: 448122 - RNA, 15 nt, Brucella suis 1330
aucggaaccgcucua

SEQ ID NO: 448123 - RNA, 22 nt, Brucella suis 1330
aucgcgaagaagaauacgcagc

SEQ ID NO: 448124 - RNA, 19 nt, Brucella suis 1330
aucgcuauuuggcacucau

SEQ ID NO: 448125 - RNA, 14 nt, Brucella suis 1330
aucgccugcuuccu

SEQ ID NO: 448126 - RNA, 18 nt, Brucella suis 1330
aucgccugcuuccuuuuc

SEQ ID NO: 448127 - RNA, 20 nt, Brucella suis 1330
aucgcugaucggcgcagggg

SEQ ID NO: 448128 - RNA, 22 nt, Brucella suis 1330
aucgccaccguugcauauucca

SEQ ID NO: 448129 - RNA, 13 nt, Brucella suis 1330
aucgccaagcuug

SEQ ID NO: 448130 - RNA, 16 nt, Brucella suis 1330
aucgacucauuuuuag

SEQ ID NO: 448131 - RNA, 12 nt, Brucella suis 1330
aucgacaaaggu

SEQ ID NO: 448132 - RNA, 22 nt, Brucella suis 1330
aucgaagcgggaucagaaauca

SEQ ID NO: 448133 - RNA, 18 nt, Brucella suis 1330
aucgaauagggcauggau

SEQ ID NO: 448134 - RNA, 23 nt, Brucella suis 1330
auccuugucggcaucggucuugc

SEQ ID NO: 448135 - RNA, 23 nt, Brucella suis 1330
auccuuguucuuggcgacggcca

SEQ ID NO: 448136 - RNA, 15 nt, Brucella suis 1330
auccuguucaagcag

SEQ ID NO: 448137 - RNA, 14 nt, Brucella suis 1330
auccuguagacgaa

SEQ ID NO: 448138 - RNA, 23 nt, Brucella suis 1330
auccugcugcgcggcauugguga

SEQ ID NO: 448139 - RNA, 16 nt, Brucella suis 1330
auccugcgcccuguca

SEQ ID NO: 448140 - RNA, 13 nt, Brucella suis 1330
auccuccugcgcc

SEQ ID NO: 448141 - RNA, 22 nt, Brucella suis 1330
auccucggcccuggaaagaagc

SEQ ID NO: 448142 - RNA, 23 nt, Brucella suis 1330
auccucucacuccgaccauuucc

SEQ ID NO: 448143 - RNA, 15 nt, Brucella suis 1330
auccggcugggucau

SEQ ID NO: 448144 - RNA, 19 nt, Brucella suis 1330
auccgcuugcuucgggcau

SEQ ID NO: 448145 - RNA, 13 nt, Brucella suis 1330
auccgcuccagau

SEQ ID NO: 448146 - RNA, 13 nt, Brucella suis 1330
auccgcaucggcc

SEQ ID NO: 448147 - RNA, 21 nt, Brucella suis 1330
auccgcauucccuugaaauca

SEQ ID NO: 448148 - RNA, 15 nt, Brucella suis 1330
aucccuuacuccauu

SEQ ID NO: 448149 - RNA, 12 nt, Brucella suis 1330
auccgacgcauc

SEQ ID NO: 448150 - RNA, 13 nt, Brucella suis 1330
auccgaucggcgc

SEQ ID NO: 448151 - RNA, 19 nt, Brucella suis 1330
auccgcaauacgccuggcc

SEQ ID NO: 448152 - RNA, 16 nt, Brucella suis 1330
aucccgucaagacaag

SEQ ID NO: 448153 - RNA, 22 nt, Brucella suis 1330
aucccgccccuaaaggcucugc

SEQ ID NO: 448154 - RNA, 19 nt, Brucella suis 1330
auccauuccucaagauaca

SEQ ID NO: 448155 - RNA, 15 nt, Brucella suis 1330
auccaugagcagcgg

SEQ ID NO: 448156 - RNA, 20 nt, Brucella suis 1330
auccauagcgaauggcaauu

SEQ ID NO: 448157 - RNA, 23 nt, Brucella suis 1330
auccaguugucgccgggcugcuu

SEQ ID NO: 448158 - RNA, 16 nt, Brucella suis 1330
auccaggugcagucuu

SEQ ID NO: 448159 - RNA, 22 nt, Brucella suis 1330
auccagcggugacggcggcaga

SEQ ID NO: 448160 - RNA, 22 nt, Brucella suis 1330
auccagccggugaaaauacggc

SEQ ID NO: 448161 - RNA, 14 nt, Brucella suis 1330
auccaccgcgcuga

SEQ ID NO: 448162 - RNA, 13 nt, Brucella suis 1330
auccacgcccuga

SEQ ID NO: 448163 - RNA, 21 nt, Brucella suis 1330
aucauuggcguugagccgcgc

SEQ ID NO: 448164 - RNA, 14 nt, Brucella suis 1330
aucauuuauuuuag

SEQ ID NO: 448165 - RNA, 15 nt, Brucella suis 1330
aucaugucauggccg

SEQ ID NO: 448166 - RNA, 17 nt, Brucella suis 1330
aucaugucauggccgcc

SEQ ID NO: 448167 - RNA, 19 nt, Brucella suis 1330
aucagguugaugccgggca

SEQ ID NO: 448168 - RNA, 20 nt, Brucella suis 1330
aucaggucgagcgccugucc

SEQ ID NO: 448169 - RNA, 22 nt, Brucella suis 1330
aucagggccggagggcauugca

SEQ ID NO: 448170 - RNA, 14 nt, Brucella suis 1330
aucaggauuuggga

SEQ ID NO: 448171 - RNA, 16 nt, Brucella suis 1330
aucaauccuucaugcc

SEQ ID NO: 448172 - RNA, 14 nt, Brucella suis 1330
aucagucgaauuuc

SEQ ID NO: 448173 - RNA, 19 nt, Brucella suis 1330
aucaagaaugugccgcugc

SEQ ID NO: 448174 - RNA, 19 nt, Brucella suis 1330
auauuugccgccagaaaau

SEQ ID NO: 448175 - RNA, 15 nt, Brucella suis 1330
aucaaaagaaaccuu

SEQ ID NO: 448176 - RNA, 16 nt, Brucella suis 1330
aucaaaagaaaccuug

SEQ ID NO: 448177 - RNA, 17 nt, Brucella suis 1330
aucaaaagaaaccuugc

SEQ ID NO: 448178 - RNA, 18 nt, Brucella suis 1330
auauugagagauuucacc

SEQ ID NO: 448179 - RNA, 21 nt, Brucella suis 1330
auauugaaguauuagacgaau

SEQ ID NO: 448180 - RNA, 22 nt, Brucella suis 1330
auaugguccgcaccggcaugga

SEQ ID NO: 448181 - RNA, 17 nt, Brucella suis 1330
auauggucgcugcggcc

SEQ ID NO: 448182 - RNA, 20 nt, Brucella suis 1330
auaugccgacgcgcucggca

SEQ ID NO: 448183 - RNA, 13 nt, Brucella suis 1330
auauccucuguga

SEQ ID NO: 448184 - RNA, 18 nt, Brucella suis 1330
auauccucugugacugcg

SEQ ID NO: 448185 - RNA, 15 nt, Brucella suis 1330
auauccauaucuuuc

SEQ ID NO: 448186 - RNA, 16 nt, Brucella suis 1330
auagccuuggcccuuu

SEQ ID NO: 448187 - RNA, 15 nt, Brucella suis 1330
auagccuuucugcca

SEQ ID NO: 448188 - RNA, 17 nt, Brucella suis 1330
auagucgaaaaaagaau

SEQ ID NO: 448189 - RNA, 20 nt, Brucella suis 1330
auagucgaaaaaagaaugac

SEQ ID NO: 448190 - RNA, 15 nt, Brucella suis 1330
auagucggcaaccau

SEQ ID NO: 448191 - RNA, 18 nt, Brucella suis 1330
auagucggcaaccaucuu

SEQ ID NO: 448192 - RNA, 14 nt, Brucella suis 1330
auauaaagcaaagg

SEQ ID NO: 448193 - RNA, 19 nt, Brucella suis 1330
auagccgaucuggcugaga

SEQ ID NO: 448194 - RNA, 14 nt, Brucella suis 1330
auagauuguggcaa

SEQ ID NO: 448195 - RNA, 14 nt, Brucella suis 1330
auagcaacuuccuu

SEQ ID NO: 448196 - RNA, 12 nt, Brucella suis 1330
auagaccaugcc

SEQ ID NO: 448197 - RNA, 14 nt, Brucella suis 1330
auagaccaugccgc

SEQ ID NO: 448198 - RNA, 13 nt, Brucella suis 1330
auagacauauugc

SEQ ID NO: 448199 - RNA, 17 nt, Brucella suis 1330
auagacaucgaacgugg

SEQ ID NO: 448200 - RNA, 13 nt, Brucella suis 1330
auaccgacggucg

SEQ ID NO: 448201 - RNA, 16 nt, Brucella suis 1330
auaccgucgaggaaaa

SEQ ID NO: 448202 - RNA, 16 nt, Brucella suis 1330
auacccaugccuuuca

SEQ ID NO: 448203 - RNA, 18 nt, Brucella suis 1330
auacagcccaugacagca

SEQ ID NO: 448204 - RNA, 22 nt, Brucella suis 1330
auacaugaugaucgccagcacg

SEQ ID NO: 448205 - RNA, 23 nt, Brucella suis 1330
auacaugcuuucgacaaaggccc

SEQ ID NO: 448206 - RNA, 14 nt, Brucella suis 1330
auacaaaaaauccc

SEQ ID NO: 448207 - RNA, 16 nt, Brucella suis 1330
auaacgcuugcagagc

SEQ ID NO: 448208 - RNA, 13 nt, Brucella suis 1330
auaaugcauggag

SEQ ID NO: 448209 - RNA, 16 nt, Brucella suis 1330
aguuuuugcaggucug

SEQ ID NO: 448210 - RNA, 15 nt, Brucella suis 1330
aguuuucaaaccaaa

SEQ ID NO: 448211 - RNA, 20 nt, Brucella suis 1330
aguuuggcugugcugguaaa

SEQ ID NO: 448212 - RNA, 13 nt, Brucella suis 1330
aguuuccagccuu

SEQ ID NO: 448213 - RNA, 18 nt, Brucella suis 1330
aguugucaauacaccugc

SEQ ID NO: 448214 - RNA, 21 nt, Brucella suis 1330
aguugucgccgggcugcuucu

SEQ ID NO: 448215 - RNA, 14 nt, Brucella suis 1330
aguuuauucauugg

SEQ ID NO: 448216 - RNA, 17 nt, Brucella suis 1330
aguuccggcggaaagcg

SEQ ID NO: 448217 - RNA, 12 nt, Brucella suis 1330
aguucgcccguc

SEQ ID NO: 448218 - RNA, 23 nt, Brucella suis 1330
aguuauguuugguuuuagaagcu

SEQ ID NO: 448219 - RNA, 21 nt, Brucella suis 1330
aguggcgggguguacaacaac

SEQ ID NO: 448220 - RNA, 15 nt, Brucella suis 1330
aguggccuucagcac

SEQ ID NO: 448221 - RNA, 20 nt, Brucella suis 1330
auaaccugcgcgaauagcga

SEQ ID NO: 448222 - RNA, 19 nt, Brucella suis 1330
agugcuuccucguccuuga

SEQ ID NO: 448223 - RNA, 13 nt, Brucella suis 1330
agugccgcgccga

SEQ ID NO: 448224 - RNA, 13 nt, Brucella suis 1330
agugccaccagau

SEQ ID NO: 448225 - RNA, 13 nt, Brucella suis 1330
agugcaaucaggg

SEQ ID NO: 448226 - RNA, 21 nt, Brucella suis 1330
agugcaaagcggcuuuccagc

SEQ ID NO: 448227 - RNA, 13 nt, Brucella suis 1330
agugaagcgaaga

SEQ ID NO: 448228 - RNA, 12 nt, Brucella suis 1330
agucgaggaagc

SEQ ID NO: 448229 - RNA, 22 nt, Brucella suis 1330
aguccucggcaauccccggacc

SEQ ID NO: 448230 - RNA, 20 nt, Brucella suis 1330
agucccauuggucugucucc

SEQ ID NO: 448231 - RNA, 12 nt, Brucella suis 1330
agcuggcaucca

SEQ ID NO: 448232 - RNA, 16 nt, Brucella suis 1330
agcuggcauccagcac

SEQ ID NO: 448233 - RNA, 17 nt, Brucella suis 1330
agcuggcauccagcacu

SEQ ID NO: 448234 - RNA, 17 nt, Brucella suis 1330
aguacgguuauggcuca

SEQ ID NO: 448235 - RNA, 17 nt, Brucella suis 1330
agcucgccauccuugaa

SEQ ID NO: 448236 - RNA, 22 nt, Brucella suis 1330
agcucgccauccuugaacauca

SEQ ID NO: 448237 - RNA, 22 nt, Brucella suis 1330
agcucgauaagauugcggcuga

SEQ ID NO: 448238 - RNA, 12 nt, Brucella suis 1330
agcucgaaacau

SEQ ID NO: 448239 - RNA, 21 nt, Brucella suis 1330
agcucgaaacauucggggcuu

SEQ ID NO: 448240 - RNA, 12 nt, Brucella suis 1330
agcucgaaaucc

SEQ ID NO: 448241 - RNA, 14 nt, Brucella suis 1330
agcuccggguucuc

SEQ ID NO: 448242 - RNA, 18 nt, Brucella suis 1330
agcguuuugucauggccg

SEQ ID NO: 448243 - RNA, 20 nt, Brucella suis 1330
agcgugaugaugcuugccuc

SEQ ID NO: 448244 - RNA, 14 nt, Brucella suis 1330
agcgucuucugaga

SEQ ID NO: 448245 - RNA, 16 nt, Brucella suis 1330
agcgucuucugagaaa

SEQ ID NO: 448246 - RNA, 19 nt, Brucella suis 1330
agcgucagcgcaaagccug

SEQ ID NO: 448247 - RNA, 22 nt, Brucella suis 1330
agcgucagcgcaaagccugcua

SEQ ID NO: 448248 - RNA, 20 nt, Brucella suis 1330
agcguauugccguugagaau

SEQ ID NO: 448249 - RNA, 16 nt, Brucella suis 1330
agcguaaguucauaag

SEQ ID NO: 448250 - RNA, 20 nt, Brucella suis 1330
agcgguuccugauugaagac

SEQ ID NO: 448251 - RNA, 22 nt, Brucella suis 1330
agcgguuccuguuuuaacacaa

SEQ ID NO: 448252 - RNA, 14 nt, Brucella suis 1330
agcggcagcagcca

SEQ ID NO: 448253 - RNA, 13 nt, Brucella suis 1330
agcggcagaccug

SEQ ID NO: 448254 - RNA, 18 nt, Brucella suis 1330
agcggaucgugagguucu

SEQ ID NO: 448255 - RNA, 20 nt, Brucella suis 1330
agcggaucgugagguucuug

SEQ ID NO: 448256 - RNA, 23 nt, Brucella suis 1330
agcggaucauccuugaugcccag

SEQ ID NO: 448257 - RNA, 21 nt, Brucella suis 1330
agcggauaguucaaggcugcu

SEQ ID NO: 448258 - RNA, 17 nt, Brucella suis 1330
agcgcucagcuuuucca

SEQ ID NO: 448259 - RNA, 16 nt, Brucella suis 1330
agcgcguugccuugcu

SEQ ID NO: 448260 - RNA, 21 nt, Brucella suis 1330
agcgcgaacaugccugccgca

SEQ ID NO: 448261 - RNA, 21 nt, Brucella suis 1330
agcgccuuugcgggggaaugu

SEQ ID NO: 448262 - RNA, 19 nt, Brucella suis 1330
agcgccugcugccaugucu

SEQ ID NO: 448263 - RNA, 21 nt, Brucella suis 1330
agcgccuacgcggggaaauca

SEQ ID NO: 448264 - RNA, 22 nt, Brucella suis 1330
agcgccggggccaaaggcggcu

SEQ ID NO: 448265 - RNA, 18 nt, Brucella suis 1330
agcgccgcauaauccuca

SEQ ID NO: 448266 - RNA, 17 nt, Brucella suis 1330
agcgccagauaaagcag

SEQ ID NO: 448267 - RNA, 22 nt, Brucella suis 1330
agcgccagaucgauggugcgga

SEQ ID NO: 448268 - RNA, 20 nt, Brucella suis 1330
agcgcauuggcgaccgaaug

SEQ ID NO: 448269 - RNA, 12 nt, Brucella suis 1330
agcgcaucgcca

SEQ ID NO: 448270 - RNA, 13 nt, Brucella suis 1330
agcgcaucgccac

SEQ ID NO: 448271 - RNA, 19 nt, Brucella suis 1330
agcgcauccgccugcgcau

SEQ ID NO: 448272 - RNA, 18 nt, Brucella suis 1330
agcgcauaaaggccgaaa

SEQ ID NO: 448273 - RNA, 20 nt, Brucella suis 1330
agcgcagccugguagcgcac

SEQ ID NO: 448274 - RNA, 19 nt, Brucella suis 1330
agcgcacgcaggcaucaau

SEQ ID NO: 448275 - RNA, 21 nt, Brucella suis 1330
agcgcacauaaaacgcgccga

SEQ ID NO: 448276 - RNA, 13 nt, Brucella suis 1330
agcgcaaagcuuu

SEQ ID NO: 448277 - RNA, 17 nt, Brucella suis 1330
agcgauuccauuuuaac

SEQ ID NO: 448278 - RNA, 15 nt, Brucella suis 1330
agcgaucgucuugca

SEQ ID NO: 448279 - RNA, 19 nt, Brucella suis 1330
agcgaugccguggcgaaga

SEQ ID NO: 448280 - RNA, 17 nt, Brucella suis 1330
agcgagcuugcaaugag

SEQ ID NO: 448281 - RNA, 18 nt, Brucella suis 1330
agcgaggggaaacugcgg

SEQ ID NO: 448282 - RNA, 14 nt, Brucella suis 1330
agcgacuuccagug

SEQ ID NO: 448283 - RNA, 15 nt, Brucella suis 1330
agcgacuuccagugg

SEQ ID NO: 448284 - RNA, 21 nt, Brucella suis 1330
agcgacaggguaagcgccuuu

SEQ ID NO: 448285 - RNA, 17 nt, Brucella suis 1330
agcgacauauucuuccg

SEQ ID NO: 448286 - RNA, 23 nt, Brucella suis 1330
agcgaaggcugccgggguuuuuc

SEQ ID NO: 448287 - RNA, 18 nt, Brucella suis 1330
agccuugcccuggcucuu

SEQ ID NO: 448288 - RNA, 20 nt, Brucella suis 1330
agccuuucaaugucgccgga

SEQ ID NO: 448289 - RNA, 14 nt, Brucella suis 1330
agccuuucugccag

SEQ ID NO: 448290 - RNA, 22 nt, Brucella suis 1330
agccuuuuugacgcaaaagcuc

SEQ ID NO: 448291 - RNA, 23 nt, Brucella suis 1330
agccuuuuugacgcaaaagcucc

SEQ ID NO: 448292 - RNA, 16 nt, Brucella suis 1330
agccuucauugcggcc

SEQ ID NO: 448293 - RNA, 20 nt, Brucella suis 1330
agccuucccgggagaaaaga

SEQ ID NO: 448294 - RNA, 22 nt, Brucella suis 1330
agccugcaucauaggcccaggc

SEQ ID NO: 448295 - RNA, 17 nt, Brucella suis 1330
agccugcaccggcccaa

SEQ ID NO: 448296 - RNA, 12 nt, Brucella suis 1330
agccugaacagc

SEQ ID NO: 448297 - RNA, 15 nt, Brucella suis 1330
agccugaacagcguu

SEQ ID NO: 448298 - RNA, 16 nt, Brucella suis 1330
agccucccuucauuca

SEQ ID NO: 448299 - RNA, 16 nt, Brucella suis 1330
agccgugagcauggca

SEQ ID NO: 448300 - RNA, 16 nt, Brucella suis 1330
agccgucuauuugcac

SEQ ID NO: 448301 - RNA, 17 nt, Brucella suis 1330
agccggguuuuuuaugc

SEQ ID NO: 448302 - RNA, 19 nt, Brucella suis 1330
agccgguaauauugaagcc

SEQ ID NO: 448303 - RNA, 16 nt, Brucella suis 1330
agccgguauccagcag

SEQ ID NO: 448304 - RNA, 14 nt, Brucella suis 1330
agccggucugucau

SEQ ID NO: 448305 - RNA, 17 nt, Brucella suis 1330
agccggucugucauuug

SEQ ID NO: 448306 - RNA, 17 nt, Brucella suis 1330
agccggucgagccgaca

SEQ ID NO: 448307 - RNA, 17 nt, Brucella suis 1330
agccgggcuuuccugca

SEQ ID NO: 448308 - RNA, 21 nt, Brucella suis 1330
agccggcgauaccagacgcgc

SEQ ID NO: 448309 - RNA, 21 nt, Brucella suis 1330
agccggccacgaaaugggggc

SEQ ID NO: 448310 - RNA, 14 nt, Brucella suis 1330
agccggagcauucc

SEQ ID NO: 448311 - RNA, 18 nt, Brucella suis 1330
agccgcuucugcucacca

SEQ ID NO: 448312 - RNA, 18 nt, Brucella suis 1330
agccgcggcgcgaccugc

SEQ ID NO: 448313 - RNA, 22 nt, Brucella suis 1330
agccgcggcgcgaccugcucga

SEQ ID NO: 448314 - RNA, 18 nt, Brucella suis 1330
agccgcgccaugccaucc

SEQ ID NO: 448315 - RNA, 16 nt, Brucella suis 1330
agccgcgccaauccag

SEQ ID NO: 448316 - RNA, 21 nt, Brucella suis 1330
agccgcgaucacagccgcgcc

SEQ ID NO: 448317 - RNA, 19 nt, Brucella suis 1330
agccgccgccgcaaaggca

SEQ ID NO: 448318 - RNA, 16 nt, Brucella suis 1330
agccgcccgccuugga

SEQ ID NO: 448319 - RNA, 17 nt, Brucella suis 1330
agccgcccgccuuggaa

SEQ ID NO: 448320 - RNA, 22 nt, Brucella suis 1330
agccgccccgcugaggcggccg

SEQ ID NO: 448321 - RNA, 22 nt, Brucella suis 1330
agccgccauaccgucgaggaaa

SEQ ID NO: 448322 - RNA, 18 nt, Brucella suis 1330
agccgccagcaggccggc

SEQ ID NO: 448323 - RNA, 21 nt, Brucella suis 1330
agccgccaagccagcccguga

SEQ ID NO: 448324 - RNA, 14 nt, Brucella suis 1330
agccgaugccuuga

SEQ ID NO: 448325 - RNA, 16 nt, Brucella suis 1330
agccgaugcagaugcc

SEQ ID NO: 448326 - RNA, 22 nt, Brucella suis 1330
agccgaugcagaugccaugggc

SEQ ID NO: 448327 - RNA, 15 nt, Brucella suis 1330
agccgaucuggcuga

SEQ ID NO: 448328 - RNA, 11 nt, Brucella suis 1330
agccgagcugc

SEQ ID NO: 448329 - RNA, 21 nt, Brucella suis 1330
agccgagcgccagauaaagca

SEQ ID NO: 448330 - RNA, 21 nt, Brucella suis 1330
agccgaccuugggcgagaaug

SEQ ID NO: 448331 - RNA, 20 nt, Brucella suis 1330
agccgacauaggcgaucacc

SEQ ID NO: 448332 - RNA, 22 nt, Brucella suis 1330
agccgaaagcacguccuuggca

SEQ ID NO: 448333 - RNA, 16 nt, Brucella suis 1330
agcccuuccacugcaa

SEQ ID NO: 448334 - RNA, 22 nt, Brucella suis 1330
agcccggcuggaauuguuccag

SEQ ID NO: 448335 - RNA, 22 nt, Brucella suis 1330
agcccggaugaaccgggcccuu

SEQ ID NO: 448336 - RNA, 23 nt, Brucella suis 1330
agcccggaugaaccgggcccuuc

SEQ ID NO: 448337 - RNA, 14 nt, Brucella suis 1330
agcccggacaggcg

SEQ ID NO: 448338 - RNA, 19 nt, Brucella suis 1330
agcccgcugcgccgcacgc

SEQ ID NO: 448339 - RNA, 18 nt, Brucella suis 1330
agcccgccccaagaucag

SEQ ID NO: 448340 - RNA, 23 nt, Brucella suis 1330
agcccgccgaaagccucgaucac

SEQ ID NO: 448341 - RNA, 19 nt, Brucella suis 1330
agcccgccacgaggaagaa

SEQ ID NO: 448342 - RNA, 20 nt, Brucella suis 1330
agcccgccacgaggaagaaa

SEQ ID NO: 448343 - RNA, 22 nt, Brucella suis 1330
agccccuugccccggcaccgcg

SEQ ID NO: 448344 - RNA, 22 nt, Brucella suis 1330
agccccuuugcuucggccgaca

SEQ ID NO: 448345 - RNA, 18 nt, Brucella suis 1330
agccccccuggauaucca

SEQ ID NO: 448346 - RNA, 19 nt, Brucella suis 1330
agcccccagaugaagguaa

SEQ ID NO: 448347 - RNA, 12 nt, Brucella suis 1330
agccccagcacg

SEQ ID NO: 448348 - RNA, 12 nt, Brucella suis 1330
agccccagcccg

SEQ ID NO: 448349 - RNA, 21 nt, Brucella suis 1330
agcccaugacagcaaccgaaa

SEQ ID NO: 448350 - RNA, 15 nt, Brucella suis 1330
agcccagcgccuuca

SEQ ID NO: 448351 - RNA, 22 nt, Brucella suis 1330
agcccaccggacugauuucuga

SEQ ID NO: 448352 - RNA, 19 nt, Brucella suis 1330
agcccaagaaagaucagcc

SEQ ID NO: 448353 - RNA, 15 nt, Brucella suis 1330
agccaucuuucuuga

SEQ ID NO: 448354 - RNA, 21 nt, Brucella suis 1330
agccauccccauugcaucgcc

SEQ ID NO: 448355 - RNA, 17 nt, Brucella suis 1330
agccauacgacaauaau

SEQ ID NO: 448356 - RNA, 22 nt, Brucella suis 1330
agccagguggcugcccgccgca

SEQ ID NO: 448357 - RNA, 19 nt, Brucella suis 1330
agccagcgcauaaaggccg

SEQ ID NO: 448358 - RNA, 20 nt, Brucella suis 1330
agccagaucccguuuugaga

SEQ ID NO: 448359 - RNA, 22 nt, Brucella suis 1330
agcauuuucgagccaaaagugc

SEQ ID NO: 448360 - RNA, 12 nt, Brucella suis 1330
agccaaaagugc

SEQ ID NO: 448361 - RNA, 21 nt, Brucella suis 1330
agccaaaagugcgcagcaucu

SEQ ID NO: 448362 - RNA, 21 nt, Brucella suis 1330
agcauuccgggccgcacaaau

SEQ ID NO: 448363 - RNA, 22 nt, Brucella suis 1330
agcauucuuuccccaugaccgg

SEQ ID NO: 448364 - RNA, 15 nt, Brucella suis 1330
agcauugaaaggcag

SEQ ID NO: 448365 - RNA, 18 nt, Brucella suis 1330
agcauugaaaggcagcac

SEQ ID NO: 448366 - RNA, 22 nt, Brucella suis 1330
agcauugaacgccuuuuucacu

SEQ ID NO: 448367 - RNA, 23 nt, Brucella suis 1330
agcauugaacgccuuuuucacug

SEQ ID NO: 448368 - RNA, 16 nt, Brucella suis 1330
agcauuuccagcaaaa

SEQ ID NO: 448369 - RNA, 15 nt, Brucella suis 1330
agcauggcaaggcca

SEQ ID NO: 448370 - RNA, 23 nt, Brucella suis 1330
agcaugcgguucagguggaucgg

SEQ ID NO: 448371 - RNA, 22 nt, Brucella suis 1330
agcaugaugccgacgaaagcca

SEQ ID NO: 448372 - RNA, 21 nt, Brucella suis 1330
agcauccuauccccuggaugu

SEQ ID NO: 448373 - RNA, 16 nt, Brucella suis 1330
agcaucagcuugccca

SEQ ID NO: 448374 - RNA, 16 nt, Brucella suis 1330
agcauauguuccugcg

SEQ ID NO: 448375 - RNA, 14 nt, Brucella suis 1330
agcagucaaaaacg

SEQ ID NO: 448376 - RNA, 20 nt, Brucella suis 1330
agcaguaccgacaugccaag

SEQ ID NO: 448377 - RNA, 17 nt, Brucella suis 1330
agcaggcuuucggccug

SEQ ID NO: 448378 - RNA, 21 nt, Brucella suis 1330
agcaggcuuucggccugugcg

SEQ ID NO: 448379 - RNA, 21 nt, Brucella suis 1330
agcaggcucugaaacugaaaa

SEQ ID NO: 448380 - RNA, 15 nt, Brucella suis 1330
agcaggcgcgcagca

SEQ ID NO: 448381 - RNA, 13 nt, Brucella suis 1330
agcaggcguugca

SEQ ID NO: 448382 - RNA, 22 nt, Brucella suis 1330
agcaggccggcgagggcgggca

SEQ ID NO: 448383 - RNA, 18 nt, Brucella suis 1330
agcaggccgguaagcccu

SEQ ID NO: 448384 - RNA, 20 nt, Brucella suis 1330
agcaggccgguaagcccugu

SEQ ID NO: 448385 - RNA, 21 nt, Brucella suis 1330
agcaggccauucccgccucag

SEQ ID NO: 448386 - RNA, 16 nt, Brucella suis 1330
agcaggcaggccgccu

SEQ ID NO: 448387 - RNA, 13 nt, Brucella suis 1330
agcaggaagaagg

SEQ ID NO: 448388 - RNA, 12 nt, Brucella suis 1330
agcaggagauag

SEQ ID NO: 448389 - RNA, 14 nt, Brucella suis 1330
agcaggaucggcag

SEQ ID NO: 448390 - RNA, 14 nt, Brucella suis 1330
agcagcgcaaacuc

SEQ ID NO: 448391 - RNA, 15 nt, Brucella suis 1330
agcagcaucuugcca

SEQ ID NO: 448392 - RNA, 20 nt, Brucella suis 1330
agcagcaggggcagcgcgcg

SEQ ID NO: 448393 - RNA, 14 nt, Brucella suis 1330
agcacuuccagaua

SEQ ID NO: 448394 - RNA, 14 nt, Brucella suis 1330
agcacucugccagg

SEQ ID NO: 448395 - RNA, 18 nt, Brucella suis 1330
agcacuacgucaacagcc

SEQ ID NO: 448396 - RNA, 19 nt, Brucella suis 1330
agcacuacgucaacagccg

SEQ ID NO: 448397 - RNA, 17 nt, Brucella suis 1330
agcacgaguaucuggcg

SEQ ID NO: 448398 - RNA, 23 nt, Brucella suis 1330
agcacgaggauagcguaaaacgc

SEQ ID NO: 448399 - RNA, 21 nt, Brucella suis 1330
agcaccucgaaaacaucggaa

SEQ ID NO: 448400 - RNA, 16 nt, Brucella suis 1330
agcaccggaagcgcaa

SEQ ID NO: 448401 - RNA, 14 nt, Brucella suis 1330
agcacccgcuuggg

SEQ ID NO: 448402 - RNA, 19 nt, Brucella suis 1330
agcacagccagaaagaaga

SEQ ID NO: 448403 - RNA, 18 nt, Brucella suis 1330
agcaauugcugggcuucc

SEQ ID NO: 448404 - RNA, 13 nt, Brucella suis 1330
agcacaaagaaca

SEQ ID NO: 448405 - RNA, 14 nt, Brucella suis 1330
agcacaagccaucc

SEQ ID NO: 448406 - RNA, 13 nt, Brucella suis 1330
agcaaggcggccc

SEQ ID NO: 448407 - RNA, 19 nt, Brucella suis 1330
agcaagagcgucauugaac

SEQ ID NO: 448408 - RNA, 14 nt, Brucella suis 1330
agcaacuuccuugc

SEQ ID NO: 448409 - RNA, 19 nt, Brucella suis 1330
agcaacagggcgaaaagcc

SEQ ID NO: 448410 - RNA, 16 nt, Brucella suis 1330
agcaaagcgauuucac

SEQ ID NO: 448411 - RNA, 16 nt, Brucella suis 1330
agcaaauacaccaaug

SEQ ID NO: 448412 - RNA, 22 nt, Brucella suis 1330
agcaaaagccccgcccauugaa

SEQ ID NO: 448413 - RNA, 12 nt, Brucella suis 1330
agcaaaagugcg

SEQ ID NO: 448414 - RNA, 17 nt, Brucella suis 1330
agauuguaauccauggc

SEQ ID NO: 448415 - RNA, 15 nt, Brucella suis 1330
agagugcuuccucgu

SEQ ID NO: 448416 - RNA, 20 nt, Brucella suis 1330
agagggauuuucguugcuuc

SEQ ID NO: 448417 - RNA, 14 nt, Brucella suis 1330
agagccgcaggcac

SEQ ID NO: 448418 - RNA, 15 nt, Brucella suis 1330
agagacaguggcucu

SEQ ID NO: 448419 - RNA, 23 nt, Brucella suis 1330
agagaccuucgguacgcugcccu

SEQ ID NO: 448420 - RNA, 21 nt, Brucella suis 1330
agagaccuugaugauagaaua

SEQ ID NO: 448421 - RNA, 12 nt, Brucella suis 1330
agacuucagcca

SEQ ID NO: 448422 - RNA, 17 nt, Brucella suis 1330
agacgcgcagacgcagc

SEQ ID NO: 448423 - RNA, 23 nt, Brucella suis 1330
agacggacuucuucaccagccuu

SEQ ID NO: 448424 - RNA, 17 nt, Brucella suis 1330
agaccuucuggaagcgc

SEQ ID NO: 448425 - RNA, 16 nt, Brucella suis 1330
agaccgucaaaacgcc

SEQ ID NO: 448426 - RNA, 20 nt, Brucella suis 1330
agacaggauuugcccgguuu

SEQ ID NO: 448427 - RNA, 19 nt, Brucella suis 1330
agaaggcaagccccagcac

SEQ ID NO: 448428 - RNA, 18 nt, Brucella suis 1330
agaaggcgggaaggcaau

SEQ ID NO: 448429 - RNA, 21 nt, Brucella suis 1330
agaagguacuggcaauaaaag

SEQ ID NO: 448430 - RNA, 19 nt, Brucella suis 1330
agaagcgcgggguguugcu

SEQ ID NO: 448431 - RNA, 21 nt, Brucella suis 1330
agaagaccaaacagccccgca

SEQ ID NO: 448432 - RNA, 15 nt, Brucella suis 1330
agaagagccugccgu

SEQ ID NO: 448433 - RNA, 22 nt, Brucella suis 1330
agaagauagacaacgcgcagca

SEQ ID NO: 448434 - RNA, 13 nt, Brucella suis 1330
agaaguugggggc

SEQ ID NO: 448435 - RNA, 20 nt, Brucella suis 1330
agaaguuucagcgcauuggc

SEQ ID NO: 448436 - RNA, 15 nt, Brucella suis 1330
agaauauccggcuca

SEQ ID NO: 448437 - RNA, 22 nt, Brucella suis 1330
agaauaucuuccggcagaccgg

SEQ ID NO: 448438 - RNA, 19 nt, Brucella suis 1330
agaaugccguucuuggcca

SEQ ID NO: 448439 - RNA, 17 nt, Brucella suis 1330
agaaauagggccagaca

SEQ ID NO: 448440 - RNA, 12 nt, Brucella suis 1330
agaaaauauagc

SEQ ID NO: 448441 - RNA, 17 nt, Brucella suis 1330
acuuggaaauugacauu

SEQ ID NO: 448442 - RNA, 12 nt, Brucella suis 1330
acuugaagagcc

SEQ ID NO: 448443 - RNA, 19 nt, Brucella suis 1330
acuugaagagccgcaggca

SEQ ID NO: 448444 - RNA, 20 nt, Brucella suis 1330
acuugaucugcuccaucgca

SEQ ID NO: 448445 - RNA, 14 nt, Brucella suis 1330
acuucuucaccagc

SEQ ID NO: 448446 - RNA, 20 nt, Brucella suis 1330
acuucuuuguucugcagcaa

SEQ ID NO: 448447 - RNA, 19 nt, Brucella suis 1330
acuucgucgcugacuucaa

SEQ ID NO: 448448 - RNA, 22 nt, Brucella suis 1330
acuucgucgcugacuucaaaau

SEQ ID NO: 448449 - RNA, 14 nt, Brucella suis 1330
acuuccagauagau

SEQ ID NO: 448450 - RNA, 19 nt, Brucella suis 1330
acugugauuugauccaugc

SEQ ID NO: 448451 - RNA, 21 nt, Brucella suis 1330
acuucaucgcgccgcaacucu

SEQ ID NO: 448452 - RNA, 21 nt, Brucella suis 1330
acugaauccgcgacgccgccc

SEQ ID NO: 448453 - RNA, 13 nt, Brucella suis 1330
acucuuuccuguu

SEQ ID NO: 448454 - RNA, 12 nt, Brucella suis 1330
acucucacagcc

SEQ ID NO: 448455 - RNA, 20 nt, Brucella suis 1330
acguuccgugaaucugaggc

SEQ ID NO: 448456 - RNA, 22 nt, Brucella suis 1330
acguuccgcauccgaaaugcgc

SEQ ID NO: 448457 - RNA, 17 nt, Brucella suis 1330
acguggcuugaagcugc

SEQ ID NO: 448458 - RNA, 12 nt, Brucella suis 1330
acguccagccag

SEQ ID NO: 448459 - RNA, 13 nt, Brucella suis 1330
acguagggcgcga

SEQ ID NO: 448460 - RNA, 14 nt, Brucella suis 1330
acgggcagaacagu

SEQ ID NO: 448461 - RNA, 17 nt, Brucella suis 1330
acgggaaagggccgccu

SEQ ID NO: 448462 - RNA, 16 nt, Brucella suis 1330
acggcuucaacgccgu

SEQ ID NO: 448463 - RNA, 16 nt, Brucella suis 1330
acggcagccucgacac

SEQ ID NO: 448464 - RNA, 16 nt, Brucella suis 1330
acggcauaaaugcccu

SEQ ID NO: 448465 - RNA, 14 nt, Brucella suis 1330
acggcacguucggc

SEQ ID NO: 448466 - RNA, 23 nt, Brucella suis 1330
acgcuucuugcuguaaccgccac

SEQ ID NO: 448467 - RNA, 12 nt, Brucella suis 1330
acgcuugcguuc

SEQ ID NO: 448468 - RNA, 15 nt, Brucella suis 1330
acgcuuggcaccgcc

SEQ ID NO: 448469 - RNA, 22 nt, Brucella suis 1330
acgcuucaugauaaggccgcuu

SEQ ID NO: 448470 - RNA, 20 nt, Brucella suis 1330
acgcuccgcccuggcggcgu

SEQ ID NO: 448471 - RNA, 20 nt, Brucella suis 1330
acgcuccacacgaacagcag

SEQ ID NO: 448472 - RNA, 16 nt, Brucella suis 1330
acgcggcaggugccau

SEQ ID NO: 448473 - RNA, 15 nt, Brucella suis 1330
acgcgccuuuucuuc

SEQ ID NO: 448474 - RNA, 16 nt, Brucella suis 1330
acgcgccuuuucuuca

SEQ ID NO: 448475 - RNA, 20 nt, Brucella suis 1330
acgcgccgacaaaaaacacc

SEQ ID NO: 448476 - RNA, 22 nt, Brucella suis 1330
acgcgccgacaaaaaacaccgc

SEQ ID NO: 448477 - RNA, 14 nt, Brucella suis 1330
acgcgcagcagcau

SEQ ID NO: 448478 - RNA, 18 nt, Brucella suis 1330
acgcgcagacgcagcgca

SEQ ID NO: 448479 - RNA, 17 nt, Brucella suis 1330
acgcgcacguccggcac

SEQ ID NO: 448480 - RNA, 16 nt, Brucella suis 1330
acgccugauugaucgu

SEQ ID NO: 448481 - RNA, 22 nt, Brucella suis 1330
acgccugucacgaucuugccga

SEQ ID NO: 448482 - RNA, 14 nt, Brucella suis 1330
acgccggcaccgcc

SEQ ID NO: 448483 - RNA, 21 nt, Brucella suis 1330
acgcccuucaaaccauccucg

SEQ ID NO: 448484 - RNA, 18 nt, Brucella suis 1330
acgcccgaucagauagcc

SEQ ID NO: 448485 - RNA, 12 nt, Brucella suis 1330
acgcccgccccc

SEQ ID NO: 448486 - RNA, 22 nt, Brucella suis 1330
acgccagccgcgaucacagccg

SEQ ID NO: 448487 - RNA, 16 nt, Brucella suis 1330
acgcauagagccacga

SEQ ID NO: 448488 - RNA, 22 nt, Brucella suis 1330
acgcagcguguagccgcgaacc

SEQ ID NO: 448489 - RNA, 16 nt, Brucella suis 1330
acgcacggucuugccg

SEQ ID NO: 448490 - RNA, 20 nt, Brucella suis 1330
acgcacggucuugccggccu

SEQ ID NO: 448491 - RNA, 14 nt, Brucella suis 1330
acgcaccaagaccg

SEQ ID NO: 448492 - RNA, 22 nt, Brucella suis 1330
accgcucaccacauaggugcgc

SEQ ID NO: 448493 - RNA, 18 nt, Brucella suis 1330
accgcgccaaggcugcgc

SEQ ID NO: 448494 - RNA, 18 nt, Brucella suis 1330
accgauauagagcagcac

SEQ ID NO: 448495 - RNA, 19 nt, Brucella suis 1330
accgagggcagcuucgagc

SEQ ID NO: 448496 - RNA, 15 nt, Brucella suis 1330
accgagcagaaugcc

SEQ ID NO: 448497 - RNA, 23 nt, Brucella suis 1330
accgaacugaugcggauuuggac

SEQ ID NO: 448498 - RNA, 20 nt, Brucella suis 1330
accgaaugaaccggcucugc

SEQ ID NO: 448499 - RNA, 22 nt, Brucella suis 1330
accgaauugaucuugagcuuca

SEQ ID NO: 448500 - RNA, 15 nt, Brucella suis 1330
accgaaaauggcccu

SEQ ID NO: 448501 - RNA, 18 nt, Brucella suis 1330
acccuuuuccgcaccgcc

SEQ ID NO: 448502 - RNA, 19 nt, Brucella suis 1330
acccggcgcaaaggccggg

SEQ ID NO: 448503 - RNA, 17 nt, Brucella suis 1330
acccggccuuugcgccg

SEQ ID NO: 448504 - RNA, 13 nt, Brucella suis 1330
acccgcucccccc

SEQ ID NO: 448505 - RNA, 21 nt, Brucella suis 1330
acccggcaccgcaaagagaac

SEQ ID NO: 448506 - RNA, 21 nt, Brucella suis 1330
acccgauaaacccgcccccac

SEQ ID NO: 448507 - RNA, 23 nt, Brucella suis 1330
acccgaaacgguggccuuccuuc

SEQ ID NO: 448508 - RNA, 20 nt, Brucella suis 1330
acccgaccaguaaggcgggc

SEQ ID NO: 448509 - RNA, 15 nt, Brucella suis 1330
acccaucaaugcacc

SEQ ID NO: 448510 - RNA, 11 nt, Brucella suis 1330
acccauggccu

SEQ ID NO: 448511 - RNA, 19 nt, Brucella suis 1330
accauuuucgcacgcgcau

SEQ ID NO: 448512 - RNA, 14 nt, Brucella suis 1330
accaugcggcucca

SEQ ID NO: 448513 - RNA, 16 nt, Brucella suis 1330
accauggcgcauucag

SEQ ID NO: 448514 - RNA, 16 nt, Brucella suis 1330
accaucgagcauuuca

SEQ ID NO: 448515 - RNA, 15 nt, Brucella suis 1330
accaucugccgucag

SEQ ID NO: 448516 - RNA, 15 nt, Brucella suis 1330
accauauuugccgcc

SEQ ID NO: 448517 - RNA, 19 nt, Brucella suis 1330
accauauuugccgccagaa

SEQ ID NO: 448518 - RNA, 22 nt, Brucella suis 1330
accauauuugccgccagaaaau

SEQ ID NO: 448519 - RNA, 15 nt, Brucella suis 1330
accagcgugcagccu

SEQ ID NO: 448520 - RNA, 19 nt, Brucella suis 1330
accagccguuccagggcgc

SEQ ID NO: 448521 - RNA, 23 nt, Brucella suis 1330
accagccguuccagggcgcgcca

SEQ ID NO: 448522 - RNA, 19 nt, Brucella suis 1330
accagcccccagaugaagg

SEQ ID NO: 448523 - RNA, 20 nt, Brucella suis 1330
accagcccccagaugaaggu

SEQ ID NO: 448524 - RNA, 14 nt, Brucella suis 1330
accagcaggaagaa

SEQ ID NO: 448525 - RNA, 22 nt, Brucella suis 1330
accagauuggcaacaucaccau

SEQ ID NO: 448526 - RNA, 20 nt, Brucella suis 1330
accagcaacgcgcccgccac

SEQ ID NO: 448527 - RNA, 16 nt, Brucella suis 1330
accaccuuccugccuu

SEQ ID NO: 448528 - RNA, 23 nt, Brucella suis 1330
accaccuaaaccuuugaaauaau

SEQ ID NO: 448529 - RNA, 22 nt, Brucella suis 1330
acauugucugaaaacgaauuca

SEQ ID NO: 448530 - RNA, 14 nt, Brucella suis 1330
acauuuucgccggg

SEQ ID NO: 448531 - RNA, 23 nt, Brucella suis 1330
accaaaaggcgugaaccacagcc

SEQ ID NO: 448532 - RNA, 14 nt, Brucella suis 1330
accaaacagccccg

SEQ ID NO: 448533 - RNA, 14 nt, Brucella suis 1330
acauguuuuggaaa

SEQ ID NO: 448534 - RNA, 15 nt, Brucella suis 1330
acaugcgccagagca

SEQ ID NO: 448535 - RNA, 18 nt, Brucella suis 1330
acaugaaauaaggucgcu

SEQ ID NO: 448536 - RNA, 12 nt, Brucella suis 1330
acaucuucuucg

SEQ ID NO: 448537 - RNA, 22 nt, Brucella suis 1330
acaucgucggucgucauuuccg

SEQ ID NO: 448538 - RNA, 23 nt, Brucella suis 1330
acauucccgaagacgaucuuuuc

SEQ ID NO: 448539 - RNA, 17 nt, Brucella suis 1330
acauucuguaaggccug

SEQ ID NO: 448540 - RNA, 12 nt, Brucella suis 1330
acauccauaugc

SEQ ID NO: 448541 - RNA, 20 nt, Brucella suis 1330
acauccucggcccuggaaag

SEQ ID NO: 448542 - RNA, 22 nt, Brucella suis 1330
acauccucggcccuggaaagaa

SEQ ID NO: 448543 - RNA, 14 nt, Brucella suis 1330
acauagccugcaag

SEQ ID NO: 448544 - RNA, 23 nt, Brucella suis 1330
acauagacgcuuggcaccgccug

SEQ ID NO: 448545 - RNA, 11 nt, Brucella suis 1330
acauaaaacgc

SEQ ID NO: 448546 - RNA, 21 nt, Brucella suis 1330
acagcauauugccgagcaugg

SEQ ID NO: 448547 - RNA, 13 nt, Brucella suis 1330
acagacuggaaug

SEQ ID NO: 448548 - RNA, 14 nt, Brucella suis 1330
acacggcgcaggca

SEQ ID NO: 448549 - RNA, 15 nt, Brucella suis 1330
acacggcgcaggcag

SEQ ID NO: 448550 - RNA, 20 nt, Brucella suis 1330
acacgccgccgcgcggcagc

SEQ ID NO: 448551 - RNA, 15 nt, Brucella suis 1330
acagaaccaucggaa

SEQ ID NO: 448552 - RNA, 13 nt, Brucella suis 1330
acagaagcaccag

SEQ ID NO: 448553 - RNA, 13 nt, Brucella suis 1330
acacgaacagcag

SEQ ID NO: 448554 - RNA, 14 nt, Brucella suis 1330
acacgaacuugccc

SEQ ID NO: 448555 - RNA, 20 nt, Brucella suis 1330
acaccgaacugggcggccag

SEQ ID NO: 448556 - RNA, 15 nt, Brucella suis 1330
acaccgaccagcgca

SEQ ID NO: 448557 - RNA, 23 nt, Brucella suis 1330
acaccgaccggcacccacugccc

SEQ ID NO: 448558 - RNA, 16 nt, Brucella suis 1330
acaagcuucaggcucu

SEQ ID NO: 448559 - RNA, 20 nt, Brucella suis 1330
acaaguccuaaaacaccggc

SEQ ID NO: 448560 - RNA, 18 nt, Brucella suis 1330
acaaugaagcaaaggucg

SEQ ID NO: 448561 - RNA, 16 nt, Brucella suis 1330
acacagagacaggaaa

SEQ ID NO: 448562 - RNA, 13 nt, Brucella suis 1330
acacagccaagac

SEQ ID NO: 448563 - RNA, 16 nt, Brucella suis 1330
acaacgcugcguggga

SEQ ID NO: 448564 - RNA, 16 nt, Brucella suis 1330
acaagaacagccgccc

SEQ ID NO: 448565 - RNA, 18 nt, Brucella suis 1330
acaagagccgcucuggac

SEQ ID NO: 448566 - RNA, 14 nt, Brucella suis 1330
acaagaucgucacu

SEQ ID NO: 448567 - RNA, 21 nt, Brucella suis 1330
acaagaucgucacugcaaaaa

SEQ ID NO: 448568 - RNA, 16 nt, Brucella suis 1330
acaagcgugagcuuca

SEQ ID NO: 448569 - RNA, 15 nt, Brucella suis 1330
acaagcguguugccg

SEQ ID NO: 448570 - RNA, 16 nt, Brucella suis 1330
acaaagaaguuggggg

SEQ ID NO: 448571 - RNA, 16 nt, Brucella suis 1330
acaaaucagcuuggca

SEQ ID NO: 448572 - RNA, 16 nt, Brucella suis 1330
acaaaugcaaaugccg

SEQ ID NO: 448573 - RNA, 13 nt, Brucella suis 1330
aauuugauggugc

SEQ ID NO: 448574 - RNA, 20 nt, Brucella suis 1330
aauuugcgggcgaaccaauc

SEQ ID NO: 448575 - RNA, 16 nt, Brucella suis 1330
aaugugccgcugcacc

SEQ ID NO: 448576 - RNA, 19 nt, Brucella suis 1330
aaugugcgggcuucuucca

SEQ ID NO: 448577 - RNA, 17 nt, Brucella suis 1330
aauguugagggacggcu

SEQ ID NO: 448578 - RNA, 16 nt, Brucella suis 1330
aaugugaaggcgcugu

SEQ ID NO: 448579 - RNA, 16 nt, Brucella suis 1330
aauggcuuccagcagg

SEQ ID NO: 448580 - RNA, 18 nt, Brucella suis 1330
aaugggcugauuuaggcg

SEQ ID NO: 448581 - RNA, 21 nt, Brucella suis 1330
aauggucacggccacaugguc

SEQ ID NO: 448582 - RNA, 15 nt, Brucella suis 1330
aaugcuggccaccag

SEQ ID NO: 448583 - RNA, 14 nt, Brucella suis 1330
aauggcaagcagca

SEQ ID NO: 448584 - RNA, 18 nt, Brucella suis 1330
aauggcaagcagcaaaac

SEQ ID NO: 448585 - RNA, 16 nt, Brucella suis 1330
aauggcaaucuccauc

SEQ ID NO: 448586 - RNA, 18 nt, Brucella suis 1330
aauggcgggccauuucca

SEQ ID NO: 448587 - RNA, 19 nt, Brucella suis 1330
aauggcgggccauuuccaa

SEQ ID NO: 448588 - RNA, 18 nt, Brucella suis 1330
aaucguggucgccucuuc

SEQ ID NO: 448589 - RNA, 15 nt, Brucella suis 1330
aaucguguccacaug

SEQ ID NO: 448590 - RNA, 16 nt, Brucella suis 1330
aaucgagggguuuuuc

SEQ ID NO: 448591 - RNA, 13 nt, Brucella suis 1330
aaucucacacugc

SEQ ID NO: 448592 - RNA, 14 nt, Brucella suis 1330
aaucuccccuuccu

SEQ ID NO: 448593 - RNA, 13 nt, Brucella suis 1330
aaucuccggccca

SEQ ID NO: 448594 - RNA, 20 nt, Brucella suis 1330
aaucugcgcugcccucuuga

SEQ ID NO: 448595 - RNA, 20 nt, Brucella suis 1330
aaucuucucgaacugguuca

SEQ ID NO: 448596 - RNA, 14 nt, Brucella suis 1330
aaugaaccggcucu

SEQ ID NO: 448597 - RNA, 19 nt, Brucella suis 1330
aaugauagcuggaaaaaau

SEQ ID NO: 448598 - RNA, 19 nt, Brucella suis 1330
aaugauguucggcaaggcc

SEQ ID NO: 448599 - RNA, 19 nt, Brucella suis 1330
aaugcaagggcuggcucua

SEQ ID NO: 448600 - RNA, 16 nt, Brucella suis 1330
aauacaccugcaucgg

SEQ ID NO: 448601 - RNA, 15 nt, Brucella suis 1330
aauagucaguuccug

SEQ ID NO: 448602 - RNA, 12 nt, Brucella suis 1330
aauagucgaaaa

SEQ ID NO: 448603 - RNA, 14 nt, Brucella suis 1330
aauagucgaaaaaa

SEQ ID NO: 448604 - RNA, 18 nt, Brucella suis 1330
aauagucgaaaaaagaau

SEQ ID NO: 448605 - RNA, 23 nt, Brucella suis 1330
aauaucggauucuuaugccagau

SEQ ID NO: 448606 - RNA, 12 nt, Brucella suis 1330
aauaucuugaag

SEQ ID NO: 448607 - RNA, 19 nt, Brucella suis 1330
aauaucuuuuuucaaagag

SEQ ID NO: 448608 - RNA, 21 nt, Brucella suis 1330
aauauucagcgaaccugaucc

SEQ ID NO: 448609 - RNA, 13 nt, Brucella suis 1330
aaucaaaaacaau

SEQ ID NO: 448610 - RNA, 15 nt, Brucella suis 1330
aaucaccagagacag

SEQ ID NO: 448611 - RNA, 15 nt, Brucella suis 1330
aaucagaucgaaacc

SEQ ID NO: 448612 - RNA, 14 nt, Brucella suis 1330
aaucagcagaagga

SEQ ID NO: 448613 - RNA, 19 nt, Brucella suis 1330
aaucagcggauagagaaca

SEQ ID NO: 448614 - RNA, 15 nt, Brucella suis 1330
aaucagcgucagcgc

SEQ ID NO: 448615 - RNA, 16 nt, Brucella suis 1330
aaucaguccacuggac

SEQ ID NO: 448616 - RNA, 15 nt, Brucella suis 1330
aagugcauaaucggc

SEQ ID NO: 448617 - RNA, 18 nt, Brucella suis 1330
aagugaaaccagcguggc

SEQ ID NO: 448618 - RNA, 16 nt, Brucella suis 1330
aaguuuggcuaaagau

SEQ ID NO: 448619 - RNA, 18 nt, Brucella suis 1330
aaggugaaggccugcuuc

SEQ ID NO: 448620 - RNA, 20 nt, Brucella suis 1330
aaggugaaggccugcuucac

SEQ ID NO: 448621 - RNA, 18 nt, Brucella suis 1330
aaggcgcuguagucuguu

SEQ ID NO: 448622 - RNA, 22 nt, Brucella suis 1330
aaggcucugcgccagccuugcg

SEQ ID NO: 448623 - RNA, 18 nt, Brucella suis 1330
aaggcgcagauagccuuu

SEQ ID NO: 448624 - RNA, 15 nt, Brucella suis 1330
aaggcgaucagguug

SEQ ID NO: 448625 - RNA, 17 nt, Brucella suis 1330
aaggcgaucagguugau

SEQ ID NO: 448626 - RNA, 14 nt, Brucella suis 1330
aaggcgaagccgaa

SEQ ID NO: 448627 - RNA, 22 nt, Brucella suis 1330
aaggccucaucgaucacggcgc

SEQ ID NO: 448628 - RNA, 18 nt, Brucella suis 1330
aaggccgcgcuccagauc

SEQ ID NO: 448629 - RNA, 21 nt, Brucella suis 1330
aaggccgauggcgaucacgaa

SEQ ID NO: 448630 - RNA, 22 nt, Brucella suis 1330
aaggauuuccugucccuucuug

SEQ ID NO: 448631 - RNA, 17 nt, Brucella suis 1330
aaggcaagccccagcac

SEQ ID NO: 448632 - RNA, 23 nt, Brucella suis 1330
aagcuuuuuauuaaauggcuucc

SEQ ID NO: 448633 - RNA, 16 nt, Brucella suis 1330
aaggaaugggcgggga

SEQ ID NO: 448634 - RNA, 13 nt, Brucella suis 1330
aagcugucguucc

SEQ ID NO: 448635 - RNA, 19 nt, Brucella suis 1330
aagcgucauaggcagcgau

SEQ ID NO: 448636 - RNA, 16 nt, Brucella suis 1330
aagcggauuugaggau

SEQ ID NO: 448637 - RNA, 18 nt, Brucella suis 1330
aagcggccuaccauaucc

SEQ ID NO: 448638 - RNA, 16 nt, Brucella suis 1330
aagccacgcuccacac

SEQ ID NO: 448639 - RNA, 14 nt, Brucella suis 1330
aagccaaagcccgu

SEQ ID NO: 448640 - RNA, 16 nt, Brucella suis 1330
aagccaaagcccguga

SEQ ID NO: 448641 - RNA, 18 nt, Brucella suis 1330
aagcgugagaccagcgca

SEQ ID NO: 448642 - RNA, 15 nt, Brucella suis 1330
aagcgugagcuucag

SEQ ID NO: 448643 - RNA, 23 nt, Brucella suis 1330
aagcuccagcgugcgauugaugu

SEQ ID NO: 448644 - RNA, 23 nt, Brucella suis 1330
aagcagggcauggguggccgcca

SEQ ID NO: 448645 - RNA, 24 nt, Brucella suis 1330
aagcaguuccugcgcgaacacgau

SEQ ID NO: 448646 - RNA, 18 nt, Brucella suis 1330
aagcauaucuuccagagc

SEQ ID NO: 448647 - RNA, 15 nt, Brucella suis 1330
aagcaucagcuugcc

SEQ ID NO: 448648 - RNA, 14 nt, Brucella suis 1330
aagcacccgcuugg

SEQ ID NO: 448649 - RNA, 16 nt, Brucella suis 1330
aagcacagccagaaag

SEQ ID NO: 448650 - RNA, 17 nt, Brucella suis 1330
aagcacagccagaaaga

SEQ ID NO: 448651 - RNA, 20 nt, Brucella suis 1330
aagcacagccagaaagaaga

SEQ ID NO: 448652 - RNA, 14 nt, Brucella suis 1330
aagcacaaagaaca

SEQ ID NO: 448653 - RNA, 17 nt, Brucella suis 1330
aagcaccagcgcgccga

SEQ ID NO: 448654 - RNA, 14 nt, Brucella suis 1330
aagcaaagagcggu

SEQ ID NO: 448655 - RNA, 22 nt, Brucella suis 1330
aagcaaaggccccggaacauau

SEQ ID NO: 448656 - RNA, 22 nt, Brucella suis 1330
aagcaaaggucgggugccagau

SEQ ID NO: 448657 - RNA, 13 nt, Brucella suis 1330
aagcaacagggcg

SEQ ID NO: 448658 - RNA, 17 nt, Brucella suis 1330
aagaugagcgacaggaa

SEQ ID NO: 448659 - RNA, 16 nt, Brucella suis 1330
aagaugcgccgggcaa

SEQ ID NO: 448660 - RNA, 19 nt, Brucella suis 1330
aagauggagcggcugaugc

SEQ ID NO: 448661 - RNA, 22 nt, Brucella suis 1330
aagauugccgugguaugccagc

SEQ ID NO: 448662 - RNA, 17 nt, Brucella suis 1330
aagaucgacaaagccug

SEQ ID NO: 448663 - RNA, 14 nt, Brucella suis 1330
aagaucagccagcc

SEQ ID NO: 448664 - RNA, 21 nt, Brucella suis 1330
aagaucgucacugcaaaaaau

SEQ ID NO: 448665 - RNA, 22 nt, Brucella suis 1330
aagagcuugcccucgccuucca

SEQ ID NO: 448666 - RNA, 18 nt, Brucella suis 1330
aagagccccaggaacggc

SEQ ID NO: 448667 - RNA, 16 nt, Brucella suis 1330
aagagccgcucuggac

SEQ ID NO: 448668 - RNA, 19 nt, Brucella suis 1330
aagagccgcugaaccacug

SEQ ID NO: 448669 - RNA, 20 nt, Brucella suis 1330
aagagcggcguugaugucgu

SEQ ID NO: 448670 - RNA, 21 nt, Brucella suis 1330
aagagagugaugcagauaaaa

SEQ ID NO: 448671 - RNA, 15 nt, Brucella suis 1330
aagacgaucuuuucc

SEQ ID NO: 448672 - RNA, 14 nt, Brucella suis 1330
aagacgcgcaacac

SEQ ID NO: 448673 - RNA, 22 nt, Brucella suis 1330
aagacauugccaaggagcgcga

SEQ ID NO: 448674 - RNA, 16 nt, Brucella suis 1330
aagaccagcaggaaga

SEQ ID NO: 448675 - RNA, 22 nt, Brucella suis 1330
aagaccagcaggaagaaggcga

SEQ ID NO: 448676 - RNA, 13 nt, Brucella suis 1330
aagacaaagcccg

SEQ ID NO: 448677 - RNA, 20 nt, Brucella suis 1330
aagaauggcaagcagcaaaa

SEQ ID NO: 448678 - RNA, 17 nt, Brucella suis 1330
aaauucauugaaauauu

SEQ ID NO: 448679 - RNA, 19 nt, Brucella suis 1330
uuuugcguuggaaaaugcg

SEQ ID NO: 448680 - RNA, 14 nt, Brucella suis 1330
uuuugaaucuguga

SEQ ID NO: 448681 - RNA, 15 nt, Brucella suis 1330
uuuugacgcaaaagc

SEQ ID NO: 448682 - RNA, 13 nt, Brucella suis 1330
uuuucugcacagc

SEQ ID NO: 448683 - RNA, 13 nt, Brucella suis 1330
uuuucugcaucau

SEQ ID NO: 448684 - RNA, 14 nt, Brucella suis 1330
uuuucuauugaaca

SEQ ID NO: 448685 - RNA, 21 nt, Brucella suis 1330
uuuuguuucaagcucccaagc

SEQ ID NO: 448686 - RNA, 13 nt, Brucella suis 1330
uuuuuauccuccc

SEQ ID NO: 448687 - RNA, 12 nt, Brucella suis 1330
uuuuuccagacc

SEQ ID NO: 448688 - RNA, 19 nt, Brucella suis 1330
uuuuuccgcugcgaucugc

SEQ ID NO: 448689 - RNA, 14 nt, Brucella suis 1330
uuuucggauaagau

SEQ ID NO: 448690 - RNA, 22 nt, Brucella suis 1330
uuuucggcacgucauaaacuga

SEQ ID NO: 448691 - RNA, 19 nt, Brucella suis 1330
uuuucgggauuuuucuuug

SEQ ID NO: 448692 - RNA, 16 nt, Brucella suis 1330
uuuucgagccaaaagu

SEQ ID NO: 448693 - RNA, 14 nt, Brucella suis 1330
uuuucauucugaau

SEQ ID NO: 448694 - RNA, 23 nt, Brucella suis 1330
uuuuagcccgguugcgccaaaac

SEQ ID NO: 448695 - RNA, 22 nt, Brucella suis 1330
uuuggcuaaagauaccagauca

SEQ ID NO: 448696 - RNA, 14 nt, Brucella suis 1330
uuugcugccugcgg

SEQ ID NO: 448697 - RNA, 16 nt, Brucella suis 1330
uuuguauuucaaugcu

SEQ ID NO: 448698 - RNA, 21 nt, Brucella suis 1330
uuugcggggccugaaugcaau

SEQ ID NO: 448699 - RNA, 15 nt, Brucella suis 1330
uuugcggggcuucca

SEQ ID NO: 448700 - RNA, 24 nt, Brucella suis 1330
uuugcgggggaaugugcuuaguug

SEQ ID NO: 448701 - RNA, 14 nt, Brucella suis 1330
uuugcgcaccagau

SEQ ID NO: 448702 - RNA, 13 nt, Brucella suis 1330
uuugccgccagaa

SEQ ID NO: 448703 - RNA, 22 nt, Brucella suis 1330
uuugccguugcgaugagccuca

SEQ ID NO: 448704 - RNA, 21 nt, Brucella suis 1330
uuugcagggcuugcuugccau

SEQ ID NO: 448705 - RNA, 21 nt, Brucella suis 1330
uuugaucucggagcggccgga

SEQ ID NO: 448706 - RNA, 16 nt, Brucella suis 1330
uuugaucugauugaau

SEQ ID NO: 448707 - RNA, 20 nt, Brucella suis 1330
uuugaucugauugaaucaga

SEQ ID NO: 448708 - RNA, 18 nt, Brucella suis 1330
uuugcagcaauuccugcg

SEQ ID NO: 448709 - RNA, 20 nt, Brucella suis 1330
uuucuuuguccagaaagagc

SEQ ID NO: 448710 - RNA, 22 nt, Brucella suis 1330
uuugaaucccggcuguuacaua

SEQ ID NO: 448711 - RNA, 22 nt, Brucella suis 1330
uuucgggagggaugcucuuucu

SEQ ID NO: 448712 - RNA, 23 nt, Brucella suis 1330
uuucgguccacacuuccgcucau

SEQ ID NO: 448713 - RNA, 20 nt, Brucella suis 1330
uuucggcaaggaugcugcca

SEQ ID NO: 448714 - RNA, 21 nt, Brucella suis 1330
uuucggcaaggaugcugccag

SEQ ID NO: 448715 - RNA, 17 nt, Brucella suis 1330
uuucuaugcucaaaugc

SEQ ID NO: 448716 - RNA, 17 nt, Brucella suis 1330
uuucgccgcgcacuggc

SEQ ID NO: 448717 - RNA, 17 nt, Brucella suis 1330
uuuccgguagcgaaugc

SEQ ID NO: 448718 - RNA, 14 nt, Brucella suis 1330
uuuccggccuggcg

SEQ ID NO: 448719 - RNA, 13 nt, Brucella suis 1330
uuuccggcaaaaa

SEQ ID NO: 448720 - RNA, 21 nt, Brucella suis 1330
uuuccggcugccuuggcauca

SEQ ID NO: 448721 - RNA, 21 nt, Brucella suis 1330
uuuccgaaaaccguuucacac

SEQ ID NO: 448722 - RNA, 22 nt, Brucella suis 1330
uuucccgguuuuuccaaaagcu

SEQ ID NO: 448723 - RNA, 22 nt, Brucella suis 1330
uuuccaugaaauacuuguaagg

SEQ ID NO: 448724 - RNA, 20 nt, Brucella suis 1330
uuuccaucgucauugcgauc

SEQ ID NO: 448725 - RNA, 15 nt, Brucella suis 1330
uuuccagugcaaagc

SEQ ID NO: 448726 - RNA, 15 nt, Brucella suis 1330
uuuccaguuccauug

SEQ ID NO: 448727 - RNA, 14 nt, Brucella suis 1330
uuuccauuccagcc

SEQ ID NO: 448728 - RNA, 15 nt, Brucella suis 1330
uuuccaaugcacugg

SEQ ID NO: 448729 - RNA, 13 nt, Brucella suis 1330
uuuccaaugugcc

SEQ ID NO: 448730 - RNA, 17 nt, Brucella suis 1330
uuucauugucgaaaauc

SEQ ID NO: 448731 - RNA, 12 nt, Brucella suis 1330
uuucauuaaagc

SEQ ID NO: 448732 - RNA, 19 nt, Brucella suis 1330
uuucagaaagaaagcuguc

SEQ ID NO: 448733 - RNA, 13 nt, Brucella suis 1330
uuucauagauucc

SEQ ID NO: 448734 - RNA, 19 nt, Brucella suis 1330
uuuauucaggauagauauu

SEQ ID NO: 448735 - RNA, 16 nt, Brucella suis 1330
uuucaaacaacgcugc

SEQ ID NO: 448736 - RNA, 20 nt, Brucella suis 1330
uuucaaagcgcguuucauug

SEQ ID NO: 448737 - RNA, 20 nt, Brucella suis 1330
uuucaccagaugcugaacaa

SEQ ID NO: 448738 - RNA, 23 nt, Brucella suis 1330
uuucaccagaugcugaacaagca

SEQ ID NO: 448739 - RNA, 20 nt, Brucella suis 1330
uuucacccgccagaugauca

SEQ ID NO: 448740 - RNA, 21 nt, Brucella suis 1330
uugcugaugagccgcuuguag

SEQ ID NO: 448741 - RNA, 16 nt, Brucella suis 1330
uugcugaugauuuccc

SEQ ID NO: 448742 - RNA, 23 nt, Brucella suis 1330
uuuaacagaaccaucggaaccgc

SEQ ID NO: 448743 - RNA, 12 nt, Brucella suis 1330
uugcugaaauag

SEQ ID NO: 448744 - RNA, 13 nt, Brucella suis 1330
uugcuaaaugcaa

SEQ ID NO: 448745 - RNA, 18 nt, Brucella suis 1330
uugcucaacgcuugaacc

SEQ ID NO: 448746 - RNA, 17 nt, Brucella suis 1330
uugccuuaaucccuuac

SEQ ID NO: 448747 - RNA, 20 nt, Brucella suis 1330
uugcgcaagugcugcaaagg

SEQ ID NO: 448748 - RNA, 15 nt, Brucella suis 1330
uugccggccugaaac

SEQ ID NO: 448749 - RNA, 14 nt, Brucella suis 1330
uugccgccuuucau

SEQ ID NO: 448750 - RNA, 17 nt, Brucella suis 1330
uugccgaccuugagccc

SEQ ID NO: 448751 - RNA, 16 nt, Brucella suis 1330
uugccgagaaugacca

SEQ ID NO: 448752 - RNA, 12 nt, Brucella suis 1330
uugcccagaaca

SEQ ID NO: 448753 - RNA, 21 nt, Brucella suis 1330
uugcccauaccgaucugauug

SEQ ID NO: 448754 - RNA, 20 nt, Brucella suis 1330
uugcaccgcgccggaaggcg

SEQ ID NO: 448755 - RNA, 18 nt, Brucella suis 1330
uugauuccgaucuguuca

SEQ ID NO: 448756 - RNA, 11 nt, Brucella suis 1330
uugaguuucau

SEQ ID NO: 448757 - RNA, 20 nt, Brucella suis 1330
uugaucaacccgucuucauu

SEQ ID NO: 448758 - RNA, 14 nt, Brucella suis 1330
uugaugaaaaaccc

SEQ ID NO: 448759 - RNA, 14 nt, Brucella suis 1330
uugacauuugaagc

SEQ ID NO: 448760 - RNA, 16 nt, Brucella suis 1330
uugaagccgauccgca

SEQ ID NO: 448761 - RNA, 22 nt, Brucella suis 1330
uugaaucccggcuguuacauau

SEQ ID NO: 448762 - RNA, 10 nt, Brucella suis 1330
uugaaauaau

SEQ ID NO: 448763 - RNA, 12 nt, Brucella suis 1330
uucugcaucaug

SEQ ID NO: 448764 - RNA, 23 nt, Brucella suis 1330
uucugcaucaugucauggccgcc

SEQ ID NO: 448765 - RNA, 13 nt, Brucella suis 1330
uucugcccagaaa

SEQ ID NO: 448766 - RNA, 21 nt, Brucella suis 1330
uucugccggugccggcaggcu

SEQ ID NO: 448767 - RNA, 12 nt, Brucella suis 1330
uucucuugccgc

SEQ ID NO: 448768 - RNA, 14 nt, Brucella suis 1330
uucucgaaucccgg

SEQ ID NO: 448769 - RNA, 12 nt, Brucella suis 1330
uucucgcaaaac

SEQ ID NO: 448770 - RNA, 20 nt, Brucella suis 1330
uucucgaacagguugcgcca

SEQ ID NO: 448771 - RNA, 20 nt, Brucella suis 1330
uucuauugaacaccaaaaac

SEQ ID NO: 448772 - RNA, 19 nt, Brucella suis 1330
uucgccaaguucuuccgcc

SEQ ID NO: 448773 - RNA, 13 nt, Brucella suis 1330
uucgccgcgcacu

SEQ ID NO: 448774 - RNA, 19 nt, Brucella suis 1330
uucgccgcgcacuggcagc

SEQ ID NO: 448775 - RNA, 16 nt, Brucella suis 1330
uuccuugccgggaaga

SEQ ID NO: 448776 - RNA, 20 nt, Brucella suis 1330
uuccuuuucggcuuccuugc

SEQ ID NO: 448777 - RNA, 23 nt, Brucella suis 1330
uuccugcccggcaucacgaagag

SEQ ID NO: 448778 - RNA, 14 nt, Brucella suis 1330
uuccucguccuuga

SEQ ID NO: 448779 - RNA, 21 nt, Brucella suis 1330
uuccucauaaagcgcgcuguc

SEQ ID NO: 448780 - RNA, 21 nt, Brucella suis 1330
uuccuccagaucguccucgug

SEQ ID NO: 448781 - RNA, 22 nt, Brucella suis 1330
uuccgcaagccaguccuugccc

SEQ ID NO: 448782 - RNA, 22 nt, Brucella suis 1330
uuccaucgaauccucgaucuug

SEQ ID NO: 448783 - RNA, 14 nt, Brucella suis 1330
uuccaguuucugaa

SEQ ID NO: 448784 - RNA, 15 nt, Brucella suis 1330
uuccaguuucugaau

SEQ ID NO: 448785 - RNA, 15 nt, Brucella suis 1330
uuccagccggaaugc

SEQ ID NO: 448786 - RNA, 19 nt, Brucella suis 1330
uuccagcaggcucugaaac

SEQ ID NO: 448787 - RNA, 23 nt, Brucella suis 1330
uuccagcaaaagugugaaacggu

SEQ ID NO: 448788 - RNA, 16 nt, Brucella suis 1330
uuccagcaaagcgauu

SEQ ID NO: 448789 - RNA, 18 nt, Brucella suis 1330
uuccacaggcgccagccc

SEQ ID NO: 448790 - RNA, 13 nt, Brucella suis 1330
uucagggcaucga

SEQ ID NO: 448791 - RNA, 14 nt, Brucella suis 1330
uucagccagaaucu

SEQ ID NO: 448792 - RNA, 22 nt, Brucella suis 1330
uucagccuccugugcauugcca

SEQ ID NO: 448793 - RNA, 16 nt, Brucella suis 1330
uucagcacaagccauc

SEQ ID NO: 448794 - RNA, 19 nt, Brucella suis 1330
uucacauccuucacuucau

SEQ ID NO: 448795 - RNA, 17 nt, Brucella suis 1330
uucaccugagcaagagc

SEQ ID NO: 448796 - RNA, 19 nt, Brucella suis 1330
uucacauagccugcaagcg

SEQ ID NO: 448797 - RNA, 21 nt, Brucella suis 1330
uucaacgagaacaaacuuauc

SEQ ID NO: 448798 - RNA, 23 nt, Brucella suis 1330
uuauccgcggcgguuuugagcug

SEQ ID NO: 448799 - RNA, 18 nt, Brucella suis 1330
uuaugcuggcagcggcag

SEQ ID NO: 448800 - RNA, 18 nt, Brucella suis 1330
uuaugcuuuaaaagcaua

SEQ ID NO: 448801 - RNA, 22 nt, Brucella suis 1330
uuacugcccuauugccuuaauc

SEQ ID NO: 448802 - RNA, 13 nt, Brucella suis 1330
uuaccgcaaccca

SEQ ID NO: 448803 - RNA, 16 nt, Brucella suis 1330
uuacguuuucgucaaa

SEQ ID NO: 448804 - RNA, 17 nt, Brucella suis 1330
uuagagcaaucccguca

SEQ ID NO: 448805 - RNA, 21 nt, Brucella suis 1330
uuaguaucggcagccuugagc

SEQ ID NO: 448806 - RNA, 21 nt, Brucella suis 1330
uuacccaucacgggcuuugcc

SEQ ID NO: 448807 - RNA, 23 nt, Brucella suis 1330
ugugccgguuuauccgccgaacc

SEQ ID NO: 448808 - RNA, 17 nt, Brucella suis 1330
ugugcccuugagagcca

SEQ ID NO: 448809 - RNA, 18 nt, Brucella suis 1330
ugugccgcugcaccgggc

SEQ ID NO: 448810 - RNA, 14 nt, Brucella suis 1330
ugucgucgugcagc

SEQ ID NO: 448811 - RNA, 23 nt, Brucella suis 1330
ugucgcauuauccuacgcaaaac

SEQ ID NO: 448812 - RNA, 20 nt, Brucella suis 1330
ugucgaccggcggcaggcag

SEQ ID NO: 448813 - RNA, 13 nt, Brucella suis 1330
ugucgaaugucuu

SEQ ID NO: 448814 - RNA, 12 nt, Brucella suis 1330
uguccuccagcc

SEQ ID NO: 448815 - RNA, 20 nt, Brucella suis 1330
uguccuccagcccuucauca

SEQ ID NO: 448816 - RNA, 13 nt, Brucella suis 1330
uguccggccagcu

SEQ ID NO: 448817 - RNA, 13 nt, Brucella suis 1330
uguccgccugcca

SEQ ID NO: 448818 - RNA, 20 nt, Brucella suis 1330
ugucagcuuuccggcuucca

SEQ ID NO: 448819 - RNA, 13 nt, Brucella suis 1330
ugguuugaaaaug

SEQ ID NO: 448820 - RNA, 24 nt, Brucella suis 1330
ugguuugcagcaauuccugcgcca

SEQ ID NO: 448821 - RNA, 20 nt, Brucella suis 1330
uguaaggugaugucaguuca

SEQ ID NO: 448822 - RNA, 18 nt, Brucella suis 1330
uggugucauagaccauga

SEQ ID NO: 448823 - RNA, 21 nt, Brucella suis 1330
ugguguagaagacaaagcccg

SEQ ID NO: 448824 - RNA, 14 nt, Brucella suis 1330
uggugcucuaucca

SEQ ID NO: 448825 - RNA, 19 nt, Brucella suis 1330
uggugcgauccaccaucac

SEQ ID NO: 448826 - RNA, 16 nt, Brucella suis 1330
uggugccgcuggcucc

SEQ ID NO: 448827 - RNA, 17 nt, Brucella suis 1330
uggugagcuugcgcagc

SEQ ID NO: 448828 - RNA, 15 nt, Brucella suis 1330
uggucugcggcuucc

SEQ ID NO: 448829 - RNA, 19 nt, Brucella suis 1330
uggucguuugccucggagc

SEQ ID NO: 448830 - RNA, 14 nt, Brucella suis 1330
uggguaggauaaug

SEQ ID NO: 448831 - RNA, 18 nt, Brucella suis 1330
ugggccuuguuuucugcc

SEQ ID NO: 448832 - RNA, 12 nt, Brucella suis 1330
ugggccucaagc

SEQ ID NO: 448833 - RNA, 11 nt, Brucella suis 1330
ugggccugaug

SEQ ID NO: 448834 - RNA, 13 nt, Brucella suis 1330
ugggccugaugau

SEQ ID NO: 448835 - RNA, 18 nt, Brucella suis 1330
ugggccggucuucccgca

SEQ ID NO: 448836 - RNA, 17 nt, Brucella suis 1330
ugggcauugucguccag

SEQ ID NO: 448837 - RNA, 21 nt, Brucella suis 1330
ugggagcgcagugccuuugcc

SEQ ID NO: 448838 - RNA, 19 nt, Brucella suis 1330
ugggaagaucauaaaccga

SEQ ID NO: 448839 - RNA, 14 nt, Brucella suis 1330
uggcuguuucgcau

SEQ ID NO: 448840 - RNA, 15 nt, Brucella suis 1330
uggcugcccgcgccg

SEQ ID NO: 448841 - RNA, 22 nt, Brucella suis 1330
uggcucuuccggccguuauucc

SEQ ID NO: 448842 - RNA, 22 nt, Brucella suis 1330
uggcuaaaaaugggcugauuua

SEQ ID NO: 448843 - RNA, 19 nt, Brucella suis 1330
uggcguagaaauagggcca

SEQ ID NO: 448844 - RNA, 12 nt, Brucella suis 1330
uggcucaaaucc

SEQ ID NO: 448845 - RNA, 14 nt, Brucella suis 1330
uggcggccggcaac

SEQ ID NO: 448846 - RNA, 17 nt, Brucella suis 1330
uggcgcgaaaccggaac

SEQ ID NO: 448847 - RNA, 14 nt, Brucella suis 1330
uggcgacggccagc

SEQ ID NO: 448848 - RNA, 16 nt, Brucella suis 1330
uggcgacggccagcgc

SEQ ID NO: 448849 - RNA, 22 nt, Brucella suis 1330
uggcccugucagcgaaaccauc

SEQ ID NO: 448850 - RNA, 15 nt, Brucella suis 1330
uggcccgauaucggu

SEQ ID NO: 448851 - RNA, 21 nt, Brucella suis 1330
uggcccgauaucgguggccuu

SEQ ID NO: 448852 - RNA, 20 nt, Brucella suis 1330
uggccccauaaagcugguug

SEQ ID NO: 448853 - RNA, 14 nt, Brucella suis 1330
uggccccggagcgg

SEQ ID NO: 448854 - RNA, 18 nt, Brucella suis 1330
uggcccagcccuuuucag

SEQ ID NO: 448855 - RNA, 16 nt, Brucella suis 1330
uggcauugcccaugga

SEQ ID NO: 448856 - RNA, 16 nt, Brucella suis 1330
uggcaugggagcaccg

SEQ ID NO: 448857 - RNA, 19 nt, Brucella suis 1330
uggcaucgguuucagccgu

SEQ ID NO: 448858 - RNA, 20 nt, Brucella suis 1330
uggcaucagucgaauuucag

SEQ ID NO: 448859 - RNA, 17 nt, Brucella suis 1330
uggcaucaauccuucau

SEQ ID NO: 448860 - RNA, 12 nt, Brucella suis 1330
uggcauccacuc

SEQ ID NO: 448861 - RNA, 20 nt, Brucella suis 1330
uggcaagcgccaugaaagaa

SEQ ID NO: 448862 - RNA, 16 nt, Brucella suis 1330
uggcaagcccgcugcg

SEQ ID NO: 448863 - RNA, 17 nt, Brucella suis 1330
uggcaagugugcagaca

SEQ ID NO: 448864 - RNA, 15 nt, Brucella suis 1330
uggcaauaaaaggca

SEQ ID NO: 448865 - RNA, 16 nt, Brucella suis 1330
uggcaaaagccuccag

SEQ ID NO: 448866 - RNA, 17 nt, Brucella suis 1330
uggaugugcagcgugcc

SEQ ID NO: 448867 - RNA, 12 nt, Brucella suis 1330
uggaugccgcaa

SEQ ID NO: 448868 - RNA, 17 nt, Brucella suis 1330
uggagcguacaccgacc

SEQ ID NO: 448869 - RNA, 22 nt, Brucella suis 1330
uggaggcaacauugaguuucau

SEQ ID NO: 448870 - RNA, 15 nt, Brucella suis 1330
uggacugaaugcaga

SEQ ID NO: 448871 - RNA, 16 nt, Brucella suis 1330
uggaauuguuccagcc

SEQ ID NO: 448872 - RNA, 16 nt, Brucella suis 1330
uggaagugaauuucgg

SEQ ID NO: 448873 - RNA, 23 nt, Brucella suis 1330
uggaagcgcgcgcccgugacaag

SEQ ID NO: 448874 - RNA, 14 nt, Brucella suis 1330
uggaaggccaggcc

SEQ ID NO: 448875 - RNA, 23 nt, Brucella suis 1330
uggaagccgacagaagauagaca

SEQ ID NO: 448876 - RNA, 15 nt, Brucella suis 1330
uggaaccggcugucc

SEQ ID NO: 448877 - RNA, 15 nt, Brucella suis 1330
uggaacaauuccagc

SEQ ID NO: 448878 - RNA, 15 nt, Brucella suis 1330
uggaaaugcgcucga

SEQ ID NO: 448879 - RNA, 19 nt, Brucella suis 1330
uggaaauauucgggcggca

SEQ ID NO: 448880 - RNA, 23 nt, Brucella suis 1330
uggaaacgggaaagggccgccuu

SEQ ID NO: 448881 - RNA, 18 nt, Brucella suis 1330
uggaaaccaucaacggga

SEQ ID NO: 448882 - RNA, 17 nt, Brucella suis 1330
uggaaacgauuuucgcc

SEQ ID NO: 448883 - RNA, 21 nt, Brucella suis 1330
ugcuuucggcggcaguuucac

SEQ ID NO: 448884 - RNA, 15 nt, Brucella suis 1330
ugcuuugaugcguug

SEQ ID NO: 448885 - RNA, 16 nt, Brucella suis 1330
ugcuuuggugaagguu

SEQ ID NO: 448886 - RNA, 23 nt, Brucella suis 1330
ugcuuguguacccaaacguacau

SEQ ID NO: 448887 - RNA, 14 nt, Brucella suis 1330
ugcuugccucgucc

SEQ ID NO: 448888 - RNA, 13 nt, Brucella suis 1330
ugcuucaggcacu

SEQ ID NO: 448889 - RNA, 22 nt, Brucella suis 1330
ugcuucaggcacucuccucugc

SEQ ID NO: 448890 - RNA, 20 nt, Brucella suis 1330
ugcuuccuuuucggcuuccu

SEQ ID NO: 448891 - RNA, 20 nt, Brucella suis 1330
ugcuucgaucagauaagaug

SEQ ID NO: 448892 - RNA, 22 nt, Brucella suis 1330
ugcuucgcaccuuccacauugu

SEQ ID NO: 448893 - RNA, 13 nt, Brucella suis 1330
ugcuugaagcaag

SEQ ID NO: 448894 - RNA, 17 nt, Brucella suis 1330
ugcuggucguuugccuc

SEQ ID NO: 448895 - RNA, 15 nt, Brucella suis 1330
ugcuggugaaagacc

SEQ ID NO: 448896 - RNA, 17 nt, Brucella suis 1330
ugcugggcuuccucacg

SEQ ID NO: 448897 - RNA, 13 nt, Brucella suis 1330
ugcuggccugugc

SEQ ID NO: 448898 - RNA, 17 nt, Brucella suis 1330
ugcuggccaccagaaau

SEQ ID NO: 448899 - RNA, 19 nt, Brucella suis 1330
aaaugucacgcucgucgga

SEQ ID NO: 448900 - RNA, 20 nt, Brucella suis 1330
ugcugcaccguugccucugu

SEQ ID NO: 448901 - RNA, 18 nt, Brucella suis 1330
ugcugcaacaaaaugccc

SEQ ID NO: 448902 - RNA, 13 nt, Brucella suis 1330
ugcugcaauccac

SEQ ID NO: 448903 - RNA, 16 nt, Brucella suis 1330
ugcugcaauccacagg

SEQ ID NO: 448904 - RNA, 16 nt, Brucella suis 1330
ugcugaaaaggcuggc

SEQ ID NO: 448905 - RNA, 23 nt, Brucella suis 1330
ugcucgcgguugaggauuuccac

SEQ ID NO: 448906 - RNA, 13 nt, Brucella suis 1330
ugcuccuuccugc

SEQ ID NO: 448907 - RNA, 17 nt, Brucella suis 1330
ugcucauggcuuccugc

SEQ ID NO: 448908 - RNA, 21 nt, Brucella suis 1330
ugcucaucaucacauuggugc

SEQ ID NO: 448909 - RNA, 17 nt, Brucella suis 1330
ugcguuuuuggcaaaac

SEQ ID NO: 448910 - RNA, 20 nt, Brucella suis 1330
ugcuacaaaaaacaacagca

SEQ ID NO: 448911 - RNA, 23 nt, Brucella suis 1330
ugcuauggcacaagaacagccgc

SEQ ID NO: 448912 - RNA, 12 nt, Brucella suis 1330
ugcucaaaugcg

SEQ ID NO: 448913 - RNA, 12 nt, Brucella suis 1330
ugcguuggaaaa

SEQ ID NO: 448914 - RNA, 16 nt, Brucella suis 1330
ugcguuggaaaaugcg

SEQ ID NO: 448915 - RNA, 16 nt, Brucella suis 1330
ugcggugugaagcgga

SEQ ID NO: 448916 - RNA, 15 nt, Brucella suis 1330
ugcggucggccgcgc

SEQ ID NO: 448917 - RNA, 17 nt, Brucella suis 1330
ugcggucggccgcgcgg

SEQ ID NO: 448918 - RNA, 13 nt, Brucella suis 1330
ugcggucucgguu

SEQ ID NO: 448919 - RNA, 22 nt, Brucella suis 1330
ugcggucuuuaccuugaaaguc

SEQ ID NO: 448920 - RNA, 17 nt, Brucella suis 1330
ugcggugagaagaagga

SEQ ID NO: 448921 - RNA, 19 nt, Brucella suis 1330
ugcggucgagcgugaucuc

SEQ ID NO: 448922 - RNA, 20 nt, Brucella suis 1330
ugcggcggcgucagcuuguc

SEQ ID NO: 448923 - RNA, 15 nt, Brucella suis 1330
ugcggcggucggccu

SEQ ID NO: 448924 - RNA, 12 nt, Brucella suis 1330
ugcggcggcgcg

SEQ ID NO: 448925 - RNA, 19 nt, Brucella suis 1330
ugcggcgccuugaugccgc

SEQ ID NO: 448926 - RNA, 15 nt, Brucella suis 1330
ugcggcuugccacca

SEQ ID NO: 448927 - RNA, 19 nt, Brucella suis 1330
ugcggcuugccaccacgau

SEQ ID NO: 448928 - RNA, 15 nt, Brucella suis 1330
ugcgcuucgaggaac

SEQ ID NO: 448929 - RNA, 17 nt, Brucella suis 1330
ugcgcuucgcgcaggcc

SEQ ID NO: 448930 - RNA, 18 nt, Brucella suis 1330
ugcgcuucgcgcaggccg

SEQ ID NO: 448931 - RNA, 14 nt, Brucella suis 1330
ugcgccgcaggaac

SEQ ID NO: 448932 - RNA, 19 nt, Brucella suis 1330
ugcgccgauauagacgcca

SEQ ID NO: 448933 - RNA, 21 nt, Brucella suis 1330
ugcgccgaacagcgcccagag

SEQ ID NO: 448934 - RNA, 18 nt, Brucella suis 1330
ugcgccagccuugcgauu

SEQ ID NO: 448935 - RNA, 21 nt, Brucella suis 1330
ugcgccacgagaaccgcgccg

SEQ ID NO: 448936 - RNA, 15 nt, Brucella suis 1330
ugcgcacauauuugc

SEQ ID NO: 448937 - RNA, 16 nt, Brucella suis 1330
ugcgaugcgccagcga

SEQ ID NO: 448938 - RNA, 15 nt, Brucella suis 1330
ugcgcaagugcugca

SEQ ID NO: 448939 - RNA, 20 nt, Brucella suis 1330
ugcgagguccggggugaaug

SEQ ID NO: 448940 - RNA, 12 nt, Brucella suis 1330
ugcgauaaaaug

SEQ ID NO: 448941 - RNA, 16 nt, Brucella suis 1330
ugcgauccaccaucac

SEQ ID NO: 448942 - RNA, 19 nt, Brucella suis 1330
ugcgaauggcaaucuccau

SEQ ID NO: 448943 - RNA, 17 nt, Brucella suis 1330
ugcgaaacggagaaaac

SEQ ID NO: 448944 - RNA, 13 nt, Brucella suis 1330
ugcgaaccaucac

SEQ ID NO: 448945 - RNA, 20 nt, Brucella suis 1330
ugcgaaaaugauagcugcau

SEQ ID NO: 448946 - RNA, 18 nt, Brucella suis 1330
ugccuugggaggcgauuu

SEQ ID NO: 448947 - RNA, 16 nt, Brucella suis 1330
ugccuuuuacagcgua

SEQ ID NO: 448948 - RNA, 18 nt, Brucella suis 1330
ugccuuaaucccuuacuc

SEQ ID NO: 448949 - RNA, 15 nt, Brucella suis 1330
ugccuucaucggcaa

SEQ ID NO: 448950 - RNA, 17 nt, Brucella suis 1330
ugccuucuucauauccu

SEQ ID NO: 448951 - RNA, 14 nt, Brucella suis 1330
ugccugccgcgccg

SEQ ID NO: 448952 - RNA, 20 nt, Brucella suis 1330
ugccucgcgaacauucaggc

SEQ ID NO: 448953 - RNA, 17 nt, Brucella suis 1330
ugccucggagccuucau

SEQ ID NO: 448954 - RNA, 21 nt, Brucella suis 1330
ugccucggcaucggaacccca

SEQ ID NO: 448955 - RNA, 16 nt, Brucella suis 1330
ugccucugucagcuuu

SEQ ID NO: 448956 - RNA, 18 nt, Brucella suis 1330
ugccgucgaagcgcugca

SEQ ID NO: 448957 - RNA, 14 nt, Brucella suis 1330
ugccgguaucaagc

SEQ ID NO: 448958 - RNA, 14 nt, Brucella suis 1330
ugccgggguuuuuc

SEQ ID NO: 448959 - RNA, 22 nt, Brucella suis 1330
ugccggccgagaacuucggcac

SEQ ID NO: 448960 - RNA, 18 nt, Brucella suis 1330
ugccagaagguuucagcc

SEQ ID NO: 448961 - RNA, 17 nt, Brucella suis 1330
ugcauuggcgauuuucu

SEQ ID NO: 448962 - RNA, 19 nt, Brucella suis 1330
ugcauucucgcccaagguc

SEQ ID NO: 448963 - RNA, 15 nt, Brucella suis 1330
ugcaucauaggccca

SEQ ID NO: 448964 - RNA, 24 nt, Brucella suis 1330
ugcagucuucggccgggcaucgcu

SEQ ID NO: 448965 - RNA, 21 nt, Brucella suis 1330
ugcagcgugccguguagggca

SEQ ID NO: 448966 - RNA, 18 nt, Brucella suis 1330
ugcagcggcgcacucauc

SEQ ID NO: 448967 - RNA, 19 nt, Brucella suis 1330
ugcagcaauuccugcgcca

SEQ ID NO: 448968 - RNA, 21 nt, Brucella suis 1330
ugcagaugagcggcagcagcc

SEQ ID NO: 448969 - RNA, 23 nt, Brucella suis 1330
ugcagaugagcggcagcagccau

SEQ ID NO: 448970 - RNA, 15 nt, Brucella suis 1330
ugcagaugcaccauc

SEQ ID NO: 448971 - RNA, 17 nt, Brucella suis 1330
ugcagaugcaccaucau

SEQ ID NO: 448972 - RNA, 13 nt, Brucella suis 1330
ugcacuucuuuau

SEQ ID NO: 448973 - RNA, 18 nt, Brucella suis 1330
ugcacuucuuuauggcuc

SEQ ID NO: 448974 - RNA, 19 nt, Brucella suis 1330
ugcacuucuuuauggcuca

SEQ ID NO: 448975 - RNA, 23 nt, Brucella suis 1330
ugcacuugcgccaaucgccgcga

SEQ ID NO: 448976 - RNA, 14 nt, Brucella suis 1330
ugcacgucaucauc

SEQ ID NO: 448977 - RNA, 20 nt, Brucella suis 1330
ugcaccggcccaaaggccgc

SEQ ID NO: 448978 - RNA, 23 nt, Brucella suis 1330
ugcaccagcgucuguacauacau

SEQ ID NO: 448979 - RNA, 20 nt, Brucella suis 1330
ugcaccagagcauucccuuc

SEQ ID NO: 448980 - RNA, 21 nt, Brucella suis 1330
ugcacagccuggaugacaucg

SEQ ID NO: 448981 - RNA, 19 nt, Brucella suis 1330
ugcaauggucgacaaugaa

SEQ ID NO: 448982 - RNA, 21 nt, Brucella suis 1330
ugcaagugugcgcgcgccauc

SEQ ID NO: 448983 - RNA, 20 nt, Brucella suis 1330
ugcaagcgucuucugagaaa

SEQ ID NO: 448984 - RNA, 21 nt, Brucella suis 1330
ugcaagcgucuucugagaaaa

SEQ ID NO: 448985 - RNA, 15 nt, Brucella suis 1330
ugcaagggcuggcuc

SEQ ID NO: 448986 - RNA, 16 nt, Brucella suis 1330
ugcaagggcuggcucu

SEQ ID NO: 448987 - RNA, 16 nt, Brucella suis 1330
ugcaacgcgccaaacu

SEQ ID NO: 448988 - RNA, 16 nt, Brucella suis 1330
ugcaacaaaagaagau

SEQ ID NO: 448989 - RNA, 20 nt, Brucella suis 1330
ugcaacaaaugcaaaugccg

SEQ ID NO: 448990 - RNA, 13 nt, Brucella suis 1330
ugcaaaaccgguu

SEQ ID NO: 448991 - RNA, 19 nt, Brucella suis 1330
ugcaaagcggcuuuccagc

SEQ ID NO: 448992 - RNA, 15 nt, Brucella suis 1330
ugaugauaggcugcu

SEQ ID NO: 448993 - RNA, 21 nt, Brucella suis 1330
ugauugcaggucuuucugcuu

SEQ ID NO: 448994 - RNA, 22 nt, Brucella suis 1330
ugaucuggggcacgagaacggu

SEQ ID NO: 448995 - RNA, 20 nt, Brucella suis 1330
ugaucgccgcccuugugauc

SEQ ID NO: 448996 - RNA, 18 nt, Brucella suis 1330
ugaucgcccgcccggcau

SEQ ID NO: 448997 - RNA, 15 nt, Brucella suis 1330
ugauccgcuccagau

SEQ ID NO: 448998 - RNA, 13 nt, Brucella suis 1330
ugauaggcugcuu

SEQ ID NO: 448999 - RNA, 17 nt, Brucella suis 1330
ugauagggcaauuggcc

SEQ ID NO: 449000 - RNA, 22 nt, Brucella suis 1330
ugauaagggcgcuuuucccaau

SEQ ID NO: 449001 - RNA, 17 nt, Brucella suis 1330
ugaguuuuucuuccaga

SEQ ID NO: 449002 - RNA, 14 nt, Brucella suis 1330
ugagguccaccaca

SEQ ID NO: 449003 - RNA, 15 nt, Brucella suis 1330
ugagggccagaagau

SEQ ID NO: 449004 - RNA, 14 nt, Brucella suis 1330
ugaggggccaaagg

SEQ ID NO: 449005 - RNA, 14 nt, Brucella suis 1330
ugaggcucauaccg

SEQ ID NO: 449006 - RNA, 19 nt, Brucella suis 1330
ugagggaaacacucugccu

SEQ ID NO: 449007 - RNA, 15 nt, Brucella suis 1330
ugagcugcuggguga

SEQ ID NO: 449008 - RNA, 14 nt, Brucella suis 1330
ugagauauccauau

SEQ ID NO: 449009 - RNA, 15 nt, Brucella suis 1330
ugagaagaaggaaua

SEQ ID NO: 449010 - RNA, 13 nt, Brucella suis 1330
ugagaagcuugag

SEQ ID NO: 449011 - RNA, 24 nt, Brucella suis 1330
ugacguccggcuucgugcaaaccu

SEQ ID NO: 449012 - RNA, 21 nt, Brucella suis 1330
ugacgggaugauugcgccauc

SEQ ID NO: 449013 - RNA, 17 nt, Brucella suis 1330
ugacgccgggcauggaa

SEQ ID NO: 449014 - RNA, 16 nt, Brucella suis 1330
ugacgcgagcggacgg

SEQ ID NO: 449015 - RNA, 23 nt, Brucella suis 1330
ugacgcccauuucacccgccaga

SEQ ID NO: 449016 - RNA, 18 nt, Brucella suis 1330
ugacgauacagcccauga

SEQ ID NO: 449017 - RNA, 20 nt, Brucella suis 1330
ugacgccaucuucuuccagu

SEQ ID NO: 449018 - RNA, 15 nt, Brucella suis 1330
ugacgagcgcacgca

SEQ ID NO: 449019 - RNA, 15 nt, Brucella suis 1330
ugacgacugaaauaa

SEQ ID NO: 449020 - RNA, 16 nt, Brucella suis 1330
ugacgacugaaauaau

SEQ ID NO: 449021 - RNA, 18 nt, Brucella suis 1330
ugacgacugaaauaauag

SEQ ID NO: 449022 - RNA, 12 nt, Brucella suis 1330
ugacgaauucaa

SEQ ID NO: 449023 - RNA, 18 nt, Brucella suis 1330
ugaccagauagccauagc

SEQ ID NO: 449024 - RNA, 22 nt, Brucella suis 1330
ugaagcugucgccagcgccggu

SEQ ID NO: 449025 - RNA, 20 nt, Brucella suis 1330
ugaagacauggcgggccaug

SEQ ID NO: 449026 - RNA, 21 nt, Brucella suis 1330
ugaagaagauaaucagcagaa

SEQ ID NO: 449027 - RNA, 18 nt, Brucella suis 1330
ugaagaagcuucacaucc

SEQ ID NO: 449028 - RNA, 22 nt, Brucella suis 1330
ugaacaguuugagcaugaugcc

SEQ ID NO: 449029 - RNA, 18 nt, Brucella suis 1330
ugaaccccagacaugcga

SEQ ID NO: 449030 - RNA, 21 nt, Brucella suis 1330
ugaaagcgcaauugcacagcg

SEQ ID NO: 449031 - RNA, 17 nt, Brucella suis 1330
ugaaagcacaaagaaca

SEQ ID NO: 449032 - RNA, 16 nt, Brucella suis 1330
ugaaaucauugcgcac

SEQ ID NO: 449033 - RNA, 16 nt, Brucella suis 1330
ugaaacagcauauugc

SEQ ID NO: 449034 - RNA, 14 nt, Brucella suis 1330
ugaaacaggccuuc

SEQ ID NO: 449035 - RNA, 17 nt, Brucella suis 1330
ugaaaacaucgcggaac

SEQ ID NO: 449036 - RNA, 19 nt, Brucella suis 1330
ugaaaacggugaucaggac

SEQ ID NO: 449037 - RNA, 14 nt, Brucella suis 1330
ucuuggccaugaug

SEQ ID NO: 449038 - RNA, 14 nt, Brucella suis 1330
ucuugcgcuugcga

SEQ ID NO: 449039 - RNA, 14 nt, Brucella suis 1330
ucuugccggccuga

SEQ ID NO: 449040 - RNA, 11 nt, Brucella suis 1330
ucuugcccaga

SEQ ID NO: 449041 - RNA, 15 nt, Brucella suis 1330
ucuugaccuggccag

SEQ ID NO: 449042 - RNA, 19 nt, Brucella suis 1330
ucuugagguugagcugcuc

SEQ ID NO: 449043 - RNA, 18 nt, Brucella suis 1330
ucuucgauauugagagau

SEQ ID NO: 449044 - RNA, 20 nt, Brucella suis 1330
ucuucugagaaaaaaaugcg

SEQ ID NO: 449045 - RNA, 12 nt, Brucella suis 1330
ucuucugcaucg

SEQ ID NO: 449046 - RNA, 17 nt, Brucella suis 1330
ucuucuuccaguuucug

SEQ ID NO: 449047 - RNA, 13 nt, Brucella suis 1330
ucuucauucgcug

SEQ ID NO: 449048 - RNA, 23 nt, Brucella suis 1330
ucuucauugaccgaaaauggccc

SEQ ID NO: 449049 - RNA, 21 nt, Brucella suis 1330
ucuuccgacccgucaaugcca

SEQ ID NO: 449050 - RNA, 17 nt, Brucella suis 1330
ucuggccgauaagcucg

SEQ ID NO: 449051 - RNA, 22 nt, Brucella suis 1330
ucugcgcugcccucuugauccu

SEQ ID NO: 449052 - RNA, 23 nt, Brucella suis 1330
ucugcgcgucgagcaaugcgccg

SEQ ID NO: 449053 - RNA, 18 nt, Brucella suis 1330
ucugccugcccucguccu

SEQ ID NO: 449054 - RNA, 18 nt, Brucella suis 1330
ucugccuugucagaagca

SEQ ID NO: 449055 - RNA, 19 nt, Brucella suis 1330
ucugcccgccggggccgga

SEQ ID NO: 449056 - RNA, 19 nt, Brucella suis 1330
ucugauugcaggucuuucu

SEQ ID NO: 449057 - RNA, 21 nt, Brucella suis 1330
ucugauuugaaaagccccgcu

SEQ ID NO: 449058 - RNA, 21 nt, Brucella suis 1330
ucugacgggaugauugcgcca

SEQ ID NO: 449059 - RNA, 20 nt, Brucella suis 1330
aaaugcucuaggaaaacuug

SEQ ID NO: 449060 - RNA, 14 nt, Brucella suis 1330
ucugaaaucucuca

SEQ ID NO: 449061 - RNA, 18 nt, Brucella suis 1330
ucucgucgaaauccuuca

SEQ ID NO: 449062 - RNA, 23 nt, Brucella suis 1330
ucgccaaagaccagcaggaagaa

SEQ ID NO: 449063 - RNA, 22 nt, Brucella suis 1330
ucgcauccagaacuucgccaag

SEQ ID NO: 449064 - RNA, 19 nt, Brucella suis 1330
ucgcaucgggaucaaugau

SEQ ID NO: 449065 - RNA, 16 nt, Brucella suis 1330
ucgcagcguauucagg

SEQ ID NO: 449066 - RNA, 15 nt, Brucella suis 1330
ucgcacgcgcaugcc

SEQ ID NO: 449067 - RNA, 20 nt, Brucella suis 1330
ucgcaaugccggggaagggu

SEQ ID NO: 449068 - RNA, 16 nt, Brucella suis 1330
ucgcaagccaaagccc

SEQ ID NO: 449069 - RNA, 17 nt, Brucella suis 1330
ucgauuugcgcaccaga

SEQ ID NO: 449070 - RNA, 21 nt, Brucella suis 1330
ucgaugcgcuggaugaugcuu

SEQ ID NO: 449071 - RNA, 16 nt, Brucella suis 1330
ucgaugauaucgccuu

SEQ ID NO: 449072 - RNA, 23 nt, Brucella suis 1330
ucgaugaacaggagcggaagcau

SEQ ID NO: 449073 - RNA, 16 nt, Brucella suis 1330
ucgaucaucagcggcg

SEQ ID NO: 449074 - RNA, 19 nt, Brucella suis 1330
ucgaucagugccaccagau

SEQ ID NO: 449075 - RNA, 15 nt, Brucella suis 1330
ucgauauccuggccu

SEQ ID NO: 449076 - RNA, 22 nt, Brucella suis 1330
ucgauaucggacuggauuucga

SEQ ID NO: 449077 - RNA, 20 nt, Brucella suis 1330
ucgauaucugcaacaccauc

SEQ ID NO: 449078 - RNA, 16 nt, Brucella suis 1330
ucgaguugugccugcc

SEQ ID NO: 449079 - RNA, 22 nt, Brucella suis 1330
ucgagcggcauggcguagaaau

SEQ ID NO: 449080 - RNA, 18 nt, Brucella suis 1330
ucgagcagcaucuugcca

SEQ ID NO: 449081 - RNA, 22 nt, Brucella suis 1330
ucgagaagcaucagcuugccca

SEQ ID NO: 449082 - RNA, 15 nt, Brucella suis 1330
ucgagaaucugcuug

SEQ ID NO: 449083 - RNA, 18 nt, Brucella suis 1330
ucgacccgccaugcggcc

SEQ ID NO: 449084 - RNA, 18 nt, Brucella suis 1330
ucgacagcggaagcgcgu

SEQ ID NO: 449085 - RNA, 11 nt, Brucella suis 1330
ucgacagggug

SEQ ID NO: 449086 - RNA, 14 nt, Brucella suis 1330
ucgacagcacugcc

SEQ ID NO: 449087 - RNA, 14 nt, Brucella suis 1330
ucgacaaaggugcu

SEQ ID NO: 449088 - RNA, 18 nt, Brucella suis 1330
ucgacaaucuccccuucc

SEQ ID NO: 449089 - RNA, 19 nt, Brucella suis 1330
ucgacaaucuccccuuccu

SEQ ID NO: 449090 - RNA, 17 nt, Brucella suis 1330
ucgaagggcugagggaa

SEQ ID NO: 449091 - RNA, 20 nt, Brucella suis 1330
ucgaagggcugagggaaaca

SEQ ID NO: 449092 - RNA, 21 nt, Brucella suis 1330
ucgaagcgggaucagaaauca

SEQ ID NO: 449093 - RNA, 22 nt, Brucella suis 1330
ucgaagcgggaucagaaaucag

SEQ ID NO: 449094 - RNA, 20 nt, Brucella suis 1330
ucgaacagguugcgccacca

SEQ ID NO: 449095 - RNA, 21 nt, Brucella suis 1330
ucgaaaaugcucuaggaaaac

SEQ ID NO: 449096 - RNA, 15 nt, Brucella suis 1330
ucgaaacaaguucau

SEQ ID NO: 449097 - RNA, 23 nt, Brucella suis 1330
uccuuggcacguugcgccuggcg

SEQ ID NO: 449098 - RNA, 14 nt, Brucella suis 1330
uccuugaucgauuu

SEQ ID NO: 449099 - RNA, 12 nt, Brucella suis 1330
uccuugaugccc

SEQ ID NO: 449100 - RNA, 18 nt, Brucella suis 1330
uccuugaccgcuaugucg

SEQ ID NO: 449101 - RNA, 15 nt, Brucella suis 1330
uccuugaaaagcugg

SEQ ID NO: 449102 - RNA, 18 nt, Brucella suis 1330
uccugucccuucuugcuc

SEQ ID NO: 449103 - RNA, 15 nt, Brucella suis 1330
uccuucacauauugu

SEQ ID NO: 449104 - RNA, 17 nt, Brucella suis 1330
uccuucacauauugugc

SEQ ID NO: 449105 - RNA, 21 nt, Brucella suis 1330
uccuucaggcccuugccggcc

SEQ ID NO: 449106 - RNA, 22 nt, Brucella suis 1330
uccuggccuuccuugacgcuga

SEQ ID NO: 449107 - RNA, 17 nt, Brucella suis 1330
uccugcggaaugcccug

SEQ ID NO: 449108 - RNA, 19 nt, Brucella suis 1330
uccugcggaaugcccugga

SEQ ID NO: 449109 - RNA, 16 nt, Brucella suis 1330
uccugcaccggcuucc

SEQ ID NO: 449110 - RNA, 16 nt, Brucella suis 1330
uccugcaaaccggcug

SEQ ID NO: 449111 - RNA, 18 nt, Brucella suis 1330
uccugcaaaccggcugcc

SEQ ID NO: 449112 - RNA, 11 nt, Brucella suis 1330
uccugaucuug

SEQ ID NO: 449113 - RNA, 13 nt, Brucella suis 1330
uccugaucuugcg

SEQ ID NO: 449114 - RNA, 19 nt, Brucella suis 1330
uccugaauggucugcgcca

SEQ ID NO: 449115 - RNA, 13 nt, Brucella suis 1330
uccugacccaugg

SEQ ID NO: 449116 - RNA, 19 nt, Brucella suis 1330
uccugacccauggccugcu

SEQ ID NO: 449117 - RNA, 22 nt, Brucella suis 1330
uccugacccauggccugcugca

SEQ ID NO: 449118 - RNA, 18 nt, Brucella suis 1330
uccucggcaauccccgga

SEQ ID NO: 449119 - RNA, 15 nt, Brucella suis 1330
uccuacgcaaaaccg

SEQ ID NO: 449120 - RNA, 16 nt, Brucella suis 1330
uccuacgcaaaaccgc

SEQ ID NO: 449121 - RNA, 13 nt, Brucella suis 1330
uccucaagauaca

SEQ ID NO: 449122 - RNA, 14 nt, Brucella suis 1330
uccgugccgauuuc

SEQ ID NO: 449123 - RNA, 12 nt, Brucella suis 1330
uccgucugcauc

SEQ ID NO: 449124 - RNA, 15 nt, Brucella suis 1330
uccguccugaugccg

SEQ ID NO: 449125 - RNA, 15 nt, Brucella suis 1330
uccguaucuccgggc

SEQ ID NO: 449126 - RNA, 14 nt, Brucella suis 1330
uccggguuuuguuu

SEQ ID NO: 449127 - RNA, 22 nt, Brucella suis 1330
uccgggcuuuguuguuucaggc

SEQ ID NO: 449128 - RNA, 14 nt, Brucella suis 1330
uccgggcaccgacc

SEQ ID NO: 449129 - RNA, 22 nt, Brucella suis 1330
uccggcucgggccgguccagau

SEQ ID NO: 449130 - RNA, 15 nt, Brucella suis 1330
uccggcucaaugccg

SEQ ID NO: 449131 - RNA, 22 nt, Brucella suis 1330
uccggcucaaugccgcauucag

SEQ ID NO: 449132 - RNA, 15 nt, Brucella suis 1330
uccggccagccgacc

SEQ ID NO: 449133 - RNA, 18 nt, Brucella suis 1330
uccggcagguuccagucc

SEQ ID NO: 449134 - RNA, 20 nt, Brucella suis 1330
uccggcagcccgacauccuu

SEQ ID NO: 449135 - RNA, 12 nt, Brucella suis 1330
uccgcuccagau

SEQ ID NO: 449136 - RNA, 16 nt, Brucella suis 1330
uccgccggggcaggcu

SEQ ID NO: 449137 - RNA, 23 nt, Brucella suis 1330
uccgccagauaagacauggcuuc

SEQ ID NO: 449138 - RNA, 11 nt, Brucella suis 1330
uccgcaccgca

SEQ ID NO: 449139 - RNA, 21 nt, Brucella suis 1330
uccgcaauacgccuggccggc

SEQ ID NO: 449140 - RNA, 16 nt, Brucella suis 1330
uccgcaacucauggaa

SEQ ID NO: 449141 - RNA, 19 nt, Brucella suis 1330
uccgaggcgcgcagcagcg

SEQ ID NO: 449142 - RNA, 15 nt, Brucella suis 1330
uccgacauccaucgg

SEQ ID NO: 449143 - RNA, 20 nt, Brucella suis 1330
uccgaauuugcugccugcgg

SEQ ID NO: 449144 - RNA, 12 nt, Brucella suis 1330
uccgacaccagc

SEQ ID NO: 449145 - RNA, 12 nt, Brucella suis 1330
ucccuugccgcc

SEQ ID NO: 449146 - RNA, 13 nt, Brucella suis 1330
aaaucugcgcgcg

SEQ ID NO: 449147 - RNA, 16 nt, Brucella suis 1330
ucccuucuugcucuca

SEQ ID NO: 449148 - RNA, 22 nt, Brucella suis 1330
ucccuuaacauacugccuuacu

SEQ ID NO: 449149 - RNA, 20 nt, Brucella suis 1330
ucccgugucggagccggccu

SEQ ID NO: 449150 - RNA, 19 nt, Brucella suis 1330
ucccggcccuuuuucaugc

SEQ ID NO: 449151 - RNA, 21 nt, Brucella suis 1330
ucccgccgcgaaaaccggcug

SEQ ID NO: 449152 - RNA, 23 nt, Brucella suis 1330
ucccgccccuaaaggcucugcgc

SEQ ID NO: 449153 - RNA, 14 nt, Brucella suis 1330
uccccuacucccuu

SEQ ID NO: 449154 - RNA, 15 nt, Brucella suis 1330
uccccuacucccuua

SEQ ID NO: 449155 - RNA, 15 nt, Brucella suis 1330
uccccuauuccccua

SEQ ID NO: 449156 - RNA, 12 nt, Brucella suis 1330
uccccgccgccg

SEQ ID NO: 449157 - RNA, 21 nt, Brucella suis 1330
uccccauacguccagccaggu

SEQ ID NO: 449158 - RNA, 13 nt, Brucella suis 1330
uccccccauucau

SEQ ID NO: 449159 - RNA, 19 nt, Brucella suis 1330
uccccaaaguggaaagcgg

SEQ ID NO: 449160 - RNA, 14 nt, Brucella suis 1330
ucccaaagcgggcg

SEQ ID NO: 449161 - RNA, 22 nt, Brucella suis 1330
ucccaaagcgggcgcuccagcc

SEQ ID NO: 449162 - RNA, 19 nt, Brucella suis 1330
uccauugccgguugcuucc

SEQ ID NO: 449163 - RNA, 19 nt, Brucella suis 1330
uccauggccacgacagggc

SEQ ID NO: 449164 - RNA, 17 nt, Brucella suis 1330
uccaugagcgcaccauu

SEQ ID NO: 449165 - RNA, 23 nt, Brucella suis 1330
uccaugacgcgggugaggcuuuc

SEQ ID NO: 449166 - RNA, 14 nt, Brucella suis 1330
uccaucggcgagga

SEQ ID NO: 449167 - RNA, 16 nt, Brucella suis 1330
uccauccggcggcgcc

SEQ ID NO: 449168 - RNA, 22 nt, Brucella suis 1330
uccauccggcggcgcccaccau

SEQ ID NO: 449169 - RNA, 14 nt, Brucella suis 1330
uccauaucuuucca

SEQ ID NO: 449170 - RNA, 18 nt, Brucella suis 1330
uccagugcaaagcggcuu

SEQ ID NO: 449171 - RNA, 15 nt, Brucella suis 1330
uccaguggaagcaca

SEQ ID NO: 449172 - RNA, 18 nt, Brucella suis 1330
uccagcggugacggcggc

SEQ ID NO: 449173 - RNA, 11 nt, Brucella suis 1330
uccagcgggcg

SEQ ID NO: 449174 - RNA, 23 nt, Brucella suis 1330
uccagcauggugcgcacuuccgc

SEQ ID NO: 449175 - RNA, 17 nt, Brucella suis 1330
uccagaagccgcuugca

SEQ ID NO: 449176 - RNA, 21 nt, Brucella suis 1330
uccagaaggcgggaaggcaau

SEQ ID NO: 449177 - RNA, 22 nt, Brucella suis 1330
uccagaaggcgggaaggcaauc

SEQ ID NO: 449178 - RNA, 14 nt, Brucella suis 1330
uccagaaagagcau

SEQ ID NO: 449179 - RNA, 13 nt, Brucella suis 1330
uccaaugugcccu

SEQ ID NO: 449180 - RNA, 20 nt, Brucella suis 1330
uccaaugugcccuugagagc

SEQ ID NO: 449181 - RNA, 22 nt, Brucella suis 1330
uccaaugugcccuugagagcca

SEQ ID NO: 449182 - RNA, 15 nt, Brucella suis 1330
uccacaaugauguuc

SEQ ID NO: 449183 - RNA, 16 nt, Brucella suis 1330
uccaauauugccuucc

SEQ ID NO: 449184 - RNA, 15 nt, Brucella suis 1330
ucauguuucaaaagu

SEQ ID NO: 449185 - RNA, 16 nt, Brucella suis 1330
ucauguuuugaaucug

SEQ ID NO: 449186 - RNA, 17 nt, Brucella suis 1330
ucauuccggcgcugcuc

SEQ ID NO: 449187 - RNA, 20 nt, Brucella suis 1330
ucauugaacccgccaccaga

SEQ ID NO: 449188 - RNA, 16 nt, Brucella suis 1330
ucauuugccaccugca

SEQ ID NO: 449189 - RNA, 18 nt, Brucella suis 1330
ucauuuggacaaaagccc

SEQ ID NO: 449190 - RNA, 18 nt, Brucella suis 1330
ucauuugcgaccauggcg

SEQ ID NO: 449191 - RNA, 15 nt, Brucella suis 1330
ucauuuuuagaagau

SEQ ID NO: 449192 - RNA, 16 nt, Brucella suis 1330
ucaggucgagcgccug

SEQ ID NO: 449193 - RNA, 18 nt, Brucella suis 1330
ucaggucgagcgccuguc

SEQ ID NO: 449194 - RNA, 16 nt, Brucella suis 1330
ucaggcuacugacaaa

SEQ ID NO: 449195 - RNA, 19 nt, Brucella suis 1330
ucaguagccugacccggcc

SEQ ID NO: 449196 - RNA, 21 nt, Brucella suis 1330
ucaggccgauccugcgcccug

SEQ ID NO: 449197 - RNA, 20 nt, Brucella suis 1330
ucaggcccuugucgcgcaac

SEQ ID NO: 449198 - RNA, 21 nt, Brucella suis 1330
ucaggauaucgccguccuuug

SEQ ID NO: 449199 - RNA, 15 nt, Brucella suis 1330
ucaggccaaagccuu

SEQ ID NO: 449200 - RNA, 18 nt, Brucella suis 1330
ucaggcccagaugcagcg

SEQ ID NO: 449201 - RNA, 15 nt, Brucella suis 1330
ucagcgucagcgcaa

SEQ ID NO: 449202 - RNA, 16 nt, Brucella suis 1330
ucagcucgaaauccag

SEQ ID NO: 449203 - RNA, 19 nt, Brucella suis 1330
ucagcaucgcccccuugau

SEQ ID NO: 449204 - RNA, 22 nt, Brucella suis 1330
ucagcaccgugaagcgcuugcc

SEQ ID NO: 449205 - RNA, 16 nt, Brucella suis 1330
ucagcacaagccaucc

SEQ ID NO: 449206 - RNA, 14 nt, Brucella suis 1330
ucagauaagaugcg

SEQ ID NO: 449207 - RNA, 15 nt, Brucella suis 1330
ucagaucgaaaugcg

SEQ ID NO: 449208 - RNA, 22 nt, Brucella suis 1330
ucagaucgacgcagaaauugca

SEQ ID NO: 449209 - RNA, 17 nt, Brucella suis 1330
ucagaagugcugcugca

SEQ ID NO: 449210 - RNA, 15 nt, Brucella suis 1330
ucagacgauccucaa

SEQ ID NO: 449211 - RNA, 23 nt, Brucella suis 1330
ucagacgguccgccggauagggc

SEQ ID NO: 449212 - RNA, 15 nt, Brucella suis 1330
ucagagcuucauugu

SEQ ID NO: 449213 - RNA, 16 nt, Brucella suis 1330
ucagaaagaaagcugu

SEQ ID NO: 449214 - RNA, 15 nt, Brucella suis 1330
ucagaaauuugcggg

SEQ ID NO: 449215 - RNA, 19 nt, Brucella suis 1330
ucacggaacgucacagauu

SEQ ID NO: 449216 - RNA, 23 nt, Brucella suis 1330
ucacggaguguagcgcagccugg

SEQ ID NO: 449217 - RNA, 20 nt, Brucella suis 1330
ucacccucggugccaagaag

SEQ ID NO: 449218 - RNA, 14 nt, Brucella suis 1330
ucacgucauaggca

SEQ ID NO: 449219 - RNA, 18 nt, Brucella suis 1330
ucacaucgagacggcgcu

SEQ ID NO: 449220 - RNA, 21 nt, Brucella suis 1330
ucacagccgcgccaauccagg

SEQ ID NO: 449221 - RNA, 19 nt, Brucella suis 1330
ucaaucacgccacugcccu

SEQ ID NO: 449222 - RNA, 16 nt, Brucella suis 1330
ucaauucccuggcuuu

SEQ ID NO: 449223 - RNA, 13 nt, Brucella suis 1330
ucaauacccaugc

SEQ ID NO: 449224 - RNA, 22 nt, Brucella suis 1330
ucaacagccuuggcuuccagcg

SEQ ID NO: 449225 - RNA, 15 nt, Brucella suis 1330
ucaacaugcacaucc

SEQ ID NO: 449226 - RNA, 16 nt, Brucella suis 1330
ucaaaagcuggaugau

SEQ ID NO: 449227 - RNA, 21 nt, Brucella suis 1330
ucaaaccaaaaaaccuccggu

SEQ ID NO: 449228 - RNA, 18 nt, Brucella suis 1330
ucaaagcgcggaaugaca

SEQ ID NO: 449229 - RNA, 20 nt, Brucella suis 1330
ucaaaggagccgcugcgcag

SEQ ID NO: 449230 - RNA, 17 nt, Brucella suis 1330
uauucaaccguuuccug

SEQ ID NO: 449231 - RNA, 18 nt, Brucella suis 1330
uauucaaccguuuccuga

SEQ ID NO: 449232 - RNA, 18 nt, Brucella suis 1330
uauuccccuauuccccua

SEQ ID NO: 449233 - RNA, 23 nt, Brucella suis 1330
uauucggcgaccgccuuuuccag

SEQ ID NO: 449234 - RNA, 19 nt, Brucella suis 1330
uauucgugccuggcgaaaa

SEQ ID NO: 449235 - RNA, 13 nt, Brucella suis 1330
uauucuugcgaac

SEQ ID NO: 449236 - RNA, 11 nt, Brucella suis 1330
uauggcaaaag

SEQ ID NO: 449237 - RNA, 23 nt, Brucella suis 1330
uaugccagauaugcagcguguug

SEQ ID NO: 449238 - RNA, 22 nt, Brucella suis 1330
uaugcaccagcgucuguacaua

SEQ ID NO: 449239 - RNA, 20 nt, Brucella suis 1330
uaucucuuuguuuugccgca

SEQ ID NO: 449240 - RNA, 22 nt, Brucella suis 1330
uaucugcgcgugcacgcgggcc

SEQ ID NO: 449241 - RNA, 15 nt, Brucella suis 1330
uaucuuccagagcgg

SEQ ID NO: 449242 - RNA, 13 nt, Brucella suis 1330
uaucuuuuuucaa

SEQ ID NO: 449243 - RNA, 22 nt, Brucella suis 1330
uaucggauucuuaugccagaua

SEQ ID NO: 449244 - RNA, 15 nt, Brucella suis 1330
uaucgccugcuuccu

SEQ ID NO: 449245 - RNA, 21 nt, Brucella suis 1330
uaucgcgaagaagaauacgca

SEQ ID NO: 449246 - RNA, 15 nt, Brucella suis 1330
uaucgagauugggcg

SEQ ID NO: 449247 - RNA, 18 nt, Brucella suis 1330
uauccugaaaauacucua

SEQ ID NO: 449248 - RNA, 18 nt, Brucella suis 1330
uauccuggccuuccuuga

SEQ ID NO: 449249 - RNA, 14 nt, Brucella suis 1330
uauccaggugcagu

SEQ ID NO: 449250 - RNA, 16 nt, Brucella suis 1330
uauccggcucauucug

SEQ ID NO: 449251 - RNA, 13 nt, Brucella suis 1330
uauccggcugggu

SEQ ID NO: 449252 - RNA, 15 nt, Brucella suis 1330
uaucagcucuucaca

SEQ ID NO: 449253 - RNA, 14 nt, Brucella suis 1330
uauaugcaccagcg

SEQ ID NO: 449254 - RNA, 16 nt, Brucella suis 1330
uagucgaaaaaagaau

SEQ ID NO: 449255 - RNA, 14 nt, Brucella suis 1330
uagucaguuccugc

SEQ ID NO: 449256 - RNA, 15 nt, Brucella suis 1330
uaggugagcggcagg

SEQ ID NO: 449257 - RNA, 17 nt, Brucella suis 1330
uaggugagcggcaggcc

SEQ ID NO: 449258 - RNA, 20 nt, Brucella suis 1330
uaggugcgcggacgggcagg

SEQ ID NO: 449259 - RNA, 23 nt, Brucella suis 1330
uaggugcgcggacgggcaggcag

SEQ ID NO: 449260 - RNA, 11 nt, Brucella suis 1330
uacuggcaaua

SEQ ID NO: 449261 - RNA, 12 nt, Brucella suis 1330
uacuguuagagc

SEQ ID NO: 449262 - RNA, 15 nt, Brucella suis 1330
uacggcggaucuugc

SEQ ID NO: 449263 - RNA, 19 nt, Brucella suis 1330
uacggcccucgaccgccac

SEQ ID NO: 449264 - RNA, 16 nt, Brucella suis 1330
uacgccccgugaucuu

SEQ ID NO: 449265 - RNA, 15 nt, Brucella suis 1330
uaccccucccucacc

SEQ ID NO: 449266 - RNA, 13 nt, Brucella suis 1330
uaccauaacgcuu

SEQ ID NO: 449267 - RNA, 19 nt, Brucella suis 1330
uaccauaggccguuccgcc

SEQ ID NO: 449268 - RNA, 12 nt, Brucella suis 1330
uaccauauccuc

SEQ ID NO: 449269 - RNA, 21 nt, Brucella suis 1330
uaccaacccuuuuccgcaccg

SEQ ID NO: 449270 - RNA, 17 nt, Brucella suis 1330
uacagugacgcgcgcau

SEQ ID NO: 449271 - RNA, 13 nt, Brucella suis 1330
uacaaguggcuuu

SEQ ID NO: 449272 - RNA, 23 nt, Brucella suis 1330
uaauagaugagcugguuuuucac

SEQ ID NO: 449273 - RNA, 21 nt, Brucella suis 1330
uaaucaaaaacaaucuccggc

SEQ ID NO: 449274 - RNA, 18 nt, Brucella suis 1330
uaaucaaaagaaaccuug

SEQ ID NO: 449275 - RNA, 23 nt, Brucella suis 1330
uaaucagcgucagcgcaaagccu

SEQ ID NO: 449276 - RNA, 20 nt, Brucella suis 1330
uaauccacauucauaaccga

SEQ ID NO: 449277 - RNA, 15 nt, Brucella suis 1330
uaauccauggccacg

SEQ ID NO: 449278 - RNA, 20 nt, Brucella suis 1330
uaaugcguaaaaauaaagaa

SEQ ID NO: 449279 - RNA, 22 nt, Brucella suis 1330
uaauuccacgcgccgacaaaaa

SEQ ID NO: 449280 - RNA, 20 nt, Brucella suis 1330
uaaguuuggcuaaagauacc

SEQ ID NO: 449281 - RNA, 21 nt, Brucella suis 1330
uaagcuuuucauuuuccucau

SEQ ID NO: 449282 - RNA, 17 nt, Brucella suis 1330
uaagcgccuuugccgcg

SEQ ID NO: 449283 - RNA, 19 nt, Brucella suis 1330
uaagcggaaaacggcugca

SEQ ID NO: 449284 - RNA, 22 nt, Brucella suis 1330
uaagcggaaaacggcugcaaca

SEQ ID NO: 449285 - RNA, 15 nt, Brucella suis 1330
uaagcggcucucaaa

SEQ ID NO: 449286 - RNA, 18 nt, Brucella suis 1330
uaagcugauaaaacgaau

SEQ ID NO: 449287 - RNA, 16 nt, Brucella suis 1330
uaagccccggcaucac

SEQ ID NO: 449288 - RNA, 18 nt, Brucella suis 1330
uaagccccggcaucacug

SEQ ID NO: 449289 - RNA, 22 nt, Brucella suis 1330
uaagccggcaugaaugugccug

SEQ ID NO: 449290 - RNA, 23 nt, Brucella suis 1330
uaaccgaagaaugcgcagccguc

SEQ ID NO: 449291 - RNA, 16 nt, Brucella suis 1330
uaaauccuccagauug

SEQ ID NO: 449292 - RNA, 15 nt, Brucella suis 1330
guuuuggaaagaaau

SEQ ID NO: 449293 - RNA, 13 nt, Brucella suis 1330
guuuuggcaucag

SEQ ID NO: 449294 - RNA, 22 nt, Brucella suis 1330
uaaaccucccuguccugccagc

SEQ ID NO: 449295 - RNA, 14 nt, Brucella suis 1330
uaaagccgcuccau

SEQ ID NO: 449296 - RNA, 18 nt, Brucella suis 1330
uaaagcuuaacccaacca

SEQ ID NO: 449297 - RNA, 13 nt, Brucella suis 1330
guuugaucagccg

SEQ ID NO: 449298 - RNA, 22 nt, Brucella suis 1330
guuugccgucgaagcgcugcaa

SEQ ID NO: 449299 - RNA, 15 nt, Brucella suis 1330
guuuucagcggcggg

SEQ ID NO: 449300 - RNA, 12 nt, Brucella suis 1330
guuuugagcugc

SEQ ID NO: 449301 - RNA, 20 nt, Brucella suis 1330
guuuugcguuggaaaaugcg

SEQ ID NO: 449302 - RNA, 16 nt, Brucella suis 1330
guuucgccccguugca

SEQ ID NO: 449303 - RNA, 19 nt, Brucella suis 1330
guuucggcggcuuuccagu

SEQ ID NO: 449304 - RNA, 12 nt, Brucella suis 1330
guuuccgccauc

SEQ ID NO: 449305 - RNA, 20 nt, Brucella suis 1330
guuuccggacgcgcagauau

SEQ ID NO: 449306 - RNA, 14 nt, Brucella suis 1330
aaaucaaccucgcg

SEQ ID NO: 449307 - RNA, 15 nt, Brucella suis 1330
guuucaagaucggac

SEQ ID NO: 449308 - RNA, 15 nt, Brucella suis 1330
guuucaagcucccaa

SEQ ID NO: 449309 - RNA, 13 nt, Brucella suis 1330
guuggaaaaugcg

SEQ ID NO: 449310 - RNA, 14 nt, Brucella suis 1330
guugcuccagcccu

SEQ ID NO: 449311 - RNA, 17 nt, Brucella suis 1330
guugcuccagcccuuuc

SEQ ID NO: 449312 - RNA, 14 nt, Brucella suis 1330
guugcgauggcgcc

SEQ ID NO: 449313 - RNA, 17 nt, Brucella suis 1330
guugccuugcccauggu

SEQ ID NO: 449314 - RNA, 18 nt, Brucella suis 1330
guugcaccgcucucggcu

SEQ ID NO: 449315 - RNA, 17 nt, Brucella suis 1330
guugcacuccggcugga

SEQ ID NO: 449316 - RNA, 11 nt, Brucella suis 1330
guugagcuguu

SEQ ID NO: 449317 - RNA, 18 nt, Brucella suis 1330
guucgggcauuguggugc

SEQ ID NO: 449318 - RNA, 14 nt, Brucella suis 1330
guucgggacgaggg

SEQ ID NO: 449319 - RNA, 19 nt, Brucella suis 1330
guucggcuuccaggccggg

SEQ ID NO: 449320 - RNA, 19 nt, Brucella suis 1330
guuccuuuuccacacgaac

SEQ ID NO: 449321 - RNA, 21 nt, Brucella suis 1330
guuccuugaggccgcgcgcgc

SEQ ID NO: 449322 - RNA, 17 nt, Brucella suis 1330
guuccuguuuuaacaga

SEQ ID NO: 449323 - RNA, 18 nt, Brucella suis 1330
guuccgccugugggaaga

SEQ ID NO: 449324 - RNA, 12 nt, Brucella suis 1330
guuccggcacuc

SEQ ID NO: 449325 - RNA, 15 nt, Brucella suis 1330
guuccgaauacaagc

SEQ ID NO: 449326 - RNA, 15 nt, Brucella suis 1330
guuccacgauuuccg

SEQ ID NO: 449327 - RNA, 19 nt, Brucella suis 1330
guuccacggacgaucugga

SEQ ID NO: 449328 - RNA, 17 nt, Brucella suis 1330
guuccaguccagcgcgc

SEQ ID NO: 449329 - RNA, 18 nt, Brucella suis 1330
guuaccuugccgucacca

SEQ ID NO: 449330 - RNA, 12 nt, Brucella suis 1330
guguugaccaca

SEQ ID NO: 449331 - RNA, 14 nt, Brucella suis 1330
gugugcgcgcgcca

SEQ ID NO: 449332 - RNA, 16 nt, Brucella suis 1330
guguagcgcagccugg

SEQ ID NO: 449333 - RNA, 13 nt, Brucella suis 1330
gugucauaaaaaa

SEQ ID NO: 449334 - RNA, 16 nt, Brucella suis 1330
guguccacgcgcuuga

SEQ ID NO: 449335 - RNA, 12 nt, Brucella suis 1330
guggccuucagc

SEQ ID NO: 449336 - RNA, 19 nt, Brucella suis 1330
guggcaugggagcaccgca

SEQ ID NO: 449337 - RNA, 11 nt, Brucella suis 1330
guggcaaugac

SEQ ID NO: 449338 - RNA, 23 nt, Brucella suis 1330
guggcaaugacggcauuuugcga

SEQ ID NO: 449339 - RNA, 21 nt, Brucella suis 1330
guggagcguacaccgaccagc

SEQ ID NO: 449340 - RNA, 13 nt, Brucella suis 1330
guggagcaccgcc

SEQ ID NO: 449341 - RNA, 22 nt, Brucella suis 1330
guggaagcacauggcggccuuu

SEQ ID NO: 449342 - RNA, 15 nt, Brucella suis 1330
gugcugucgcccaga

SEQ ID NO: 449343 - RNA, 15 nt, Brucella suis 1330
gugcuggccguggca

SEQ ID NO: 449344 - RNA, 14 nt, Brucella suis 1330
gugcagggugcggu

SEQ ID NO: 449345 - RNA, 16 nt, Brucella suis 1330
gugcagaugcgaggga

SEQ ID NO: 449346 - RNA, 18 nt, Brucella suis 1330
gugagcagaagaaagggc

SEQ ID NO: 449347 - RNA, 16 nt, Brucella suis 1330
gugagcauggcaaggc

SEQ ID NO: 449348 - RNA, 18 nt, Brucella suis 1330
gugagcgcgcaaacaagc

SEQ ID NO: 449349 - RNA, 12 nt, Brucella suis 1330
gugagcggcagg

SEQ ID NO: 449350 - RNA, 14 nt, Brucella suis 1330
gugacggcggcaga

SEQ ID NO: 449351 - RNA, 15 nt, Brucella suis 1330
gugaccagagagcgg

SEQ ID NO: 449352 - RNA, 14 nt, Brucella suis 1330
gugaccagccccug

SEQ ID NO: 449353 - RNA, 19 nt, Brucella suis 1330
gugaccagcgccgaggcgc

SEQ ID NO: 449354 - RNA, 22 nt, Brucella suis 1330
aaauagggccagacauagaccu

SEQ ID NO: 449355 - RNA, 19 nt, Brucella suis 1330
gugaaacggccaagcagga

SEQ ID NO: 449356 - RNA, 23 nt, Brucella suis 1330
gugaaauauuuauccgcggcggu

SEQ ID NO: 449357 - RNA, 19 nt, Brucella suis 1330
gugaacauuucggucggga

SEQ ID NO: 449358 - RNA, 18 nt, Brucella suis 1330
gucuuuuccgcugccagc

SEQ ID NO: 449359 - RNA, 17 nt, Brucella suis 1330
gucuugcgcuccaccag

SEQ ID NO: 449360 - RNA, 20 nt, Brucella suis 1330
gucuucgcccgacugcacgu

SEQ ID NO: 449361 - RNA, 12 nt, Brucella suis 1330
gucuucgcccgg

SEQ ID NO: 449362 - RNA, 18 nt, Brucella suis 1330
gucuucugagaaaaaaau

SEQ ID NO: 449363 - RNA, 19 nt, Brucella suis 1330
gucuggugcucuauccagc

SEQ ID NO: 449364 - RNA, 21 nt, Brucella suis 1330
gucucgacaguccagcuuucc

SEQ ID NO: 449365 - RNA, 14 nt, Brucella suis 1330
gucgucuuucaguu

SEQ ID NO: 449366 - RNA, 14 nt, Brucella suis 1330
gucgggaagcccag

SEQ ID NO: 449367 - RNA, 17 nt, Brucella suis 1330
gucggcucaucgcgcug

SEQ ID NO: 449368 - RNA, 21 nt, Brucella suis 1330
gucggcguccacacugauuuu

SEQ ID NO: 449369 - RNA, 21 nt, Brucella suis 1330
gucgcuuucgauuuuugccag

SEQ ID NO: 449370 - RNA, 21 nt, Brucella suis 1330
gucgcuuuucaguugcgcaaa

SEQ ID NO: 449371 - RNA, 14 nt, Brucella suis 1330
gucggcaagcugga

SEQ ID NO: 449372 - RNA, 21 nt, Brucella suis 1330
gucgcggcucccguugccggg

SEQ ID NO: 449373 - RNA, 19 nt, Brucella suis 1330
gucgauauugaccuuggca

SEQ ID NO: 449374 - RNA, 15 nt, Brucella suis 1330
gucgagcuuuccauc

SEQ ID NO: 449375 - RNA, 23 nt, Brucella suis 1330
gucgagcggcauggcguagaaau

SEQ ID NO: 449376 - RNA, 19 nt, Brucella suis 1330
gucgagcagcaucuugcca

SEQ ID NO: 449377 - RNA, 14 nt, Brucella suis 1330
gucgaccggcggca

SEQ ID NO: 449378 - RNA, 14 nt, Brucella suis 1330
guccugccagcggc

SEQ ID NO: 449379 - RNA, 17 nt, Brucella suis 1330
guccugcaaaccggcug

SEQ ID NO: 449380 - RNA, 18 nt, Brucella suis 1330
guccgggaagcaguuccu

SEQ ID NO: 449381 - RNA, 16 nt, Brucella suis 1330
guccggcgcgcugcaa

SEQ ID NO: 449382 - RNA, 21 nt, Brucella suis 1330
guccggcauugaugagaaccg

SEQ ID NO: 449383 - RNA, 22 nt, Brucella suis 1330
guccggccagcuugaaaagccg

SEQ ID NO: 449384 - RNA, 17 nt, Brucella suis 1330
guccaccaccucgccaa

SEQ ID NO: 449385 - RNA, 17 nt, Brucella suis 1330
gucauuuuugacaagcc

SEQ ID NO: 449386 - RNA, 16 nt, Brucella suis 1330
gucaggcccagaugca

SEQ ID NO: 449387 - RNA, 14 nt, Brucella suis 1330
gucacguccagaag

SEQ ID NO: 449388 - RNA, 17 nt, Brucella suis 1330
gucacggucagaucauc

SEQ ID NO: 449389 - RNA, 18 nt, Brucella suis 1330
gucacugcaaaaaauacc

SEQ ID NO: 449390 - RNA, 21 nt, Brucella suis 1330
gucacgcgcguugcggccggg

SEQ ID NO: 449391 - RNA, 20 nt, Brucella suis 1330
gucacgcugcaucggcaaau

SEQ ID NO: 449392 - RNA, 23 nt, Brucella suis 1330
gucacggaguguagcgcagccug

SEQ ID NO: 449393 - RNA, 19 nt, Brucella suis 1330
gucacgauggcccagcggu

SEQ ID NO: 449394 - RNA, 22 nt, Brucella suis 1330
gucacccgcgucgucugcaucc

SEQ ID NO: 449395 - RNA, 16 nt, Brucella suis 1330
gucaagacaagagccg

SEQ ID NO: 449396 - RNA, 13 nt, Brucella suis 1330
ggucugcgacggc

SEQ ID NO: 449397 - RNA, 16 nt, Brucella suis 1330
ggucggaaagaugguc

SEQ ID NO: 449398 - RNA, 15 nt, Brucella suis 1330
ggucgaugccgccga

SEQ ID NO: 449399 - RNA, 12 nt, Brucella suis 1330
ggucgaaaccuu

SEQ ID NO: 449400 - RNA, 16 nt, Brucella suis 1330
ggucaaaacgccccgg

SEQ ID NO: 449401 - RNA, 16 nt, Brucella suis 1330
gguauagacauucugc

SEQ ID NO: 449402 - RNA, 21 nt, Brucella suis 1330
gguaaaggcgaguuuucaaac

SEQ ID NO: 449403 - RNA, 17 nt, Brucella suis 1330
gguaacgauauccggcu

SEQ ID NO: 449404 - RNA, 12 nt, Brucella suis 1330
ggguuucuuuug

SEQ ID NO: 449405 - RNA, 19 nt, Brucella suis 1330
gguaaaaugcaccgccugc

SEQ ID NO: 449406 - RNA, 12 nt, Brucella suis 1330
ggguugccuucg

SEQ ID NO: 449407 - RNA, 15 nt, Brucella suis 1330
ggguugacgaucacc

SEQ ID NO: 449408 - RNA, 23 nt, Brucella suis 1330
ggguguuugcgacgggcgagcgc

SEQ ID NO: 449409 - RNA, 13 nt, Brucella suis 1330
ggguggcgcccgc

SEQ ID NO: 449410 - RNA, 12 nt, Brucella suis 1330
gggugagcgugu

SEQ ID NO: 449411 - RNA, 22 nt, Brucella suis 1330
gggucacgcgcguugcggccgg

SEQ ID NO: 449412 - RNA, 17 nt, Brucella suis 1330
ggguagagcuucuuuuc

SEQ ID NO: 449413 - RNA, 20 nt, Brucella suis 1330
gggguaaauccuccagauug

SEQ ID NO: 449414 - RNA, 20 nt, Brucella suis 1330
ggggcuguagcgcgcaccga

SEQ ID NO: 449415 - RNA, 13 nt, Brucella suis 1330
ggggcuuggcuug

SEQ ID NO: 449416 - RNA, 13 nt, Brucella suis 1330
ggggcgacgcugc

SEQ ID NO: 449417 - RNA, 17 nt, Brucella suis 1330
ggggccaaggccccaga

SEQ ID NO: 449418 - RNA, 11 nt, Brucella suis 1330
ggggcaggggu

SEQ ID NO: 449419 - RNA, 18 nt, Brucella suis 1330
ggggcaagaaaaaagguc

SEQ ID NO: 449420 - RNA, 18 nt, Brucella suis 1330
gggcuucaugauggaaga

SEQ ID NO: 449421 - RNA, 14 nt, Brucella suis 1330
gggcuucuuccagu

SEQ ID NO: 449422 - RNA, 23 nt, Brucella suis 1330
gggcuggcucuauacgaugcaga

SEQ ID NO: 449423 - RNA, 20 nt, Brucella suis 1330
gggcugcuuccacaggcgcc

SEQ ID NO: 449424 - RNA, 21 nt, Brucella suis 1330
gggcguaucguuaucgcgcag

SEQ ID NO: 449425 - RNA, 18 nt, Brucella suis 1330
gggcgguauugcugccgg

SEQ ID NO: 449426 - RNA, 19 nt, Brucella suis 1330
gggcggucacgcuccgcca

SEQ ID NO: 449427 - RNA, 16 nt, Brucella suis 1330
gggcggcguuuugcuu

SEQ ID NO: 449428 - RNA, 13 nt, Brucella suis 1330
gggcggcaccccc

SEQ ID NO: 449429 - RNA, 15 nt, Brucella suis 1330
gggcgaacgggggcg

SEQ ID NO: 449430 - RNA, 21 nt, Brucella suis 1330
gggccucaagcggcuccacca

SEQ ID NO: 449431 - RNA, 15 nt, Brucella suis 1330
gggccgggaaaucug

SEQ ID NO: 449432 - RNA, 19 nt, Brucella suis 1330
gggccgggaaaucugcgcg

SEQ ID NO: 449433 - RNA, 14 nt, Brucella suis 1330
gggccgcucaaggc

SEQ ID NO: 449434 - RNA, 16 nt, Brucella suis 1330
gggccggaugcgcgga

SEQ ID NO: 449435 - RNA, 20 nt, Brucella suis 1330
gggccgcaugauccgcucca

SEQ ID NO: 449436 - RNA, 14 nt, Brucella suis 1330
gggcccuucgcuuu

SEQ ID NO: 449437 - RNA, 19 nt, Brucella suis 1330
gggccaucuuccucacccu

SEQ ID NO: 449438 - RNA, 18 nt, Brucella suis 1330
gggccagaucgcgcgcgg

SEQ ID NO: 449439 - RNA, 19 nt, Brucella suis 1330
gggccaaggccccagauca

SEQ ID NO: 449440 - RNA, 22 nt, Brucella suis 1330
gggcauucgaugaacaggagcg

SEQ ID NO: 449441 - RNA, 17 nt, Brucella suis 1330
gggcaguccggcagccg

SEQ ID NO: 449442 - RNA, 14 nt, Brucella suis 1330
gggcaguagggcag

SEQ ID NO: 449443 - RNA, 21 nt, Brucella suis 1330
gggcaguagggcaguagggca

SEQ ID NO: 449444 - RNA, 18 nt, Brucella suis 1330
gggcagcuucgagcgccu

SEQ ID NO: 449445 - RNA, 13 nt, Brucella suis 1330
gggcagcggcgcg

SEQ ID NO: 449446 - RNA, 16 nt, Brucella suis 1330
gggcaauuggccccca

SEQ ID NO: 449447 - RNA, 17 nt, Brucella suis 1330
gggcaauuggcccccaa

SEQ ID NO: 449448 - RNA, 22 nt, Brucella suis 1330
gggcaaggggcggaacaggcag

SEQ ID NO: 449449 - RNA, 15 nt, Brucella suis 1330
gggcaaccgcgcgua

SEQ ID NO: 449450 - RNA, 16 nt, Brucella suis 1330
gggaugggggccgggc

SEQ ID NO: 449451 - RNA, 22 nt, Brucella suis 1330
gggaucagaagugcugcugcaa

SEQ ID NO: 449452 - RNA, 20 nt, Brucella suis 1330
gggaggacauucaugaagau

SEQ ID NO: 449453 - RNA, 21 nt, Brucella suis 1330
gggagcggcacaugaaauaag

SEQ ID NO: 449454 - RNA, 18 nt, Brucella suis 1330
gggagauguguaggcugg

SEQ ID NO: 449455 - RNA, 14 nt, Brucella suis 1330
gggacgggcggugc

SEQ ID NO: 449456 - RNA, 16 nt, Brucella suis 1330
gggacgagcggcaggc

SEQ ID NO: 449457 - RNA, 21 nt, Brucella suis 1330
gggacaaucuugcgcagcgca

SEQ ID NO: 449458 - RNA, 14 nt, Brucella suis 1330
gggaaugcggaagc

SEQ ID NO: 449459 - RNA, 17 nt, Brucella suis 1330
gggaauggcgcgcgcgg

SEQ ID NO: 449460 - RNA, 18 nt, Brucella suis 1330
gggaagugcauaugauga

SEQ ID NO: 449461 - RNA, 18 nt, Brucella suis 1330
gggaauagcaacuuccuu

SEQ ID NO: 449462 - RNA, 13 nt, Brucella suis 1330
gggaagcccagcg

SEQ ID NO: 449463 - RNA, 16 nt, Brucella suis 1330
gggaaaucaguccacu

SEQ ID NO: 449464 - RNA, 18 nt, Brucella suis 1330
ggcuuuuuauccucccau

SEQ ID NO: 449465 - RNA, 16 nt, Brucella suis 1330
ggcuuuucauucugaa

SEQ ID NO: 449466 - RNA, 16 nt, Brucella suis 1330
ggcuuuuccggcggcg

SEQ ID NO: 449467 - RNA, 23 nt, Brucella suis 1330
ggcuuucgccgguccagcggcua

SEQ ID NO: 449468 - RNA, 15 nt, Brucella suis 1330
ggcuuucggucagga

SEQ ID NO: 449469 - RNA, 15 nt, Brucella suis 1330
ggcuuugugaaagcg

SEQ ID NO: 449470 - RNA, 23 nt, Brucella suis 1330
ggcuuggugaaacggccaagcag

SEQ ID NO: 449471 - RNA, 21 nt, Brucella suis 1330
ggcuugccgaccuccccccgc

SEQ ID NO: 449472 - RNA, 12 nt, Brucella suis 1330
ggcuucuuccag

SEQ ID NO: 449473 - RNA, 13 nt, Brucella suis 1330
ggcuuccagcagg

SEQ ID NO: 449474 - RNA, 16 nt, Brucella suis 1330
ggcuucaagcggcguc

SEQ ID NO: 449475 - RNA, 15 nt, Brucella suis 1330
ggcuguuggccggca

SEQ ID NO: 449476 - RNA, 23 nt, Brucella suis 1330
ggcuguuuuccugcccggcauca

SEQ ID NO: 449477 - RNA, 17 nt, Brucella suis 1330
ggcuggucuggcgaggc

SEQ ID NO: 449478 - RNA, 10 nt, Brucella suis 1330
ggcugggccc

SEQ ID NO: 449479 - RNA, 19 nt, Brucella suis 1330
ggcuggcacaaagcggccc

SEQ ID NO: 449480 - RNA, 20 nt, Brucella suis 1330
ggcuggaacgagcuccccgg

SEQ ID NO: 449481 - RNA, 12 nt, Brucella suis 1330
ggcugcggcgcc

SEQ ID NO: 449482 - RNA, 16 nt, Brucella suis 1330
ggcugccgcgugggcg

SEQ ID NO: 449483 - RNA, 20 nt, Brucella suis 1330
ggcugccgggguuuuucuuu

SEQ ID NO: 449484 - RNA, 13 nt, Brucella suis 1330
ggcugcccgccgc

SEQ ID NO: 449485 - RNA, 14 nt, Brucella suis 1330
ggcugcccgccgca

SEQ ID NO: 449486 - RNA, 15 nt, Brucella suis 1330
ggcugcccgcgccgg

SEQ ID NO: 449487 - RNA, 20 nt, Brucella suis 1330
ggcugcccgcgccggucucc

SEQ ID NO: 449488 - RNA, 13 nt, Brucella suis 1330
ggcugcaaauggc

SEQ ID NO: 449489 - RNA, 15 nt, Brucella suis 1330
ggcugcaacaaaaga

SEQ ID NO: 449490 - RNA, 16 nt, Brucella suis 1330
ggcugagggaaacacu

SEQ ID NO: 449491 - RNA, 20 nt, Brucella suis 1330
ggcucucacgcgcagcagca

SEQ ID NO: 449492 - RNA, 13 nt, Brucella suis 1330
ggcucgcucgacu

SEQ ID NO: 449493 - RNA, 13 nt, Brucella suis 1330
ggcucgggcagcu

SEQ ID NO: 449494 - RNA, 23 nt, Brucella suis 1330
ggcucauucuguaaacugccgcg

SEQ ID NO: 449495 - RNA, 14 nt, Brucella suis 1330
ggcucauccuccac

SEQ ID NO: 449496 - RNA, 15 nt, Brucella suis 1330
ggcguauccggcccc

SEQ ID NO: 449497 - RNA, 19 nt, Brucella suis 1330
ggcguagauagcgucagca

SEQ ID NO: 449498 - RNA, 16 nt, Brucella suis 1330
ggcgguucggcugccu

SEQ ID NO: 449499 - RNA, 17 nt, Brucella suis 1330
ggcgguguuucggucca

SEQ ID NO: 449500 - RNA, 13 nt, Brucella suis 1330
ggcgguaaugcug

SEQ ID NO: 449501 - RNA, 14 nt, Brucella suis 1330
ggcgguaaugcugg

SEQ ID NO: 449502 - RNA, 16 nt, Brucella suis 1330
ggcgggagcggcacau

SEQ ID NO: 449503 - RNA, 12 nt, Brucella suis 1330
ggcggcgcucgg

SEQ ID NO: 449504 - RNA, 14 nt, Brucella suis 1330
ggcggcgcggcggc

SEQ ID NO: 449505 - RNA, 21 nt, Brucella suis 1330
ggcggccuugaugcggcggcg

SEQ ID NO: 449506 - RNA, 21 nt, Brucella suis 1330
ggcggccaggacaacgggugc

SEQ ID NO: 449507 - RNA, 22 nt, Brucella suis 1330
ggcggccaggacaacgggugcg

SEQ ID NO: 449508 - RNA, 17 nt, Brucella suis 1330
ggcggcaggcagacaug

SEQ ID NO: 449509 - RNA, 20 nt, Brucella suis 1330
ggcggcaacgggcgagggcg

SEQ ID NO: 449510 - RNA, 23 nt, Brucella suis 1330
ggcggcaaaaagcggcgucagca

SEQ ID NO: 449511 - RNA, 15 nt, Brucella suis 1330
ggcggaucggcagga

SEQ ID NO: 449512 - RNA, 12 nt, Brucella suis 1330
ggcgcugcacac

SEQ ID NO: 449513 - RNA, 12 nt, Brucella suis 1330
ggcgcggcagcu

SEQ ID NO: 449514 - RNA, 12 nt, Brucella suis 1330
ggcgcggcagga

SEQ ID NO: 449515 - RNA, 18 nt, Brucella suis 1330
ggcgcggacaagcucgcg

SEQ ID NO: 449516 - RNA, 23 nt, Brucella suis 1330
ggcgcgcuaugcgugguccagcc

SEQ ID NO: 449517 - RNA, 15 nt, Brucella suis 1330
ggcgcgccaguaggc

SEQ ID NO: 449518 - RNA, 13 nt, Brucella suis 1330
ggcgcgaccugcu

SEQ ID NO: 449519 - RNA, 17 nt, Brucella suis 1330
ggcgccagcgcggauca

SEQ ID NO: 449520 - RNA, 15 nt, Brucella suis 1330
ggcgcaggcagggag

SEQ ID NO: 449521 - RNA, 17 nt, Brucella suis 1330
ggcgcacccgaaaggau

SEQ ID NO: 449522 - RNA, 16 nt, Brucella suis 1330
ggcgcaaagcccagcc

SEQ ID NO: 449523 - RNA, 13 nt, Brucella suis 1330
ggcgaugagcgcc

SEQ ID NO: 449524 - RNA, 17 nt, Brucella suis 1330
ggcgauaccagacgcgc

SEQ ID NO: 449525 - RNA, 21 nt, Brucella suis 1330
ggcgauaauaauuggcaagcg

SEQ ID NO: 449526 - RNA, 12 nt, Brucella suis 1330
aaauaaugccaa

SEQ ID NO: 449527 - RNA, 19 nt, Brucella suis 1330
ggcgagcgccagcguaucc

SEQ ID NO: 449528 - RNA, 18 nt, Brucella suis 1330
ggcgagccgagcggcgca

SEQ ID NO: 449529 - RNA, 17 nt, Brucella suis 1330
ggcgagacagacuggaa

SEQ ID NO: 449530 - RNA, 16 nt, Brucella suis 1330
ggcgacgcgcucgucg

SEQ ID NO: 449531 - RNA, 13 nt, Brucella suis 1330
ggcgacggccagc

SEQ ID NO: 449532 - RNA, 14 nt, Brucella suis 1330
ggcgaaagcugccg

SEQ ID NO: 449533 - RNA, 23 nt, Brucella suis 1330
ggccuuguguuucaccagaugcu

SEQ ID NO: 449534 - RNA, 14 nt, Brucella suis 1330
ggccgaaaauauca

SEQ ID NO: 449535 - RNA, 19 nt, Brucella suis 1330
ggcccugucagcgaaacca

SEQ ID NO: 449536 - RNA, 15 nt, Brucella suis 1330
ggcccuggaaagaag

SEQ ID NO: 449537 - RNA, 20 nt, Brucella suis 1330
ggcccuggaaagaagcgaaa

SEQ ID NO: 449538 - RNA, 16 nt, Brucella suis 1330
ggcccggugcagcggc

SEQ ID NO: 449539 - RNA, 20 nt, Brucella suis 1330
ggcccgcgugcacgcgcaga

SEQ ID NO: 449540 - RNA, 18 nt, Brucella suis 1330
ggcccgcgugugacggau

SEQ ID NO: 449541 - RNA, 11 nt, Brucella suis 1330
aaagugagaaa

SEQ ID NO: 449542 - RNA, 15 nt, Brucella suis 1330
ggcccgaaagcagac

SEQ ID NO: 449543 - RNA, 17 nt, Brucella suis 1330
ggccccuaaagccgcuc

SEQ ID NO: 449544 - RNA, 16 nt, Brucella suis 1330
ggccccaucggguguu

SEQ ID NO: 449545 - RNA, 15 nt, Brucella suis 1330
ggcccaugagcuuca

SEQ ID NO: 449546 - RNA, 15 nt, Brucella suis 1330
ggcccauaccgcgcc

SEQ ID NO: 449547 - RNA, 19 nt, Brucella suis 1330
ggcccaggccucugccucc

SEQ ID NO: 449548 - RNA, 20 nt, Brucella suis 1330
ggcccagcaugucauccgaa

SEQ ID NO: 449549 - RNA, 17 nt, Brucella suis 1330
ggcccagaaccugcccg

SEQ ID NO: 449550 - RNA, 19 nt, Brucella suis 1330
ggcccagaaccugcccguc

SEQ ID NO: 449551 - RNA, 22 nt, Brucella suis 1330
ggccaugaugccgacaagcagc

SEQ ID NO: 449552 - RNA, 21 nt, Brucella suis 1330
ggccagcuugaaaagccguga

SEQ ID NO: 449553 - RNA, 22 nt, Brucella suis 1330
ggccagauugcgccuaccaagg

SEQ ID NO: 449554 - RNA, 19 nt, Brucella suis 1330
ggccagaucgcgcgcggcc

SEQ ID NO: 449555 - RNA, 20 nt, Brucella suis 1330
ggccagaucgcgcgcggccc

SEQ ID NO: 449556 - RNA, 20 nt, Brucella suis 1330
ggccagacauagaccucauu

SEQ ID NO: 449557 - RNA, 21 nt, Brucella suis 1330
ggccacgcgcagaagauaauc

SEQ ID NO: 449558 - RNA, 14 nt, Brucella suis 1330
ggccacgacagggc

SEQ ID NO: 449559 - RNA, 18 nt, Brucella suis 1330
ggccacgacagggcgcug

SEQ ID NO: 449560 - RNA, 21 nt, Brucella suis 1330
ggccacgauagacgcggcggc

SEQ ID NO: 449561 - RNA, 13 nt, Brucella suis 1330
ggccacgaaaugg

SEQ ID NO: 449562 - RNA, 22 nt, Brucella suis 1330
ggccaagcgcaucgguggcauu

SEQ ID NO: 449563 - RNA, 19 nt, Brucella suis 1330
ggcauugaggaucgaccag

SEQ ID NO: 449564 - RNA, 18 nt, Brucella suis 1330
ggcauugcgaagcgacuc

SEQ ID NO: 449565 - RNA, 14 nt, Brucella suis 1330
ggcauuguggugcg

SEQ ID NO: 449566 - RNA, 17 nt, Brucella suis 1330
ggcaucggugcgcggcg

SEQ ID NO: 449567 - RNA, 15 nt, Brucella suis 1330
ggcaucagccucccu

SEQ ID NO: 449568 - RNA, 18 nt, Brucella suis 1330
ggcauccacucggcggca

SEQ ID NO: 449569 - RNA, 16 nt, Brucella suis 1330
ggcaucaaaggagcau

SEQ ID NO: 449570 - RNA, 17 nt, Brucella suis 1330
ggcaggggugcaaagcu

SEQ ID NO: 449571 - RNA, 16 nt, Brucella suis 1330
ggcaggccgccuggga

SEQ ID NO: 449572 - RNA, 13 nt, Brucella suis 1330
ggcaggagcgcga

SEQ ID NO: 449573 - RNA, 12 nt, Brucella suis 1330
ggcaggaggcca

SEQ ID NO: 449574 - RNA, 17 nt, Brucella suis 1330
ggcaggaggccaaaaag

SEQ ID NO: 449575 - RNA, 18 nt, Brucella suis 1330
ggcagccuucgcugccgg

SEQ ID NO: 449576 - RNA, 20 nt, Brucella suis 1330
ggcagauagagguaggacug

SEQ ID NO: 449577 - RNA, 19 nt, Brucella suis 1330
ggcagacggacuucuucac

SEQ ID NO: 449578 - RNA, 22 nt, Brucella suis 1330
ggcaagcuuuucacgcgagcgc

SEQ ID NO: 449579 - RNA, 14 nt, Brucella suis 1330
ggcaacaucgccuu

SEQ ID NO: 449580 - RNA, 16 nt, Brucella suis 1330
ggaugugucggccaga

SEQ ID NO: 449581 - RNA, 16 nt, Brucella suis 1330
ggaugcugccagcagc

SEQ ID NO: 449582 - RNA, 20 nt, Brucella suis 1330
ggaugcgcucuaugcagcau

SEQ ID NO: 449583 - RNA, 21 nt, Brucella suis 1330
ggaugcgcuuuaaagcaggau

SEQ ID NO: 449584 - RNA, 15 nt, Brucella suis 1330
ggaugaugcuuuauu

SEQ ID NO: 449585 - RNA, 11 nt, Brucella suis 1330
ggaugagggag

SEQ ID NO: 449586 - RNA, 14 nt, Brucella suis 1330
ggaucguguagaac

SEQ ID NO: 449587 - RNA, 13 nt, Brucella suis 1330
ggaucggcagcag

SEQ ID NO: 449588 - RNA, 20 nt, Brucella suis 1330
ggaucagugcgcacauuguc

SEQ ID NO: 449589 - RNA, 13 nt, Brucella suis 1330
ggaucauauuugc

SEQ ID NO: 449590 - RNA, 22 nt, Brucella suis 1330
ggaucauccuugaugcccagcu

SEQ ID NO: 449591 - RNA, 13 nt, Brucella suis 1330
ggauagauggaaa

SEQ ID NO: 449592 - RNA, 16 nt, Brucella suis 1330
ggauaaagccuguccu

SEQ ID NO: 449593 - RNA, 14 nt, Brucella suis 1330
ggagccgaagcgca

SEQ ID NO: 449594 - RNA, 16 nt, Brucella suis 1330
ggagccggacgugaca

SEQ ID NO: 449595 - RNA, 21 nt, Brucella suis 1330
ggagagcaugaucgcccgccc

SEQ ID NO: 449596 - RNA, 21 nt, Brucella suis 1330
ggagcaccgcccgucccccaa

SEQ ID NO: 449597 - RNA, 16 nt, Brucella suis 1330
ggacuucuucaccagc

SEQ ID NO: 449598 - RNA, 14 nt, Brucella suis 1330
ggagaaaagauggg

SEQ ID NO: 449599 - RNA, 16 nt, Brucella suis 1330
aaagggugcgagcagg

SEQ ID NO: 449600 - RNA, 21 nt, Brucella suis 1330
ggacgcgugaaaauagcuggg

SEQ ID NO: 449601 - RNA, 18 nt, Brucella suis 1330
ggaccggcgaaaaggcga

SEQ ID NO: 449602 - RNA, 18 nt, Brucella suis 1330
aaaggcucuauuuuucca

SEQ ID NO: 449603 - RNA, 22 nt, Brucella suis 1330
aaaggcucuauuuuuccacgaa

SEQ ID NO: 449604 - RNA, 15 nt, Brucella suis 1330
aaaggcucugcgcca

SEQ ID NO: 449605 - RNA, 23 nt, Brucella suis 1330
ggaauuucuaaaaugaaaagccc

SEQ ID NO: 449606 - RNA, 19 nt, Brucella suis 1330
ggaauggucuggguuucgu

SEQ ID NO: 449607 - RNA, 21 nt, Brucella suis 1330
ggaauaccaagcucguuccag

SEQ ID NO: 449608 - RNA, 14 nt, Brucella suis 1330
ggaagcgcgcguga

SEQ ID NO: 449609 - RNA, 22 nt, Brucella suis 1330
ggaacauauaaagcaaaggccc

SEQ ID NO: 449610 - RNA, 15 nt, Brucella suis 1330
ggaacaggcccagca

SEQ ID NO: 449611 - RNA, 19 nt, Brucella suis 1330
ggaacaauaggcgcgggca

SEQ ID NO: 449612 - RNA, 20 nt, Brucella suis 1330
ggaacaauuccagccgggcu

SEQ ID NO: 449613 - RNA, 18 nt, Brucella suis 1330
gcuuucgauuuuugccag

SEQ ID NO: 449614 - RNA, 16 nt, Brucella suis 1330
gcuuuccggcaaaaaa

SEQ ID NO: 449615 - RNA, 19 nt, Brucella suis 1330
gcuuuccauggucaggcca

SEQ ID NO: 449616 - RNA, 21 nt, Brucella suis 1330
gcuuucccggcuuuuuauccu

SEQ ID NO: 449617 - RNA, 22 nt, Brucella suis 1330
gcuuuccgacagggcaagcgcc

SEQ ID NO: 449618 - RNA, 16 nt, Brucella suis 1330
gcuuuaugcaaggccg

SEQ ID NO: 449619 - RNA, 16 nt, Brucella suis 1330
gcuuuauucaaccguu

SEQ ID NO: 449620 - RNA, 20 nt, Brucella suis 1330
gcuuucaaauucggcuauaa

SEQ ID NO: 449621 - RNA, 12 nt, Brucella suis 1330
gcuuucaaugcu

SEQ ID NO: 449622 - RNA, 19 nt, Brucella suis 1330
aaaggccuccguaacaauu

SEQ ID NO: 449623 - RNA, 23 nt, Brucella suis 1330
aaaggcgauggcuugcggcacug

SEQ ID NO: 449624 - RNA, 24 nt, Brucella suis 1330
aaaggcgauguuuucaccagucac

SEQ ID NO: 449625 - RNA, 16 nt, Brucella suis 1330
aaaggauucgaaccuc

SEQ ID NO: 449626 - RNA, 16 nt, Brucella suis 1330
gcuuggccucuuccag

SEQ ID NO: 449627 - RNA, 15 nt, Brucella suis 1330
gcuugcgcccgcggu

SEQ ID NO: 449628 - RNA, 22 nt, Brucella suis 1330
gcuugccgaccuccccccgcgu

SEQ ID NO: 449629 - RNA, 17 nt, Brucella suis 1330
gcuugccgaccuugagc

SEQ ID NO: 449630 - RNA, 19 nt, Brucella suis 1330
gcuugccauucuccgcagc

SEQ ID NO: 449631 - RNA, 21 nt, Brucella suis 1330
gcuugauggcgagcuggaaac

SEQ ID NO: 449632 - RNA, 19 nt, Brucella suis 1330
gcuugcaugguucuggaau

SEQ ID NO: 449633 - RNA, 12 nt, Brucella suis 1330
gcuugcauucca

SEQ ID NO: 449634 - RNA, 21 nt, Brucella suis 1330
gcuugaugacgccaucuucuu

SEQ ID NO: 449635 - RNA, 21 nt, Brucella suis 1330
gcuugagcgucaggccgauga

SEQ ID NO: 449636 - RNA, 18 nt, Brucella suis 1330
gcuugaggaucgucugac

SEQ ID NO: 449637 - RNA, 14 nt, Brucella suis 1330
gcuugaacaaaacc

SEQ ID NO: 449638 - RNA, 18 nt, Brucella suis 1330
gcuucuuccuucggcaag

SEQ ID NO: 449639 - RNA, 14 nt, Brucella suis 1330
gcuucgcgcaggcc

SEQ ID NO: 449640 - RNA, 15 nt, Brucella suis 1330
gcuucgcacuuuugc

SEQ ID NO: 449641 - RNA, 20 nt, Brucella suis 1330
gcuuccuugcgcuugcgaug

SEQ ID NO: 449642 - RNA, 15 nt, Brucella suis 1330
gcuuccggcguggug

SEQ ID NO: 449643 - RNA, 17 nt, Brucella suis 1330
gcuuccagcaggcgcgc

SEQ ID NO: 449644 - RNA, 19 nt, Brucella suis 1330
gcuucauaucguugccgau

SEQ ID NO: 449645 - RNA, 22 nt, Brucella suis 1330
gcuucaggcacucuccucugcc

SEQ ID NO: 449646 - RNA, 23 nt, Brucella suis 1330
gcuucaacgccguggcggcuggc

SEQ ID NO: 449647 - RNA, 16 nt, Brucella suis 1330
gcuguagcagcaacag

SEQ ID NO: 449648 - RNA, 21 nt, Brucella suis 1330
aaaggaugaugaccugacuug

SEQ ID NO: 449649 - RNA, 18 nt, Brucella suis 1330
gcuggaugucgauuucac

SEQ ID NO: 449650 - RNA, 15 nt, Brucella suis 1330
gcuggaaccagcgug

SEQ ID NO: 449651 - RNA, 23 nt, Brucella suis 1330
gcuggaacgagcuccccggcggg

SEQ ID NO: 449652 - RNA, 17 nt, Brucella suis 1330
gcugcugcgugcugcuu

SEQ ID NO: 449653 - RNA, 17 nt, Brucella suis 1330
gcugcguuucggcggcu

SEQ ID NO: 449654 - RNA, 18 nt, Brucella suis 1330
gcugcgagaacacgccga

SEQ ID NO: 449655 - RNA, 20 nt, Brucella suis 1330
gcugccuuuagccaagccau

SEQ ID NO: 449656 - RNA, 18 nt, Brucella suis 1330
gcugccgcaauccuggug

SEQ ID NO: 449657 - RNA, 13 nt, Brucella suis 1330
gcugccagccgcg

SEQ ID NO: 449658 - RNA, 13 nt, Brucella suis 1330
gcugcaauggucg

SEQ ID NO: 449659 - RNA, 17 nt, Brucella suis 1330
gcugcaaagggugcaag

SEQ ID NO: 449660 - RNA, 13 nt, Brucella suis 1330
gcugcaacaaaug

SEQ ID NO: 449661 - RNA, 21 nt, Brucella suis 1330
gcugcaacaaaugcaaaugcc

SEQ ID NO: 449662 - RNA, 16 nt, Brucella suis 1330
gcugaucgcaagcagg

SEQ ID NO: 449663 - RNA, 15 nt, Brucella suis 1330
gcugaucggcgcagg

SEQ ID NO: 449664 - RNA, 18 nt, Brucella suis 1330
gcugauucuggauuucau

SEQ ID NO: 449665 - RNA, 12 nt, Brucella suis 1330
gcugauuuaggc

SEQ ID NO: 449666 - RNA, 22 nt, Brucella suis 1330
gcugagcagauaggcguugaug

SEQ ID NO: 449667 - RNA, 18 nt, Brucella suis 1330
gcugaagcggccuaccau

SEQ ID NO: 449668 - RNA, 19 nt, Brucella suis 1330
gcucucgcauugagcgccc

SEQ ID NO: 449669 - RNA, 17 nt, Brucella suis 1330
gcucuauacgaugcaga

SEQ ID NO: 449670 - RNA, 14 nt, Brucella suis 1330
gcucuauccagcug

SEQ ID NO: 449671 - RNA, 23 nt, Brucella suis 1330
gcucuaucguuguugaagagccu

SEQ ID NO: 449672 - RNA, 22 nt, Brucella suis 1330
gcucgucgccucauggcggcgc

SEQ ID NO: 449673 - RNA, 15 nt, Brucella suis 1330
gcucgcccagaaaca

SEQ ID NO: 449674 - RNA, 13 nt, Brucella suis 1330
gcucgaucuggcc

SEQ ID NO: 449675 - RNA, 20 nt, Brucella suis 1330
gcucgauaagauugcggcug

SEQ ID NO: 449676 - RNA, 12 nt, Brucella suis 1330
gcucgaaaaugc

SEQ ID NO: 449677 - RNA, 16 nt, Brucella suis 1330
gcuccugguucaucag

SEQ ID NO: 449678 - RNA, 13 nt, Brucella suis 1330
gcuccuuccugcg

SEQ ID NO: 449679 - RNA, 22 nt, Brucella suis 1330
gcuccugcgucgcauccagaac

SEQ ID NO: 449680 - RNA, 10 nt, Brucella suis 1330
gcuccagcuc

SEQ ID NO: 449681 - RNA, 18 nt, Brucella suis 1330
gcuccagauugcgggcaa

SEQ ID NO: 449682 - RNA, 20 nt, Brucella suis 1330
gcuccagauugcgggcaagc

SEQ ID NO: 449683 - RNA, 22 nt, Brucella suis 1330
gcuccagauugcgggcaagcau

SEQ ID NO: 449684 - RNA, 16 nt, Brucella suis 1330
gcucaucgcaguugca

SEQ ID NO: 449685 - RNA, 20 nt, Brucella suis 1330
gcucauauggaugccgccgc

SEQ ID NO: 449686 - RNA, 16 nt, Brucella suis 1330
gcggguagccgccauu

SEQ ID NO: 449687 - RNA, 15 nt, Brucella suis 1330
gcgggcuucuuccag

SEQ ID NO: 449688 - RNA, 19 nt, Brucella suis 1330
gcgggcuucuuccaguucc

SEQ ID NO: 449689 - RNA, 20 nt, Brucella suis 1330
gcgggcuuuuucguaucggg

SEQ ID NO: 449690 - RNA, 21 nt, Brucella suis 1330
gcgggccauuuccaaugccuc

SEQ ID NO: 449691 - RNA, 14 nt, Brucella suis 1330
gcgggcaugggcac

SEQ ID NO: 449692 - RNA, 21 nt, Brucella suis 1330
gcgggcauugcggauacccau

SEQ ID NO: 449693 - RNA, 16 nt, Brucella suis 1330
gcgggagcggcacaug

SEQ ID NO: 449694 - RNA, 14 nt, Brucella suis 1330
gcgggaaggcgcga

SEQ ID NO: 449695 - RNA, 20 nt, Brucella suis 1330
gcggcuuuccagcgggcgcg

SEQ ID NO: 449696 - RNA, 14 nt, Brucella suis 1330
gcggcuugccacca

SEQ ID NO: 449697 - RNA, 14 nt, Brucella suis 1330
gcggcuugccagau

SEQ ID NO: 449698 - RNA, 23 nt, Brucella suis 1330
gcggcuggaacgagcuccccggc

SEQ ID NO: 449699 - RNA, 17 nt, Brucella suis 1330
gcggcucaagcuccagc

SEQ ID NO: 449700 - RNA, 21 nt, Brucella suis 1330
gcggcuaauggcgguuucgau

SEQ ID NO: 449701 - RNA, 18 nt, Brucella suis 1330
gcggcgguucggcugccu

SEQ ID NO: 449702 - RNA, 23 nt, Brucella suis 1330
gcggcgguuuugagcugcugggu

SEQ ID NO: 449703 - RNA, 19 nt, Brucella suis 1330
gcggcggcguuccagcuuc

SEQ ID NO: 449704 - RNA, 21 nt, Brucella suis 1330
gcggcgcggcaggaucgccag

SEQ ID NO: 449705 - RNA, 17 nt, Brucella suis 1330
gcggcgcggcggcaccg

SEQ ID NO: 449706 - RNA, 14 nt, Brucella suis 1330
gcggcgccaaccau

SEQ ID NO: 449707 - RNA, 13 nt, Brucella suis 1330
gcggccagccagc

SEQ ID NO: 449708 - RNA, 21 nt, Brucella suis 1330
gcggccacaagcgccgguucg

SEQ ID NO: 449709 - RNA, 24 nt, Brucella suis 1330
gcggccaacgccacgaaccguguu

SEQ ID NO: 449710 - RNA, 20 nt, Brucella suis 1330
gcggcauggcguagaaauag

SEQ ID NO: 449711 - RNA, 16 nt, Brucella suis 1330
gcggcaugaaagcgca

SEQ ID NO: 449712 - RNA, 18 nt, Brucella suis 1330
gcggcauauugcggcgga

SEQ ID NO: 449713 - RNA, 17 nt, Brucella suis 1330
gcggcagcggaccgcaa

SEQ ID NO: 449714 - RNA, 17 nt, Brucella suis 1330
gcggcacgucggacuuc

SEQ ID NO: 449715 - RNA, 16 nt, Brucella suis 1330
gcggcacgaugcgcag

SEQ ID NO: 449716 - RNA, 19 nt, Brucella suis 1330
gcggcacgaugcgcagccg

SEQ ID NO: 449717 - RNA, 14 nt, Brucella suis 1330
gcggcaacggcgcu

SEQ ID NO: 449718 - RNA, 21 nt, Brucella suis 1330
gcggcaagauaagcgccguug

SEQ ID NO: 449719 - RNA, 16 nt, Brucella suis 1330
gcggauugcuguugcg

SEQ ID NO: 449720 - RNA, 16 nt, Brucella suis 1330
gcggaucgugacccgc

SEQ ID NO: 449721 - RNA, 12 nt, Brucella suis 1330
gcggaucggcag

SEQ ID NO: 449722 - RNA, 13 nt, Brucella suis 1330
gcggaaaggcuuc

SEQ ID NO: 449723 - RNA, 18 nt, Brucella suis 1330
gcggaacacgccgccaua

SEQ ID NO: 449724 - RNA, 19 nt, Brucella suis 1330
gcggaagcauauguuccug

SEQ ID NO: 449725 - RNA, 16 nt, Brucella suis 1330
gcggaaaacggcugca

SEQ ID NO: 449726 - RNA, 22 nt, Brucella suis 1330
gcggaaaauguuccgcaccgca

SEQ ID NO: 449727 - RNA, 23 nt, Brucella suis 1330
gcgcuuaugugaagauuucuugc

SEQ ID NO: 449728 - RNA, 14 nt, Brucella suis 1330
gcgcugucgccugu

SEQ ID NO: 449729 - RNA, 19 nt, Brucella suis 1330
gcgcucuaaccauuuguuu

SEQ ID NO: 449730 - RNA, 17 nt, Brucella suis 1330
gcgcucggugccgcgcg

SEQ ID NO: 449731 - RNA, 15 nt, Brucella suis 1330
gcgcucgcggcuggu

SEQ ID NO: 449732 - RNA, 14 nt, Brucella suis 1330
gcgcggcgcauggc

SEQ ID NO: 449733 - RNA, 17 nt, Brucella suis 1330
gcgcggcaggaucgcca

SEQ ID NO: 449734 - RNA, 23 nt, Brucella suis 1330
gcgcggaaaauguuccgcaccgc

SEQ ID NO: 449735 - RNA, 20 nt, Brucella suis 1330
gcgcggcaacgcuggcgcgc

SEQ ID NO: 449736 - RNA, 14 nt, Brucella suis 1330
gcgcgcgccgccau

SEQ ID NO: 449737 - RNA, 21 nt, Brucella suis 1330
gcgcgauuuuuccguggugcu

SEQ ID NO: 449738 - RNA, 15 nt, Brucella suis 1330
gcgcgaccugcucga

SEQ ID NO: 449739 - RNA, 22 nt, Brucella suis 1330
gcgcgaccugcucgaucuggcc

SEQ ID NO: 449740 - RNA, 22 nt, Brucella suis 1330
gcgcgaacaugccugccgcagc

SEQ ID NO: 449741 - RNA, 19 nt, Brucella suis 1330
gcgccuucauucuuucaga

SEQ ID NO: 449742 - RNA, 17 nt, Brucella suis 1330
gcgccuguguggcccug

SEQ ID NO: 449743 - RNA, 23 nt, Brucella suis 1330
gcgccgucgggaccaccggccug

SEQ ID NO: 449744 - RNA, 18 nt, Brucella suis 1330
gcgccggucuucauggcu

SEQ ID NO: 449745 - RNA, 17 nt, Brucella suis 1330
gcgccggucuccucagc

SEQ ID NO: 449746 - RNA, 16 nt, Brucella suis 1330
gcgccggaaugggccu

SEQ ID NO: 449747 - RNA, 17 nt, Brucella suis 1330
gcgccggaaugggccug

SEQ ID NO: 449748 - RNA, 18 nt, Brucella suis 1330
gcgccggaaugggccuga

SEQ ID NO: 449749 - RNA, 14 nt, Brucella suis 1330
gcgccggaaacacc

SEQ ID NO: 449750 - RNA, 17 nt, Brucella suis 1330
gcgccgcuugccagcac

SEQ ID NO: 449751 - RNA, 20 nt, Brucella suis 1330
gcgccggaagauggagcggc

SEQ ID NO: 449752 - RNA, 18 nt, Brucella suis 1330
gcgccggaaggcggggcu

SEQ ID NO: 449753 - RNA, 12 nt, Brucella suis 1330
gcgccgcuggug

SEQ ID NO: 449754 - RNA, 14 nt, Brucella suis 1330
gcgccgcauggcgg

SEQ ID NO: 449755 - RNA, 18 nt, Brucella suis 1330
gcgccgccaagggccgcc

SEQ ID NO: 449756 - RNA, 21 nt, Brucella suis 1330
gcgccgaugcggggaaaucag

SEQ ID NO: 449757 - RNA, 14 nt, Brucella suis 1330
gcgccgaugaggcc

SEQ ID NO: 449758 - RNA, 14 nt, Brucella suis 1330
gcgccgauaccaag

SEQ ID NO: 449759 - RNA, 16 nt, Brucella suis 1330
gcgccgauaccaaggc

SEQ ID NO: 449760 - RNA, 18 nt, Brucella suis 1330
gcgccgauauagacgcca

SEQ ID NO: 449761 - RNA, 20 nt, Brucella suis 1330
gcgccgaacagcgcccagag

SEQ ID NO: 449762 - RNA, 19 nt, Brucella suis 1330
gcgccgaaccgggccgcau

SEQ ID NO: 449763 - RNA, 14 nt, Brucella suis 1330
gcgcccucgcgcuc

SEQ ID NO: 449764 - RNA, 22 nt, Brucella suis 1330
gcgcccgccuuuaccgccgggg

SEQ ID NO: 449765 - RNA, 13 nt, Brucella suis 1330
gcgcccaggcgcc

SEQ ID NO: 449766 - RNA, 12 nt, Brucella suis 1330
gcgcccagggaa

SEQ ID NO: 449767 - RNA, 19 nt, Brucella suis 1330
gcgcccacuuugccgucuu

SEQ ID NO: 449768 - RNA, 22 nt, Brucella suis 1330
gcgccauaaccucgacggcggc

SEQ ID NO: 449769 - RNA, 20 nt, Brucella suis 1330
gcgccagucauugacggcag

SEQ ID NO: 449770 - RNA, 21 nt, Brucella suis 1330
gcgccagucauugacggcagc

SEQ ID NO: 449771 - RNA, 23 nt, Brucella suis 1330
gcgccagucauugacggcagccu

SEQ ID NO: 449772 - RNA, 12 nt, Brucella suis 1330
gcgccagcuucc

SEQ ID NO: 449773 - RNA, 22 nt, Brucella suis 1330
gcgccagcuuccgucagggccg

SEQ ID NO: 449774 - RNA, 18 nt, Brucella suis 1330
gcgccagccgccagcagg

SEQ ID NO: 449775 - RNA, 15 nt, Brucella suis 1330
gcgccagcacucugc

SEQ ID NO: 449776 - RNA, 12 nt, Brucella suis 1330
gcgccagaaaga

SEQ ID NO: 449777 - RNA, 15 nt, Brucella suis 1330
gcgccagaugcgcaa

SEQ ID NO: 449778 - RNA, 14 nt, Brucella suis 1330
gcgccaaggcugcg

SEQ ID NO: 449779 - RNA, 12 nt, Brucella suis 1330
gcgcauuuuccg

SEQ ID NO: 449780 - RNA, 20 nt, Brucella suis 1330
gcgcauggguggugcccggu

SEQ ID NO: 449781 - RNA, 14 nt, Brucella suis 1330
gcgcauggcagcaa

SEQ ID NO: 449782 - RNA, 17 nt, Brucella suis 1330
gcgcauaucgcgcgacc

SEQ ID NO: 449783 - RNA, 15 nt, Brucella suis 1330
gcgcauaaaggccga

SEQ ID NO: 449784 - RNA, 13 nt, Brucella suis 1330
gcgcagcggcagc

SEQ ID NO: 449785 - RNA, 13 nt, Brucella suis 1330
gcgcagcgcgacc

SEQ ID NO: 449786 - RNA, 21 nt, Brucella suis 1330
gcgcagcgacagcggcgcgcc

SEQ ID NO: 449787 - RNA, 19 nt, Brucella suis 1330
gcgcagauggggcuggccg

SEQ ID NO: 449788 - RNA, 16 nt, Brucella suis 1330
gcgcagaucggcgagc

SEQ ID NO: 449789 - RNA, 19 nt, Brucella suis 1330
gcgcagaucggcgagcgcc

SEQ ID NO: 449790 - RNA, 18 nt, Brucella suis 1330
gcgcagauauggcgccug

SEQ ID NO: 449791 - RNA, 23 nt, Brucella suis 1330
gcgcagaagauugaugauaggcu

SEQ ID NO: 449792 - RNA, 11 nt, Brucella suis 1330
gcgcagaaggc

SEQ ID NO: 449793 - RNA, 17 nt, Brucella suis 1330
gcgcacgccugccgcgc

SEQ ID NO: 449794 - RNA, 23 nt, Brucella suis 1330
gcgcacaccgaacugggcggcca

SEQ ID NO: 449795 - RNA, 18 nt, Brucella suis 1330
gcgcaauugcgcaaggcc

SEQ ID NO: 449796 - RNA, 16 nt, Brucella suis 1330
gcgcaauugcgcgccu

SEQ ID NO: 449797 - RNA, 13 nt, Brucella suis 1330
gcgcaauggcugu

SEQ ID NO: 449798 - RNA, 18 nt, Brucella suis 1330
gcgcaaugugcuggcggc

SEQ ID NO: 449799 - RNA, 15 nt, Brucella suis 1330
gcgcaauucaugccc

SEQ ID NO: 449800 - RNA, 15 nt, Brucella suis 1330
gcgcaaugcccucuu

SEQ ID NO: 449801 - RNA, 16 nt, Brucella suis 1330
gcgcaaggucucgaca

SEQ ID NO: 449802 - RNA, 17 nt, Brucella suis 1330
gcgcaagauuuuggcga

SEQ ID NO: 449803 - RNA, 13 nt, Brucella suis 1330
gcgcaaggcccuc

SEQ ID NO: 449804 - RNA, 18 nt, Brucella suis 1330
gcgcaacuguucgggcgu

SEQ ID NO: 449805 - RNA, 19 nt, Brucella suis 1330
gcgcaaccaaaacauacuc

SEQ ID NO: 449806 - RNA, 21 nt, Brucella suis 1330
gcgauugcgcuccugcgugcg

SEQ ID NO: 449807 - RNA, 17 nt, Brucella suis 1330
gcgauuuccuugccgcu

SEQ ID NO: 449808 - RNA, 17 nt, Brucella suis 1330
gcgcaaagcccagccgu

SEQ ID NO: 449809 - RNA, 13 nt, Brucella suis 1330
gcgcaaagcgcgc

SEQ ID NO: 449810 - RNA, 14 nt, Brucella suis 1330
gcgcaaagcgcgcg

SEQ ID NO: 449811 - RNA, 13 nt, Brucella suis 1330
gcgcaaaggccgg

SEQ ID NO: 449812 - RNA, 15 nt, Brucella suis 1330
gcgcaaaggccgggu

SEQ ID NO: 449813 - RNA, 15 nt, Brucella suis 1330
gcgaugcccaucgca

SEQ ID NO: 449814 - RNA, 18 nt, Brucella suis 1330
gcgaugauagcgcccgcc

SEQ ID NO: 449815 - RNA, 17 nt, Brucella suis 1330
gcgaugaagaccuggaa

SEQ ID NO: 449816 - RNA, 19 nt, Brucella suis 1330
gcgaugaagcgggccgcuu

SEQ ID NO: 449817 - RNA, 20 nt, Brucella suis 1330
gcgaucuucugcucggcgag

SEQ ID NO: 449818 - RNA, 20 nt, Brucella suis 1330
gcgaucaacgcuuugaccgc

SEQ ID NO: 449819 - RNA, 16 nt, Brucella suis 1330
gcgauagcuuucuaug

SEQ ID NO: 449820 - RNA, 23 nt, Brucella suis 1330
gcgagcuugcaaugagcgcgcuu

SEQ ID NO: 449821 - RNA, 14 nt, Brucella suis 1330
gcgaggaagagaau

SEQ ID NO: 449822 - RNA, 15 nt, Brucella suis 1330
gcgagccgggaaugc

SEQ ID NO: 449823 - RNA, 17 nt, Brucella suis 1330
gcgagccgagcggcgca

SEQ ID NO: 449824 - RNA, 13 nt, Brucella suis 1330
gcgacuccuugua

SEQ ID NO: 449825 - RNA, 14 nt, Brucella suis 1330
gcgacggccagcgc

SEQ ID NO: 449826 - RNA, 15 nt, Brucella suis 1330
gcgaagcucaucggg

SEQ ID NO: 449827 - RNA, 13 nt, Brucella suis 1330
gcgaagaacagaa

SEQ ID NO: 449828 - RNA, 21 nt, Brucella suis 1330
gcgaagaacagaagcaccagc

SEQ ID NO: 449829 - RNA, 20 nt, Brucella suis 1330
gcgaacaugccugccgcagc

SEQ ID NO: 449830 - RNA, 14 nt, Brucella suis 1330
gcgaaaugccgaua

SEQ ID NO: 449831 - RNA, 16 nt, Brucella suis 1330
gcgaaaugcgcgcggc

SEQ ID NO: 449832 - RNA, 13 nt, Brucella suis 1330
gcgaaaucgccac

SEQ ID NO: 449833 - RNA, 16 nt, Brucella suis 1330
gccuuuuucaguuuca

SEQ ID NO: 449834 - RNA, 19 nt, Brucella suis 1330
gcgaaacggagaaaacgcc

SEQ ID NO: 449835 - RNA, 12 nt, Brucella suis 1330
gcgaaagcaccc

SEQ ID NO: 449836 - RNA, 16 nt, Brucella suis 1330
gcgaaagcacccgcuu

SEQ ID NO: 449837 - RNA, 15 nt, Brucella suis 1330
gcgaaagccagaacc

SEQ ID NO: 449838 - RNA, 22 nt, Brucella suis 1330
gccuuggcgaucagcgcaagaa

SEQ ID NO: 449839 - RNA, 15 nt, Brucella suis 1330
gccuuggaugccgca

SEQ ID NO: 449840 - RNA, 17 nt, Brucella suis 1330
gccuuucaggucgucuu

SEQ ID NO: 449841 - RNA, 21 nt, Brucella suis 1330
gccuuucaggucgucuuucag

SEQ ID NO: 449842 - RNA, 19 nt, Brucella suis 1330
gccuuugcgccggguuuug

SEQ ID NO: 449843 - RNA, 14 nt, Brucella suis 1330
gccuuugcgcgccu

SEQ ID NO: 449844 - RNA, 12 nt, Brucella suis 1330
gccuuugcuuca

SEQ ID NO: 449845 - RNA, 16 nt, Brucella suis 1330
gccuuuguuuucauug

SEQ ID NO: 449846 - RNA, 14 nt, Brucella suis 1330
gccuugaauagcgg

SEQ ID NO: 449847 - RNA, 19 nt, Brucella suis 1330
gccuugagggcagcgguca

SEQ ID NO: 449848 - RNA, 15 nt, Brucella suis 1330
gccuucggcaccaca

SEQ ID NO: 449849 - RNA, 18 nt, Brucella suis 1330
gccuucagcacauccugc

SEQ ID NO: 449850 - RNA, 18 nt, Brucella suis 1330
gccuguuuccggguuuuu

SEQ ID NO: 449851 - RNA, 24 nt, Brucella suis 1330
gccuguuucaguuuguugaaacag

SEQ ID NO: 449852 - RNA, 15 nt, Brucella suis 1330
gccuguuccugcaug

SEQ ID NO: 449853 - RNA, 13 nt, Brucella suis 1330
gccuguccgccug

SEQ ID NO: 449854 - RNA, 15 nt, Brucella suis 1330
gccuguccgccugcc

SEQ ID NO: 449855 - RNA, 16 nt, Brucella suis 1330
gccugggugaggcugg

SEQ ID NO: 449856 - RNA, 22 nt, Brucella suis 1330
gccugggugaggcuggcgccgc

SEQ ID NO: 449857 - RNA, 14 nt, Brucella suis 1330
gccugggcuuucaa

SEQ ID NO: 449858 - RNA, 12 nt, Brucella suis 1330
gccuggcccggc

SEQ ID NO: 449859 - RNA, 17 nt, Brucella suis 1330
gccugccgcgcgggcaa

SEQ ID NO: 449860 - RNA, 17 nt, Brucella suis 1330
gccucugucaccugacg

SEQ ID NO: 449861 - RNA, 16 nt, Brucella suis 1330
gccucuuccaggagag

SEQ ID NO: 449862 - RNA, 18 nt, Brucella suis 1330
gccucgcaggcaaagcgg

SEQ ID NO: 449863 - RNA, 23 nt, Brucella suis 1330
gccucauugucgcauccaugagc

SEQ ID NO: 449864 - RNA, 18 nt, Brucella suis 1330
gccguuccucuuccucaa

SEQ ID NO: 449865 - RNA, 22 nt, Brucella suis 1330
gccgugagcauggcaaggccac

SEQ ID NO: 449866 - RNA, 14 nt, Brucella suis 1330
gccgugaccagcgc

SEQ ID NO: 449867 - RNA, 22 nt, Brucella suis 1330
gccgugaaaggugaaggccugc

SEQ ID NO: 449868 - RNA, 14 nt, Brucella suis 1330
gccgucaaaggaaa

SEQ ID NO: 449869 - RNA, 21 nt, Brucella suis 1330
gccggaaagguguccuccagc

SEQ ID NO: 449870 - RNA, 23 nt, Brucella suis 1330
gccgcuuugcggaggcggcugcc

SEQ ID NO: 449871 - RNA, 22 nt, Brucella suis 1330
gccggaaacaccgccuguccgg

SEQ ID NO: 449872 - RNA, 12 nt, Brucella suis 1330
gccggaaacacg

SEQ ID NO: 449873 - RNA, 18 nt, Brucella suis 1330
gccggaaacacggauaga

SEQ ID NO: 449874 - RNA, 15 nt, Brucella suis 1330
gccgcuuccagcauc

SEQ ID NO: 449875 - RNA, 18 nt, Brucella suis 1330
gccgcuuccagcauccgc

SEQ ID NO: 449876 - RNA, 20 nt, Brucella suis 1330
gccgcuggugcgauccacca

SEQ ID NO: 449877 - RNA, 12 nt, Brucella suis 1330
gccgcugcgcag

SEQ ID NO: 449878 - RNA, 13 nt, Brucella suis 1330
gccgcugcgcaga

SEQ ID NO: 449879 - RNA, 17 nt, Brucella suis 1330
gccgcucaugcgguaga

SEQ ID NO: 449880 - RNA, 20 nt, Brucella suis 1330
gccgcuccagccgagcgcca

SEQ ID NO: 449881 - RNA, 13 nt, Brucella suis 1330
gccgcuauuugag

SEQ ID NO: 449882 - RNA, 15 nt, Brucella suis 1330
gccgcgugggcgcga

SEQ ID NO: 449883 - RNA, 15 nt, Brucella suis 1330
gccgcgucagccggu

SEQ ID NO: 449884 - RNA, 21 nt, Brucella suis 1330
gccgcggcguuucggaauaga

SEQ ID NO: 449885 - RNA, 16 nt, Brucella suis 1330
gccgcggcgcgaccug

SEQ ID NO: 449886 - RNA, 14 nt, Brucella suis 1330
gccgcgcuccagau

SEQ ID NO: 449887 - RNA, 14 nt, Brucella suis 1330
gccgcgcggcagcg

SEQ ID NO: 449888 - RNA, 18 nt, Brucella suis 1330
gccgcgccgaucaucagc

SEQ ID NO: 449889 - RNA, 17 nt, Brucella suis 1330
gccgcgcacuggcagca

SEQ ID NO: 449890 - RNA, 19 nt, Brucella suis 1330
gccgcgauugcaucggcag

SEQ ID NO: 449891 - RNA, 21 nt, Brucella suis 1330
gccgcgauugcaucggcagcu

SEQ ID NO: 449892 - RNA, 17 nt, Brucella suis 1330
gccgcgcaaguuccgca

SEQ ID NO: 449893 - RNA, 19 nt, Brucella suis 1330
gccgcgaucacagccgcgc

SEQ ID NO: 449894 - RNA, 17 nt, Brucella suis 1330
gccgcgaucacggccau

SEQ ID NO: 449895 - RNA, 16 nt, Brucella suis 1330
gccgcgaaccgucgcc

SEQ ID NO: 449896 - RNA, 19 nt, Brucella suis 1330
gccgcgaaaaccggcuggc

SEQ ID NO: 449897 - RNA, 16 nt, Brucella suis 1330
gccgcccgacagaaug

SEQ ID NO: 449898 - RNA, 15 nt, Brucella suis 1330
gccgccagcaggccg

SEQ ID NO: 449899 - RNA, 13 nt, Brucella suis 1330
gccgccgcagacc

SEQ ID NO: 449900 - RNA, 14 nt, Brucella suis 1330
gccgccgcagacca

SEQ ID NO: 449901 - RNA, 20 nt, Brucella suis 1330
gccgccgcagaccacccggc

SEQ ID NO: 449902 - RNA, 23 nt, Brucella suis 1330
gccgcaugaacaugcgccacuuc

SEQ ID NO: 449903 - RNA, 15 nt, Brucella suis 1330
gccgcacguuccgca

SEQ ID NO: 449904 - RNA, 23 nt, Brucella suis 1330
gccgcaagcgugagaccagcgca

SEQ ID NO: 449905 - RNA, 23 nt, Brucella suis 1330
gccgcaagcuggaaccagcgugc

SEQ ID NO: 449906 - RNA, 17 nt, Brucella suis 1330
gccgcaaccggcgggcg

SEQ ID NO: 449907 - RNA, 19 nt, Brucella suis 1330
gccgaugacggcgcggcgc

SEQ ID NO: 449908 - RNA, 15 nt, Brucella suis 1330
gccgaucugauucaa

SEQ ID NO: 449909 - RNA, 20 nt, Brucella suis 1330
gccgaucugauucaaucaga

SEQ ID NO: 449910 - RNA, 18 nt, Brucella suis 1330
gccgauaugccgacgcgc

SEQ ID NO: 449911 - RNA, 13 nt, Brucella suis 1330
gccgagcugcaag

SEQ ID NO: 449912 - RNA, 21 nt, Brucella suis 1330
gccgagcugcaagggaaugcg

SEQ ID NO: 449913 - RNA, 20 nt, Brucella suis 1330
gccgagcgaacgcuccugca

SEQ ID NO: 449914 - RNA, 14 nt, Brucella suis 1330
gccgagcgccgccg

SEQ ID NO: 449915 - RNA, 15 nt, Brucella suis 1330
gccgagcgccgccgc

SEQ ID NO: 449916 - RNA, 18 nt, Brucella suis 1330
gccgagauugggcagcag

SEQ ID NO: 449917 - RNA, 22 nt, Brucella suis 1330
gccgagaaugaccacgccgagg

SEQ ID NO: 449918 - RNA, 17 nt, Brucella suis 1330
gccgagaucacccagaa

SEQ ID NO: 449919 - RNA, 19 nt, Brucella suis 1330
gccgacaaaaaacaccgcg

SEQ ID NO: 449920 - RNA, 14 nt, Brucella suis 1330
gccgaacccgccga

SEQ ID NO: 449921 - RNA, 20 nt, Brucella suis 1330
gcccugucagaaagucugcu

SEQ ID NO: 449922 - RNA, 23 nt, Brucella suis 1330
gcccugucagaaagucugcuucc

SEQ ID NO: 449923 - RNA, 11 nt, Brucella suis 1330
gcccugucagc

SEQ ID NO: 449924 - RNA, 15 nt, Brucella suis 1330
gcccuggaaagaagc

SEQ ID NO: 449925 - RNA, 16 nt, Brucella suis 1330
gcccuggaaagaagcg

SEQ ID NO: 449926 - RNA, 11 nt, Brucella suis 1330
gcccggcugga

SEQ ID NO: 449927 - RNA, 22 nt, Brucella suis 1330
gcccggcggugaagaagcgcca

SEQ ID NO: 449928 - RNA, 20 nt, Brucella suis 1330
gcccggcauccgaggcgcgc

SEQ ID NO: 449929 - RNA, 19 nt, Brucella suis 1330
gcccgcuuuuacgcgccgc

SEQ ID NO: 449930 - RNA, 14 nt, Brucella suis 1330
gcccggaagcgaaa

SEQ ID NO: 449931 - RNA, 21 nt, Brucella suis 1330
gcccggaagcgcaaggcggcg

SEQ ID NO: 449932 - RNA, 14 nt, Brucella suis 1330
gcccgcugcgccgc

SEQ ID NO: 449933 - RNA, 13 nt, Brucella suis 1330
gcccgcgccgcuu

SEQ ID NO: 449934 - RNA, 23 nt, Brucella suis 1330
gcccgcgccggucuccucagcua

SEQ ID NO: 449935 - RNA, 17 nt, Brucella suis 1330
gcccgccuuugccgcaa

SEQ ID NO: 449936 - RNA, 14 nt, Brucella suis 1330
gcccgccuuggaaa

SEQ ID NO: 449937 - RNA, 15 nt, Brucella suis 1330
gcccgcccgccgcaa

SEQ ID NO: 449938 - RNA, 16 nt, Brucella suis 1330
gcccgaagcgcaaagc

SEQ ID NO: 449939 - RNA, 14 nt, Brucella suis 1330
gcccgaaagcagac

SEQ ID NO: 449940 - RNA, 19 nt, Brucella suis 1330
gccccuaaagccgcuccau

SEQ ID NO: 449941 - RNA, 23 nt, Brucella suis 1330
gccccuaaaggcucugcgccagc

SEQ ID NO: 449942 - RNA, 23 nt, Brucella suis 1330
gccccguugcaccguuucucugc

SEQ ID NO: 449943 - RNA, 14 nt, Brucella suis 1330
gcccccucgcaacc

SEQ ID NO: 449944 - RNA, 19 nt, Brucella suis 1330
gcccccagaaggcgcggca

SEQ ID NO: 449945 - RNA, 22 nt, Brucella suis 1330
gcccauugaacugcccccgaaa

SEQ ID NO: 449946 - RNA, 17 nt, Brucella suis 1330
gcccauugcccgcccgu

SEQ ID NO: 449947 - RNA, 19 nt, Brucella suis 1330
gcccauacgcgcggcaacu

SEQ ID NO: 449948 - RNA, 22 nt, Brucella suis 1330
gcccauaaggcggaugcgcggc

SEQ ID NO: 449949 - RNA, 23 nt, Brucella suis 1330
gcccauaccgcgccaaggcugcg

SEQ ID NO: 449950 - RNA, 13 nt, Brucella suis 1330
gcccagcucgccg

SEQ ID NO: 449951 - RNA, 20 nt, Brucella suis 1330
gcccagaaccugcccgucuu

SEQ ID NO: 449952 - RNA, 16 nt, Brucella suis 1330
gcccacgcccagcgcg

SEQ ID NO: 449953 - RNA, 15 nt, Brucella suis 1330
gcccaccgaagccac

SEQ ID NO: 449954 - RNA, 20 nt, Brucella suis 1330
gcccacccaccgccugcagc

SEQ ID NO: 449955 - RNA, 13 nt, Brucella suis 1330
gcccacauagaca

SEQ ID NO: 449956 - RNA, 20 nt, Brucella suis 1330
gcccacauagggccuuuccg

SEQ ID NO: 449957 - RNA, 18 nt, Brucella suis 1330
gccauugcccaaaagcgc

SEQ ID NO: 449958 - RNA, 12 nt, Brucella suis 1330
gccauugccgcg

SEQ ID NO: 449959 - RNA, 14 nt, Brucella suis 1330
gccauuuccaaugc

SEQ ID NO: 449960 - RNA, 13 nt, Brucella suis 1330
gccauguuggggu

SEQ ID NO: 449961 - RNA, 14 nt, Brucella suis 1330
gccaugcccaugca

SEQ ID NO: 449962 - RNA, 19 nt, Brucella suis 1330
gccaugcccgucagcgcgc

SEQ ID NO: 449963 - RNA, 20 nt, Brucella suis 1330
gccaugcccgucagcgcgcc

SEQ ID NO: 449964 - RNA, 18 nt, Brucella suis 1330
gccaugccauccucgcca

SEQ ID NO: 449965 - RNA, 13 nt, Brucella suis 1330
gccaucuuccuca

SEQ ID NO: 449966 - RNA, 19 nt, Brucella suis 1330
gccaucagcauugaacgcc

SEQ ID NO: 449967 - RNA, 20 nt, Brucella suis 1330
gccauauuuuguuaucaagc

SEQ ID NO: 449968 - RNA, 19 nt, Brucella suis 1330
gccaggcaaaugcuccuuc

SEQ ID NO: 449969 - RNA, 21 nt, Brucella suis 1330
gccaggcaaaugcuccuuccu

SEQ ID NO: 449970 - RNA, 14 nt, Brucella suis 1330
gccaggacaacggg

SEQ ID NO: 449971 - RNA, 16 nt, Brucella suis 1330
gccagcuugaaaagcc

SEQ ID NO: 449972 - RNA, 14 nt, Brucella suis 1330
gccagcuccggguu

SEQ ID NO: 449973 - RNA, 16 nt, Brucella suis 1330
gccagcgucggcgguc

SEQ ID NO: 449974 - RNA, 14 nt, Brucella suis 1330
gccagcggcagacc

SEQ ID NO: 449975 - RNA, 19 nt, Brucella suis 1330
gccagcgcaaagcgcgcgc

SEQ ID NO: 449976 - RNA, 16 nt, Brucella suis 1330
gccagccgcgggggcc

SEQ ID NO: 449977 - RNA, 16 nt, Brucella suis 1330
gccagccgccagcagg

SEQ ID NO: 449978 - RNA, 21 nt, Brucella suis 1330
gccagccgcgaucacagccgc

SEQ ID NO: 449979 - RNA, 15 nt, Brucella suis 1330
gccagccgcaaucag

SEQ ID NO: 449980 - RNA, 21 nt, Brucella suis 1330
gccagcagaaccgcuuuccau

SEQ ID NO: 449981 - RNA, 21 nt, Brucella suis 1330
gccagcaccagcggcacgccg

SEQ ID NO: 449982 - RNA, 22 nt, Brucella suis 1330
gccagcaauugcugggcuuccu

SEQ ID NO: 449983 - RNA, 18 nt, Brucella suis 1330
gccagaucaugggcggcc

SEQ ID NO: 449984 - RNA, 18 nt, Brucella suis 1330
gccagauccgcugacugc

SEQ ID NO: 449985 - RNA, 14 nt, Brucella suis 1330
gccagauaaagcag

SEQ ID NO: 449986 - RNA, 18 nt, Brucella suis 1330
gccagaucgcgcgcggcc

SEQ ID NO: 449987 - RNA, 21 nt, Brucella suis 1330
gccagauugcgaauggaaaga

SEQ ID NO: 449988 - RNA, 16 nt, Brucella suis 1330
gccagaaucugcgcgu

SEQ ID NO: 449989 - RNA, 15 nt, Brucella suis 1330
gccagaaaaugcagc

SEQ ID NO: 449990 - RNA, 21 nt, Brucella suis 1330
gccacgcgccgccaucugugc

SEQ ID NO: 449991 - RNA, 13 nt, Brucella suis 1330
gccacgcuccaca

SEQ ID NO: 449992 - RNA, 16 nt, Brucella suis 1330
gccacgccuucaaagc

SEQ ID NO: 449993 - RNA, 19 nt, Brucella suis 1330
gccacgccuucaaagcgcg

SEQ ID NO: 449994 - RNA, 19 nt, Brucella suis 1330
gccaccguugcauauucca

SEQ ID NO: 449995 - RNA, 12 nt, Brucella suis 1330
gccaaagcccgu

SEQ ID NO: 449996 - RNA, 17 nt, Brucella suis 1330
gccaaagaccagcagga

SEQ ID NO: 449997 - RNA, 17 nt, Brucella suis 1330
gcauuuucgagccaaaa

SEQ ID NO: 449998 - RNA, 23 nt, Brucella suis 1330
gcauuugacguccggcuucgugc

SEQ ID NO: 449999 - RNA, 12 nt, Brucella suis 1330
gcauuuccagca

SEQ ID NO: 450000 - RNA, 15 nt, Brucella suis 1330
gcauuuccagcaaaa

SEQ ID NO: 450001 - RNA, 21 nt, Brucella suis 1330
gcauuggcgauuuucugcaca

SEQ ID NO: 450002 - RNA, 18 nt, Brucella suis 1330
gcauugccgagcuugcgg

SEQ ID NO: 450003 - RNA, 15 nt, Brucella suis 1330
gcauuccgggccgca

SEQ ID NO: 450004 - RNA, 19 nt, Brucella suis 1330
gcauuccccgcccgcggcc

SEQ ID NO: 450005 - RNA, 20 nt, Brucella suis 1330
gcauuccccgcccgcggcca

SEQ ID NO: 450006 - RNA, 18 nt, Brucella suis 1330
gcauuacggccagccggu

SEQ ID NO: 450007 - RNA, 22 nt, Brucella suis 1330
gcauggccucaagugccgccuu

SEQ ID NO: 450008 - RNA, 11 nt, Brucella suis 1330
gcaucuuugcc

SEQ ID NO: 450009 - RNA, 20 nt, Brucella suis 1330
gcaugaucgugagcgagcgc

SEQ ID NO: 450010 - RNA, 14 nt, Brucella suis 1330
gcaucuguucugcc

SEQ ID NO: 450011 - RNA, 20 nt, Brucella suis 1330
gcaucugauuugaaaagccc

SEQ ID NO: 450012 - RNA, 21 nt, Brucella suis 1330
gcaucugauuugaaaagcccc

SEQ ID NO: 450013 - RNA, 18 nt, Brucella suis 1330
gcaucugaaaaagcccgg

SEQ ID NO: 450014 - RNA, 14 nt, Brucella suis 1330
gcaucgccgccagc

SEQ ID NO: 450015 - RNA, 13 nt, Brucella suis 1330
gcaucgcccccuu

SEQ ID NO: 450016 - RNA, 14 nt, Brucella suis 1330
gcauccuugucggc

SEQ ID NO: 450017 - RNA, 21 nt, Brucella suis 1330
gcauccagcggugacggcggc

SEQ ID NO: 450018 - RNA, 19 nt, Brucella suis 1330
gcauccacucggcggcauc

SEQ ID NO: 450019 - RNA, 21 nt, Brucella suis 1330
gcaucauuggcguugagccgc

SEQ ID NO: 450020 - RNA, 22 nt, Brucella suis 1330
gcaucagucgaauuucagcagg

SEQ ID NO: 450021 - RNA, 15 nt, Brucella suis 1330
gcauauguuccugcg

SEQ ID NO: 450022 - RNA, 19 nt, Brucella suis 1330
gcauaucuuccagagcggg

SEQ ID NO: 450023 - RNA, 16 nt, Brucella suis 1330
gcauaggaaucagcaa

SEQ ID NO: 450024 - RNA, 20 nt, Brucella suis 1330
gcauaggaaucagcaaguuu

SEQ ID NO: 450025 - RNA, 14 nt, Brucella suis 1330
gcauaggagacugu

SEQ ID NO: 450026 - RNA, 16 nt, Brucella suis 1330
gcauagccggcaugga

SEQ ID NO: 450027 - RNA, 22 nt, Brucella suis 1330
gcauaaucggcaucggaaaggu

SEQ ID NO: 450028 - RNA, 17 nt, Brucella suis 1330
gcaguuucaccauggcc

SEQ ID NO: 450029 - RNA, 17 nt, Brucella suis 1330
gcaggggugcaaagcuu

SEQ ID NO: 450030 - RNA, 16 nt, Brucella suis 1330
gcaggggcagcgcgcg

SEQ ID NO: 450031 - RNA, 20 nt, Brucella suis 1330
gcagggucaaaauggccuca

SEQ ID NO: 450032 - RNA, 19 nt, Brucella suis 1330
gcaguaucgucguccagcc

SEQ ID NO: 450033 - RNA, 13 nt, Brucella suis 1330
gcaggcucugaaa

SEQ ID NO: 450034 - RNA, 14 nt, Brucella suis 1330
gcaggcucccgccu

SEQ ID NO: 450035 - RNA, 15 nt, Brucella suis 1330
gcaggcgcaggcccu

SEQ ID NO: 450036 - RNA, 18 nt, Brucella suis 1330
gcaggcgcaacuguucgg

SEQ ID NO: 450037 - RNA, 14 nt, Brucella suis 1330
gcaggcgagaugcc

SEQ ID NO: 450038 - RNA, 18 nt, Brucella suis 1330
gcaggccgguaagcccug

SEQ ID NO: 450039 - RNA, 18 nt, Brucella suis 1330
gcaggaucggcagcagcg

SEQ ID NO: 450040 - RNA, 20 nt, Brucella suis 1330
gcaggagauaggcaacaggc

SEQ ID NO: 450041 - RNA, 16 nt, Brucella suis 1330
gcaggaaagcccggcu

SEQ ID NO: 450042 - RNA, 17 nt, Brucella suis 1330
gcagcuaugcgccacac

SEQ ID NO: 450043 - RNA, 16 nt, Brucella suis 1330
gcagcgucacaaaaca

SEQ ID NO: 450044 - RNA, 23 nt, Brucella suis 1330
gcagcgguuccugauugaagaca

SEQ ID NO: 450045 - RNA, 16 nt, Brucella suis 1330
gcagcggucacagaag

SEQ ID NO: 450046 - RNA, 13 nt, Brucella suis 1330
gcaacccggcggc

SEQ ID NO: 450047 - RNA, 20 nt, Brucella suis 1330
gcaacacgccgccgcgcggc

SEQ ID NO: 450048 - RNA, 21 nt, Brucella suis 1330
gcaacacgccgccgcgcggca

SEQ ID NO: 450049 - RNA, 18 nt, Brucella suis 1330
gcaacagggcgaaaagcc

SEQ ID NO: 450050 - RNA, 14 nt, Brucella suis 1330
gcaacaccccgcgc

SEQ ID NO: 450051 - RNA, 19 nt, Brucella suis 1330
gcaaauggcaauuuaucug

SEQ ID NO: 450052 - RNA, 14 nt, Brucella suis 1330
gcaaaggucgggug

SEQ ID NO: 450053 - RNA, 14 nt, Brucella suis 1330
gcaaaggaggagga

SEQ ID NO: 450054 - RNA, 17 nt, Brucella suis 1330
gcaaaggccggguuuuu

SEQ ID NO: 450055 - RNA, 18 nt, Brucella suis 1330
gcaaaggccggguuuuuc

SEQ ID NO: 450056 - RNA, 11 nt, Brucella suis 1330
gcaaagagaac

SEQ ID NO: 450057 - RNA, 21 nt, Brucella suis 1330
gcaaagagaaccaccuuccug

SEQ ID NO: 450058 - RNA, 15 nt, Brucella suis 1330
gcaaaaggcgcaaug

SEQ ID NO: 450059 - RNA, 18 nt, Brucella suis 1330
gcaaaagugagaaacggu

SEQ ID NO: 450060 - RNA, 12 nt, Brucella suis 1330
gcaaaagugcga

SEQ ID NO: 450061 - RNA, 18 nt, Brucella suis 1330
gcaaaaguggcgcgugcc

SEQ ID NO: 450062 - RNA, 15 nt, Brucella suis 1330
gcaaaacggcaggca

SEQ ID NO: 450063 - RNA, 21 nt, Brucella suis 1330
gcaaaacggcccaugagcuuc

SEQ ID NO: 450064 - RNA, 19 nt, Brucella suis 1330
gcaaaaaauaucuuuuuuc

SEQ ID NO: 450065 - RNA, 21 nt, Brucella suis 1330
gauuuugccuucaggcggcgc

SEQ ID NO: 450066 - RNA, 16 nt, Brucella suis 1330
gauuucggcaaaggcg

SEQ ID NO: 450067 - RNA, 15 nt, Brucella suis 1330
gauuucggcgugcag

SEQ ID NO: 450068 - RNA, 12 nt, Brucella suis 1330
gauuucgagcug

SEQ ID NO: 450069 - RNA, 17 nt, Brucella suis 1330
gauuucugauccugcuu

SEQ ID NO: 450070 - RNA, 19 nt, Brucella suis 1330
gauuuggacuauuuccauc

SEQ ID NO: 450071 - RNA, 14 nt, Brucella suis 1330
gauuuaaaacuuaa

SEQ ID NO: 450072 - RNA, 19 nt, Brucella suis 1330
gauuucaccgggaaucuug

SEQ ID NO: 450073 - RNA, 22 nt, Brucella suis 1330
gauuucauccagcguuaccuug

SEQ ID NO: 450074 - RNA, 12 nt, Brucella suis 1330
gauugcgggcau

SEQ ID NO: 450075 - RNA, 21 nt, Brucella suis 1330
gauugaucgcaagccaaagcc

SEQ ID NO: 450076 - RNA, 16 nt, Brucella suis 1330
gauugaugaaaaaccc

SEQ ID NO: 450077 - RNA, 14 nt, Brucella suis 1330
gauugcaaacgaau

SEQ ID NO: 450078 - RNA, 21 nt, Brucella suis 1330
gauugccccgccauaaagcac

SEQ ID NO: 450079 - RNA, 19 nt, Brucella suis 1330
gauugccgccgcacuuaca

SEQ ID NO: 450080 - RNA, 21 nt, Brucella suis 1330
gauugccgugguaugccagcc

SEQ ID NO: 450081 - RNA, 16 nt, Brucella suis 1330
gauucuuaugccagau

SEQ ID NO: 450082 - RNA, 15 nt, Brucella suis 1330
gauucuuucuucgcc

SEQ ID NO: 450083 - RNA, 23 nt, Brucella suis 1330
gauugaggacgaaccccgcauca

SEQ ID NO: 450084 - RNA, 21 nt, Brucella suis 1330
gauucccuuuuccgcaaaaau

SEQ ID NO: 450085 - RNA, 17 nt, Brucella suis 1330
gauuccgaauagaugau

SEQ ID NO: 450086 - RNA, 16 nt, Brucella suis 1330
gauucgaaccucugac

SEQ ID NO: 450087 - RNA, 16 nt, Brucella suis 1330
gaugugccaccagcac

SEQ ID NO: 450088 - RNA, 15 nt, Brucella suis 1330
gaugucgauuucacc

SEQ ID NO: 450089 - RNA, 23 nt, Brucella suis 1330
gaugucgccgcucaugcgguaga

SEQ ID NO: 450090 - RNA, 13 nt, Brucella suis 1330
gauuagagcgccg

SEQ ID NO: 450091 - RNA, 17 nt, Brucella suis 1330
gaugguccagucuucau

SEQ ID NO: 450092 - RNA, 21 nt, Brucella suis 1330
gauggcguucugaaaccgcag

SEQ ID NO: 450093 - RNA, 16 nt, Brucella suis 1330
gauggcgagcgcgcuu

SEQ ID NO: 450094 - RNA, 15 nt, Brucella suis 1330
gauggcgacgcgcuc

SEQ ID NO: 450095 - RNA, 15 nt, Brucella suis 1330
gauggcauggaccac

SEQ ID NO: 450096 - RNA, 19 nt, Brucella suis 1330
gauggcagaccccaucagc

SEQ ID NO: 450097 - RNA, 15 nt, Brucella suis 1330
gauggaaggaaagcc

SEQ ID NO: 450098 - RNA, 21 nt, Brucella suis 1330
gaugcgcgccagccgccagca

SEQ ID NO: 450099 - RNA, 20 nt, Brucella suis 1330
gaugcgcggauaaacgcuuc

SEQ ID NO: 450100 - RNA, 15 nt, Brucella suis 1330
gaugcgcgucaaaac

SEQ ID NO: 450101 - RNA, 17 nt, Brucella suis 1330
gaugcgcuuuaaagcag

SEQ ID NO: 450102 - RNA, 13 nt, Brucella suis 1330
gaugcggcggcgc

SEQ ID NO: 450103 - RNA, 14 nt, Brucella suis 1330
gaugcgcaggcgcu

SEQ ID NO: 450104 - RNA, 17 nt, Brucella suis 1330
gaugccgccgcagacca

SEQ ID NO: 450105 - RNA, 19 nt, Brucella suis 1330
gaugccgauacuguagaaa

SEQ ID NO: 450106 - RNA, 13 nt, Brucella suis 1330
gaugcagauaaaa

SEQ ID NO: 450107 - RNA, 15 nt, Brucella suis 1330
gaugcaaugcaccga

SEQ ID NO: 450108 - RNA, 11 nt, Brucella suis 1330
gaugauuuccc

SEQ ID NO: 450109 - RNA, 22 nt, Brucella suis 1330
aaagccuguccuuguuccaguc

SEQ ID NO: 450110 - RNA, 18 nt, Brucella suis 1330
aaagccugcuacaaaaaa

SEQ ID NO: 450111 - RNA, 13 nt, Brucella suis 1330
gaugaucgccagc

SEQ ID NO: 450112 - RNA, 15 nt, Brucella suis 1330
gaugaucgccagcac

SEQ ID NO: 450113 - RNA, 19 nt, Brucella suis 1330
gaugaucgguacggaaagg

SEQ ID NO: 450114 - RNA, 21 nt, Brucella suis 1330
gaugaucgguacggaaagggc

SEQ ID NO: 450115 - RNA, 13 nt, Brucella suis 1330
gaugaugaagaaa

SEQ ID NO: 450116 - RNA, 17 nt, Brucella suis 1330
gaugagcgccauuuccc

SEQ ID NO: 450117 - RNA, 17 nt, Brucella suis 1330
gaugagcggcagcagcc

SEQ ID NO: 450118 - RNA, 12 nt, Brucella suis 1330
gaugagccucaa

SEQ ID NO: 450119 - RNA, 17 nt, Brucella suis 1330
gaugagccucaauggca

SEQ ID NO: 450120 - RNA, 16 nt, Brucella suis 1330
gaugagggccgugacc

SEQ ID NO: 450121 - RNA, 20 nt, Brucella suis 1330
gaugagggccgugaccagcg

SEQ ID NO: 450122 - RNA, 17 nt, Brucella suis 1330
gaugagaaugccguucu

SEQ ID NO: 450123 - RNA, 16 nt, Brucella suis 1330
gaugacggcgcggcgc

SEQ ID NO: 450124 - RNA, 22 nt, Brucella suis 1330
gaugacgguaucauaaaugccg

SEQ ID NO: 450125 - RNA, 12 nt, Brucella suis 1330
gaugaagagcgu

SEQ ID NO: 450126 - RNA, 18 nt, Brucella suis 1330
gaugaauggggggcaggc

SEQ ID NO: 450127 - RNA, 22 nt, Brucella suis 1330
gaugaagaagauaaucagcaga

SEQ ID NO: 450128 - RNA, 18 nt, Brucella suis 1330
gaucuucggcaucagaaa

SEQ ID NO: 450129 - RNA, 20 nt, Brucella suis 1330
gaucuucgaucauuuccuuc

SEQ ID NO: 450130 - RNA, 20 nt, Brucella suis 1330
gaucugcaucccgaaaagug

SEQ ID NO: 450131 - RNA, 16 nt, Brucella suis 1330
gaucucggagcggccg

SEQ ID NO: 450132 - RNA, 21 nt, Brucella suis 1330
gaucucggccuggucuagccg

SEQ ID NO: 450133 - RNA, 15 nt, Brucella suis 1330
gaucgugagguucuu

SEQ ID NO: 450134 - RNA, 14 nt, Brucella suis 1330
gaucgucaggcgca

SEQ ID NO: 450135 - RNA, 21 nt, Brucella suis 1330
gaucguauccccggcaaagac

SEQ ID NO: 450136 - RNA, 15 nt, Brucella suis 1330
gaucgggaaauaaac

SEQ ID NO: 450137 - RNA, 23 nt, Brucella suis 1330
gaucggcaagcuugacgaucuuu

SEQ ID NO: 450138 - RNA, 21 nt, Brucella suis 1330
gaucgccuuuauauggcgguc

SEQ ID NO: 450139 - RNA, 14 nt, Brucella suis 1330
gaucgauguucuuu

SEQ ID NO: 450140 - RNA, 14 nt, Brucella suis 1330
gaucgacauauuug

SEQ ID NO: 450141 - RNA, 18 nt, Brucella suis 1330
aaagccgcuccauuccca

SEQ ID NO: 450142 - RNA, 15 nt, Brucella suis 1330
gauccuguagacgaa

SEQ ID NO: 450143 - RNA, 20 nt, Brucella suis 1330
aaagcccgccacgaggaaga

SEQ ID NO: 450144 - RNA, 19 nt, Brucella suis 1330
gauccugcugcgcggcauu

SEQ ID NO: 450145 - RNA, 14 nt, Brucella suis 1330
gauccucuugcaug

SEQ ID NO: 450146 - RNA, 20 nt, Brucella suis 1330
gauccggcgggcuuuucauu

SEQ ID NO: 450147 - RNA, 22 nt, Brucella suis 1330
gaucccgcuucgaugcgcugga

SEQ ID NO: 450148 - RNA, 17 nt, Brucella suis 1330
gauccaccaucacgucg

SEQ ID NO: 450149 - RNA, 23 nt, Brucella suis 1330
gauccaauauugccuuccccaua

SEQ ID NO: 450150 - RNA, 23 nt, Brucella suis 1330
gaucauccauuccucaagauaca

SEQ ID NO: 450151 - RNA, 18 nt, Brucella suis 1330
gaucaucgucaugcagac

SEQ ID NO: 450152 - RNA, 17 nt, Brucella suis 1330
gaucauauaggugccga

SEQ ID NO: 450153 - RNA, 21 nt, Brucella suis 1330
gaucaucagcccauagaucag

SEQ ID NO: 450154 - RNA, 13 nt, Brucella suis 1330
gaucagugccacc

SEQ ID NO: 450155 - RNA, 17 nt, Brucella suis 1330
gaucaggcgaucaacgc

SEQ ID NO: 450156 - RNA, 18 nt, Brucella suis 1330
gaucagcgcaagaaggcg

SEQ ID NO: 450157 - RNA, 14 nt, Brucella suis 1330
gaucagaagugcug

SEQ ID NO: 450158 - RNA, 22 nt, Brucella suis 1330
gaucaccgcagucaugcccaua

SEQ ID NO: 450159 - RNA, 17 nt, Brucella suis 1330
gaucaacccgucuucau

SEQ ID NO: 450160 - RNA, 16 nt, Brucella suis 1330
gauagauauuucuucc

SEQ ID NO: 450161 - RNA, 18 nt, Brucella suis 1330
gauagauauuucuuccag

SEQ ID NO: 450162 - RNA, 19 nt, Brucella suis 1330
gauagauauuucuuccaga

SEQ ID NO: 450163 - RNA, 17 nt, Brucella suis 1330
gauaggcccaggccucu

SEQ ID NO: 450164 - RNA, 18 nt, Brucella suis 1330
gauagagggccgaaucgc

SEQ ID NO: 450165 - RNA, 14 nt, Brucella suis 1330
gauaagacauggcu

SEQ ID NO: 450166 - RNA, 17 nt, Brucella suis 1330
gauaagauugcggcuga

SEQ ID NO: 450167 - RNA, 19 nt, Brucella suis 1330
gaguucugcgcggaaacca

SEQ ID NO: 450168 - RNA, 20 nt, Brucella suis 1330
gauaaagaugcgcgccagcc

SEQ ID NO: 450169 - RNA, 20 nt, Brucella suis 1330
gaguucgcccgucucgcagc

SEQ ID NO: 450170 - RNA, 20 nt, Brucella suis 1330
gaguaucuggcgauaaagau

SEQ ID NO: 450171 - RNA, 17 nt, Brucella suis 1330
gagggguaaauccucca

SEQ ID NO: 450172 - RNA, 18 nt, Brucella suis 1330
gaggcggauaucgccuga

SEQ ID NO: 450173 - RNA, 21 nt, Brucella suis 1330
gaggccugauagcggaaacca

SEQ ID NO: 450174 - RNA, 20 nt, Brucella suis 1330
gaggccgcgcgcgcgcagga

SEQ ID NO: 450175 - RNA, 20 nt, Brucella suis 1330
gaggccauuuugacccugcc

SEQ ID NO: 450176 - RNA, 16 nt, Brucella suis 1330
gaggccgaccagaacg

SEQ ID NO: 450177 - RNA, 15 nt, Brucella suis 1330
gaggccauggcuuca

SEQ ID NO: 450178 - RNA, 19 nt, Brucella suis 1330
gaggaggggacgcagccuu

SEQ ID NO: 450179 - RNA, 14 nt, Brucella suis 1330
gaggaaaaagcccg

SEQ ID NO: 450180 - RNA, 13 nt, Brucella suis 1330
gagcggcagcagc

SEQ ID NO: 450181 - RNA, 15 nt, Brucella suis 1330
gagcggcaggccgca

SEQ ID NO: 450182 - RNA, 20 nt, Brucella suis 1330
gagcggauggaccggcuggu

SEQ ID NO: 450183 - RNA, 22 nt, Brucella suis 1330
gagcgguuucaaaggagccgcu

SEQ ID NO: 450184 - RNA, 12 nt, Brucella suis 1330
gagcgguuccaa

SEQ ID NO: 450185 - RNA, 20 nt, Brucella suis 1330
gagcgucaggccgaugacgg

SEQ ID NO: 450186 - RNA, 15 nt, Brucella suis 1330
gagcgugaccagccc

SEQ ID NO: 450187 - RNA, 14 nt, Brucella suis 1330
gagcgcacauaaaa

SEQ ID NO: 450188 - RNA, 23 nt, Brucella suis 1330
gagcgagcuugcaaugagcgcgc

SEQ ID NO: 450189 - RNA, 19 nt, Brucella suis 1330
gagcgauuucuggagccgc

SEQ ID NO: 450190 - RNA, 21 nt, Brucella suis 1330
gagccugccguucgcaaaugg

SEQ ID NO: 450191 - RNA, 22 nt, Brucella suis 1330
gagccucaucggcgggccaggu

SEQ ID NO: 450192 - RNA, 21 nt, Brucella suis 1330
gagccucggcgcggacaagcu

SEQ ID NO: 450193 - RNA, 20 nt, Brucella suis 1330
gagccgaaccggggcagggc

SEQ ID NO: 450194 - RNA, 17 nt, Brucella suis 1330
gagccacgagaaaaugg

SEQ ID NO: 450195 - RNA, 17 nt, Brucella suis 1330
gagccaaaaaugugaaa

SEQ ID NO: 450196 - RNA, 22 nt, Brucella suis 1330
gagccaaaagugugaaacgccu

SEQ ID NO: 450197 - RNA, 15 nt, Brucella suis 1330
aaagcacaaagaaca

SEQ ID NO: 450198 - RNA, 21 nt, Brucella suis 1330
gagcaggcaggccgccuggga

SEQ ID NO: 450199 - RNA, 22 nt, Brucella suis 1330
gagcagcucuauugcccggcgg

SEQ ID NO: 450200 - RNA, 20 nt, Brucella suis 1330
gagcagcaucuugccaagcu

SEQ ID NO: 450201 - RNA, 18 nt, Brucella suis 1330
gagaucguaggcuuuccc

SEQ ID NO: 450202 - RNA, 17 nt, Brucella suis 1330
gagauugggcagcagau

SEQ ID NO: 450203 - RNA, 20 nt, Brucella suis 1330
gacuaugcgccacgagaacc

SEQ ID NO: 450204 - RNA, 16 nt, Brucella suis 1330
gacgugucaaagccuc

SEQ ID NO: 450205 - RNA, 19 nt, Brucella suis 1330
gacggucgaagccacggcg

SEQ ID NO: 450206 - RNA, 20 nt, Brucella suis 1330
gacggcuguuuucgaggcca

SEQ ID NO: 450207 - RNA, 22 nt, Brucella suis 1330
gacggcgcggcgcauggccuca

SEQ ID NO: 450208 - RNA, 13 nt, Brucella suis 1330
gacggcauaaaug

SEQ ID NO: 450209 - RNA, 13 nt, Brucella suis 1330
gacggagccuucg

SEQ ID NO: 450210 - RNA, 16 nt, Brucella suis 1330
gacgcuuggcaccgcc

SEQ ID NO: 450211 - RNA, 18 nt, Brucella suis 1330
gacgcuuggcaccgccug

SEQ ID NO: 450212 - RNA, 12 nt, Brucella suis 1330
gacgcagccuuu

SEQ ID NO: 450213 - RNA, 16 nt, Brucella suis 1330
gacgaucaccuguggc

SEQ ID NO: 450214 - RNA, 19 nt, Brucella suis 1330
gacgaucaccuguggcugu

SEQ ID NO: 450215 - RNA, 15 nt, Brucella suis 1330
gacgacugaaauaau

SEQ ID NO: 450216 - RNA, 18 nt, Brucella suis 1330
gacgaaccccgcaucaug

SEQ ID NO: 450217 - RNA, 17 nt, Brucella suis 1330
gacgaaaggcggcgcau

SEQ ID NO: 450218 - RNA, 20 nt, Brucella suis 1330
gacgaaagccacgcuccaca

SEQ ID NO: 450219 - RNA, 17 nt, Brucella suis 1330
gaccuugaugauagaau

SEQ ID NO: 450220 - RNA, 19 nt, Brucella suis 1330
gaccugcuucuugccuuca

SEQ ID NO: 450221 - RNA, 16 nt, Brucella suis 1330
gaccggcggcaggcag

SEQ ID NO: 450222 - RNA, 12 nt, Brucella suis 1330
gaccggccaccc

SEQ ID NO: 450223 - RNA, 18 nt, Brucella suis 1330
gaccgccuuuuccagugc

SEQ ID NO: 450224 - RNA, 18 nt, Brucella suis 1330
gaccgcgaggaagccugc

SEQ ID NO: 450225 - RNA, 13 nt, Brucella suis 1330
gaccgccgcgauu

SEQ ID NO: 450226 - RNA, 18 nt, Brucella suis 1330
gaccauggcggaacccac

SEQ ID NO: 450227 - RNA, 20 nt, Brucella suis 1330
gaccauauugcugggcaagu

SEQ ID NO: 450228 - RNA, 13 nt, Brucella suis 1330
gaccacgccgagg

SEQ ID NO: 450229 - RNA, 14 nt, Brucella suis 1330
gaccacgccgagga

SEQ ID NO: 450230 - RNA, 16 nt, Brucella suis 1330
gaccacccggccgccc

SEQ ID NO: 450231 - RNA, 15 nt, Brucella suis 1330
gaccaccaggccgga

SEQ ID NO: 450232 - RNA, 13 nt, Brucella suis 1330
gacauguucuagu

SEQ ID NO: 450233 - RNA, 13 nt, Brucella suis 1330
gacauggggcgag

SEQ ID NO: 450234 - RNA, 23 nt, Brucella suis 1330
gacaucaucaaggaaaaaaccgg

SEQ ID NO: 450235 - RNA, 17 nt, Brucella suis 1330
gacaggguaagcgccuu

SEQ ID NO: 450236 - RNA, 18 nt, Brucella suis 1330
gacagggcaagcgccugc

SEQ ID NO: 450237 - RNA, 14 nt, Brucella suis 1330
gacagacuggaaug

SEQ ID NO: 450238 - RNA, 22 nt, Brucella suis 1330
gacaaccgcgccgcuggugcga

SEQ ID NO: 450239 - RNA, 13 nt, Brucella suis 1330
gacaaaaaacacc

SEQ ID NO: 450240 - RNA, 22 nt, Brucella suis 1330
gaaugugcuuaguuguuuucuu

SEQ ID NO: 450241 - RNA, 17 nt, Brucella suis 1330
gaaugcccuugagaagc

SEQ ID NO: 450242 - RNA, 12 nt, Brucella suis 1330
gaaugaaucaga

SEQ ID NO: 450243 - RNA, 23 nt, Brucella suis 1330
gaaugacauggaaaugcagguga

SEQ ID NO: 450244 - RNA, 23 nt, Brucella suis 1330
gaauccacguuuggagcggcggu

SEQ ID NO: 450245 - RNA, 22 nt, Brucella suis 1330
gaauaaaacgccggguaugaca

SEQ ID NO: 450246 - RNA, 15 nt, Brucella suis 1330
gaagugaaaccagcg

SEQ ID NO: 450247 - RNA, 21 nt, Brucella suis 1330
aaagaucaccauuacaaaaau

SEQ ID NO: 450248 - RNA, 13 nt, Brucella suis 1330
gaaguuuuccugc

SEQ ID NO: 450249 - RNA, 16 nt, Brucella suis 1330
gaaggucaaaaagggc

SEQ ID NO: 450250 - RNA, 21 nt, Brucella suis 1330
gaagguaagcuuugcaccgcg

SEQ ID NO: 450251 - RNA, 20 nt, Brucella suis 1330
gaagggcggguucaugauga

SEQ ID NO: 450252 - RNA, 19 nt, Brucella suis 1330
gaagggcugagggaaacac

SEQ ID NO: 450253 - RNA, 22 nt, Brucella suis 1330
gaaggcgcggcagcuaugcgcc

SEQ ID NO: 450254 - RNA, 14 nt, Brucella suis 1330
gaaggcccuucagg

SEQ ID NO: 450255 - RNA, 14 nt, Brucella suis 1330
gaaggcaucggugc

SEQ ID NO: 450256 - RNA, 18 nt, Brucella suis 1330
gaaggcaagccccagcac

SEQ ID NO: 450257 - RNA, 14 nt, Brucella suis 1330
gaaggaaagcccag

SEQ ID NO: 450258 - RNA, 23 nt, Brucella suis 1330
gaaggacaagacuuccucgccgu

SEQ ID NO: 450259 - RNA, 13 nt, Brucella suis 1330
gaagcgcugcaaa

SEQ ID NO: 450260 - RNA, 18 nt, Brucella suis 1330
gaagcgccuacgcgggga

SEQ ID NO: 450261 - RNA, 21 nt, Brucella suis 1330
gaagcgcgcgcccgugacaag

SEQ ID NO: 450262 - RNA, 19 nt, Brucella suis 1330
gaagcgccuuugcggggga

SEQ ID NO: 450263 - RNA, 19 nt, Brucella suis 1330
gaagccaucuuucuugaag

SEQ ID NO: 450264 - RNA, 22 nt, Brucella suis 1330
gaagcaaucgacaauugcccac

SEQ ID NO: 450265 - RNA, 19 nt, Brucella suis 1330
gaagaucaauucccuggcu

SEQ ID NO: 450266 - RNA, 16 nt, Brucella suis 1330
gaacuucgccaagccc

SEQ ID NO: 450267 - RNA, 17 nt, Brucella suis 1330
gaacuggaugacaguuu

SEQ ID NO: 450268 - RNA, 22 nt, Brucella suis 1330
gaacuggcggaugaagaagaua

SEQ ID NO: 450269 - RNA, 19 nt, Brucella suis 1330
gaacuggcaagugugcaga

SEQ ID NO: 450270 - RNA, 15 nt, Brucella suis 1330
gaacugggcggccag

SEQ ID NO: 450271 - RNA, 23 nt, Brucella suis 1330
gaacucgcccaccgaagccacga

SEQ ID NO: 450272 - RNA, 19 nt, Brucella suis 1330
gaacgggggcgaucaucaa

SEQ ID NO: 450273 - RNA, 16 nt, Brucella suis 1330
gaacggcgugcgcugu

SEQ ID NO: 450274 - RNA, 17 nt, Brucella suis 1330
gaacgccuuuuucacug

SEQ ID NO: 450275 - RNA, 20 nt, Brucella suis 1330
gaacgccgccggaaacgggc

SEQ ID NO: 450276 - RNA, 15 nt, Brucella suis 1330
gaacgcaucgagcug

SEQ ID NO: 450277 - RNA, 17 nt, Brucella suis 1330
gaacgcaucgagcuggu

SEQ ID NO: 450278 - RNA, 21 nt, Brucella suis 1330
gaaccgucgcuauauugccgc

SEQ ID NO: 450279 - RNA, 21 nt, Brucella suis 1330
gaaccguguucgcacaagaag

SEQ ID NO: 450280 - RNA, 11 nt, Brucella suis 1330
gaaccuccacg

SEQ ID NO: 450281 - RNA, 12 nt, Brucella suis 1330
gaaccuccacgc

SEQ ID NO: 450282 - RNA, 18 nt, Brucella suis 1330
gaaccggcugucccugcg

SEQ ID NO: 450283 - RNA, 22 nt, Brucella suis 1330
gaaccgggcccuucucgacagc

SEQ ID NO: 450284 - RNA, 17 nt, Brucella suis 1330
gaaccggggcagggcag

SEQ ID NO: 450285 - RNA, 16 nt, Brucella suis 1330
gaaccggcgagccggg

SEQ ID NO: 450286 - RNA, 19 nt, Brucella suis 1330
gaaccgaggcaaugaaaac

SEQ ID NO: 450287 - RNA, 17 nt, Brucella suis 1330
gaaccgaaaccgugaca

SEQ ID NO: 450288 - RNA, 16 nt, Brucella suis 1330
gaaccgaacgcgccuu

SEQ ID NO: 450289 - RNA, 23 nt, Brucella suis 1330
gaaccccaugguuugcagcaauu

SEQ ID NO: 450290 - RNA, 13 nt, Brucella suis 1330
gaacaucagaagc

SEQ ID NO: 450291 - RNA, 17 nt, Brucella suis 1330
gaacaguuugagcauga

SEQ ID NO: 450292 - RNA, 18 nt, Brucella suis 1330
gaacaggcccaccgugcc

SEQ ID NO: 450293 - RNA, 14 nt, Brucella suis 1330
gaacacgaugaugg

SEQ ID NO: 450294 - RNA, 22 nt, Brucella suis 1330
gaacaaacuuauccagccgccg

SEQ ID NO: 450295 - RNA, 15 nt, Brucella suis 1330
gaaauugcuccagcc

SEQ ID NO: 450296 - RNA, 18 nt, Brucella suis 1330
gaaauccuucagaagcac

SEQ ID NO: 450297 - RNA, 17 nt, Brucella suis 1330
gaaagguguccuccagc

SEQ ID NO: 450298 - RNA, 19 nt, Brucella suis 1330
gaaagcggauuggcguuca

SEQ ID NO: 450299 - RNA, 18 nt, Brucella suis 1330
gaaagcguaaaccucccu

SEQ ID NO: 450300 - RNA, 23 nt, Brucella suis 1330
gaaauagcacauaucagcccgcu

SEQ ID NO: 450301 - RNA, 15 nt, Brucella suis 1330
gaaaucaagaugcuu

SEQ ID NO: 450302 - RNA, 20 nt, Brucella suis 1330
gaaauccguuucggaaagcg

SEQ ID NO: 450303 - RNA, 14 nt, Brucella suis 1330
gaaacucucacagc

SEQ ID NO: 450304 - RNA, 20 nt, Brucella suis 1330
gaaacugaaaaaggccggga

SEQ ID NO: 450305 - RNA, 14 nt, Brucella suis 1330
gaaagaugaaucac

SEQ ID NO: 450306 - RNA, 17 nt, Brucella suis 1330
gaaagauggucaagagc

SEQ ID NO: 450307 - RNA, 15 nt, Brucella suis 1330
gaaagcacaaagaac

SEQ ID NO: 450308 - RNA, 19 nt, Brucella suis 1330
gaaagcacaaagaacaagc

SEQ ID NO: 450309 - RNA, 16 nt, Brucella suis 1330
gaaagcgccagauuca

SEQ ID NO: 450310 - RNA, 12 nt, Brucella suis 1330
gaaaaucuugau

SEQ ID NO: 450311 - RNA, 21 nt, Brucella suis 1330
gaaaaugcccggcgcgaugag

SEQ ID NO: 450312 - RNA, 20 nt, Brucella suis 1330
gaaaacgccgaagccaggca

SEQ ID NO: 450313 - RNA, 14 nt, Brucella suis 1330
gaaaacgccgccuu

SEQ ID NO: 450314 - RNA, 16 nt, Brucella suis 1330
gaaaacggcugcaaca

SEQ ID NO: 450315 - RNA, 18 nt, Brucella suis 1330
gaaaacggcugcaacaaa

SEQ ID NO: 450316 - RNA, 23 nt, Brucella suis 1330
gaaaacggcugcaacaaaagaag

SEQ ID NO: 450317 - RNA, 12 nt, Brucella suis 1330
gaaaacaucgga

SEQ ID NO: 450318 - RNA, 19 nt, Brucella suis 1330
gaaaacuugcugaaacgag

SEQ ID NO: 450319 - RNA, 22 nt, Brucella suis 1330
gaaaagacgugucaaagccucg

SEQ ID NO: 450320 - RNA, 18 nt, Brucella suis 1330
gaaaaagcccggucucgc

SEQ ID NO: 450321 - RNA, 21 nt, Brucella suis 1330
cuuuuugacgcaaaagcucca

SEQ ID NO: 450322 - RNA, 15 nt, Brucella suis 1330
cuuuucauucugaau

SEQ ID NO: 450323 - RNA, 16 nt, Brucella suis 1330
cuuuucauucugaaug

SEQ ID NO: 450324 - RNA, 12 nt, Brucella suis 1330
cuuuuccagugc

SEQ ID NO: 450325 - RNA, 13 nt, Brucella suis 1330
cuuuuccagugca

SEQ ID NO: 450326 - RNA, 14 nt, Brucella suis 1330
cuuuuccgcugcca

SEQ ID NO: 450327 - RNA, 16 nt, Brucella suis 1330
cuuuucggcgaaagcc

SEQ ID NO: 450328 - RNA, 17 nt, Brucella suis 1330
cuuuucggcuuccuugc

SEQ ID NO: 450329 - RNA, 21 nt, Brucella suis 1330
cuuuucgggaugcgcuuuaaa

SEQ ID NO: 450330 - RNA, 22 nt, Brucella suis 1330
cuuuucggcaaggaugcugcca

SEQ ID NO: 450331 - RNA, 13 nt, Brucella suis 1330
cuuuucuucaucc

SEQ ID NO: 450332 - RNA, 17 nt, Brucella suis 1330
cuuuugcuggaaaugcu

SEQ ID NO: 450333 - RNA, 23 nt, Brucella suis 1330
cuuuugcuggaaaugcucuagaa

SEQ ID NO: 450334 - RNA, 17 nt, Brucella suis 1330
cuuuugcuggaucucua

SEQ ID NO: 450335 - RNA, 20 nt, Brucella suis 1330
cuuugcggaggcggcugccu

SEQ ID NO: 450336 - RNA, 15 nt, Brucella suis 1330
cuuuguauuucaaug

SEQ ID NO: 450337 - RNA, 20 nt, Brucella suis 1330
cuuuguauuucaaugcugca

SEQ ID NO: 450338 - RNA, 15 nt, Brucella suis 1330
cuuugucauaucaga

SEQ ID NO: 450339 - RNA, 14 nt, Brucella suis 1330
cuuugugccgccgc

SEQ ID NO: 450340 - RNA, 19 nt, Brucella suis 1330
cuuuccauccagucgauca

SEQ ID NO: 450341 - RNA, 15 nt, Brucella suis 1330
cuuuccauuccagcc

SEQ ID NO: 450342 - RNA, 16 nt, Brucella suis 1330
cuuucagcgcagugga

SEQ ID NO: 450343 - RNA, 19 nt, Brucella suis 1330
aaagaccagcaggaagaag

SEQ ID NO: 450344 - RNA, 22 nt, Brucella suis 1330
cuucggcauaggcuucggccgc

SEQ ID NO: 450345 - RNA, 13 nt, Brucella suis 1330
cuucggagcgcgu

SEQ ID NO: 450346 - RNA, 18 nt, Brucella suis 1330
cuucgcuccgcaccucag

SEQ ID NO: 450347 - RNA, 16 nt, Brucella suis 1330
cuuuaccgcaacccag

SEQ ID NO: 450348 - RNA, 13 nt, Brucella suis 1330
cuucgcccggcau

SEQ ID NO: 450349 - RNA, 14 nt, Brucella suis 1330
cuucgcagcuaugu

SEQ ID NO: 450350 - RNA, 18 nt, Brucella suis 1330
cuucgccaagcccuucca

SEQ ID NO: 450351 - RNA, 16 nt, Brucella suis 1330
cuucgaucauuuccuu

SEQ ID NO: 450352 - RNA, 15 nt, Brucella suis 1330
cuuccucguccuuga

SEQ ID NO: 450353 - RNA, 16 nt, Brucella suis 1330
cuuccugacccauggc

SEQ ID NO: 450354 - RNA, 23 nt, Brucella suis 1330
cuuccugacccauggccugcugc

SEQ ID NO: 450355 - RNA, 14 nt, Brucella suis 1330
cuuccucgccgugc

SEQ ID NO: 450356 - RNA, 19 nt, Brucella suis 1330
cuuccgccuuggcgaagcu

SEQ ID NO: 450357 - RNA, 20 nt, Brucella suis 1330
cuuccgacccgucaaugcca

SEQ ID NO: 450358 - RNA, 22 nt, Brucella suis 1330
cuuccgacccgucaaugccauc

SEQ ID NO: 450359 - RNA, 19 nt, Brucella suis 1330
cuuccgcaagccaguccuu

SEQ ID NO: 450360 - RNA, 22 nt, Brucella suis 1330
cuuccgcaagccaguccuugcc

SEQ ID NO: 450361 - RNA, 21 nt, Brucella suis 1330
cuuccaugcccaucaaccgug

SEQ ID NO: 450362 - RNA, 16 nt, Brucella suis 1330
cuuccagcaggcgcgc

SEQ ID NO: 450363 - RNA, 19 nt, Brucella suis 1330
cuuccagagcggguuccca

SEQ ID NO: 450364 - RNA, 18 nt, Brucella suis 1330
cuucacaugcuugccgac

SEQ ID NO: 450365 - RNA, 20 nt, Brucella suis 1330
cuuauuccugcggcuucugg

SEQ ID NO: 450366 - RNA, 16 nt, Brucella suis 1330
cuucagccagaaucug

SEQ ID NO: 450367 - RNA, 13 nt, Brucella suis 1330
cuucagccauuca

SEQ ID NO: 450368 - RNA, 17 nt, Brucella suis 1330
cuucagcgugaugcccg

SEQ ID NO: 450369 - RNA, 18 nt, Brucella suis 1330
cuucauagaccccgccug

SEQ ID NO: 450370 - RNA, 16 nt, Brucella suis 1330
cuucaugaaacagggu

SEQ ID NO: 450371 - RNA, 22 nt, Brucella suis 1330
cuuauaggagcgugucuugccc

SEQ ID NO: 450372 - RNA, 13 nt, Brucella suis 1330
cuuauccagccgc

SEQ ID NO: 450373 - RNA, 22 nt, Brucella suis 1330
cuguuccaaaagucguccugug

SEQ ID NO: 450374 - RNA, 14 nt, Brucella suis 1330
cuguucagccgcag

SEQ ID NO: 450375 - RNA, 15 nt, Brucella suis 1330
cuguucagccgcagc

SEQ ID NO: 450376 - RNA, 15 nt, Brucella suis 1330
cugugucacgcagcg

SEQ ID NO: 450377 - RNA, 17 nt, Brucella suis 1330
cugugcggcugcaaaug

SEQ ID NO: 450378 - RNA, 14 nt, Brucella suis 1330
cugugacugcggca

SEQ ID NO: 450379 - RNA, 13 nt, Brucella suis 1330
cugucguuccaau

SEQ ID NO: 450380 - RNA, 15 nt, Brucella suis 1330
cugucgccagcgccg

SEQ ID NO: 450381 - RNA, 13 nt, Brucella suis 1330
cugucgcccagaa

SEQ ID NO: 450382 - RNA, 21 nt, Brucella suis 1330
cugucgauaaauccgacgggc

SEQ ID NO: 450383 - RNA, 21 nt, Brucella suis 1330
cuguccugccagcggcagacc

SEQ ID NO: 450384 - RNA, 21 nt, Brucella suis 1330
cuguccggccagcuugaaaag

SEQ ID NO: 450385 - RNA, 16 nt, Brucella suis 1330
cuguccgccugccaug

SEQ ID NO: 450386 - RNA, 21 nt, Brucella suis 1330
cugucaccgccagcagaaccg

SEQ ID NO: 450387 - RNA, 18 nt, Brucella suis 1330
cugucagcgccgcccagg

SEQ ID NO: 450388 - RNA, 15 nt, Brucella suis 1330
cuguaaccgccaccu

SEQ ID NO: 450389 - RNA, 13 nt, Brucella suis 1330
cuguaaggccugc

SEQ ID NO: 450390 - RNA, 16 nt, Brucella suis 1330
cuguaaggccugcugg

SEQ ID NO: 450391 - RNA, 17 nt, Brucella suis 1330
cugguuuuucaccaucu

SEQ ID NO: 450392 - RNA, 19 nt, Brucella suis 1330
cuggugcggcugcacacaa

SEQ ID NO: 450393 - RNA, 14 nt, Brucella suis 1330
cugguagagacugg

SEQ ID NO: 450394 - RNA, 22 nt, Brucella suis 1330
cuggguucguagcugcuuugcu

SEQ ID NO: 450395 - RNA, 20 nt, Brucella suis 1330
cugggugaauucgggguucu

SEQ ID NO: 450396 - RNA, 24 nt, Brucella suis 1330
cugggugaggcuggcgccgccgcu

SEQ ID NO: 450397 - RNA, 15 nt, Brucella suis 1330
cuggggauacgugca

SEQ ID NO: 450398 - RNA, 16 nt, Brucella suis 1330
cuggggcacgagaacg

SEQ ID NO: 450399 - RNA, 16 nt, Brucella suis 1330
cugggcgacccagcca

SEQ ID NO: 450400 - RNA, 21 nt, Brucella suis 1330
cugggccuuguuuucugccgg

SEQ ID NO: 450401 - RNA, 16 nt, Brucella suis 1330
cuggcuuuucugacca

SEQ ID NO: 450402 - RNA, 21 nt, Brucella suis 1330
cuggcuucucuugccgccgcu

SEQ ID NO: 450403 - RNA, 20 nt, Brucella suis 1330
aaacucgucggaaaauucca

SEQ ID NO: 450404 - RNA, 22 nt, Brucella suis 1330
aaacucgucggguuuuggcauc

SEQ ID NO: 450405 - RNA, 13 nt, Brucella suis 1330
cuggcggccaagc

SEQ ID NO: 450406 - RNA, 19 nt, Brucella suis 1330
cuggcggccaagcgccaga

SEQ ID NO: 450407 - RNA, 13 nt, Brucella suis 1330
cuggcggcacuug

SEQ ID NO: 450408 - RNA, 18 nt, Brucella suis 1330
cuggcgcguaauggccuc

SEQ ID NO: 450409 - RNA, 21 nt, Brucella suis 1330
cuggcgcguaauggccucgau

SEQ ID NO: 450410 - RNA, 20 nt, Brucella suis 1330
cuggcgcgcgaacgggaaca

SEQ ID NO: 450411 - RNA, 21 nt, Brucella suis 1330
cuggcgcgcgaacgggaacaa

SEQ ID NO: 450412 - RNA, 14 nt, Brucella suis 1330
cuggcgauaaagau

SEQ ID NO: 450413 - RNA, 20 nt, Brucella suis 1330
cuggccgucgcguucagccu

SEQ ID NO: 450414 - RNA, 14 nt, Brucella suis 1330
cuggcagcggcagg

SEQ ID NO: 450415 - RNA, 15 nt, Brucella suis 1330
cuggcacugucgggc

SEQ ID NO: 450416 - RNA, 13 nt, Brucella suis 1330
cuggauaucuucc

SEQ ID NO: 450417 - RNA, 15 nt, Brucella suis 1330
cuggaugaucuuugu

SEQ ID NO: 450418 - RNA, 16 nt, Brucella suis 1330
cuggagugcacggcca

SEQ ID NO: 450419 - RNA, 12 nt, Brucella suis 1330
cuggagccgcuc

SEQ ID NO: 450420 - RNA, 23 nt, Brucella suis 1330
cuggaagucauauucggccuuga

SEQ ID NO: 450421 - RNA, 23 nt, Brucella suis 1330
cugcuggccgucgcguucagccu

SEQ ID NO: 450422 - RNA, 23 nt, Brucella suis 1330
cugcucgcgguugaggauuucca

SEQ ID NO: 450423 - RNA, 14 nt, Brucella suis 1330
cugcuaaugcguuu

SEQ ID NO: 450424 - RNA, 13 nt, Brucella suis 1330
cugcgucuugugg

SEQ ID NO: 450425 - RNA, 22 nt, Brucella suis 1330
cugcgugauauugcagacacgc

SEQ ID NO: 450426 - RNA, 19 nt, Brucella suis 1330
cugcgucgcauccagaacu

SEQ ID NO: 450427 - RNA, 18 nt, Brucella suis 1330
cugcgguagcgcauggca

SEQ ID NO: 450428 - RNA, 21 nt, Brucella suis 1330
cugcgguagcgcauggcagca

SEQ ID NO: 450429 - RNA, 16 nt, Brucella suis 1330
cugcgggcggcggcuc

SEQ ID NO: 450430 - RNA, 17 nt, Brucella suis 1330
cugcgaggauuucaggu

SEQ ID NO: 450431 - RNA, 17 nt, Brucella suis 1330
cugcgaaagcgccagau

SEQ ID NO: 450432 - RNA, 16 nt, Brucella suis 1330
cugcgaaggcccuuca

SEQ ID NO: 450433 - RNA, 19 nt, Brucella suis 1330
cugccuucuucauauccuc

SEQ ID NO: 450434 - RNA, 18 nt, Brucella suis 1330
cugccuugcccccacaac

SEQ ID NO: 450435 - RNA, 18 nt, Brucella suis 1330
cugccuugucagaagcaa

SEQ ID NO: 450436 - RNA, 17 nt, Brucella suis 1330
cugccgcgaaaaagccg

SEQ ID NO: 450437 - RNA, 21 nt, Brucella suis 1330
cugcccucguccuucgaggcu

SEQ ID NO: 450438 - RNA, 22 nt, Brucella suis 1330
cugcauauuaagccgggcggcg

SEQ ID NO: 450439 - RNA, 23 nt, Brucella suis 1330
cugcagccggaagaacagcgcga

SEQ ID NO: 450440 - RNA, 14 nt, Brucella suis 1330
cugcacuugcgcca

SEQ ID NO: 450441 - RNA, 16 nt, Brucella suis 1330
cugcacgucaucaucg

SEQ ID NO: 450442 - RNA, 14 nt, Brucella suis 1330
cugcaccggcccaa

SEQ ID NO: 450443 - RNA, 14 nt, Brucella suis 1330
cugcaccagagcau

SEQ ID NO: 450444 - RNA, 19 nt, Brucella suis 1330
cugcacagccuggaugaca

SEQ ID NO: 450445 - RNA, 23 nt, Brucella suis 1330
cugaugguuagcgacuucggguc

SEQ ID NO: 450446 - RNA, 16 nt, Brucella suis 1330
cugaugagccgcuugu

SEQ ID NO: 450447 - RNA, 12 nt, Brucella suis 1330
cugauucaauca

SEQ ID NO: 450448 - RNA, 22 nt, Brucella suis 1330
cugagggaaacacucugccugc

SEQ ID NO: 450449 - RNA, 16 nt, Brucella suis 1330
cugagggauagauggu

SEQ ID NO: 450450 - RNA, 21 nt, Brucella suis 1330
cugagggguaaauccuccaga

SEQ ID NO: 450451 - RNA, 22 nt, Brucella suis 1330
cugagggguaaauccuccagau

SEQ ID NO: 450452 - RNA, 22 nt, Brucella suis 1330
cugauagaaaaacccggucuug

SEQ ID NO: 450453 - RNA, 22 nt, Brucella suis 1330
cugaggccauuuugacccugcc

SEQ ID NO: 450454 - RNA, 16 nt, Brucella suis 1330
cugacuggcggccaag

SEQ ID NO: 450455 - RNA, 13 nt, Brucella suis 1330
cugaaucuccggc

SEQ ID NO: 450456 - RNA, 14 nt, Brucella suis 1330
cucguucugccagu

SEQ ID NO: 450457 - RNA, 17 nt, Brucella suis 1330
cucguucugccaguucg

SEQ ID NO: 450458 - RNA, 17 nt, Brucella suis 1330
cucuaacuauucguuuu

SEQ ID NO: 450459 - RNA, 18 nt, Brucella suis 1330
cucggcggaagcgacgau

SEQ ID NO: 450460 - RNA, 15 nt, Brucella suis 1330
cucggcggcaucgcc

SEQ ID NO: 450461 - RNA, 18 nt, Brucella suis 1330
cucggcgcggcguucggc

SEQ ID NO: 450462 - RNA, 14 nt, Brucella suis 1330
cucgccggcuucca

SEQ ID NO: 450463 - RNA, 21 nt, Brucella suis 1330
cucgcccaccgaagccacgaa

SEQ ID NO: 450464 - RNA, 21 nt, Brucella suis 1330
cucgcagcguauucagggaca

SEQ ID NO: 450465 - RNA, 17 nt, Brucella suis 1330
cucgaugguccagucuu

SEQ ID NO: 450466 - RNA, 18 nt, Brucella suis 1330
cucgaccgcaacaggaaa

SEQ ID NO: 450467 - RNA, 14 nt, Brucella suis 1330
cucgaccgccacca

SEQ ID NO: 450468 - RNA, 20 nt, Brucella suis 1330
cucgaagaucaaguggcuuu

SEQ ID NO: 450469 - RNA, 17 nt, Brucella suis 1330
cuccucagcuauagccu

SEQ ID NO: 450470 - RNA, 21 nt, Brucella suis 1330
cucgaacagguugcgccacca

SEQ ID NO: 450471 - RNA, 22 nt, Brucella suis 1330
cuccggcuugauacugcgcgca

SEQ ID NO: 450472 - RNA, 17 nt, Brucella suis 1330
cuccgguucauuuuuag

SEQ ID NO: 450473 - RNA, 13 nt, Brucella suis 1330
cuccguaacaauu

SEQ ID NO: 450474 - RNA, 14 nt, Brucella suis 1330
cuccuaaacucauc

SEQ ID NO: 450475 - RNA, 22 nt, Brucella suis 1330
cuccuaucgugacgacggcuaa

SEQ ID NO: 450476 - RNA, 15 nt, Brucella suis 1330
cucccggcacgacca

SEQ ID NO: 450477 - RNA, 17 nt, Brucella suis 1330
cucccucacccugagga

SEQ ID NO: 450478 - RNA, 18 nt, Brucella suis 1330
cuccaugcggucggccgc

SEQ ID NO: 450479 - RNA, 17 nt, Brucella suis 1330
cuccagcccuucaucaa

SEQ ID NO: 450480 - RNA, 13 nt, Brucella suis 1330
cuccagcccuuuc

SEQ ID NO: 450481 - RNA, 17 nt, Brucella suis 1330
cucccaaagcgggcgcu

SEQ ID NO: 450482 - RNA, 15 nt, Brucella suis 1330
cucccaugcaggccg

SEQ ID NO: 450483 - RNA, 21 nt, Brucella suis 1330
cuccagauaccgguacuggcc

SEQ ID NO: 450484 - RNA, 15 nt, Brucella suis 1330
cuccagaucguccuc

SEQ ID NO: 450485 - RNA, 16 nt, Brucella suis 1330
cuccagauugcgggca

SEQ ID NO: 450486 - RNA, 18 nt, Brucella suis 1330
cuccacacgaacagcagc

SEQ ID NO: 450487 - RNA, 14 nt, Brucella suis 1330
cucauuaucagcau

SEQ ID NO: 450488 - RNA, 12 nt, Brucella suis 1330
cucaggccuugc

SEQ ID NO: 450489 - RNA, 19 nt, Brucella suis 1330
cucaggccuugcggcggcg

SEQ ID NO: 450490 - RNA, 17 nt, Brucella suis 1330
cucaggagauaggggcc

SEQ ID NO: 450491 - RNA, 14 nt, Brucella suis 1330
cucagcguuuucug

SEQ ID NO: 450492 - RNA, 16 nt, Brucella suis 1330
cucacgcgcagcagca

SEQ ID NO: 450493 - RNA, 14 nt, Brucella suis 1330
cuauuucugaugaa

SEQ ID NO: 450494 - RNA, 18 nt, Brucella suis 1330
cuauggcacaagaacagc

SEQ ID NO: 450495 - RNA, 21 nt, Brucella suis 1330
cuaguggagcaccgcccgucc

SEQ ID NO: 450496 - RNA, 18 nt, Brucella suis 1330
cuaguggauuggauuuga

SEQ ID NO: 450497 - RNA, 16 nt, Brucella suis 1330
cuauaagcaacagggc

SEQ ID NO: 450498 - RNA, 16 nt, Brucella suis 1330
cuagcgaugaugaucc

SEQ ID NO: 450499 - RNA, 23 nt, Brucella suis 1330
cuacaggucggcguaaaugcacc

SEQ ID NO: 450500 - RNA, 23 nt, Brucella suis 1330
cuacagccuagacagcagugccu

SEQ ID NO: 450501 - RNA, 13 nt, Brucella suis 1330
cguuuuccaugaa

SEQ ID NO: 450502 - RNA, 23 nt, Brucella suis 1330
cguuuccaucggggcgagcgcgc

SEQ ID NO: 450503 - RNA, 22 nt, Brucella suis 1330
cguuuccgggucuucgcccggc

SEQ ID NO: 450504 - RNA, 23 nt, Brucella suis 1330
cguuucgauauccuggccuuccu

SEQ ID NO: 450505 - RNA, 23 nt, Brucella suis 1330
cguuucgaucugauugaaucaga

SEQ ID NO: 450506 - RNA, 20 nt, Brucella suis 1330
cguugaggcguuccgccucc

SEQ ID NO: 450507 - RNA, 21 nt, Brucella suis 1330
cguuccucugccgguuuccag

SEQ ID NO: 450508 - RNA, 14 nt, Brucella suis 1330
cguuccucuuccuc

SEQ ID NO: 450509 - RNA, 20 nt, Brucella suis 1330
cguuccgccgaucugcacgg

SEQ ID NO: 450510 - RNA, 22 nt, Brucella suis 1330
cguuccgccucccugcgcgcgc

SEQ ID NO: 450511 - RNA, 15 nt, Brucella suis 1330
cguucagaucgacgc

SEQ ID NO: 450512 - RNA, 13 nt, Brucella suis 1330
cguucagccaccg

SEQ ID NO: 450513 - RNA, 20 nt, Brucella suis 1330
cguucacguaggcgcggcgu

SEQ ID NO: 450514 - RNA, 16 nt, Brucella suis 1330
cguuaugcucuauuuc

SEQ ID NO: 450515 - RNA, 16 nt, Brucella suis 1330
cuaacuauuuguuuug

SEQ ID NO: 450516 - RNA, 22 nt, Brucella suis 1330
cuaagcggaaaacggcugcaac

SEQ ID NO: 450517 - RNA, 14 nt, Brucella suis 1330
cuaauuuuaugcug

SEQ ID NO: 450518 - RNA, 15 nt, Brucella suis 1330
cgugccguuuccauc

SEQ ID NO: 450519 - RNA, 13 nt, Brucella suis 1330
cgugcgauagccc

SEQ ID NO: 450520 - RNA, 16 nt, Brucella suis 1330
cgugccgguauccggc

SEQ ID NO: 450521 - RNA, 21 nt, Brucella suis 1330
cgugaucucauccacagucac

SEQ ID NO: 450522 - RNA, 13 nt, Brucella suis 1330
cgugaugagccgc

SEQ ID NO: 450523 - RNA, 22 nt, Brucella suis 1330
cgugaaucugaggccauuuuga

SEQ ID NO: 450524 - RNA, 23 nt, Brucella suis 1330
cgugaagaauggcaagcagcaaa

SEQ ID NO: 450525 - RNA, 23 nt, Brucella suis 1330
cgucuucgcccgacugcacgucu

SEQ ID NO: 450526 - RNA, 16 nt, Brucella suis 1330
cgucguaaucgccggu

SEQ ID NO: 450527 - RNA, 22 nt, Brucella suis 1330
cgucgccauuaguaucggcagc

SEQ ID NO: 450528 - RNA, 18 nt, Brucella suis 1330
cgucccggaagccgccuu

SEQ ID NO: 450529 - RNA, 15 nt, Brucella suis 1330
cguccgagcggcagc

SEQ ID NO: 450530 - RNA, 15 nt, Brucella suis 1330
cguccagaucggccu

SEQ ID NO: 450531 - RNA, 15 nt, Brucella suis 1330
cguccaccaccucgc

SEQ ID NO: 450532 - RNA, 22 nt, Brucella suis 1330
cgucauugaacagguuuccggc

SEQ ID NO: 450533 - RNA, 13 nt, Brucella suis 1330
cgucauucaucag

SEQ ID NO: 450534 - RNA, 15 nt, Brucella suis 1330
cgucagggaaaugcg

SEQ ID NO: 450535 - RNA, 13 nt, Brucella suis 1330
cgucagcaccgcu

SEQ ID NO: 450536 - RNA, 20 nt, Brucella suis 1330
cgucaggccgaugacggcgc

SEQ ID NO: 450537 - RNA, 14 nt, Brucella suis 1330
cgucacugcaaaaa

SEQ ID NO: 450538 - RNA, 15 nt, Brucella suis 1330
cgucacugcaaaaaa

SEQ ID NO: 450539 - RNA, 20 nt, Brucella suis 1330
cgucaccggcugggccuugu

SEQ ID NO: 450540 - RNA, 12 nt, Brucella suis 1330
cguaucuccggg

SEQ ID NO: 450541 - RNA, 14 nt, Brucella suis 1330
cguaucgccaaaga

SEQ ID NO: 450542 - RNA, 19 nt, Brucella suis 1330
cguauccaggugcagucuu

SEQ ID NO: 450543 - RNA, 20 nt, Brucella suis 1330
cguauccaggugcagucuuc

SEQ ID NO: 450544 - RNA, 16 nt, Brucella suis 1330
cguacggcccucgacc

SEQ ID NO: 450545 - RNA, 20 nt, Brucella suis 1330
cguaccggcaucagccuucg

SEQ ID NO: 450546 - RNA, 16 nt, Brucella suis 1330
cguaccgaauccacgu

SEQ ID NO: 450547 - RNA, 18 nt, Brucella suis 1330
cguaauggccucgauggc

SEQ ID NO: 450548 - RNA, 14 nt, Brucella suis 1330
aaaaacaacagcag

SEQ ID NO: 450549 - RNA, 18 nt, Brucella suis 1330
aaaaagcccggcuggaau

SEQ ID NO: 450550 - RNA, 16 nt, Brucella suis 1330
aaaaagcccggucucg

SEQ ID NO: 450551 - RNA, 18 nt, Brucella suis 1330
aaaaaggcgaucagguug

SEQ ID NO: 450552 - RNA, 22 nt, Brucella suis 1330
aaaaacuggugcgucaggccca

SEQ ID NO: 450553 - RNA, 13 nt, Brucella suis 1330
aaaaacccggccu

SEQ ID NO: 450554 - RNA, 21 nt, Brucella suis 1330
aaaaacgcuuuccggcaaaaa

SEQ ID NO: 450555 - RNA, 17 nt, Brucella suis 1330
aaaaaucgcgcggcuua

SEQ ID NO: 450556 - RNA, 15 nt, Brucella suis 1330
aaaaauggaaaaacc

SEQ ID NO: 450557 - RNA, 23 nt, Brucella suis 1330
aaaaccgguucccacuuucggga

SEQ ID NO: 450558 - RNA, 21 nt, Brucella suis 1330
aaacaucgacauggacaggau

SEQ ID NO: 450559 - RNA, 18 nt, Brucella suis 1330
aaaccaucgagcauuuca

SEQ ID NO: 450560 - RNA, 12 nt, Brucella suis 1330
aaacccgaccag

SEQ ID NO: 450561 - RNA, 18 nt, Brucella suis 1330
aaacccggcgcaaaggcc

SEQ ID NO: 450562 - RNA, 22 nt, Brucella suis 1330
aaaccggccaugcccaugcagu

SEQ ID NO: 450563 - RNA, 15 nt, Brucella suis 1330
aaaccggcuggcuuu

SEQ ID NO: 450564 - RNA, 19 nt, Brucella suis 1330
aaaccggggcggacggggu

SEQ ID NO: 450565 - RNA, 22 nt, Brucella suis 1330
aaacagcauauugccgagcaug

SEQ ID NO: 450566 - RNA, 12 nt, Brucella suis 1330
aaacaccgcgca

SEQ ID NO: 450567 - RNA, 15 nt, Brucella suis 1330
aaaacgcgccgauac

SEQ ID NO: 450568 - RNA, 18 nt, Brucella suis 1330
aaaaggccgggaaaaccg

SEQ ID NO: 450569 - RNA, 22 nt, Brucella suis 1330
aaaaggccuuccgcgucggaaa

SEQ ID NO: 450570 - RNA, 23 nt, Brucella suis 1330
aaaagugagaaacgguuuugcgu

SEQ ID NO: 450571 - RNA, 16 nt, Brucella suis 1330
aaaauaucaaagcgcu

SEQ ID NO: 450572 - RNA, 18 nt, Brucella suis 1330
aaaaucuguucacauuuc

SEQ ID NO: 450573 - RNA, 13 nt, Brucella suis 1330
aaaauggcccugu

SEQ ID NO: 450574 - RNA, 17 nt, Brucella suis 1330
aaaaugggcugauuuag

SEQ ID NO: 450575 - RNA, 20 nt, Brucella suis 1330
aacaagagggcgcagcagcg

SEQ ID NO: 450576 - RNA, 13 nt, Brucella suis 1330
aacaagcagaugc

SEQ ID NO: 450577 - RNA, 12 nt, Brucella suis 1330
aacaaaugcaaa

SEQ ID NO: 450578 - RNA, 17 nt, Brucella suis 1330
aacaaaugcaaaugccg

SEQ ID NO: 450579 - RNA, 16 nt, Brucella suis 1330
aaaugggcugauuuag

SEQ ID NO: 450580 - RNA, 20 nt, Brucella suis 1330
aaauggcccugucagcgaaa

SEQ ID NO: 450581 - RNA, 17 nt, Brucella suis 1330
aaaugcaccgccugcca

SEQ ID NO: 450582 - RNA, 20 nt, Brucella suis 1330
aaauccauagcgaauggcaa

SEQ ID NO: 450583 - RNA, 20 nt, Brucella suis 1330
aaagcggauuggcguucaca

SEQ ID NO: 450584 - RNA, 20 nt, Brucella suis 1330
aaagcgcaucccgaaaagug

SEQ ID NO: 450585 - RNA, 20 nt, Brucella suis 1330
aaagcgccagauucagggca

SEQ ID NO: 450586 - RNA, 21 nt, Brucella suis 1330
aaagcgcgcgccaagacuuuc

SEQ ID NO: 450587 - RNA, 20 nt, Brucella suis 1330
aaagccuuuucgauaacgaa

SEQ ID NO: 450588 - RNA, 13 nt, Brucella suis 1330
aaagcauaucuuc

SEQ ID NO: 450589 - RNA, 19 nt, Brucella suis 1330
aaagccguccaggcaucau

SEQ ID NO: 450590 - RNA, 21 nt, Brucella suis 1330
aaagcugccgcgaaaaagccg

SEQ ID NO: 450591 - RNA, 17 nt, Brucella suis 1330
aaagcuuuccagcggaa

SEQ ID NO: 450592 - RNA, 13 nt, Brucella suis 1330
aaaggauauccuu

SEQ ID NO: 450593 - RNA, 23 nt, Brucella suis 1330
aaaggaugaaugccgaagccagg

SEQ ID NO: 450594 - RNA, 20 nt, Brucella suis 1330
aaaggcgauggcuugcggca

SEQ ID NO: 450595 - RNA, 17 nt, Brucella suis 1330
aaaggcgaucagguuga

SEQ ID NO: 450596 - RNA, 14 nt, Brucella suis 1330
aaaggcucugcgcc

SEQ ID NO: 450597 - RNA, 21 nt, Brucella suis 1330
aaagggugcgagcaggcuuuc

SEQ ID NO: 450598 - RNA, 17 nt, Brucella suis 1330
aaaggucgggugccaga

SEQ ID NO: 450599 - RNA, 20 nt, Brucella suis 1330
aaagcacagccagaaagaag

SEQ ID NO: 450600 - RNA, 21 nt, Brucella suis 1330
aaagcacagccagaaagaaga

SEQ ID NO: 450601 - RNA, 18 nt, Brucella suis 1330
aaagaugcgcgccagccg

SEQ ID NO: 450602 - RNA, 19 nt, Brucella suis 1330
aaagaugcgcgccagccgc

SEQ ID NO: 450603 - RNA, 21 nt, Brucella suis 1330
aaagaugcgcgucaaaacaaa

SEQ ID NO: 450604 - RNA, 23 nt, Brucella suis 1330
aaagaugcgcgucaaaacaaagg

SEQ ID NO: 450605 - RNA, 17 nt, Brucella suis 1330
aaagaccagcaggaaga

SEQ ID NO: 450606 - RNA, 14 nt, Brucella suis 1330
aaagauccuucaca

SEQ ID NO: 450607 - RNA, 16 nt, Brucella suis 1330
aaagauccuucacaua

SEQ ID NO: 450608 - RNA, 22 nt, Brucella suis 1330
aaagauccuucacauauugugc

SEQ ID NO: 450609 - RNA, 10 nt, Brucella suis 1330
aaagaucugc

SEQ ID NO: 450610 - RNA, 18 nt, Brucella suis 1330
aaagaucugcaucccgaa

SEQ ID NO: 450611 - RNA, 22 nt, Brucella suis 1330
aaagaagaugagcgacaggaac

SEQ ID NO: 450612 - RNA, 16 nt, Brucella suis 1330
aaagugugaugcgguu

SEQ ID NO: 450613 - RNA, 13 nt, Brucella suis 1330
aaauaaugccaag

SEQ ID NO: 450614 - RNA, 19 nt, Brucella suis 1330
aaauacaccaaugcaggcg

SEQ ID NO: 450615 - RNA, 23 nt, Brucella suis 1330
cacgucaucaucgucuucaagca

SEQ ID NO: 450616 - RNA, 15 nt, Brucella suis 1330
cacgguugccuugcu

SEQ ID NO: 450617 - RNA, 12 nt, Brucella suis 1330
aaaauauagccg

SEQ ID NO: 450618 - RNA, 13 nt, Brucella suis 1330
cacggucagauca

SEQ ID NO: 450619 - RNA, 16 nt, Brucella suis 1330
cacggacgaucuggaa

SEQ ID NO: 450620 - RNA, 12 nt, Brucella suis 1330
cacgcuugcccg

SEQ ID NO: 450621 - RNA, 14 nt, Brucella suis 1330
cacgccggaacacc

SEQ ID NO: 450622 - RNA, 18 nt, Brucella suis 1330
cacgcagggucgcgaccu

SEQ ID NO: 450623 - RNA, 22 nt, Brucella suis 1330
cacgcaaugugcgggcuucuuc

SEQ ID NO: 450624 - RNA, 15 nt, Brucella suis 1330
caccuuguugccauu

SEQ ID NO: 450625 - RNA, 21 nt, Brucella suis 1330
caccugacggauuucggcggc

SEQ ID NO: 450626 - RNA, 21 nt, Brucella suis 1330
caccugauacaaaacgccggc

SEQ ID NO: 450627 - RNA, 18 nt, Brucella suis 1330
caccggcccaaaggccgc

SEQ ID NO: 450628 - RNA, 23 nt, Brucella suis 1330
caccgcccggaucaaaccggcca

SEQ ID NO: 450629 - RNA, 18 nt, Brucella suis 1330
caccgcaaguggcgcuga

SEQ ID NO: 450630 - RNA, 15 nt, Brucella suis 1330
caccgauggccagga

SEQ ID NO: 450631 - RNA, 17 nt, Brucella suis 1330
caccgauggccaggaaa

SEQ ID NO: 450632 - RNA, 21 nt, Brucella suis 1330
caccgaacugggcggccagcu

SEQ ID NO: 450633 - RNA, 15 nt, Brucella suis 1330
caccgaaauccaggc

SEQ ID NO: 450634 - RNA, 14 nt, Brucella suis 1330
cacccggccgcccu

SEQ ID NO: 450635 - RNA, 16 nt, Brucella suis 1330
cacccgcacgccgugc

SEQ ID NO: 450636 - RNA, 17 nt, Brucella suis 1330
cacccgauaaacccgcc

SEQ ID NO: 450637 - RNA, 19 nt, Brucella suis 1330
cacccgauaaacccgcccc

SEQ ID NO: 450638 - RNA, 13 nt, Brucella suis 1330
caccauucugccc

SEQ ID NO: 450639 - RNA, 18 nt, Brucella suis 1330
caccauugggcauggaaa

SEQ ID NO: 450640 - RNA, 19 nt, Brucella suis 1330
caccaugcggcuccaguuc

SEQ ID NO: 450641 - RNA, 20 nt, Brucella suis 1330
caccaugcggcuccaguucc

SEQ ID NO: 450642 - RNA, 22 nt, Brucella suis 1330
caccauggugucauagaccaug

SEQ ID NO: 450643 - RNA, 11 nt, Brucella suis 1330
caccaucaucg

SEQ ID NO: 450644 - RNA, 22 nt, Brucella suis 1330
caccaucgaggaauaggcgcca

SEQ ID NO: 450645 - RNA, 22 nt, Brucella suis 1330
caccaccgggcagucagcaccg

SEQ ID NO: 450646 - RNA, 18 nt, Brucella suis 1330
cacauggcggccuuuucg

SEQ ID NO: 450647 - RNA, 13 nt, Brucella suis 1330
cacaugcgcgccc

SEQ ID NO: 450648 - RNA, 15 nt, Brucella suis 1330
cacaugcgcgcccuc

SEQ ID NO: 450649 - RNA, 21 nt, Brucella suis 1330
cacauugccuucgcgccaggc

SEQ ID NO: 450650 - RNA, 20 nt, Brucella suis 1330
cacauugucugaaaacgaau

SEQ ID NO: 450651 - RNA, 13 nt, Brucella suis 1330
cacauuucaugaa

SEQ ID NO: 450652 - RNA, 11 nt, Brucella suis 1330
caccaagaccg

SEQ ID NO: 450653 - RNA, 14 nt, Brucella suis 1330
caccaagaccgccg

SEQ ID NO: 450654 - RNA, 20 nt, Brucella suis 1330
cacagucacgccaucagcau

SEQ ID NO: 450655 - RNA, 15 nt, Brucella suis 1330
cacaggaucgcaccg

SEQ ID NO: 450656 - RNA, 22 nt, Brucella suis 1330
cacagccgguucggauccuccu

SEQ ID NO: 450657 - RNA, 15 nt, Brucella suis 1330
cacagccccuugccc

SEQ ID NO: 450658 - RNA, 17 nt, Brucella suis 1330
cacagccccuugccccg

SEQ ID NO: 450659 - RNA, 13 nt, Brucella suis 1330
cacaccugcacca

SEQ ID NO: 450660 - RNA, 14 nt, Brucella suis 1330
cacaccgaacuggg

SEQ ID NO: 450661 - RNA, 15 nt, Brucella suis 1330
cacaaugugaaugaa

SEQ ID NO: 450662 - RNA, 15 nt, Brucella suis 1330
caauuuaucaugacc

SEQ ID NO: 450663 - RNA, 18 nt, Brucella suis 1330
caaugcgccgugcagggu

SEQ ID NO: 450664 - RNA, 18 nt, Brucella suis 1330
caaugccgcauucagcac

SEQ ID NO: 450665 - RNA, 19 nt, Brucella suis 1330
caaugcccugcugcaacaa

SEQ ID NO: 450666 - RNA, 17 nt, Brucella suis 1330
caaugcaccgauggcca

SEQ ID NO: 450667 - RNA, 16 nt, Brucella suis 1330
caaugcaggcgcggca

SEQ ID NO: 450668 - RNA, 23 nt, Brucella suis 1330
caaugaaaacggugaucaggacc

SEQ ID NO: 450669 - RNA, 23 nt, Brucella suis 1330
caaugagcccgcgcaggauuuca

SEQ ID NO: 450670 - RNA, 19 nt, Brucella suis 1330
caaugauguucggcaaggc

SEQ ID NO: 450671 - RNA, 16 nt, Brucella suis 1330
caaucgccggaaccgc

SEQ ID NO: 450672 - RNA, 14 nt, Brucella suis 1330
caagggcuggcucu

SEQ ID NO: 450673 - RNA, 14 nt, Brucella suis 1330
caagggcggcaagc

SEQ ID NO: 450674 - RNA, 19 nt, Brucella suis 1330
caaggcgcgggaugacgcc

SEQ ID NO: 450675 - RNA, 13 nt, Brucella suis 1330
caaggccuguucc

SEQ ID NO: 450676 - RNA, 15 nt, Brucella suis 1330
caaggccguuauuuc

SEQ ID NO: 450677 - RNA, 15 nt, Brucella suis 1330
caaggccggaagcgc

SEQ ID NO: 450678 - RNA, 16 nt, Brucella suis 1330
caaggccgagcgccgc

SEQ ID NO: 450679 - RNA, 18 nt, Brucella suis 1330
caaggccgcgcuccagau

SEQ ID NO: 450680 - RNA, 14 nt, Brucella suis 1330
caaggccccagauc

SEQ ID NO: 450681 - RNA, 17 nt, Brucella suis 1330
caaggagcgagcuugca

SEQ ID NO: 450682 - RNA, 17 nt, Brucella suis 1330
caagcuuuugcagccgu

SEQ ID NO: 450683 - RNA, 14 nt, Brucella suis 1330
caagcgucuucuga

SEQ ID NO: 450684 - RNA, 15 nt, Brucella suis 1330
caagcgucuucugag

SEQ ID NO: 450685 - RNA, 17 nt, Brucella suis 1330
caagcgugagaccagcg

SEQ ID NO: 450686 - RNA, 20 nt, Brucella suis 1330
caagcggauaguucaaggcu

SEQ ID NO: 450687 - RNA, 14 nt, Brucella suis 1330
caagccccagcacg

SEQ ID NO: 450688 - RNA, 20 nt, Brucella suis 1330
caagcccagaaauccauagc

SEQ ID NO: 450689 - RNA, 17 nt, Brucella suis 1330
caagccaguccuugccc

SEQ ID NO: 450690 - RNA, 22 nt, Brucella suis 1330
caagcacuacgucaacagccgu

SEQ ID NO: 450691 - RNA, 21 nt, Brucella suis 1330
caagaagcaagugugaaagca

SEQ ID NO: 450692 - RNA, 23 nt, Brucella suis 1330
caagaaagaucagccagccgaca

SEQ ID NO: 450693 - RNA, 17 nt, Brucella suis 1330
caagaacagccgccccg

SEQ ID NO: 450694 - RNA, 21 nt, Brucella suis 1330
caacuucuuuguucugcagca

SEQ ID NO: 450695 - RNA, 15 nt, Brucella suis 1330
caacgcccuucaaac

SEQ ID NO: 450696 - RNA, 22 nt, Brucella suis 1330
caacgcccuucaaaccauccuc

SEQ ID NO: 450697 - RNA, 17 nt, Brucella suis 1330
caacgccgucagccccg

SEQ ID NO: 450698 - RNA, 23 nt, Brucella suis 1330
caacgacggcuguuuucgaggcc

SEQ ID NO: 450699 - RNA, 22 nt, Brucella suis 1330
caacgaccagcugaauacgacc

SEQ ID NO: 450700 - RNA, 21 nt, Brucella suis 1330
caaccgccucggccuuuuugu

SEQ ID NO: 450701 - RNA, 13 nt, Brucella suis 1330
caaccgcgccgcu

SEQ ID NO: 450702 - RNA, 16 nt, Brucella suis 1330
caacccgaugagccaa

SEQ ID NO: 450703 - RNA, 19 nt, Brucella suis 1330
caacccgaugagccaaacu

SEQ ID NO: 450704 - RNA, 16 nt, Brucella suis 1330
caaccaaaacauacuc

SEQ ID NO: 450705 - RNA, 22 nt, Brucella suis 1330
caacagggcgaaaagccgccuc

SEQ ID NO: 450706 - RNA, 14 nt, Brucella suis 1330
caacaaggcgaaau

SEQ ID NO: 450707 - RNA, 15 nt, Brucella suis 1330
caacacgcgcuccag

SEQ ID NO: 450708 - RNA, 20 nt, Brucella suis 1330
caaaaguuuucagcggcggg

SEQ ID NO: 450709 - RNA, 21 nt, Brucella suis 1330
caaaaccacgguggcucaaau

SEQ ID NO: 450710 - RNA, 20 nt, Brucella suis 1330
caaaacccggcgcaaaggcc

SEQ ID NO: 450711 - RNA, 21 nt, Brucella suis 1330
caaaauggugcugccauggca

SEQ ID NO: 450712 - RNA, 17 nt, Brucella suis 1330
caaagcuuuccagcgga

SEQ ID NO: 450713 - RNA, 21 nt, Brucella suis 1330
caaaggaaagauccuucacau

SEQ ID NO: 450714 - RNA, 17 nt, Brucella suis 1330
caaaaauggaaaaaccc

SEQ ID NO: 450715 - RNA, 20 nt, Brucella suis 1330
caaaacagcgccauuugcag

SEQ ID NO: 450716 - RNA, 17 nt, Brucella suis 1330
auuuggaaguuuuccug

SEQ ID NO: 450717 - RNA, 15 nt, Brucella suis 1330
auuuccaccacgcgc

SEQ ID NO: 450718 - RNA, 12 nt, Brucella suis 1330
auuuccagcaaa

SEQ ID NO: 450719 - RNA, 17 nt, Brucella suis 1330
auuuccagcaaaagugc

SEQ ID NO: 450720 - RNA, 23 nt, Brucella suis 1330
auuucaucgagaauuucucuugc

SEQ ID NO: 450721 - RNA, 21 nt, Brucella suis 1330
auuggcgauuuucugcacagc

SEQ ID NO: 450722 - RNA, 19 nt, Brucella suis 1330
auuggcccccaacuucuuu

SEQ ID NO: 450723 - RNA, 15 nt, Brucella suis 1330
auuggaucagucgac

SEQ ID NO: 450724 - RNA, 22 nt, Brucella suis 1330
auuggcagcgccggggccaaag

SEQ ID NO: 450725 - RNA, 16 nt, Brucella suis 1330
auuggaacucgaagau

SEQ ID NO: 450726 - RNA, 14 nt, Brucella suis 1330
auugcgcuaucagc

SEQ ID NO: 450727 - RNA, 22 nt, Brucella suis 1330
auuuacguuuucgucaaaguua

SEQ ID NO: 450728 - RNA, 20 nt, Brucella suis 1330
auugaaugccagauaaccug

SEQ ID NO: 450729 - RNA, 12 nt, Brucella suis 1330
auugagagauuu

SEQ ID NO: 450730 - RNA, 14 nt, Brucella suis 1330
auucuuucuugcgc

SEQ ID NO: 450731 - RNA, 18 nt, Brucella suis 1330
auugaaauucuuuugggc

SEQ ID NO: 450732 - RNA, 23 nt, Brucella suis 1330
auucggcgaccgccuuuuccagu

SEQ ID NO: 450733 - RNA, 12 nt, Brucella suis 1330
auucggcuucac

SEQ ID NO: 450734 - RNA, 14 nt, Brucella suis 1330
auucgggguucuuc

SEQ ID NO: 450735 - RNA, 15 nt, Brucella suis 1330
auuccgccggggcag

SEQ ID NO: 450736 - RNA, 17 nt, Brucella suis 1330
auuccccuauuccccua

SEQ ID NO: 450737 - RNA, 20 nt, Brucella suis 1330
auucccuuaacauacugccu

SEQ ID NO: 450738 - RNA, 11 nt, Brucella suis 1330
auucccauuga

SEQ ID NO: 450739 - RNA, 18 nt, Brucella suis 1330
auucaaugccacccuuug

SEQ ID NO: 450740 - RNA, 15 nt, Brucella suis 1330
aaaaggcgcaaugug

SEQ ID NO: 450741 - RNA, 21 nt, Brucella suis 1330
auucaaccauauaaagcuuga

SEQ ID NO: 450742 - RNA, 17 nt, Brucella suis 1330
auucaaccguuuccuga

SEQ ID NO: 450743 - RNA, 18 nt, Brucella suis 1330
auucaggauagauauuuc

SEQ ID NO: 450744 - RNA, 22 nt, Brucella suis 1330
auucaggaucuuuccaaguuca

SEQ ID NO: 450745 - RNA, 20 nt, Brucella suis 1330
auuauccgacgcaucgaagc

SEQ ID NO: 450746 - RNA, 12 nt, Brucella suis 1330
auuaaucaaaaa

SEQ ID NO: 450747 - RNA, 16 nt, Brucella suis 1330
auuaaacuaccaucug

SEQ ID NO: 450748 - RNA, 15 nt, Brucella suis 1330
augucaugcuccgca

SEQ ID NO: 450749 - RNA, 19 nt, Brucella suis 1330
augguccgcaccauucugc

SEQ ID NO: 450750 - RNA, 17 nt, Brucella suis 1330
augguuuuagcccgguu

SEQ ID NO: 450751 - RNA, 12 nt, Brucella suis 1330
auggucaagagc

SEQ ID NO: 450752 - RNA, 22 nt, Brucella suis 1330
auggggcuggccgacaccgacc

SEQ ID NO: 450753 - RNA, 13 nt, Brucella suis 1330
augggggccgggc

SEQ ID NO: 450754 - RNA, 21 nt, Brucella suis 1330
auggcgguaaugcuggccacc

SEQ ID NO: 450755 - RNA, 16 nt, Brucella suis 1330
auggcgggccauuucc

SEQ ID NO: 450756 - RNA, 16 nt, Brucella suis 1330
auggcgaaaucgccac

SEQ ID NO: 450757 - RNA, 14 nt, Brucella suis 1330
auggccugcugcau

SEQ ID NO: 450758 - RNA, 15 nt, Brucella suis 1330
auggcauuggcugcu

SEQ ID NO: 450759 - RNA, 16 nt, Brucella suis 1330
auggccacgcaaucuu

SEQ ID NO: 450760 - RNA, 20 nt, Brucella suis 1330
augcuggcagcggcaggagc

SEQ ID NO: 450761 - RNA, 14 nt, Brucella suis 1330
augcuggccaccag

SEQ ID NO: 450762 - RNA, 16 nt, Brucella suis 1330
augcuggccaccagaa

SEQ ID NO: 450763 - RNA, 14 nt, Brucella suis 1330
augcucuuucugga

SEQ ID NO: 450764 - RNA, 21 nt, Brucella suis 1330
augcucuuucuggacaaagaa

SEQ ID NO: 450765 - RNA, 20 nt, Brucella suis 1330
augcgugguccagccagccg

SEQ ID NO: 450766 - RNA, 17 nt, Brucella suis 1330
augcggguggguuugag

SEQ ID NO: 450767 - RNA, 14 nt, Brucella suis 1330
augcggugcacgaa

SEQ ID NO: 450768 - RNA, 19 nt, Brucella suis 1330
augcguaaaaauaaagaaa

SEQ ID NO: 450769 - RNA, 19 nt, Brucella suis 1330
augcguaccauaggcgcgc

SEQ ID NO: 450770 - RNA, 22 nt, Brucella suis 1330
augcgguccgaauuugcugccu

SEQ ID NO: 450771 - RNA, 14 nt, Brucella suis 1330
augcggcggcgcgc

SEQ ID NO: 450772 - RNA, 17 nt, Brucella suis 1330
augcggcggugaaaaua

SEQ ID NO: 450773 - RNA, 20 nt, Brucella suis 1330
augcggaucguaucgccaau

SEQ ID NO: 450774 - RNA, 20 nt, Brucella suis 1330
augcgcuuuaaagcaggauc

SEQ ID NO: 450775 - RNA, 12 nt, Brucella suis 1330
augcgcuugccc

SEQ ID NO: 450776 - RNA, 17 nt, Brucella suis 1330
augcgauuucgccuucg

SEQ ID NO: 450777 - RNA, 16 nt, Brucella suis 1330
augccggucgcaggcg

SEQ ID NO: 450778 - RNA, 17 nt, Brucella suis 1330
augccggcgaucuuuuc

SEQ ID NO: 450779 - RNA, 21 nt, Brucella suis 1330
augcccugcugcaacaaaaug

SEQ ID NO: 450780 - RNA, 14 nt, Brucella suis 1330
augccccgcaccga

SEQ ID NO: 450781 - RNA, 23 nt, Brucella suis 1330
augcccgccaauaccgugaucag

SEQ ID NO: 450782 - RNA, 14 nt, Brucella suis 1330
augcccgcuuuccc

SEQ ID NO: 450783 - RNA, 22 nt, Brucella suis 1330
augcccaugcaguuccauccau

SEQ ID NO: 450784 - RNA, 23 nt, Brucella suis 1330
augcccacaucgccuugcagaua

SEQ ID NO: 450785 - RNA, 19 nt, Brucella suis 1330
augcaguuccauccauuga

SEQ ID NO: 450786 - RNA, 16 nt, Brucella suis 1330
augcaggccgugaaga

SEQ ID NO: 450787 - RNA, 22 nt, Brucella suis 1330
augcaggccgugaagauugcuu

SEQ ID NO: 450788 - RNA, 15 nt, Brucella suis 1330
augaucgccagcacg

SEQ ID NO: 450789 - RNA, 14 nt, Brucella suis 1330
augauccagguaua

SEQ ID NO: 450790 - RNA, 15 nt, Brucella suis 1330
augauagcugcaucc

SEQ ID NO: 450791 - RNA, 18 nt, Brucella suis 1330
augauagcuggaaaaaau

SEQ ID NO: 450792 - RNA, 21 nt, Brucella suis 1330
augauaggcaacaucgccuug

SEQ ID NO: 450793 - RNA, 16 nt, Brucella suis 1330
augagcggcagcagcc

SEQ ID NO: 450794 - RNA, 21 nt, Brucella suis 1330
augagccgcuucugcucacca

SEQ ID NO: 450795 - RNA, 11 nt, Brucella suis 1330
augagccucaa

SEQ ID NO: 450796 - RNA, 21 nt, Brucella suis 1330
augacauccaugaaagccaca

SEQ ID NO: 450797 - RNA, 20 nt, Brucella suis 1330
augacugaaggggcaaauuu

SEQ ID NO: 450798 - RNA, 23 nt, Brucella suis 1330
augacuucgguuuccacauccgc

SEQ ID NO: 450799 - RNA, 14 nt, Brucella suis 1330
augaagguaagcuu

SEQ ID NO: 450800 - RNA, 12 nt, Brucella suis 1330
augaaucaccag

SEQ ID NO: 450801 - RNA, 21 nt, Brucella suis 1330
augaagcgggccgcuugcuug

SEQ ID NO: 450802 - RNA, 22 nt, Brucella suis 1330
augaacagaucggaaucaaaac

SEQ ID NO: 450803 - RNA, 17 nt, Brucella suis 1330
aucuucgaucauuuccu

SEQ ID NO: 450804 - RNA, 16 nt, Brucella suis 1330
aucuggcugagauaaa

SEQ ID NO: 450805 - RNA, 16 nt, Brucella suis 1330
aucuguaucccgaaaa

SEQ ID NO: 450806 - RNA, 22 nt, Brucella suis 1330
aucugcggcggcgucagcuugu

SEQ ID NO: 450807 - RNA, 13 nt, Brucella suis 1330
aucugaaugaauc

SEQ ID NO: 450808 - RNA, 17 nt, Brucella suis 1330
aucugacagaauuugga

SEQ ID NO: 450809 - RNA, 14 nt, Brucella suis 1330
aucucauccacagu

SEQ ID NO: 450810 - RNA, 12 nt, Brucella suis 1330
aucucucgccug

SEQ ID NO: 450811 - RNA, 11 nt, Brucella suis 1330
aucgucacuga

SEQ ID NO: 450812 - RNA, 19 nt, Brucella suis 1330
aucguauccccggcaaaga

SEQ ID NO: 450813 - RNA, 20 nt, Brucella suis 1330
aucgucaaucacgccacugc

SEQ ID NO: 450814 - RNA, 19 nt, Brucella suis 1330
aucggguacgaaccacggc

SEQ ID NO: 450815 - RNA, 14 nt, Brucella suis 1330
aucggguugacgau

SEQ ID NO: 450816 - RNA, 17 nt, Brucella suis 1330
aucguaaucgccgggcc

SEQ ID NO: 450817 - RNA, 15 nt, Brucella suis 1330
aucggcgggccaggu

SEQ ID NO: 450818 - RNA, 16 nt, Brucella suis 1330
aucggcgcgcuuggca

SEQ ID NO: 450819 - RNA, 19 nt, Brucella suis 1330
aucggcgaggaagagaauc

SEQ ID NO: 450820 - RNA, 16 nt, Brucella suis 1330
aucggcgaggucuccc

SEQ ID NO: 450821 - RNA, 13 nt, Brucella suis 1330
aucggcagccuug

SEQ ID NO: 450822 - RNA, 15 nt, Brucella suis 1330
aucggaaucaaaacc

SEQ ID NO: 450823 - RNA, 17 nt, Brucella suis 1330
aucgcucaccuuuucca

SEQ ID NO: 450824 - RNA, 15 nt, Brucella suis 1330
aucgcggcagccgcc

SEQ ID NO: 450825 - RNA, 23 nt, Brucella suis 1330
aucgccgcccuugugaucgccac

SEQ ID NO: 450826 - RNA, 21 nt, Brucella suis 1330
aucgauccaguugucgccggg

SEQ ID NO: 450827 - RNA, 20 nt, Brucella suis 1330
aucgaagcgggaccauaaau

SEQ ID NO: 450828 - RNA, 18 nt, Brucella suis 1330
aucgacaaucuccccuuc

SEQ ID NO: 450829 - RNA, 14 nt, Brucella suis 1330
aucgacaggcgccu

SEQ ID NO: 450830 - RNA, 23 nt, Brucella suis 1330
aucgacauauuugucgccgacuu

SEQ ID NO: 450831 - RNA, 22 nt, Brucella suis 1330
aucgaccaggaugugucggcca

SEQ ID NO: 450832 - RNA, 17 nt, Brucella suis 1330
auccuugaugcccagcu

SEQ ID NO: 450833 - RNA, 23 nt, Brucella suis 1330
auccgcggcgguuuugagcugcu

SEQ ID NO: 450834 - RNA, 17 nt, Brucella suis 1330
auccuggccuuccuuga

SEQ ID NO: 450835 - RNA, 18 nt, Brucella suis 1330
auccgcauucccuugaaa

SEQ ID NO: 450836 - RNA, 17 nt, Brucella suis 1330
auccgccaaucagaaug

SEQ ID NO: 450837 - RNA, 15 nt, Brucella suis 1330
auccgccaccgguuu

SEQ ID NO: 450838 - RNA, 19 nt, Brucella suis 1330
auccgcaacucauggaagu

SEQ ID NO: 450839 - RNA, 22 nt, Brucella suis 1330
auccgaucggcgcucuaauccu

SEQ ID NO: 450840 - RNA, 17 nt, Brucella suis 1330
auccgaggcgcgcagca

SEQ ID NO: 450841 - RNA, 18 nt, Brucella suis 1330
aucccguuuugagaugac

SEQ ID NO: 450842 - RNA, 19 nt, Brucella suis 1330
aucccucaaaacgcugcca

SEQ ID NO: 450843 - RNA, 19 nt, Brucella suis 1330
aucccgcuucgaugcgcug

SEQ ID NO: 450844 - RNA, 21 nt, Brucella suis 1330
aucccgccccuaaaggcucug

SEQ ID NO: 450845 - RNA, 23 nt, Brucella suis 1330
auccaggugcagucuucggccgg

SEQ ID NO: 450846 - RNA, 19 nt, Brucella suis 1330
aaaagaaaaagcccggucu

SEQ ID NO: 450847 - RNA, 21 nt, Brucella suis 1330
aucauuuauuuuagcugcugu

SEQ ID NO: 450848 - RNA, 14 nt, Brucella suis 1330
aucauuuccuucca

SEQ ID NO: 450849 - RNA, 19 nt, Brucella suis 1330
aucauccauuccucaagau

SEQ ID NO: 450850 - RNA, 16 nt, Brucella suis 1330
aucaucacauuggugc

SEQ ID NO: 450851 - RNA, 16 nt, Brucella suis 1330
aucaucaaggaaaaaa

SEQ ID NO: 450852 - RNA, 20 nt, Brucella suis 1330
aaaacgcaccgugcuccaga

SEQ ID NO: 450853 - RNA, 23 nt, Brucella suis 1330
aaaacgcaccgugcuccagauac

SEQ ID NO: 450854 - RNA, 10 nt, Brucella suis 1330
aucagcuugg

SEQ ID NO: 450855 - RNA, 16 nt, Brucella suis 1330
aucagugccaccagau

SEQ ID NO: 450856 - RNA, 15 nt, Brucella suis 1330
aucauaggcccaggc

SEQ ID NO: 450857 - RNA, 18 nt, Brucella suis 1330
aucauauaggugccgagc

SEQ ID NO: 450858 - RNA, 12 nt, Brucella suis 1330
aucagccagccg

SEQ ID NO: 450859 - RNA, 15 nt, Brucella suis 1330
aucagccagccgaca

SEQ ID NO: 450860 - RNA, 13 nt, Brucella suis 1330
aucagaucggcgc

SEQ ID NO: 450861 - RNA, 15 nt, Brucella suis 1330
aucaauucccuggcu

SEQ ID NO: 450862 - RNA, 17 nt, Brucella suis 1330
aucaaugcaccccauga

SEQ ID NO: 450863 - RNA, 22 nt, Brucella suis 1330
aucaauacgcucgcacaucggg

SEQ ID NO: 450864 - RNA, 21 nt, Brucella suis 1330
aucaaaagcugccgcaacaag

SEQ ID NO: 450865 - RNA, 15 nt, Brucella suis 1330
auauugaaguauuag

SEQ ID NO: 450866 - RNA, 13 nt, Brucella suis 1330
auauugcccugcu

SEQ ID NO: 450867 - RNA, 18 nt, Brucella suis 1330
auauuuuguuaucaagcc

SEQ ID NO: 450868 - RNA, 14 nt, Brucella suis 1330
auaucuucgcccug

SEQ ID NO: 450869 - RNA, 18 nt, Brucella suis 1330
auaucgccugcuuccuuu

SEQ ID NO: 450870 - RNA, 13 nt, Brucella suis 1330
auauccagcuugc

SEQ ID NO: 450871 - RNA, 16 nt, Brucella suis 1330
auauccauaucuuucc

SEQ ID NO: 450872 - RNA, 17 nt, Brucella suis 1330
auauccauaucuuucca

SEQ ID NO: 450873 - RNA, 16 nt, Brucella suis 1330
auagcucgacgcuuuc

SEQ ID NO: 450874 - RNA, 14 nt, Brucella suis 1330
auagugaagccacg

SEQ ID NO: 450875 - RNA, 23 nt, Brucella suis 1330
auaguggcgggguguacaacaac

SEQ ID NO: 450876 - RNA, 15 nt, Brucella suis 1330
auaguuggagcgguu

SEQ ID NO: 450877 - RNA, 14 nt, Brucella suis 1330
auagccugcaagcg

SEQ ID NO: 450878 - RNA, 22 nt, Brucella suis 1330
auagcauggccccggagcgggg

SEQ ID NO: 450879 - RNA, 13 nt, Brucella suis 1330
auagauggaaaga

SEQ ID NO: 450880 - RNA, 13 nt, Brucella suis 1330
auagauuccagau

SEQ ID NO: 450881 - RNA, 23 nt, Brucella suis 1330
auagauuguggcaaaagccucca

SEQ ID NO: 450882 - RNA, 17 nt, Brucella suis 1330
auagacggcguuuccaa

SEQ ID NO: 450883 - RNA, 16 nt, Brucella suis 1330
auacgccccgugaucu

SEQ ID NO: 450884 - RNA, 16 nt, Brucella suis 1330
auacgaccaacccuuu

SEQ ID NO: 450885 - RNA, 20 nt, Brucella suis 1330
auacgaccaacccuuuuuca

SEQ ID NO: 450886 - RNA, 12 nt, Brucella suis 1330
auacugccuuac

SEQ ID NO: 450887 - RNA, 18 nt, Brucella suis 1330
auacugccuuacugcccu

SEQ ID NO: 450888 - RNA, 17 nt, Brucella suis 1330
auacuggguugaacggu

SEQ ID NO: 450889 - RNA, 13 nt, Brucella suis 1330
auacaagcccaag

SEQ ID NO: 450890 - RNA, 13 nt, Brucella suis 1330
auaaucagcagaa

SEQ ID NO: 450891 - RNA, 11 nt, Brucella suis 1330
auaaucagccu

SEQ ID NO: 450892 - RNA, 22 nt, Brucella suis 1330
aguuuucaaaccaaaaaaccuc

SEQ ID NO: 450893 - RNA, 15 nt, Brucella suis 1330
auaaacgcaccaaga

SEQ ID NO: 450894 - RNA, 20 nt, Brucella suis 1330
aguuuguugaaacaggccuu

SEQ ID NO: 450895 - RNA, 15 nt, Brucella suis 1330
aguuucauuuccuca

SEQ ID NO: 450896 - RNA, 22 nt, Brucella suis 1330
aguuucggaucggcaagcuuga

SEQ ID NO: 450897 - RNA, 17 nt, Brucella suis 1330
aguugccacgcgccgcc

SEQ ID NO: 450898 - RNA, 15 nt, Brucella suis 1330
aguugucgccgggcu

SEQ ID NO: 450899 - RNA, 17 nt, Brucella suis 1330
aguugugccugccgcgc

SEQ ID NO: 450900 - RNA, 18 nt, Brucella suis 1330
aguucugcgcggaaacca

SEQ ID NO: 450901 - RNA, 17 nt, Brucella suis 1330
aguuaaugccuuugcug

SEQ ID NO: 450902 - RNA, 20 nt, Brucella suis 1330
aguggcaugggagcaccgca

SEQ ID NO: 450903 - RNA, 14 nt, Brucella suis 1330
aguggcagcaggca

SEQ ID NO: 450904 - RNA, 21 nt, Brucella suis 1330
agugcggccugcacggcuuca

SEQ ID NO: 450905 - RNA, 23 nt, Brucella suis 1330
agugccgccaucggcaaaggcuc

SEQ ID NO: 450906 - RNA, 15 nt, Brucella suis 1330
agugccggaaacacg

SEQ ID NO: 450907 - RNA, 17 nt, Brucella suis 1330
agugcgcacgccugccg

SEQ ID NO: 450908 - RNA, 19 nt, Brucella suis 1330
agugcgcgaauuccaugcg

SEQ ID NO: 450909 - RNA, 15 nt, Brucella suis 1330
agugcauaaucggca

SEQ ID NO: 450910 - RNA, 18 nt, Brucella suis 1330
agugcacggccaugaaga

SEQ ID NO: 450911 - RNA, 16 nt, Brucella suis 1330
agucggcaaggcggcu

SEQ ID NO: 450912 - RNA, 18 nt, Brucella suis 1330
agucgauguucggguaga

SEQ ID NO: 450913 - RNA, 20 nt, Brucella suis 1330
aguccucggcaauccccgga

SEQ ID NO: 450914 - RNA, 17 nt, Brucella suis 1330
aguccugaaaccauacc

SEQ ID NO: 450915 - RNA, 14 nt, Brucella suis 1330
agucgaauuucagc

SEQ ID NO: 450916 - RNA, 15 nt, Brucella suis 1330
agucgaauuucagca

SEQ ID NO: 450917 - RNA, 19 nt, Brucella suis 1330
aguccggcagcacgugccc

SEQ ID NO: 450918 - RNA, 20 nt, Brucella suis 1330
aguaucgucguccagcccug

SEQ ID NO: 450919 - RNA, 17 nt, Brucella suis 1330
aguagggcaguagggca

SEQ ID NO: 450920 - RNA, 22 nt, Brucella suis 1330
aguagggcaguagggcagugaa

SEQ ID NO: 450921 - RNA, 16 nt, Brucella suis 1330
aguagcuucuggguga

SEQ ID NO: 450922 - RNA, 17 nt, Brucella suis 1330
aguagcuucugggugag

SEQ ID NO: 450923 - RNA, 21 nt, Brucella suis 1330
agguuuccggcugccuuggca

SEQ ID NO: 450924 - RNA, 13 nt, Brucella suis 1330
agguugagcugcu

SEQ ID NO: 450925 - RNA, 19 nt, Brucella suis 1330
aguaagggaaaaaaucacc

SEQ ID NO: 450926 - RNA, 15 nt, Brucella suis 1330
aggucgucuuucagu

SEQ ID NO: 450927 - RNA, 14 nt, Brucella suis 1330
aggucgugcauuug

SEQ ID NO: 450928 - RNA, 17 nt, Brucella suis 1330
aggucgugcuauagcca

SEQ ID NO: 450929 - RNA, 22 nt, Brucella suis 1330
agguacuggcaauaaaaggcaa

SEQ ID NO: 450930 - RNA, 21 nt, Brucella suis 1330
agggguuuuucaucaaucuga

SEQ ID NO: 450931 - RNA, 23 nt, Brucella suis 1330
aggguaagcgccuuugccgcgcg

SEQ ID NO: 450932 - RNA, 16 nt, Brucella suis 1330
aggggccaaggcccca

SEQ ID NO: 450933 - RNA, 17 nt, Brucella suis 1330
agggcgggcggccagga

SEQ ID NO: 450934 - RNA, 13 nt, Brucella suis 1330
agggcugagggaa

SEQ ID NO: 450935 - RNA, 17 nt, Brucella suis 1330
agggccgcaucggaagg

SEQ ID NO: 450936 - RNA, 18 nt, Brucella suis 1330
agggccgcaucggaaggg

SEQ ID NO: 450937 - RNA, 13 nt, Brucella suis 1330
agggccagaagau

SEQ ID NO: 450938 - RNA, 22 nt, Brucella suis 1330
agggaaucgcgcaauucaugcc

SEQ ID NO: 450939 - RNA, 19 nt, Brucella suis 1330
aggcuuucagcgcagugga

SEQ ID NO: 450940 - RNA, 21 nt, Brucella suis 1330
aggcgcggcguggaaagcugg

SEQ ID NO: 450941 - RNA, 14 nt, Brucella suis 1330
aggcgccagcacuu

SEQ ID NO: 450942 - RNA, 12 nt, Brucella suis 1330
aggcgcaggccc

SEQ ID NO: 450943 - RNA, 14 nt, Brucella suis 1330
aggcgcaggcccug

SEQ ID NO: 450944 - RNA, 23 nt, Brucella suis 1330
aggcgauuuaaaacuuaauugcu

SEQ ID NO: 450945 - RNA, 21 nt, Brucella suis 1330
aggcgauauggcccagaaccu

SEQ ID NO: 450946 - RNA, 23 nt, Brucella suis 1330
aggcgaucagguugaugccgggc

SEQ ID NO: 450947 - RNA, 18 nt, Brucella suis 1330
aggcgaagccgaagaaca

SEQ ID NO: 450948 - RNA, 13 nt, Brucella suis 1330
aggcgaaugaucu

SEQ ID NO: 450949 - RNA, 23 nt, Brucella suis 1330
aggcgaauggauugcgggcauga

SEQ ID NO: 450950 - RNA, 21 nt, Brucella suis 1330
aggcgacacggccgaucgcca

SEQ ID NO: 450951 - RNA, 18 nt, Brucella suis 1330
aggccuuccgcgucggaa

SEQ ID NO: 450952 - RNA, 16 nt, Brucella suis 1330
aggccugauagcggaa

SEQ ID NO: 450953 - RNA, 16 nt, Brucella suis 1330
aggccucaucgaucac

SEQ ID NO: 450954 - RNA, 18 nt, Brucella suis 1330
aggccguuacucggccgc

SEQ ID NO: 450955 - RNA, 13 nt, Brucella suis 1330
aggccgggucagg

SEQ ID NO: 450956 - RNA, 15 nt, Brucella suis 1330
aggccgggcuuugga

SEQ ID NO: 450957 - RNA, 16 nt, Brucella suis 1330
aggccgguaagcccug

SEQ ID NO: 450958 - RNA, 21 nt, Brucella suis 1330
aggccgguaagcccugucagc

SEQ ID NO: 450959 - RNA, 19 nt, Brucella suis 1330
aggccgguaauaacuuccg

SEQ ID NO: 450960 - RNA, 22 nt, Brucella suis 1330
aggccgagcgcaucggccagcu

SEQ ID NO: 450961 - RNA, 23 nt, Brucella suis 1330
aggcccgccucgaccgcaacagg

SEQ ID NO: 450962 - RNA, 17 nt, Brucella suis 1330
aggcagacggacuucuu

SEQ ID NO: 450963 - RNA, 16 nt, Brucella suis 1330
aggcacucuccucugc

SEQ ID NO: 450964 - RNA, 23 nt, Brucella suis 1330
aggcacccuugguugcgcgccag

SEQ ID NO: 450965 - RNA, 15 nt, Brucella suis 1330
aggacauucaaagau

SEQ ID NO: 450966 - RNA, 14 nt, Brucella suis 1330
aggaagggaaagcg

SEQ ID NO: 450967 - RNA, 19 nt, Brucella suis 1330
aggaacucgcccaccgaag

SEQ ID NO: 450968 - RNA, 13 nt, Brucella suis 1330
aggaagagaaucu

SEQ ID NO: 450969 - RNA, 14 nt, Brucella suis 1330
aggaaccaaggcag

SEQ ID NO: 450970 - RNA, 14 nt, Brucella suis 1330
agcuuugcaccgcg

SEQ ID NO: 450971 - RNA, 21 nt, Brucella suis 1330
agcuugccgccaauccccuca

SEQ ID NO: 450972 - RNA, 24 nt, Brucella suis 1330
agcuugccgccaauccccucaccu

SEQ ID NO: 450973 - RNA, 14 nt, Brucella suis 1330
agcuugcccgucac

SEQ ID NO: 450974 - RNA, 16 nt, Brucella suis 1330
agcuugcaaugagcgc

SEQ ID NO: 450975 - RNA, 13 nt, Brucella suis 1330
agcuucggaagaa

SEQ ID NO: 450976 - RNA, 15 nt, Brucella suis 1330
agcuucggaagaaag

SEQ ID NO: 450977 - RNA, 14 nt, Brucella suis 1330
agcuggaaggccag

SEQ ID NO: 450978 - RNA, 16 nt, Brucella suis 1330
agcuggaaggccaggc

SEQ ID NO: 450979 - RNA, 22 nt, Brucella suis 1330
agcuggaaccagcgugcagccu

SEQ ID NO: 450980 - RNA, 19 nt, Brucella suis 1330
agcugguugcgcggccagc

SEQ ID NO: 450981 - RNA, 13 nt, Brucella suis 1330
agcugccgcaaca

SEQ ID NO: 450982 - RNA, 18 nt, Brucella suis 1330
agcugcauccagcgguga

SEQ ID NO: 450983 - RNA, 20 nt, Brucella suis 1330
agcuacgccggaagaaugcu

SEQ ID NO: 450984 - RNA, 13 nt, Brucella suis 1330
agcuaaaguaucu

SEQ ID NO: 450985 - RNA, 15 nt, Brucella suis 1330
agcgugcgauaaaua

SEQ ID NO: 450986 - RNA, 22 nt, Brucella suis 1330
agcgguuucgguuaugccggaa

SEQ ID NO: 450987 - RNA, 17 nt, Brucella suis 1330
agcgguuuugcguagga

SEQ ID NO: 450988 - RNA, 23 nt, Brucella suis 1330
agcgucuugcgcuccaccagcau

SEQ ID NO: 450989 - RNA, 17 nt, Brucella suis 1330
agcgugaccagccccug

SEQ ID NO: 450990 - RNA, 14 nt, Brucella suis 1330
agcgggcaauagaa

SEQ ID NO: 450991 - RNA, 20 nt, Brucella suis 1330
agcggcuccaccaccucgcc

SEQ ID NO: 450992 - RNA, 16 nt, Brucella suis 1330
agcggcucucaaaaag

SEQ ID NO: 450993 - RNA, 17 nt, Brucella suis 1330
agcggcgucaggccaaa

SEQ ID NO: 450994 - RNA, 20 nt, Brucella suis 1330
agcggccggauuuugccuuc

SEQ ID NO: 450995 - RNA, 21 nt, Brucella suis 1330
agcgcguucacguaggcgcgg

SEQ ID NO: 450996 - RNA, 20 nt, Brucella suis 1330
agcgcggccuaccccucccu

SEQ ID NO: 450997 - RNA, 20 nt, Brucella suis 1330
agcgcgccgaaaaucggcac

SEQ ID NO: 450998 - RNA, 17 nt, Brucella suis 1330
agcgcgaaggacagaag

SEQ ID NO: 450999 - RNA, 17 nt, Brucella suis 1330
agcgccuuugcggggga

SEQ ID NO: 451000 - RNA, 15 nt, Brucella suis 1330
agcgcccuugccgga

SEQ ID NO: 451001 - RNA, 22 nt, Brucella suis 1330
agcgcccuugccggauaucgcc

SEQ ID NO: 451002 - RNA, 16 nt, Brucella suis 1330
agcgccgaugcgggga

SEQ ID NO: 451003 - RNA, 13 nt, Brucella suis 1330
agcgccagauaaa

SEQ ID NO: 451004 - RNA, 14 nt, Brucella suis 1330
agcgccacgccuuc

SEQ ID NO: 451005 - RNA, 13 nt, Brucella suis 1330
agcgccagaaaga

SEQ ID NO: 451006 - RNA, 14 nt, Brucella suis 1330
agcgcaucgccacc

SEQ ID NO: 451007 - RNA, 14 nt, Brucella suis 1330
agcgcauccagccg

SEQ ID NO: 451008 - RNA, 16 nt, Brucella suis 1330
agcgcauccagccggc

SEQ ID NO: 451009 - RNA, 23 nt, Brucella suis 1330
agcgcauccgccugcgcauggga

SEQ ID NO: 451010 - RNA, 21 nt, Brucella suis 1330
agcgcaauaucggcgaugccc

SEQ ID NO: 451011 - RNA, 16 nt, Brucella suis 1330
agcgauucgcgauccu

SEQ ID NO: 451012 - RNA, 15 nt, Brucella suis 1330
agcgcaaaacagcgc

SEQ ID NO: 451013 - RNA, 20 nt, Brucella suis 1330
agcgauggcgacgcgcucgu

SEQ ID NO: 451014 - RNA, 20 nt, Brucella suis 1330
agcgagcgcacauaaaacgc

SEQ ID NO: 451015 - RNA, 15 nt, Brucella suis 1330
agcgagaaugaggcc

SEQ ID NO: 451016 - RNA, 21 nt, Brucella suis 1330
agcgaauggcaauuuccagau

SEQ ID NO: 451017 - RNA, 16 nt, Brucella suis 1330
agcgaauagaccaugc

SEQ ID NO: 451018 - RNA, 17 nt, Brucella suis 1330
agccuguuuggucucaa

SEQ ID NO: 451019 - RNA, 15 nt, Brucella suis 1330
agccuguccuuguuc

SEQ ID NO: 451020 - RNA, 23 nt, Brucella suis 1330
agccugcaccggcccaaaggccg

SEQ ID NO: 451021 - RNA, 15 nt, Brucella suis 1330
agccugacccggccu

SEQ ID NO: 451022 - RNA, 18 nt, Brucella suis 1330
agccgccaagccagcccg

SEQ ID NO: 451023 - RNA, 16 nt, Brucella suis 1330
agcccuucaucaagcu

SEQ ID NO: 451024 - RNA, 22 nt, Brucella suis 1330
agcccuuccacugcaaggaagg

SEQ ID NO: 451025 - RNA, 15 nt, Brucella suis 1330
agcccugucagcgcc

SEQ ID NO: 451026 - RNA, 20 nt, Brucella suis 1330
agcccgugauuacccaucac

SEQ ID NO: 451027 - RNA, 12 nt, Brucella suis 1330
agcccgccccaa

SEQ ID NO: 451028 - RNA, 19 nt, Brucella suis 1330
agccccguuggcgcccagg

SEQ ID NO: 451029 - RNA, 17 nt, Brucella suis 1330
agccccaggaacggcag

SEQ ID NO: 451030 - RNA, 14 nt, Brucella suis 1330
agcccagaaaucca

SEQ ID NO: 451031 - RNA, 18 nt, Brucella suis 1330
agcccaagaaagaucagc

SEQ ID NO: 451032 - RNA, 19 nt, Brucella suis 1330
agcccaaccgagcagaaug

SEQ ID NO: 451033 - RNA, 15 nt, Brucella suis 1330
agccauagcgcagaa

SEQ ID NO: 451034 - RNA, 24 nt, Brucella suis 1330
agccauagcgcagaaugagcuugc

SEQ ID NO: 451035 - RNA, 16 nt, Brucella suis 1330
agccauaucggggcgu

SEQ ID NO: 451036 - RNA, 23 nt, Brucella suis 1330
agccagaagacggcggguggcag

SEQ ID NO: 451037 - RNA, 14 nt, Brucella suis 1330
agccacgaaacgcc

SEQ ID NO: 451038 - RNA, 18 nt, Brucella suis 1330
agcauggcaaggccacgc

SEQ ID NO: 451039 - RNA, 21 nt, Brucella suis 1330
agcaugaucgcccgcccggca

SEQ ID NO: 451040 - RNA, 23 nt, Brucella suis 1330
agcaugaucgcccgcccggcauc

SEQ ID NO: 451041 - RNA, 14 nt, Brucella suis 1330
agcaucgccgccag

SEQ ID NO: 451042 - RNA, 15 nt, Brucella suis 1330
agcaucagcuugccc

SEQ ID NO: 451043 - RNA, 18 nt, Brucella suis 1330
agcaucagcuugcccauc

SEQ ID NO: 451044 - RNA, 23 nt, Brucella suis 1330
agcagucuucuugugaacaugga

SEQ ID NO: 451045 - RNA, 22 nt, Brucella suis 1330
agcaguaccgacaugccaagag

SEQ ID NO: 451046 - RNA, 16 nt, Brucella suis 1330
agcaggcuuucggccu

SEQ ID NO: 451047 - RNA, 22 nt, Brucella suis 1330
agcaggcguugcagauauuccu

SEQ ID NO: 451048 - RNA, 19 nt, Brucella suis 1330
agcaggccgguaagcccug

SEQ ID NO: 451049 - RNA, 11 nt, Brucella suis 1330
agcaggcgcgc

SEQ ID NO: 451050 - RNA, 14 nt, Brucella suis 1330
agcagcggcaaaaa

SEQ ID NO: 451051 - RNA, 14 nt, Brucella suis 1330
agcagcaggggcag

SEQ ID NO: 451052 - RNA, 17 nt, Brucella suis 1330
agcagcaucuugccaag

SEQ ID NO: 451053 - RNA, 12 nt, Brucella suis 1330
agcagcaacagg

SEQ ID NO: 451054 - RNA, 20 nt, Brucella suis 1330
agcagcaccggcggaaggcu

SEQ ID NO: 451055 - RNA, 14 nt, Brucella suis 1330
agcagauccuguag

SEQ ID NO: 451056 - RNA, 12 nt, Brucella suis 1330
agcacucugcca

SEQ ID NO: 451057 - RNA, 14 nt, Brucella suis 1330
agcacguccuuggc

SEQ ID NO: 451058 - RNA, 23 nt, Brucella suis 1330
agcaacagggcgaaaagccgccu

SEQ ID NO: 451059 - RNA, 20 nt, Brucella suis 1330
agcaaauucaaagaauuccc

SEQ ID NO: 451060 - RNA, 13 nt, Brucella suis 1330
agcaaaagccccg

SEQ ID NO: 451061 - RNA, 13 nt, Brucella suis 1330
agcaaaagugaga

SEQ ID NO: 451062 - RNA, 16 nt, Brucella suis 1330
agcaaagagcgguucc

SEQ ID NO: 451063 - RNA, 15 nt, Brucella suis 1330
agauugggcagcaga

SEQ ID NO: 451064 - RNA, 16 nt, Brucella suis 1330
agauugaacccggccu

SEQ ID NO: 451065 - RNA, 17 nt, Brucella suis 1330
agauugaacccggccuc

SEQ ID NO: 451066 - RNA, 14 nt, Brucella suis 1330
agauugcaaacgaa

SEQ ID NO: 451067 - RNA, 14 nt, Brucella suis 1330
agauucccuuuucc

SEQ ID NO: 451068 - RNA, 15 nt, Brucella suis 1330
agauuccgaauagau

SEQ ID NO: 451069 - RNA, 17 nt, Brucella suis 1330
agaugugccaccagcac

SEQ ID NO: 451070 - RNA, 22 nt, Brucella suis 1330
agauguuccugcggugugaagc

SEQ ID NO: 451071 - RNA, 23 nt, Brucella suis 1330
agaugcgcguagggcagaucugu

SEQ ID NO: 451072 - RNA, 22 nt, Brucella suis 1330
agaugcgcgucaaaacaaagga

SEQ ID NO: 451073 - RNA, 17 nt, Brucella suis 1330
agaugccgugggcaaga

SEQ ID NO: 451074 - RNA, 17 nt, Brucella suis 1330
agaugcgcgccagccgc

SEQ ID NO: 451075 - RNA, 18 nt, Brucella suis 1330
agaugagcggcagcagcc

SEQ ID NO: 451076 - RNA, 14 nt, Brucella suis 1330
agaugagcugguuu

SEQ ID NO: 451077 - RNA, 22 nt, Brucella suis 1330
agaugagguccaccacaccauc

SEQ ID NO: 451078 - RNA, 20 nt, Brucella suis 1330
aaaacccggcgcaaaggccg

SEQ ID NO: 451079 - RNA, 21 nt, Brucella suis 1330
agaucaugggcggccacggca

SEQ ID NO: 451080 - RNA, 22 nt, Brucella suis 1330
agaucauccggcucauaguuga

SEQ ID NO: 451081 - RNA, 13 nt, Brucella suis 1330
agauagcccggca

SEQ ID NO: 451082 - RNA, 19 nt, Brucella suis 1330
agauauccauaucuuucca

SEQ ID NO: 451083 - RNA, 19 nt, Brucella suis 1330
agauaagcggcaaaggccg

SEQ ID NO: 451084 - RNA, 21 nt, Brucella suis 1330
agagggauuuucguugcuucc

SEQ ID NO: 451085 - RNA, 22 nt, Brucella suis 1330
agagcuucuuuucgaugaaaua

SEQ ID NO: 451086 - RNA, 19 nt, Brucella suis 1330
agagccuuuuccacagcag

SEQ ID NO: 451087 - RNA, 23 nt, Brucella suis 1330
agacgugaccgccuggcccggcu

SEQ ID NO: 451088 - RNA, 16 nt, Brucella suis 1330
agacgccauccaugug

SEQ ID NO: 451089 - RNA, 22 nt, Brucella suis 1330
agacgccauccauguggaaggc

SEQ ID NO: 451090 - RNA, 23 nt, Brucella suis 1330
agacgccauccauguggaaggcg

SEQ ID NO: 451091 - RNA, 21 nt, Brucella suis 1330
agaccuuccgggcaauaucgc

SEQ ID NO: 451092 - RNA, 14 nt, Brucella suis 1330
agaccagcaggaag

SEQ ID NO: 451093 - RNA, 19 nt, Brucella suis 1330
agaccagcaggaagaaggc

SEQ ID NO: 451094 - RNA, 17 nt, Brucella suis 1330
agaccaucggcaacaag

SEQ ID NO: 451095 - RNA, 18 nt, Brucella suis 1330
agacauggcgggccaugc

SEQ ID NO: 451096 - RNA, 17 nt, Brucella suis 1330
agacauggguggcgccc

SEQ ID NO: 451097 - RNA, 14 nt, Brucella suis 1330
agaaugcaccgccg

SEQ ID NO: 451098 - RNA, 16 nt, Brucella suis 1330
agaaugccacaagguc

SEQ ID NO: 451099 - RNA, 22 nt, Brucella suis 1330
agaaggcgcugcacacccuuga

SEQ ID NO: 451100 - RNA, 19 nt, Brucella suis 1330
agaagguacuggcaauaaa

SEQ ID NO: 451101 - RNA, 21 nt, Brucella suis 1330
agaagcuucacauccuucacu

SEQ ID NO: 451102 - RNA, 23 nt, Brucella suis 1330
agaagcaagugugaaagcacaaa

SEQ ID NO: 451103 - RNA, 22 nt, Brucella suis 1330
agaagaucgucggcaagcugga

SEQ ID NO: 451104 - RNA, 14 nt, Brucella suis 1330
agaaccgauuaaaa

SEQ ID NO: 451105 - RNA, 23 nt, Brucella suis 1330
agaaccgcuuuccauggucaggc

SEQ ID NO: 451106 - RNA, 18 nt, Brucella suis 1330
agaacacagccccuugcc
